United States Patent 10,975,383 (ISOLATED POLYNUCLEOTIDES, POLYPEPTIDES AND METHODS OF USING SAME FOR INCREASING ABIOTIC STRESS TOLERANCE, BIOMASS AND YIELD OF PLANTS) - sequence listing, part 3

SEQ ID NO: 2926 - DNA, 1372 bp, Ricinus communis
caacacccaactctctttctccactccactctccaatctccatcttcttcttgttgttgcgtttgaacaaaaaatggctagaaagaagattagagagtatgattcaaagcgacttcttaaagaacacctgaaacgccttgccggtcttgatatccagatctgctctgctcaggtgactgagtctacagactttacagagttaacaaatcaagaaccatggctttcttcatcgagattggtggttaagcctgatatgttatttgggaaacgtgggaagagtggtttggttgctttgaatttagatctagctcaagttgctgaatttgtgaaagcaaggcttggagttgaggttgaaatgagtggctgtaaggcaccaataactacattcattgttgaaccatttgttccacatgatcaagaattttacctctcaatagtctctgaaagacttggctgcaccattagtttttcagaatgtggaggtattgaaattgaagagaattgggataaggttaagactgtattccttcccactgaaaagcctatgaacttggaggcatgtgctccattgattgctacacttcctctggagattcgaggtaaaattggtgccttcataatgggagtctttgctgtctttcaagatctagatttcagttttatagagatgaatccttttaccctggttaatggagagccatatccactagatatgagaggcgaattggatgacactgctgcttttaagaactttaagaagtggggtaacatagagtttcctcttccctttggaagagttctgagtcctactgaaagcttcattcattcgctggatgaaaagacaagtgcatctttgaaattcactgttttgaacccaaaagggcgtatctggacaatggtagctggaggtggtgccagcgtaatttatgccgacactgttggagatttgggttatgcatcagagcttggcaactatgcagagtatagtggagctcctaatgaggaggaagttttacaatatgcaagagttgtaattgattgcgccactgctgatcctgatggtcgaaagagagcccttctaattggaggtggcattgctaacttcacagatgttgcagctactttcaatggtatcatacgagccctcagagaaaaggaatccaagttaaaagcagcaagaatgcacatctatgttcgaagagggggtccaaactaccagactggtttggcaaagatgcggactctgggagaagaggtgggagtgccacttgaggtttatgggcctgaagccaccatgactggcatctgcaagcaggccattgattgcatcatgtctgcggcatagtttcatagcccattttctcctttatca

SEQ ID NO: 2927 - DNA, 1615 bp, Avena sativa
gggcacaagctcaagcacacctagcacctactactccgccttcgagcccaggccatggcgcgcaagaagatccgggagtacgactctaagcgcctcctcaaggagcacctcaagcgcctggccgccatcgacctccacatcctctccgcccaggtcactgaatcgacagacttcacagagcttgtgaatgagcagccatggctgtcgagcacaaagttggtcgtcaagcccgacatgctgttcgggaagcgtgggaagagtggccttgtggccctcaacctggatattgctcaagtcaaggagtttgtgaaggagcggctgggagtcgaggttgagatgggcggctgcaaggctcctattacaaccttcatagttgagccatttgtgccccatgatcaagagtactatctttcgattgtgtcagagaggctgggtagcaccattagcttctcagagtgcggaggaattgaaattgaggagaactgggacaaggttaagacagtatttcttcccactgagaaaccaatgacacctgagacgtgtgctcccttgattgcaacccttccactggaggcacgtggaaaaatcggtgatttcattaagggagtgtttgctgtcttccaagacttggatttctcatttattgagatgaacccatttaccatggtgaatggggagccatatcccctggacatgagaggagaactggatgatacagcagctttcaagaacttcaagaagtggggaaatttagagttccctttaccgtttggcagagttctcagctctacagaaagttttatccaagatctggatgacaagacgagcgcatctctgaagttcacagttctgaacccaaagggacgcatttggacaatggttgcaggaggcggtgccagtgtcatatacgccgacacggttggagatttgggatatgcttcggagttaggaaattatgcagaatacagtggtgcccccaaggaggaggaggttctgcagtatgctagagtagtacttgattgtgcgacttctgatcccgatggccgcaagagagcccttctcattggaggtggtatagccaacttcactgatgttgctgcgacatttaatggcatcattcgggcgttaagagagaaggaatccaagttaaaggcgtccaggatgcacctatatgttcgacgaggcggtccaaattaccaaactggactagcaaaaatgcgcaagcttggtgcagaaatcggcgttccgatcgaggtctatggacccgaagcgacaatgactggcatctgcaagcaagcaattgaatgcatcatggctgcagcataaatcgggatacagttgagtagcagtttgggatctacaaacaagaaacttgatgcgcatagatgagagcatagctggaataatttacatcacatggttgatcagtttcttcagaagctatttgagcaaacacatagagtgttgtctcgaagaaacatctactgctgtaatgtgaaaaactaaagacttagcatttcttatttttggtttgctggttgagctgcattgcaaccaccctgtttcaccatactataacgttcttgattccatcgcagtagattcaggttcctat

SEQ ID NO: 2928 - DNA, 1819 bp, Musa acuminata
gtggtgatcgtgtccgtcggagccacgggcggaagaaccgaagaagggaggcgatggccaggaagaagatccgggagtacgattccaagcgtctcctcaaggagcacctcaagcgtctcgccggcatcgatctccagatccgatccgtccaggtgacggaatcgacggacttcaatgagttggtgaacaaggaaccatggctttcgtccatgaagttggtcgtgaagcccgacatgctgttcggcaagcgtggaaagagcggtttggtggctctcaacctagatctggctcaggcggctcagtttgtcaaggaacgtctgggagtggaggttgagatgggagggtgcaaggctccgatcaccacgttcataatcgagccatttgttccccacgatcaagaatactacctctctattgtgtcagagaggctgggttgcaccgtcagcttctcagagtgtggaggcattgaaatagaggagaactgggacaaggtcaagacggtatatcttcctacagagaagcctatgacaggcgaggcatgtgctcctttgatcgcaacgcttccattggaggtacgagggaagataggggactttattaagggagtttttactgtgttccaagatttggatttcagttttatagagatgaacccatttactttggtaaatggtgaaccatacccactggatatgcgaggagaattggatgatacagctgctttcaagaacttcaaaaagtggggaggcattgacttcccacttccttttggaagagtcctgagccctacagaaaaatttgttcatgaactcgatgagaagaccagtgcctccttgaagttcactgttctaaatccaaaaggacgcatatggacaatggtagctggtggtggtgctagtgtcatttatgctgatacggtcggagatctgggctatgcatctgaacttggaaactatgcggagtacagtggtgctccaaatgaggaagaggttcttcaatatgccagagtcgttcttgattgtgcaaccgccgatccagatggccgtaagagagctcttctcattggaggaggtatagcaaactttactgacgttgctgctacattcaatggcatcatcagggcactgaaagagaaggaatcaaagctgaaggcagcaaggatgcacatctatgttagaagagggggaccaaattatcagactggtctggcaaaaatgaggaaagtgggcgaggagcttggagttcctctggaggtatatggaccggaggccacgatgacaggaatttgcaaagaagctattgactgtgtcatgtctgctgcataactaccattacatcgatcatttcttttgctacccttcattttgtcttgctaatcaaaaccatgcttcaggaacaatgtgtagcttcagtgagaaatttgacatgtgaacattagaatacatgattgttgagcttcaaagttaatttgatcatggaaataaattaaggttcctttttgaagtgtctgatgtgaaagcttgtgtgattcatgaaggtgcctatctgcataggaaaaaagatagtgcgtggtacctgctgctgctgcttctaacagtcgtcgccaaacgctcctatcgagaagaaccgagtcttaccgatcagcattctagccaccgaccaaaagagcagaacttagtctgcacaggtacagtagtcatcagccggataaaaaactggttaattacatgttatcctttgtggtttgtgttttgatttctacattgccatttttcttattatggaagtaaaacatctcggacgatgttagtggttgcgc

SEQ ID NO: 2929 - DNA, 1671 bp, Brachypodium distachyon
aaagctcgcctaccagcaaccagcaagcgctctctctgcagaagcttccagaaccttccgggagccctgccctgccggagccaatggcgcgcaagaagatccgggagtacgactccaaacgcctcctcagggagcatctcaagcgcctcgccgccatcgacctccaaatcctctccgcccaggtcacgcaatcaacagacttcgaggagctagtgaaccagtatccatggctgtcgaccatgaagctggtcgtgaagcccgacatgctgttcgggaagcgtgggaagagtggcctcgtggcactcaacctggacattgtgcaagtcaaggagtttgtcaaggagcggctcggagtcgaggtagagatgggtggctgcaaggctcctattacgaccttcatagttgagccgtttgtgccacatgatcaagagtactacctttcaattgtgtcggagaggttgggcagcaccattagcttctctgaatgtggaggaattgaaatcgaggagaactgggacaaggttaagacagtctttcttccaactgagaagccaatggcacctgatgcctgtgctcccttgattgcaacccttccactggaggcacgtggaaagatcagtgatttcattaaaggagtgtttgctgtgttccaagacttggatttctcatttattgagatgaacccattcaccatggtgaatggggagccatatccgcttgacatgagaggagaactggatgacactgcatctttcaagaacttcaagaagtggggaaatgtagaattccctctaccatttggcagagttctcagctctacagaaagctttatccatgacctggacgataagaccagtgcatctctgaagtttacagttttgaacccaaagggacgcatctggacaatggttgcaggaggtggtgccagtgtcatatatgctgacacagttggagatttgggatatgcttcagagttaggaaattatgcagagtacagtggtgctcccaacgaggaggaggttctgcaatatgcaagagtagtactagattgtgcaactgctgatcctgatggccgtaagagagcccttctcattggaggtggtatagccaacttcactgatgtcgctgccacatttagtggcatcattcgggccttaagagagaaggaatccaagttaaaggcttccaggatgcacctctatgttcgacgaggtggaccaaattaccgaactggactggctaaaatgcgcaagcttggtgcagaaattggcgttccaattgaggtctatggacccgaagcgacaatgaccggcatctgcaaacaagcaattgaatgcatcatggctgcagcataaatcagaatgcagttgtggtcttgtggagtagtttggcacctgcaaacaagaaactgcaggcgccatggctgcggcataaatgggaatgtagttgcagtacctcaccattacgtggttgattaccctttttctgaagttaattaaacaaacacatagaatgttgtccgaaagcagacactatggttgccatgcagtaaatgaaagatttagcattttcttttttgacctgctcattgagctgcattttttttgggggtctcaccacactataatgtgctcatacacaaataatgatgttcctgccttctctggatag

SEQ ID NO: 2930 - DNA, 1685 bp, Brachypodium distachyon
aaagctcgcctaccagcaaccagcaagcgctctctctgcagaagcttccagaaccttccgggagccctgccctgccggagccaatggcgcgcaagaagatccgggagtacgactccaaacgcctcctcagggagcatctcaagcgcctcgccgccatcgacctccaaatcctctccgcccaggtcacgcaatcaacagacttcgaggagctagtgaaccagtatccatggctgtcgaccatgaagctggtcgtgaagcccgacatgctgttcgggaagcgtgggaagagtggcctcgtggcactcaacctggacattgtgcaagtcaaggagtttgtcaaggagcggctcggagtcgaggtagagatgggtggctgcaaggctcctattacgaccttcatagttgagccgtttgtgccacatgatcaagagtactacctttcaattgtgtcggagaggttgggcagcaccattagcttctctgaatgtggaggaattgaaatcgaggagaactgggacaaggttaagacagtctttcttccaactgagaagccaatggcacctgatgcctgtgctcccttgattgcaacccttccactggaggcacgtggaaagatcagtgatttcattcaaggagtgtttgctgtgttccaagacttggatttctcatttattgagatgaacccattcaccatggtgaatggggagccatatccgcttgacatgagaggagaactggatgacactgcatctttcaagaacttcaagaagtggggaaatgtagaattccctctaccatttggcagagttctcagctctacagaaagctttatccatgacctggacgataagaccagtgcatctctgaagtttacagttttgaacccaaagggacgcatctggacaatggttgcaggaggtggtgccagtgtcatatatgctgacacagttggagatttgggatatgcttcagagttaggaaattatgcagagtacagtggtgctcccaacgaggaggaggttctgcaatatgcaagagtagtactagattgtgcaactgctgatcctgatggccgtaagagagcccttctcattggaggtggtatagccaacttcactgatgtcgctgccacatttagtggcatcattcgggccttaagagagaaggaatccaagttaaaggcttccaggatgcacctctatgttcgacgaggtggaccaaattaccgaactggactggctaaaatgcgcaagcttggtgcagaaattggcgttccaattgaggtctatggacccgaagcgacaatgaccggcatctgcaaacaagcaattgaatgcatcatggctgcagcataaatcagaatgcagttgtggtcttgtggagtagtttggcacctgcaaacaagaaactgcaggcgccatggctgcggcataaatgggaatgtagttgcagtacctcaccattacgtggttgattaccctttttctgaagttaattaaacaaacacatagaatgttgtccgaaagcagacactatggttgccatgcagtaaatgaaagatttagcattttcttttttgacctgctcattgagctgcattttttttgggggtctcaccacactataatgtgctcatacacaaataatgatgttcctgccttctctggatagcaaaactgtatttc

SEQ ID NO: 2931 - DNA, 1758 bp, Ricinus communis
ggtgattataattttagaaattggctccaacttctcccctgcccaaatcgcccactaaccaaccaacacccaactctctttctccactccactctccaatctccatcttcttcttgttgttgcgtttggtaagttccaaaaatcgtacctttgaagcaaaacattaactctctctctaaattttaagtcttttagtagtcctttctttttctttccctctaaaaacagagtatagatacaaaaaacagagtgtcttttacttaacagatcttgaattgaattgaaacagaacaaaaaatggctagaaagaagattagagagtatgattcaaagcgacttcttaaagaacacctgaaacgccttgccggtcttgatatccagatctgctctgctcaggtgactgagtctacagactttacagagttaacaaatcaagaaccatggctttcttcatcgagattggtggttaagcctgatatgttatttgggaaacgtgggaagagtggtttggttgctttgaatttagatctagctcaagttgctgaatttgtgaaagcaaggcttggagttgaggttgaaatgagtggctgtaaggcaccaataactacattcattgttgaaccatttgttccacatgatcaagaattttacctctcaatagtctctgaaagacttggctgcaccattagtttttcagaatgtggaggtattgaaattgaagagaattgggataaggttaagactgtattccttcccactgaaaagcctatgaacttggaggcatgtgctccattgattgctacacttcctctggagattcgaggtaaaattggtgccttcataatgggagtctttgctgtctttcaagatctagatttcagttttatagagatgaatccttttaccctggttaatggagagccatatccactagatatgagaggcgaattggatgacactgctgcttttaagaactttaagaagtggggtaacatagagtttcctcttccctttggaagagttctgagtcctactgaaagcttcattcattcgctggatgaaaagacaagtgcatctttgaaattcactgttttgaacccaaaagggcgtatctggacaatggtagctggaggtggtgccagcgtaatttatgccgacactgttggagatttgggttatgcatcagagcttggcaactatgcagagtatagtggagctcctaatgaggaggaagttttacaatatgcaagagttgtaattgattgcgccactgctgatcctgatggtcgaaagagagcccttctaattggaggtggcattgctaacttcacagatgttgcagctactttcaatggtatcatacgagccctcagagaaaaggaatccaagttaaaagcagcaagaatgcacatctatgttcgaagagggggtccaaactaccagactggtttggcaaagatgcggactctgggagaagaggtgggagtgccacttgaggtttatgggcctgaagccaccatgactggcatctgcaagcaggccattgattgcatcatgtctgcggcatagtttcatagcccattttctcctttatcaatctgtacaaggaaaataatttggggcaaaatgtgtgtgttgagaagatcatcttttgttgagacaatactttctgtgcagaaggcatgaaccagattgagattttttttttttccttcttttctttcttaatggaaaagtttgattgaattgctttataca

SEQ ID NO: 2932 - DNA, 1771 bp, Setaria italica
ctcttctgttcttcccctgtctgtcactgcgtgcaccccggccggcacgcccagcgccagtcaccaaccccgcccaccatccatcccactcctcccagtccaaacgccatggcgcgcaagaagatccgggagtacgactccaagcgcctcctcaaggagaacctcaagcgcctcgccggcatcgacctcaccattctctccgcccagatcacacaatcaacagacttcgcagagcttctgagccagcagccatggctgtcaaccacaaagttggttgtgaagcccgatatgttgtttgggaagcgtggcaagagtggccttgtggctctcaacctggatttcgatcaagtcaaggagtttgtcaaggagcggttgggagtcgaggttgagatgggtggctgcaaggctccaatcacgaccttcattgttgaaccatttgtgccccatgatcaagagtattacctatcgattgtgtcagagaggctgggcagcactatcagcttctcagagtgtggaggaattgagattgaagagaactgggacaaggttaagacagtttttcttccgactgagaagccaatgacacaggatgcttgtgctcccttgattgccacccttccattggaggcgcgtggaaaaattggtgacttcattaaaggagtgtttgctgtcttccaagacttggacttctcatttcttgagatgaacccatttaccatggtgaatggagagccatatcctctggacatgagaggagaactagatgacacagcagctttcaagaacttcaagaagtggggagctattgaatttcctctaccatttggaagagtactcagcgctacagaaagtttcatccatgaactagatgagaagacaagcgcctctctgaagtttacagttttgaacccaaaggggcgcatctggacaatggttgctggaggtggtgctagtgtcatatatgctgatactgttggagatctgggatatgcttcagagctaggaaactatgcagagtatagtggtgcacccaacgaggaggaggttctgcactatgctagagttgtacttgattgcgcaactgctgatcctgatggtcgcaagagggcacttctcattggaggtggcatagcaaacttcaccgatgttgctgccacattcaatggcatcatccgggccttaagagagaaggaatccaagttgaaggcttcaaggatgcacatttatgttcgccgaggtggcccaaattaccaaactggactggctaaaatgcgtaagcttggtgcagaactcggtgttccaattgaggtgtacgggccagaagcgacgatgacaggaatctgcaaacaagcaattgaatgcgtcatggctgcagcatagtccgcaattgaatgggtagtttgggatctgcaaacacgcaactgaatgtgtcatgggctcaacataaatgagggatggagagtgtagtagcagtagttaaccacacatgattgttctcttttttcagatatgtcgttgtagcgagaggagctgtttgaatgaaacttttataggtcgttactgcaaagaaattactattgtgagatggaataattaaattcgaggtctagtttatgtgtgtgttttatcatgaacactgagttgaaatggccctgtcaagtggattgcgttgtaatgttcttgttgattgctgccacatacacagattagtacattgagcttttcgggtgatgcacattttaatagaattaatttgtcaccatggtcagaa

SEQ ID NO: 2933 - DNA, 1686 bp, Setaria italica
cccggccggcacgcccagcgccagtcaccaaccccgcccaccatccatcccactcctcccagtccaaacgccatggcgcgcaagaagatccgggagtacgactccaagcgcctcctcaaggagaacctcaagcgcctcgccggcatcgacctcaccattctctccgcccagatcacacaatcaacagacttcgcagagcttctgagccagcagccatggctgtcaaccacaaagttggttgtgaagcccgatatgttgtttgggaagcgtggcaagagtggccttgtggctctcaacctggatttcgatcaagtcaaggagtttgtcaaggagcggttgggagtcgaggttgagatgggtggctgcaaggctccaatcacgaccttcattgttgaaccatttgtgccccatgatcaagagtattacctatcgattgtgtcagagaggctgggcagcactatcagcttctcagagtgtggaggaattgagattgaagagaactgggacaaggttaagacagtttttcttccgactgagaagccaatgacacaggatgcttgtgctcccttgattgccacccttccattggaggcgcgtggaaaaattggtgacttcattaaaggagtgtttgctgtcttccaagacttggacttctcatttcttgagatgaacccatttaccatggtgaatggagagccatatcctctggacatgagaggagaactagatgacacagcagctttcaagaacttcaagaagtggggagctattgaatttcctctaccatttggaagagtactcagcgctacagaaagtttcatccatgaactagatgagaagacaagcgcctctctgaagtttacagttttgaacccaaaggggcgcatctggacaatggttgctggaggtggtgctagtgtcatatatgctgatactgttggagatctgggatatgcttcagagctaggaaactatgcagagtatagtggtgcacccaacgaggaggaggttctgcactatgctagagttgtacttgattgcgcaactgctgatcctgatggtcgcaagagggcacttctcattggaggtggcatagcaaacttcactgatgttgctgccacattcaatggcatcatccgggccttaagagagaaggaatccaagttgaaggcttcaaggatgcacatttatgttcgccgaggtggcccaaattaccaaactggactggctaaaatgcgtaagcttggtgcagaactcggtgttccaattgaggtgtacgggccagaagcgacgatgacaggaatctgcaaacaagcaattgaatgcgtcatggctgcagcatagtccgcaattgaatgggtagtttgggatctgcaaacacgcaactgaatgtgtcatgggctcaacataaatgagggatggagagtgtagtagcagtagttaaccacacatgattgttctcttttttcagatatgtcgttgtagcgagaggagctgtttgaatgaaacttttataggtcgttactgcaaagaaattactattgtgagatggaataattaaattcgaggtctagtttatgtgtgtgttttatcatgaacactgagttgaaatggccctgtcaagtggattgcgttgtaatgttcttgttgattgctgccacatacacagattagtacattgagctt

SEQ ID NO: 2934 - DNA, 1582 bp, Ipomoea nil
ctctctctcactctctctcactctcaggagtctcagctgtggagttgttgaagttgggtgtcggcggcagggcgtagtgatatggcaaggaagaagatcagagagtacgattctaagagggttctgaaggagcatttgaagcgtctgtctggcatcgacctacagatctgctctgctcaagtaacagaatctacggattttgctgagttaacaaacaaagaaccatggctttcgtccacaaaattggttgtaaaaccagacatgttgtttgggaagcgtggaaagagtggcttggtggctttgaagttggatctagcagaagttgctgaatttgtcaaagcacgtcttggtgtggaggttgagatgggtggctgcaaagcacctattacaaccttcattgttgaaccatttgttccccatgccgaggagtattatctttcaatagtatctgaaaggttagggtgtaccattagcttctcagaatgtggaggcattgaaattgaagaaaactgggacaaggtcaagacagtattccttccaactgaaaagcctatgaccctggaggtgtgcgcaccactgattgctactcttcccttggaggtacgggggaaaattggcaattttatattgggtgtgttttctgtttttcaagacctggacttcagttttcttgagatgaatccctttacgcttgtcaatggtgaaccatatcccctggacatgagaggagagttagatgacacagctgcctttaaaaactttcagaagtggggcaatattgagttccctctgccttttggaagagttttgagcccaacagaaagttttattcattccttggatgaaaaaaccagtgcctctttgaagtttactgtcttgaatcccaaaggtcgaatttggacaatggttgctggaggtggagcaagtgtaatatatgctgatacagtcggagatttaggctatgcatctgagcttggtaactatgcagaatatagtggagctccaaatgaagaggaggttttacaatatgctcgtgtagttcttgattgtgccacagctgatccagatggccgtaagagagctctcattattggaggtggcattgctaattttactgatgttgctgctaccttcaatggaattatccgggctcttagggagaaggaatccaagttaaaagctgctagaatgaacatttatgttcgaagaggtggccctaattatcaaacaggtttggcaaagatgcgtgcattgggtgaagagttgggagttcccctagaggtttatggacctgaggctacaatgactggcatttgcaaacgggctattgattgcgttatgtcttaagcatagatataaaagttccccttttaaattcatgcaatgctctggtgtttcatccactcttttcagactctcttcccatgcttgaaaggaaactgcatttgctgaatttatgaaaaactttgcaataagggggaagcctcatatttctgtggatggttttctgaaattttacggatattttatatttgttgtgaaatttgcgttatctttgaatgttcgcggaagcaattagggt

SEQ ID NO: 2935 - DNA, 1798 bp, Populus trichocarpa
aaaaacacatgatgatggtgattgagttgttagctgatcaacaactttgactaaccattttagcttcccctcctcgtgcaaatcgcctaccaccacgccccacattattagacaccacctaaccagctgcaccacccctctctcttacaagacacaaccttgctgttgtctgatcatctttgatttgaattgttgaaatggctagaaagaagataagagagtatgattctaagagacttttgaaagagcacttgaaacgtctctctggtattgatcttcagatctgctctgctcaggtgacagaaggtacagatttcactgagttaacaaataaagagccatggctttcatctacaaaattggttgtgaagcctgacatgctatttgggaagcgtgggaagagtggtttggtagctttgaatttagatctagctcaagttgctgaatttgtgaaagcacgccttggtgctgaggttgagatgggtggctgtaaggcaccaataactaccttcattgttgaaccatttgttccacatgaccaagagttttacatctcaattgtctctgaaagactcggcagcactattagcttctcagaatgtgggggtattgaaattgaggagaactgggataaggttaaaaccatattcctcccaactgaaaaaccaatgacactggaagcatgtgctccattgattgctacacttcctttggagattcgaggaaaaatcggtgatttcatcatcggtgtcttttctgtatttcaagatctggacttcagttttctagaaatgaatccatttacactggtgaatggggaaccatatccactggatatgagaggagaattggacgacactgctgctttcaagaacttcaagaaatggggtaatgtagagtttcctctgccttttggaagagttctgagttctaccgaaagcttcattcattctctggatgaaaagacaagttcatctttgaaattcactgttttgaatccaaagggacgtatctggacaatggttgctggaggtggtgccagtgttatatatgctgataccgttggagatttgggttatgcatcagagcttggcaactatgcagagtatagtggagctccaaatgaagacgaggtcttgcaatatgcaagagttgtcattgattgtgccacttctgaccctgatggtcgcaaaagagcccttcttattggaggaggcatcgctaacttcaccgatgttgctgctactttcaatggtattatacgagcactgagagagaaggaatccaagttaaaggctgcaagaatgcacatctatgtccgaagaggtggtccaaactatcagactggtttggccaagatgcgcactctaggagaggaactgggagtacctcttgaggtttatgggccagaggccacaatgacaggcatctgcaagcaagccattgattgcatcatgtctacggcatagtctaccaattcattctctcctttgtcggtgtgagtgaagaaaatgtattgtgggaagttgtgttgagaaaataatttagcgtagaaggcgtaagctggattgaattgctgtatacttggcatcaaattctcccttatgataaacaatcttggatcaatgttttgaaatatgcatgacacggtttcgactctgtatattggcaacttaccaatttattgtttgagtaatcaaatcacttttgctattttcctatgaaattcccagtccatgtcttcttcatgctatcgaaatcttctattgattgaatttgtactcaattcttctctgat

SEQ ID NO: 2936 - DNA, 1805 bp, Panicum virgatum
tctctcactacgtgcacccggcacgcccagcgcttgggaccaacccgcccaccttccagtcctcccagtccaacacctcgcacgcccaggtctgaaccctctccctcgccatcgccatggcgcgcaagaagatccgggagtacgactccaagcgcctcctcaaggagaacctcaagcgcctcgccggcatcgacctcaccatcctctccgcccagatcacacaatcaacagacttcgcagagcttgtgagccagcagccatggctgtcaaccacaaagttggtcgtgaagcctgatatgctgtttgggaagcgtggcaagagtggcctggtggccctcaaccttgattttgatcaagtcaaggagttcgtcaaggagcgattgggagtcgaggttgagatgggtggctgcaaggctccaattacaaccttcattgttgagccatttgtgccccacgatcaagagtattacttatcgattgtgtcagagaggctgggcagcacaatcagcttctcagagtgtggagggattgagatcgaggagaactgggacaaggttaagacggtttttcttccaactgagaagccaatgacaccagatgcatgtgctcccttgattgctacccttccactggaggcacgcggaaaaattggtgacttcatcgaaggagtgtttgctgtattccaagacctggacttctcatttatggagatgaacccatttaccatggtgaatggagagccatatcctctggacatgaggggagaacttgatgacacagcagctttcaagaacttcaagaagtggggagctattgaattccctctaccatttggaagagtactgagccctacagaaagtttcatccatgaactagatgagaagacaagcgcctctctgaagtttacagttttgaacccaaagggacgcatctggacaatggttgctggaggtggtgctagtgtcatatacgctgatacagttggagatttggggtatgcttcagagcttggaaactatgcggagtatagtggtgctcccaatgaggaggaggttctgcattatgctagagttgtacttgattgtgcaactgctgatcccgatggtcgtaagagggcgcttctcattggaggtggcattgctaacttcactgatgtggctgccacattcaatggcatcatccgggccttaagagagaaggaatccaagttgaaggcttcaaggatgcacatttatgttcgccgaggtggcccgaattaccaatctggactggctaaaatgcgtaagcttggtgcagagctcggcattccaattgaggtgtatgggccagaagcgacaatgacaggaatctgcaaacaagcgattgaatgcatcatggctgcagcataattggagtgtagttctgggtagtttgggatctgcagacacgcaattgaatgtgtcatagactcagccataaatgaggggtggagagttgttgcagtagttcacccacacaatggttcctcccttttgtttcagatatgttgtagcgtggagttgtttgacgatatctttctagatcactactgcaaagaattactgtcgtgatgcaataaatccgaggtctagtttcgtatccagttgttttgtgagtatctatgattgagttggttgagtcgatggcttgatgcaatattgggcagcacagatttcaataaaattagtctctagccatggttacaacagcaacacaatactctacatttcatctgtgccagattcttgcaagaattaaatgaatatgtcgccatggtaagcttgagc

SEQ ID NO: 2937 - DNA, 1679 bp, Avena sativa
caagcacacctagcacctactactccgccttcgagtccactgcacgtcgcgcgctctctcccccataagctgcaggagctccccggagcccaggcaatggcgcgcaagaagatccgggagtacgactctaagcgcctcctcaaggagcacctcaagcgcctggccgccatcgacctccacatcctctccgcgcaggtcaccgaatcgacagacttcacagagcttgtgaatgagcagccatggttgtcgagcacaaagttggtcgtcaagcctgacatgctgttcgggaagcgtgggaagagtggccttgtggccctcaacctggatattgctcaagtcaaggagtttgtgaaggagcggttgggagtcgaggttgagatgggtggctgcaaggctcctattacaaccttcatagttgagccatttgtgccccatgatcaagagtactatctttcgattatgtcagagaggctgggtagcaccattagcttctcagagtgcggaggaattgaaattgaggagaactgggacaaggttaagacagtatttcttcccactgagaaaccaatgacaccagagacatgtgctcccttgattgcaacccttccactggaggcacgtggaaaaatcggtgatttcattaagggagtgtttgctgtcttccaagacttggatttctcatttattgagatgaacccatttaccatggtgaatggggagccatatcccctggacatgagaggagaattagatgatacagcagctttcaagaacttcaagaagtggggaaatttagagttccctttaccgtttggcagagttctcagctctacagaaagttttatccaagatttggacgacaagacgagcgcatctctgaaattcacagttctgaacccaaagggacgcatttggacaatggttgcaggaggtggtgccagtgtcatatatgccgacacggttggagatttgggatatgcttcggagttaggaaattatgcagaatacagtggtgcccccaaggaggaggaggttctgcagtatgctagagtagtacttgattgtgcgacttctgatcccgatggccgcaagagagcccttctcattggaggtggtatagccaacttcactgatgttgctgcgacatttaacggcatcattcgggccttaagagagaaggaatccaagttaaaggcgtccaggatgcacctatatgttcgacgaggcggtccaaattaccaaactggactagcaaaaatgcgcaagcttggtgcagaaatcggcgttccgatcgaggtctatggacccgaagcgacaatgaccggcatctgcaagcaagcaattgaatgcatcatggctgcagcataaatcgggatacagttgagtagcagtttgggatccacaaacaagaaacttgatgcgcataaatgagagcatagctggaataattttcacatcacatggctgatcagtttctccagaagctatttgagcaaacacatagtgttgtctcgaagaaacatctactgctgtgatgtgaaaaccgaaagacttagcatttcttattttttgatttgctggatgagctgcatcgcaaccaccctgtttcactatatacgttcttgtttcgattgcagaagattcaggttcctatgttatatggggcttataggtcctat

SEQ ID NO: 2938 - DNA, 1872 bp, Hordeum vulgare
gtgcaacgctactggcacctaccaccgctctactccgcttcgagaccacagcacctcgcgcgcgctccacccaccataagccttccggccttcagggagcccaagccatggcgcgcaagaagattcgggagtacgactccaagcgcctcctcaaggagcacctcaagcgcctggccgccatcgacctgcacatcctctccgcccaggtaacacaatcgacggattttgcggagcttgtaaaccagcatccatggctgtcgaccaccaaactggttgtgaagcctgacatgctgttcgggaagcgtgggaagagtggacttgtggcactcaacctggatgtagcccaagtcaaggagtttgtgaaggatcggttgggagttgaggttgagatgggcgtctgcaaagctccaattaccacctttatagttgagccgtttgtcccccacgatcaagaatactatctttcaattgtgtccgaaaggttgggtagcaccattagcttctcggaatgtggaggcattgaaatcgaggaaaactgggacaaggttaagacagtctttcttccgactgagaagccaatgacacctgatgcttgtgctcccttgattgcaacccttccattggaggcacgcggaaagattggtgatttcattaaaggagtgtttgctgtcttccaagacttagatttctcatttattgagatgaacccattcaccatggtgaatgaggagccatatcctctggacatgagaggagaattggatgacactgcatctttcaagaacttcaagaagtggggaaatgtagaattccctctaccattcggcagagttctcagttctacagaaagttttatccatgagctggacgataagaccagtgcgtctttaaagttcacagttttgaacacaaagggacgcatctggacaatggttgctggaggtggtgccagtgtcatatacgccgacacagttggagatttgggatatgcttcagagttaggaaattacgcagaatacagtggtgctcccaacgaggaggaggttctgcagtatgctagagtagtacttgattgtgcgactgcggaccctgatggccgcaagagagcccttctcattggaggtggtatagccaacttcactgatgttgctgccacctttagtggcatcattcgggcattaagagagaaggaatccaagttaaaggcatccaggatgtacctctatgttcgacgaggtggtccaaactaccaaactggactggcgaaaatgcgcaagcttggtgcagaaatcggtgttccgattgaggtatatggacccgaagcaacaatgactggcatctgcaagcaggcgattgaatgcattatggcagcttaataaatcaggatacagttgagaagttgtttgcgatctgcaaacaagaaactggatgcgtcatggctgccacataaatgagagcatagtcgaagtaggatcacatcacatggttgattagctttttcagaagttatttgaacagacagacacatatattgttgtcgtaaaggaacctgtgctgttgtaatgtgacaaacaaaagatttattaccatgcaaaccggcatatgtctgtagccttttacaagcacggaattgcaatgatcttgctttgactgcctcatacacacctgcaatttggtgtgttgtgttactgaacttgttcagaaactgcactgaacaaggagcaagaagatggctgatcttgtaggcccctcctgttaagcttctctgatgctacagatacagtaccgaatcgacaaccaaatgaaaattttgcaattaagggcattggcatttacagcgctgaccctcaagccatccgaccgtgcgatccg

SEQ ID NO: 2939 - DNA, 1600 bp, Gossypium hirsutum
agatcttcttcaatctaagcttctcaaagacttaaaatggctcgcaagaagatcagagaatacgattccaagagacttctcaaacaacacctcaaacgcctcgctaatatcgacctccaaatctgttctgctcaggtgactcaatctactgatttcaccgagttaacgaacgaacaaccatggctttcgtccaccagattggttgttaagccggatatgttgtttggtaaacgtgggaagagtggcttggttgctctcaatttggatcttgctcaagttgctgaattcgtcaaagctcgcctcggcactgaggttgaaatgggcggttgcaaagcacctataaccacattcattgtcgaaccttttgtaccccatgaacaagagtattacctttcaatagtctctgaaaggcttggttctaccattagtttttcggaatgtggaggtattgatattgaagagaactgggataaggttaaaaccatcttccttccaaccgagaaacctatgaccttggatacatgtgcaccgttgatagctacacttcctttggaagtccgcgggaagattggtgacttcatcatgggtgtcttttctgtctttcaagatcttgacttcagctttctcgagatgaatccatttacactggtgaatggagaaccatacccactggatatgaggggggagctggacgacactgctgcattcaagaacttcaacaagtggggtaacatagagtttcctctaccttttgggagagtcctgagctctacagaaagcttcattcattcattggatgaaaagacaagtgcatctctgaaattcactgttttgaatccaaaagggcgtatctggacaatggttgccggaggtggtgctagtgtcatttatgctgatactgtaggagatttaggttatgcttcagaactgggaaactatgcggagtatagtggagctccaaatgaagaggaggtcttgcaatatgcaagagtcgttattgattgtgccactgcaaaccctgatggtcgtaagagagcccttctcattggaggtggcattgctaacttcactgatgtagctgctactttcaacggaatcattcgagcattgagagaaaaggaagccaagttaaaagcagcaagaatgcacatctatgttcgaagaggtggtccaaactatcaaactggtttggcaaggatgcgtgctcttggggaggaactaggagtaccccttgaggtttacgggcctgaggccacgatgactggcatatgcaagcaggctatagattgcattatgtctgaagcataagtagggtattatttttgttctccaaagtcgagttattctgccaatgcagtttggtattctttgttcaagtcataagctggacaagactgttgttgtagaccgaaatactcaaattacagagtatttcatcctctcttttttgtgtgtgttcttgtgcgataaacacgaaacatggtttccgtcggtccatgtttgtttgttggttgttggtattttggtgtttctgatcataattgtgctttatgatgggctggaaaaatgtttgaattaacgagaaaatgcgaaaatgcaa

SEQ ID NO: 2940 - DNA, 1400 bp, Actinidia deliciosa
cgttgcagaattcttcgagattttgaagcgaaatggctaggaagaagatcagagagtacgattcgaaaaggctactgaaggagcacctgaagagactcgctgcgatcgatctccagatctgctctgctcaggtgaatgaaaacacagacttcacagagttgacaaacaaagaaccatggctttcgtcgacaaaattggttgtgaaacctgatatgttgtttgggaagcgtgggaagagtgggctggtggcattgaatttagatctagctgcagttgccgaatttgttaaagcacgccttggtgtggaggttgagatgggtggttgcaaagcaccaatcactacattcattgtcgaaccatttgtaccccatgaccaagaatactacctttccattgtatctgaaaggctcggctctaccattagcttttcagaatgtggaggtattgagattgaagagaactgggacaaggttaaaactatcttccttccatctgagaaacctatgtcgctggaggcctgtgctcccttgattgctacccttccactggaggttcgagggaaaattgccgacttcatactgggcgtatttgctgtatttcaagatctggatttcagtttccttgagatgaatccttttaccctggtgaatggggagccatacccattggatatgaggggagagttggatgacactgctgcctttaagaactttaagaagtggagtaacatagagtttcctctccctttcggaagggttcttagtcctacagaaagcttcattcactcgttggatgaaaagactagtgcatctctgaaatttactgttttgaacccaaaaggacgcatttggactatggtagctggaggtggtgccagtgtaatatatgccgacacagtcggagatttgggatatgcatcagaacttggtaattatgcagagtatagtggagctccaaatgaagaggaggtgctgcaatatgccagagtcgttattgattgtgctactgcagaccctgatggtcgtaagagagccctcctaattgggggaggtattgcaaatttcaccgatgttgctgctactttcaatgggattattcgggccctcagagagaaggaatccaagttaaaagcatccagaatgcacatttacgttcgaagaggtggtcccaactatcagacgggattggcaaagatgcgtgccctgggagaggaactcggagttccccttgaggtatatggacctgaggctacaatgactgggatttgcaaggaagcaattgattgcatcatgtcttcagcatagccttgccattttttctcgtctccttccaccagctgagaaaataattcagctcgaggattcctccaaggcaccagttgcattggtcagtttttaggc

SEQ ID NO: 2941 - DNA, 1745 bp, Pennisetum glaucum
gctctctgctcactacgtgcacgccggcacgcccgacgccagtgaccaacccgcccccacccaccttcccactcatctctcagtccaaacaaacgccatggcgcgcaagaagatccgggagtacgactccaagcgcctcctcaaggagaacctcaagcgcctcgccggcatcgacctcaccatcctctccgcgcagatcacagaatcgacggactttgcggagcttgtgagccagcagccatggctattgaccacaaagttggtcgtgaagcccgacatgctgtttgggaagcgtggcaagagtggcctggtggcccttaaccttgattttgatcaagtcaaggagtttgtcaaggagcggttgggagtcgaggttgagatgggtggctgcaaggctccaatcacgaccttcattgttgagccatttgttccccacgatcaagagtattacctatcaattgtgtcagagaggcttggcagcactatcagcttctcggagtgtggaggaattgagattgaggagaactgggacaaggttaaaacagtttttcttccgactgagaagccaatgacacaggatgcctgtgctcccttgattgccacccttccattggaggcgcgcggaaaaattggtgaattcattaaaggagtgtttgctgtcttccaagacttggacttctcatttcttgagatgaacccatttaccatggtgaatggggaaccatatccactagacatgagaggagaactagatgacacagcagctttcaagaacttcaagaagtggggagctattgaatttcctctaccatttggaagagtactcagcgcttcagaaagtttcatccatgaactagatgagaagacaagcgcctctcttaagttcacagttttgaacccaaaggggcgcatctggacaatggttgctggaggcggtgctagtgtcatatacgctgatactgttggagatctgggatatgcttcagagctaggaaactatgcagagtatagtggtgcacccaacgaggaggaggttctgcactatgctagagttgtacttgattgtgcaactgctgatcctgacggtcgtaagagggcacttctcattggaggtggcatagctaacttcactgatgttgcagccacattcaatggcatcatccgggccttaagagagaaggaatccaagttgaaggcttcaaggatgcacatttatgttcgccgaggtggtccgaattaccaaactggactggctaaaatgcgtaagcttggtgcagaactcggtgttccaattgaggtgtatgggccagaagcgacgatgacaggaatctgcaaacaagcaattgaatgcgtcatggctgcagcgtaacccgagcgtagttccgggcagttcaggatctgcaaacacgcaattgaatctgtcatgagctcagcataaatgagaggagatggagagtgtagatgcagtagttcatccatacatgtttgttctctttttttcgtttgaagatgtgttgtagcgtgaagttgtttgaccataccttgatctatcatggctgcaaaaagttactgttgggatataataaatctctgtaggtctagtttcgtgagttctgttatatgagcgttgagctgcaatgcaatgaaatggccttgtcacttgcattggatggtaatttgttgcttactgttgccagcccagacacagtttagcaactcaatggaatgagcgcatctcacgtttc

SEQ ID NO: 2942 - DNA, 1529 bp, Carica papaya
gcccaagttgctcgccaaatcaaacccgcaacgctggtcatcgccattcccaattttcttgcgtctgatcttgaaaattttcaaagtgtggtgagttttgttcaatggcccgaaagaagatcagagagtacgattccaagaagctcctcaaggagcacttgaagcgtcttgctggaattgacctccagatctgctctgctcaggtgactcaatctacggacttcacagagctaacaaaccaagagccatggctttcatccacaagattggtggtgaagcctgatatgctgtttgggaagcgtgggaaaagtgggatggtggctttgaatttagatctagctcaagttgcagaatttgtcaaatcacgtcttggagttgaggttgagatgggtggttgcaaggcgccaataacaacctttattgttgaaccatttgttcctcatgaccaagaatattacctttcaataatatctgaaaggcttggatgcactattagcttctcagagtgcggaggtattgaaattgaagaaaactgggataaggttaagactgtatttcttccaactgaaaaacctatgacactggaggcatgtgctccactgatagcaactcttcctttggaagttcgagggaaaattggtgattttataatgggtgtcttcgctgtatttcaagatctggacttcagttttatagagatgaatccatttacattggtgcatggggagccatatccactggatatgaggggagagttggatgatactgctgccttcaagaattttaagaagtggggtaacatagagtttccactgccttttgggagagttctgagccctactgagagcttcattcattcattggatgagaagacaagtgcatctttgaaattcactgttctgaatccaaaaggacggatctggacaatggtagctggaggtggtgctagtgttatatatgctgatactgttggggatttaggctatgcatcagagctgggtaattatgcagagtacagtggagctccaaatgaggaagaggttttgcagtatgccagagtagttattgattgtgccactgctgatcctgatggtcgtaaaagagcccttctcattggaggaggcattgccaacttcactgatgttgctactaccttcaatgggattattagagccctgaaggagaaggaagccaagttaaaagcagcaagaatgcacatttatgtacgaagaggtggtccaaattatcagattggtttagcgagaatgcgtgctttgggagaggaattgggaattccccttgaggtttatggacctgaggcgacaatgactgggatctgcaaaaacgcaattgactgcatcatggctgccgcatgacttcactgtccttggttgtagctgatcctcggtttagataatgaatgaatgtaactcaaggttcatcaaggggaacgattctgcagaaaggtttggatagagttgatgtaagctttgaagggaattgatttctgtgtttgtattattttttcc

SEQ ID NO: 2943 - DNA, 1957 bp, Cajanus cajan
agttacaagcagagcaataagtgtttggagcacagcataatttgcgttcacccactcacagtgagagtgtaataagaataagaagaaagagcaaccactccactccacgttcattactccgaattcatcatcttcgtttgaattgagatcgtaaatggcgaggaagaagatcagagagtatcactcgaagaggctcctcaaggagcacctcaaacgcctcgcctccatcgacatccaaattctatcagctcaggtaaccgagtcaacggacttcacggagttgacgaacgagcatccatggctttcctccaccaaactcgtcgtcaagccggacatgctgttcgggaagcgcggaaagagtggcttagtcgctctcaatttggacattgcgcaagtcgccgagttcgtcaaagcgcgtctcggcgtcgaggttgagatgggaggttgtaaggcgcctataactactttcattgttgaaccgtttgttcctcacgaccaagagtattatctctccgttgtttctgagaggctgggctccaccatcagcttctccgaatgcgggggcattgaaatcgaagagaactgggataaggttaaaactatattccttccgacagaaaagccgctgactccagaggcatgtgcgccgttgattgctacacttcctttggagattcgcgggaaaattggtcatttcataatgggtgtgtttgctgtcttccaagatctggacttcagttttctagagatgaatccatttacactggtgaatgaaaagccatatccattggatatgagaggggaattggatgacactgctgcattcaagaacttcaacaagtggggtaatatagagtttccgttgcctttcggaagagttctgagccctacagaaagctttattcattccttggatgataagacaagtgcatcattgaaatttactgtattgaatccaaaaggacgcatctggacaatggtagcaggaggcggtgcaagcgtaatttatgctgatactgttggagatttaggctatgcatcagagcttggcaactatgctgagtatagtggagctccaaatgaggaggaggtgttgcagtatgcgagagtcgtaattgattgtgctactgcggatcctgatggccgtaagagagcccttcttattggaggtggcattgcaaacttcactgatgttgctgccacatttagcgggattattcgagccctgaaagaaaaggaatcaaaacttaaagcagcgcgaatgcacatctatgtcagaagaggtggtccaaactatcagactggtttggcaaagatgcgtgcattgggggaggaattgggagtaccaattcaggtttatgggccggaggctacaatgaccggcatctgcaaacaggctattgattgcatcatgtctaaagcataaagcagaggtggtgtttggatggatacaagtctttagtctgtaccaagcaagaaggaggaataagatcgaagggaggaggataaatgttgcaaccttgaactgttcttttcttcctattgtgattttattgttatattttgactgcaatatagcttaacattataaaatcctcaacagtaaatgtgaaaattgtgattgtcgttgacaactttcctttaaagtgctaaattccatgtttgattctctgtttcaattgtttgtgttgatatcatggacaaatgcaaagatttcttaagcccattatcaagaacccattcttcccaaggcttgcttttgggtagttaaaggctcttgacagtgatttgaagttaggtttcccgcgttctttaagatacaagttgggagagggaggctggtctgaggaacatagtgggcacatgagttagcttctctattgaggacgctgggagaccaacacatctccggaaacaaatataggaccgttagatttgcttatttgtaaattgaaac

SEQ ID NO: 2944 - DNA, 1805 bp, Populus trichocarpa
gtgggcacagtgcacatgatgatttgagtagttagctgattggataaagtaacaaaacaattatttcaacttctcctcctcttccgcctcgtggaattcgcctaccaccacaccctccaccaaacaccaaccaaccaaaccctctctctctctcttacaagacacaaccttgctgttgtttgatcatctttgaattgttgaaatggcaagaaagaagataagagagtatgattccaagagactcctgaaagagcacttgaaacgtctctctggtattgatctcctgatccgctctgctcaggtgacagaaggtacagatttcacggagttaacgaaccaggagccatggatttcatctacaaaattggttgtgaagcccgacatgctattcggaaagcgtgggaagagtggtttggtagctttgaatttagatctagctcaagttgctgactttgtgaaggcacgccttggcgttgaggttgagatgggtggctgtaaggcaccaataactacctttatagtcgaaccatttgttccacatgaccaagagttttacttttcaattgtctctgaaagactcggctgcaccattagcttctcagaatgtggaggtattgaaattgaggagaactgggataaggttaagaccatattcctccctactgaaaagccaatgacactggaagcatgtgctcctttgattgctacacttcctctggagattcgaggaaaaattggtgatttcatcatcggtgtcttttctgtgtttcaagatctggacttcagttttctagagatgaatccatttacactggtgaatggggagccatatccactggatatgagaggagagttggacgacactgctgcttttaagaacttcaagaagtggggtaacatagagtttcctctgccttttggaagagttctgagttctactgaaagcttcatccactcactggatgaaaagacaagtgcatctttgaaattcactgttttgaaccaaaaaggaagaatctggacgatggtagctggaggtggtgccagtgtcatatatgccgatactgttggagatttgggctatgcatcagagcttggaaactatgcagagtatagtggagctccaaacgaggaggaggtcttgcaatatgcaagagttgtcattgattgtgcaactgctgatcctgatggtcgcaaaagagcccttctcattggaggaggcattgctaacttcactgatgttgctgctactttcaacggtatcatacgagcattgagggagaaggaatccaagttaaaggcagcaagaatgcacctctatgtccgaagaggtggtccaaactatcagactggtttggccaagatgcgcactctgggagaggaattgggagtacctcttgaggtttatggacccgaggccacaatgacaagcatctgcaagcaagccattgattgcatcatgtctacggcatagtctcacaactcgtttttctcctttgtcagcgtgaatcaagaaaatgtgtgtggcaaggtgtgctgagaaaataatttagtgtacaaggcgcaagctggattattgcagacttagcatcaatttttcccttatgataaataatcttgaatcaatgttttgaaatatgcatgacacgatttaaactctgtataattgcatattatcaatttattgttggagtaagtcacttttgttattttcctatgaaattcccaagccacatctcttcatgctttcaaatcttatatttattgaatttattctcattcttctccgataaattgtcgcatca

SEQ ID NO: 2945 - DNA, 1725 bp, Solanum phureja
aggggcgcaaataacattatcagggaaaaataattggattatgaaatgaggcagcatcattcttcccaatacagtatgttccattgttaaaaacgcccaactacctactcccctgtccccacccccctcctcagatcattcatctcactcaccagtttggtgaatacccacaattcttctacctttagctaatttcctactcttcgatctttgctttttgtaatcaattatatacccaccaactgtttgtataattgttttgtgtaagagaaagagatagttatcgtttgtttggattgttagaaaaacagagtaatatggcgaggaagaagatcagagagtatgattcaaagaggcttctaaaggagcatttgaaacgccttgctggcatcgatcttcagatctgctctgctcaagtgacagaatctacagattttaccgagttaacaaacaaagaaccatggctttcgtcgacaaagctggttgtaaaaccagacatgctgtttggtaagcgtggaaagagtggcttggtagctttgaatctggatctagcaggagttgctgagtttgtaaaaacacgacttggtgtggaggttgaaatgggtggctgcaaggcacctataacaacatttattgttgaaccatttattccccatgaccaagaatattacctttccatagtctctgaaaggttggggtgcacaattagcttttcagaatgtggaggcattgagattgaagagaactgggacaaggtcaagactatattccttccaacagagaaacctatgaccctagaggcgtgtgctccactgattgctactctccccttggaggtacggggaaagattggcaatttccttatgggtgtttttgatgtgtttcaagatctcgattttagtttcatagagatgaacccatttacgcttgtaaatggggagccttacccattggatatgaggggagagttggatgacacagcagccttcaaaaattttaagaagtggggaagcatcgagtttcctctgccctttggaagagttttgagccctaccgaaagcttcattcactctttggatgagaaaactagtgcctctttaaaatttacagttttgaacccaaaaggtcgtatctggacaatggtggctggaggtggtgcaagcgttatatatgctgatacagtaggggatttaggctatgcctctgagcttggtaactatgccgagtatagtggagctccaaatgaagaggaggttttgcaatatgctcgagtagttctagattgtgctactgctaatcctgatggccgtaagagagctctgattgttggaggtggtattgctaacttcactgatgtagctgctactttcaatgggattattcgggctctcagggagaaggaagccaagctaaaagcggctagaatgcatatctatgtacgaagaggtggtccaaattatcagactggtctagcaaaaatgcgcgccctaggagaggaacttggagttccccttgaggtttatggaccagaggctacaatgactggaatttgcaaaggggcaattgattgcattatgtctgaagcgtaagtgccaaatcagaagacttgtgttgcattcttgcaattaagaagaaactttgttggatatttaatttgccttctgatattgtattgttacaattgggacctttaagaataattgagatccttttgttttacctgga

SEQ ID NO: 2946 - DNA, 1884 bp, Panicum virgatum
ctctctctctcaccacgtgcggcacgcccagcgcctgtcaccaacccgctcacctcccagtcctcccagtccaacacctcgcgcgcccaggtctgaatcctctccctcgccatcgccatggcgcgcaagaagatccgggagtacgactccaagcgcctcctcaaggagaacctcaagcgcctcgccggcatcgacctcaccatcctctccgcccagatcacacaatcaacagactttgcagagcttgtgagccagcagccatggctgtcaaccacaaagttggtcgtgaagcccgatatgctgtttgggaagcgtggcaagagtggcctggtggccctcaaccttgattttgatcaagtcaaggagtttgtgaaggagcggttgggagtcgagattgagatgggtggctgcaaggctccaatcacgaccttcattgttgaaccatttgtgccccatgatcaagagtattacctatcgattgtgtcagagaggctgggcagcaccatcagcttctcagagtgtggtgggattgagatcgaggagaactgggacaaggttaagacggtttttcttccaactgagaagccaatgacaccagacgcatgtgctcccttgatcgccacccttccattggaggcacgcggaaaaattggtgacttcatcaaaggagtgtttgctgtcttccaagacctggacttctcatttatggagatgaacccatttaccatggtgaatggggagccatatcctctggacatgagaggagaactagatgatacagcagctttcaaaaacttcaagaagtggggagctattgaattccctctaccatttggaagagtactgagccctacagaaagtttcatccatgaactagatgagaagacaagtgcctctctgaagtttacagttttgaacccaaagggacgcatctggacaatggttgctggaggtggtgctagtgtcatatacgctgatactgttggagatttggggtatgcttcagagcttggaaactatgcagagtatagtggtgctcccaacgaggaggaggttctgcattatgctagagtcgtacttgattgtgcgactgctgatcccgatggtcgtaagagggcacttctcattggaggtggcattgctaactttactgatgtggctgccacattcaatggcatcatccgggccttaagagagaaggaatccaagttgaaggcttcaaggatgcacatttatgttcgcagaggtggcccgaattaccaatctggactggctaaaatgcgtaaacttggtgcagagcttggcattccaattgaggtgtatgggccagaagcgacgatgacaggaatctgcaaacaagcaattgaatgcatcatggctgcagcataattgggatctgcaaacgcgaaattgaatgtgtcatagactcggccataaatgagggatggagagtgtagttgcagtagttcacccacacagggttgttccctttttgttgcagatatgttgtagcgtggagttgtttgacggtatctttatagatcattactgcaacaaaatcactgttgtgatgcaataattccgaggtctagtttcgtatccagttgttttgtgagtatctgagttggttgcgtcgatggcttgatgcaatattgggcagcatgggtttcaaattgaattagtctctagctatggtcagaacagcaacacaatactctacatttcatccgtgccagatgcttgtaagaattaaatgaatatgcctccatggtaagcttgagcaaacgttaagactttcagaaactgaagcttacgatatgaaagcttgattgcttgtgctcttgctactgctgcagtacaaatataacaagagcatgttcagct

SEQ ID NO: 2947 - DNA, 1630 bp, Triphysaria pusilla
tgcatatactcctcaacaaccacttctcatcgtctaaatcgccaaaccacctaactactcttcatcctccattctttcatctcaatccaaatcattcttttacactcactataaactctgagcaggtgtgaaaatttactttcttcggattaaaaatggcgagaaagaagatcagagagtacgattccaaaaggctcctcaaagagcatctcaaaagattgaccggtctcgatcttcagatctgctctgcccaggtaactgaatctacagactttagtgatttaacaaacaaagaagcttggttgtcatctacaaagctggttgtgaaacccgacatgttgttcgggaaacgagggaagagtggcttggtagctttaaacttagatctggcccaagttgctggatttgtcaaagaacgtcttggcgttgaggttgagatgggaggttgcaaagcaccgataacgacattcattgttgagccttttgttcctcatgatcaagaatattacctgtccatagtgtctgagaggttaggttgtaccattagcttctcggaatgtggaggtatcgaaattgaagagaactgggacaaggttaaaactgtcttccttccaactgaaaagccaatgaatttggacgcatgtgctcctttgattgctacacttcctttagaggttaggagtaagatcggcgatttcataatgggtgttttttctgtatttcaagatttggattttagtttcattgagatgaatccgtttactttggtgaatggcgagccatatccgctagacatgcgaggagagttggacgacactgctgctttcaagaacttcaagaaatggggtggtattgagtttcctcagccttttggaagagtcatgagcccaactgaaagtttcatacactcgttggatgaaaaaactagtgcgtcgttgaaatttaccgttttgaacccaaaagggcgcatttggactatggtggctggaggtggtgctagcgtaatatacgcagatacagttggagatttggggtatgcatccgagcttggaaactatgctgagtacagtggagctccaaacgaagaggaggttttgcaatatgcccgaatagttattgattgtgccacatctgatcctgacggccgcaagagagctcttcttattggaggaggtattgctaactttacagacgttgctgccactttcaatggaattatccgggctctcagggagaaggaatcaaagttgaaagcggctaggatgaacctttatgtacgtagaggtgggcccaactatcagactggtttggcaagaatgcgcactttgggagaagaattgggacttcccatcgaggtttatggacctgaggccacaatgactggcatatgcaagcaggcaattgactgcatcatatctgcagcataaatatggatatgtgttatcctttgccatttagacggtttattgattatttttgtaatcggactattactcggattgttgtttgtgatcacttctttcttttttcgttttcggaatgcagtcgagcattgaatttgttaggttttgtggtgaataacgatgcctgtcgttctgcattaattgctatgaaacaacttgtgttcagt

SEQ ID NO: 2948 - DNA, 1556 bp, Triphysaria pusilla
atcgtctatatcgccaaaccacctcactactcttcaccctccattctttcatctcaatccaaatcattcttttacactcactatatactttgggcaggtgtgaaattttactttcttcggattaaaaaaatggcgagaaagaagatcagagagtacgattccaaaaggctcctcaaagagcatctcaaaagattgaccggtctcgatcttcagatctgctctgcccaggtaactgaatctacagactttagtgatttaacaaacaaagaagcttggttgtcatctacaaagctggttgtgaaacccgacatgttgttcgggaaacgagggaagagtggcttggtagctttgaacttagatttggcccaagttgctggatttgtcaaagaacgtcttggcgttgaggttgagatgggaggttgcaaagcaccgataacgacattcattgttgagccttttgttcctcatgatcaagaatattacctgtccatagtgtctgagaggttaggttgtaccattagcttctcggaatgtggaggtatcgaaattgaagataactgggacaaggttaaaactatcttccttccaactgaaaagccaatgaatttggacgcatgtgctcctttgattgctacacttcctttagaggttaggagtaagatcggcgatttcataatgggtgttttttctgtatttcaagatttggattttagtttcattgagatgaatccgtttactttagtgaacggtgagccatatccgctagacatgagaggagagttggatgacactgctgctttcaaaaacttcaagaaatggggtggtattgagtttcctcagccttttggaagagtcatgagcccaactgaaagtttcatacactcgttggatgaaaaaactagtgcgtcgttgaaatttactgttttgaatccaaaaggacgcatttggacaatggtggccggaggtggtgctagcgtaatatacgcagatacagttggagatttggggtatgcatccgagcttggaaactatgctgagtacagtggagctccaaacgaagaggaggttttgcaatatgccagaatagttattgattgtgccacatctgatcctgatggccgtaagagagctcttcttattggaggaggcattgctaactttacagatgttgctgccactttcaatggaattatccgggctctcagggagaaggaatcaaagctgaaagcggcaaggatgaacctttacgttcgtagaggtgggcccaactatcagactggtttggcaagaatgcgcactttgggagaagaattgggacttcccatcgaggtttatggacctgaggccacaatgactggcatttgcaagcaggcaattgactgcatcatatctgcagcataaatctggatatgtgttttcctttgccatttaggcggtttattgattatttttgtaatcggattgttactcggattgttgtttgtgatcactttttgctttttttcgttttcggattgcagtcgagcattgtatttgttaggttttgtggtgaataa

SEQ ID NO: 2949 - DNA, 1642 bp, Echinochloa colona
gctactacgtgcacgccgctcagcgccagtgaccaaaccaaccccgcccacctcccttccagtcctctcccagtccaactccatggcgcgcaagaagatccgggagtacgactccaagcgcctcctcaaggagaacctcaagcgcctcgccggcatcgacctcgccatcctctccgcccagatcacacaatcaacagacttcgcggagcttgttagccagcagccatggctgttgacgacaaagttggttgtgaagcccgatatgctgtttgggaagcgtggcaagagtggccttgtggctctcaacctggattttgatcaagtcaaggagtttgtgaagcagcggttgggagtagaggttgagatgggtggctgcaaggctccaatcacgaccttcatcgttgagccgtttgtgccccatgatcaagagtattatctatcgattgtgtcagagaggttgggcagcaccatcagcttctcagagtgtggagggattgagatcgaggagaactgggacaaggttaagacaatttttcttcctactgagaagccaatgacacaagatgcatgtgctcccttgattgctacccttccattggaggcacgcggaaaaattggtgacttcatcaaaggagtgtttgctgtcttccaagacttggacttctcatttcttgagatgaacccatttaccatggtgaatggggagccataccctctggacatgagaggagaactcgatgacacagcagctttcaagaacttcaagaagtggggagctattgaattccctctaccatttggaagagtactcagcgctaccgaaagtttcatccatgaactggatgagaagacaagcgcctctctgaagtttacagttttgaacccaaagggacgcatctggacaatggttgctggaggtggtgctagtgtcatatatgctgatactgtcggtgatctggggtatgcttcagagctaggaaactatgcagagtatagtggtgcgcccaatgaggaggaggttctgcactatgctagagttgtacttgattgtgcaactgctgatcctgatggtcgtaagagggcacttctcattggaggtggcatagctaacttcactgatgttgctgccacattcaatggcatcatccgggccttaagagagaaggaatccaagttgaaggcttcaaggatgcacatttatgttcgccgaggtggcccgaactaccaatctggactggctaaaatgcgtaagcttggtgcagaacttggcgttccaattgaggtgtatgggccagaagcgacgatgacaggaatctgcaagcaagcaattgaatgcgtcatggctgcagcataaccggagtgtagttctgctgtcctggatagtttgggatctgcaaacacgcaattgaatgtgtcagactcagcataaatgagagatggagagtgtagttgcagtacttcacccacacatgattgttctccttttgtttcagttactatgttgtagcgaggagttgtttaacgatacctttatagatcagtacggaaagaaattactgttgcgatgcaataaatccaaggtctagtttgtgtgttatatatattatgaacattgagctgcaatgcaatgcaagtggcaggc

SEQ ID NO: 2950 - DNA, 1481 bp, Echinochloa colona
ccaaccccgcccacctcccttccagtcctctcccagtccaactccatggcgcgcaagaagatccgggagtacgactccaagcgcctcctcaaggagaacctcaagcgcctcgccggcatcgacctcgccatcctctccgcccagatcacacaatcaacagactttgcagagcttgttagccagcagccatggctgttgacaacaaagttggttgtgaaacccgatatgctgtttgggaagcgtggcaagagtggccttgtggctctcaacctggattttgatcaagtcaaggagtttgtgaagcagcggttgggagtagaggttgagatgggtggctgcaaggctccaatcacgaccttcatcgttgagccgtttgtgccccatgatcaagagtattatctatcgattgtgtcagagaggttgggcagcaccatcagcttctcagagtgtggagggattgagatcgaggagaactgggacaaggttaagacaatttttcttcctactgagaagccaatgacacaagatgcatgtgctcccttgattgctacccttccattggaggcacgcggaaaaattggtgacttcatcaaaggagtgtttgctgtcttccaagacttggacttctcatttcttgagatgaacccatttaccatggtgaatggggagccataccctctggacatgagaggagaactcgatgacacagcagctttcaagaacttcaagaagtggggagctattgaattccctctaccatttggaagagtactcagcgctaccgaaagtttcatccatgaactggatgagaagacaagcgcctctctgaagtttacagttttgaacccaaagggacgcatctggacaatggttgctggaggtggtgctagtgtcatatatgctgatactgttggtgatctggggtatgcttcagagctaggaaactatgcagagtatagtggtgcgcccaatgaggaggaggttctgcactatgctagagttgtacttgattgtgcaactgctgatcctgatggtcgtaagagggcacttctcattggaggtggcatagctaacttcactgatgttgctgccacattcaatggcatcatccgggccttaagagagaaggaatccaagttgaaggcttcaaggatgcacatttatgttcgccgaggtggcccgaactaccaatctggactggctaaaatgcgtaagcttggtgcagaacttggcgttccaattgaggtgtatgggccagaagcgaccatgacaggaatctgcaaacaagcaattgaatgcgtcatggctgcagcataactggctgctgtcctggatagtttgggatctgcaaacacgcaattgaatgtgtgagactcagcataaatgagagatggagagtgtaattgcagtagttcacccacatatagttgttctctttttgtttcagttatgttgtagcgaggagttgtttgacgatacct

SEQ ID NO: 2951 - DNA, 1949 bp, Allium cepa
aaggctacctattcttaccggaacctttattcagcacccgacccgttaaggagctgcaatggcgaggaagaagatccgagagtacgattccaagcggattctcaaagaacatctcaaacgtatcgctaacattgatctccagatccgctcagctcaggtgacacagtcaacagacttcactgaactagtggacaaagaacaatggctttcatcgatgaaacttgttgtaaagcctgatatgttgtttggaaagcgtgggaagagtgggctggttgccttgaatctggacatggcgcaggttgctcagtttgttaagcaacgccttggagttgaggttgagatgggtgggtgcaaggctcctattacaacattcattgttgagccattcgtgcctcacgatcaagagtattatctttcaattgtttctgagagacttggctgcaccattagcttttcagagtgtggcgggattgaaatcgaagaaaactgggacaaggttaagacaatatttcttcctactgagaaatccatgacaactgaggcgtgtgcccctctaattgctactcttccacttgagattcggggtaaaattggtgacttcattaaaggtgtttttgctgtattccaagatctggattttacttttctagagatgaacccatttacgttggtgaatggtgagccatacccattagatatgcgaggagaattggatgatacagctgctttcaagaattttattaagtggggagacattgaatttccacttccttttggtagagttttaagccctactgaaagatatattcatggacttgacgagaagacaagtgcctctctgaagttcaccgttttaaatccaaaaggccgcatatggacaatggtagctggtggtggtgctagtgtcatatacgccgatacagtcggagatttgggctatgcttctgagcttggaaactatgcagaatatagtggtgctccaaacgaggaggaggttctacaatatgctagagttgttcttgattgtgctactgcagatcctgatggtcacaagagagctctacttattggtggtggaattgcaaacttcaccgatgttgctgctacttttaatggaataataaaagctctaagggaaaaggagtctaagctaaaggcatcgagaatgaatatttttgttcgaagagggggtccaaattatcaaactggtctagcaaaaatgagggctttgggtgaggaacttggcgttcctcttgaggtgtatggacctgaggccacgatgactggaatctgcaagcaagctattgattgtatcatgtcagctgcatgatccaagtaatttgtttcttttttgtatatcaagtgtgagaatgtaaacttataattatctgtacaacaggaataagaatctcaattcaataacaataagaattaagaatcatgtattacatttatctagaaaggaataagaacgttgaagaaatacaaagaatggcttctatgatgacaagcacaatggctatccttccgtacacacccaccaccagccgccgcctttctctagcacccacaaaaggcagggttccaacaaagaaaaaccaacgttctgaagcacgtgcatctctgtcagcgaaagagcatgcagcggcagcagtggcaatgacagcgatgctggtgattcctgaaatcgcagaggcagctcagccagggatgtccccttccttgaacaacttcttgctcagcatcgcctctggtggactcgtgcttaccgccatcattggtgctgttgtcggggtttcgaacttcgaccctgtcaaaagggcataaatcctacttccatattgtttaatttgaatgtttttatgtatcaacactgcttgctactcgtgtaatatcattgcaatttggagatatttaaacacaatcttcatgaacaatcacattttaat

SEQ ID NO: 2952 - DNA, 1721 bp, Musa acuminata
gacagcgatcccgccgctggtggaatcttgcgcggtcgtcctcgttctattggtcttcgaccggccataaattgcaactgtccgcagcttcgcagccacggcgatcgatctgctctccgactccgagctccgaatccatcttcgtccgtcgaccgaccgaagcagtcgttttgaagcgatggcgaggaagaagatccgggagtacgattcgaagcgcctcctcaagcagcacctcaagcggctcgccgccatcgatctccagctctgctccgcccaggtgacgcaatcgacggacttcacggagttggtgaaccaggaaccatggctctcgtccatgaaacttgtcgtgaagcccgacatgctgttcgggaagcgcggcaagagtggcttggtgtctctcaacttggatctggccgaggttgcagagtttgtcaagaaacgctttggagtggaggttgagatgggaggatgtaaggcaccgatcactacatttatagtcgagccatttgtccctcatgaccaagagtactacctctctatcgtctccgagaggcttggctgctccatcagcttttcagagtgcggaggcattgaaattgaggacaactgggacaaggttaagaccatatttcttcctactgaaaagccgatgacatctgaggcatgtgctccactgatcgcaactcttcctctcgaggttagaggaaaaataggagacttcataagaggtgtgttcgctgtgttccaagacttggacttcagttttatcgaaatgaacccatttacgttcgtaaatggagaaccatatccattggatatgcgaggagaactggacgacactgctgcttttaagaatttcaacaagtggggtaacatagaattcccactcccttttggcagagtcttgagccccgcagaaagctatatccatgaacttgatgaaaagactagtgcctcattaaagttcaccattttaaatcccaaaggacgcatttggaccatggtggcaggtggtggtgctagtgtcatatatgctgatacagttggagatctgggttatgcattggagcttggaaactatgcagagtacagtggtgctccaaacgaggaggaggtcttgcagtatgctagagttgttcttgattgtgcaaccgccgaccctgatggccgcaagagagcgcttctcattggagggggtatagccaactttactgatgttgccacaacttttaatggtatcatccgggctctgagagagaaggaggccaagctaaaggctgcaagggtgcacatttatgttagacgaggtggtccaaattatcagactggtcttgcaaaaatgaggtctctaggtgatgaaattgggattcctcttgaggtttatgggccagaggctacaatgacagggatctgcaaacaagctattgattgcatcatgtctgctgcatgaacatagtcttcctttaatctttcttccgtctcccttttgttcccgatctcatgatgatttggtggtgcattgagtgaaagattgtacttcaaaatttagaggcataaagggttgttaatgcaataatactattactgctttgctgaaccttccccttgtcgtaagaaaaacatctcttttattcatgcataaatctcatgaaaaagaattctttgtcatgtgagatcagattaacctaagactacccgctgagagctatcaagttaaatcc

SEQ ID NO: 2953 - DNA, 1850 bp, Panax ginseng
ttggtatcagctggttgctaccagcaaccagctcagtgctcatcagtcatcacaaagtttcttgctaaagtcgcccaactaccactcctcttcatcctattttcccctaaatttctctctctgtcagttggggtttggtttttgcctttttgggtgagctcaatcgtcccttcaaagcaatcagcctcttcttcccaatccaccctcctcctgtatttgtataaactagtattacatcccactttaatcgatcaattttggtgaattagataaagaaatggctcgaaagaagatcagagagtacgattcgaagaggctcctcaaggaacacttgaagagactcgctgccattgatcttcagatctactctgctcaggtgactgaatccacacactttaccgagttaacaaacaaagaaccatggctctcatctgcaaagttagttgtaaaacctgatatgttgttcgggaagcgtggaaagagtggcttggtagcgttgaatttagatttagctcaagttgctcaatttgtgaaagggcgccttggtgtggaggttgagatgggaggttgcaaggcaccaataaccacattcatcattgagccgttcattccgcatgaccaagaatattacctttccatagtctctgaacggctaggctgtaccattagcttttcagaatgtgggggcattgaaattgaagagaactgggacaaggtcaagacagtatttctcccaactgaaaagcctatgacgctggaggcttgtgctccattgattgctacacttcctttggaggttcgaccgaagattggtgatttcattatgggagttttttctgtatttaaagatctagatttcagtttccttgagatgaatccctttactttggtgaatggggagccataccctttagatatgcggggagagttggatgacacagctgcctttaagaactttaagaagtggggcaagatagaatttcctctgccttttggaagagttatgagcccaacagaaagcttcatccactcgttagatgacaaaactagtgcatctttaaaattcaccgtcttaaacccaaaaggtcgcatctggacaatggtggctggaggtggtgcaagcgtgatatatgcagacaccgttggagatttaggttatgcatctgagcttggaaattatgcagagtatagtggagctcctaatgaggaagaggtgttgcaatatgccagagttgtgattgattgtgccactgcggatcccgacggtcgtaagaaagctctcctcattggaggaggtattgccaatttcactgatgttgctgccactttcaatgggattattcgagccctcagggaaaaggaatcaaagcttaaagcttcaaggatgcatatctatgttcgacgaggtggtcccaattatcagactggtttggcaaagatgcgtgcccttggagaggaattgggagttccccttgaggtctatggacccgaagctacgatgactggcatttgcaagcaagcaattgaatgcgtcatggctgccgcatagtctttataccattcataatcttttcctccaagaaaatgagaaatggtctgtgtttgtttttggaaaacatgttttttctttttatttttatattgaaagtgacaatgtgatgatgttgtagaacctagcgtgggcttttctatgctagtttgaatgtttgggaatctttttgtatgtgactgaataggtccttgcctccttggaatttactccctggcttgtgaaattaatttcatagttttatgtttttgaataaaaaaaaaaaaaacaaaaaaacaaaaaaaagaaaaaaaggtaaagt

SEQ ID NO: 2954 - DNA, 1581 bp, Allium cepa
gaaggctacctattcttaccggaacctttattcagcacccgacccgttaaggagctgcaatggcgaggaagaagatccgagagtacgattccaagcggattctcaaagaacatctcaaacgtatcgctaacattgatctccagatccgctcagctcaggtgacacagtcaacagacttcactgaactagtggacaaagaacaatggctttcatcgatgaaacttgttgtaaagcctgatatgttgtttggaaagcgtgggaagagtgggctggttgccttgaatctggacatggcgcaggttgctcagtttgttaagcaacgccttggagttgaggttgagatgggtgggtgcaaggctcctattacaacattcattgttgagccattcgtgcctcacgatcaagagtattatctttcaattgtttctgagagacttggctgcaccattagcttttcagagtgtggcgggattgaaatcgaagaaaactgggacaaggttaagacaatatttcttcctactgagaaatccatgacaactgaggcgtgtgcccctctaattgctactcttccacttgagattcggggtaaaattggtgacttcattaaaggtgtttttgctgtattccaagatctggattttacttttctagagatgaacccatttacgttggtgaatggtgagccatacccattagatatgcgaggagaattggatgatacagctgctttcaagaattttattaagtggggagacattgaatttccacttccttttggtagagttttaagccctactgaaagatatattcatggacttgacgagaagacaagtgcctctctgaagttcaccgttttaaatccaaaaggccgcatatggacaatggtagctggtggtggtgctagtgtcatatacgccgatacagtcggagatttgggctatgcttctgagcttggaaactatgcagaatatagtggtgctccaaacgaggaggaggttctacaatatgctagagttgttcttgattgtgctactgcagatcctgatggtcacaagagagctctacttattggtggtggaattgcaaacttcaccgatgttgctgctacttttaatggaataataaaagctctaagggaaaaggagtctaagctaaaggcatcgagaatgaatatttttgttcgaagagggggtccaaattatcaaactggtctagcaaaaatgagggctttgggtgaggaacttggcgttcctcttgaggtgtatggacctgaggccacgatgactggaatctgcaagcaagctattgattgtatcatgtcagctgcatgatccaagtaatttgtttcttttttgtatatcaagtgtgagaatgtaaacttataattatctgtacaacaggaataagaatctcaattcaataacaataagaattaagaatcatgtattacatttatctagaaaggaataagaacgtattgaaagcttgtaagctgaggtggtcggaattagtatttttatcaaacggataatgagctaaatgaaaaaccttttgaaatcaatatttcaaaggtatttcaac

SEQ ID NO: 2955 - DNA, 1764 bp, Nicotiana tabacum
cacctcatttcattcttctcctctctctctctctctctctctctctgcttaagccttcactcaccagttgttgttagtttggtgaaacacacccaattcattcttgtcccttaagctaatttatttcagatccttttatttttccactcagttatatacccaccaggtgtttgtattttttctagagctatctattgtaatcctacgtttgaattgtaaagaaagggaacatggcaaggaagaagatcagagagtatgattccaagaggcttctcaaggagcatttgaaacgccttgctggcatcgatcttcagatctgctctgctcaagtgacagaatctacagattttactgagttaacaaacaaagaaccatggctctcatcgacaaagttggttgtaaaaccagacatgctgtttgggaagcgtggaaagagtggcttggtcgcattaaatctggatctagcagcagttgccgagtttgtcaaagcacgacttggggtggaggttgaaatgggtggctgcaaggcacctataacaacatttattgttgaaccatttgttccccatgaccaagaatattacctttccatagtctctgaaaggttggggtgcactattagcttttcagaatgtggaggcattgagattgaagagaactgggacaaggtcaagacaatattccttccaacagaaaaacctatgaccctagaggcgtgtgctccactgattgctactctgcccttggaggtacggggaacgattggcaatttcctaatgggtgtttttaatgtgtttcaagatctcgattttagtttcatagagatgaacccttttacgcttgtaaatggggatccatacccattggatatgaggggagagttggacgacacagcggccttcaaaaattttaagaagtggggaagtattgagtttcctctgccctttggacgagttttgagccctactgaaagcttcattcactctttggatgagaaaactagtgcctccttaaaattcacagttttgaacccaaaaggccgtatctggacaatggtggctggaggtggtgcaagcgttatatatgctgatacagtaggggatttaggctatgcctctgagcttggtaactatgccgagtatagtggggctccaaatgaagaggaggttctgcaatatgctcgagtggttctagattgtgctactgctaatcctgatggccgtaagagagctctcattgttggaggtggtattgctaacttcaccgatgttgctgctactttcaatgggattattcgggctctcagggagaaggaagccaagctaaaggcagctagaatgcatatctatgtacgaagaggtggtccaaattatcagactggtctagcaaaaatgcgtgccctaggagaggaacttggagttccccttgaggtttatggaccagaggctacaatgactggcatttgcaaacgggcaattgattgcattatgtctgaagcttagatgatgtatacttttggttcattcattcaacaattccaagcacaatatgaatttgtgaactcttcataagtgcccaagtcatgatccgcaaatcagaatacttttgttgcattcttgaaatttcctgcgattaaaaagaaacttttttggattttcattggcctgtgattatgaaatttcctgcagtttggactatttggaacattgacccgccctaaatagtttggataaagaaagcttgttgatatattactagtaatat

SEQ ID NO: 2956 - DNA, 1713 bp, Triticum aestivum
aacgcacaccggcacctaccatcgctctactccgcttcgagtccacagcacctcgcgcgcgctctacccaccataagccttcgggccttccgggagcccaagccatggcgcgcaagaagatccgggagtacgactccaagcgcctcctcaaggagcacctcaagcgcctggccggcatcgacctgcacatcctctccgcccaggtcacacaatcgacggactttgcggagcttgtgaaccagcatccatggctgtcgaccaccaaactggttgtgaagcctgacatgctgttcgggaagcgtgggaagagtggccttgtggcactcaacctggatgtagcccaagtcaaggagtttgtgaaggagcggttgggagtcgaggtcgagatgggtggctgcaaagctccaattaccaccttcatagttgagccgtttgtcccccacgatcaagagtactacctttcagttgtgtccgaaaggttgggtagcaccattagcttctcggaatgtggaggcattgaaatcgaggagaactgggacaaggttaagacagtctttcttccgactgagaagccaatgacacctgatgcttgtgctcccttgattgcaacccttccactggaggcacgcggaaagattggtgatttcatcaaaggagtgtttgctgtcttccaagacttagatttctcatttattgagatgaacccattcaccatggtgaatggggagccatatccgctggacatgagaggagaattggatgacactgcatctttcaagaacttcaagaagtggggaaatttagaattccctctaccattcggcagagttctcagttctacagaaagttttatccatgagctggacgataagaccagcgcgtctttgaagttcacagttttgaacccaaagggacgcatctggacaatggttgctggaggtggtgccagtgtcatatacgctgacacggttggagatttgggatatgcttcagagttaggaaattatgcagaatacagtggtgctcccaaccaggaggaggttctgcagtatgctagagtagtacttgattgtgtgactgcggaccctgatggccgcaagagagcccttctcattggaggtggtatagccaacttcactgatgtcgctgccacttttagtggcatcattcaggcattaagagagaaggaatccaagttaaaggcatccaggatgcacctctatgttcgacgaggcggtccaaattaccaaactggactggcgaaaatgcgcaagcttggtgcagaaatcggtgttccgattgaggtgtatggaccggaagagacaatgactggcatctgcaagcaagcaattgaatgcattatggcggcatcataaatcaggatacagttgagaagtagtttgagatctacaaacaagaaactggctgccgcataaatgagagcatagtggcactaggttcacatcacatggttgattagtttcttcagaagttatttggacaaagacacatatattgttatcgtaaaggaacctgtactgttgtaatgtgacaaacaaaagatttattaccatgcaaaccggtatgtccgtagcctgttacaagcacggaattgcaatgatcttgattggactgcctcatacacacctgctattgggtttgttgtgttactgaacttgttcagaaattgcatgtcctcacaactttctagag

SEQ ID NO: 2957 - DNA, 1777 bp, Panax ginseng
accagctaccagcaaccagctcagtgctcatcagtcatcacaaagtttcttgctaaagtcgcccaactaccactcctcttcatcctattttcccctaaatttctctctctgtcagttggggtttggtttttgcctttttggataaagaaatggctcgaaagaagatcagagagtacgattcgaagaggctcctcaaggaacacttgaagagactcgctgccattgatcttcagatctactctgctcaggtgactgaatccacacactttaccgagttaacaaacaaagaaccatggctctcatctgcaaagttagttgtaaaacctgatatgttgttcgggaagcgtggaaagagtggcttggtagcgttgaatttagatttagctcaagttgctcaatttgtgaaagggcgccttggtgtggaggttgagatgggaggttgcaaggcaccaataaccacattcatcattgagccgttcattccgcatgaccaagaatattacctttccatagtctctgaacggctaggctgtaccattagcttttcagaatgtgggggcattgaaattgaagagaactgggacaaggtcaagacagtatttctcccaactgaaaagcctatgacgctggaggcttgtgctccattgattgctacacttcctttggaggttcgaccgaagattggtgatttcattatgggagttttttctgtatttaaagatctagatttcagtttccttgagatgaatcctttactttggtgaatggggagccataccctttagatatgcggggagagttggatgacacagctgcctttaagaactttaagaagtggggcaagatagaatttcctctgccttttggaagagttatgagcccaacagaaagcttcatccactcgttagatgacaaaactagtgcatctttaaaattcaccgtcttaaacccaaaaggtcgcatctggacaatggtggctggaggtggtgcaagcgtgatatatgcagacaccgttggagatttaggttatgcatctgagcttggaaattatgcagagtatagtggagctcctaatgaggaagaggtgttgcaatatgccagagttgtgattgattgtgccactgcggatcccgacggtcgtaagaaagctctcctcattggaggaggtattgccaatttcactgatgttgctgccactttcaatgggattattcgagccctcagggaaaaggaatcaaagcttaaagcttcaaggatgcatatctatgttcgacgaggtggtcccaattatcagactggtttggcaaagatgcgtgcccttggagaggaattgggagttccccttgaggtctatggacccgaagctacgatgactggcatttgcaagcaagcaattgaatgcgtcatggctgccgcatagtctttataccattcataatcttttcctccaagaaaatgagaaatggtctgtgtttgtttttggaaaacatgttttttctttttatttttatattgaaagtgacaatgtgatgatgttgtagaacctagcgtgggcttttctatgctagtttgaatgtttgggaatctttttgtatgtgactgaataggtccttgcctccttggaatgtagtaaagatgaattatctttacatatatttacatgaaaaattgtcactatacacctatagcgacacttgaaaaaccgtcgctacatctatagtgacatttttcatgtagaaaataataaaacaaaaaaaaaaaaaaaaaaaaaaaacaa

SEQ ID NO: 2958 - DNA, 1688 bp, Avena sativa
gggcacaagctcaagcacacctagcacctactactccgccttcgaacccaggccatggcgcgcaagaagatccgggagtacgactctaagcgcctccccaaggagcatctcaagcgcctggccgccatcgacctccacatcctctccgcccaggtcactgaatcgacagacttcacagagcttgtgaatgagcagccatggctgtcaagcacaaagttggtcgtcaagcccgacatgctgttcgggaagcgtgggaagagtggccttgtggccctcaacctggatattgctcaagcaaggagtttgtgaaggagcggctgggagtcgaggttgagatgggcggctgcaaggctcctattacaaccttcatagttgagccatttgtgccccatgatcaagagtactatctttcgattgtgtcagagagactgggtagcaccattagcttctcagagtgcggaggaattgaaattgaggagaactgggacaaggttaagacagtatttcttcccactgagaaaccaatgacacctgagacgtgtgctcccttgattgcaacccttccactggaggcacgtggaaaaatcggtgatttcattaagggagtgtttgctgtcttccaagacttggatttctcacttattgagatgaacccatttaccatggtgaatggggagccatatcccctggacatgagaggagaactggatgatacagcagctttcaagaacttcaagaagtggggaaatttagagttccctttaccgtttggcagagctctcagctctacagaaagttttatccaagatctggatgacaagacgagcgcatctctgaagttcacagttctgaacccaaagggacgcatttggacaatggttgcaggaggcggtgccagtgtcatatacgccgacacggttggagatttgggatatgcttcggagttaggaaattatgcagaatacagtggtgcccccaaggaggaggaggttctgcagtatgctagagtagtacttgattgtgcgacttctgatcctgatggccgcaagagagcccttctcattggaggtggtatagccaacttcactgatgttgctgcgacatttaacggcatcattcgggcgttaagagagaaggaatccaagttaaaggcgtccaggatgcacctatatgttcgacgaggcggtccaaattaccaaactggactagcaaaaatgcgcaagcttggtgcagaaatcggcgttcccatcgaggtctatggacccgaagcgacaatgactggcatctgcaagcaagcaattgaatgcatcatggctgcagcataaatcgggatacagttgagtagcagtttgggatctacaaacaagaaacttgatgcgcataaatgagagcatagctggaataattcacatcacatggttgatcagtttcttcagaagctatttgaacaaacacacagtgttgtctcgaagaaacatctgctgctgtaatgtgaaaaacgaaagacttagcatttcttatttttggtttgctggttgagattcaggttcctatgttatatgctagcaaaactgcatttcttcagctttatgtccaagttcaactgctacgaccttatatgtttgcgatagtttttgcatgccactggtatgaatctgtagcctgttaaaagcacaacagtgcaatga

SEQ ID NO: 2959 - DNA, 1725 bp, Solanum tuberosum
gctcagatcattcatctcactcaccagtttggtgaatacccacaattcttctacctttagctaatttcctactcttagatctttgctttttgtaatcaattatatacccaccaactgtttgtataattgttttgtgtaagagaaagagatagttatcgtttgtttggattgttagaaaaacagagtaatatggcgaggaagaagatcagagagtatgattcaaagaggcttctaaaggagcatttgaaacgccttgctggcatcgatcttcagatctgctctgctcaagtgacagaatctacagattttaccgagttaacaaacaaagaaccatggctttcgtcgacaaagctggttgtaaaaccagacatgctgtttggtaagcgtggaaagagtggcttggtagctttgaatctggatctagcaggagttgctgagtttgtaaaaacacgacttggtgtggaggttgaaatgggtggctgcaaggcacctataacaacatttattgttgaaccatttattccccatgaccaagaatattacctttccatagtctctgaaaggttggggtgcacaattagcttttcagaatgtggaggcattgagattgaagagaactgggacaaggtcaagactatattccttccaacagagaaacctatgaccctagaggcgtgtgctccactgattgctactctccccttggaggtacggggaaagattggcaatttccttatgggtgtttttgatgtgtttcagatctcgattttagtttcatagagatgaacccatttacgcttgtaaatggggagccttacccattggatatgaggggagagttggatgacacagcagccttcaaaaattttaagaagtggggaagcatcgagtttcctctgccctttggaagagttttgagccctaccgaaagcttcattcactctttggatgagaaaactagtgcctctttaaaatttaccagttttgaacccaaaaggtcgtatctggacaatggtggctggagttggtgcaagcgttatatatgctgatacagtaggggatttaggctatgcctctgagcttggtaactatgccgagtatagtggagctccaaatgaagaggaggttttgcaatatgctcgagtagttctagattgtgctactgctaatcctgatggccgtaagagagctctgattgttggaggtggtattgctaacttcactgatgtagctgctactttcaatgggattattcgggctctcagggagaaggaagccaagctaaaagcggctagaatgcatatctatgtacgaagaggtggtccaaattatcagactggtctagcaaaaatgcgcgccctaggagaggaacttggagttccccttgaggtttatggaccagaggctacaatgactggaatttgcaaaggggcaattgattgcattatgtctgaagcgtaagtgccaaatcagaagacttgtgttgcattcttgcaattaagaagaaactttgttggatatttaatttgccttctgatattgtattgttacaattgggacctttaagaataattgagatccttttgttttacctggaaactaactgtacgagaacatgtgcgtgttccagcaaaacacttttttttgtgtgtaatatagtaatacgtatttagaaatattccaaaaatatacatatatcgaaaacgccctaattagtaaaagtac

SEQ ID NO: 2960 - DNA, 1544 bp, Musa acuminata
aattgcaactgtccgcagcttcgcagccacagcgatcgatctgctctccgactccgagctccgaatccatcttcgtccgtcgaccgaccgaagcagtcgttttgaagcgatggcgaggaagaagatccgggagtacgattcgaagcgcctcctcaagcagcacctcaagcggctcgccgccatcgatctccagctctgctccgcccaggtgacgcaatcgacggacttcacggagttggtgaaccaggaaccatggctctcgtccatgaaactagtcgtgaagcccgacatgctgttcgggaagcgcggcaagagtggcatggtgtctctcaacttggatctggccgaggttgcagagtttgtcaagaaacgctttggagtggaggttgagatgggaggatgtaaggcaccgatcactacatttatagtcgagccatttgtccctcatgaccaagagtactacctctctatcgtctccgagaggcttggctgctccatcagcttttcagagtgcggaggcattgaaattgaggacaactgggacaaggttaagaccatatttcttcctactgaaaagccgatgacatctgaggcatgtgctccactgatcgcaactcttcctctcgaggttagaggaaaaataggagacttcataagaggtgtgtttgctgtgttccaagacttggacttcagttttatcgaaatgaacccatttaccttcgtaaatggagaaccatatccattggatatgcgaggagaactggacgacactgctgcttttaagaatttcaacaagtggggtaacatagaattcccactcccttttggcagagtcttgagccccgcagaaagctatatccatgaacttgatgaaaagactagtgcctcattaaagttcaccattttaaatcccaaaggacgcatttggaccatggtggcaggtggtggtgctagtgtcatatatgctgatacagttggagatctgggttatgcattggagcttggaaactatgcagagtacagtggtgctccaaacgaggaggaggtcttgcagtatgctagagttgttcttgattgtgcaaccgccgaccctgatggccgcaagagagcgcttctcattggagggggtatagccaactttactgatgttgccacaacttttaatggtatcatccgggctctgagagagaaggaggccaagctaaaggctgcaagggtgcacatttatgttagacgaggtggtccaaattatcagactggtcttgcaaaaatgaggtctctaggtgatgaaattgggattcctcttgaggtttatgggccagaggctacaatgacagggatctgcaaacaagctattgattgcatcatgtctgctgcatgaacatagtcttcctttaatctttcttccgtctcccttttgttcccgatctcatgatgatttggtggtgcattgagtgaaagattgtacttcaaaatttagaggcataaagggttgttaatgcaataatactattactgctttgctgaaccttccccttgtcgta

SEQ ID NO: 2961 - DNA, 1521 bp, Castanea mollissima
taggccaggaagaagatcagagagtacgactcgaaacgcctcgtaaaggagcacctcaagcgcctcgccaatatcgacctccagatccactctgctcaggtgacggaagcaacggacttcactgaattaacaaatcaagagccatggctttcgtccaccagattggtcgtgaagcccgacatgttgtttgggaagcgtggaaagagtggcttggtggcgctgaacttggatttagctcaagttgctgagtttgtgaaagctcgccttggtgttgaggttgagatgggtggttgcaaagcaccgataactacattcattgttgagccctttgttccccatgaccaagaatactacctctctatagtctctgaaaggcttggatgcaccattagcttttcggaatgtgggggtattgagattgaagagaactgggataaagttaaaactatattccttccatctgaaaagcctatcacactggaggcttgtgctccattgatagctacacttcccttggaggttcgggggaaaattggtgacttcataattggcgtgtttaaagtgtttcaagatcttgacttcagtttcatagagatgaatccatttacactggtgaatggggagccatatcccttggatatgaggggagaattggatgacactgctgcgtttaagaactttaagaagtggggtaacatcgagtttccgttgccttttggaagagtcctgaaccctacagaaagtttcattcactccttggatgaaaagacaagttcatctttgaaattcactgtgttgaacccaaaaggacgcatctggacaatggtcgctggaggtggtgctagtgttatatatgctgacactgttggcgatttgggttatgcacaggagcttggtaactatgcagagtatagtggagctccaaatgaggacgaagtgttgcaatatgcaagagttgttattgattgtgctactgcagaccctgatggtcgtaagagagcccttcttattggagggggtattgctaacttcactgatgttgctgctactttcaatgggataattcgagcccttaaagagaaggagtccaaattaaaagcagcaagaatgcacatctatgttcgaagaggtggtccaaactaccagactggtctggcaaagatgcgtgctttgggagaggaactcggactacccattgaggtgtatggacctgaggcgaccatgaccggaatctgcaaacaggcgatagactgtgtcatggctgcagcctaattccacaataatttttgctactgagagtcaacatgtgtcagtttgtttcaaaaggacttggttgaatgtgtgccaggaataatttatcatgaggcttcctaaggcaaaagattgaaaagagtggattgttgtaaaatgtaaactctaaaaacatttataaaaaaaaatttctttcgttttaaaattggaaattatgtcttccagaaaccatgacatggttgtaaacactgtgcattcactagtgatcct

SEQ ID NO: 2962 - DNA, 1415 bp, Echinochloa colona
aggtcatgcaatcaacggatttcactgagcttgcaaaccaggagccatggctctcatctatgaagttggttgtcaaacctgacatgttgtttggtaaacgcgggaagagcggacttgtggccctcaacctagaccttgctcaagttcgccaatttgtcaaggagcggttgggagttgaggtcgagatgggtggctgcaaagctccaattacaaccttcatagttgagccatttgttccccatgatcaagagtattacctttcaattgtatcagaaaggcttggctgcaccattagtttctctgagtgtggaggtattgagattgaggagaactgggacaaggttaagacaatcttccttcccacagagaaacaaatgacacctgatgcatgtgctccgttgattgccaccctgccattggaggtccgcacaaaaataggcgatttcattagaggtgtattttctgttttccaagacttggatttctcatttcttgagatgaacccattcaccttggtaaatggtgaaccttatcctctggatatgagaggagaactagatgacacagccgctttcaagaacttccaaaaatggggtaacattgagtttcctctgcctttcggaagagttctcagtccctcagaaagctttatccatgaactggatgagaagacaagttcttctctgaaattcacagtattgaacccaaaaggacgcatttggacaatggttgcaggtggcggtgctagtgtcatatatgctgatacggttggagatttgggatatgcttcagagctaggaaattatgcagagtacagtggagctcccaacgaggaggaggttctgcagtacgctagagtggttctggatactgctaccgctgatcctgatgggcgcaagagagcccttctcatcggaggaggtattgctaacttcaccgatgtcgccgccacatttagtggcatcattcgggctttaagagagaaggaatccaaattgaaggccgcaaggatgaacatttacgtccggagaggcggtccaaactaccaaaccgggctcgcgaaaatgcgcactcttggtgcagaacttggtgttccaattgaggtgtacggaccagaggcgaccatgaccgggatctgcaaagaagccattgaatgcatcatggccgcataaaccacggtatagttgccctgcttgcagttgcatccattttgtaccaaaagttcaatgtaagtgattgttcgagcgaaacagagaagcatcattgttgtgagtaaactccacctttgtaacgcaataatcaagatcgtggcttgggatgtgaatggttaaagcaattgtgacgatccactggattgcggtagtgttcatggccgtgctggcatcctgtacagtatcaatatgtcgtgagtttcg

SEQ ID NO: 2963 - DNA, 1783 bp, Amsonia hubrichtii
gaagtcgccccaactacctacccttcttcccacacctctctactaactactgaaaattcacctgccgattcgtctcttttaagcaagtccgatctctctctcctgttatctactgcccgttctctacttctataaatctttgaatcggtgtcctccacaggtattgatcaatttcaagaattttcttggagcgtatagttcagtagatagagcagaagataaaggaggaggagaatggcaaggaagaagatcagagagtatgattccaagaggcttcttaaggagcatttgaaaagacttgctgggattgatcttcagatctgctctgctcaagtgaatgaggctacggattttgctgagttgacaaataaagaaccatggctgtcatccactaagttagttgtcaaacctgatatgttatttgggaagcgtggaaagagtggattagtggctttgaatctggatcttgcacaagttgctgagtttgtcaaagctcgccttggtgtagaggttgatatgggtggttgcagggcacctattactacatttatagtagaaccatttgttccccatgaccaagaatattacctcaacattgtctctgataggttgggttgtagtattagcttttcggaatgtggaggtatcgaaattgaagagaattgggacaaggttaagaccatttttcttccaaccgaaaagcctatgacgctggaggcatgtgctccactaattgctacgcttcccttggaggtacgggggaagattggtgattttataatgggtgtttttgcagtatttcaagatctggatttcagtttccttgagatgaatccctttacactggttaatggggagccattcccattggatatgcgtggggagttggatgacactgctgcatttaagaactttaaaaaatggagtaacatagaatttcctctaccttttggaagagttttgagcccgaccgagagcttcattcacacattggatgaaaaaactagcgcatctctaaaatttactgttttgaatccaaaagggcgtatatggactatggtggcaggaggtggtgccagtgtcatatatgctgacacagttggagacttgggatatgcttctgagctcggtaattatgcagaatatagtggagctccaaatgaggaggaggttttgcaatatgctcgagtagttattgattgtgcaacggctaatcctgatggccgtaagagagctctgctaattggtggtggtattgcaaattttactgatgttgctgctacattcaatggcattattcgggctctcagggagaaggaatcaaagttaaaggcttctagaatgaatatatatgttcgaagaggtgggcctaactaccagactggtttggcgaaaatgcgtgctcttggagaggagctgggagttcctattgaggtatatggacctgaggcaactatgactggcatctgcaagcaagcaattgattgcatcatgtctacagcatagtcaaacaacttaaatttccatgaagcattgaggatacagtaatctgggtttcctgtaagggtggactaatttggccgtctcttgagtgtgcatgtctctccccctcctttccccacaatttgactgggataagttccacaactcgatttgatggagtttacatcttcagcttttatatattctgaaacaattacatatataataaacgtactgtaggtatgcatccttgcaattgttcacaaattccatatattataaaatggtaaaatattcttta

SEQ ID NO: 2964 - DNA, 1553 bp, Fagus grandifolia
atccacttcccaacctactctactcttaacattcctatgtgtctctgtttctcactcacacacacaaaaacagagcactcttacatatttctcatcttcttcttcttattccattgctttgaaataataataataaatcaaaagcaaaagctaatggcgaggaagaagatcagagagtacgattcgaagcgcctgttgaaggagcacctcaaacgcctcgctaatatcgatctccagatcaactctgctcaggtgacggaagcaacagacttcaccgagctaacaaaccaagagccatggctttcgtccaccagattggttgtgaagcccgacatgttgttcgggaagcgaggaaagagtggcttggtgtcgctgaacttggatttagctcaagttgctgagtttgtgaaagctcgtcttggtgttgaggttgagatgggaggttgcaaggcaccgataactacattcattgttgagccatttgttccccatgaccaagaatattacctctcaatagtctctgaaaggcttggatccaccattagcttttctgaatgcgggggtattgaaattgaagagaactgggataaagttaaaacgatattccttccaactgaaaaggctatgacactggaggtttgtgctccattgatagctacacttcccttggaggttcggggcaaaattgctgacttcataattggtgtgtttagagtatttcaagatcttgacttcagtttcatagagatgaatccatttacactggtgaatggggaaccatatcccttggatatgagaggagaattggacgacactgctgcatttaaaaacttcaagacgtggggtaacattgagtttccgctgccttttggaagagtcctgagccctaccgaaaacttcgttcactctttggatgaaaagacaagtgcatctttgaaattcactgtattgaacccaaaaggacgcatctggacaatggtagctggaggtggtgctagtgttatatatgctgacactgttggagatttgggttatgcacaggagcttggtaattatgcagagtatagtggagctccaaatgaagaggaggtgttgcaatatgcaagagttgttattgattgtgctactgcagaccctgatggtcgcaagagagccctacttattggagggggtattgctaacttcaccgatgttgctgctactttcaatgggataattcgagcccttaaagagaaggaatccaaattaaaagcagcaagaatgcacatctatgttcgaagaggtggtccaaactatcaaactggtttggcaaagatgcgtgctttgggagaggaactcggaatacccattgaggtttatgggcctgaggcgaccatgaccggaatctgcaaacaggcaattgattgcgtcatggctgcagcatagtttcacaattatttttgcttctcggtcaacatgtgtcagaaaaataacttggtgcaagctgccacgagtaatttatcatgaggcttccttgaaggcataagattgagttgattcgattgttgtaaaat

SEQ ID NO: 2965 - DNA, 1638 bp, Theobroma cacao
tcatttcatctcccaacgaaccaacccgcccttgtctccgcctcttcctctctttcttttctgtcagtcagtagctctgtctgtttggtgtttgatcttcgaggatcaaaaatggcccgcaagaagatcagggagtacgattccaagaggcttctgaaagagcacctcaaacgcctcgccaacatccatctccagatctgctctgctcaggtgacagaatctactgatttcactgagttgaccaacaaagaaccctggctttcatccaccagattggttgtgaagcccgatatgttgtttgggaagcgtggaaagagtggcttggttgcattaaatttggatcttgctcaagttgctgaattcgtcaaagcacgccttggcgttgaggttgaaatgggtgggtgtaaagctcctataaccacattcattgttgaacctttcgtcccccacgaacaggagtattacctttcaatagtctctgagaggcttggttcaatcattagcttttcagaatgtggaggtattgaaattgaagagaattgggataaggttaagaccattttccttccaactgagaaacctatgacccaggagacatgtgcgccattgatagctacactccctttggaagttcgcgggaagattggtgacttcatcatgggtgtcttctctgtctttcaggatcttgacttcagctttctggagatgaatccatttacactggtgaacggggaaccatacccactggatatgaggggagagctggatgacactgctgcatttaagaacttcaagaagtggggtgacatagagttccctctgccttttggaagagtcatgagccccacagaaggatttattcattccttggatgaaaagacgagcgcatctctgaaattcactgtcttgaatccaaaagggcgtatctggacaatggttgccggaggtggtgctagtgtcatatatgctgatactgttggagatttaggttatgcatcggaactcggcaactatgcagagtatagtggagctccaaatgaggaggaggtcttgcaatatgcaagagttgttgttgattgtgccactgcaaaccctgatggtcgtaagagagcccttctcattggaggtggcattgctaacttcactgatgttgctgctactttcaatggaattattcgagcattgagagagaaggaagccaagttaaaagcagcaagaatgcacgtctatgttcgaagaggtggtccaaactatcagactggtttggcaaggatgcgtacacttggagaggaactgggagtacctcttgaggtttatgggcctgaggccacaatgactggcatatgcaaggaggcaatagattgcattatgtcagaagcatagacacggtattcatttttgtgccgatacaatttggtaatcttccttgaaggaggcataagctggacggtgctgttgtagacttttccattattgaaaaattttgaaagtagtgtgcaataagcatgaaacttttggtctttcagcaatccttttatgtgtttgttggtactctggtctttttgagagagaagtgtttataatggttatgcttcttctcatctgttggaagaattattggatcaaaatgagaaatgc

SEQ ID NO: 2966 - DNA, 1687 bp, Cucumis sativus
acctactcacctaaccagttgttgaagctcttcatccacacccttatttttcatacctctctctctctatttaatcttccaatctattttcccttatttctcacattcgttgaatttcttttctcaattggaagaacatcaggaagtttgtaatggctaggaagaagatcagggagtatgactctaagaggcttctcaaggagcatctcaaacgcctcgctaatatcgacctccagatctgctctgctcaggtaaatcaatcaaccgacttcgctgagctgacaaacaacgaaccatggctgtcatctaccaggttagtagtgaaaccagacatgttatttgggaaacgtggaaagagtggcttggtagctttgaatttggatctagctcaagttgctgagtttgtgaagcaacgccttggagtgcaggttgagatgggtggttgcaaggctccaattacaacattcattgtggagccatttgttccccatgatcaagagtactacctatctattgtctctgaaaggcttggctgcgaaataagtttttcagaatgtgggggtatcgaaattgaagagaactgggataaagtcaagacgattttccttccaactgaaaaaccttttacacttgaggcatgtgctccgttaatagctacacttcctctggagattcgaggaaagattggtgacttcataatgggtgtattcaatgtatttcaagatctggacttcagttttctggagatgaatccattcaccctggtgaacggggagccatatccactggatatgagaggggaattggatgacactgctgctttcaaaaattttaagaaatggggaaacattgaatttcctttgccctttggtcgagtgctaagctctacagaaagttttgttcactctttagatgaaaagacaagtgcatccttgaaattcactgttttgaacccaaaagggcgcatatggacaatggtggcaggagggggtgctagcgttatatatgcggatactgtcggagatttgggttatgcatctgagcttggtaattatgcggaatacagtggagctccaaatgaggaggaggtgttgcaatatgcccgagttgttattgattgtgctacttctgaccctgatgggcggaagcgagcccttctaattggagggggaatagctaatttcacagatgttgctgctactttcaatggaattatccgagctctaagagagaaagaatcgaaattaaaggctgcaagaatgcatatctatgttcggagaggtggtccaaattatcagactggtctttcaaaaatgcgggctctcggagaggagcttggagttccacttgaggttttcggtccagaagccacaatgactggcatctgcaaacaagcaattgagtgcataatgtctgctgcataatcccccatttcttttgcagcggatgacaactaagttgaaagatttaagaaatatcttttatcgcttggtcagtggggaagggaaaggtcaaggaaagggagttgtggtatatgcttctgtagcatcgctcgtttaattttgtggtccttggaatttgaaaaacaatcccttcatatttctttgtcatatgaagatgatgccagagttaagttatatgtgtactctttttgactcaggttaacctgttgtgtgcaccatttgta

SEQ ID NO: 2967 - DNA, 2077 bp, Eucalyptus grandis
ggaatcaattctttaattcttggactttggaacctaaacccaaaaccggccccattctcttaaaatatttgagcaaatcactctatggaaaggaaaaaaaaaaaaaaaaccgacccgtcaaacaccaagaaaattttgaccaaaaaagaaaaacaccaacacaaccatcattaacctcgtcgggtgcgcaaaaccatgtggttgctttcttctcccgttgtccgccgagtcctattcacggcacaaatccagctcaactaactcgcagcagcccaccaacatccctcgacctactccatccactcccgatcctcgcaatcctcgacctacccaaattcccatccgatcgatccaaccctcttctgcttctcctcctccttcactgcagcgaccgagtactgggtagttcgtaacgcccacgaagcgggtctgcgcagagtctccgtgtcgggtcgaaaatggcgaggaagaagatcagggagtacgactccaagcggctcctcaagcagcacctgaagcgcctcgccaacatcgacctcccgatccgatccgctcaggtgacggaatcgacggattttggtgaactggtgaacaaagaaacgtggctgtcctctacgaagttggtcgtgaagcccgacatgttgttcgggaagcgtggcaagagcggacttgtggccctgaatttggatatggctcaagttgcgcagtttgtgaaggaacgtcttggtgtggaggtcgaaatgggcggttgcagagcacccgtgaccacattcatagtcgagccctttgttccccatgaccaggagtactatctttctatagtatcggacaggctgggatgcactataagcttttcagagtgtggagggattgaaatcgaagagaattgggacaaggtcaagactatttctctgcctaccgagaagcctttgacaagtgagacctgtgctccacttattgcgacactgcctctggaggttcgtggaaagattggggatttcataaagggagtcttctcagtatttcaggatttggacttcagcttcctggagatgaacccattcactttggttgatggtgagccctatcctttggatatgaggggggagcttgatgacactgcagctttcaagaactttaataaatggggtgatattgagtttccattgccatttggcagagtgttgagtccaacggaaagcttcattcattcattggatgaaaagacaagtgcatccctgaagtttactgttttgaatccaaaaggacgtatttggaccatggtggctggaggtggagccagtgtaatctatgcagacactgttggtgacttgggctatgcatcagaactcggcaactatgcagagtacagtggagctccaaatgaggaagaggttttgcagtatgctagggtagttatcgactgcgctactgcaaatcctgatggccgtaagagagcccttttgataggaggcggcatcgctaacttcaccgacgttgctgccacgttcaatggcataattagagcccttagggagaaggaatctaagctgaaagcagcaagaatgcatatttatgtgagaagaggtggtccaaactaccagaccggtctagcaaagatgcgtgcacttggtgaagaacttggagttccacttgaggtttacggacctgaagcgacgatgactggaatttgcaaggaagcaattgagtgcataatggcggagtcatagaatgcattcgatctccagcagctttctaaagggattgctccggtggtttgtctcatgcattttgatttggccaagagaaaattattttcaagatatggtccccagaatttctccccaaaaaatgaaaaaagaggacttaatattgcttggaaattctcgaacattgctcacttccccaaatttgcaatgtgccaaaagtgtgttttgcatcttcaataatactcttctaagctgagagctaatacacacattttctctttgtacttaaaacggaaggtctccaagctggaattgcttttgtgaagtgcctagccctacatattcttactgattttgtttttgcttta

SEQ ID NO: 2968 - DNA, 1598 bp, Panax ginseng
accagcaaccagctcagtgctcatcagtcatcacaaagtttcttgctaaagtcgcccaactaccactcctcgtcatcccattttcccctaaatttctctctctgtcagttggggtttggtttttgcctttttggataaagaaatggctcgaaagaagatcagagagtacgattcgaagaggctcctcaaggaacacttgaagagactcgctgccattgatcttcagatctactctgctcaggtgactgaatccacagactttaccgagttaacaaacaaagaaccatggctctcatctgcaaagttagttgtaaaacctgatatgttgttcgggaagcgtggaaagagtggcttggtagcgttgaatttagatttagctcaagttgctcaatttgtgaaagggcgccttggtgtggaggttgagatgggaggttgcaaggcaccaataaccacattcatcattgagccgttcattccgcatgaccaagaatattacctttccatagtctctgaacggctaggttgtaccattagcttttcagaatgtgggggcattgaaattgaagagaactgggacaaggtcaagacagtatttctcccaactgaaaagcctatgacgctggaggcttgtgctccattgattgctacacttcctttggaggttcgaccaaagattggtgatttcattatgggagttttttctgtatttaaagatctagatttcagtttccttgagatgaatccctttactttggtgaatgggaagccataccctttagatatgcggggagagttggatgacacagctgcctttaagaactttaagaattggggcaagatagaatttcctctgccttttggaagagttatgagcccaacagaaagcttcatccactcgttagatgacaaaactagtgcttctttaaaattcaccgtcttaaacccaaaaggtcgcatctggacaatggtggctggaggtggtgcaagcgtaatatatgcagacaccgttggagatttaggttatgcatctgagcttggaaattatgcagagtatagtggagctcctaatgaggaagaggtgttgcaatatgccagagttgtgattgattgtgccactgcggatcccgacggtcataagagagctctcctcattggaggaggtattgccaatttcactgatgttgctgccactttcaatgggattattcgagccctcagggaaaaggaatccaagcttaaagcttcaaggatgcatatctatgttcgacgaggtggtcccaattatcagactggtttggcaaagatgcgtgcccttggagaggaattgggagttccccttgaggtctatggacccgaagctacgatgactggcatttgcaagcaagcaattgaatgcgtcatggctgccgcatagtctttaccattcataatcttttcctccaagaaaatgagaaatggtctgtgtttgtttttggaaaacatgttttttcttttatttttgtattgaaagtgacaatgtgatgatgttgtagaacctggcgtgggcttttctatgctagtttgaatgtttgggaatcttataatatgcgactgaataa

SEQ ID NO: 2969 - DNA, 2141 bp, Cannabis sativa
ttttattagtgagagtcattatttgatctaggactgggtgggacttgagcacgtagtagactctgcgcttgaacgtctcttctaagcttttccgaagttattaatcactcactcataactcacccaccaccaaaccaaaccaaaccaaacccaattctcacactgcccacctacctcttctctctacccttcattgaaattgggttaattgtatctaaattcgacagagtagagtaaaagcttcaccatggccaggaagaagatcagagagtacgactccaagagactcctcaaggagcatctcaagcgccttgccgccatcgaccttcagatctcctctgctcaggtgaatgaagcaacggattttactgagttgacgaatcagcagccatggctttcgtccacaaggttggttgtgaaaccagatatgttgtttgggaagcgtgggaagagtggtttggttgctttgaacttggatcttgctcaggttgctgagtttgttaaagcacgtctgggaaaggaggttgagatgggtggctgcaaggcaccaataacaacttttattgttgagccatttgttccccacaatcaagagtattacctttcaatagtttctgacagacttggctctaccattagcttttcagaatgtggaggtattgagattgaagagaactgggataaggttaagactatattccttcctactgaaaaatcattgacgctggagtcatgcgctccattgatagctacacttcctttggaggtgcgagggaaaattggtgacttcttaatgggtgtctttgcagtatttcaagatctggactttagttttctggaaatgaatccttttacgctggtcaatggagagccatatccactggatatgagaggggaattggacgacactgctgctttcaagaactttcaaaagtggggaaacattgaatttccccttccttttggaagagttatgagccctacagaaagctttattcactcattagatgaaaaaacaagtgcgtctttgaagttcactgttttgaatccgaaaggacgcatctggacaatggttgctgggggaggagctagtgttatatatgctgatactgttggagatttgggctatgcatccgagcttggtaattatgcagaatatagtggagctccaaacgaggatgaagtcttacaatatgctcgagttgttattgattgtgccactgcagaccctgatggtcgtaagagagcccttttaattggagggggcattgctaatttcactgatgtggctgctactttcaatggaattattcgtgctctaagggagaaggaatccaagctgaaggcagcaagaatgcacatctatgtacgaagaggcggtcctaattatcagaccggtttggcaaagatgcgagctttgggtgaagaacttggagtaccccttgaggtttatggaccagaagccacaatgactggtatctgcaaggaggcaatagattgcattatgtccacagcataaagtccaaacattgatctctgaaattgttgatgtgtgcccagaaaataatttgtcattggaacagcacataactagccccaaaaaaaggaagaaaaaaataaacgcagagagggagaaatagagatggtcgcgcatgaaactaaaagaacatttttcctttgtattcaaatggcattggaacttttgtgccctcaaaagaagaaaaaaggaaaaaagaaaaaaatggcattgcctacttctttttgttcttttatttatttggtagaaaagtgcatgcttaacaacatgtaataatttcttttcatatacataatgtgtgaatgtgtactttccaaagtgtttgatttagaagatactattaaatttagaaattaatttaataaatgagttgtggaggcacaaaagaattattaaaaatattgggaataaaatgtataatagctaaattttaatctcaccaatactatcattctaattaatttatttttgttactaaaataagtaaattaaaataataataaaagagaatcaaagaatgataaaatgtaatttttctatcttattttacaatgccaaaaggttgtctttatagtgttaggctaaaattagtctaagtttcggg

SEQ ID NO: 2970 - DNA, 1613 bp, Castanea mollissima
ctttatctctctcacaaaaacagagcaatatttatatatttctctcacagatattcttcttctgcaaaaaaaaatacaaaaaatggccaggaagaagatcagagagtacgactcgaaacgcctcgtaaaggagcacctcaagcgcctcgccaatatcgacctccagatccactctgctcaggtgacggaagcaacggacttcactgaattaacaaatcaagagccatggctttcgtccaccagattggtcgtgaagcccgacatgttgtttgggaagcgtggaaagagtggcttggtggcgctgaacttggatttagctcaagttgctgagtttgtgaaagctcgccttggtgttgaggttgagatgggtggttgcaaagcaccgataactacattcattgttgagccctttgttccccatgaccaagaatactacctctctatagtctctgaaaggcttggatgcaccattagcttttcggaatgtgggggtattgagattgaagagaactgggataaagttaaaactatattccttccatctgaaaagcctatcacactggaggcttgtgctccattgatagctacacttcccttggaggttcgggggaaaattggtgacttcttaattggcgtgtttaaagtgtttcaagatcttgacttcagtttcatagagatgaatccatttacactggtgaatggggagccatatcccttggatatgaggggagaattggatgacactgctgcgtttaagaactttaagaagtggggtaacattgagtttcctttgccttttggaagagtcctgaaccctacagaaagtttcattcactccttggatgaaaagacaagttcatctttgaaattcactgtgttgaacccaaaaggacgcatctggacaatggtcgctggaggtggtgctagtgttatatatgctgacactgttggcgatttgggttatgcacaggagcttggtaactatgcagagtatagtggagctccaaatgaggacgaagtgttgcaatatgcaagagttgttattgattgtgctactgcagaccctgatggtcgtaagagagcccttcttattggagggggtattgctaacttcactgatgttgctgctactttcaatgggataattcgagcccttaaagagaaggagtccaaattaaaagcagcaagaatgcacatctatgttcgaagaggtggtccaaactaccagactggtctggcaaagatgcgtgctttgggagaggaactcggactacccattgaggtgtatggacctgaggcgaccatgaccggaatctgcaaacaggcgatagactgtgtcatggctgcagcctaattccacaataatttttgctactgagagtcaacatgtgtcagtttgtttcaaaaggacttggttgaatgtgtgccaggaataatttatcatgaggcttcctaaggcaaaagattgaaaagagtggattgttgtaaaatgtaaactctaaaaacatttataaaaaaaaatttctttcgttttaaaattggaaatcatgtcttccagaaaccatgacatggttgtaaacactgtgcattcactagtgatccttcaattttct

SEQ ID NO: 2971 - DNA, 1667 bp, Festuca arundinacea
caccaagaacacctagcacctactaccgttctactctgccttccagtccaccgcacgtcgcgcgctctctccccataatcttcaggaccttccaagcaatggcgcgcaagaagatccgagagtacgactctaagcgcctcctcaaggagcacctcaagcgcctggccgccatcgacctccacatcctctccgcccagatcacggaatcaacagacttcacagagcttgtgaaccagcagccatggttgtcgaccatgaagttggtcgtcaagcccgacatgctgttcgggaagcgtgggaagagcggccttgtggccctcaacctggatattgctcaagtcaaggagtttgtgaaggagcggctgggagtcgaggttgagatgggcggctgcaaggctccgattacaaccttcattgttgagccatttgtgccccatgaccaagagtactatctttcagttgtctcagagaggctgggtagcaccattagcttctcagagtgtggaggaattgaaattgaggagaactgggacaaggttaagacagtatttcttcccactgagaaaccaatgacacctgagacatgtgctcccttgattgcaacccttccactggaggcacgtggaaaaatcggtgattttattaagggagtgtttgctgtcttccaagacttggatttctcatttattgagatgaacccatttaccatggtgaatggagagccatatcctctggacatgagaggagaattggatgacacagcatctttcaagaacttcaagaagtggggagatttagaattccctttaccatttggcagagttctcagctctacagaaagttttatccaagatctggacgataagacgagcgcatctctgaagttcacagttttgaacccaaagggacgcatttggacaatggttgcaggaggcggtgccagtgtcatatatgctgacacagttggagatctaggatatgcttcagagttaggaaattatgcagagtacagtggtgcccccaaggaagaggaggttctgcagtatgctagagtagtacttgattgcgcgactgctgatcccgatggccgcaagagagctcttctcattggaggtggtatagccaacttcactgatgttgctgccacatttaatggcattattcgggcgctaagagagaaggaatccaagttaaaggcatccaggatgcacctgtatgttcgacgaggcggtccaaattaccaaactggactagcaaaaatgcgcaagcttggtgcagaaattggcgttccgattgaggtgtatggaccagaagcgacaatgactggcatctgcaagcaagcaattgaatgcatcatggctgcagcataaatcgggatacagttgattagtagttcgggatctacaaacaagaaacttgatgagtagtccacgtcacatggttgatcagtaatttcggaagctatttgaccaaacacatagattgttgtcacaaagaaacctctcctgctgtaatgtgagaaacggaggttttatcatttcttatttttgttttgctcggtgagaaacggaggtttcaccatactgtaatgttcttgatacaattgcctcgtatacaaaacttcaggttcatgtgcttttatgctagcaaaactgcatttattcagc

SEQ ID NO: 2972 - DNA, 1713 bp, Gossypium raimondii
cttcattttcttctacctacctctttctttctatcaataaaaagcctcggcctcggcctcggcctcggcgttgttgttgtggttgtggttgtggttgcggttgtagatcttcttcaatctaagcttctcagagacttaaaatggctcgcaagaagatcagagaatacgattccaagagacttctcaaacaacacctcaaacgcctcgctaatatcgacctccaaatctgttctgctcaggtgactcaatctactgatttcaccgagttaacgaacgaacaaccatggctttcgtccaccagattagttgttaagccggatatgttgtttggtaaacgtgggaagagtggcttggttgctctcaatttggatcttgctcaagttgctgaattcgtcaaagctcgcctcggcactgaggttgaaatgggcggttgcaaagcacctataaccacattcattgtcgaaccttttgtaccccatgaacaagagtattacctttcaatagtctctgaaaggcttggttttaccattagtttttcggaatgtggaggtattgatattgaagagaactgggataaggttaaaaccatcttccttccaaccgagaaacctatgaccttggatacatgtgcaccgttgatagctacacttcctttggaagtccgcgggaagattggtgacttcatcatgggtgtcttttctgtctttcaagatcttgacttcagctttctcgagatgaatccatttacactggtgaatggagaaccatacccactggatatgaggggggagctggacgacactgctgcattcaagaacttcaacaagtggggtaacatagagtttcctctaccttttgggagagtcctgagctctacagaaagcttcattcattcattggatgaaaagacaagtgcatctctgaaattcactgttttgaatccaaaagggcgtatctggacaatggttgctggaggtggtgctagtgtcatttatgctgatactgtaggagatttaggttatgcttcagaactgggaaactatgcggagtatagtggagctccaaatgaagaggaggtcttgcaatatgcaagagttgttattgattgtgccactgcaaaccctgatggtcgtaagagagcccttctcattggaggtggcattgctaacttcactgatgtagctgctactttcaacggaatcattcgagcattgagagaaaaggaagccaagttaaaagcagcaagaatgcacatctttgctcgaagaggtggtccaaactatcaaactggtttggcaaggatgcgtgctcttggggaggaactaggagtaccccttgaggtttacgggcctgaggccacgatgactggcatatgcaagcaggctatagattgcattctgtccgaagcataagtatggtattatttttgttctccaaagtcgagttatgctgccaatgcagtttggtattctttgttgaagtcataagctggacaagactgttgttgtagaccgaaatactcaaattactgagtatttcatcctctcttttttgtgtgtgttcttgtgcgataaacacgaaacatggtttccgtcggtccatgtttgtttgttggttgttggtattttggtgtttctgatcataattgtgctttatgatgggctggaaaaatgtttgaattaacgagaaaatgcgaaaatgcaattcccagta

SEQ ID NO: 2973 - DNA, 1467 bp, Cucumis melo
acctactcacctaaccagttgttgaaactctcctccacacccttattcttcatatctctctctctatttaatcttcccatctattctcccttatttctcacactcgttgagtttcttttctcaatcggaagaacgtcagcaagtttgtaatggctaggaagaagatcagagagtatgactctaagaggcttctcaaggagcatctcaaacgcctcgctaatatcgacctccagatctgctctgctcagataaatcaatcaactgacttcgctgagctgacaaacaacgaaccatggctgtcatccaccaggttggtagtgaaaccagacatgttatttgggaaacgtggaaagagtggcttggtagctttgaatttggatctagctcaagttgctgagttcgtgaagcaacgccttggagtgcaggttgagatgggtggttgcaaggctccaattacaacgttcattgtggagccatttgttccccatgatcaagaatactacctatctattgtctctgaaaggcttggctgcacaataagtttttcggagtgtgggggtatcgaaattgaagagaactgggataaagtcaagacgattttccttccaactgaaaaaacttttacacttgaggcatgtgctccgttaatagctacacttcctctggagattcgaggaaagattggtgacttcataatgggtgtattcaatgtatttcaagatctggacttcagtttcctggagatgaatccattcaccctggtgaacggggagccatatccactggatatgataggggaattggatgacactgctgccttcaaaaattttaagaaatggggaaacattgaatttcctttgccctttggtcgagtgctaaaccctacagaaagttttgttcactctttagatgaaaagacaagtgcatccttgaaattcactgttttgaacccaaaagggcgcatatggacaatggtggcaggagggggtgctagcgttatatatgcggatactgtcggagatttgggttatgcgtctgagcttggtaattatgcagaatacagtggagctccaaatgaggaggaggtgttgcaatatgcccgagttgttattgattgtgctacttctgaccctgatgggcggaagcgagcccttctaattggagggggaatagctaatttcacagatgttgctgctactttcaatggaattatccgagctctaagagagaaagaatcaaaattaaaggctgcaagaatgcatatctatgttcggagaggtggtccaaattatcagactggtcttacgaaaatgcgggctctcggggaagagcttggagttccactcgaggttttcggcccagaagccacaatgactggtatctgcaaacaagcaattgagtgcataatgtctgctgcatagtcccccatttcttttgcagcggataactgagttgaaagatctataa

SEQ ID NO: 2974 - DNA, 1784 bp, Nicotiana benthamiana
acacctcatttcattctgttcctctctctctctctctctctctctctctctctctctctgcttaagccttcactcaccagttgttgtgagtttggtaaaacccacccaattcattcttgtcccttaagctaatttatttcagatccttctacttttctactcaattttatacccaccaagtgtttgtattttttctagagctatctattgtaatccttcgtttgaattgtaaagaaagagaacatggcaaggaagaagatcagagagtatgattctaagagacttctcaaggagcatttgaaacgccttgctggcatcgatcttcagatctgctctgctcaagtgacagaatctacagattttactgagttaacaaacaaagaaccatggctctcatcgacaaagttggttgtaaaaccagacatgctgtttgggaagcgtggaaagagtggcttggtcgcattaaatctggatctagcagcagttgccgagtttgtcaaagcacgacttggggtggaggttgaaatgggtggctgcaaggcacctataacaacatttattgttgaaccatttgttccccatgaccaagaatattacctttccatcgtctctgaaaggttggggtgcactattagcttttcagaatgtggaggcgttgagattgaagagaactgggacaaggtcaagacaatattccttccaacagaaaaacctatgaccctaaaggcgtgtgctccactgattgctactctgcccttggaggtacggggaacgattggcaatttcctaatgggcgtttttaatgtgtttcaagatctcgattttagtttcatagagatgaacccttttgcgcttgtaaatggggatccatacccattggatatgaggggagagttggacgacacagcagccttcaaaaattttaagaagtggggaagcattgagtttcctctgccctttggaagagttttgagccctactgaaagcttcattcactctttggatgagaaaactagtgcctccttaaaattcacagttctgaacccaaaaggccgtatctggacaatggtggctggaggtggtgcaagcgttatatatgctgatacagtaggggatttaggttatgcctctgaacttggtaactatgccgagtatagtggggctccaaatgaagaggaggttctgcaatatgctcgagtggttctagattgtgctactgcaaatcctgatggccgtaagagagctctcattgttggaggtggtattgctaacttcaccgatgttgctgctactttcaatgggattattcgggctctcagggagaaggaagccaagctaaaagcagctagaatgcacatttatgtacgaagaggtggtccaaactatcagactggactagccaaaatgcgagccctgggagaggaacttggagttccccttgaggtttatggaccagaggctacaatgactggcatttgcaaacgggcaattgattgcattatgtctgaagcttagatgatgtttacttttgatacattcattcaacaattccaagcacaatatgaatttgtgaactcttcataagtgcccaagccatgatccccaaatcagaatacttttgttgcattcttgaaatttcctgcaattaagaaaaaaacttttttggattttcattggcctgtgattatggtcctgcagtttggactatttggagcattgactcgccccaaatagtttggataaagagagcttgtttatatattagtagttaaatccttctcacg

SEQ ID NO: 2975 - DNA, 1715 bp, Citrus sinensis
tctttcaagcaataaacctccttcttgattctctctccttctctgtgtgtgtatatatataattcaatcaagagactgtatcatacagcattagcttgatatattgatttgaaaaataccttcttgttttgttgttcctgcagaggtattgagttgtatttgatatggctaggaagaagatcagagagtatgattctaagagacttttgaaagagcacttgaagcgtcttgctggcctcgaccttcagatctgctctgctcaggtgacagaatctacggacttctctgagttgacaaacaaagaaccatggctttcatcctcaagattggttgtgaaacccgatatgttgtttgggaaacgtgggaagagtggtttggtggcattgaatttagatctagctcaagtggctgaatttgtcaaaggacgccttggtacagaggttgagatgggcggttgcaagggaccaataactacctttatcgttgaaccatttgtccctcacaaccaagagtactatctttcaatagtctccgataggcttggatgcaccataagcttctcagagtgtgggggtattgaaattgaagagaactgggacaaggtgaaaacaatattccttccaacagagaaacatatgacactggatgcatgtgctcctttgatagccacacttcctttggagtttcgtggaaaaattggtgacttcataatgggggtctttgctgtatttcaagatctcgacttcagtttcatagagatgaatccctttacactggttaatggggagccatacccgctggatatgaggggagagctggatgacactgctgcctttaagaactttaagaagtgggccaacatcgagtttcctttgccttttggaagagtcttgagctctaccgaaagcttcattcactcattggatgaaaagacaagtgcatctttgaaatttactgtattgaaccccaaagggcgtatatggacaatggtagctggaggtggtgctagtgtaatatatgctgatactgttggagacttgggttatgcatcggagcttggtaactatgcagagtacagtggagctcccaacgaggaggaggtgttgcagtatgcaagggttgttattgattgtgccactgcagatcctgatggtcgtaagagagcccttctcattggagggggtattgcaaattttactgatgttgctacaacattcaatgggattattcgagctttgagggagaaggaatccaaactaaaagcagcaagaatgcacatatttgttcgaagaggtggtccgaactatcagactggtcttgcaaagatgcgtgctctgggagaggaactgggaataccacttgaggtctatggccctgaggccacgatgacaggcatatgcaagcaggcaattgactgcatcatgtcggcatcatagattcaacaattcctttttctccatcgttaaggtgtcgcgagagagtaagtctgcgtcatcctagtggagaaaataatttggcatttatgggttcattggaggcggacgatggagacattgttgtcaaaaactttgaaccttttgtttcttttttaatttttttgtccgattttgagacaatgttttttaataacgcttgaactcttgtaactttgtacatcatatttgtgaacttttgatcccatttatttgaaaacgtgttttttattgtgatagaaa

SEQ ID NO: 2976 - DNA, 1495 bp, Phalaenopsis aphrodite
cttctctctctctctatatatattggcttctataacccaaatcatacagattgagctttgggattcggcttactcctttaacctcgaccagatctcgactcatcaggggccggagatggcgaggaagaagattcgagagtacgactccaagcgcctcctcaaagagcacctcaagcaactcgctggaatcgagcttcagatctcctcagcccaggtgactgaggctaccgatttcacggagctgacggacagggagccatggctctcttccaatcggctggtggtgaaacccgatatgctgttcgggaagcgcgggaagagcggcctggtcgcgcttaacttggatcttgcacaggtggctcagtttgttaagggacgcttgggaaccgaggttgagatgggtggatgcaaagctcctattaccaccttcattgttgagccctttgtgccccatgaacaagagtattacttctccatcgtctcagagaggcttggttgcactctcagcttctctgagtgtggcggtattgaaattgaagagaattgggagaaggttaagacggttttcctccctacagagaaatccatgacttatgaagtctgtgctccattgattgctactcttcctctggagattagaggcaagattggaaactttataaaaggagtctttgatgttttccaagatctggatttcagttttcttgagatgaatccgtttactttggttaatggggagccttatccattggatatgcgaggagagttggatgacacggccgcttttaagaactttaagaagtggggggacattgaatttccgcttcctttcggcagggttctgagcccgacggaaagctttatccactccttggacgaaaagaccagtgcttcgcttaagttcacggtcttaaatccgaaagggcggatatggacaatggtggctggtggcggtgccagtgttatatatgctgatacagttggtgacttgggctatgcatcagagctcggaaattatgccgagtacagtggcgctccgaaagaggatgaagttctgcagtatgccagagttgttcttgattgtgctacatcggatcccgacggccgcaagagagctcttctcatcggtggtggtatagcgaacttcactgatgttgcggctactttcaatggaattataagagccttgagggaaaaggaatcaaaattgaaggcagcaagaatgcacatttatgttcgaagaggcggtccgaattatcagactggcctggcaaagatgcgagctcttggagatgaacttggtgttcctcttgaggtttatggacctgaggcaacaatgacaggaatctgcaagagagccatcgactgtgtcatgtctgctgcttgatctaccttcattaatttcttattattattatttttttcattcttctccgagttctctttgatatggcagtgagaataatgaaattatttcaactcttcaatcttaatg

SEQ ID NO: 2977 - DNA, 1712 bp, Secale cereale
tgctaagctacttgcaccaagcacaccggcacctaccatcgctctactccgcttctagtccgcagcacctcgcgcgctctctatccaccataagccttcgggccttccgggagcccaagccatggcgcgcaagaagatccgggagtacgactccaagcgcctcctcaaggagcacctcaagcgcctggccggcatcaacctgcacatcctctccgcccaggtcacaaaatcgacggactttgcggagcttgtgaaccagcatccatggctgtcgaccaccaaactggttgtgaagcctgacatgctgttcgggaagcgtgggaagagtggccttgtggcactcaacctggatgtagcccaagtcaaggagtttgtgaaggagcggttgggagtcgaggtcgagatgggcggctgcaaagctccaattaccactttcatagttgagccgtttgtcccccacgatcaagagtactacctttcagttgtgtccgaaaggttgggtagcaccattagcttctcggaatgtggaggcattgagatcgaggagaactgggacaaggttaagacagtctttattccgactgagaagccaatgacacctgatgcttgtgctcccttgattgcgacccttccactggaggcacgcggaaagattggtgatttcattaaaggagtgtttgctgtcttccaagacttagatttctcatttattgagatgaacccattcaccatggtgaatggggagccatatcctctggacatgagaggagaattggatgacactgcatctttcaagaacttcaagaagtggggaaatgtagaattccctctaccattcggcagagttctcagttctacagaaagttttatccatgagctggacgataagaccagcgcgtctttgaagttcacagttttgaacccaaagggacgcatctggactatggttgctggaggtggtgccagtgtcatatacgctgacacggttggagatttgggatatgcttcagagttgggaaattatgcagaatacagtggtgcccccaacgaggaggaggttctgcagtatgctagagtagtacttgattgtgcgactgcggaccctgatggccgcaagagagcccttctcattggaggtggtatagccaacttcactgatgtcgctgccacttttagtggcatcattcaggcattaagagagaaggaatccaagttaaaggcatccaggatgcacctctatgttcgacgaggcggtccaaattaccaaactggactggcgaaaatgcgcaagcttggtgcagaaatcggtgttccaattgaggtgtatggaccggaagagacaatgactgggatctgcaggcaagcaattgaatgcattatggcggcatcataaatcaggatacagttgagaagtagtttgagatctacaaacaagaaactggctgccgcataaatgagagcacagtggcactaggttcacatcacatggtcgattagtttttgcagaagttacttgaacaaacagacacatatattgttgtcgtaaaggaacctgttctgttgtaatgtgacaaacaaaagatttattacgatgcaaaccggtatgtccgtagcctgttacaagcacggaattgcaatgaataaaactaaaaaaaaaaaaaagaaaaaaaaaagaaactactagacgttgtatacacctagccttctgtaga

SEQ ID NO: 2978 - DNA, 1713 bp, Tragopogon dubius
tcgggggatacaaaatgtgaccctatgtaatcgatggcaatgggtccctggtctctcctcgatctcctcgcccacccaccgcgtataattcatcagcatcttcttcctacttgccaacaaccacactcctaaagtccgattctacaatcaaaccaatcttatcttctaagcaaaaccatcaacttccagttttgtttataactcaagatcaccttattcagaagatcgaattgcaagtgttgaacgttttgcagagagtcgttccgagtcttgaagaatggcgagaaagaagatcagagagtacgattcaaagaggcttttgaaggaacatttgaaaagactcgcagcgatcgacctccagatctgctctgctcaggtgaatgcatctacagatttcaccgaattaacagacagagaaccatggctctcatcaacaaagctggttgtgaaacccgatatgctatttgggaaacgtgggaagagcggtttggttgctttaaacctagacgtagctcaagttgcagattttgtcaaatcccgtattggtgttgaggttgaaatgggtggatgtaaagcaccaattacaacatttatagtggaaccatttgttccacatgaccaagaatattacctttctattgtctctgaaaggctaggaagcaccattagcttttcagaatgtggtggtattgatattgaagagaattgggataaggttaaaaccgcttttcttccaaccgaaaaacgtcttaccctcgagacttgtgctccattaattgccacacttccgttagaggttcgagcgaaaattggaaatttcataataggagtttttactgtgtttcaagatcttgatttcagtttccttgagatgaatccatttacattggtaaatggagagccgttcccgttggatatgaggggagagttggatgatactgcagcatttaagaatttccaaaagtggggtaacatagagttccctttgccatttggaagggtgcttagctctacagagagcttcattcacaccctagatgaaaaaacgagcgcttcgttaaaattcacagtgttgaatccgaaaggacgaatatggacaatggtggctggagggggtgcaagtgtaatatacgcagacacagttggagatttaggttatgcatcagaacttggtaactatgctgagtacagtggagctcctaatgaggaagaagtgttgcaatatgctagagttgtgatcgattgtgctactgctgatcccgatggccgtaaaagagcacttttaattggaggaggtattgctaattttacagatgttgctgctactttcaatggaattatccgagccctaagagaaaaggaatcgaagctgaaagcagcaagaatgcatatatatgttcgaagaggcggtcctaattaccaaactggtttggcaaaaatgcgcgctttgggagaggaactgggaattccccttgaggtttatggaccggaggctacaatgaccggaatttgcaaacaagctattgattgcataatgtcgtaatgagttttttttttacttcttgaaaacaatatttcattgcccttgttactttttcttgccagcatttgagattaatttttatatgcaaatgtatcagactatcaattatcaacctgttataattatttctttgagtaaattgttgattaagtaccaaaaaaaaaaaaaaa

SEQ ID NO: 2979 - DNA, 1332 bp, Vaccinium corymbosum
gaggcttactcggagaattcttgagaagcgatagtagagggtgaaaatggctcggaagaagataagagagtacgattcgaaaaggattcttaaggagcacttgaagagactcgccgggattgatctccagatctgctctgctcaggtgaacgagtccacagaattcacggagttgacaaaccaagaaccatggctttcatcaacaaaattggttgtcaagcctgatatgttgttcggtaagcgggggaagagtgggctggttgccttgaatttagatctggctcaagttgctgagtttgtgaaaacacgccttggtgtggaggttgagatgggtggctgcaaggcaccaattaccacattcattgtcaaccatttgttccccatgccgaagaatactaccttaacattgtatctgacaggcttggcagtaacattagcttttcggaatgtggaggtattgaaattgaagagaattgggataaggtaaaaactgtttccttccaactgagaaacctatgacgctggaggcatgtgctcctctgattgcgacacttcctctggaggttcgaggaaaaattggagacttcataatgggcgtatttgctgttttccaagatctggatttcagtttcattgagatgaatccgtttaccctggtgaatggggagccatacccattggatatgaggggagagttggatgacactgctgcctttaagaactttaaaaaagtggggtaatataaagtttcctctccccttcggaagagttctgagtcctacagaaagcttcgttcactctttggacgaaaagaccagtgcctctctgaaatttactgtgttgaacccaaaaggacgcatttggacaatggtagctggaggcggtgctagtgttatttatgctgatacagttggagatttgggttatgcatctgaacttggtaattatgcagagtatagtggagctccaaatgaagaggaggttctgcaatatgccagagttgttattgattgtgccacggcagatcctgatggtcgtaagagagcccttctaattggaggaggtattgctaacttcaccgatgttgctgctactttcaatgggattattcgggccctcagagagaaggaatccaagttgaaagcttcaagaatgcacatctatgttagaagaggtggtcccaactatcagaccgggttggcaaagatgcgtgccttgggagaggaactaggtgttccccttgaggtttacgggcctgaggctacaatgactggcatttgcaagcaagcaattgattgcatcatgtcttcagcatagccttatcatttttct

SEQ ID NO: 2980 - DNA, 1570 bp, Pteridium aquilinum
tccaaacggataacatctcggatcatttcatctcccaacgaaccaacccgcccttgtctccgcctcttcctctctttcttttctgtcagtcagtagctctgtctgtttggtgtttgatcttcgaggatcaaaaaatggcccgcaagaagatcagggagtacgattccaagaggcttctgaaagagcacctcaaacgcctcgccaacatccatctccagatctgctctgctcaggtgacagaatctactgatttcactgagttgaccaacaaagaccctggctttcatccaccagattggttgtgaagcccgatatgttgtttgggaagcgtggaaagagtggcttggttgcattaaatttggatcttgctcaagttgctgaattcgtcaaagcacgccttggcgttgaggttgaaatgagtgggtgtaaagctcctataaccacattcattgttgaacctttcgtcccccacgaacaggagtattacctttcaatagtctctgagaggcttggttcaatcattagcttttcagaatgtggaggtattgaaattgaagagaattgggataaggttaagaccattttccttccaactgagaaacctatgacccaggagacatgtgcgccattgatagctacactccctttggaagttcgcgggaagattggtgacttcatcatgggtgtcttctctgtctttcaggatcttgacttcagctttctggagatgaatccatttacactggtgaacggggaaccatacccactggatatgaggggagagctggatgacactgctgcatttaagaacttcaagaagtggggtgacatagagttccctctgccttttggaagagtcatgagccccacagaaggatttattcattccttggatgaaaagacgagcgcatctctgaaattcactgtcttgaatccaaaagggcgtatctggacaatggttgccggaggtggtgctagtgtcatatatgctgatactgttggagatttaggttatgcatcggaactcggcaactatgcagagtatagtggagctccaaatgaggaggaggtcttgcaatatgcaagagttgttgttgattgtgccactgcaaaccctgatggtcgtaagagagcccttctcattggaggtggcattgctaacttcactgatgttgctgctactttcaatggaattattcgagcattgagagagaaggaagccaagttaaaagcagcaagaatgcatgtctatgttcgaagaggtggtccaaactatcagactggtttggcaaggatgcgtacacttggagaggaactgggagtacctcttgaggtttatgggcctgaggccacaatgactggcatatgcaaggaggcaatagattgcattatgtcggaagcatagacacggtattcatttttgtgccgatacaatttggtaatcttccttgaaggaggcataagctggacggtgctgttgtagacttttccattattgaaaaattttgaaagtagtgtgcaataagcatgaaacttttggtctttcagcaatccttttatgtgtttgttg

SEQ ID NO: 2981 - DNA, 1629 bp, Chelidonium majus
cgtcatcaacatcatctattttttccttacaaattatagttcattttacttattgtcgtcttcttcttcttctcgttgttgtggagattttagagagagagagatctgttgaagaattaatggcgagaaagaagatcagagagtatgattcaaagagacttctcaaagaacacttgaagagactcgctgggatccaattagagatctgctctgttcaggtgaatgcatcgacagactttgctgagttgacagacaaagaaccatggctttcatctacaaaattggttgtgaaacccgacatgttgttcggaaagcgtgggaagagcggtttggtagctctgaacttggatctggctcaggttgcacagtttgtgaaagagcgtctcggcgtggaggttgagatgggagggtgcaaggcaccaattacgacatttgttgtggaaccttttgttcctcacgatgacgaatattacctttctatcgtttctgagaggcttggtagcaccataagcttttcagaatgtggaggtatcgaaattgaagagaattgggataaggttaagagtatatttctacctacagagaagccaatgacatctgattcatgtgctccactgattgccactcttcccttggaagttcgagggaaaataggcgacttcataaagggtgtatttgctgtatttcaagatctggacttcagtttcttagagatgaacccatttacgttggtgaagggggagccatacccattggatatgaggggagaattggatgacactgctaccttcaagaattttaaaaagtggggtaacatagagtttcctctgccttttggtagagttatgagtcctacagagagctttgttcattcattggatgaaaagacaagtgcatccttgaagttcactgttttgaaccctaaaggaagaatttggactatggtggctggaggtggtgcaagtgtgatatacgctgatactgttggagatttgggttatgcatcggagcttgggaactatgcagaatatagtggagctccaaatgaggaggaggtgctgcagtatgccagagtagttattgattgtgctactgcggatcctgatggtcgtaagagggctcttctcattggagggggcatagctaacttcactgatgtagctgctacttttaatggaatcattcgggccctccgagaaaaggagtccaagctgaaggcagcaagaatgcacatctatgttcgaagagggggtccaaactatcagactggtctggccaaactgcgtgccttgggtgaggaactcggggttcctcttgaggtttttgggcctgaggcaacaatgacaggaatttgcaagcaagcaattgattgcgtcatggctgcggcataagatctctccgcgtctttttctttttcctgtcttttcttgatggttttaaaatttcttcaacatgtgtttgaagtgattgggcttgagaatttttgtttattcaaagagaaagaaagcaggactaaatcgattgattgttgcaactctgtggacatcaaaatttactcccacagtgggatggtaaccttaaattagtcatcaatcataatcccttgttaatgttttggtttttattaac

SEQ ID NO: 2982 - DNA, 1617 bp, Euphorbia peplus
tcaatatccatccatctagttggccgtttgggtttgaatttggtgaactctaaattcgtctctttgaagctaatcaaaacccccaccttctttttctctctttcaatttctggtcttcttcagtcatttctggtcatcaaaactcagcaattcttgtgttgttaagccttgatattgaaacccaaatggcccgaaagaagatcagagagtatgactccaaaagacttctcaaacaccacttgaaacgtctctcaggaatcgatctgcagatctgctctgcccaggtgacggagagtacggacttttcggagttgacgaacaaggaggcatggctgtcgtcttcaagattagtagtgaagcctgatatgttgtttgggaaaagggggaagagtggtttagttgctttgaatttagatcttgctcaagttgctgaatttgttaaaggacgccttggtgctgaggttgagatgggcggttgtaaggcaccaatttctacattcatcgttgagccatttgttccacatgatcaagaattttacctttcaataatttctgaaagacttgggagcaccattagcttttcagaatgcggaggcattgaaattgaagagaactgggataaggttaagactatattccttcctactgaaaaacctttgactttggaggcatgtgctccattgattgctacacttcctttggagattcgaggtaaaattggtgacttcataactggtgtcttcaccgtcttccaagatcttgacttcagttttctagagatgaacccgttcaccttggtcaatggagagccatatccactggacatgagaggagagcttgatgatactgccgcctttaagaacttcaacaagtggggaaacatagaatttcctcttccgtttggcagagttcttagctcaacagaaagcttcattcattcactggatgagaagacaagtgcatctttgaagttcaccgttctgaaccccaaaggacgtatttggacaatggttgctggtggtggcgccagtgttatatatgctgatactgtaggagatttgggttatgcatcggagcttggcaactatgcagagtacagcggagctcctaatgaagaggaagtcctgcaatatgcaagagttgtgattgattgtgctactgctgatcctgatggtcgtaagagagcccttctgattggtggtggcattgctaacttcacagacgttgcagcaactttcaatggtattataagggccctcagagaaaaggaatccaagctgaaagcatcaagaatgcacatctttgttcgaagaggtggcccaaactaccagactggtttggccaagatgcgagctctcggagaagagctaggtgttcctcttgaggtttatgggcctgaggctacaatgacaggcatctgcaaagaggcaattgattgcattatgtctacagcataatcatttttattttttttctcacttgtgaaaccccattgcctcttgttatcaaatgtgcattgaggaaataattggggtcagtcagtttgtgttgaacaagaatattttgatgtgaaactatattatatcaggtgcaagatattttttctttattaatgga

SEQ ID NO: 2983 - DNA, 1563 bp, Vitis vinifera
ctctctgcggttggtgagcctaatcctctgtttctgtgagatctttctccactataaatcacagagctcctctgtttcttcctctcttgtaggggctccgatttctgaattaaacatggccaggaagaagatcagagagtacgactccaagaggcttctcaaggagcacctcaagaggctcgttggcatcgatctccagatctgctcagctcaggttactgaggcaacggactttgctgagctaacaaacaaagaaccatggctttcatccactagattggttgtgaaacctgacatgttgtttggaaagcgtgggaagagtgggttggttgcattgaatttagatctggctcaagttgctgaatttgtgaaagcacggcttggtgttgaggttgagatgggtggttgcaaggcaccaataaccacttttattgtcgaaccgtttgttccccatgaccaagagtattacctttcgattgtatctgataggcttggctgcactattagcttttcagaatgtggtggtattgaaattgaagagaactgggataaggtgaagactattaatcttccaactgaaaagcctatgacacctgagacatgtgctccattgattgccactcttcccctggaggttcgagggaaaattggtgacttcataaagggtgtgtttgctgtatttcaagatcttgacttcagtttcctagagatgaacccatttaccctggtgaatggggaaccatacccactggatatgaggggagaattggatgatactgctgcttttaaaaacttcaagacgtggggcaatattgagtttccgctgccttttggaagagtactaagccccacagagggctacattcacttgttggatgaaaagacaagtgcatctttgaagttcactgttttgaaccccaaaggacgcatctggactatggtagctggaggtggtgcaagtgttatatatgccgatactgttggagatttgggttatgcgtcagagcttggtaactatgcagagtatagtggagctccgaatgaggaagaggtgttgcaatatgccagggttgttcttgattgtgctactgctgaccctgatggccgtaagagagcccttctcattggagggggtattgctaacttcactgatgttgctgccactttcaatgggattatccgggctctgaaggagaaggaatccaaattaaaagcctccagaatgcacatctatgttcgaagaggtggtcctaactatcagactggcttggcaaggatgcgtgccttgggagaggaactgggaatccctcttgaggtatatgggcctgaggcaacaatgaccgggatttgcaagcaggcaattgattgcatcatgtctactgcctaatatcccaccattctcgattctccttcctggacatttactcgggcaataatttagtgtgaggctcccatcaaggcataagctagattggattgttgtgaactatgaggttgttgaattcttgttaaagtaaaactgaaacaattttctgcaataatcaccccatatttgtagctcaa

SEQ ID NO: 2984 - DNA, 1876 bp, Tropaeolum majus
ggggacggtttctatcaacaattgtccgttctacatatatagctaaataaaaaaatgtgaccaagcaattgttgtactcaaaatagagttggaagggcaaacgtggtagattgaaaaagacatattcatttcataaattgtaacgtccaacagcaccaacctaccacattgatcccatccataattctcttgaattagctgagcctaatagtcttcttcttcaaaacttcaagtttaatcctttctctacacttctcttttcagagatcctttctgttccatcattttgatccataactcaacgacacggattaaatttagctttagcttcaattggatggctcggaagaagattagagagtatgattccaagaggcttatcaaagagcacttgaagcgtctctccggaatcgaccttcagatctgctccgctcaggtcacccaatcgacagacttcaccgacctaacaaacaaagagccatggctatcgtctgaaaggctggttgtgaagccagatatgctgttcggtaaacgtgggaagagtggattggtagctttgaatttagatatggctcaagtttctgaattcgtgaaggcgcgtcttggtgctgaggttgagatgggtggttgcaaagcaccaataacaacctttattgttgaaccatttgttccgcatgaccaagaatactatctttccatcgtctctgaaaggcttggctgcactattagcttctctgaatgtggggggattgagattgaagagaactgggataaggttaagacgatattccttccaactgaaaaacatttgacactagaggcatgtgcaccattgatagctacactacctttggaggttcgaggaaaaattggtgacttcataatgggtgtcttttcagtttttcaagacctggacttcagttttatagagatgaacccatttacactagtaaatggggagccatatcctctagacatgaggggagagttggatgatacagccgccttcaagaattttaagaagtggggtgacatagaatttcctctacctttcgggagagtcctgagctctacggaaagcttcattcactctttggatgagaagacgagtgcatctttgaaattcactgttctgaaccaaagtggacgaatatggacaatggtagccggaggtggtgcaagtgttatatatgctgatacagttggcgacttgggatatgcatcagagcttggcaactatgcagaatatagtggagctccaaacgaggaagaagtcctgcagtacgcgagagtagttattgattgtgccacttcgaatcctgatgggcgtaagagagcccttctcattggaggaggtattgccaatttcacagatgttgctgctaccttcaacggaattattcgagcgctcaaggaaaaggagtccaaattaaaagcatcgagaatgcacatctatgtacgacgaggtggtccaaactaccagaccggattagcgagaatgcgagcattaggagaggaactaggtgttccctttgaggtttatggacctgaggccacaatgactggcatctgcaaaagtgcaattgattgcataatgtcagcagcttaaggaagtttgtttgttcttcatcttcttcaacttgaatgtgtgttttttgtgggcagtggggatagataataaaaggctaaaaactttcacgaataaattagcttctttctttttaatgtctgcatatggcttgaaacacactttaacagtctgaaggattgtgtttttgatttgtttcgtgtgtaacttttactagtaacataattcgatatttatgttggaacttagttatattggtagtcaaccaaatttggctactttcctttc

SEQ ID NO: 2985 - DNA, 1622 bp, Quercus alba
tggtcattcttcaataacaattgtgtttttcttgccaccaacccaaccaattaaccaataaccacctacttcccatccaactcaattcttccatctctatctcttttctctctctcaaaaacagatcaatatttttatatttctctcacagatattcttcttctgcaaaaaataaaaaaaaatggctaggaagaagatcagagagtacgactcgaaacgcctcgtgaaggagcacctcaaacgtctcgccaatatcgacctccagatccactctgctcaggtgacggaagcaacagactttgctgaattaacaaaccaagagccatggctttcgtccaccagattggtagtcaagcccgacatgttgtttgggaagcgtggaaagagtggcttggtggcgctgaacttggatttagctcaagttgctgagtttgtgaaagctcgccttggtgttgaggttgagatgggcggttgcaagtcaccgataactacattcattgttgagccctttgttccccatgaccaagaatattacctctctatagtctctgacaggcttggatgcaccattagcttttcggaatgtgggggtattgaaattgaagagaactgggataaagttaaaactatcttccttccaactgaaaagcctatcacactggaggcttgtgctccattgatagctacacttcctttggaggttcgggggaaaattggcgactacataattggcgtgtttaaagtgtttcaagatcttgacttcagtttcatagagatgaatccgtttacactggtgaatggggagccatatcccttggatatgaggggagaattggatgacactgctgcatttaagaactttaagaagtggggtaacatcgagtttccgctgccttttggaagagtcctgaaccctacagaaagtttcattcactccttggatgaaaagacgagttcatctttgaaattcactgtgttgaacccaaaaggacgcatctggacaatggtcgctggaggtggtgctagtgttatatatgctgacactgttggcgatttgggttatgcacaggagcttggtaactatgcagagtatagtggagctccaaatgaggacgaggtgttgcaatatgcaagagttgttattgattgtgctactgcagaccctgatggtcgtaagagagcccttcttattggagggggtattgctaacttcactgatgttgctgctacgttcaatgggataattcgagcccttaaagagaaggagtccaaattaaaagcagcaagaatgcacatctatgttcgaagaggtggtccaaactaccagactggtctggcaaagatgcgtgctttgggagaggaactcggagtgcccattgaggtgtatggacctgaggcgaccatgaccggaatctgcaaacaggcaattgactgcgtcatggctgcagcctaattccacaataatttttgctactgagagtcaacatgtgtcagtttgtttcaaaagaacttggttgaatgtgtgccaggaataatttatcatgaggcttcctttaaggcaaaagattgagaagagtggattgttgtaaaatgtaaactctaaaaacatttaaaaaaaataa

SEQ ID NO: 2986 - DNA, 1575 bp, Papaver somniferum
gaattcattgtcatcattatcatcatcactagtggagtttccttgaagtaatcacacatttcgaaattcgattgttggttttctcctttaaaatttactgagcgtcagagggagatctgttgaggaaaaaaaaatggctagaaaaaagattagagaatatgattctaaaagacttcttaaagaacacttgaaaagacttgctggaattcaattggatatttcttctgttcaggtaagtgaaaaaacagactttacggagttaacaaacaaagaaccatggctttcatctacaaaactagtagtaaagccggatatgttgttcggaaagcgtgggaagagtggtttggtagctctaaacttggatttagctcaggttgcacagtttgtaaaagaacgtcttggtgtagaggtggagatggaaggatgtaaggcgccgattaccacatttgttgtcgaaccttttgttccacatgacgatgagtattacctttctattgtttctgagaggcttggtagcaccatcagcttttcagaatgtgggggtattgaaattgaagagaactgggataaggtaaagaccatcttcttaccaacagagaagccgatgacatctgaggcatgtgctccactgatcgctacccttcccttagaagttcgttcaaaaataggagatttcataaagggtgttttttctgtatttcaagatctggacttcagtttcgtagagatgaatccatttacgctggtgaaaggggagccatacccgttggatatgagaggagaattggatgacactgcagccttcaagaattttaagaagtggggtaatgtagagtttccattgcctttcggcagagttatgagtcctacagagagttacattcatacacttgatgagaagacaagtgcatcgttgaagttcacggttttgaaccctaaaggaagaatctggacgatggtggctggaggtggtgcaagtgtgatatatgctgataccgttggagatttgggttatgcgtcagaacttgggaactatgcagaatatagtggagccccaaatgaggaggaagtgttgcagtacgcgagagttgttattgattgtgctactgcagaacctgatggtcgtaagagagctctactgattggaggaggcatagctaacttcactgatgtagctgctacatttaatgggattattcgagcccttcgtgaaaaggaatcaaagctaaaagcgtcaagaatgcacatctatgttcgaagaggaggtccaaattatcagactggtctagccaaaatgcgttctctaggagaagaactcggcgttcctcttgaggttttcggtcctgaggcaacaatgactggaatttgcaagcaagcaattgattgcatcatgtctgcctcataagctcttggattattatctgtcttattttctatgagttgtcctagcatatggtcgaaagtgatggagttcgaagcttttgatctctacatcttattctaaaacccaaaactaccaaacctgtggactcgtataaataaaattttaattcataattcaattgaaatgacatt

SEQ ID NO: 2987 - DNA, 1700 bp, Tripterygium wilfordii
tcttctaagcaaaagtgcaaaacaaacattcttccttccttttttaaaaaaattccttttgtaatttagttccttctctagttgtctttgtttatatcgccggcttcagggacgatcctatattgaagatttgaaatccttctgttcttcgatacccactagagttgcagagactgaattgtattatcaacaagtgatcaatcaaatggctcgaaagaagatcagagagtacgattccaagaggcttctcaaacaacacctcaagcgcctcgcaggcatcgacctgcagatctgctctgctcaggttacagcatctaccgacttcaccgacttaacaaacaaagaaccatggctttcatctactagattggttgtcaagcctgatatgctgtttgggaagcgtgggaaaagtggcttggttgctttgaacttcgatctagctcaagttgctgaattcgtcaaggcacgccttggagttgaggttgagatgggtggctgcaaggctcctataactacattcattgttgaaccatttgttcctcacgagcaagaatattatctctcaatcgtctctgaaaggcttggatgtaccatcagcttctcagaatgtgggggtattgaaattgaagaaaactgggataaggttaagactatatatcttccaactgaaaagcctatgacacttgaggcttgtgctccattgatagctacacttcctttggaggttagaggaaagattggagacttcataatgggtgtctatgctgtatttcaagatctggacttcagctttgtagagatgaatccgtttactctggtaaatggggagccatatccactggacatgagaggagaattggatgatactgccgcctttaagaactttaagaattggggtagcatagagtttccacttccttttggaagagttttgagccctactgaaggctttattcattcgttggatgagaagacaagtgcatccttgaaattcacagtgttgaatccaaaggggcgtatctggacaatggtagctggaggtggtgcaagtgttatatatgctgatacagttggagatttgggttatgcatcagagcttgggaattatgctgagtatagtggagctccaaatgaggaggaggtgttgcagtatgctagagttgttattgattgtgccaccgctaaccctgatggtcgtaaaagagccctcctcattggagggggtattgctaacttcacagatgttgctgctacatttagtgggattattcgagcattgagagagaaggaatctaagttaaaagctgctaggatgcacatttatgttcgtagaggtggtccaaactatcaaactggtttggcaaagatgcgtgctcttggagaagagctgggagttcgccttgaggtttatgggccagaggcgaccatgactggaatctgcaagcaggccatcgactgtatcatgtctgaagcataagatcatatgcatctcttttgtttgtcagttgtgttgcaaggtgtgaaaatacaatcgcaaaacacttccttggaaggcataagctggattggattggattgcttgaattttcctttcaattttgaaacattatcgcaataagcatgtataatcatatgatggttcctggcaaactctttgcattttggttcctttgttaacaaatatagatgaactcttaact

SEQ ID NO: 2988 - DNA, 1632 bp, Panax ginseng
aaccagcaaccagctcagtgctcatcagtcatcacaaagtttcttgctaaagtcgcccaactaccactcctcgtcattccattttcccctaaatttctctctctgtcagttggggtttggtttttgcctttttgggtgagctcaatcgtcccttcaaagcaatcagcctcttcttcccaatccacccctcctcctgtatttgtataaactagtattacatccaacttaaatcgatcaattttggtgaattagataaagaaatggctcgaaagaagatcagagagtacgattcgaagaggctcctcaaggaacacttgaagagactcgctgccattgatcttcagatctactctgctcaggtgactgaatccacagactttaccgagttaacaaacaaagaaccatggctctcatctgcaaagttagttgtaaaacctgatatgttgttcgggaagcgtggaaagagtggcttggtagcgttgaatttagatttagctcaagttgctcaatttgtgaaagggcaccttggtgtggaggttgagatgggaggttgcaaggcaccaataaccacattcatcattgagccgttcattccgcatgaccaagaatattacctttccatagtctctgaacggctaggttgtaccattagcttttcagaatgtgggggcattgaaattgaagagaactgggacaaggtcaagacagtatttctcccaactgaaaagcctatgacgctggaggcttgtgctccattgattgctacacttcctttggaggttcgaccgaagattggtgatttcattatgggagtttttctgtatttaaagatctagatttcagtttccttgagatgaatcccttactttggtgaatgggaagccataccctttagatatgcggggagagttggatgacacagctgcctttaagaactttaagaattggggcaagatagaatttcctctgccttttggaagagttatgagcccaacagaaagcttcatccactcgttagatgacaaaactagtgcttctttaaaattcaccgtcttaaacccaaaaggtcgcatctggacaatggtggctggaggtggtgcaagcgtaatatatgcagacaccgttggagatttaggttatgcatctgagcttggaaattatgcagagtatagtggagctcctaatgaggaagaggtgttgcaatatgccagagttgtgattgattgtgccactgcggatcccgacggtcataagagagctctcctcattggaggaggtattgccaatttcactgatgttgctgccactttcaatgggattattcgagccctcagggaaaaggaatccaagcttaaagcttcaaggatgcatatctatgttcgacgaggtggtcccaattatcagactggtttggcaaagatgcgtgcccttggagaggaattgggagttccccttgaggtctatggacccgaagctacaatgactggcatttgcaagcaagcaattgaatgcgtcatggctgccgcatagtctttaccattcataatcttttcctccaagaaaatgagaaatggtctgtgtttgtttttggaaaacatgttttttctttttatttttgtattgaaagtgaca

SEQ ID NO: 2989 - DNA, 1475 bp, Cyclamen graecum
cctaaagtttggtgggcacaatttcatatttttcttcatcaccactgtctgtctctctctcttggtgttgggagttaggtaagtgagaaattgcagaggtgtggaggatttggaattgcagggaaagggagatggcgaggaagaagataagagagtacgattccaagaggctactcgtacagcacctgaaaagactcgctaacatccatctccatctctcctctgctcaggtgaatgagtcgaccgattttctggagctgacaaatcaagagccatggctgtcgtcagcgaagttagttgtgaagcccgatatgttgttcggaaagcgtggaaagagtggtttagtggctttgaatttggatctagctcaagttgctgaatttgcgaaaggacgccttggtgtagaggttgagatgggaggttgtaaggcgcctattacaacattcattgtcgaaccatttgttcctcatgacaaagaatattacctctccatcgtatctgaaaggcttggttctaccattagtttttcagaatgcggaggtattgaaattgaagagaactgggacaaggtcaaaactatttttctcccaacggagaaacctatgacgttggagacatgcgctcctttgattgctacacttccactggaggttcgagggacaattggtgacttcatacagggtgtattttctgtattccaagatctggattttagtttcctagagatgaatccgtttacgctagtgaatggggagccctacccacttgatatgaggggagagctagacgacactgcggcttttaagaacttcaagaagtggggtaacattgagtttcctctgccctttggaagagttttaagttctacagagagcttcattcactctttggatgagaagactagtgcatctctaaagttcaccgtcttgaatcctaatggacgtatttggacaatggttgccggtggtggtgctagtgtgatatatgctgatacagttggagatctgggttatgcatctgagcttggtaactatgcggagtatagtggtgctccaaatgaggaagaggtgctgcaatatgccaaagtagttatagattgtgccactgcaaacccagatggtcgtaagagagcgcttctaattggaggaggaatagctaacttcactgatgttgctgctactttcaacgggattattcgtgcactaagagagaaggagtccaagctaaaagcatcacgtatgcacatttttgtgcggagaggtggtcccaactatcagactggtttggctaagatgcgtgccttgggagaagaacttggagttcccctagaggtttatggacccgaggctacgatgactgggatttgcaaggaagcaattgactgcatcatgtcataaccatcttatcagtatttatctccttcaactagctgaaaaagcaggagaagaaaacgttactggagtgatatttacttg

SEQ ID NO: 2990 - DNA, 1512 bp, Centaurea maculosa
aaattcaccttccttccttcttcaatcccaaatttcaaacacttttgattaatggcgagaaagaagatcagagagtacgattcgaagaggcttttgaaacaacatttgaaaaggctcgcagggatcgaccttcagatctgctctgctcaggttaatgcgtccacggacttcattgagttaacagacaaagaaccatggctttcatcaacaaagctggttgtaaaacccgatatgctgtttgggaagcgtgggaagagcggcctggttgctttgaacttagatgtagcacaagttgcagactttgtgaaagctcgtcttggtgttgaggtcgagatgggtggatgtaaagcaccgataacaacatttattgtcgaaccatttgtcccccatgatcaagaatattacctttctatcgtctctgaaaggcttggcagcacaattagcttctcggaatgtggtggtattgaaatcgaagataattgggacaaggttaagaccgtttttcttccaaccgaaaaacctatgactcttgagacttgcgctccattaattgccacacttccattggaggttcgtgcaaaaattggcgatttcataatgggcgtgtttgccgtatttcaagatttagatttcagttttctggaaatgaatccatttacgctggtgaatggagaaccattccctttggatatgaggggagagttggatgacactgcagcatttaagaactttcaaaagtggggtaacttggagttccctttgccatttggaagggtcttaagctctacagaacgcttcattcacacgttagatgaaaaaactagcgcatcactgaagttcactgtattgaatcctaaaggacgcatctggactatggtggccggaggtggtgcaagtgtgatatatgcagacacagttggagatttaggttatgcatcagaactaggcaactatgcagagtacagtggagctcctaatgaggaagaggtgttgcaatatgctagagttgtgattgattgtgctactgcagatcccgatggtcgtaaaagagcccttctgattggaggaggtattgctaacttcacagatgttgctgcaactttcaatggaataatccgagcccttagggaaaaggagtcaaaactgaaagcagcaagaatgcacatctatgttcgaagaggtggtcctaattaccagaccggtttggcaaagatgcgtgcgttgggggaggaactaggaattccccttgaggtttatggaccagaggctacaatgaccggcatttgcaaggaagcaattgaatgcataatgtcacaggcataagttcagaaaacccaaatcaattgatatatttttattccggtaaaagaggacttgattgctgtgaaattttcttgcaagtgtcaataacatttctttctttgtcggcttgggttgatgtagtctggtccgtgagcggttagccgctgagtggttggattgaacaggtccttttatatccaatctacttgt

SEQ ID NO: 2991 - DNA, 1786 bp, Cichorium intybus
aaacattaacgaaagagtaaaaccctttcattggtggatgatctaattgatcttccaaaactaacaagttcggaaaacatccacataaaatatgtttattcttggatctattatatggaatcaatgtctttgggacctagtctctcctcgatctcctcgcccaactacccttcgcatcaaatcatcagtaccctcctcctacttgccaacaaccacactcctaaagttcggtgctacaatcaaactaatcttatcttctaagcaaaactatcaacttccagggtcgttccgattcttgaagaatggcgagaaagaagattagagagtatgattcaaagaggctgttgaaggaacatttgaaaagactctcagggatcaaccttcagatctgctctgctcaggtgaatgcatctacagacttcacggagttaacagacaaagaaccatggctttcatctacaaagctggttgtgaaaccggatatgttgtttgggaagcgtggcaagagtggcttggttgctttgaacttagatgtggctcaagttgcagattttgtgaaatcccgtcttggtgttgaggtggagatgggtggatgtaaagcaccaataacaacatttattgtggaaccatttgttccacatgatgaagaatattacctttctattgtctctgaaaggctggggagcaccattagcttttcagaatgtggtgggattgatattgaggaaaactgggagaaggttaagactgcttttcttccaaccgaaaaacctctaaccctagagacttgcgcaccattaattgctacgcttccattggaggttcgagcaaaaattggaaatttcataatgggtgtgtttgctgtatttcaagatctagatttcagtttcctagagatgaatccatttacattggtgaatggagagccattccctttggatatgaggggtgaattggatgacactgcagcatttaagaacttcaaaaagtggggtaatgtagagttccctttgccattcggaagggtcctaagccctacagagggtttcattcacacgctagatgaaaaaactagcgcttcattaaagttcaccgtgctgaatcccaaaggaagaatatggacaatggtggctggaggtggtgcaagtgtaatatatgcagacacggttggagatttaggttatgcatcagaacttggtaactatgcggagtacagtggagctcctaatgaagaagaggtgttgcaatatgctagagttgtgatcgattgtgccactgcagatcctgatggtcgtaaacgagcccttctgattggaggaggcattgctaactttacagatgttgctgctactttcaatggaattatccgagcccttagagaaaaggagtccaagctgaaagcggcaagaatgcacatctttgttcgaagaggtggtcctaattaccagactggtttggccaagatgcgtgcattgggacaggaactgggagttcccctcgaggtttatggaccggaggctacaatgaccggcatttgcaaggaagcaattgattgcataatgtcataggcataagttatctctttcaatacacatagccccaaggcaaagccagagtgtgttttttatttcttgatgacaagactatattgttcatgtgaattttacttgtaagcattaaatgggaatttcttgatgaatcttattcaaactatgagactatgggtgtttaggattgaacatatttttatcatttctaatcaataaacaattgggctaatcatgaa

SEQ ID NO: 2992 - DNA, 1668 bp, Cichorium intybus
gatcaatgtctttgggacctaatctctcctcgatctcctcgcccaactacccttcgcatcaaatatcatcagtaccctcctcctacttgccaacaaccacactcctaaagttcggtgctacaatcaaactaatcttatcttctaagcaaaactatcaacttccagggtcgttccgattcttaacgaatggcgagaaagaagattagagagtatgattcaaagaggctgttgaaggaacatttgaaaagactctcagggatcaaccttcagatctgctctgctcaggtgaatgcatctacagacttcacggagttaacagacaaagaaccatggctttcatctacaaagctggttgtgaaaccggatatgttgttcgggaagcgtggcaagagtggcttggttgctttgaacttagatgtggctcaagttgcagattttgtgaaatcccgtcttggtgttgaggtggagatgggtggatgtaaagcaccaataacaacatttattgtggaaccatttgttccacatgatgaagaatattacctttctattgtctctgaaaggctggggagcaccattagcttttcagaatgtggtgggattgatattgaggaaaactgggagaaggttaagactgcttttcttccaaccgaaaaacctcttaccctagagacttgcgcaccattaattgctacgcttccattggaggttcgagcaaaaattggaaatttcataatgggtgtgtttgctgtatttcaagatctagatttcagtttcctagagatgaatccatttacattggtgaatggagagccattccctttggatatgaggggtgaattggatgacactgcagcatttaagaacttcaaaaagtggggtaatgtagagttccctttgccattcggaagggtcctaagccctacagagggtttcattcacacgctagatgaaaaaactagcgcttcattaaagttcaccgtgctgaatcccaaaggaagaatatggacaatggtggctggaggtggtgcaagtgtaatatatgcagacacggttggagatttaggttatgcatcagaacttggtaactatgcggagtacagtggagctcctaatgaagaagaggtgttgcaatatgctagagttgtgatcgattgtgccactgcagatcctgatggtcgtaaacgagcccttctgattggaggaggcattgctaactttacagatgttgctgctactttcaatggaattatccgagcccttagagaaaaggagtccaagctgaaagcggcaagaatgcacatctttgttcgaagaggtggtcctaattaccagactggtttggccaagatgcgtgcattgggacaggaactgggagttcccctcgaggtttatggaccggaggctacaatgaccggcatttgcaaggaagcaattgattgcataatgtcataggcataagttatctctttcaatacacatagccccaaggcaaagccagagtgtgttttttatttcttgatgacaagactatattgttcatgtgaattttacttgtaagcattaaatgggaatttcttgatgaatcttattcaaactatgagactatgggtgtttaggattgaacatatttttatcatttctaatcaataaacaattgggctaatcatg

SEQ ID NO: 2993 - DNA, 1529 bp, Eschscholzia californica
atcccagtaaaatctaaagaagaagaagaaatggcgaggaagaagatcagagagtacgattccaaaaggcttctcaaagaacacttaaagagactcgcaggaatccaattagagatccgatctgttcaggtaaatgcatcgacagactttacagagttaacaaacaaagaaccatggttgtcttccacaaaattggttgtgaagcccgatatgttattcggaaagcgcgggaagagtggtttggtagctctaaacatggatctggctcaggttgcacagtttgttaaagagcgtctcggagttgaggttgagatgggaggatgtaaggcacccattacaacatttgttgttgaaccttttattccccatgatgatgaatattatctttctattgtatctgaaaggcttggttgtacaataagtttttcagaatgtgggggtatcgaaattgaagagaattgggacaaggttaagactatatttctaccaacggagaagcctatgacttctgagacgtgtgctccgctgattgctaccctccccttggaagttcgggcaaagataggggacttcgtaaagggtgtattttctatattccaggatctggacttcagtttcttagagatgaacccatttacgctggtaaatggggagccatacccgttggatatgaggggagagttagacgacactgccgcctttaagaatttcaagaagtggggtaacatagagtttccattgccttttggtagagttatgagtcctacagaaagctatattcactcgctggatgaaaagacaagtgcatcgttgaagttcactgtattgaactctaaaggaagaatctggacaatggtcgctggaggtggtgcaagtgtgatatatgctgatacagtcggagacttgggttacgcatctgagcttgggaactatgcagaatatagtggagctccaaatgaggaggaggtgctgcaatatgctagagttgttattgattgcgctactgctgatcctgatggtcgtaaaagagctctgctcgtaggaggaggtatagctaacttcactgatgttgctgctacttttaacggcattattcgtgcccttcgagaaaaggaatccaagttaaaagcatcaagaatgcacatttatgttagaagaggaggtccaaactatcagacgggtctagctaaaatgcgcgctcttggagaagaacttggggttcctcttgaggtttttggacctgaggcaacaatgactggaatttgcaaacaagcaattgattgcatcatgtctgcagcttaatatctcttgcggattattttctttccgtttttcctcgacgattctagaatttcttcgtgttttgagaagcctctggttaattgagcttaaaagagtcataaagaggtaatcaggattgattgttgtaaaatctgcaaagagacatatgttactcaatttcagactgagactgttaattcattcttaatttctctcttgctctttatctgtaataactgaaaactctg

SEQ ID NO: 2994 - DNA, 1537 bp, Lotus japonicus
ttactacgtcattcctaggtagcatcgttcaaggttgtctgaaactctgaatggcgaggaagaagatcagagagtaccactccaagaagctcctcaaagagcacctcaaacgcctcgcctccatcgaccttgacatcaaatccgctcaggtcactgaatcaacggattttgctgagttgactaaccagcatccatggctttcatccaccaaactggttgtcaagccagacatgctgttcgggaagcgtgggaaaagtggcttagtagctctcaatttagatgttgcccaagttgctgaatttgtcaaagaacgccttggcgttgaggttgagatgggtggttgcaaagcacctataactacgtttattgttgagccctttgttcctcatgagctagagttttatctgtctgttgtttctgaaaggttgggctctaccatcagcttctcagaatgtgggggcatagaaattgaagagaactgggataaggttaaaactatattccttccaacagagaaacctatgactttggaggcatgtgcgcccttgattgctactcttcccttggaggttcgggggaaaattggcgatttcataatgggtgtgtttgctgtctttcaagatctggacttcagttttctagagatgaatccatttacactagtggatgagaagccatatccactggacatgagaggggaattggatgacacggctgcattcaaaaacttcaacaagtggggtgatatagagtttccattgccttttggaagagttctaagccctacagaaagcttcattcattccttggatgacaagacaagtgcatctttgaaatttactgtattgaatccaaaaggacgcatctggacaatggtggctggaggtggtgcaagtgtaatttatgctgatactgttggagatttaggctatgcatccgagcttggcaactatgctgagtatagtggagctccaaatgaggaggaagtgttgcagtatgcaagagtcgtaatagattgtgctactgcagatcctgatggccgtaaaagagcccttcttattggaggtggcatcgcaaacttcactgatgttgctgccacattcagtgggattattcgagccctgaaagagaaggaatcaaagcttaaagcagcaagaatgcacatctttgtcagaagaggtggtccaaattatcagactggtttggcaaagatgcgtgcattgggggaggaattgggagtaccaattgaggtttatgggccggaggccacaatgactggcatctgcaagcaagctattgattgcatcatgtctgaagcatagcagagtcctttctgtcaccagcatcatcattttgcattccagagacttatttgatgttttgatggatgtaagtttgtatctaggagacgaggagtaagattgaaggcaagaggatatgaatgttgcaagcctgaacttcttttcttcttttcttcctgttgttattttgaccaaaacgttacttgaaaatatatgtgaaaaatgtattttttttt

SEQ ID NO: 2995 - DNA, 1447 bp, Nicotiana benthamiana
agccttcactcaccagttgttgttagtttggtgaaacccacccaattcattcttgtaccttaagctaatttgtttcagatccttttatttttccactcagttatatacccaccaagtgtttgtatctttttctagacctctgttgtaatccttcgtttgaattgtaaagaaaaagaacatggcaaggaagaagatcagagagtatgagtctaagaggcttctcaaggagcatttgaaacgcctttctggcatcgatcttcagatctgctctgctcaagtgacggaatctacagattttactgagttaacaaacaaagaaccatggctctcatcgacaaagttggtagtaaaaccagacatgctgtttgggaagcgtggaaagagtggcttggtcgcattaaatctggatctggcaggagttgccgagtttgtcaaagcacgacttggggtggaggttgaaatgggtggctgcaaggcacctataacaacatttattgttgaaccattcgttccccatgaccaagaatattacctttccatagtctctgaaaggttggggtgcactattagcttttcagaatgtggaggcattgagattgaagagaactgggacaaggtcaagacaatattccttccaacagaaaaacctatgaccctagaggcgtgtgctccactgattgctactctgcccttggaggtacggggaacgattggaaatttcctaatgggtgtttttaatgtatttcaagatctcgattttagtttcatagagatgaacccttttgcgcttgtaaatggggatccatacccattggatatgaggggagagttggacgacacagcagccttcaaaaattttaagaagtggggaagcattgagtttcctctgccctttggaagagttttgagccctactgaaagcttcattcactctttggatgagaaaactagtgcctccttaaaattcacagttttgaacccaaaaggccgtatctggacaatggtggctggaggtggtgcaagcgttatatatgctgatacagtaggggatttaggttatgcctcagagcttggtaactatgccgagtatagtggggctccaaatgaagaggaggttctgcaatatgctcgagtggttctagattgtgctactgcaaatcctgatggccgtaagagagctctcattgttggaggtggtattgctaacttcactgacgttgctgctactttcaatgggattattcgggctctcagggagaaggaagccaagctaaaggcagctggaatgcacatctatgtacgaagaggtggtccaaattatcagactggactagccaaaatgcgtgccctgggagaggaacttggagttccccttgaggtttatggaccagaggctacaatgactggcatttgcaaaagggcaattgattgcattatgtctgaagca

SEQ ID NO: 2996 - DNA, 1693 bp, Eutrema halophilum
aacgtcaacgtctcttctggttccgagtcggcgtctgcgtttctctctcttgttgttgcctgttggtgagatcaccttccacccaacttcttcgatcttatcttctcgaaagttctcacctttttctgcgagaaagacttctgtgatttacgtgtcgagaacgatcactgtttataactctatggccaggaagaagatcagagagtatgactccaagagacttctcaaacaacacttgaagcgtctcgctaacattgacctgcagattcgctctgctcaggtgacacaatctacggatttcactgagttgaccaaccaggagtcatggctatcgtccacaaagctagttgtgaagcctgacatgctatttggaaaacgtgggaaaagtggcttggtagctctaaagctggatcttgctgaagttgcggagtttgtcaaagtccgcctcggtactgaggtcgagatgggtggctgtaaagctcctatcactacgttcattgtggagccctttgtgcctcatgatcaagaatactatctttctatagtatccgataggcttggctgcactataagcttctctgaatgtggcggcattgaaatagaagagaattgggacaaagtgaagactatatttcttccttcggaaaagccaatgacgcttgaagtatgtgctccattgatagcaactcttcctcttgaggttcgagctaaaatcggcaacttcataatgggtgcgttttctgtatttcaagatttggatttcagctttatggagatgaatccttttacactagttgatggagagccataccctctggatatgaggggggaattggacgataccgctgccttcaagaatttcaacaagtggggagacattgaattccctctaccatttggaagggtcctaagtccaacggaaagcttcattcatggtttagatgaaaagacaagtgcttctttgaagttcactgttctgaatcctaaaggccgcatttggacaatggttgctggaggcggtgctagcgtcatatatgctgatacggttggggatttaggttatgcatcagagctcggtaactacgctgagtatagtggagcacctaatgaggaagaagtgttacaatacgcaagagttgtcattgattgtgctactgctgatcctgatgggcgtaaacgggcacttctaattggaggaggcattgcaaatttcaccgatgtggcagctaccttcaatggtatcatccgagccctaagagaaaaggaaacaaggttgaaagcatcaagaatgcacatttacgtaaggagaggtggaccaaattaccagaccggtttggctagaatgcgagctctgggagatgaactcggtgttcctctagaggtatatggaccagaagcaacgatgacgggaatatgcaaacgagccattgactgcatcatgttggcggatacataacctacgttgagtctagaaatgcaaaacaaaaattcgaagctgaagattgagaggagtgtatgagtgtgttgattcatgttcttcatctctctatccctttgagaaaatgaaaagctctttgaaacctttttcttgtgtggttgtgaatttaaaaaaattcttttgcaagtgtaactgtaatcaaacggccaaaatccttgttgcaaatgtacaataagatttcaaaagtgaacaatg

SEQ ID NO: 2997 - DNA, 1464 bp, Echinochloa colona
ttccgcacgcacgctcgccgctcgagctctccacccacccatccacccacctgctcctgcccttcgcttccagaaggttcggccggcggcgatggcgcggaagaagatccgggagtacgactccaagcgcctcctccggagcacctcaagcgcctcgccggaatcgacctccagatcctctccgcgcaggttacacaatcaacagatttcactgagcttgcaaaccaggagccatggctctcatctatgaagttggtcgtaaaacctgacatgctgtttggtaaacgtgggaagagcggacttgtggccctcaacctagaccttgctcaagttcgccaatttgtcaaggagcggttgggagttgaggtcgagatgggtggctgcaaagctccaattacaaccttcatagttgagccgtttgtgccccatgatcaagagtactacctttcgattgtatctgaaaggcttggctgcaccattagtttctctgagtgtggaggtattgagattgaggagaactgggacaaggttaagacaatctttcttcccacagagaagcaaatgacacccgatgcatgtgctccgttgattgccaccctcccattggaggtgcgcacaaaaataggcgatttcattagaggtgtattttctgttttccaagacttggatttctcatttcttgagatgaatccattcacattggtaaatggtgaaccgtatcctctggatatgagaggagaactagatgacacagctgctttcaagaacttcaataaatggggtaacattgagtttcctctacctttcggaagagtcctcaatccctcagaaagctttatccatgaactggatgagaagacaagttcttctctgaaattcacagtattgaacccaaaaggacgcatttggacaatggttgcaggtggcggtgctagtgtcatatatgctgatacggttggagatttgggatatgcttcggagctaggaaattatgcagagtacagtggagctcccaatgaggaggaggttctgcagtatgctagagtggttctggattgtgctactgctgatcctgatgggcgcaagagagcccttctcatcggaggaggtattgctaacttcaccgatgtcgccgccacatttagtggcatcattcgggctttaagagagaaggaatccaaattgaaggccgcaaggatgaacatttacgtccggagaggcggtccaaactaccaaaccggactcgcgaaaatgcgcactcttggtgcagaacttggtgttccaattgaggtgtacggaccagaggcgaccatgaccgggatttgcaaagaagccattgattgcatcatggctgcataaaccgccgtatagttgcgctgcttgcggttgcatccgttttgtaccagacgttcaatgtagtaagtgattgttcgagtgaaacagagaagcatcattgttgtgagt

SEQ ID NO: 2998 - DNA, 1715 bp, Daucus carota
agtcgcccacctaccactggaggtcatcaaatcttccattcttccttagttctcagtagtagtttggttggacttgcgtaacttcacttcaaagccatcaaccaccctctatcttctttttatatattatatcaagacaagaagatcagcagtgatattttacatacaaagaaatggcaagaaagaagatcagagagtatgattccaagaggcttattaaagaacacttgaagagacttgctggtattgatcttcagatctgctctgctcaggtaactgaatctacagacttcactgatttaacaaacaaagagccatggctttcatcctcaaagttggttgtgaaacctgatatgttgtttgggaaacgtggaaagagtggtttggtagctctaaacttagatttggctcaagttgctgaatttgtgaaaggccgccttggtgtagaggttgagatgggtggttgcaaggcaccaataacaacatttattgtcgagccgtttattcctcatgaccaagaatattatcttaacatagtgtctgaaaggcttggttgtagtatcagcttttcagaatgcggtggtattgatatcgaagagaactgggacaaggtcaagacaatattccttccaaccgaaaaacccatgactcaggaggtttgtgctccgttgattgcgacacttcctttggaggttcgagcaaagattggtgatttcattttggctgtgttttccgtgtttacagatctggatttcaccttccttgagatgaatccatttacgctcgttaatggggaaccataccccttggatatgcgtggagagttggatgatacagctacttttaagaactttaagaagtggggtaagatcgaatttcctctgcctttcggaagagtcctgagtccaactgagagctttattctctccttggatgagaaaactagtgcttctctgaaattcactgtattaaacccaaaaggacggatatggacgatggttgctggaggtggtgcaagtgtaatatatgccgataccgttggagatttaggttatgcaacagaacttggcaactatgctgagtacagtggagctcctaatgaggaagaggtgctgcaatatgccagagttgtgattgattgtgccactgcggaccccgatggtcgtaaaagagctcttcttatcggaggaggtattgctaattttactgatgttgctgccaccttcaatggaattatccgagcccttagggaaaaggaatctaaactcaaagcatcaaggatgcatatctatgtccgaagaggtggtccgaattaccagactggtctggcaaagatgcgtgctcttggagaggaacttgaaattccccttgaggtttatggccccgaagctacaatgactggaatttgtaaacaagcaatcgaatgtgttatggcagcagcatagtcatccatttgatcctggcctcagttaaaaagaaatattaatcatgcccttctgcctcagtacaagccagcacatcgttttcaaaaaacaatgtattttgcatttcgctcttgactttatggaatttcaccattaaagctgtcgttttgtaattcatggaacaatttttccaccttataaaggcatgcccgttgttaaaacaaataattactgttcataaaattcttgaatttcattctttctgctgtttcatctagttatatattcctt

SEQ ID NO: 2999 - DNA, 1733 bp, Allium cepa
tagttacgggggacatatagagtggtggatccaaaagaagggggaagtccatttgaattgaaaatctcaactaccatcttcttctttccacaacaactcaccaaacaaaccaaccaccaacaaaatctattgctttccttgttctttcattccctctcctcatctcccttttctttgcttaatttaattaagtttaataatggcgaggaagaagatcagagagtacgattcgaagaggctattgaaggagcatcttaagagattggccggaatcgaacttcagatccagtctgctcaggttacagaatcaacagatttcactgaattggtgaacaaagaaccatggatgtcatccacaaagttggttgtaaagcccgacatgttatttggaaagcgtggaaagagtggtctggttgcgttgaatttagatatggctcaggtttcagaatttgttaaggaacgtcttggggtagaggttgagatgagtggatgtaaagcgccaataactacatttattgttgaaccttttgtccctcatgatgatgaatattacctcaatattgtctctgagagactgggttgctctgtaagcttctctgaatgtggtgggattgacattgaagagaactgggacaaggttaaaacggtatttctgcctaccgagaagcccttgacttcggaggcatgtgctccattgattgcaactcttccccttgaggttaaagagaaaattggtgccttcatacaaggtgtcttttcggtattccaagatctggatatgagtttccttgagatgaatccattcacaatggtgaatggagagccttatccattggatatgcgaggggaattggatgacactgctgctttcaagaacttcaaaaaatggggaaacatagagtttccacttccatttggaagagttttaagcccaacagaaagcttcattcatggactggatgaaaagacaagtgcctctctcaagtttactgtcttaaatcccaaaggaagaatctggactatggtggctggtggtggtgctagtgtgatatacgctgatacagttggagatttgggatatgcaaacgaacttggaaactatgctgagtatagtggagctccaaatgaggaagaggttctgcagtatgctagagttgtgcttgattgtgcaactgctgatcctgatggacggaagagagcccttctgatcggaggaggtatagctaatttcactgatgttgcagcaacatttaatggaatcatccgagctatcagggaaaaggaatccaagataaaggctgcaaggatgcatatctatgttagaagaggaggtccaaattatctgactggtttagccaaaatgcgtgctttgggtgctgaaataggcgttcctttagaggtttatggcccggaagcaacaatgactggaatttgcaaggaagcaatcaattgtatcatggcagaggcatagatagttaagcttccatttttgctgcttttctcttagtctctctttttcatatttccccaagggtaataatgcttcgaagtaattattacatttataaatgagttgaaatgttgcttcatttatcaaatgcaataaattggaaggggtatttattcggaaatatcatgctgtaagatttgttgctgtgcatgggcattatgtggtatatttataatatttaaatttgaaatatgtcatttcaatactttaaaaaacaacacac

SEQ ID NO: 3000 - DNA, 1475 bp, Arnica chamissonis
tcaattcactcgtatcctatttctacttgccaactactactactccaatccaccaatcttatcttctaagcaaagacatcagcttccagatttgtttacatattcagattcggggcaagatccaaattccaacggattgagaaaatggcgagaaagaagatcagagagtatgattcgaagaggcttttgaaggaaaatttgaaacgactcgcaggaatcgaccttctcatttgctctgctcaggtggatgcatccacagactttacagagttgacagacaaagaaccatggctttcatcaacaaagctggttgtcaaacctgatatgctatttggaaagcgtgggaagagtggcttggttgctttgaacttagatgtagctcaagttgccgattttgtgaaagctcgtcttggtgttgaggttgagatgggtggatgcaaagcaccaataacaacatttattgtggaaccatttgttccacatgatcaagaatattacctttctattgtctctgaaaggctgggcagcaccattagcttttcagaatgtggtggcattgatatcgaagagaactgggagaaggttaagaccgtctttcttccaaccgagaaacctatcatgctagagacttgtgctccattaattgctactcttccattagaggttcgagcaaaaattggcaatttcataatgggtgtgtttgctgtatttcaagatttggatttcacttttctggagatgaatccatttacgttggtaaacggagagcccttccctctggatatgaggggagagttggatgacactgcagcatttaagaacttcaaaaagtggggtaacatagagtttccattgccattcggaagggtcctaagttctacggagagcttcattcacaccttagatgaaaagactagtgcttcattaaagttcacagtgttaaatcctaagggtcgtatatggacgatggtggctggaggtggtgccagtgtaatatatgcagatacggttggagatttaggttatgcatcagaacttggtaactatgcagagtatagtggagctcctaacgaggaagaggtgttgcaatatgctagaattgtaattgattgtgctactgcagatcctgatggtcgtaaaagagcccttctgattggtggaggcatcgctaacttcacggatgtggctgccactttcagtggaatcatccgagctcttagggaaaaggagtcaaagctgaaagcagcaagaatgcacatatacgttcgaagaggcggtcctaattaccagactggtttggcgaagatgcgtgcattgggagaggaacttggagtaccccttgaggtttatggacccgaggctacgatgacgggcatttgcaaggaggcaattgaatgcataatgtcgaaggcataaatacgcgaccttgatgacgagcgtgtttttttcttctaatgtcaatgtatgatcgccca

SEQ ID NO: 3001 - DNA, 1672 bp, Phaseolus vulgaris
cgaaaaacaacttaatcctttattatatcattttggtgtcattaggaagcaattacgcagtccttcttccctgttctcacagtgcatgataagagagcagagcacagagcacgtactctgtatttctcatctgagtttgagatcgtaaaatggcgaggaagaagatcagggagtaccattccaagaggcttctcaaggaacacctcaaacggcttgcctctatcgacctcgacatcctttctgctcaggtcacacagtcaacggacttcgctgaatttacagaccaccatccctggttgtcgtcaacaaaggtggtcgtcaaaccggacatgctcttcgggaagcgcggaaagagtggcttagtggctctcaatttggacatagctgaagtcgctgagtttgtcaaagcacgcctcggcgttgaggttgagatgggaggttgcaaggcgcctataactactttcattgttgaaccgtttgttcctcacgaccaagagtattatttgtccattgtttctgaaaggcttggctccaccatcagcttttctgaatgcgggggcattgatattgaagagaattgggataaggttaaaactatattccttccaacggagaaacagttgactccgaaggcatgtgcaccgttgattgctacacttcctttggagattcgggagacaataggtgatttcatactgggtgtgtttgctgtcttccaagatctggacttcagtttccttgagatgaatccatttacaatagtgaatgaaaagccatatccgctggatatgagaggggaattggatgacactgctgcattcaagaacttcaacaagtggggcaatatagaatttccattgccttttggaagagttctgagccctacagaaagcttcatccattcattggatgataagacaagtgcgtcgttgaaatttactgtattgaacccaaaaggacgcatctggacaatggtagctggaggtggtgcaagcgtaatttatgctgatactgttggagatttaggctatgcatcagagcttggtaactatgctgagtatagtggagcaccaaatgaggaagaagtgttgcagtatgcgagagtcgtaattgattgtgctactgcagaccctgatggccgtaagagagcccttcttattggaggtggcatagcaaatttcactgacgttgctgccacattcagtgggattattcgagcgctgaaagagaaggaatcaaagcttaaagcagcgcgagtccacatctatgtcagaagaggtggtccaaactatcagactggtttggcaaagatgcgttcattgggggaggaattgggagtaccaattcaggtttatggaccggaggccacaatgacgggtatatgcaaacaagctattgattgcatcatgtccgaagcttaacgcagagcaatttttcggtaaccaatttggtggcgttttgatggataagtccgtagtgtataccaagcaaggaggaataagatcgatgtgaagaggatagatgttgcaaggaagctgttcttatcttttgttattgttaaatttgtactaaaaaatggtcaataaaattcctcgccaaaatgtaattttagttgacgtcattctctttaaagagattattataaccaatgttttgttgttttttccctttt

SEQ ID NO: 3002 - DNA, 1616 bp, Capsicum annuum
tctttctcactaaccagttgttgcctgtttggtgaatgagaatacgcactattcttctcccttaagctaaattcccactaatttacaatctaagatctctgtttctggctacttaattatataaccacaccaactgtttgtataattgtctaagagaaagtgttctttttgtttgaattgtaaaaaaggaaaaaaacagagtagtaatatggcgaggaagaagatcagagagtatgattccaagagacttctcaaagagcatttgaaacgcctttgtggcatcgatctgaagatctgttctgctcaagtgacagaatctacagattttactgagttaacaaacaaagatccatggctttcatcaacaaagctggttgtaaaaccagacatgctgtttgggaagcgtggaaagagtggcttggtagctttgaatctggatctagcaggagttgctgagtttgtaaaaacacgacttggtgtggaggttgaaatgggtggctgcaaggcccctataacaacatttattgttgaaccatttgttccccatgaccaagagtattacctttccatagtctctgaaaggttggggtgtacaattagcttttcagaatgtggaggcattgagattgaagagaactgggacaaggtcaagacaatattccttctaacagagaaacctatgaacctagaagcatgtgctccacttattgctactctgcccttggaggtacggggaacaattggcaatttcctaatgggtgtttttaatgtgtttcaagatctcgattttagtttcatagagatgaacccttttacgcttgtaaatggggagccttacccattggatatgaggggagagttggatgacacagcagccttcaaaaattttaagaagtggggaagcattgaatttcctctgcccttcggtagagttttgagttctaccgaaagcttcattcattctttggatgagaaaactagtgcctccttaaaatttacagttttgaacccaaaaggtcgtatctggacaatggtggctggaggtggtgccagcgtcatatatgctgatacagtaggggatttaggctatgcctctgagcttggtaactatgccgagtatagtggagctccaaatgaagaggaggttctgcaatatgctcgagtagttctagattgtgctactgctactcccgatggccgtaagagagctctcattgttggaggtggcattgctaacttcaccgatgttgctgctactttcaatgggattattcgggctcttagggagaaggaatccaagctaaaagcggctagaatgcatatctatgtacgaagaggtggtcccaattatcagactggtctagcaaaaatgcgtgccctaggagaggaacttggagttccccttgaggtttacggaccagaggctacaatgacgggcatttgcgaacgggcaattgattgcattatgtctgaagcttaagtgccaaatcagagtgttgcaattcttgaaatttcctgcaattaaaaagaaactttgttggatttttcacctttttcttctgatattgttatatttaaattgggaccttggagaataattgagatccttttgtttt

SEQ ID NO: 3003 - DNA, 1616 bp, Allium cepa
ctcaccaaacaaaccaaccaccaacaaaatctattgctttccttgttctttcattccctctcctcatctcccttttctttgcttaatttaattaagtttaataatggcgaggaagaagatcagagagtacgattcgaagaggctattgaaggagcatcttaagagattggccggaatcgaacttcagatccagtctgctcaggttacagaatcaacagatttcactgaattggtgaacaaagaaccatggatgtcatccacaaagttggttgtaaagcccgacatgttatttggaaagcgtggaaagagtggtctggttgcgttgaatttagatatggctcaggtttcagaatttgttaaggaacgtcttggggtagaggttgagatgagtggatgtaaagcgccaataactacatttattgttgaaccttttgtccctcatgatgatgaatattacctcaatattgtctctgagagactgggttgctctgtaagcttctctgaatgtggtgggattgacattgaagagaactgggacaaggttaaaacggtatttctgcctaccgagaagcccttgacttcggaggcatgtgctccattgattgcaactcttccccttgaggttaaagagaaaattggtgccttcatacaaggtgtcttttcggtattccaagatctggatatgagtttccttgagatgaatccattcacaatggtgaatggagagccttatccattggatatgcgaggggaattggatgacactgctgctttcaagaacttcaaaaaatgggaaacatagagtttccacttccatttggaagagttttaagcccaacagaaagcttcattcatggactggatgaaaagacaagtgcctctctcaagtttactgtcttaaatcccaaaggaagaatctggactatggtggctggcggtggtgctagtgtgatatacgctgatacagttggagatttgggatatgcaaacgaacttggaaactatgctgagtatagtggagctccaaatgaggaagaggttctgcagtatgctagagttgtgcttgattgtgcaactgctgatcctgatggacggaagagagcccttctgatcggaggaggtatagctaatttcactgatgttgcagcaacatttaatggaatcatccgagctatcagggaaaaggaatccaagataaaggctgcaaggatgcatatctatgttagaagaggaggtccaaattatctgactggtttagccaaaatgcgtgctttgggtgctgaaataggcgttcctttagaggtttatggcccggaagcaacaatgactggaatttgcaaggaagcaatcaattgtatcatggcagaggcatagatagttaagcttccatttttgctgcttttctcttagtctctctttttcatatttccccaagggtaataatgcttcgaagtaattattacatttataaatgagttgaaatgttgcttcatttatcaaatgcaataaattggaaggggtatttattcggaaatatcatgctgtaagatttgttgctgtgcatgggcattatgtggtatatttataatatttaaatttgaaatatgtcatttcat

SEQ ID NO: 3004 - DNA, 1653 bp, Brassica napus
gttgctgttggtgagatcacctgtaactcaaacttcttcgatcttatcttctctaaactcgtcacctaacacttgtgtgattcagacgatcactgtcttttaaaacttactgtctccgtttcagattctgagtttctctctttctttagttttttgagcttgtaaatggcgaggaagaagatcagagagtacgactccaagagacttctcaaggaacacttgaaacgtctcgctaacatcaacctccaaatccgctctgctcaggtgacagaagctacggatttcactgagttgaccaaccaggagccatggctatcttccacgaagctagttgtgaagcctgatatgctgtttggaaaacgcgggaaaagcgggttggtagctctcaagctggatcttgctgaagttgcagagtttgtcaaagcccgtctcggctctgaggttgagatgggtggatgtaaagctcctatcactacattcattgtggagccctttgtgcctcatgatcaagagtactatctttctatagtgtctgataggcttggctgcactataagcttctctgaatgtggcggtattgaaattgaagagaactgggacaaggtgaagactgtgttccttcctgcggaaaagtcaatgacgcttgaagtttgtgctcctttgatagcaacacttcctcttgaggttagaggtaaaataggcagcttcataatgggcgtgtttgctgtattcaagatttggatttcagtttcatggagatgaatccgtttacgctagtcgatggagagccatatcctttggacatgaggggagagttagatgacacagctgccttcaaaaatttcaacaagtggggagacattgagttccctctgccatttggaagggtcctgagtcctactgagagcttcatccatggtttagatgagaagacaagtgcgtctttgaagttcattgttttgaatcctaaaggtcgcatttggactatggtagctggaggcggtgctagcgtcatatatgctgatacggttggagatttaggttacgcatcagagcttgggaactacgcagagtatagtggagcacctaatgaggaagaagtgttacaatacgctagagttgtcattgattgtgctaccgctgatcctgatgggcgcaaacgagctcttctcattggaggtggcattgccaatttcacagacgtggcagctactttcagcggtatcatccgcgctctaagagaaaaggaaacaagactgaaagcatcaagaatgcacatttacgtaagaagaggtggtcctaattaccagactggtctggctagaatgcgtgctctgggtgatgaactcggtgttcctctagaggtatatggaccagaagcaacgatgacaggaatatgcaagcgagccattgattgcatcatgttacctgatgcataatcaaccaaacctattatgatctcttcttcagttgaaaacagcagaacacaaacgtggagttggagactgggaggagtgtatgtgttgaaccctgttcttcatctctctttctacatttgaaaatgaaaagctctttgaatcttttgcttgtgtgagtgtaatattgaaaaccaaatcattgtgtgttgtgttgcaaaaagtgtaagtaatcata

SEQ ID NO: 3005 - DNA, 1690 bp, Centaurea maculosa
gaggcgaatactgtgttggaaaaaagattaggccatacgatccctcgatctggtcgcccaacaaccctccccatagcatagcatacataattttctactcttcctacttaccaacaaccacacttgttattaattaattatcttttaagcaaaaactatcaagacttgttaattactctgtttcttctttcaattccaaatttctaacacttgaagaagaaaagaagaatggcgagaaagaagatcagagagtacgattcaaagaggcttttgaaacaacatttgaaaaggctgtcagggatcgaccttcagatctgctctgctcaggtgaatgcgtccacggacttcattgagttaacagacaaagaaccatggctttcgtcaacaaagctggttgtaaaacccgacatgttgtttggaaagcgtgggaagagtggtttggttgctttaaacttagatgtagctcaagttgcagattttgtgaaagctcgtcttggtgttgaggttgagatgggtggatgtaaagcaccgataacaacatttattgtcgaaccatttgtcccccatgatcaagaatattacctttctattgtctctgaaaggcttggcagcacaattagcttttcagaatgtggtggtattgagatcgaagataactgggacaaggttaagactgtttttcttccaaccgaaaaacctatgactcttgagacttgcgctccattgattgccacacttccattggaggttcgtgcaaaaattggcgatttcataatgggcgtgtttgccgtatttcaagatttagatttcagttttatggaaatgaatccatttacgctggtcaatggagaaccattccctttggatatgagaggagagttggatgacactgcagcatttaagaactttcaaaagtggggtaacttagagttccctttgccatttgggagggtcttaagctctacagagcgcttcattcacacgttagatgaaaaaactagcgcatcactgaagttcactgtattgaatcctaaaggacgcatctggactatggtggccggaggcggtgcaagtgtgatatatgcagacacagttggagatttaggttatgcatcagaacttggtaactatgcagagtacagtggagctcctaatgaggaagaggtgttgcaatatgctagagttgtgatcgattgtgctactgcagatcccgatggtcgtaaaagagcccttctgattggaggaggtattgctaatttcacagatgttgctgcaactttcaatggaataatccgagcccttagggagaaggagtcaaagctgaaagcagcaagaatgcacatctatgttcgaagaggtggtcctaattaccagaccggtttggctaagatgcgtgcattgggggaggaactgggaattccccttgaggtttatggaccagaggctacaatgaccggcatttgcaaggaagcaattgagtgcataatgtcacaggcataagtccagaaaaagcaaatcaattgatatatttttattccggtaaaagaggacttgattgctgtgaattttttttgcaagcgtcaatggtacgtttctttctttgtcggcttgggttgatgtagtgtggtgtggtctggtccgtgagcggttagccgctgagtggttggattgaacaggttcttttatatct

SEQ ID NO: 3006 - DNA, 1801 bp, Glycine max
gttgaaagtgttataatataggttgacccaccccttccttcgttcccagaacagagtgtgataatagtaagacagagcacctactcactcgtaaatggcgaggaagaagatcagagagtaccactccaagaggcttctcaaggagcatctcaaacgtctcgcctctatcgacctccaaatcctctcagctcaggtgacagaatctacggatttcactgagctgacagaccagcatccatggctttcgtcaaccagattggtcgtcaagccagacatgctgttcgggaagcgcggcaagagtggcttagttgctctcaatttagacatagctcaagtcgccgagttcgtcaaagcacgcctcggcgttgaggttgagatgggaggttgcaaggcgcctataaccacttttattgtcgaaccgtttgttcctcacgaccaagagttttatctgtctattgtttctgaaaggcttggctccactatcagcttctccgaatgtggcggcattgaaattgaagagaattgggataaggtcaaaactatattccttccgacggaaaaaccattgactccggaggcatgtgcgccattgattgctatacttcctttggagattagggggacaattggcgatttcataatgggtgtgtttgctgtcttcaaagatctggacttcagttttttagagatgaatccatttacactggtgaatgaaaagccatatccactggatatgagaggggaattggatgacactgccgcattcaagaacttcaacaagtggggtaatatagaatttccattgccttttggaagaattctgagccctacagaaagcttcattcattccttggatgataagacaagtgcatcattgaaatttactatattgaatccgaaaggacgcatatggacaatggtagcaggaggtggtgcaagtgtaatttatgctgatacggttggagatttaggctatgcatcagagcttggaaactatgctgagtatagtggagctccgaatgaggaggaggtgttgcagtatgcaagagttgtaattgattgtgctactgaagaccccgatggccgtaagagagcccttcttattggaggtggcatagcaaacttcactgatgttgctgccacattcaacgggattattcgagccctgaaagagaaggaatcaaagcttaaagcagcgcaaatgcacatatatgtcagaagaggtggtccaaactaccagactggtttggcaaagatgcgtgcattgggggaggagttgggagtaccaattcaggtttatggaccggaggccacgatgacgggtatctgcaaacaagctattgattgcatcatgtccgaagcataaagaagattaatttttgtctcatcatgtttcatttgtgaaactaatttggtggtgttttgatggatatattgatataagtccataatctgaaccaaagcaaagagtaataaggtgaagatgatagatgttacaagcctgaaactgttaaattcttatcttttcttcctattgtgattttattgttatattttgactaaacattataaaaatccccaatagtatccgtgaaaaatgtaatcttagttggcgatttttccttaaagtgttgagttccatatttgattctctcttgaaatcttttttgttgatatcaaggacaagtgcaaagatttctcaagctcattatcaagaacatattcttcccaaagctaagcttctcgggtagttaattcatgacataatattaataaagcctcttgcctgtgatttgaagtt

SEQ ID NO: 3007 - DNA, 1563 bp, Brassica oleracea
attctgagtttctctctttttctttaggctttgaggttgaaactcgatggcgaggaagaagatcagagagtacgactccaagagacttctcaaggaacacttgaaacgtctcgctaacatcaacctccaaatccgctctgctcaggtgacagaagctacggatttcactgagttgaccaaccaggagccatggctatcttcaacaaagctagttgtgaagcctgatatgctgtttggaaaacgcgggaaaagtggtttggtagctctgaagctggatcttgctgaagttgcagagtttgtcaaagcccgcctcggttctgaggttgagatgggtggatgtaaagctcctatcactacattcattgtggagccctttgtgcctcatgatcaagaatactatctttctgtagtgtctgataggcttggctgcactataagcttctctgaatgtggcggtattgaaattgaagagaactgggacaaggtgaagactgtgtttcttcctgcggaaaagtcaatgacgcttgaagtatgtgctcctttgatagcaacacttcctcttgaggttagaggtaaaataggcagcttcataatgggcgtgtttgctgtatttcaagatttggatttcagttttttggagatgaatccttttacgctagtcgatggagagccatatcctttggacatgaggggagagttagatgacacagctgccttcaaaaatttcaacaagtggggagacattgaatttcctctgccatttggacgagtcctgagtccaacagagagcttcatccatggtttagatgaaaagacaagtgcttctttgaagttcactgttttgaatcctaaaggtcgcatttggactatggtagctggaggcggtgctagcgtcatatatgctgatacggttggagatttaggttacgcatcagagcttgggaactacgcagagtatagtggagcacctaatgaggaagaagtgttacaatacgctagagttgtcattgattgtgctactgctgatcctgatgggcgcaaaagagctcttctcattggaggtggcattgccaatttcacagacgtggcagctactttcaacggtatcatccgcgctctaagagaaaaggaaacaagactgaaagcatcaagaatgcacatttacgtaagaagaggtggtcctaattaccagactggtctggctagaatgcgtgctctgggtgatgaactcggtgttcctctagaggtatatggaccagaagcaacgatgacaggaatatgcaagcgagccattgactgcatcatgttgcctgatgcataatcaaccaaacctatgatctcttcttcagttgaaaacagcagaacacaaacgtggagttggagactgggaagtgtgtgtgtgtgtgttgaaccctgttcttcatctctctttctacatttgaaaatgaaaagctctttgaatcttttgcttgtgtgggtgtaatattgaaaaccaaatcattgtgtgttgtgttgcaaaagtgtaagtaatcataacggtcaaaatcctttttttaagtgtac

SEQ ID NO: 3008 - DNA, 1718 bp, Elaeis guineensis
ccaacagcccccacctccctcgcttttaaatctccctctcggcttccatccatctcccgtcgaagccatcgctccttggaagctcgaatcgaggtttgagagctcttgaaatatcgttctccaaatcgatccaagaaggaggaggagatggcgagaaagaagatccgggaatacgactctaagcggctcctcaaggagcatctcaagcggatcgtcggcatcgacctccagatctgctctgcccaggtcacggaatctacggactttactgagttagtgaaaaacgagccgtggctttcatccacgaaactggttgtgaagcccgacatgctatttgggaagcgaggcaagagtggtttggtggctctggacttggatatggcacaggtggctcagtttgtgaaggaacgccttggagttgaggttgaaatgggtgggtgcaaggccccgatcaccacatttataattgagccatttgttccccatgaccaagagtactatctctcgtttgtctctgagaggcttggttgcaccatcagcttttcagaatgtggtggaattgaagttgaagagaactgggacaaagttaagactatctatcttcctgctgagaatcctatgacgtctgacgcatgtgctccacttattgcaacccttcccctggaggtacgagggaaaatagatgacttcataaaaggggtttttgctgttttccaagacttggacttcacttttcttgagatgaacccatttagtttggtaaatggggagccataccccttggatatgcggggagagttggatgacactgctgcattcaagaacttcaagaagtggggcaatatagaatttccacttccttttggcagagtcctgagccctacagaaagctttattcacaaacttgatgagaagactagtgcctccctgaagtttactgttttaaatcccaaaggacgcatatggaccatggtggctggtggtggcgctagtgtcatatatgctgatactgttggtgacttgggttatgcatctgagctcggaaactatgcagagtacagtggtgcccctaatgaggatgaggtcctgcagtatgctagagtgattcttgattctgcgactgctgatccggatggccgaaagagggcccttctcattggagggggtatagctaacttcactgatgttgctgctacttttggtggcattatccgtgccctgagggagaaggaatccaagctaaaggctgcaaggatgcacatttatgtccgaagaggtggccctaattatcaaagaggtctggccaaaatgcgggctctgggtgaggagttgggcatttcctttgaggtgtatgggccagaggcaacgatgactggaatttgcaagcaagctattgattgcgtcatgtctaccgcataattttgatttcattactccttttgtttttctccatatatttttggtcaagcaaaaattagaattcagtgattcctccacggtgaatgataaaaagaaaatatttttatagagaataaatgagtcaatcgagaccatcatttggttgccttctcaaatttctgtagtgcaacttgcaacttgtgctaagtgaacgtagttttgttctcataacaaaaaaaaaaaaaactaaacgtaagacgtaacgtaccgaaccggaacgtacgaaccaacgggaacggggtaaggtaagaggggggggg

SEQ ID NO: 3009 - DNA, 1764 bp, Euonymus alatus
ccaagtcgtcccaacctaacccaaccaatcaaacaaccattactctttctgcctcttccttttcctagccaattctgcgctaggtttgataagaatcccgcactagtcgtttggtgtgccagacttatcacatatcatcgtctcttccaagcaaaacaaacatccttaggcctttctctaaaaaataaagtttgttttgtaatttgttccctgtttgtctagttgtctttgtttatatcgcccgcttcaagggacgatcctatattgaaatcgttcttcgatagccacgagagatactgaattggattttctgcaagtgatcacatggctcgaaagaagatcagagagtatgattccaagaggcttctcaaacaacacctcaagcgattctcaggcatcgatctacagatctgctctgctcaggttacagaatctaccgacttcaccgacttaacaaacaaagaaccatggatttcatctactagattggttgtcaagcctgatatgctgtttgggaagcgtgggaaaagtggcttggttgctttgaacttagatctagctcaagttgctgaattcgtcaaggcacgccttggagttgaggttgagatgggtggctgcaaagctcctataactacatttattgtagaaccatttgttcctcatgagcaagaatattatctctcaatagtctctgaaaggcttggatgtaccgtcagcttctcagaatgtggggtattgaaattgaagaaaactgggataaggttaagactatatatcttccaactgaaaagcctatgacacttgaggcatgtgctccattgattgctacactacctttggaggttagaggaaagattggagacttcataatgggtgtctatgccgtatttcaagatctggacttcagctttctagagatgaatccatttactctggtgaatggggagccatatccactggacatgagaggagaattggatgatactgccgcctttaagaactttaagaattggggtagcatagagtttccacttcctttcggaagagttttgagctctactgaaggctttattcattcgttggatgagaagacaagtgcatccttgaaattcactgtgttgaatccaaaggggcgtatctggacaatggtagctggaggtggtgcaagtgttatatatgctgatacagttggagatttgggttatgcatcagagcttggtaattatgctgagtatagtggagctccaaacgaggaggaggttttgcaatatgctagagttgttattgattgtgccaccgctaaccctgatggtcgtaaaagagccctcctcattggagggggtattgctaacttcacagatgttgctgctacatttagtgggattattcgagcattgagagagaaggaatccaagttaaaagctgctagaatgcacatttatgttcgtcgaggtggaccaaactatcaaattggtttggcaaagatgcgtgctcttggagaagagctgggagttccccttgaggtttatgggccagaggcgactatgactggaatatgcaagcaggccattgagtgtatcatgtctgaagcatagatcatgcatcacttttgtttgtcacttgttgcaaggtgtgaaaatacattcacatgacacttccttgaaggcataggctggattggattgtttcagtgtttccaattggtgttttcatttcaattttcgaaacattatcgcaataagcttgtataatcaataatatgat

SEQ ID NO: 3010 - DNA, 1897 bp, Malus domestica
gcgcacttcccatacccaataaaacatcatttgccactccaatccaccacacaacaccagaccccgacccgaccccgacccgacccgaattgacttctccgtctccggggacgccagcgttatccgacaaaacccgacccgatggcccgcaagaagatcagagagtacgactccaagaggctgctcaaacagcacctgaaacgactcgccggaatcgacctccagatcaactcagctctggtgaccgagtcgacggacttctccgagttgtcgaacgagcatacatggctgtcgtctacgcgcctcgtggtgaagcccgacatgctgttcgggaagcgcgggaagagcggcctcgtcgccctgaacttggacatggctcaggtcgccgagttcgtcaagcagcgactcggtaaggaggttgagatgggaggatgcaaggcgccgattacgacgtttatagtggagccgttcatgccccatgatcaagaattttacctctcaattgtgtccgaaaggctcggatcaaccgtgagcttttcggagtgtggagggatcgaaattgaagagaattgggacaaggttaagactatatttcttccgaccgagaagcctatgacgaatgatgcttgtgctccactgattgccactcttccattggaggtcagaggcaaaattggagatttcataaagggcgtatttgctgtattccaggatttggattttagtttcctggaaatgaacccatttaccttggttgatggtgaaccttatccactagatatgaggggggagctagatgacactgctgccttcaagaacttcaataaatggggcaacgtggagtttccattgcctttcggcagagtcttaagtcctacagaaacatttattcattctctggatgaaaagacaagtgcatccttaaaattcactgtgttgaacccaaagggacgcatctggaccatggtagctggaggcggtgcgagtgttatttatgctgatactgttggagatttgggttatgcttcagaacttggaaattatgcagagtatagtggagctccaaatgagggagaggtgttgcagtatgcaagagttgtgatcgattgtgcaacagctgatccagatggtcgtaaaagagcacttataattggaggtggcatagctaatttcacagacgtagctgctacattcaatggaattattagagccctcaaggagaaggaatccaagctaaaagcagcaagaatgcatatttttgtgagaaggggtggtccaaactatcaaactggtttggcaaagatgcgcgcattgggagaagaacttggagttccgcttgaggtttatggccctgaggcaacaatgacgggaatttgcaagcaagcaattgagtgcatcatgggtgaagcttaaaagtttcttattttgcagacttttgaacgagttttcgaggctcgaagtgtgtgttgtggtttggccaagaaggcaaaaagtgtgaactgtgagtttgtcttggcaagatgagaccacaggacgacttcagttttccagtctcttcaacttttgtgacttactctgatatacgaaccctgtttaagtgtgttcttggttttgaaagtaaatggttgcatttcaagtttaaacaagtgaaaggtaaaataagcaaacgaaaaaaattatagaaatttctaaggaatgaggattttgttgtgaaacgttgtgaatgctctcggaatatgactaaagatgaaatgtaagaaagatcaaaacggtagtatagatatattatctgattttttttttttattgttctaaggcatgacttcaatatgcattaattggtactgtaaacttttgcacgttaagagctctatatattatcttaatgctcatgtaa

SEQ ID NO: 3011 - DNA, 1752 bp, Arabidopsis lyrata
ttgtgttgatgagatcatcttctgctcaacttcatcgatcttatcgtctcgaaagttgtcaccttttttctcagctacttacactttctgtgatttaactgttgaggacgatcactgtttgtaattcgatggcgaggaagaagatcagagaatatgactccaagagacttctcaaggaacatttgaagcgtcttgctaacattgacctgcagattcgctctgctcaggtgacagaatctacggatttcactgagttgaccaaccaggagtcatggctatcgtccacaaagctagttgtgaagcctgatatgctgtttggaaaacgcggtaaaagtggcttggtagctctgaagctggatcttgctgaagttgcagcttttgtcaaagcccgcctcggtactgaggttgagatggagggatgtaaagcccctatcactacattcattgtggagccttttgtgcctcatgatcaagaatactacctttctatagtatctgataggcttggctgcactataagcttctctgaatgtggtggcattgaaattgaagagaactgggacaaagtgaagactatatttcttcctgcggagaagtcaatgacgctagaagtatgtgctccattgatagcaactcttcctcttgaggttcgagctaaaattggtaacttcataatgggtgcgtttgctgtatttcaagatttggatttcagttttatggagatgaatccttttacactagtcgatggagagccataccctctggatatgaggggagagttagatgacactgctgcctttaagaattttaacaagtggggagacattgaatttcctctgccatttggaagggtcctcagttcgacggagagcttcatccatggtttagatgagaagacaagtgcttctttgaagttcaccgttttgaatcctaaaggccgcatttggacaatggtagctggaggtggtgctagcgtcatatatgctgatacagttggggatttaggttatgcatcagagctcgggaactacgcagagtatagtggagcacctaatgaggaagaggtgttacaatatgcaagagttgtcattgattgtgccactgctgatcctgacgggcggaaacgagctcttctaattggaggaggtattgccaatttcactgatgtggcagctactttcaacggcatcattcgagcgctaagagaaaaggaaacaaggttgaaagcatcaagaatgcacatttacgtaaggagaggaggaccaaattaccagactggtttggccagaatgcgagctctgggagaggaacttggtgtccctctagaggtatatggtccagaagcaacgatgacgggaatatgcaaacgagccattgactgcatcatgttgcctgatgcataaccaacccaaacctttgatctcttcttcagtttgaaagcagaataaaagctttgtagctggatgtgtgagtgagtgtgcggtgattcctgttcttcatctctctttccacgtaagaaaatgaaaagctctttacaaactcttttttcctgtgggtgtgagaatttgaaaactgtatcattgtgttgtaagtgtaattgtaaccaaacggtcaaaatccttatttgaaatgtacaataagacttcaaaagtttaatgtcgctatacacaccaatctattatactaatgtaagggtttcaagacaaatccaattcccatatacaaacatgtctatgtatataatatatatca

SEQ ID NO: 3012 - DNA, 1382 bp, Musa acuminata
atggctaggaagaagatccgggagtacgattccaagcgcctccttaaggagcacctcaagcggctcgccggcaccgatctccagatccgctccgcgcaggtgacagaatcgacggacttcaatgagttagtcaacaaagaaccatggatttcgtccacgaaattggtcgtgaagcccgacatgctgtttgggaagcgtgggaagagcggtctggtggctctcaacttggatctggctcaggccgcgcagtttgtgaaggaacgtctgggaacggaggttgagatgggagggtgcaaggctccgattaccacattcataattgagccattcattccccatgatcaagagtactacctctcgatcgtttccgagaggcttggttgcaccattagcttctccgagtgtggtggcattgaaatcgaggagaactgggacaaggttaagacggtttaccttcccacggagaagtcgatggcatccgaggcatgtgctccgttgatcgtaacccttcccttggaggttcgagggaaaataggggacttcataaagggagttctcactgtgttccaagacttggatttcagtttcatagaaatgaacccattcactttggtaaatggtgaaccatacccactagatatgcgaggagaactggatgacacagctgctttcaaaaacttcaagaagtggggtagcatagaatttccacttccctttggtagagtcctgagctccacagaaaaatttgttcatgaacttgatgaaaagactagtgcctccctgaagttcactgttttaaaccccaaaggacgcatatggacaatggtggctggtggtggtgctagtgtcatttatgctgatacagttggagatttaggttatgcatctgaacttggaaactacgcggaatacagtggtgctccaaatgaggaggaggtccttaagtatgctcgagtcgtccttgattgtgcaactgcagatcctgatggtcgtaagagagctcttctcattggagggggtatagcaaactttactgatgttgctgccacattcaatggtatcatcaaggccctgaaagagaaggagtcaaagctaaaggctgcaaggatgcacatttatgttagaagaggtggtccaaactatcaaactggcctggccaaaatgaggaaactgggtgaggaacttggcattcctctcgaggtttatgggccagaggccacaatgaccggaatttgcaagcaagctatcgattgtgtcatgtctgctgcatgactaactcacgtttttgttttaagcaatatcaagctcgaccataattgatttcttgtaggtgccgattgtgttggttcgaacatttgataagttaatgcgcatttgagaaa

SEQ ID NO: 3013 - DNA, 1660 bp, Catharanthus roseus
cacctgctcatccgtctcttgaaagcaagtccgatctgtccattcttttatctacttccggtttttctacttctataaatctttgatttggtggcttgcacaagaatttgattaatttcaagaatttccttgggagtggatagttcagttgattgagttgcagaaagaaagaagatcaggaggcggaaaatggcaaggaagaagatcagagagtatgattccaagaggcttcttaaggagcatttgaaaacacttgctgggattgatcttcagatctgctcggctcaagtgaatgaagatacagattttgttgagttgacaaataaggaaccatggctctcgtccactaggttggttgtcaaacctgatatgttatttggtaagcgtggaaagagtggattagtagctctgaatctggatattgcacaagttgctgactttgttaaagctcgtcttggtaaagaggttgagatgggtggttgcaaggcgcctattactacatttattgtagaaccatttttaccccatgaccaagaatattatctcaacattgtctccgaaagattgggttgtagtattagcttttcagaatgtggaggcattgaaattgaagagaattgggataaggttaagaccatttttcttccaaccgagaagcctttgacattggaggcatgcgctccactgattgctacgcttcccttggaggtacgggggaagattggtgattttattatggctgtttttgcagtatttcaagatttggatttcagtttccttgagatgaatccctttacactgattaatggggagccattcccattggacatgcgtggggagttggatgatactgctgcatttaagaactttaagaaatggggtaatatagagttccctctgccttttggaagagttttgagctcaaccgagagcttcattcactcgttggatgaaaaaactagtgcatctctaaagtttactgttctaaatccaaaagggcgtatctggactatggtggcaggaggtggtgccagtgtcatatatgctgacacagttggagacttgggatatgcttctgaactcggcaattatgcagaatatagtggagctccaaatgaggaggaggttttgcaatatgcccgagtagttattgattgtgctacggctaatcctgatggtctaaagagagctctgctaattggtggtggcattgcaaattttactgatgttgctgctactttcaatgggattataagggctctccgggagaaggaatctaagctaaaggctgctaggatgcatatatatgttcggagaggtgggcctaactaccagagtggcttagcaaaaatgcgtgctcttggagaggagttgggagttcctcttgaggtatatggaccggaggcaaccatgaccggcatctgcaagcaagcaattgactgcatcatgtctgaggataattaaagaaaaaaaacagaaatttctatgaagcacatggagaatatatagtagtctgaggtaatttccttttaaaatcaatgcattggtcctcattccccccatcaatttggctggcacaacttctggaattctatttcttgaattttcttttaaagagaactgcagaaatcaattgttttccttttggaaattttgaaca

SEQ ID NO: 3014 - DNA, 1629 bp, Gossypium hirsutum
tgttgttgcggttgtagatcttcttcaatctaagcttctcagagacttaaaatggctcgcaagaagatcagagaatacgattccaagagacttctcaaacaacacctcaaacgcgtcgctaatatcgacctccaaatctgttctgctcaggtgactcaatctactgatttcaccgagttaacgaacgaacaaccatggctttcgtccaccagattagttgttaagccggatatgttgtttggtaaacgtgggaagagtggcttggttgctctcaatttggatcttgctgaagttgctgaattcgtcaaagctcgcctcggcactgaggttgaaatgggcggttgcaaagctcctataaccacattcattgttgaaccttttgtaccccatgaacaagagtattacctttcaatagtctctgaaaggcttggttttaccattagtttttcggaatgtggaggtattgatattgaagagaactgggataaggttaaaaccatcttccttccaaccgagaaacctatgaccttggagacatgtgcaccgttgatagctacacttcctttggaagtccgcgggaagattggtgacttcatcatgggtgtcttttctgtctttcaagatcttgacttcagctttctcgagatgaatccatttacactggtgaatggagaaccatacccactggatatgaggggggagctggacgacactgctgcattcaagaacttcaacaagtggggtaacatagagtttcctctaccttttgggagagtcctgagctctacagaaagcttcatttattcattggatggaaagacaagtgcatctctgaaattcactgttttgaatccaaaagggcgtatctggacaatggttgctggaggtggtgctagtgtcatttatgctgatactgtaggagatttaggttatgcttcagaactgggaaactatgcggagtatagtggagcaccaaatgaagaggaggtcttgcaatatgcaagagttgttattgattgtgccactgcaaaccctgatggtcgtaagagagcccttctcattggaggtggcattgctaacttcactgatgtagctgctactttcaacggaatcattcgagcattgagagaaaaggaagccaagttaaaagcagcaagaatgcacatctttgctcgaagaggtggtccaaactatcaaattggtttggcaaggatgcgtgctcttggggaggaactaggagtaccccttgaggtttacgggccggaggccacgatgactggcatatgcaagcaggctatagattgcattctgtccgaagcataagtatggtattatttttgttctccaaagtcgaattatgctgccaatgcagtttggtattctttgttgaagtcataagctggacaagactgttgttgtagaccgaaatactcaaattactgagtatttcatcctctttgtgtgtgtgtgtgtgtgttcttgtgcaataaacacgaaacttggtttctgtcggtccatgtttgtttgttggtagttggtattttggtgtttctgattataattgtgctttatgatgggctggaaaaatgtttgaattaacgagaaaatgcgaaaatgcaattcccaagt

SEQ ID NO: 3015 - DNA, 1907 bp, Prunus mume
acccgccacgctcctaatgcagccaaccaccgcgcctatccactcccctggcacgtcgaaagcgtgagctattgccgcgcgtgtgccttcaccatctaatccaaatatagtacactcatcagccgcacctgccaactgcactttctctttccttcgcaaatcgacttgtatatcaacacccaccgcaccagaccagaccagaccagacccagaactcgatcagacccgacccgaattctttggccacggtgatccgactacccaaatggctcggaagaagatcagagaatacgactccaagaggctgctcaaacaacacttgaaacgagtcgccggaatcgacctccagatcaactcagctcaggtgaccgagtccacggacatcgctgagttggtgaacacggagacatggctgtcgtcgacgaggctcgtggtgaagcccgatatgttgttcgggaagcgcgggaagagtggccttgttgctctcaatttggatatggctcaggtcgccgagtttgtgaagcagcgtcttggcaaagaggttgagatgggaggctgtaaggctcctataacgacgtttatagtggagccatttatgcctcatgatcaagaattttacctttcgattgtttctgaaaggcttggatcgacattgagcttttcggagtgtggaggaattgaaattgaagagaactgggacaaggttaagactatatttcttccaaccgagaagtctttgacaaatgaggcttgcgctccactgattgccactcttccattggaggtcagagacaaaattggggatttcataaagggcgtcttcactgtatttcaggatttggattttagcttcctggaaatgaacccgtttaccttggttaacggtgaaccttatccattggatatgaggggggagctagatgacactgctgctttcaagaacttcaataaatggggtaacgtggagtttccactgccttttggtagagttttaagtcctacagaaacatttattcattctttggatgaaaagacgagtgcatccttaaaattcaccgtgttgaacccaaaaggacgcatctggaccatggtagctggaggtggtgcaagtgttatatatgctgatactgttggagatttgggttatgcttcagaactcggaaattatgcagagtatagtggagctccaaatgaggaagaggtgttgcaatatgcgagagttgtgattgattgtgcaactgctgatccagatggtcagaaaagagctcttattattggaggtggtatagcaaatttcacagatgttgctgctacatttaatggaatcattagagccctcagagagaaggaatccaagctaaaagcagcaagaatgcatatcttcgtgagaaggggcggtccaaattatcaaactggtttggcaaagatgcgtgcgttgggagaggaacttggagttcctcttgaggtttatggacccgaggcaacaatgactggaatttgcaagcaagcaattgagtgcatcatgggtgaagaataagaaagaatttcttattttcggctctttgtatgagttttggaggttcagagtgtgtattatgatttggccaaaaaaaaaaaaggtgtgtattgtgagtttgtctttggaagatgagaccacagctgaaataatttaaaatttccgatctttctagttttgtgagtctctgactgaaacattccgtgtgttttaagtgttcatgttcttgtttagaaatcaatggttgctctccctcctacccttcctttttctccaccttttttaagtttaaagaaacaaaaagtaataataaaatgagaaaattatggaaatcaagaaatgaggatgtgagccattttcttttggtttattttttatttttattcgatta

SEQ ID NO: 3016 - DNA, 1663 bp, Raphanus sativus
gggtctgcttttctctctctctctctctctctctctctctctctctcttgttgttgcctgctggtgagatcacctgttactcaacttcttcgatcttatcttctctaaacttgtcacctttttgccagacacttgttttgagttggtaactcgatggcgaggaagaagatcagagagtacgactccaagagacttctcaaggaacacttgaaacgtctcgctaacattgacctccaaatccgctctgctcaggtgacagaagctacggatttcactgagctgaccaaccaggagtcatggctctcttccacaaagctagttgtgaagcctgatatgctgtttggaaaacgcgggaaaagtggtttggtagctctgaagctggatcttgctgaagttgcagagtttgtcaaagcccgcctcggttctgaggttgagatgggtggatgtaaagctcctatcactacattcattgtggagccatttgtgcctcatgatcaagagtactatctttctgtagtgtctgataggcttggctgcactataagcttctctgaatgtggtggtattgaaattgaagagaattgggacaaggtgaagactgtgtttcttcctgcggaaaagtcaatgacgcttgaagtatgtgctccactgatagcaacacttcctcttgaggttagaggtaaaataggcagcttcataatgggcgtgtttgctgtgtttcaagatctggatttcagttttttggagatgaatccttttacgctggttgatggagagccatatcctcttgacatgaggggcgagttagatgacacagccgccttcaaaaatttcaacaagtggggagacattgaatttcctctgccatttggaagggtactcagtccaacggagagcttcatccatggtttagatgagaagacaagtgcttctttgaagtttactgttttgaatcctaaaggtcgcatttggactatggtagctggaggcggtgctagcgtcatatacgctgatacagttggagatttaggctacgcatcagagctcgggaactacgcggagtatagtggagcacctaacgaggaagaggtgttacattacgctagagttgtcattgattgtgctactgctgatcctgatggacgcaaacgagctcttctcattggaggtggcattgccaattttaccgacgtggcagctactttcaacggtatcatccgcgctctaagagaaaaggaaacaaggctgaaagcatcaagaatgcacatttacgtaagaagaggtggtcctaattaccagactggtctggctagaatgcgtgctctgggggatgaactcggtgttcctctagaggtatatggaccagaagcaacgatgacaggaatatgcaagcgagccattgactgcatcatgttgcctgatgcatgatcaagtaaacctatgatctcttattcagtttaaaacagcagaacacgaactcggacctgagcaatgggaagtgtttgttgatccctgttcttcatctctctatcagcatatgaaaatgaaaagctctttgaaactgttgcttgtgtgtgtgtaatactgaaaaccaaatcattggttgttgtgtaattgtaatcaaaacggtcaaaatcctcttttgaagtgtacaaataagatt

SEQ ID NO: 3017 - DNA, 1787 bp, Fragaria vesca
cctgacccgacccgactcggagcaaaatggcgaggaagaagatcagggagtacgattcgaagaggctgctgaagcagcacttgaagcgagtcgccggaatcgacctccagatcaactcggctcaggtgacggaggcgacggacttcacggagctggcgaacaaggagacgtggctgtcgtcgacgaggctcgtcgtcaagccggacatgctgttcggaaagcgcgggaagagcgggctcgtcgcgctcaatctggacatggctcaggtcgccgacttcgtcaagcagcggctcggtaaggaggtggagatgggagggtgtaaggcgccgattacgacgtttatagtggagccgtttatgcctcatgataaggagttttacctctcgattgtatccgaaaggctcggcagcacgataagcttttcggagtgtggaggtatcgaaatcgaagagaattgggacaaggtcaagactatttttcttccaactgagaagtctctgacgaatgaggcttgtgctccgctgattgctacccttccattagaggtcaaggagaaaattggagatttcataaaaggcgtatttgctgtatttcaggatttggattttaccttcctagaaatgaacccgtttaccttggtcaacggggaaccttttccattagatatgaggggggagctagatgacactgcggctttcaagaactttaacaaatggggtaatgtggagtttccattgccttttggcagagttttaagtccaacagaatcatttattcatactttggatgaaaagactagtgcgtccttaaaattcacagttctgaacccaaaaggacgcatctggaccatggtagccggaggtggtgcaagcgttatttatgctgataccgttggagatttgggttatgcatcagaacttggaaactatgcagagtacagtggagctccaaatgaagaagaggtgttgcaatatgcaagagttgtgattgattgtgcaacagcgaatccagatggtcgtaaaagagctcttcttattggaggtggtatagccaatttcactgatgttgctgctacatttaatggaataattagagcactgagggagaaggaatccaagctcaaagcgtcaagaatgcatatgtatgtaagaaggggtggtccaaattatcaaactggtttggcaaggatgcgtgcattgggagatgaacttggagttcctcttgaggtttatgggcctgaggcaactatgacgggaatttgcaaggacgcaattgattgcatcatgagtgaatcataagaagtttcttttgtgaatctttgtataacaattgtgtattgtgatttgggaaaaacaaaaattgtgcattctgagtttgtcttgggaagatgggattgcaagtgaaactcaactttccaaagacatgcatttcacaggtttccttctgctacttgcgttatttgaggagcaaaagactcggaaaatggcggaaagcggtcaattaccatgtttttactgtctcgtttgagtcaatgataccccctctagcagatcatgaaatgcgaataattactgctacttgtgttggttaaagatccgatatattattggaagctgctgggttgactcttactgtaataatttcaagcttgtggttttggaaggtctttcgtgttattatttggttctaaactttcgttctaagatgaaaagcatttttctaaatgactgaaagctgatttgatgtatgtcacgagcaatgcgaccagtattattagatcttttcta

SEQ ID NO: 3018 - DNA, 1405 bp, Musa acuminata
aactatctcctgttggattggaggaggtggagatggctaggaagaagatccgggagtacgattccaagcgcctccttaaggagcacctcaagcggctcgccggcaccgatctccagatccgctccgcgcaggtgacagaatcgacggacttcaatgagttagtcaacaaagaaccatggatttcgtccacgaaattggtcgtgaagcccgacatgctgtttgggaagcgtgggaagagcggtctggtggctctcaacttggatctggctcaggccgcgcagtttgtgaaggaacgtctgggaacggaggttgagatgggagggtgcaaggctccgattaccacattcataattgagccattcattccccatgatcaagagtactacctctcgatcgtttccgagaggcttggttgcaccattagcttctccgagtgtggtggcattgaaatcgaggagaactgggacaaggttaagacggtttaccttcccacggagaagtcgatggcatccgaggcatgtgctccgttgatcgtaacccttcccttggaggttcgagggaaaataggggacttcataaagggagttctcactgtgttccaagacttggatttcagtttcatagaaatgaacccattcactttggtaaatggtgaaccatacccactagatatgcgaggagaactggatgacacagctgctttcaaaaacttcaagaagtggggtagcatagaatttccacttccctttggtagagtcctgagctccacagaaaaatttgttcatgaacttgatgaaaagactagtgcctccctgaagttcactgttttaaaccccaaaggacgcatatggacaatggtggctggtggtggtgctagtgtcatttatgctgatacagttggagatttaggttatgcatctgaacttggaaactacgcggaatacagtggtgctccaaatgaggaggaggtccttaagtatgctcgagtcgtccttgattgtgcaactgcagatcctgatggtcgtaagagagctcttctcgttggagggggtatagcaaactttactgatgttgctgccacattcaatggtatcatcaaggccctgaaagagaaggagtcaaagctaaaggctgcaaggatgcacatttatgttagaagaggtggtccaaactatcaaacaggcctggccaaaatgaggaaactgggtgaggaacttggcattcctctcgaggtttatgggccagaggccacaatgaccggaatttgcaagcaagctatcgattgtgtcatgtctgctgcatgactaactcgcgtttttgttttaagcaatatcaagctcgaccataattgatttcttgtaggtgccgattgtgttggttcgaacatttgataagttaatgcgca

SEQ ID NO: 3019 - DNA, 1657 bp, Cocos nucifera
ccacccaccatcacgcccaacagctcccacctccctcgcttttaaatctccctctcgccttccatcagcttcccttcgaagccatcgcttcttggaagcccgaatcgagggtttgagagctctcgaaatatcgttctccgaatcgatccaacgaggaggaggagatggcgagaaagaagatccgggaatacgactctaagcggctcctcaaggaacatctcaagcggatcgccggcatcgacctccagatctgctctgcccaggtcacggaatctacggactttactgagttagtgaaaaaagagccatggatttcatccacgaaactggttgtgaagcccgacatgctatttgggaagcgaggcaagagtggtttggtagctctggacttagatatggcacaggtggctcagtttgtgaaggaacgccttggagttgaggttgaaatgggtgggtgcaaggcccccatcaccacatttataattgagccatttgttccccatgaccaagagtactatctctcgtttgtctccgagaggcttggttgcaccatcagcttctcagaatgtggtggaattgaaattgaagagaactgggagaaggtcaagaccatctttcttcctgctgagaatcctatgacatttgatgcatgtgctccacttattgcaagccttcccctggaggtacgagggaaaatggatgatttcataaaaggggtttttgctgttttccaagacttggacttcacttttcttgagatgaacccatttagtttcgtaaatggggagccataccccttggatatgcggggagagttggatgacactgctgcattcaagaacttcaagaagtgggggaatatagaatttccacttccttttggcagagtcctgaggcctacagaaaactttattcacaaacttgatgagaagactagtgcctccctgaagtttactgttttaaatcccaaaggacgcatatggaccatggtggctggtggtggcgctagtgtcatatatgctgatactgttggtgacttgggttatgcatcagagcttggaaactatgcagagtacagtggtgcccctaatgaggatgaggtcctgcagtatgctagagtgattcttgattctgcaactgctgatccggatggccgaaagagggcccttctcattggaggtggtatagctaacttcactgatgttgctgctacttttggtggcattatccgtgccctgagggagaaggaatccaagctaaaggctgcaaggatgcacatttatgtccgaagaggtggccctaattatcaaacaggtctggccaaaatgcgggctctgggtaaggagttgggcattccccttgaggtgtatgggccagatgcaacgatgactggaatttgcaagcaagctattgattgcgtcatgtctgctgcataatttttatttcattactccttttgtttttctccatccatttttggttgaacaaaaaattagaattcagtgattcctccagagtgaatgataaaatgaaaacatttatggagaataaatgagtcaatccagaccatcatttcattgccttctcaaatttctgtagtgcaacttgtgctaggtcaacgtagttttgttctcatagaaaatttctattccagctt

SEQ ID NO: 3020 - DNA, 1306 bp, Flaveria ramosissima
tccaaacttaaacaaaaatggccagaaagaagatcagagagtatgattccaagaggcttttgaagcaaaatttgaaaagactcgccggaatcgaccttcagatttgctctgctcaggtcactgcatccacagactttactgatttgacagacaaagaaccatggctttcatcaacaaagctggttgtcaaacctgatatgctatttggaaagcgtgggaagagtggcttggttggattgaacttagatgtagctcaagttgctgattttgtgaaagctcgtcttggtgctgaggttgagattagtggatgtaaagcaccaataacgatgtttattgtcgaaccatttgttccacatgatcaagagtattacttttctatcgtctctgaaaggcttggtagcaccattagcttttcagaatgtggtggtattgatattgaagagaactgggagaaggttaaaaccgtgtttcttccaaccgaaaaacctatgacgctagagacttgtgctccattaattgctactcttccattagaggtacgagcaaaaattggcaatttcataatgggtgtgtttgctgtatttcaagatttagatttcacttttctagagatgaatccgtttacgttggttaacggagagcccttccctctggatatgaggggagagttggatgacacagcagcatttaagaacttcaaaaagtggggtaacatagagtttccattgccatttggaagagtcctaagctctacggagagtttcattcacacattagatgaaaaaaactagtgcttctttgaagttcacagtgttgaatcctaagggacggatatggacgatggtggctggaggtggtgctagtgtaatatacgcagacacagttggagatttaggttatgcatcagaacttggtaactatgcagagtatagtggagctcctaacgaggaagaggtcttgcaatatgctagaattgtaattgattgtgctactgcagatcctgatggtcgtaaaagagcccttctaattggtggaggcatcgctaactttactgatgtggctgccactttcagtggaattatccgagctcttagagaaaaggaatcgaaactgaaagcagcaagaatgcacatatatgttcgaaggggcggtcctaattaccagactggtttggcaaagatgcgtgcactaggagaggaactagggataccccttgaggtgtatggacctgaggctacaatgacgggcatttgcaaggaagcaattgaatgcataatgtcaaataaataagcaacctggaagataa

SEQ ID NO: 3021 - DNA, 1638 bp, Prunus persica
ctgcactttctctttccttcgcaaatcgacttgtatatcaacacccaccgcgcctgaccagaccagaccagacccagaactcgatcagacccgacccgaattctttggccacggtgatccgacgatctgaatggctcggaagaagatcagagaatacgactccaagaggctgctcaaacaacacttgaaacgagtcgccggaatcgacctccagatcaactcagctcaggtgaccgagtccacggacatcgctgagttggcgaacacggagacatggctgtcgtcgacgaggctcgtggtgaagcccgatatgttgttcgggaaacgcgggaagagtggccttgttgctctcaatttggatatggctcaggtggccgagtttgtgaagcagcgtcttggcaaagaggttgagatgggaggctgtagggcccctataacgacgtttatagtggagccatttatgcctcatgatcaagaattttacctttcgattgtttctgaaaggcttggatcgacattgagcttttcggagtgtggaggaattgaaattgaagagaactggggcaaggttaagactatatttcttccgaccgagaagtctttgacaaatgaggcttgtgctccactgattgccactcttccattggaggtcagagacaaaattggggatttcataaagggcgtcttcgctgtatttcaggatttggattttagcttcctggaaatgaacccgtttaccttggttaacggtgaaccttatccattggatatgaggggggagctagatgacactgctgctttcaagaacttcaataaatggggtaacgtggagtttccactgccttttggtagagttttaagtcctacagaaacatttattcattctttggatgaaaagacaagtgcatccttaaaattcaccgtgttgaacccaaaaggacgcatctggaccatggtagctggaggtggtgcaagtgttatatatgctgatactgttggagatttgggttatgcttcagaactgggaaattatgcagagtatagtggagctccaaatgaggaagaggtgttgcaatatgcgagagttgtgattgattgtgcaactgctgatccagatggtcagaaaagagctcttattattggaggtggtatagctaatttcacagatgttgctgctacatttaatggaatcattagagccctcagagagaaggaatccaagctaaaagcagcaagaatgcatatcttcgtgagaaggggcggtccaaattatcaaactggtttggcaaagatgcgtgcgttgggagaggaacttggagttcctcttgaggtttatggacccgaggcaacaatgactggaatttgcaagcaagcaattgagtgcatcatgggtgaagaataagaaagaatttcttattttcagctctttttatgagttttggaggttcagagtgtgtgttttatgatttggccaaaaaaaatgtgtgtattgtgagtttgtctttggaagatgagaccacggccgaaataatttaaactttccgatctttctagttttgtgagtctctgactgatacattccatttgtttttaagtgttcatgttcttgtttagaaatcaatggttgctctccctccc

SEQ ID NO: 3022 - DNA, 1732 bp, Amborella trichopoda
ggtgtgggctggaagcaccaaacaattttctccattcataaattcattacctagttctaatggtggtggtgtgggtagttagctcgcccaccaacttgtgatcatctccccattacattactcatgataacctctcaccatcccttcttctgacctttgaacttccggtggctggtgaccaatggctaggaagaagatcagggagtacgactctaaacgcttattgaaagagcatttgaagagaatttctgaaattgaaatcgggatccgctctgctcaggtcaccgaatcaacagatttcacagaaattacggacaaagagccatggctttcctccaccaagcttgtcgtgaagcctgatatgttgtttgggaagagggggaagagtggattggtcgcacttaacctcgatctagctcaagttgcagcttttgtcaaagaacgccttggtaaagaggtggagatggggggttgcaaggcaccaattaccacatttattgtagaaccatttgttcctcacacccaagagttttacctttcaattgtctctgagaggcttggatgtacagtgagtttctcggaatgtggtggaattgaaattgaagagaactgggacaaggttaaaacaatctttctcccaaccgaaaagtcaatgacacctgaagcctgtgctccactaattgcaactctgcctttggagattcgaggcacaattggagacttcataaagggtgtctttgccatatttcaagacctggacttcactttccttgagatgaacccatttactttggtcaatggggcaccataccctctggatatgcgaggagagttggatgatactgctgccttcaagaatttcaagaagtggggcaatgtggagttcccattaccttttggaagagtgttgagtccaacagaaagctttattcatggtttggatgaaaagactagcgcctctctgaagttcactgtattgaatccgaaagggcgcatttggacaatggtagctggaggaggtgcaagtgtaatttatgcagatactgttggagacttgggctatgcctcagagcttgggaactatgcagaatatagtggtgctcccaatgaagaagaggtgttgcagtatgccagagtcgttattgattgcgctacatctgatcctgatggtcggaaaagggcactcttgattggtgggggcattgcaaactttactgatgttgctgccacgttcaatggcataatcagggcattgagggagaaggaagcaaagctgaaagcatcacgaatgcatgtttatgttcgtagaggtggtcctaattatcagacggggttagcaaggatgcgagttcttggggaagagcttggagttccccttgaggtctatggccctgaggcaacaatgactggaatctgcaaacaggcaattgagtgcatcatgtctgctgcataaacattatgttcttccattgttttctcttttgatctttgatcccatggactgctcttcatcatcaaggggcatttaataatccaataaggcctgaatcaattgatagctggtcttgtatgacagttttctgccatttaatctgaatccattttgtagattgtaaacaggaccacttatggacttcaaaagtctgtagtgcacaaacaaagaccctttgatatatcttttattgctctccatgtggttcttttcttttctatatttttcatgaacttcaaa

SEQ ID NO: 3023 - DNA, 1633 bp, Arabidopsis thaliana
gtctcgaaaattgtcaccttttcttctcagctacttcaggcggagaaacactttccgtggtttagtgttgaggacgatcactgtttgtaattcgatggcgaggaagaagatcagagaatatgactccaagagacttctcaaggagcatttgaagcgtcttgctaatattgacctgcagattcgctctgctcaggtgacagaatctacggatttcactgagttaaccaaccaggagtcatggctatcgtccacaaagctagttgtgaaaccggatatgctatttgggaaacgcgggaaaagtggtttggtagctctaaagctggatcttgctgaagttgcagactttgtcaaagcccgcctcggcactgaggtcgagatggagggatgtaaagcacctatcactacattcattgtggagccttttgtgcctcatgatcaagaatactacctctctatagtatctgatagacttggatgcactataagcttctctgaatgtggtggcattgaaatagaagagaattgggacaaagtgaagactatatttcttcctgcggaaaagtcgatgacgctagaagtatgtgctccattaatagcaactcttcctcttgaggttcgagctaaaatcggcaacttcataatgggtgcctttgctgtatttcaagatttggatttcagttttatggagatgaatccttttacactagtcgatggagaaccattccctctggatatgagaggagaattagatgacactgctgccttcaagaatttcaacaagtggggagacattgaatttcctctgccatttggaagggtcctcagttctacagagaacttcatccatggtttagatgagaagacaagtgcttctttgaagttcactgttttgaatcctaaaggccgcatttggacgatggtagctggaggtggtgctagcgtcatatatgctgatacagttggggatttaggttatgcatcagagcttggaaactacgcagagtatagtggagcacctaatgaggaagaggtgttacaatatgcaagagttgtcattgattgtgccactactgatcctgacgggcgtaaacgagctcttctaattggaggaggcattgccaatttcactgatgtggcagctactttcaacggtatcattcgagcgctaagagaaaaggaaacaagattgaaagcatcaagaatgcacatttacgtaaggagaggtggaccaaattaccagactggtttggctagaatgcgagctttaggagaggaacttggtgtccctctagaggtatatggtccagaggcaacaatgacgggaatatgcaaacgagccattgactgcatcatgttgcctgatgcataacctacccaaaccttttatctcttcttcagtttgaaagcagaacaaaagctttggagctggacgaatgagtgagtgtaaaatgagtcatgtccttcatctctctctttccacataagaaaatgaaaatctctttaaaactttttttccactgggtgtgaatttgaaaactgtatcattgtgtgtaagcgtaattgtaatcagacggtcaaaatccttattttgaaatgtacaataagacttcaaaagttaatgttgcttttgatt

SEQ ID NO: 3024 - DNA, 1477 bp, Brassica juncea
gtgagatcacctgttactcaaacttcttcgatcttatcttctctaaacttgtcacctaacacttgtgtgattcagacgatcactgtctcttaaaacttactgtctccgtttcagattctgagtttctctctttctttaggttttttgagcttgtaaatggcgaggaagaagatcagagagtacgactccaagagacttctcaaggaacacttgaaacgtctcgctaacatcaacctccaaatccgctctgctcaggtgacagaagctacggatttcaatgagttgaccaaccaggaggcatggctatcttccacaaagctagttgtgaagcctgatatgctatttggaaaacgcgggaaaagtggattggtagctctgaagctggatcttgctgaagtttcagagtttgtcaaagcccgtctcggctctgaggttgagatgggtggatgtaaagctcctataaccacattcattgtggagccctttgtgcctcatgatcaagagtactatctgtctatagtgtctgataggcttggctgcaccgtaagcttctctgaatgtggtggcattgaaattgaagagaactgggacaaggtgaagactgtgtttcttccagcggaaaaatcaatgacgcttgaagtttgtgctcctttgatagcaacacttcctcttgaggttagaggtaaaataggcagcttcataatgggcgtgtttgctgtatttcaagatttggatttcagtttcatggagatgaatccgtttacgctagtcgatggagagccatatcctttggacatgaggggagagttagatgacacagctgccttcaaaaatttcaacaagtggggagacattgagtttcctctgccatttggaagggtcctgagtccaacagagagcttcatccatggtttagatgaaaagacaagtgcgtctttgaagttcactgttttgaatccgaaaggtcgcatttggactatggtagctggaggcggtgctagcgtcatatatgctgatacggttggagatttaggttacgcatcagagctggggaactacgcagagtatagtggagcacctaatgaggaagaggtgttacaatacgctagagttgtcattgattgtgctactgctgatcctgatgggcgcaaaagagctcttctcattggaggtggcattgctaattttaccgacgtggcagctactttcaacggtatcattcgcgctctaagagaaaaggaaacaagactgaaagcatcaagaatgcacatttacgtaagaagaggtggtccaaattaccagactggtctggctagaatgcgtgctctgggagaggaactcggtgttcctcttgaggtatatggaccagaagcaacgatgacaggaatatgcaagcgagccattgactgcatcatgttgcctgatgcatgatcaaccaaacctttgatctcttcttcagttgaaaacagcagaacac

SEQ ID NO: 3025 - DNA, 1400 bp, Flaveria ramosissima
cctacaactacaaccaatcaatcttatcttctaagcaattccatcaactttcaaagcttttcaattttcatatattcagacttgttctcaacatccaaattcaaagtaaaatggcgagaaagaagatcagagagtacgattccaagaggcttctgaagcaaaatttgaaaagactcgccggaatcgaccttcacatttgctctgctcaggtgactgcatccacagactttactgatttgacagacaaagaaccatggctttcatcgacaaagctggttgtcaaacctgatatgctatttggaaagcgtgggaagagtggcttggttggattgaacttagatgtagctcaagttgctgattttgtgaaagctcgtcttggtgctgaggttgagatcagtggatgtaaagcaccaataacgacatttattgtcgaaccatttgttccacatgatcaagagtattacttttctattgtctctgaaaggcttggtagcaccattagcttttcagaatgtggtggtattgatattgaagaaaactgggagaaggttaaaaccgtgtttcttccaaccgaaaaacctatgacgctagaggcttgtgctccattaattgctactcttccattagaggtacgagcaaaaattggcaatttcataatgggtgtgttcgctgtatttcaagatttagatttcacttttctagagatgaatccgtttacgttggttaatggagagccctttcctctggatatgaggggagagttggatgacacggcagcatttaagaacttcaaaaagtggggtaacatagagtttccattgccatttggaagagtcctaaactctacggagagtttcattcacacattagatgaaaaaactagtgcttctttaaagttcacagtgttgaatcctaagggacggatatggacgatggtggctggaggtggtgctagtgtaatatacgcagacacagttggagatttaggttatgcatcagaacttggtaactatgcagagtatagtggagctcctaacgaggaagaggtcttgcaatatgctagaattgtaattgattgtgctactgcagatcctgatggtcgtaaaagagcccttctaattggtggaggcatcgctaactttactgatgtggccgccactttcagtggaattatccgagctcttagagaaaaggaatcgaaactgaaagcagcaagaatgcacatatatgttcgaaggggcggtcctaattaccagactggtttggcaaagatgcgtgcactaggagaggaactagggataccccttgaggtgtatggacctgaggctacaatgacgggcatttgcaaggaagcaattgaatgcataatgtcaaataaataagcaacctggaagataagt

SEQ ID NO: 3026 - DNA, 1673 bp, Oryza sativa
gatccaatctagaacagagcgagtcatcttctttatattcattccattctccctaggcaacgtgcacacaccaccaccaccttcgtcttggttggcttcgttcactccgcctacctacctacctctgcagttggtttgctgaaccctcaagaacccacacctctcgcctctcgcggcggcagcccatggcgcgcaagaagatccgggagtacgactccaagcgcctcctcaaggagcacctcaagcgcctcgccggtatcgacctccagatcctctccgcgcaggttacacaatcgacggacttcacagagctggtaaaccagcagccatggctgtcaaccatgaagttggtcgtgaagcccgacatgctgttcgggaagcgtggcaagagcggacttgtggccctcaacctagatattgctcaagtcaaggagtttgtgaaggagaggctgggagttgaggtcgagatgggtggctgcaaggctccaatcaccaccttcattgtggagccatttgtaccccatgatcaagaatactacctttctattgtctcggagaggctgggcagcaccattagcttctcagaatgtggaggaatagaaattgaggagaactgggacaaggttaagacaatttttctttccactgagaagccaatgacacctgatgcatgtgctcccttgattgctacccttccattggaggcacgtggaaaaattggtgatttcattaaaggagtctttgctgtcttccaagacttggatttctcatttctcgagatgaacccatttaccatcgtgaatggagagccgtatcctctggacatgagaggagaattagatgacacagcagctttcaaaacttcaagaagtaagtggggaaatatcgaattcccactaccattcggtagagttctcagttctacagaaggctttatccatgacttggatgagaagacaagtgcatctctgaagttcaccgttttgaacccaaaggggcgcatctggacaatggttgctggaggtgaattagaaaactatgcagagtatagcggtgctcccaacgaggaggaggttctgcagtatgctagagtagtacttgattgtgcgactgctgatcctgatggccgcaagagagctcttctcattggagggggtatagctaacttcaccgacgtcggggccacatttagcggcatcattcgggccttaagagagaaggaatccaagttgaaggctgcaaggatgcacatctatgtccgacgtggtggtccaaattaccaaactgggctggctaaaatgcgcaagcttggcgcagaactcggtgtcccgattgaggtgtatgggccagaagcgacgatgactggaatctgcaagcaagcaattgaatgcgttatggccgcagcataaatgaagatgcaagttctgggatctgcaggcaagatgctgaatgcgtgatgggtgcgacatggatgagagtgtggtgtagttgcagtagttctctgcagatggctgatttgtttcttgatacatgttatacttggacgagatctggataggttattgatgtactgaaactactactgcgatgcaataaaagtgagagtagcgtttcctgatttgttctcttctttattgtgatattgttgcaatgcaatcgcgctgtatttcatc

SEQ ID NO: 3027 - DNA, 1741 bp, Eutrema parvulum
gttgcctgttggtgagattactcaacttcttcgatcttatcttctcgaaagttctcacctttttttgcgagcaagacaagacttctgtaattcaagtgctgaggacgatcactgtgcttttttatttaacttactgtctctgtttcagattctgggtttcactcatttttttgtccttttcttagttttacgggtttgagcttgtaattcgatggcgaggaagaagatcagagagtatgactccaagagacttctcaaggaacacttgaaacgtcttgctaatatcgacctgcaaattcgctctgctcaggtgactcaagctacagatctcactgagttgaccaaccaggagtcatggctatcgtccacaaagctcgttgtgaagcctgatatgctgtttggtaaacgcgggaaaagtggcttggtagctctgaaactggatcttgctgaagttgcagagtttgtcaaagtccgcctcggtactgaggtcgagatagatggttgtaaagcccctatcactacattcattgtggagccctttgtgcctcatgatcaagaatactatctttctatagtatctgataggcttggctgcactataagcttctctgaatgtggcggcattgaaattgaagagaactgggacaaggtgaagactgtatttcttccttcagaaaagtcaatgacgcttgaagtatgtgctccattgatagcaatacttcctcttgaggttcgaggtaaaatcggcggcttcataatgggtgtgtttgctgtatttcaagatttggatttcagttttatggagatgaatccttttacgctagtcgatggagagccatatcctctggacatgaggggagaattagatgacacagctgccttcaagaattttaacaagtggggagacattgagtttcctctgccatttggaagagtcctcagtccgacggagagtttcatccatggtttagatgagaagacaagtgcttctttgaagttcactgttttgaatcctaaaggccgcatttggacaatggtcgctggaggcggtgctagcgtcatatatgctgatacggttggggatttaggttatgcatcagagctcggtaattatgcagagtatagtggagcacctaatgaggaagaggtgttacaatacgcaagagttatcattgattgtgctactgctgatcctgatgggcgcaaacgagctcttctaattggaggaggcattgcaaatttcaccgatgtggctgctactttcaacggtatcatccgcgctctaaatgaaaaggaaacaagattgaaagcatcaaggatgcacatttacgtaagaagaggtggtccaaattaccagactggtctgactagaatgcgagctctgggagaggaactcggggttcctctagaggtgtatggaccagaagcaacgatgacaggaatatgcaaacgagccattgactgtatcatgttgcctgacgcataaccaaccaaacctttcatctcttcttcagttaacaaagcagaacaataactcggagctggacattgagaagagtgtgtgtcggttcctgttcttcatctctctttctatataagaaaatcaaaagcgctttgaaacttttctctttgtgagggtgtgaatttaaaaaccaaatcattgtgtgttgcagtgtaattgtaatcaaaacggtcaaaatccttctttgaagtgtacaaataagatttcaaaaagtgaatg

SEQ ID NO: 3028 - DNA, 1728 bp, Amaranthus tuberculatus
ctacccaaatctacactccacaaacttactctgttttgctcatctatctaccctcccaactcccaaatatattcagtaaactttgaatattataccaacacctaacaactaccaccgctccaaatcccaatcccatcttcctccctaaaaaattttgaattccaattgtaattctgtgcaaaaatggcaaggaagaagatcagagagtatgattccaagaggcttcttaagcaacatcttaaacgaattgctggcatcgatttacccatttgctctgctcaaataacagaatctactgattttacccaattggtgaatgaagagacatggttgtcatcttctagattggttgttaaaccagatatgctttttggtaagcgcggtaagagtggcctagtgggtttgaatttggatttggctcaagttgcggagtttgtgaaagagcggatagggaaagaggttgaggttggaggttgcaaggcacccgttaccacatttatcgttgaaccatttgtccctcacgaacaagagttttatctatccattgtatctgataggctaggttgcactataagcttttcagagtgtggtggtattgaaattgaagaaaattgggacaaggttaagagcatagttttgccaaccgaaaagtccttgtccagtgaagcttgcgctccattgattgctacacttcctttggagatacgagggaaaattggggattttatcaaaggtgtctttgcagtattcgaagatcttgactttagcttcttggagatgaatccctttacattagttaatggggagccatatccattggacatgaggggagaacttgatgatacagcagctttcaagaattttaacaagtggggcaacatagagttcccattaccttttggccgggttttaagccctaccgagagctatattcattctttggatgaaaagacaagtgcttccttgaaattcaccattttgaacccgaaaggacgcatttggactatggttgctggaggtggagctagtgttatatatgctgacaccgttggagacttgggttatgcatccgagctagggaattatgccgagtacagtggagctcctaatgaagaagaagtattgcagtatgctcgagtcgttattgattgcgccacagcaaatcccgatggtcgtaaaagagctctccttataggagggggtattgctaacttcaccgatgttgctgctacttttagtggtatcattcgagctcttcgagagaaggaatcaaaattaaaggccgctaggatgcatatttacgttagaagaggaggtcctaactatcaaacaggtcttaaaaaatgcgtgcactcggtgaggagcttggagttcctattgaggtatacggcccagaggcaaccatgactggaatatgcaagcaagcaatcgaatgcattatggctcaggattgacgaacagcttgtgcttaaacgaacagttctttcttttttcttcgcgaaaggtacaagtgtgaaatattcaagaaacgagtcgtgtgccaaatagacttgatttatagttttatgtattgtttgtctatttttgtatttcaacttgtaacatttacaacaattgatgatgggttttgctgttgtactatcaaaatgaaacctctgcatttactacatagaactcacttcatatttcaaaactagtactacaaaacaaagcatttactagtcgtgg

SEQ ID NO: 3029 - DNA, 1330 bp, Rosa hybrid cultivar
cactactgtcaactatatcgtcaatcctaatcgactttcatcaccaccagccagagatcagacccgacccgagtccgtgatcggagggcccgaaatggcgcggaagaagatcagagagtacgattcgaagagactgctgaagcagcacttgaagcgagtagccggaatcgacctccagatcaactcggctcaggtgacggaggcgaccgacttcaccgaattggccaacaacgagacatggctttcgtcgaccagactcgtcgtcaagccggacatgctgttcgggaagcgcgggaagagtggcctcgtcgcgctcaatttggacatggctcaggtcgccgacttcgtcaagcagcgtctcggtaaggaggttgagatgggagggtgtaaggcgcctataacgacgtttatagtggagccgtttatgcctcatgatcaagagttttacctctcgattgtatccgaaaggcttggaagcacgataagcttttcggagtgtggaggtattgaaattgaagagaattgggacaaggtcaagactatttttcttccaaccgagaagtctctgacgaatgaggcttgtgctccgctgattgctactcttccactggaggtcaaggagaaaattggagatttcataaaagccgtatttgctgtatttcaggatttggattttagcttcctggaaatgaacccgtttaccttggttaatggtgaaccttttccattagatatgaggggggagctagatgacactgcggctttcaagaacttcaacaaatggggtaatgtggagtttccactgccttttggcagagttttaagtccaacagaaacatttattcatactttggatgaaaagacaagtgcgtccttaaaattcacagtgctgaatccaaaaggacgcatctggaccatggtagctggaggtggtgcaagcgttatttatgctgatactgttggagatttgggttatgcatcagaacttggaaactatgcagagtatagtggagctccaaatgaagaagaggtgttgcaatatgcaagagtagtgattgattgtgcaacagcaaatccagatggtcgtaaaagagctcttctgattggaggtggtatagctaatttcacagatgttgctgctacatttaatggaattattagagcgctgaaggagaaggaatccaagctcaaagcgtcgagaatgcatatatatgtaagaaggggtggtccaaactatcaaactggtttggcaaagatgcgtgcattaggagatgaacttggtgttcctcttgaggtttatgggcctgaggcaactatgacaggaatttgt

SEQ ID NO: 3030 - DNA, 1598 bp, Vinca minor
cctcaaagcaactcagacctatttcttctttaatctactaccggtttttctacttctataaatcattgaatctgtgccctccacaggaaattcaatcaatttcaagaattttcttggatttggattagttcaagagcagtagtagaaaaaatggcaaggaaaaagatcagagagtttgattccaagagacttcttaaggaacatttgaaaagacttgttggaattaatcttcagatctgctctgctcaagtgaatcaggatacggattttgtcgagttgacaaataaagaaacatggctgtcgtccactaagttggttgttaaacctgatatgttatttggtaagcgaggaaagagtggattggtagctttgaatctcgatctcgcacaagttgctgactttgtcaaagctcgccttggtaaagaggtggagatgggtggttgcaaggcacctattactacatttattgtagaaccatttgttcctcatgaccaagaatattatatcaacattgtctctgaaagactgggttctagtattagcttttcagaatgtggaggtattgaaattgaagataattgggataaggttaagaccatctttcttccaaccgaaaagcctttgacattggaggcatgcgctccactaattgctacacttcccttggaggtacgggggaagattggtgattttataatgggcgtttttgccgtttttcaagatttggatttcactttccttgagatgaatccctttacactgcttaatggggagccattcccattggacatgcgcggggaattggatgatactgctgcatttaagaactttaagaaatggggtagcatagaatttcctttacctttcggaagagttttaagcccaaccgagagcttcattcattcattggatgaaaaaaccagtgcatctctaaagtttactgttttgaatccaaaagggcgtatctggactatggtggcaggaggtggtgctagtgtcatatatgctgacaccgttggagacttgggatatgcttccgagctcggaaattatgcagaatatagtggagctccgaacgaggaggaagttttgcaatatgcccgagtagttattgattgtgcgacggctaatcctgatggccgtaagagaggtctgctaattggtggtggcattgcaaattttacggatgttgctgctactttcaatgggatcattcgagctctccgtgagaaggaatcgaagttaaaggctgctaggatgcatttatacgttcgaagaggtggtcctaactaccaaagtggtttggccaaaatgcgtgttcttggagaggagctgggagttcctcttgaggtatatggacctgaggcaactatgactggcatctgcaaacaagcaattgagtgcatcatgtcttaggatatttaaaaaatggactgctttggctgtttctactgtctgcatcctctctctctttgttcctccttccctcgattgcgatttgacttggataagtcccggaacttcattcgatgaattttctttaagaagaactgtagaaataatttattttggtctgtttggagattttaacattgtaa

SEQ ID NO: 3031 - DNA, 4794 bp, Brassica rapa
gactttagaactaaaaacgtcaacgtctcttctggttcccactcggcgtctacttttctctctctctctctgtcttgttgttgcctgttggtgagatcacctgttactcaaacttcctcgatcttatcttctctaaacttgtcacctaacacttgtgtgattcagacaaccactgtctttaaaacttactgtctccgtttcagattctgagtttccctcttttttctttaggttttttgagtttgtaactcgatggcaaggaagaagatcagagagtacgactccaagagacttatcaaggaacacttgaaacgtctcgctaacatcaacctccaaacccgctctgctcaggtgacagaagctacggatttcaatgagttgaccaaccaggaggcatggctatcttcaacaaagctagttgtgaagcctgatatgctgtttggaaaacgcgggaaaagcgggttggtagctctcaagctggatcttgctgaagttgcagagtttgtcaaagcccgtctcggctctgaggttgagatgggtggatgtaaagctcctataactacattcattgtggagccctttgtacctcatgatcaagagtactatctttctatagtgtctgataggcttggctgcactataagcttctctgaatgtggtggcattgaaattgaagagaactgggacaaggtgaagactgtgtttcttcctgcggaaaagtcaatgacgcttgaagtatgtgctccattgatagcaacccttcctcttgaggttagaggtataataggcagcttcataatgggggtgtttgctgtatttcaagatttggatttcagtttcatggagatgaatccgtttacgctagtcgatggagagccatatcctttggacatgaggggagagttagatgacacagctgccttcaaaaatttcaacaagtggggagacattgagttccctctgccatttggaagggtcctgagtcctactgagagcttcatccatggtttagatgagaagacaagtgcgtctttgaagttcactgttttgaatcctaaaggtcgcatttggactatggtagctggaggcggtgctagcgtcatatatgctgatacggttggagatttaggttacgcatcagagctggggaactacgcagagtatagtggagcacctaatgaggaagaggtgttacaatacgctagagttgtcattgattgtgctactgctgatcctgatgggcgcaaaagagctcttctcattggaggtggcattgctaatttcaccgacgtggcagctactttcaacggtatcatccgcgctctaagagaaaaggaaacaagactaaaagcatcaagaatgcacatatacgtaagaagaggtggtccaaattaccagactggtttggctagaatgcgtgctctgggtgatgaactcggtgttcctctagaggtatatggaccagaagcaacgatgacaggaatatgcaagcgagccattgactgcatcatgttgcctgatgcatgatcaaccaaacctaagatatcttctccagttgaaaacagcagaccacgaactcggagctggacatttggaagtgtgtgtgtgtgttgatccctgttcttcgtatctctttctgcatatgaaaatgaaacgctctttgaaactttttattttgtgaatgtatgaatttgaaaaccagatcattgtgtgttgcctgtgtaaatttgtaatcaaacagtcgaaatccttttctgaaatgtacaaataatatatcactgctttgatttttataccaaagtgtacaaataactttataccaaatttttactcaccacgcaaaatcatacagcatcacacaacaattttatttaattttggtacaaagtgttttgaggtatcactcacacttgtgtctataaagcctcagaaagaagaaaagaaaaacacacaaggcgcacacaagtttcttcacaccaaatttcaaaaaaatcataacatgagaaaagataatacgatacaattacaggagagctgaagacaaacgttgcaactcaacaaatgggttgtctcagaagctttgagatgtgtagttgtatgtccattttgagagcgaacctgagaatatcaaagcatgatgtgaagtgagggatgtacgataaacactgactacggattgatccacctattcttcagtagcttcatcttcccactcaagtgtttcaaaccattcttcattgtattcatgtaggtcaaagtagtatgccctctccttgcttaatggaagctttttcagctttggacagtattttatttccattctcttcagacttggcaattccaaccgttcccagtagatactcttcagttcctccaaatcttctaagtaaatcgtatgtagttttctaaacggtacaatactcgaccccttgtttagtataccacagaccttttctctgcttataatttcttgcaactccggtgatggcccctctacgaatacaaccgcaagattcggagcaaagattaaccacgacaaatcctgtatacaactgacgacagatatgttgacatagccgaggttttggaagcatatggcacttgtacttgtgcatccatatctcgtatgatccattatatcagagatgatacacctttctatcatgatatagcgaaggctagtcatagccgtttcaaactgcaacggaccgtcttttgctacaactccatccagtgatatagcatcgatacatctagccaattgggggatacttaaaagacgttctaaaacaaccacatcattgatacttactcccaagcctttcaaattcttcagtaactttatatcctctatcaactccagacttaaaaaagtaccttcatgtaagaatagcatttctatatttaccaaacttgatatcacactgatgctttcaagagttcgtacgcctgtcaaataaaaatatctcaactgaatcaactttcccaatcctacaggcaagttctctagacttgtatgtgataagtcaagaaatcgcaagctcactaactttgaaacctcttctggcagcttggttagatttttgttgttagatagatccaaaaccactaacttaggcatcgatagaaaaaaatcacctgagatgttcaccagcttgttgtcttttaacaacaatgtggtcaggttaggacacaccggggatacatccccggcgatgttctgaatctcattttctgccagtgacatccttctcaccgcattccagtccctaacctcaggcatctgatgcagtccagctcctgtcttgacgataaatttctcttcctctttcccaaaattagacgcaacccaaagagccatttggcgaatcacatcatgcatttttacaaagtctaaagtgtcaacaggcatcaatagacatgcactaacgaggataccgattatcttataactctggttcatagctctttctctctctccatctccatctatgatcccttcggatacccagtactcgaccaactcgtctttataaatttctttatcttctggaaataaagcacaatactggaaacattgctgtaatgtctcgtccttaagatcatcatagctaagcttgagaattttaagaatctcatctctaacttctggatagttgtcggcatttgaatccagatcatcaatcgcacactgccactcacgtactgacgttttgtaggacattgtttccccaataacggtgagtgcaagtggtaagcctttacatttcgcacatatttgttttgctagctcgaggatctttggatcactgtctagtgtggtacctctaattttctgccggaatagttcccaagcattcttctggtctagttgcttgacttccaagtcatgagctcccatacgcccacaaacgtatttcgagcgagtggtaaacacaaccttgcttccattatctgctgagggaaatggaatcccaatctcttgtagtttcactttctcccatatgtcatctaacaacataacgaatcttttacttgtaagaacttcttttatacaagtggctttctccttttggtcttttttctcccactcctcgtcacagaggcctagtcttttaccgatctccttttggatcttttcaacttgtaggttttgagacaccactacaaatatcaccaccccaaactcatcttttttttcaagtaacttctcattgatttgtttgagaagtgtggtcttccctattccacccataccgtaaatacccaagattccaacttccttctccatgagaaggctccatgcatcttcgagcgtcttctctaaaccgactgtgcgttgagtgtctatatcatttacaccaggtggaagaatcctcctagccaccacctcgccacaaggttttgaggacaaaatacttcgtactttctccaacgtttcaaatacatttttaccataatgatatgttaaaaggaagttgctggagcagtacccgtacatagacaatctttcgatttctgaagtcctatcttcaagcagtttagtgacctttggttggatggctttgacttctgaaagccataccttaatttcttctagcgctcgcaaaccttttcgttcttccatctcgagttggttctgcaagtcatccttcattgctttgaggcgtctcgcaacctcttgcaaagcctcaagattatcttccagttcgagtatatacttggccttttcaagaaaaaaacttgttgcagcttgaaagccgtttgaaagtacgttccccatcgtgtttcaac

SEQ ID NO: 3032 - DNA, 1286 bp, Flaveria ramosissima
cagaaagaagatcagagagtatgattccaagaggcttttgaagcaaaacttgaaaacactcgccggaatcgaccttcacatttgctctgctcaggtgactgcatccacagactttactgatttgacagacaaagaaccatggctttcatcaacaaagctggttgtcaaacctgatatgctatttggaaagcgtgggaagagtggcttggttggattgaacttagatgtagctcaagttgccgattttgttaaagctcgtcttggtgctgaggttgagatcagtggatgtaaagcaccaataacgacatttattgtcgaaccatttgttccacatgatcaagagtattacttttctattgtctctgaaaggcttggtagcaccattagcttttcagaatgtggtggtattgatattgaagaaaactgggagaaggttaagaccgtgtttcttccaaccgaaaaacctatgacgctagagacttgtgctccattaattgctactcttccattagaggttcgagcaaaaattggcaatttcataatgggtgtgtttgccgtatttcaagatttagatttcacttttctagagatgaatccatttacgttggtaaacggagagcccttccctctggatatgaggggagagttggatgacacggcagcatttaagaacttcaaaaagtggggtaacatagagtttccattgccatttggaagagtcctaagctctacggagagtttcattcacacattagatgaaaaaactagtgcttctttaaagttcacagtgttgaatcctaagggacggatatggacgatggtggctggaggtggtgctagtgtaatatacgcagacacagttggagatttaggttatgcatcagaacttggtaactatgcagagtatagtggagctcctaatgaggaagaggtcttgcaatatgctagaattgtaattgattgtgctactgcagatcctgatggtcgtaaaagagcccttctaattggtggaggcatcgctaactttaccgatgtggctgccacttttagtggaattatccgagctcttagagaaaaggagtcgaagctgaaagcagcaagaatgcacatatatgttcgaagaggtggtcctaattaccagactggtttggcaaagatgcgtgcattgggagaggaactagggataccccttgaggtttatggacctgaggctacaatgacaggcatttgcaaggaagcaattgaatgcataatgtcataaaaataagacaacctggaagataagt

SEQ ID NO: 3033 - DNA, 1757 bp, Silene vulgaris
cactatacacatcagccatcacccaactaccattttacaacaaatagtatcgaactttcctcttcttgtacaccaaaactatcaaattttgtattttttttccctgtgaattgtaatttatagaatttgatttgcaaaaatggcaaggaagaagatcagagagtatgattcaaagaggattcttaagcaacaccttaaacgtattgccaacattgatcttcctatttgttctgctcaagtaacagaatcaacggacttcactcaattggtgaatgaagagacatggctatcctcctcaagattggttgtaaaaccggatatgctgtttggcaagcgtgggaagagtggccttgtggccttgaatttggatctagctcaagttgctgactttgtgaaagagcgagtaggaaaggaggttgagattggaggttgtaaggcaccggttacaacatttattgttgaaccatttgtaccgcacgagcaggagttttatctctcggttgtatctgaaaggcttggttgcactataagcttctcagaatgtggtggtattgagatcgaggagaactgggacaaggtgaagactatatttctaccatcagagaaatcgttgaccaacgaggcttgtgctccattgattgccacgcttcccttagagatacgggacaaaattggtgatttcatcaagggtgtctttgcagtgtttttggacttggacttcagttttcttgagatgaatccgtttaccttggttaatggggagccatatccattggacatgaggggcgaacttgatgatacagctgccttcaagaatttcaacaagtggggaaacatagaattcccattacctttcggtcgagttttgagtcccacagaaggttttattcatgctttggatgaaaagacaagtgcatccttgaaatttaccattctaaacccaaaaggacgtatttggaccatggttgctggaggtggcgcaagtgttatatatgctgacactgttggagatttgggttatgcatcagagctcgggaattatgctgagtacagtggtgcccctaatgaagaagaggtcttacaatatgctagggtggtcatagattgtgccactgcaaaccctgatggtcgtaaaagagccctgttgattggaggcgggattgccaactttactgatgttgctgccacatttagtgggatcatcagagctcttcgtgaaaaggaaacgaaactgaaagctgcaagaatgcatatctttgttcgaagaggaggtccaaattatcaaacaggtcttgcaaagatgcgtgcacttggagaggagcttgggatccctcttgaggtgtatggacctgaggctaccatgaccggaatttgcaagcaagcaatcgactgtattatggctaaagattaaccaacatttcgatcctctaaatctgcacgctgaacgcatgttgagaatgtacaagaggttatcatcctgaggacgacaccacaccttggacaaaaagtcgacaacaaaaaacacaaatgctttatattaatatgtgaagtactcttgagtttgtacgcttacgatttttcagacttggaaagttcaaagaaatgtattgaatccattttttagtgagttgatctgatcacggttttgagtatgacactagaaggtgtcatacaaaaacgatactcgaatcatagaattataaggaaacacatgatcaaccaacattctatcatctgtactggtgctcgataatctc

SEQ ID NO: 3034 - DNA, 1519 bp, Secale cereale
gcaggtcacacaatcaacggatttcacggagctttcaaaccaggagccatggctctcgtcgacgaagttggttgttaaacctgacatgctgtttggcaagcgtgggaagagcggccttgtagccctcaacctagaccttgctcaagtccgccaatttgtcaaggagcggttaggagttgaggtcgagatgggtggatgtaaggctccaattacaacattcatagtcgagccatttgtgccacacgatcaagagtattatctctcaattgtgtcagacaggcttggttgcaccattagtttctcagagtgtgggggtattgagattgaggagaactgggacaaggttaagacaatctttcttccaacagagaagccaatgacacttgatgcatgtgcaccattgattgccactcttcccttggaagtccgcacgaaaataggcgatttcattagagggtcgttttctgttttccaagacttggatttctcatttatggagatgaacccattcaccctggtaaatggtgaaccataccctctggacatgagaggtgaactggatgacaccgctgctttcaagaactttaagaagtggggtgacattgagttccctctacctttcggaagagtcctgagcccatcagaaagttatatccatgaactggatgagaagacaagcgcatcactgaaattcacagttcttaacccgaaaggtcgcatttggacaatggttgcaggtggtggtgctagtgtcatatatgccgacacggttggagatctgggatatgcttcagagctagggaattatgcagagtacagtggagctcccaaagaggaggaggttttgcattatgctagagtggttttggattgtgccactgctgatcctgatggccggaagagagctcttctcattggagggggtatagcaaacttcaccgacgtcgctgctacatttagtggcatcatccgggctttaagagagaaggaatccaaattaaaggctgcaagggtgaacatttatgttcgcagaggtggtccaaactaccaaactggactcgccaaaatgcgtgctctaggatcagagcttggtcttccaattgaggtctatggaccagaggccacaatgactggaatctgcaagcaagccattgattgcgtcatggccgaagcatgattcgtcattgtatagttctggtgtttacagttgtgtccattttgttccatatacatttagtatgaacaactattcgtgtgaagcaaacagagaaaaattggttttgtggggggtgaagaagctacagttgtgatgcaactacgaaataatatatatcctgctttgcggttctgattcctttgggccgaggcacaatgagatcaagataaatcgacccgacttctccagatttacagcgtttttggttatgttgtgtccgcaactgtggcttcaggctttcagggtgcgtgactttgtacccaccatttgtgaacaaaatgcagttgtaccttagcatcaaaa

SEQ ID NO: 3035 - DNA, 1740 bp, Flaveria ramosissima
aaaggttgataggggaaaatgagactaggtggtctcctcgatctactcgtcaactacatttgcatcaacccacccatcccctgtctctctgtacactcattccacctaccaactactcctactatcaaccaatcttatcttataagcaattccatcatcttccacacttgttcatatatccggacttgttctcgacatccaatcttaacaaaaatggcgagaaagaagatcagagagtacgattccaagaggcttttgaaggagaatttgaaaagacttgctggaatcgaccttcagatttgctctgctcaggtggatgcatccacagactttactgagttgacagacaaagaaccatggctttcatcaacaaaactggttgtcaaacctgatatgctattcggaaagcgtgggaagagtggattggttggtttgaacttagatgtagctcaagttgctgattttgtgaaagctcgtcttggtgctgaggttgagatcagtggatgtaaggcaccaataacgacatttattgtcgaaccatttgttccacatgatcaagagtattacttttctattgtctctgaaaggcttggtagcaccattagcttttcagaatgtggtggtattgatattgaagaaactagggagaaggttaagactgtgtttcttccaactgaaaacctatcacgctagagacttgtgctccattaatagctactcttccattagaggttcgagcaaaaattggcaacttcattatgggtgtgtttgctgtatttcaagatttagatttcacatttctagagatgaatccatttacattggtaaacgaagagcccttccctctggatatgaggggagagttggatgacactgcagcatttaagaacttcaaaaagtggggtaacttagagttcccattgccatttggaagagtcctaagctctacggagagcttcattcacacattagatgaaaaaactagtgcttcgttaaagttcaccgtgttaaatcctaaaggacgaatatggactatggtggctggaggtggtgctagtgtaatatacgcagacacggttggagatttaggttatgcatcagaacttggtaactatgcagagtatagtggagctcctaacgaggaagaggtcttgcaatatgctagaattgtaattgattgtgctactgctgatcctgatggtcgcaaaagagcccttctaattggtggaggcatcgctaacttcacggatgtggctgccacttttaatggaattattcgagctcttagagaaaaggagtcgaagctgaaagcagcaagaatgcacatatatgttcgaagaggcggtcctaattaccagactggtttggcaaagatgcgcgcattgggagaggaactagggataccccttgaggtttatggacctgaggctacaatgacaggcatttgcaaggaagcaattgaatgcataatgtcaaataagtaacctggaagataagtgtgtcttttattctttcagacttcaatgtgtggtgatcttaatcttgtaaggattgtcttttattcaagtacaaaaatctttaaattcaaattcaatgaagtaattaacaaataaaaaaagtacttaacagtagatataataaaatatgttacaactataacatactaaatacaatatagagcagtgttacaagatacatattacaaactacaaacaacactcgacctaccatgtactactg

SEQ ID NO: 3036 - DNA, 1341 bp, Beta vulgaris
cttctcttgtgaattctgaggaaaaaatggcaaggaagaagatcagagagtatgattccaagagacttctaaagcaacatctcaaacgaattgccaacatcgatttacccatttgctctgctcaagtaacaggatccacagactttactcaactggtgaacgacgagacatggctttcatcttcaagattggttgtaaaaccagatatgcttttcggtaagcgtggtaagagtggccttgtggctttgaatttggatttggctcaagtttcggaatttgtgaaagagcgcatagggaaagaggttgagattgaaggttgcaaggcaccggttaccacttttattgttgaaccatttgttccgcacaagcaagagttttatctctccatagtatctgaaaggcttggttgcaccttaagtttctctgaatgtggtggtattgaaattgaagagaactgggacaaggttaagaccgtatttttgccaacggagaaacctctgactagtgatacttgtgctccattgattgctacacttcctttggagatacgggataaaatcggggatttcatcaagggtgtctttgcagttttccaggatcttgactttagctttctggagatgaatccttttactttggttaatggggaaccatatccattggacatgaggggagaactcgatgatacagctgctttcaagaattttaaaaagtggggcgacttagagttcccattaccttttggccgagttttaagctctactgaaggttatattcattctttggatgaaaagacaagtgcatcattgaaattcaccattttgaacccaaaaggacgcatttggactatggttgctggtggtggtgcaagtgttatatatgccgacactgttggagacttgggttatgcatctgaacttgggaattatgctgagtacagtggtgctcctaatgaagaagaggtcttgcagtacgctcgcgtagttattgattgcgccacagcaaatcctgatggtcgtaaaagggctcttctgataggagggggtattgctaattttactgacgttgctgctacatttagtggaatcattagagccctcagagaaaaggaatctaaactgaaggcagcaagaatgcatctttttgtgagaagaggaggtccgaactatcaaacaggtcttaaaaagatgcgtgctcttggtgaggagcttggagtccctatcgaggtatatggccctgaggcaaccatgactggaatatgtaagcaagcaattgattgcattatgaaggattaagtttgtgttttaaagcattgtcatgttcaaaggaacatttacagat

SEQ ID NO: 3037 - DNA, 1568 bp, Chenopodium quinoa
aaagcactgcacctaacaacttccgcccgctcaatcttcacccacaactcccatctacctctctctatttctctctccattttcctgtaatttgtgatttgaagatggcaagaaagaagatcagagagtatgattccaagagacttcttaagcagcatcttaaacgaattgctggcatcgatttacccatttgctctgctcaagtaacaggatccacagacttcactcaactagtgaatgacgagacatggctttcgtcttcaagattggttgtgaaaccagatatgctttttggtaagcgtggtaagagtggtcttgtggctttgaatttggacttagctcaagttgctgagtttgtgaaagaacgaattgggaaagaggttgaggttgggggttgcaaggcacctgttaccacatttatcgttgaaccatttatccctcacgagcaagagttttatctctccatagtatctgaaaggctcggttgcactgtaagcttctccgagtgtggtggtattgaaattgaagagaactgggacaaggttaagaccatctttttgccaacagagaaacccttgactagtgagacttgtgctccactgattgctacacttcctttggagacacgaggaaaaattggcgatttcatcaagggtgtctttgaagttttccaagatctggactttagtttccttgagatgaatccctttacattggttaatggggaacctttaccattggacatgaggggagaactcgatgatactgctgctttcaagaactttaaaaagtggggcgacatagagttcccattaccttttggccgagtcttaagctctactgaagactatatccattctttggatgagaagacaagtgcatcattgaaattcaccattttgaacccaaaaggacgcatttggactatggttgctggaggtggtgcaagtgttatatatgctgacaccgttggagacttaggttatgcatcagaacttggtaattatgccgagtacagtggtgctccaaatgaagaagaggtcctaaactatgctcgagtagttattgattgtgccacagcaaaccctgatggtcgtaaaagggctctattgataggagggggtattgctaactttactgatgtcgctgccacatttaacggaatcattagagccttgagagaaaaggaatccaaacttagggcagcaagaatgaatctgtttgttagaagaggaggtccaaactatcaaacaggtcttaaaaaaatgcgtgcacttggtgaggagcttggggtccctatcgaggtatatggccctgaggcaaccatgaccggcatttgcaagcaagcaattgattgcattatggctcaggaataaacaagtgtttgctatgtttaaatgaacaattttatatacatcttttttgaaagggataaacccgatacaaactgagaaattgttcgagaacatgagttttctgtcaatagacttcattactcaagtgtactacttcggttgtaactaagtgatgcttctatattgggaactagttttatgattttgttgatt

SEQ ID NO: 3038 - DNA, 1680 bp, Zostera marina
acagtttcaacaaccacgattgaaacattgatcctaagccccaacaaccacgatcgctatttcatctatttctttcacacatctctgtcgtgttagaaaaaacaaagagatctccgccttctgccagatctcaattcgactgacgacagcaatcggcaatggcgaggaagaagatcagagaatacgattccaagcgtctcctcaaggagcatctcaagagacttgcaggcatcgatctccagatcttgtccgctcaggtcacagaggcaaccgattttactcaacttgtcgatgctcagccatggctctcgtccacaaagctcgtcgtcaaacctgatatgctgtttgggaaacgtggcaagagcggtctcgttgctctaaatttggatatggctgaagtctcacacttcgttaaacaacgtcttggtgtagaggttgagatgggaggctgtaaagctcctattactaccttcattgtcgagccatttgttccacatgaacaagaattctacctttccattgtttctgagaggcttggttgcacgcttagtttttctgagtgtggtggtgttgaaattgaggaaaattgggataaggtcaaaactgtgtttcttcctactgacaaacctttgacattggaagcttgtgctccattgattgccaccctccgtctcgaggttaggggaataattggggatttcataaagggtgttttttctgttttccaagatttggacttcagtttcctagagatgaacccatttacaatagtggatggaaaaccatacccattggacatgcgtggagaacttgatgacactgctgccttcaaaaacttcaagaagtggggggatttagagtttccacttccttttggccgagtcttaagccccacagaagggtttatccatggactagatgaaaagacaagcgcttctctgaaatttactgttctaaattccaaaggaagaatttggacaatggttgccggtggtggtgcgagtgtcatatatgctgatacggttggagatttgggttatgcatcagagcttgggaattatgcagagtacagcggtgctccaaatgaggatgaggttctgcaatatgccagagttgtaattgattgtgccacagctgatcctcgtggtgaaaaacgagttcttcttattggtggtggaattgctaacttcactgatgttgctgcaacttttaatggaatcattcgtgctctgagggagaaggaatccaagttaaaagcatctagaatgcacatttatgtgagaagaggtggtccaaactaccaaacaggtttggcaaagatgcgacttctcggagaggagcttggagttccccttgaggtatatggaccagaggcaactatgactggtatttgtaagcaagctattgacactatcatgtctgcagcatgaacattttgtccattggaaatcagtaggtgagatgtctatgtttttcagttttctataccaacagttcgtgcaaactgaaaataaaagaaagggagccttttctaattatttatctaaacaattgcttttaagttatattgtaattgactaattgtttgtttattaaatgtaaaacagtattctaatgtgttggtaacgttaagtaaagactctatgctattaattaactaatcatacatagttaattctt

SEQ ID NO: 3039 - DNA, 7449 bp, Ricinus communis
ttatcataggtgcacttctctccgcaatgtttatgctgttcagcatacttaatcagctaagctgtcaagaaactggtatctgtatttgaactacagtggatggctgatcgtaatgctaatgtccgacctccgaatggcaagccttcaggaggcaccaatccttatttgattgatctggataattttactaaacggttgaaaatgctatatttgcattggagtgaaaacaacatcgaactttggggtgcttctgatgctcttgctgtagcaacacctcctccttctgaggatctgcggtacctgaagtcaactgcactaaatatctggctggttggttatgagttcccagagaccattatggttttcatgaagaagcaggtgcatttcttatgtagtcagaaaaaggcttctttgcttgatgttgtgaagaaacctgccaaggaatctattggtgttgaagttgtgatgcatgtgaagaccaaaagtgatgatggaagtagcttgatggataacattttcaatgctgtccatgcttctagcggtgacaaaactcctgtcattggacacatagcaagagaaagtccagaagggaagcttttggagatttgggataaaaagttgaagaatgggaattgtgaattaagtgatgtgacaaatgggttctcagacttatttgctgttaaggacaacactgaacttacatatgtgaggaaagcagcattcttgacttcatcggtgatgaagcagtttgtggtgccaaagcttgaaaaggtcattgatgaggagaagaagatcactcattcttcatttatggatgagacagagaaggcaattctagaacctgctagaattaaggtgaagctgaaggcagagaatattgacatttgttaccctccaattttccagagtgggggagagtttgatctgaaaccaagtgctgcaagcaatgatgataatctttactacgactccactagtgttattatatgtgcaattgggtcccgttataatagctactgctcaaatgttgctagaacttttctgattgatgcgaattccatgcagagcaaggcatatgaagtcctgcttagagcccaggaggcagcaattagcgcattgaaatctgggaaccaagttagtgctgtttatctagcagctctctctgtagttgagaaggatgcccctgaattagctgcaaacttgactaaaactgcaggaactggaattggccttgagtttcgcgagtcagggctgagtcttagctccaagaacaatagaattttgagaccaggaatggttttcaatgtgtcgcttggctttcaaaatttgcacacagagactaacaaaccaaagacgcagaaattttcagtgttacttgcagatacagtgattgttggtgaaaagctaccagatgtagtgacttcaaagagttctaaggctttcaaggatgtggcttattcattcaacgaggatgacgacgaagaagaagagctctcaaaagcgagagttgaagttaaaggtggtgaggccaccttgtcgaaggcaacactcaggtcagacaaccatgaaatgtcgaaggaagaactacgaaggcagcaccaggctgaacttgcccgccaaaagaatgaagagactgccaggaggcttgctggtgggggttcttctgcttcagataatcgtggttctgttaagatgattggcgacttgattgcatataagaatgtgaatgacctaccccctccaagagatttgatgattcaggttgaccagaagaatgaagccatcctaataccaatacatggaagcatggtcccattccatgttgccactgtcaagagtgtgtcgagccagcaggacagcaatagaacatgctacatacggataacatttaatgttcctggaacccctttcagtcctcatgatgcaaacactcttaagtttcaaggctcaatttatctgaaggaaatttcatttcgatccaaggactctagacacataagcgaagtggtacagcagattaaaaccctgcggcgacaggtcacttccagagagtctgagagagctgagagggcaacattagttactcaggaaaagctgcaacttgcatctaccaagttcaagcccataaaattgtatgatttatggattcgccctgtttttggtggtcgtggaagaaagctgactggttcactcgaagcccatgtaaatgggcttcgctattcaacttcaaggcctgatgaacgtattgatgttatgtacagtaacatcaagcacgcattcttccagccagcggataaggaaatgatcactcttctgcattttcatttgcataatcacataatggtagggaacaaaaagaccaaagatgttcaattttttattgaagtgatggatatagtccagacacttggaggaggaaagagatctgcctacgacccggatgagattgaggaagaacagcgagagagggatagaaagaataaaataaacatggacttccaaaactttgtgaaccgggtgaatgatgtttggggccaaccacaattcagaggacttgaccttgagtttgatcagcccttgagagagcttgggtttcatggggttcctcacaaagcctcagctttcattgtccctacatcaagctgtctggttgaactgatagagacacctgttgtcgtaatcaccctgagtgagatcgagatagttaatctggagagaattggtcttggacagaagaactttgatatgactattgtatttaaagacttcaagagggacgtccttcggatagactccattccatccacatcgctggacagcatcaaagagtggcttaacacaactgacctcaagtattatgagagcagactaaatctgaactggcggcctatattgaaaactatcactgatgatcctgaaaaattcatagaagatggtggatgggaatttttaaacatggaggttagtgactcagattctgagaactcagcagactccgatcatggctatgtgccttcagacgtgcaatctgactcaggatctgaagacgaggatgacggcagtgagtcactggtggagtctgaggatgatgaggatgaggactctgaggaagattcagaagaggatgaggggaagacgtgggaagagttggagagagaagcaagctatgcagacagggagaagggggatgactcagatagtgaggaagagagaaaaagaaggaagatgaaggcatttggtaaggctcgagcgccactatctcgggcaccaccgcctcgagcaccactatctcgggcaccactgcctcgagcaccaccatctcgggcaccaccgcctcgagcacctgatagaagaaattctgggggtagtcttcccaaaagacccaaattaaggtgaatgaagccatttgtcttcattagcacttttaaaggtaaactagcaggtgccgcatcgctagatatgatagttgcctaatctagctccgttgagattgttagaagatggatttattccacaatgcttggttactaggccggtatagtgtatataaatggattgtgcatcttctttcttcgagctagtttttgagaatgaattctatccaagtttatttatcatgatattagagctggctttttatctgcgacgataggtttggactcgatcccgtttgcatgtcacgttaaattttaggaggtattagaagttgtatttatgccaattacttggttactgggcacttatagtgtgtgcaagtggattgaatactctctttctttgcgctagcttttgaaaatgagttctattgagagagaaagcaaaagccggaaagatttttgttacatagctataaagcttgcatcttgatcaaatttgttgaagcataattgcttgtgaaatagtgggtaacttgttgaaatatagatttttgttccattgctattcagttttccttgtcttaatctttccatgtacaactatcttgattctctgtgttttcccttgccttgttatctgcataatctaggcatgttgccacgttgaacatttgtataaatcatggttgaaacaatcaatcttcaagttgaattaagatcaccaaagtgcattcaaaatcattcattcggcaccaagaaaattatttgcaggattgaaaattttataacttagaagagagcagaactatagattataacttattatacaaataatatatttaacaaaattttctttacagcttgacaaataggaaaaacactattaatcacacaggaaaactactgaattaaattaagaaattctgaattttgaaattatcagattttgttatgagataataacaattgtttgctaacttatacctcctatccaacttaggactctataatttgcttacaattttatttggcttctcaaagaagaaccacgcttgagagaaatgaaggcaaggaacaagatccaagagtgtaggtacgctctttaatatttggtactgttaactctttttcaattttaccttaatagccaaaatattgatttgattgtgtgtttagttgtggtttggagaaaaaaagaaacaatagtagtggataggtggaggatgttgtaattgaagcagccaagttccattatatgaaaggatgtgattctctatatcttttagggtaatttgatcgatgctggttagcagaatttcaaatagatgctatagagaatgcacaatgaattagtagcttatgtttctctcatacagacttgcactattgaaagcttgatattgcaaaaaggagagaaagctaccaataagaggcattaaaatccaaagtatctgttaaatgccattaaacttcagattctatggtatcatcaatgcatcacacatgcacctgctcgttttgtttgtcatatgagcatatctaattacactattctttgtttttgcatacaaggaaaaatgaatcctaattcagttaaatccactttgtctagtttagcctttggcaatgtaatagcagctgctgcttgcaatcatcagaaggtaaatgctgtttaataaaattgcgacgtccctctcttgtttaaaccaattattcatcttaaataacctaatttaattaggtagattacctggtaaacaattctatgtcaaagaaattcatcgccatggtttttatgacgctaaaagaaaagcatatatttagcctcagaaattcgtttagttgtcttgatatcttttatatcctagtcattgggtaaaacttgcctacatgtcttttagaaacaatctatatagcgaatctcggtaaggtaaagtagaggtctaaatgccaataagggttggtattttcccttgtgaagattggagaaggtttcgaatttcaagtctctccatccaccatctaccaactccagctgttgttagtcacctctatgatatcattgaacaccctgcccccggcaaaaaaaaaaaaaaatgctaatgtttttctttttcctgagtttccttttgtgtctgttttagaaactttatgtctattttgaacttgggatttgtgtgtattagactatagacccaaataaaaatatagaactaggttgtttaagttacatcctgtactatatagtccattatgaatgtgcatgttgattttgcaggaatttctcactcaagagaagacacactggcagcaagttctatcaactaagaggttgaccttgatgagttgatggatgaaagatttaatggtgtgcctgcatcatttctgcattgctttgcatgcaatcatctcttatgtttttttaattgtggaggtttattgcatttcatgtgaaggattttgaactggataaactgcaggcggacatgattgcagctcttaaggtaattagtttaaaaattgtatgatttattgcatgcagctcttgggtgaagtcaccggcagtgagcacatgatttgccatttctaccacagagagttctatcatgcaagtaagggattgcaattgattagactcattgggctttaagatttgggaggaacaggtaacttcaccacaaaaacaaatggagattcttctgataaagaaaggtaaacgtccagtttgctatgcaattagcagttctatggagaaaagtctcatcttacagatacataatcagtgagaagaaagataatgaagacgatgattatcacggaagcaagcaggcgaaggacaaacaaaaaatggctagaaagaagattagagagtatgattcaaagcgacttcttaaagaacacctgaaacgccttgccggtcttgatatccagatctgctctgctcaggtgactgagtctacagactttacagagttaacaaatcaagaaccatggctttcttcatcgagattggtggttaagcctgatatgttatttgggaaacgtgggaagagtggtttggttgctttgaatttagatctagctcaagttgctgaatttgtgaaagcaaggcttggagttgaggttgaaatgagtggctgtaaggcaccaataactacattcattgttgaaccatttgttccacatgatcaagaattttacctctcaatagtctctgaaagacttggctgcaccattagtttttcagaatgtggaggtattgaaattgaagagaattgggataaggttaagactgtattccttcccactgaaaagcctatgaacttggaggcatgtgctccattgattgctacacttcctctggagattcgaggtaaaattggtgccttcataatgggagtctttgctgtctttcaagatctagatttcagttttatagagatgaatccttttaccctggttaatggagagccatatccactagatatgagaggcgaattggatgacactgctgcttttaagaactttaagaagtggggtaacatagagtttcctcttccctttggaagagttctgagtcctactgaaagcttcattcattcgctggatgaaaagacaagtgcatctttgaaattcactgttttgaacccaaaagggcgtatctggacaatggtagctggaggtggtgccagcgtaatttatgccgacactgttggagatttgggttatgcatcagagcttggcaactatgcagagtatagtggagctcctaatgaggaggaagttttacaatatgcaagagttgtaattgattgcgccactgctgatcctgatggtcgaaagagagcccttctaattggaggtggcattgctaacttcacagatgttgcagctactttcaatggtatcatacgagccctcagagaaaaggaatccaagttaaaagcagcaagaatgcacatctatgttcgaagagggggtccaaactaccagactggtttggcaaagatgcggactctgggagaagaggtgggagtgccacttgaggtatgaaataatagtctgctctttt

SEQ ID NO: 3040 - DNA, 1631 bp, Lupinus angustifolius
ttcataacttcatatcacctttgacactttcatagcatctcttccactatctttcactctttgaccctttaactctttttcctcaaatggctagaaaaaagatcagagaattccactccaagaaactcatcaaagaacatctcaaacgcattgcttcaattcatcttgataccctttcagctcaggtgacagaatcaactgattttactgagttgacaaaacaatatccttggatttctacgaccaagttggttgtgaagcctgatatgttgtttgggaaacgtggaaagagtggtttagttgctcttaatttagatatagcccaagtggctaaatttgttaatactcgccttggtgttcaggttgagataggtggttgcaaggcacctataactacattcattgttgaaccatttgtgcctcatgatgatgagtattacctctctattgtttccgaaaggttggggtgtaccataaacttttctgaatgtggaggcatagaaattgaagagaattgggataaggttaaaactatattccttccaacagagaaaactatgactctagaagcatgtgcaccattgattgctacacttcctttggagattcgaggaataattggcgatttcataatgggggtgtttgctgtctttcaagatctggacttcagttttctcgagatgaatccgtttacactggtgaatgagaagccatatccgttggatatgagaggggaactagatgacactgctgcattcaagaacttcaacaagtggggcaagatcgagtttccgttgccttttggaagagttctgagccctgccgaaagcttcattaattctttcgatgagaagacaagtgcatccctgaaatttacggtattaaacccaaaaggacgcatctggacaatggtagctggaggtggtgcaagcgttatttatgccgatactgttggagatttaggctatgcatcagagcttggaaactatgctgagtacagtggagctccaaatgaggacgaggtgttgcagtatgcaagagtcgtaatcgattgtgctacagcagaccccgatggccgtaagagagcccttcttattggaggtggcattgcaaacttcaccgacgttgctgccacattcagtggtattattcgagcgctgaaagagaaggaatcgaagcttaaagcagcgagaatgaacatctatgttagaagaggtggtccaaactatcagactggtttggcaaaaatgtctgcattgggcgaagaattgggactaccaattcaggtttatggaccagaagccacaatgacaagtatatgcaaacaagctattgattgcatcatttctgaagcataaagcagaatactgacactgtttatgagacaaaaaagaataatattgaaaaaggggatgtgtttgcatgcatgatattttacttttgtctttaattctgagtgattttattgctatattttggaccaaaatatagctatgacatgataaaatcccctaaagtaatttgtgaatgatatgattttagtttatggtgtttcctaccatgttatttatacaactatatgttattatgtaaatggaacaaactggacattcattttaaactttatttat

SEQ ID NO: 3041 - DNA, 1419 bp, Flaveria ramosissima
ccaacaacatttgcatcaacccacacacgacccatctcccttctctctctacactcattccacctaccaactgcaatcaaccataccaatcttatcttctaagcaattccatcaacttccacacctgttcatatatatacatatatattcagattcagatttcctcctcttcatataacttgaactaaaatggcgagaaagaagatcagagagtatgattccaagaggcttttgaagcaaaatttgaaacgactcgccggaatcgaccttcacatttgctctgctcaggtgactgcatccacagactttactgatttgacagacaaagaaccatggctttcatcaacaaagctggttgtcaaacctgatatgctatttggaaagcgtgggaagagtggcttggttggattgaacttagatgtagctcaagttgccgattttgttaaagctcgtcttggtgctgaggttgagatcagtggatgtaaagcaccaataacgacatttattgtcgaaccatttgttccacatgatcaagagtattacttttctattgtctctgaaaggcttggtagcaccattagcttttcagaatgcggtggtattgatattgaagaaaactgggagaaggttaagaccgtgtttcttccaaccgaaaaacctatgacgctagagacttgtgctccattaattgctactcttccattagaggttcgagcaaaaattggcaatttcataatgggtgtgtttgccgtatttcaagatttagatttcacttttctagagatgaatccatttacgttggtaaacggagagcccttccctctggatatgaggggagagttggatgacacggcagcatttaagaacttcaaaaagtggggtaacatagagtttccattgccatttggaagagtcctaagctctacggagagtttcattcacacattagatgaaaaaactagtgcttcgttaaagttcacagtgttgaatcctaagggacggatatggacgatggtggctggaggtggtgctagtgtaatatacgctgacacagttggagatttaggttatgcatcagaacttggtaactatgcagagtatagtggagctcctaatgaggaagaggtcttgcaatatgctagaattgtaattgattgtgctactgcagatcctgatggtcgtaaaagagcccttctaattggtggaggcatcgctaactttactgatgtggctgccacttttagtggaattatccgagctcttagagaaaaggagtcgaaactgaaagcagcaagaatgcacatatatgttcgaagaggtggtcctaattaccagactggtttggcaaagatgcgtgcattgggagagggactagggataccccttgaggtttatggacctgaggctacgatgacaggc

SEQ ID NO: 3042 - DNA, 1746 bp, Amorphophallus konjac
gagcacctgaagaggctcgccgggatcgatctccagatctgctcgcccaggtcacggcgtcacggacttctctgagctgacagacagggagccatggctttcctccaatagattggttgtcaagcccgacatgctgttcgggaagcgtgggaagagcgggttggtggctctgaacttggatctagcgcaggttgcgcagtttgtgaaacagcgcctcggcgtagtggttgagatgggtggatgcaaggccccaatcaccacattcatcgtcgagccatttgtcccacacgaccaggaattttatctttccatggtctccgagaggattggttgcaccataagcttttccgaatgtggtgggattgaaattgaagagaactgggataaggtaaagtcaatatttcttccaaccgagaagcctatgacttctgaagcatgtgctccgctgattgcaacacttcctttggagattcgagggaaaattggggatttcatcaagggtgcttttgctgttttccaagaccttgactttactttccttgagatgaatccatttacattggtgaatggtgaaccatatccattggatatgcgtggagaattggatgacacagctgccttcaagaacttcaaaaagtggggaaacatagaatttccccttccttttggcagagtactgagtgctacagagagctttattcatggactggatgagaagacaagtgcctccttgaagttcactgttttgaaccccaaagggcgtatctggactatggttgctggtggtggtgctagtgttatatatgctgatacggttggagatttgggttatgcttcagagcttgggaattatgcagagtacagtggcgctccaaatgaagaagaggtcttgcagtattctagagttgtaatagattgtgctactgctgatcctgatggtcgcaagcgagcacttcttattggtggtggcattgcaaacttcactgatgttgctactacttttaatggcattattcgtgctctgagggagaaggaatcaaaactcaaggccgcaagaatgcatatctatgttcgaagaggtggtccaaactaccagactggcttggcgaggatgagagccctaggcgatgagctaggcattccctttgaggtttatggacctgaggccacgatgaccggaatttgcaagcaagcaatcaactgcatcatgtctgctgcatagggatgggagtctcaactctagtgctagtgatttctatctctaattgtgatcggcgttgtgagagaatcaaaagccgttctaaatatgagagggtgcagtctctagtttttgcaaatccttccatctccagctttctctgggctgtgaatcgggctgcttcagatcaatctacgacaccagtcgaggaaagttttgtcaccattcatgttcgtgaacaaaacctgtggaatcacggcagcaagcttcccgtatctattgttgtcacagttgggtttcattttcattttacttggtattattagtcaggtcaatcttgacttgcttgaataaaccggttggtataacttgacattgcctgggtaaatctttatgaaacctgatgggtcatgtgtgggccggcatggcttgttttatttcttcgatgtagtgaaatgtgtgttgctgcactgagttaaggactgcggttcacataaacaatggggttggaaacataagttttacggtttgcaggatgctaatttatt

SEQ ID NO: 3043 - DNA, 1338 bp, Humulus lupulus
tgctggtatcgacctccagatctgctctgctcaggtgaatgaagcaacggactttactgagctgacgaatcagcagccatggctttcgtccacaaggttggttgtgaaaccagatatgttgtttgggaagcgtgggaagagtggtttggttgctttgaacttggatcttgctcaggttgctgagtttgttaaagcacgtctgggaaaggaggttgagatgggtggctgcaaggcaccaataacaacttttattgttgagccatttgttccccacagtcaagagtattacgtttcaatagtttctgacagacttggctccaccattagcttttcagaatgtgggggtattgagattgaagagaactgggataaggttaagactatattccttcccactgaaaaatcattgacgctggattcatgcgctccattgatagctacacttcctttggaggtgcgagggaaaattggtgacttcttaatgggtgtctttgctgtatttcaagatctggactttagttttctggaaatgaatccttttacactggtcaacggagagccatatccactggatatgaggggggaattggatgacactgctgctttcaagaactttcaaagtggggaacattgaatttcccctcttttggaagagttctgagccctacagaaagctttattcatacattggatgaaaaaacaagtgcatctttgaaattcactgttttgaatccaaaaggacgcatctggacaatggttgctggaggaggtgctagtgttatatatgctgatactgttggagatttgggctatgcatctgagcttggtaattatgcagaatatagtggagctccaaacgaggaagaagtcttacaatatgctcgagttgttattgattgtgccactgcagacgctgatggtcgtaagagagcccttttaattggagggggcattgctaatttcactgatgtggctgctacttttaatgggattattcgtgctttaagggagaaggaatccaagctgaaggcagcaagaatgcacatctatgtacgaagaggtggtcctaattatcagactggtttggcaaagatgcgaactttgggagaagaacttggagtaccccttgaggtttatggaccggaagccacaatgactggtatctgcaagcaggcaatagattgcattatgtccacagcataaaatccaaacattgatctctgaatttgttgatgtgtgccgacataatgtagaaaaagatgtttgaactgtgaattgcttacttgtttctttttgctgaaataataagaaactataaaaggaaaaacttaaacaaaa

SEQ ID NO: 3044 - DNA, 1435 bp, Distylium racemosum
cattcctgattcccgatccacccggatctcgataagtatataatattctcaacaccaattatggcgaggaagaagatcagagagtatgactcaaagcgtgtgttgaaggaacatttaaagaggctcactggaatgcagcttgacatcaaatctgcccaggtaacagaatcaacggacttcaatgaattggcagacagagagccatggctgtcgtcaactaggcttgtagtgaagccagatatgttgttcggaaagcgaggaaagagtggtttggttgctttaaatctggacttggcccaggttattgcctttgtcaaggaacggctaggaaaggaggttgaaatgggcggggcaaaggcacccataacaacattcattgtggagccattcgtacctcatgatgcagagttttatatatcaataatgtcagaacgccttggttcaactatcagcttctcagaatgtggaggcattgaaattgaagaaaattgggacaaggttaagacaatatttgtcccaacagagaagtctctcacatcagacttatgtgcacccttgattgcaacccttgcgctggaggtccgaggaaaaattgaggcttttataaagggaattttcaatgtatttctagatctggactttactttcctggagatgaatccatttacactggttaatggggagccttatcctctggacatgcgaggagaattggatgatacagctacctttaagaacttcaaaaagtggggtaatattgaattcccaatgccttttggtagagtcatgagccctgcagagagtgcgatacatagcatggatgaaaagacaagtgcctctctaaaattcactatcctgaattcaaagggtcgtatttggacaatggttgccggaggtggggcaagtgtgatatatgcagacactgttggagatctggggtttgccaatgaactcggaaactatgcagaatacagtggagctccaaatgaagatgaggtcttgcagtatgcaagagttttgatagattgtgctactgcaaatcctgatgggcgcaagagagcacttgtaataggtggaggcatagccaatttcactgacgttgcagctacctttagtggcatcattcgagccttgcgtgaaaaggagtccaagcttaaagcagcaaggatgaacgtatatgtaagaagaggtggtccaaattatcagaatggccttgcaaagatgcgtgctcttggtgaggagattggcgttccctttgaggtttacggaccagaagctagtatgactggcatctgcaaacaagctatacagtatatcacagctactgcatagattccaaaataaatcgtttccatatgatttggcttatgttcaatttgtcttcagtctgttagatttttgagatattgcctccagaaaagcaggagtacaaact

SEQ ID NO: 3045 - DNA, 1731 bp, Sequoia sempervirens
tgatttactctctaatctgattgggctctacggtggaaaatttttagttcagacttcagagcccaaaccagttgaatagatttcaacaatggcaaggaagaagattagagagtatgattccaagcgcctgttgaaggagcatctgaagagactcgccggaatgcaacttgatattaaatctgctcaggtaacagaatcaacagatttcaatgagttagctgacagagaagcatggttgtcctcaacaaaactggtagtgaaaccagatatgttgtttggaaagcggggaaagagtggtctggtagctctaaatctggacttagctcaggttgcttcctttgtcaaggaacgtctgggaaaggagattgagatgggtggtgcaaaggcacccataacaacattcattgtggagccatttgtacctcacaatgcagagtattatatttcaatagtctcagatcgccttggctcaaccataagcttctcagaatgcgggggcattgaaattgaagaaaattgggacaaggtaaagacagtgtttgtcccaacggaaaagcctctgacagcggaatcatgtgcacctttgattgcaacccttccattggagatccgaggaaaaattgaggcttttataatgggaactttcgatgtatttcaagatttggactttacttttctggagatgaatccttttacactggttaatggagaagcttaccctctggacatgcgaggagaactggacgatacagctgcctttaagaacttcaaaaaatggggtaatattgaatttccaatgccttttggtagagtcatgagcccctcagagagtgccatacatgccatggatgaaaagacaagttcctctttgaagtttactatcctaaatccaaagggacgcatctggacaatggttgctggaggtggtgcaagtgtaatatatgctgacacggttggggatctgggatttgccaatgaactcggaaactatgcagaatacagtggagctccaaatgaagatgaggtcttgcagtatgcaagagttttgatagattgcgctactgcaagtcctgatggccgcaaaagggcactagttataggtggaggcatagctaactttactgatgttgccgctacctttaatggtatcattcgagccttgcgtgaaaaggaatccaaactcaaagcagccaggatgcaagtatatgtaagacgaggtggtcctaattaccagaatggtcttgcaaagatgcgggcacttggaaatgagatgggagttccttttgaggtttatggaccagaggctagcatgacgggcatttgcaagcaggctatagattatatcacggcaagcgcatagattcaaaactgtttctacattgctagctttgttcgagttagatagtacctcaagaaaggctagagcatatgctctgagcatgtgcctaattatttttcaagttggttttataccttgcttatgttgttcagagttgccttgctatctaaacaaagaggcaatattggatgttaatttcttaatagcatgacattgagcatgatcaaatttgtattgaatattaatggatagtttgtagtcagtagaaatgaaatcagaatagacgctctgtttggaaattagcaaaaagaattaacttctaaggattggcctgaatgaatttttcccaatttagtctgaaatatttgagactgtcttacggtttgttttgc

SEQ ID NO: 3046 - DNA, 1695 bp, Podocarpus macrophillus
caagaaaggaaatcgtccgatttgtgggcggaattgcgaagtcatcccagcccctacctgttccacatccacccagatctacctctgtaagggagagatctcaatggcgaggaagaagatcagagagtatgactccaagaggctactgaaagagcatctcaagaggcttgctggaatgcagcttgatatcaaatctgcccaggtaacggaagcaaccgattttaatgagctagcagacagagagccttggttgtcatcaactaggcttgtagtgaagccagacatgttgtttggaaagcggggaaagagtggcttggtagctttaaatctggatttggcccaagtttacgccttcgttaaggagcgtctaggaaaggaggttgatatgggcggtgcaaaggcacctataacaacatttattgtagagccctttgtaccccatgatacagagtattatatgtctatagtctcggaacgccttggttctactataagcttctcagaatgcgggggcattgaaattgaagagaactgggacaaggtaaagacgatatttgttccgacagaaaagtctcttacatcagaattgtgtgcacccttgattgcaacccttcctttggagatccgaggaaaaattgaggctttcataaagggagttttcagcgtatttctagatttggactttactttccttgagatgaatccttttactctggttaacgaggagccatacccgctagacatgcgaggagaattggatgacacagcaggttttaagaacttcaaaaagtggggtaatattgaatttccacagccttttggtagagtcatgaacccctcagaaagtgcaatacatggaatggatgaaaagacaagtgcctctttgaaattcactattctaaatccaaaaggacgcatctggacaatggttgctggcggtggtgcaagtgtaatatatgctgacacggttggagatctgggatttgccagtgaacttggaaactatgcagaatacagtggagctccaaatgaagacgaggtgttgcagtatgcaagaattttaatagattgtgctactgcaaatcctgatggccataaaagagcacttgtgataggtggaggcatagctaacttcactgatgttgctgctacctttagtggcatcattcaagccttgcgtgaaaaggaatccaaactcaaagcagcaaggatgcaagtgtatgtcagaagaggtggtccaaattaccagagtgggcttgtgaagatgcgtgcccttggtaatgaaattggcgttccttttgaggtttatggaccagaagcaagtatgacaggcatctgcaaacaagctatagagtatatcacagccagtgcatagatccccacataaattatttctaaatatgctagtttttgtttttgccagggtgtccacaaactgtcttctagtctgtgagatgactttgatattgccaaacagaaaagctacagtacaacctctcattgattgcccaattattttgaagtcaactgtattcttaaggatattcttgttatcaaacacgaacaggcaatattgcattttgatgtgttaagcatgaggttttatcatgactgaatttgttatcaatattagtgaacacattattctcttttggaagtatttggaaacaagtggtctttagcttttggcaattg

SEQ ID NO: 3047 - DNA, 1553 bp, Euphorbia peplus
gaaattcaagtcttgatctttcttctcatttcagctctccccactacctaacttcccccccatcttctaccgtgagaaatggacgcgtaagaagatcagagagtatgattcaaagaggttgttgaaggagcatttcaagaggttttccggatacgaattgcctatcaaatcagctcaagttacagagtcgaccgattttcaagagctagcagccaaggaaccatggctttcatcagggaaactggttgtgaagccagatatgttgtttgggaaacgtggaaagagtggtttagttgccttaaacctagatctggctcaagttgcaggttttgttaaagaacgccttggcaaagaggttgagatgggtggatgtaaaggacctattactacattcattgttgagccattcatcccccataacgaagagttttacctgaatattgtctctgagagacttggctgcagcataagcttttcagaatgtggaggaattgacattgaagagaactgggataaggttaaaactatattcgttccaacaggagcatcatttacctcagaagtttgtgctccccttctcacaacgcttccattagaggtaaaaggagaaattggagagttcattaaagtggttttcagtctatttcaagatctagatttcactttcttggagatgaatcctttcacttttgttaatggaaagccgtatcccttggatatgagaggcgagctcgatgatactgctgctttcaaaaacttcaagaagtggagcaacattgaatttcctatgccatttggcagagttatgagcgctacagaacgttttattcatgggctagatgaaaagacaagtgcatcattgaaattcacagtcctgaatccaaagggaagaatttggactatggttgctggaggaggtgcaagcgttatctatgccgatacagttggagatctcggttttgcttccgaacttggcaactatgcagaatatagcggtgcccccaatgaagaggaagtgttacagtatgctagagtcgtgattgattgtgcaacttctgatcctgatggccgtaagagagcccttgttgtcggaggaggaattgctaacttcacggatgttgctgctacatttaatggcattatccgagccttgagggagaaggaatccaagcttaaagcagcaagaatgcacatatacgtaaggagaggcggtcctaattaccagagaggccttgcaaaaatgaggacactaggagaagaaattggcattccaattgaggtttatgggcctgaagcaacaatgactggcatatgcaaggaggcaattcagtgcatttctgcagctgcataagtagatgccaaactgctgctttgatgaaaatttgtgtgattttttgttttttttgcttgtgttgtttaaatctttagtagtaatttcttttgcaacagaaactcaacaaaattaatttgttagcatgttaatttccacaagaaaaaaaaggaaagtaaaatgttattttgactgttttcatgattaactaagagcttcctaa

SEQ ID NO: 3048 - DNA, 1415 bp, Panax ginseng
accagcaaccagctcagtgctcatcagtcatcacaaagtttcttgctaaagtcgcccaactaccactcctcgtcattccattttcccctaaatttctctctctgtcagttggggtttggtttttgcctttttggataaagaaatggctcgaaagaagatcagagagtacgattcgaagaggctcctcaaggaacacttgaagagactcgctgccattgatcttcagatctactctgctcaggtgactgaatccacagactttaccgagttaacaaacaagaaccatggctctcatctgcaaagttagttgtaaaacctgatatgttgttcgggaagcgtggaaagagtggcttggtagcgttgaatttagatttagctcaagttgctcaatttgtgaaagggcaccttggtgtggaggttgagatgggaggttgcaaggcaccaataaccacattcatcattgagccgttcattccgcatgaccaagaatattacctttccatagtctctgaacggctaggctgtaccattagcttttcagaatgtgggggcattgaaattgaagagaactgggacaaggtcaagacagtatttctcccaactgaaaagcctatgacactggaggcttgtgctccattgattgctacactcctttggagatctagatttcagtttccttgagatgaatccctttactttggtgaatggggagccataccctttagatatgcggggtggggcaagatagaatttcctctgccttttggaagagttatgagcccaacagaaagcttcatccactcgttagatgacaaaactagtgcatctttaaaattcaccgtcttaaacccaaaaggtcgcatctggacaatggtggctggaggtggtgcaagcgtaatatatgcagacaccgttggagatttaggttatgcatctgagcttggaaattatgcagagtatagtggagctcctaatgaggaagaggtgttgcaatatgccagagttgtgattgattgtgccactgcggatcccgacggtcgtaagagagctctcctcattggaggaggtattgccaatttcactgatgttgctgccactttcaatgggattattcgagccctcagggaaaggaatcaaagcttaaagcttcaaggatgcatatctatgttcgacgaggtggtcccaattatcagactggtttggcaaagatgcgtacccttggagaggaattgggagttccccttgaggtctatggacccgaagctacgatgactggcatttgcaagcaagcaattgaatgcgtcatggctgccgcatagtactttaccattcataatcttttcctccaagaaatgagaaatggtctgtgtttgttttggaaaacatgtttttcttttattttgtattgaaagtgc

SEQ ID NO: 3049 - DNA, 1459 bp, Brassica napus
tctcgctaacatcaacctccaaatccgctctgctcaggtgacagaagctacggatttcactgagttgaccaaccaggaggcatggctctcttccacgaagctagttgtgaagcctgatatgctgtttggaaaacgcgggaaaagtggtttggtagctctgaagctggatcttgctgaagttgcagagtttgtcaaagcccgcctcggttctgaggttgagatgggtggatgtaaagctcctatcactacattcattgtggagccctttgttcctcatgatcaagaatactatctttctgtagtgtctgataggcttggctgcactataagcttctctgaatgtggcggtattgaaattgaagagaactgggacaaagtgaagactgtgtttcttcctgcggaaaagccaatgacgcttgaagtatgtgctcctttgatagcaacacttcctcttgaggttagaggtaaaataggcagcttcataatgggcgtgtttgctgtgttccaagatttggatttcagttttttggagatgaatccttttacgctagtcgatggagagccatatcctttggacatgaggggagagttagatgacacagctgccttcaaaaatttcaacaagtggggagatattgaatttcctctgccatttggacgagtcctgagtccaacggagagctttatccatggtttagatgagaagacaagtgcttctttgaagttcactgttttgaatcctaaaggtcgcatttggacaatggtagctggaggcggtgctagcgtcatatatgctgatacggttggagatttaggttacgcatcagagcttgggaactacgcagagtatagtggagcacctaatgaggaagaagtgttacaatacgctagagttgtcattgattgtgctaccgctgatcctgatgggcgcaaacgagctcttctcattggaggtggcattgccaatttcacagacgtggcagctactttcagcggtatcatccgcgctctaagagaaaaggaaacaagactgaaagcatcaagaatgcacatttacgtaagaagaggtggtcctaattaccagactggtctggctagaatgcgtgctctgggtgatgaactcggtgttcctctagaggtatatggaccagaagcaacgatgacaggaatatgcaagcgagccattgattgcatcatgttacctgatgcataatcaaccaaacctattatgatctcttcttcagttgaaaacagcagaacacaaacgtggagttggagactgggaggagtgtatgtgttgaaccctgttcttcatctctctttctacatttgaaaatgaaaagctctttgaatcttttgcttgtgtgagtgtaatattgaaaaccaaatcattgtgtgttgtgttgcaaaaagtgtaagtaatcataacggtcaaaatccttgttttaagtgtacaaat

SEQ ID NO: 3050 - DNA, 1640 bp, Cycas rumphii
gattcccggcaacggctgccgggacccgttggccacgtgatttatgaaatcgacagggtttggttcgggagcagatataaagattcaacgcaagctcctcagggaccgtggagaaccaagccttcccagttgatgctcgggttctgagtttttatatcgagattctggtcattttcttaaggtttgggctttgttgagggaagcagacctcaaaaatggccaggaagaagatcagagagtatgattccaagcgcctattgaaggagcatctgaagaggcttgcagatgtgcagcttgacattcaatctgcacaagtaacagagtcaacagacttcaatgagttggctgacaaggaaccatggttatcctcaaccaggcttgtagttaagccagatatgttgtttggaaagagaggaaagagtggtttggtagccctgaatctggatctggcacaggttgctgcatttgtcaaagaacgccttgggaaggaggttgagatgggtggagcaaaggcgccaataacaacattcattgtggagccattcatacctcatgatgaagagtattatatttcgatagtgtcagaacgccttgggtcaactataagcttctcagcatgcggaggcattgaaatagaagaaaattgggacaaggtgaaaaccatatttgtccccacggaaaagactctttcaaacgagctttgtgcatctttgattgcaacgcttccattggaggtccgaggaaaaattgaggcctttataaagaatgtttacagcgtgtttctggatttggacttcacttttcttgagatgaatccatttacgttggtcaatggaaagccttatcctctggacatgcgaggagaacttgatgacactgctgctttcaagaacttcaaaaagtggggcaaaattgaatttccaatcccttttggtagagtcatgagtccttcagaaagcatgatacatgccctggatgaaaaaacaggtgcctctctaaagttcactattctaaatccaaaaggacatatctggactatggttgccggaggaggtgctagtgtgatatatgctgatacggtcggagatttaggctatgctagtgaacttggaaattatgcagaatacagtggagctccaaatgaggatgaagtgttacattacgcaagagttttgatagattgtgcaactgcaaatcctgatggccagaagagagcactagtgataggtggaggcattgctaactttacagatgttgcttctacctttagtggcatcattagagcattgcgtgaaaaggaagcaaaactcaaagcatcaaggatgcaagtatatgtgagaagaggaggcccaaattaccagagtggtcttgcaaagatgcgtgctcttagcgaggagattggggtcccttttgaggtttatggcccagatgcaagtatgactggcatctgcaagcaagcgattgactatatcacagctgcagcataatcacccatcattttttcttttgatttgccaactctatttgagctctggctgtgccttagcatgcattattttggatgtttattagccagttggacgtcttcctcttgaaggttgggaataaaatatctcaggaatgctttaattattttgcca

SEQ ID NO: 3051 - DNA, 1609 bp, Actinidia deliciosa
ttctagtgtaaattataaaaataaaataatcaaaacccaaaatttccaactataaaattgacccatcaagatctgaagttttcattttctctctgttctttctcgcacattcgtgtccatccatccgactctctgtcttacgtttcgagtagaaatggcacgcaagaagatcagagagtacgattccaagaggttgttgaaggaacactacaagaggctcgcgggagccgaactgggaattaaatctgcacaaattacagaatcaactgatgtcaatgagctagtggaaaaggagccttggctctcatcagagaaactggttgtgaaacccgatatgttgtttgggaagcgcggaaagagtgggctagttgccttgaatctagatttggctcaagttgctgtttttgtcaaagagcgcctaggcaaagaggttgagatgggaggatgcaaaggacccataacaactttcattgtcgaacctttcgtcccgcacaatgaagagttttaccttaatattgtgtcagaacgacttgggtgtagcattagcttttccgaatgtggaggaattgagatcgaagagaactgggacaaggttaagaccatattcgtcccttcaggggtgtcctttacatctgagacttgtgctccgcttattgcaacccttcccttggagatcaaaggggaaattgaagagttcatcaaagtgatttttgctctatttatagatctggacttcactttccttgagatgaatcctttcacattggttaatggaaaaccttatcctttggatatgagaggagaacttgatgatactgctgccttcaagaacttcaagaagtggggtaacattgaatttcctctgccattcggaagagttatgagttctacggagagctttattcatgggctagatgaaaagacaagtgcatcgctgaagttcacagttttgaacccaaagggacgaatctggacaatggtagctggaggaggtgctagtgtcatctatgcagatacggttggggatctgggctttgcttctgagcttggcaactatgctgaatacagcggggcccccaacgaggaggaggtgttgcagtatgcccgagttgtaattgattgtgcgactgatgatcctgatggccacaagagagcccttgtaatcggaggaggaattgctaactttactgatgttgccgctacatttaatggcataattagagcattgaaggagaaggagtcaaagcttaaggccgcaagaatgcatatatatgttaggagaggaggtccgaattaccaaaggggactcgcaaaaatgcgggctcttggagaggaaatcggcatccctatcgaggtttatggaccggaggcgactatgaccggcatttgcaaagaggcgattgagtgcatcactgcagctgcatgaatttatcaatcttgttattgattcccctctttttttcttctttttttcatgggaagtttccggtgttcaatgaagtgttggtacatgacaattgtacccccaacatcaggaagtttaagttgtatttttgacattgctataaatgggcaagaaataaaagtttctgacaaataaaaaaaaaaa

SEQ ID NO: 3052 - DNA, 1404 bp, Nicotiana benthamiana
aaagaaaacaaaaatggcccggaagaagatcagagagtatgattccaagagattgttgaaagagcatttcaagaggctagctggttatgatttggccatcaaatccgcccaggttacagaatcaactgatctgaatgagcttgtagagaaagagccatggctttcctcaacaaaattggtggtaaagcctgatatgttatttgggaagcgtggaaaaagcgggctagttgccttaaatcttgatctggctgaggttgcttctttcgtgaaggaacgtttaggcaaagaggtggagatgggtggatgcaaggggcccattacaactttcattgttgagccatttgtaccccacaatgaagagttctaccttaacattgtctcagagagacttggttttagtgttagcttttctgaatgtggaggaattgatatcgaagagaactgggacaaggttaagacaatctttttgccaacggggacatcctttacatcagagatttgtgcaccacttgttgctactctaccacttgagatcaaaggagtaattgaagagttcctcaaggtggtttatactttgtttcaagatctggacttcactttcctggagatgaatcctttcacgttggtcgaaggaaagccttatccactagatatgaggggagagcttgatgatactgctgcttttaagaacttcaagaagtggggaaatattgaatttccattgccatttggaagagtgatgagtgctacagagagctttattcatgggctagatgaaaagacaagtgcatctttgaagttcacagtcttgaaccccaaggggcgaatttggacaatggttgctggtggaggtgccagtgtcatctatgcagacactgtcggtgatcttggatatgcttctgagcttgggaactacgcagaatacagcggtgctccaaatgaagaagaggtcttgcagtatgccagagttgtaattgattgtgcaactgcagatcctgatggccgtaagagagcccttgtgataggtggtggaatagccaacttcactgatgttgctgccacatttagtggtataattcgagctttgaaggagaaggaatcaaaacttaaagctgcaagaatgcacatatatgtgaggagaggaggtccaaacttccaaaaaggtcttgccaaaatgcggtctcttggggaagaaattggcatcccaatagaggtatatggacctgaggcaaccatgactggtatctgcaaacaggctattgagtgcatcactgcagctgcatagaggaaccaactctgtattcttcaagcttaattgctttgcttattcttttctagctttgtgttagcatgatgttgtttgccaaagataaaagagatgtgtttgtatttttatgacttttt

SEQ ID NO: 3053 - DNA, 1224 bp, Allium cepa
acctattcttaccggaacctttattcagcacccgacccgttaaggagctgcaatggcgaggaagaagatccgtgagtacgattccaaacggattcttaaagaacatctcaagcgtatcgctaacatcgatctccagatcctctcagctcaggtgacaccgtccacagacttcactgaactagtggacaaagaacaatggctttcatcgatgaaacttgttgtaaagcctgatatgttgtttggaaagcgtgggaagagtgggctggttgccttgaatctggacatggcgcaggttgctcagtttgttaagcaacgccttggagttgaggttgagatgggtgggtgcaaggctcctattacaacattcattgttgagccattcgtgcctcacgatcaagagtattatctttcaattgtttctgagagacttggctgcaccattagcttttcagagtgtggcgggattgaaatcgaagaaaactgggacaaggttaagacaatatttcttcctactgagaaatccatgacaactgaggcgtgtgcccctctaattgctactcttccacttgagattcggggtaaaattggtgacttcattaaaggtgtttttgctgtattccaagatctggattttacttttctagagatgaacccatttacgttggtgaatggtgagccatacccattagatatgcgaggagaattggatgatacagctgctttcaagaattttattaagtggggagacattgaatttccacttccttttggtagagttttaagccctactgaaagatatattcatggacttgacgagaagacaagtgcctctctgaagttcaccattttaaatccgaaagggcgcatatggacaatggtagctggtggtggtgctagtgtcatatacgccgatacagtgggagatttaggctatgcttctgagcttggaaactatgcagaatacagtggtgctccaaatgaggaggaggttctgcaatacgccagagttgttcttgattgtgctactgcagatcccgatggtcgcaagagagctcttcttatcggtggtggaattgcaaacttcaccgacgttgctgctacttttaacggaatcataaaagctttaagggaaaaggagtctaagttaaaggcatcgagaatgaatatttttgttcgtagaggaggtccaaattatcaaactggtctggcaaaaatgagggcttt

SEQ ID NO: 3054 - DNA, 1657 bp, Castanea mollissima
ggcaagttggcaattataaatagaccaagccatagactcaaagatttcaaagttctttgtttctaaatttatcacaaacttcatattagtgagcttcctcctgcttctctttcatcggttagagagaaatcggaaggaaatggcacgcaagaagatcagagagtacgattccaagagattgttgaaagagcacttcaagaggctctctggccgtgaactacccattaaatcagcccaagtcacggaatcaacagatttcaatgagttagcccaaaacgaaccttggctttcgtcgatgaagttggttgtgaaacctgatatgttgttcgggaagcgtgggaagagcggtttagttgccttgaatctcgatttggctcaagttgctacattcgtgaaggagcgtcttggcaaagaggttgagatgggtggatgtaaaggacctattacaacattcattgtagaacctttcatcccacacaacgaagagttctatcttaatatcgtctcagatcgaattgggaatagcataagcttttcagaatgtggaggaattgaaattgaagagaactgggataaggttaagactatatttatcccaacaggagtgtctcttacgtcagaattatgtgctccacttgttgcaacacttcctatggagatcaaagtagagattgaggagtttatcaaaacagtttttacactatttcaagacctggatttcactttcctagagatgaatcctttcactttggtggatggaaagccttatcctttggatatgagaggcgagttggatgatactgctgctttcaagaactttaagaagtggggcagtattgaatttccaatgccatttggaagagttatgagtccttcagagagctttattcatggactagatgaaaagacgagttcttctttgaaattcacagttttgaaccctaagggacgaatttggaccatggtagctggaggaggtgcaagtgttatctatgcagatacagttggggatcttggctacgcttctgagcttggaaactatgcagaatatagtggagctcccaatgaagacgaagtgttgcaatatgccagagttgtacttgattgtgtaactgctgatcctgatggccgtaagagagcccttgtaattggaggaggaatagctaactttactgatgttgctgctacatttaatggtataattcgtgccctgaaggagaaggaatcaaaacttaaagcagcaagggtgcacatttacgtgaggagaggaggtcctaactaccagaaaggcctggcaaaaatgcgtggacttggagaggaaattggcatcccaatcgaggtttacgggcctgaagcaacaatgaccggaatatgcaaacaggcaatcgagtgtatcactgcagctgcataatcaactgctgaagatttgtctctgtagtacttttatttttattttcatggcaagtttcaggtgtctattaaatcttagttcgactttcttggtaccagaaacatcagcaaagtgtaattctatttgttaatgggccaaaaataatggtgtccgaagatctagatgtaatctgcctgatgttattgtgttacaataataatgagcttatattcccataaaaaaataataataatgagcttatattgt

SEQ ID NO: 3055 - DNA, 1384 bp, Vaccinium corymbosum
ccgggggttggcgttgaatctctctctcacacaccagtgcaaaaagcctcttcccactctctttcaaacggttgaagacaaatggcaaggaagaagatcagagagtatgattccaagagattgttgaaggaacactacaagaggctcgccggaaaggagttggcaattaaatcggcacaaatcacagaatcaactgatgtcaatgagctagtggagaaggagccttggctctcatcagagaaactggttgtgaaacccgatatgttgtttgggaagcgtggaaagagtgggctagttgccttgaatttagatttggctgaagttgctatttttgttaaagagcgacttggaaaagaggttgagatgggaggatgcaaaggacccataacaacttttattgtcgaacctttcgtcccacacaatgaggagttttacctcaatattgtgtcagaacgacttgggtctagtgttagcttttctgaatgtggaggaattgacattgaagagaactgggacaaggttaaaaccatatttctccccacaggggtggcctttacatcagaggcatgtgctccacttgttgcaacccttccattggagatcaaaggtgaaattgaggagttcattaaacaggtttttgctctattttcagatctggatttcactttccttgagatgaatcccttcaccttggtaaatggaaagccttatcctttggatatgagaggggaacttgatgatactgcggccttcaagaacttcaagaagtggggcaacatcgaatttcctatgccatttggaagagttatgagtcctactgagagctttattcatgggctagacgaaaagacaagcgcgtcattgaagttcacagttttgaacccgaagggacgaatctggacaatggtagctggaggaggtgctagtgtgatctacgcagatacagttggggatcttggctttgcctctgagcttggtaactatgctgaatacagcggagcacccaacgaagaggaggtgttgcagtatgccagagtcgtaatcgattgtgcaactgcagatcctgatggccaaaagagggcccttgtaatagggggaggaattgctaacttcaccgatgttgctgctacatttaatggcataattagagccttgaaggagaaggagtctaagcttaaagctgcaaggatgcatatatatgttaggagaggaggtccaaactaccaaaagggggctcgctaaaatgcggtcacttggagaggaaatcggcatccctcttgaggtttatggacctgaggcaacaatgactggcatatgcaaacaggcaattcagtgcatcactgcagctgcataggtttatcaatcttgttattgtgatcacttt

SEQ ID NO: 3056 - DNA, 1566 bp, Euonymus alatus
cggccgggggaatttcgggttcgttgttgtttgttagttgtggtcttgttaagtacccacctgccttcccatctctttcaacggtgattttaaggaatggcacgcaagaagatcagagagtacgattccaagagattgttgaaggagcatttcaagaggctcgctggctacgaattgcctatcaaatctgcacaggttacggaatcaacgaatttcaatgagctagcagagaaagaaccctggttttctagtgggaaacttgtggtgaagcctgacatgttgtttggaaagcgtgggaagagcggtctggtggccttaaatttggatctggcccaagttgctacttttgtgcgagagcgccttggcaaagaggtggagatgggtggatgcaaaggacctataacgactttcattgttgaacccttcatcccacataatgaagagttctatctcaacatcgtctcagatcgacttgggtgcagcatcagcttttcagagtgtggaggaattgaaattgaggagaactgggataaggtgaaaacgatatttgtcccaacaggggtgtcactaacaccagacgtaattgctccccttgttgcaacccttcccttagagatcaaaggagtaattgaggagttcatcaaagtggtttttgctctgtttcaagacattgacttcactttccttgagatgaatcctttcactttggttgatggaaagccttatcctcttgatatgagaggcgagctggatgacactgctgctttcaagaacttcaagaagtggggcagcatcgaattcccaatgccatttggaagagttatgagccctactgaaagctttatccatgggctagatgaaaagacaagtgcttctttgaaattcacagtgctaaatcctaagggaaggatttggactatggttgccggaggaggtgcaagtgtcatctatgcggatacggttggagatcttggttacgcttctgagctcggcaactatgccgaatatagtggagcacccaatgaagaggaagtattgcagtatgccagagttgtaattgattgtgcaacttctgatcctgatggccgtaagagagcacttgtaattggaggtggcattgctaacttcactgatgttgctgcaacatttaatggcataattcgagctttaaaggagaaggaatcaaagctcaaagcagcaaggatgagcatatatgtgaggagaggagggcctaactaccaaaagggccttgcaaagatgcgagcactcggggatgaaattggcatcccaattgaggtttatggtccagaagaaacaatgactggcatatgcaaacaggcaatagaatgtatcactgcggctgcataggttaccaactctttgagacaaatctatgctttagacttttcttgtctgctatttaggaagtgtgtatttgatctttatgaacattttctttgtaatagaaactgaggattcatcgtagttctgcaaatttgactgttggttgtggtggaattatccgtacaataaatggcataaattttattcaacatcctatgctgg

SEQ ID NO: 3057 - DNA, 1616 bp, Quercus alba
atagaccaagccatagactcaaagatttcaaagttctttgtttctaaatttatcacaaacttcgtattagtgagcttcctcctgcttctctttcaacggttagagagaaatcggaaggaaatggcacgcaagaagatcagagagtacgattccaagagattgttgaaagagcacttcaagaggctctctggccgtgaactacccattaaatcagcccaagtcacggaatcaacagatttcaatgagttagcccaaaacgaaccttggctttcatcgatgaagttggttgtgaaacctgatatgttgtttgggaagcgtgggaagagcggtttagttgccttgaatctcgatttggctcaagttgttacattcgtgaaggagcgtcttggcaaagaggttgagatgggtggatgtaaaggacctattacgacattcattgtagaacctttcatcccacacaacgaagagttctatcttaatatcgtctcagaccgaattgggaatagcataagcttttcagaatgtggaggaattgaaattgaagagaactgggataaggttaagactgtatttatcccaacaggagtgtctcttacgtcagaattatgtgctccacttgttgcgacgcttcctttggagatcaaagtagagattgaggagtttatcaaaacagtttttacactatttcaagacctggacttcactttcctagagatgaatccttttgctttggttgatggaaagccttatcctttggatatgagaggagagttggatgatactgctgctttcaagaactttaagaagtggggcagtattgaatttccaatgccatttggaagagttatgagtccttcagagagctttattcatggactagatgaaaagacaagtgcttctttgaaattcacagttttgaaccctaagggtcgaatttggaccatggtagctggaggaggtgcaagtgttatctatgcagatacggttggggatcttggctacgcttctgagcttggaaactatgcagaatatagtggagctcccaatgaagatgaagtgttgcaatatgccagagttgtacttgattgtgttactgctgatcctgatggccgtaagagagcccttgtaattggaggaggaatagctaactttactgatgttgctgctacatttaatggtataattcgtgccctgaaggagaaggaatcaaaacttaaagcagcaagggtgcacatttatgtgaggagaggaggtcctaactaccagaaaggcctggcaaaaatgcgtggacttggagaggaaattggcatcccaattgaggtttatgggcctgaagcaacaatgaccggaatatgcaaacaggcaatcgagtgtatcactgcagctgcataatcaactgctgaagatttgtctctgttgtacttctattttcattttcaagccaagtttcaggtgtctattaaatcttagttcgactttcttggtaccagaaacatcagcaaagtgtaattctatttgttaatggaccaataataatggtgtccgaagctctagatgtaatctgcctgatgttattgtgttacaataataatgagcttataccgttacatttttct

SEQ ID NO: 3058 - DNA, 1532 bp, Petunia hybrida
agtgcacacattttctacttacacattcagctaaagattctctaaatcaaacttctcttttttaacgatttttttgcaaaaatggccagaaagaagatcagagagtatgattcaaagagattgttgaaagaacatttcaaaagacttgctggttatgaattggctattaagtctgcacaggtgacagagtctactgatttcaatgagctaacagagaaagagccatggctcagctcaacaaagttggttgtcaagcctgatatgttatttgggaagcgtggaaagagtgggctagtcgccttgaatcttgatcttgctcaagttgctgctttcgtgaaggagcgccttggcaaagaggtggagatgggcggatgcaaaggtcccattacaaccttcattgttgagccatttgttccccacaatgaagagtattaccttaatattgtctccgagaggcttggttgcagcgtaagcttttctgaatgtggaggaattgacattgaagaaaactgggacaaggtcaagactattttcgtacccaccggaacttcctttacgtcagagatatgtgctccacttgttgccactctaccattggagattaagggtgtcattgaggagttcctgaaagtggtttatgcactatttcaagatctggacttcactttcctagagatgaatcctttcacattggttgaaggaaagccttatcctctggatatgaggggagagcttgatgacactgctgccttcaagaacttcaaaaagtggggaaatattgaatttccactgccatttggaagggttatgagtgctacagagagctttattcatgggctcgatgaaaagacaagtgcatctttgaagttcacagtcttgaaccccaaggggagaatttggacaatggttgctggtggaggagctagtgtcatctatgcagatactgttggtgatctcggatatgcttctgagcttgggaactacgcagaatacagtggtgttcccaatgaagaagaggtcttgcagtatgccagagttgtaattgactgtgccactgcaaatcctgatggccgtaagagagcccttgtgattggtggtggaatagccaacttcactgatgttgctgcaacatttagtggtattattcgagctctgaaggagaaggaatcaaaactgaaagctgcaagaatgcacatttatgttagaagaggaggtcctaactaccaaaaaggtcttgcaaaaatgagggctctcggtgaggaaattggcatcccaattgaggtctatggacctgaggaaaccatgactggtatctgcaaacaggctattgagtgcatcactgcagctgcataaagcaaccaacctcattctccaagctgaactattttagttgtcttttttgctttgtgttagtgtcttgttgtatgccaagtataagcaattcgatttgtatctttgacatttcacataaatgggccatgaacaatgagctctagtaatgaattttattttccactttctgcatgaagtcc

SEQ ID NO: 3059 - DNA, 1491 bp, Tripterygium wilfordii
cttctcaaggtgatttaacggaatggcacgcaagaagatcagagagtacgattccaagagattgttgaaggagcacttcaagaggctcgctggctacgaattgcctatcaaatctgcacaagttacggaatcaacggatttcaatgagctaacagagaaagaaccctggctttcttccgagaaacttgtggtgaagccggacatgttgtttggaaagcgtggaaagagcggtctggtggccttaaatttggatctggcccaagttgctacttttgtgaaagagcgccttggcaaagaggtggagatgggtggatgcaaaggacctataacgacattcattgttgagcccttcattccacacaatgaagagttctatctcaacatcgtctcagatcgacttgggtgcagcatcagcttttcagagtgtggaggaattgaaattgaggagaactgggataaggtgaaaactatatttgtcccaacaggggtgtcactaaccccagaagtaattgctccccttgttgcaactcttcccttagagatcaaaggagtaattgaggagttcatcaaagtggtgtttactttatttcaagacattgacttcactttccttgagatgaatcctttcactttggttgatggaaagccttatcctctggatatgagaggcgagctggatgacactgctgctttcaagaacttcaagaagtggggcagcattgaattcccaatgccatttggaagagttatgagccctactgaaagctttatccacgggctagatgaaaagacaagtgcatctttgaaattcactgtgctgaaccccaagggaaggatttggactatggttgctggaggaggtgcaagtgtcatctatgcagatactgttggagatcttggttacgcttctgagctcggcaactatgccgaatatagtggagcacccaatgaagaggaggtattgcagtatgccagagttgtaattgattgtgcaacttctgatcctgatggtcacaagagagcccttgtaattggaggtggcattgctaacttcactgatgttgctgctacattcaatggcataattcgagctctaaaagagaaggaatcaaagctcaaagcagcaaggatgagcatatatgtgaggagaggagggcctaactaccaaaagggcctcgcaaagatgcgagcactcggggatgaaattggcatcccaattgaggtttatggaccagaagaaacaatgactggcatatgcaaacaggcaatagaatgtatcactgcagctgcataggttaccagctcattgagacaaatctctgctttcagcctttctgctatgctatttaggaagtgggcatttgatctttattaccattttctttgtaatagaaactgaggaatcatcgtagttctacaaatttgactgttgcctgtgatggcgttgtccgcacaataaataaatggcataagtttttattcaatctagtc

SEQ ID NO: 3060 - DNA, 1516 bp, Valeriana officinalis
gaaactcagccatacccagtctgttactactccattacttcccctcttttgcatctgaacgatcgagaagaaatggctcgcaagaagattagagagtacgactccaagaggttgttgaaggagcactttaagagactctccggtgcggaattggcgatcaaatcggctcaagttacagaatcaaccgactttaatgagctagtagaaagtgaaccatggttgtcttcggcaaaattggtggtgaaaccagatatgttatttgggaagcgtggaaaaagtggtcttgttgccttgaatcttgatctggctcaagttgctcaatttgtgaaagaacgacttggcaaagaggttgagatgggaggatgcaaaggaccgataacaactttcattgtcgaaccatttgttccacataatgaagaattttacctcaatattgtctctgaaagacttgggtgtagcataagcttttcagaatgtggaggaattgacattgaagagaactgggacaaggttaagactatatttattccgacaggattgtctttgacatcagagatatgtgctccacttatagctactctacctttggagatcaaatctgtgattgaggagttcatcaaagtgatctttaccctattctctgatctggacttcactttcctagagatgaatcctttcacattggttgattcaaagccttaccctttagatatgagaggcgaacttgatgacacggctgctttcaagaacttcaaaaaatggggtaaccttgaatttccattgcccttcggaagggtaatgagtccaacagagagctttattcatcgcctagatgaaaagacaagtgcatccttgaaatttacagtcttaaacccaaagggacgaatctggaccatggttgctggcggaggtgcgagtgtcatctatgcagatactgttggggatcttgggtatgcttctgagctcggcaattatgcagaatatagtggagcaccaaatgaagaggaggttttgcaatatgctcgagttgttcttgattgtgcaactgcagatcctgatggtcgcaaaagagccctagttgtaggaggtggaatagcaaattttaccgatgttgctgctacattcaatggtattattcgtgccttgaaggaaaaggaatcaaagcttaaagctgcaagaatgcacatatatgtgaggagaggaggtccaaattaccaaaagggtcttgcaaaaatgagggaacttggcgaacaaatcggtattcctattgaggtttatggacccgaggaaactatgaccggtatctgcaaacaggcaattgaatgcatcaccgcagctgcataagtgtgtttaggtgaattgtgatttagatcgacattgttgtactccgaattgtggaaaagaaacgtttgaatttttctttatgaaccctaataaaatggtattcaatctttgtgctgcaatgtaatactgttttcgtttgcgcgtctctcttaaaaatgatttattttatagc

SEQ ID NO: 3061 - DNA, 1711 bp, Amaranthus tuberculatus
agtttgaagttcaaaaacaaagacaaaaatggcaaggaagaagatccgagagtatgattcaaagaggttattgaaggaacattttaagagaatttctggttcagaacttccgatcagatccgctcaaattaaagagtcaaccgatctcaatgagcttattgaaaatgagccatggctatcatccgaaaagttggttgtgaaacccgacatgttgtttgggaagcgtggcaaaagtggcttggttgcgctgaatttggacttcgcccaggtttctgcatttgtaaaagagcgccttggcaaagaggtagagatggggggatgtaaaggaccaattacgactttcattgttgagcctttcgttccacacaacgaagagttttacctaaatattgtttcagaaagattaggaaacagtgttagtttttccgaatgtggtggaattgagattgaagagaactgggataaggtaaaaactatatttgttccaactggcgtttcttttacttctgaagtctgtgctccgctagttgctactttacctttagaggtcagaggtgtgatcgaggagtttatcaaaaatatattcaccctgttcttagatctggacttcaccttcctagaaatgaatcctttcacattagtcaacggaaagccgtatcctttggatatgagaggcgagctagatgatactgctgccttcaagaatttcaagaagtggggtaatattgagttccccttgccatttggaagagttatgagtccaaccgaaacctttgttcacggtcttgatgaaaagacaagtgcatccttaaagttcacagtattgaatccaaagggaaggatttggaccatggtagctggtggaggagctagtgtaatctacgcagatactgttggagatcttggttatgcatctgagctgggaaactatgccgaatacagtggtgctccaaatgaagaggaggttttgcaatatgcaagagttgtgattgattgtgcaacagcaaatcctgatgggcgcaagagagccctagtaattggtggaggtattgctaattttacagatgttgctgcgactttcaacggaataattagagctctgaaggagaaggaatcgaaacttaaagcggcaagaatgcacatttatgtgaggcgaggaggtccaaattaccagaagggtttagctaaaatgcggatgctcggagaagagattggtattcctattgaggtatatggccctgaggcaaccatgactggaatctgcaaacaggccatcgattgtatcgatgtagcagcttaattctgatggacgcgtggagcatataaccgaccacaaggcctcattctatctgcttgtagtgatgattcaaatttactgtagacaatttagaattattacgaatttgatgatgtgtttgtagttttgtttcgtgttttattacagggaagccgaacaatcactggcactgtaatcccatctcatgcatttgtttactccgaaaatagaagccttccctgtttagcaacacttataaacaaaatataatagaagtgcctaagaggatttggttcgattttacttgcggatgatgatatgttgtgctgttttgcttctaccatcgaacatatgagccgtatgcttgcacttaagttcttgttgcgagtaaaaagtgcggaagaattatttattgttttattattgattttatac

SEQ ID NO: 3062 - DNA, 1481 bp, Ricinus communis
ttcttgttcttgctgtagctctcttaactacctaaaccattcagttttctcccgtttccttctattccaacggtttacaaatggcacgcaagaagatcagagagtatgattctaagagattgttgaaggagcatttcaagaggctttctggctatgaattgcctatcaaatctgcacaagttacggaatcaactgatttcaatgagctagcagagaaggaaccttggctttcttctgggaaactggttgtgaagcccgacatgttatttgggaaacggggcaagagtggtctggttgctttaaatcttgatctggctgaagttgctatttttgtgaaagaacgccttggcaaagaggtggagatgggtggatgtaaaggaccaataacaacattcatcgttgaacccttcatcccccacaatgaagaattttatcttaatatggtttctgagcgacttggttgcagcataagcttttcagaatgtggtggaattgaaattgaagagaattgggataaggtcaagactatatttgttccaactggagcatcgtttacttctgaagtatgtgctccacttgttgcaaccctcccattggagataaaaggagaactcgagcagtttattaaagttgtttttgctctatttcaagatcttgacttcactttcttagagatgaatcctttcactttggttgatggaaagccttatcccttggatatgaggggtgagctggatgatactgctaccttcaagaacttcaagaaatggggagacattgaattcccaatgccatttggaagagttatgagccccactgagagcttcattcatgggctagatgaaaagacaagtgcatctctgaaattcacagttctgaatccaaaggggcgaatttggactatggtggctggaggaggcgcaagtgtcatctatgctgatactgtcggagatcttggttatgcttccgagttagggaactatgctgaatacagtggagcccccaatgaagaggaagtattgcagtatgctagagttgtaattgattatgcaacttctaatcctgatggccgtaagagagcccttgtaattggaggaggaattgctaacttcactgatgttgctgctacatttaatggcattattcgagccttgagggagaaggaatctaagcttaaggcagcaaggatgcaaatattcgtgaggagaggaggtcctaattaccagagaggtcttgcaaaaatgaggatacttggagaagaaatcggcattcccattgaggtttatggccctgaagcaacaatgactggtatatgcaagcaggcaatcgactgcatcactgcggctgcataagtttcgcctccttagattaatctgtgttgttcttttctttcttttatcgtgggaaatttattaagtgttctttacatctttgtttgtactaggacatccaacaaagaaatgttaattagtgttcgaata

SEQ ID NO: 3063 - DNA, 1915 bp, Abies balsamea
gactcagatcttctcgctacctcacaaattggatttttttgattcagccattttggcatgaatgggaataccattgtattttattattattttaatatgaaacatgcaatttcactaagctcgccatctctgtggtccctggattttcacaaatcaattggtcaggggtagtcaggaatggtgggcgagagctaaacgtggtcaggttgcgttcttcaagttttgaaagcccacgtgattcttccaacccaggcttatttaatacctacaactcgtcctgaaaacacaggccgtgaaatttttgttgggtttctcagatttctccatcattttctccagataaaacagtgctatccacaatggcgagaaagaagattagagaatatgattccaagcgcctattgaaggagcaccttaagaggctcactggaatgcagctcgacatcaaatctgcccaggtaacagaatcgaccgatttcaatgaactagcagacaaagaaccatggctatcctcgagcagactcgtagttaagcctgacatgttattcggaaagcgggggaagagtggcttggtagccttgaatctggacctggcccaggttatctcatttgtcaaggaacgcctgggaaaggaggttgagatggggggtgcaaaggcacctataacaacattcattgtggagccatttgtgcctcatgatgatgagttttatttgtcggtcatgtcagagcgcctcggttcaaccataagcttttcagagtgcggaggcattgaaatcgaagaaaattgggacaaggttaagtcagtatttgttccaaccgaaaagtctctgacacctgacctatgtgcacccttgattgcaactcttccgttggagattcgaggcaaaattgaggcattcataaagggagttttcaatttatttatggacttggactttactttcttggagatgaatccttttacactggttaacggggagccttaccctctggatatgcggggagaattggatgatactgctgcatttaaaaacttcaaaaagtggggcagtattgaattcccattaccttttggcagagtcatgagtgcttcagagagtgcaatacatggcatggatgaaaagacaagttcctctctaaagtttactattctaaatccaaaaggacgcatttggacaatggttgctggaggaggtgcaagtgtgatatatgctgacacggttggagatttgggatatgcaaatgaacttggaaactatgcggaatacagtggagctccaaatgaagatgaggtgttacattatgcgagagttttaatagattgtgctactgcaaatcctgatggccgtaagagagcactagtgataggtggagggatagctaacttcacagatgttagtgctacctttagtggaatcattcgagccttgcgcgaaaaggaatccaaactcaaagcatcacggatgcaagtatatgtgagaagaggtggtccaaattatcagaatggtctcgcaaagatgcgtgcccttggtgagcagattggggtcccattccaggtttatggaccggaagctagtatgactggcatatgcaagcaagctatacaaaatataacggctacagcataaatttctcaagtaaactgtaaaatgcatcttgcagtttgctagcttgtttgaggatgattacgttgcttctgtccattaggcttctgggatgttgtctctggaaaaactgagcacaacctcccatgattctcttaagtattttgaagttggttatttgatctcttttgttactataacaaaagggcaatgttacatttctatgatcataagtataatttggatcatggttaggtttgtgatgaataaattaatagcttatatcaattttatttaaggttgagttt

SEQ ID NO: 3064 - DNA, 1735 bp, Ricinus communis
gtataaattctttaagacaaggaaccattttttttttcttatattcagtttttcttttcctttaccaataaaataagctgaacttcccactataaatacgctaaaaccagagacagagaagttcaagtcttttttgtgtttcttgttcttgctgtagctctcttaactacctaaaccattcagttttctcccatttccttctattccaacggtttacaaatggcacgcaagaagatcagagagtatgattctaagagattgttgaaggagcatttcaagaggctttctggctatgaattgcctatcaaatctgcacaagttacggaatcaactgatttcaatgagctagcagagaaggaaccttggctttcttctgggaaactggttgtgaagcccgacatgttatttgggaaacggggcaagagtggtctggttgctttaaatcttgatctggctgaagttgctatttttgtgaaagaacgccttggcaaagaggtggagatgggtggatgtaaaggaccaataacaacattcatcgttgaacccttcatcccccacaatgaagaattttatcttaatatggtttctgagcgacttggttgcagcataagcttttcagaatgtggtggaattgaaattgaagagaattgggataaggtcaagactatatttgttccaactggagcatcgtttacttctgaagtatgtgctccacttgttgcaaccctcccattggagataaaaggagaactcgagcagtttattaaagttgtttttgctctatttcaagatcttgacttcactttcttagagatgaatcctttcactttggttgatggaaagccttatcccttggatatgaggggtgagctggatgatactgctaccttcaagaacttcaagaaatggggagacattgaattcccaatgccatttggaagagttatgagccccactgagagcttcattcatgggctagatgaaaagacaagtgcatctctgaaattcacagttctgaatccaaaggggcgaatttggactatggtggctggaggaggcgcaagtgtcatctatgctgatactgtcggagatcttggttatgcttccgagttagggaactatgctgaatacagtggagcccccaatgaagaggaagtattgcagtatgctagagttgtaattgattatgcaacttctaatcctgatggccgtaagagagcccttgtaattggaggaggaattgctaacttcactgatgttgctgctacatttaatggcattattcgagccttgagggagaaggaatctaagcttaaggcagcaaggatgcaaatattcgtgaggagaggaggtcctaattaccagagaggtcttgcaaaaatgaggatacttggagaagaaatcggcattcccattgaggtttatggccctgaagcaacaatgactggtatatgcaagcaggcaatcgactgcatcactgcggctgcataagtttcgcctccttagattaatctgtgttgttcttttctttcttttatcgtgggaaatttattgagtgttctttacatctttgtttgtactaggacatccaacaaagaaatgttaattagtgttcgaataattaagagctgcttactttgtatttacaatctctcctgctttaccttaatgcaactttctaagccgactaaaatatagtcgttgagctaggccaacccatttgagctaggccaac

SEQ ID NO: 3065 - DNA, 1573 bp, Castanea mollissima
caattataaatagaccaagccatagactcaaagatttcaaagttctttgtttctaaatttatcacaaacttcatattagtgagcttcctcctgcttctctttcatcggttagagagaaatcggaaggaaatggcacgcaagaagatcagagagtacgattccaagagattgttgaaagagcacttcaagaggctctctggccgtgaactacccattaaatcagcccaagtcacggaatcaacagatttcaatgagttagcccaaaacgaaccttggctttcgtcgatgaagttggttgtgaaacctgatatgttgttcgggaagcgtgggaagagcggtttagttgccttgaatctcgatttggctcaagttgctacattcgtgaaggagcgtcttggcaaagaggttgagatgggtggatgtaaaggacctattacaacattcattgtagaacctttcatcccacacaacgaagagttctatcttaatatcgtctcagatcgaattgggaatagcataagcttttcagaatgtggaggaattgaaattgaagagaactgggataaggttaagactatatttatcccaacaggagtgtctcttacatcagaattaagtgctccacttgttgcaacacttcctatggagatcaaagtagagattgaggagtttatcaaaacagtttttacactatttcaagacctggatttcactttcctagagatgaatcctttcactttggtggatggaaagccttatcctttggatatgagaggcgagttggatgatactgctgctttcaagaactttaagaagtggggcagtattgaatttccaatgccatttggaagagttatgagtccttcagagagctttattcatggactagatgaaaagacaagttcttctttgaaattcacagttttgaaccctaagggacgaatttggaccatggtagctggaggaggtgcaagtgttatctatgcagatacggttggggatcttggctacgcttctgagcttggaaactatgcagaatatagtggagctcccaatgaagacgaagtgttgcaatatgccagagttgtacttgattgtgtaactgctgatcctgatggccgtaagagagcccttgtaattggaggaggaatagctaactttactgatgttgctgctacatttaatggtataattcgtgccctgaaggagaaggaatcaaaacttaaagcagcaagggtgcacatttacgtgaggagaggaggtcctaactaccagaaaggcttggcaaagatgcgtggacttggagaggaaattggcatcccaattgaggtttacgggcctgaagcaacaatgaccggaatatgcaaacaggcaatcgagtgtatcactgcagctgcataatcaactgctgaagatttgtctctgtagtacttttattttatttcatggcaagtttcaggtatctattaaatcttagttcgactttcttggtaccagaaacatcagcaaagtgtaattctatttgttaatgggccaaaataatggtgtccgaagatctagatgtaatctgcct

SEQ ID NO: 3066 - DNA, 1960 bp, Vigna unguiculata
tacatacattgcgagttgaatgaaagctgaagctaagactttggtccaaaggaaggagtagtaggtgggtgaccctccatgtgtgtgccttgttcttgcctaattcatcttcattctcacacttcaccaacccaaccaccctatcattctctttacaccctttccttcttcttcaacacaaattaaattagattattaaattaatcaaatcctgcactatatctatatatatatatatatatacacccaccacaaactctctccattcgttcactcctttgttagatctaagcacccaccacacccttttcctcatctaacgagtaagaaaaatggcgcgcaagaagatcagagagtacgactccaagaggttgttgaaggagcactttaagagactctgtggcaaggagttggcaatcaagtctgcacaaataaatgcttcaactgatttcactgagctacaagagaaggaaccttggctttcatcttctaaattggttgtgaaacctgacatgttatttggaaagcgtggcaaaagcggtttggttgctttgaatttggattttgcacaagttgtctcatttgtgaaagagcgtcttggaaaagaggttgagatgggtggatgcaaaggacccataacaactttcattgttgaaccttttgtcccacacgacgaagagttttaccttaacatagtctctgagagactcggcaacagcataagcttttctgaatgtggaggaattgaaattgaagataactgggataaggttaagactgtattcattccaactggggtgtctattacatcagaaattgttgccccacttgttgcaacccttcccttggagatcaagggagaaattgaggaatttctgagagtggttttcacgctgtttcaagatctggatttcactttcttagagatgaatcctttcacattggttaatggaaagccttatcctttggatatgaggggcgagctagatgacactgctgctttcaagaacttcaagaaatggggagacattgaatttccactgccatttggaagggttatgtctgccaccgagtctttcattcatggattagatgaaaagacaagtgcatctttaaaattcactgtgttgaacccaaagggccgaatttggacaatggtagctggaggaggtgccagtgtcatctacgctgatacagttggagatcttggttttgcatctgagcttggaaactatgctgaatacagtggtgcacccaaagaagacgaagtcttgcagtatgccagagttgtaattgattgtgcaactgcaaaccctgatggccaaaagagagctcttgtgataggaggaggcatagctaactttactgatgttgctgctacatttagcggtataattcgggctctgagagagaaggagtcaaaattgaaagcagcaagaatgaacatctatgtgaggagaggagggcccaactaccagaagggtctagctttaatgcgtgcacttggagacgagattggtatccccattgaggtttatggacctgaagccacaatgactggtatatgcaaagaggcaatacaattcattaccgcttctgcttaaggtctacaccaccaccttcatcatctatagtgttttccatggcaagtttgaagtgaacttgattcttaatttccatttctattcctgaaattcggaaatttaattagagtctatgtttatgaactcaagccatccaagtggccatgaatgttgtcattgtttttgtagaattgatggcacgacagataataaatagtgttttgtttaacatatatagtctatatatactttcttacccactctccattatttgattataatttgtcttattaaacttttttgcatattctagaacctaactgtatctgtatctttaatgtcagaaagtgaggggtaagagatataagtcatatatt

SEQ ID NO: 3067 - DNA, 1850 bp, Pinus pinaster
gggggggctctgactctggagttacacaaatcaatctggtcagggatagtcaagaatggtgggcaagggctaaaacgtggtcaggtcgcatttttcagactttggaagcccacgtgattcacccaacccaggcatatttaatacccagtgctcggtctaaaaacacaggccataaaatttttgctggttttttcatatttctctaccactttctctagataaacagtgatatcgacaatggcgaggaagaagattagagaatatgattccaagaggctattgaaagagcaccttaagaggctcactggatcgcaggtcgacatcaaatctgcccaggtaacggaatcaaccgatttcaatgaactagcagacagagaaccatggctatcttcaagcagacttgtagttaagcctgacatgttgttcggaaagcggggcaagagtggcttggtagccttgaatctggacctggcccaggttattgcgtttgtcaaggaacgcttgggaaaggaggttgagatgggcggtgcaaaggcacctataacaacattcattgtggagccatttgtacctcatgatgatgaattttatatgtcgatcgtgtcagagcgccttggctcaaccattagcttttcagagtgcggaggcattgaaatcgaagaaaattgggacaaggttaagtcagtctttatcccaacggaaaagtccctgacagctgagttatgtgcacccttgattgcaactcttccattggagattcgagtcaaaattgagaccttcataaagggagttttcaatttatttctggatttggacttcactttcttggagatgaatccttttacactggttaatggggagccttaccctctggatatgcgaggggaattggatgatactgctgcatttaagaacttcaaaaagtggggtgctatagaattcccattgccttttggtagagtcatgagtccttcagagagtgcagtacatggcatggatgaaaagacaagctcctctctaaagtttactattctaaatccaaaaggacgcatttggacaatggttgctggaggaggtgcaagtgtgatatatgctgacacggttggagatttgggatttgcaaatgaacttggaaactatgctgaatatagtggagctccaaatgaagatgaggtgttacagtatgcaagagttttaatagattgtgctactgcagatcctgatggacgtaagagagcactagtgataggtggagggatagcaaacttcactgatgttagtgctacgtttagtggaatcattcgagccttgcgtgaaaaggaatccaaactcaaagcatcacggatgcaagtatatgtgagaagaggtggtccaaattatcagaatggtcttgcaaagatgcgtgcccttggtgaggagattggggtcccattccaggtttatggaccggaagctagtatgactggcatttgcaagcaagctatagaaagtataacggcttctgcataaatttcccaagtaaattgcatcttgtagttggctatcttgtttcagggtggttacgttgcttctgtctattaggctgctgggatgttgtctctggaaaaaactgagcccagcctcccatgattctctttaagtatttggaagttgattctgtagtctgcttatttgctctcttttgctacgctaacaaaaggacaatgttgcatttttatggtcataaatatcatgtcgatcatggttagatttgtgaggaaaattaattgatagcttatttcagtttcatttagaaagttgaggacgagggatgttgtgtagtaataaccttggaataatccttaatatga

SEQ ID NO: 3068 - DNA, 1706 bp, Nicotiana benthamiana
tactatttttcaattagtccaatatttataatttccagcatccatctctgaaatcccatttcacagaactataaatagtggcagttgagacccaagatttcagcctgtactgtaagttgtaaatctttaataagtacatagcaaatattcaacttttgggttctcttttataacgaaaagaaaaatggcccggaagaagatcagagagtatgattccaagcgattgttgaaagagcatttcaagaggctagctggttatgatttggccatcaaatctgcccaggttacagaatcaactgatctgaatgagcttgtagagaaagagccatgggtttcctcaacaaaattggtggtaaagcctgatatgttatttgggaagcgtggaaaaagcgggctagttgccttgaatcttgatctggctgaggttgcttctttcgtgaaggaacgtttaggcaaagaggtggagatgagtggatgcaaggggcccattacaactttcattgttgagccatttgtaccccacaatgaagagttttaccttaacattgtctcagagagacttggttgtagtgttagcttttctgaatgtggaggaatagatatcgaagagaactgggacaaggttaagacaatctttttgccaacggggacatcctttacatcagagatttgtgcaccacttgttgctactctaccacttgagatcaaaggagtaattgaggagttcctcaaagtggtttatactttgtttcaagatctggactttactttcctggagatgaatcctttcacgttggtcgaaggaaagccttatccactagatatgaggggagagcttgatgacactgctgcttttaagaacttcaagaagtggggaaatatcgaatttccattgccatttggaagagtgatgagtgctacggagagctttattcatgggctagatgaaaagacaagtgcatctttgaagttcacagtcttgaaccccaaggggcgaatttggacaatggttgctggtggaggtgccagtgtcatctatgcagacactgtcggtgatcttggatatgcttctgaacttgggaactatgcagaatacagcggtgctccaaatgaagaagaggtcttgcagtatgccagagttgtaattgattgtgcaactgcagatcctgatggccgtaagagagcccttgtgataggtggtggaatagccaacttcactgatgttgctgccacatttagtggtataattcgagctttgaaggagaaggaatcaaaacttaaagctgcaagaatgcacatatatgtgaggagaggaggtccaaactaccaaaaaggtcttaccaaaatgcggtctcttggggaagaaattggcatcccaattgaggtatatggacctgaggcaaccatgactggcatctgtaaacaggctattgagtgcatcactgcagctgcatagagcaaccaactctgtattcttcaagcttaattgttttggttattctttctagctttgtgttagcatgctgttgtttgccaaagataaaagagattgatttgtatttttatgacatttcttttacataaacgagccatcagcaatagcttcatttcaaatcagttcagtatcgcagaaaattgctgctacatagcatgagaagcataaagaaatcctacatattaatatgaaacagttttaacaaactccg

SEQ ID NO: 3069 - DNA, 1545 bp, Olea europaea
ttcttttgacgggatttcgaagtacttttgacagttaaaatggcaaggaagaagatcagagagtatgattccaagagactgttgaaagagcatttcaagaggctttctggttctgaattggctgtcaaatctgcccaagttaccgagtcaactgatttcaatgagctggtcgacaaagaaccttggctctcatctacaaaattggttgtcaaacctgatatgctatttggaaagcgtggaaaaagcggtctagttgccttgaacctggatctggctgaagttgcagcttttgtgaaggaacggctcggcaaagaggtagagatggggggatgcaaaggaccgattacgaccttcattgttgaaccatttgttcctcacaacgaagagttctacctcaatatagtctctgagaggctgggttgtagcatcagcttttcagaatgtggaggcattgaaatcgaagagaactgggacaaggtgaagacaatctttgtgccaactggcgtatcttttacaccagagctatgtgctccacttgtggcaacccttcccttggagattaaaggtgtcattgaggagttcatcaaagtgatctatgctttgtttttagatttggatttcacttttcttgagatgaatcctttcaccttagtaaacggaaagccatatcctttggatatgagaggcgaactcgatgatactgctgcatttaagaacttcaaaaaatggggaaatattgaatttcctatgccatttggaagagtcttgagtgctacagaaagatttattcatggactagacgaaaagactagtgcatctttgaaatttacagttttgaacccgaaaggccgaatttggacaatggtggctggaggaggcgcaagtgtcatatatgcagatactgttggagatcttggttatgcctccgagttggggaactatgcagaatatagtggtgctcccaatgaagaggaggtcttgcagtatgccagagttgttatcgattgtgcaactgcagatcctgatggtcgtaaacgagcacttgtaattggtggtggaatagccaattttactgatgttgcttctacatttaatggcataattcgagctttgaaggagaaggaatcgaagctgaaggctgcaagaatgcatttatacgtccgaagaggaggtcctaattaccaaaagggacttgcgaaaatgagatctcttgcagaagaaatcggccttcctattgaggtgtatggacctgaagcaaccatgactggcatatgcaaacaggcaattgagtgcattactgctgctgcataaagctaccgtctccggttacaaactcttttgtaacttccttttccaatgcgtttcgccatttttgtaccccaaatacgaagggaattcaaaaacgtatttgaatttgacataaataagccttatgttatctaagcttgttattctttctcagttttctaatgaaatgcttacttcatttcctctttacttgtggtcaatccaataagagaacatgtttgatacataatattatag

SEQ ID NO: 3070 - DNA, 1892 bp, Picea glauca
tatgaagacatataataaaagctcaagctccatctgtgtggtctctggatttccacaaatcaatcgggtcaggggtagtcaagactggtgggcaagtgctaaacgtggtcaggtcgtattcttcaggctttggaagcccacgtgattcatctaacccaggcatatttaatacccactactcgccctgaaaacacaggccgtgaaattttcgttggatttctcatatttctccatcacctttctgtagataaaacagtgatatccactatggcgaggaagaagatcagagaatatgattccaagcggctattgaaagagcacctcaagaggctcactggattgcaggtcgacatcaaatctgcccaggtaacggaatcgaccgatttcaatgaactagcagacagagaaccatgggtatcctcgagcaaactcgtagttaagcctgacatgttgttcggaaagcgggggaagagtggcttggtagccttgaatctggacctggcccaggttattgcgtttgtcaaggaacgcctgggaaaggaggttgagatggggggtgcaaaggctcctataacaacattcattgtggagccatttgtacctcatgatgatgaattttatatgtcgatcatgtcagaccgccttggttcaaccattagcttttcagagtgcggaggaattgaaatcgaagaaaattgggacaaggttaagtcagtatttgtcccaaccgaaaagtccctgacagctgagttatgtgcacccttgattgcaactcttccattggagatccgaggcaaaatcgagaccttcataaagggagttttcaatttatttctggatttggacttcactttcttggagatgaatccttttacactggttaatggggagccttaccctctagatatgcgaggagaattggatgatactgctgcatttaagaacttcaaaaagtggggcaatattgaattcccattgccttttggtagagtcatgagtccttcagagagtgcaatacatggcatggatgaaaagacaagttcctctctaaaatttactattctaaatccaaaaggacgcatttggacaatggttgctggaggaggtgcaagtgtgatatatgctgacacagttggagatttgggatttgcaaatgaacttggaaactatgcagagtatagtggagctccaaatgaagatgaggtgttacaatatgcaagagttttaatagattgtgctactgcaaatcctgatggtcgtaagagagcactagtgataggtggagggatagcaaacttcactgatgttagtgctacctttagtggaatcattcgagccttgcgtgaaaaggaatccaaactcaaagcatcacggatgcaagtatatgtgagaagaggtggtccaaattatcagaatggtcttgcaaagatgcgtgcccttggtgaggagattggggtcccattccaggtttatggaccggaagctagtatgactggcatctgcaagcaagctatacaaaatataacagctgctgcataatttctcaaggaaattgcatcttgtagtttgctggcttgtttgaggatggttacgttgtttctgtctattaggctgctgggatgttgtctctggaaaaactgagcacaacctcccgtgattctcttaagtattttgaagttgattctgtagtctgcttattttctctcttttgctactatagcaaaagggcaatgttgcatttttatgatcataaatatcatgtggatcatggttagattttcgaggaatattacttgatagcttatatcaatttcatttagaaagttgagtacgagggaggttctgtcgtaataaccttggattaattgctaaagatgattcctttttcttat

SEQ ID NO: 3071 - DNA, 1995 bp, Picea glauca
gggcatgaattgaagtaccattgtattttattcttattctaatatgaagacatataataaaagctcaagctccatctgtgtggtctctggatttccacaaatcaatcgggtcaggggtagtcaagaatggtgggcaagtgctaaacgtggtcaggtcgtattcttcaggctttggaagcccacgtgattcatctaacccaggcatatttaatacccactactcgccctgaaaacacaggccgtgaaattttcgttggatttctcatatttctccatcacctttctgtagataaaacagtgatatccactatggcgaggaagaagatcagagaatatgattccaagcggctattgaaagagcacctcaagaggctcactggattgcaggtcgacatcaaatctgcccaggtaacggaatcgaccgatttcaatgaactagcagacagagaaccatgggtatcctcgagcaaactcgtagttaagcctgacatgttgttcggaaagcgggggaagagtggcttggtagccttgaatctggacctggcccaggttattgcgtttgtcaaggaacgcctgggaaaggaggttgagatggggggtgcaaaggctcctataacaacattcattgtggagccatttgtacctcatgatgatgaattttatatgtcgatcatgtcagaccgccttggttcaaccattagcttttcagagtgcggaggaattgaaatcgaagaaaattgggacaaggttaagtcagtatttgtcccaaccgaaaagtccctgacagctgagttatgtgcacccttgattgcaactcttccattggagatccgaggcaaaatcgagaccttcataaagggagttttcaatttatttctggatttggacttcactttcttggagatgaatccttttacactggttaatggggagccttaccctctagatatgcgaggagaattggatgatactgctgcatttaagaacttcaaaaagtggggcaatattgaattcccattgccttttggtagagtcatgagtccttcagagagtgcaatacatggcatggatgaaaagacaagttcctctctaaaatttactattctaaatccaaaaggacgcatttggacaatggttgctggtggaggtgcaagtgtgatatatgctgacacagttggagatttgggatttgcaaatgaacttggaaactatgcagagtatagtggagctccaaatgaagatgaggtgttacaatatgcaagagttttaatagattgtgctactgcaaatcctgatggtcgtaagagagcactagtgataggtggagggatagcaaacttcactgatgttagtgctacctttagtggaatcattcgagccttgcgtgaaaaggaatccaaactcaaagcatcacggatgcaagtatatgtgagaagaggtggtccaaattatcagaatggtcttgcaaagatgcgtgcccttggtgaggagattggggtcccattccaggtttatggaccggaagctagtatgactggcatctgcaagcaagctatacaaaatataacagctgctgcataatttctcaaggaaattgcatcttgtagtttgctggcttgtttgaggatggttacgttgtttctgtctattaggctgctgggatgttgtctctggaaaaactgagcacaacctcccgtgattctcttaagtattttgaagttgattctgtagtctgcttattttctctcttttgctactatagcaaaagggcaatgttgcatttttatgctcataaatatcatgtggatcatggttagattttcgaggaatattacttgatagcttatatcaatttcatttagaaagttgagtacgagggaggttctgtcgtaataaccttggattaattgctaaagatgattcctttttcttatgcaatttgtgttattttgctaattgaatgatatcaatgtggatttaaaaaaaaaaaaaaaa

SEQ ID NO: 3072 - DNA, 1560 bp, Tripterygium wilfordii
gcgaaggaggtccatttcaggtttggtgttagttgtggtcttcttaaggtacctaactaccacccacccgcacacctgcctttgcatttctttcaacggtgatcagcgaaatggcacgcaagaagatcagagagtacgactccaagagattgttgaaggagcacttcaagaggctcgctggttacgaattgcctatcaaatctgcacaggttacggaatcaacggatttcaacgagctaacagtgaaagaaccctggctttctaccgggaaacttgtggtgaagcctgacatgttgtttggaaagcgtgggaagagtggtctggtggccttaaatttggatctggcccaggttgctacttttgtgaaagagcgccttggcaaagaggtggagatgggtggatgcaaaggacctataacgacattcatcgttgaacccttcatctcacacaatgaagagttctacctcaacattgtctcagatcgacttgggtgcagcatcagcttctcagagtgtggaggaattgaaattgaggaaaactgggataaggtgaaaacaatatttgtcccaacaggggtgtcgctaacaccagaagtaattgctccccttgttgcaacccttcccttagagatcaaaagtgaaattgaggagttcatcaaagtggtttttactctgtttcaagacattgacttcactttccttgagatgaatcctttcactttggttgacggaaaaccttatcctctggatatgagaggcgagctggatgacactgctgctttcaagaacttcaagaagtggggcaacattgaattcccaatgccatttggaagagttatgagctctactgaaagctttatccatgggctagatgaaaagacaagtgcatctttgaaattcacagtgctaaaccctaagggaaggatttggactatggttgctggaggaggtgcaagtgtcatctatgcagatacggttggagatcttggttatgcttctgagctcggtaactatgccgaatatagtggagcacccaatgaagaggaggtattgcagtatgccagagttgtaattgattgtgcaacttctgatcctgatggccataagagagcccttgtaattggaggcggcatcgccaacttcactgatgttgctgctacattcaatggcataattcgagctttaaaagagaaggaatcaaagctcaaagcagcaaggatgagcatttatgtgaggagaggaggacccaactaccaaaagggtcttgcaaagatgcgagcactcggagatgaaattggcatcccaatcgaggtttatggaccagaagctacaatgactggcatatgcaaacaggcaatagaatgcatcactgcagctgcatagagtaccaactcaatgagacaaatctcttccttttcctttcttctctgctatttaggaagtgtgcatttgatctttacaaccatgttctctgtacttcaaacagaggaatcgtcctagctttacaaattggctgttggtggcggcgttatccgcgcaataaatttgattcaatctagtc

SEQ ID NO: 3073 - DNA, 1585 bp, Amsonia hubrichtii
tttctcgaatagaaaaattatttctcagacaaatcccacatggttggaactctccaactataaatatacaacacattcccatgatttctgtgtctttgtagctctgatctctctctacatcactgttagagtgccctgagattgcaaaagctttcttgctgtctgttccgacggttgcaaagaaatggctcgcaagaagatcagagagtacgattccaagagattgttgaaggagcatttcaagaggctctctggttatgaacttggcatcaaatctgcccaagttacagaggcaactgatttcaatgagctagtagagaaagaaccttggctgtcctcaacaaagctggttgtgaagcctgatatgctatttggaaagcgtggaaagagtggactagttgctctgaacctagatctggctgaagtttctggttttgtaaaggagcgacttggcaaagaggtggagatgggaggttgcaaaggccccattactacatttattgttgagccatttgtgccgcataatgaggagttttacctaaatattgtttctgaaaggcttggttgtagcataagcttttcagaatgtggaggaatcgatatcgaggaaaactgggacaaggttaaaaccatttttctgccaacaggggtgtcttttacatcagaagtctgtgctccacttgttgcaacccttcccttggaggtaaaaaacgtgattgaggagttcatcaaagtaatttatgctctatttatagatctggacttcaccttcctagagatgaaccctttcacattggttgatggaaagccttatccactggatatgagaggagagcttgatgatactgctgcctttaagaacttcaagaaatggggcaacattgaatttccattgccgtttgggagagttatgagtgctactgaaacctttattcatggactggatgagaagacaagtgcatctttgaagttcacagtcttgaaccccaagggaagaatctggaccatggtggctggaggaggtgccagtgtcatatatgcggatactgttggagatctcggctatgcttctgagcttgggaactatgcagagtatagcggtgctcctaatgaagaggaggttttgcagtacgccagagttgtaatttgattgtgcaactgcagagcccaatggccgcaagagagcccttgtaataggtggtgggatagccaacttcaccgatgtcgctgccacgttcaatggcataattcgagctttgaaggaaaaggaatcaaagcttaaagctgcaagaatgagcatttatgtgaggagaggtggtccaaactaccagaagggtcttgcaaagatgagagctctaggagaggaaattggcatcccaattgaggtttacggccctgaggctacaatgactggcatatgcaaagaggcaattgaatgcataactgctgctgcttaaagcaccaatactaccactcatcaaataaacttatttcttcttccaattctttgcttaagcaatgttgtaacaaaactgcactgaattttcattttctatatattagctacttcagcctttgcagcact

SEQ ID NO: 3074 - DNA, 1691 bp, Amaranthus tuberculatus
ctacccaaatctacactccacaaacttactctgttttgctcatctatctaccctcccaactcccaaatatattcagtaaactttgaatattataccaacacctaacaactaccaccgctccaaatcccaatcccatcttcctccctaaaaaattttgaattccaattgtaattctgtgcaaaaatggcaaggaagaagatcagagagtatgattccaagaggttattgaagaagcattttaagagaattgctggttctgaacttcccattagatcagctcaaattacagagttgaccgacctcaatgaacttattgcaaatgagccatggctctcatccgaaaagttagttgtgaaacccgacatgttatttgggaagcgtggcaagagtggtttagttgctctgaatttggactttgcccaggtttctgcttttgtaaaagagcgccttggcaaagaggtggagatgggcggatgtaaaggaccaattacgactttcatcgttgagccttttgttccacataacgaagagttctatctgaatattgtttcagaaagactgggaaacagtgtaagcttttcagagtgtggtggaattgatattgaagagaactgggataaggtgaaaacagtttatattcccacaggcgtttcttttacttctgaagtctgtgctcctctagttgctactttacctttggaggtcaaaggtgtgatcgagcggtttatcaaaaatatattttcgttgttcttagatttggacttcaccttcctagaaatgaatcccttcacattagtcaacggcaagccctatcctttggacatgagaggtgaacttgatgatacggctgccttcaagaatttcaagaagtggggtaatattgagttccccttaccatttggaagagttatgagtccaacagagagctttattcacggtctcgatgaaaagactagtgcatccttaaaattcacggttttgaatccaaagggaaggatttggaccatggtggctggtggaggagccagtgtaatctatgcagatactgttggggatctgggttatgcgtctgagcttgggaactacgctgaatatagtggagctcccaacgaagaagaggtcttgcaatatgccagagttgtaattgattgtgcaacggccaaccctgatgggcgcaagagggcccttgtaattggaggaggtattgctaattttacggatgttgctgctactttcaatgggataattagagctttgaaggagaaggaatcaaagcttaaagcggctaggatgcacatttatgtgaggagaggaggtccaaactaccaaaagggtttagctaaaatgcggatgcttggtgaggagattggtattcctattgaggtatatggccctgaagcaaccatgactggaatatgcaaacaggccattgattgtatcgacgtagctgcttaagtgaggttgagcatgtaactcaatacattccctcgctctatctccataaagacgattcacatttgattctccctaatttagatttagtgcgcatttgttgatgtatttgtagaattgtttgtattcgtttgtgatcccatttcatgtactcagtttacacaacacataaagccttcaaaattagatattagcaatgtaaacgatatgtaataagttccttgaaggaatgaatgatg

SEQ ID NO: 3075 - DNA, 1658 bp, Cyclamen graecum
ctctctctctcccatctattgtttgtccttcgaaagtgggttaagaacaaatggcacgcaagaagatcagagagtatgattctaagaggcttttgaaagagcactacaagaagcttgttggggctgaattgggaatcaaatctgctcaaattacggagtcaacagatgtgaatgaactcgtagaaaaagatccctggctctcatctgagaagctggttgtgaaaccagatatgttgtttggtaaacgtggaaagagtggccttgttgctttgaacctagatttggctcaagttgctattttcgtcaaagagcgattagggaaagaggtggaaatgggaggatgcaaaggacccataacaacttttattgttgaaccatttgtcccccatgatgaagagttctatattaatattgtgtccgaaagacttgggtgtagcattagcttttccgaatgtggaggaattgaaattgaagagaactgggacaaggttaagactatattcgtccctaccggtgtgtccttcacatctgaagtgtgtgctccacttgttgcaactcttcctttggagatcaaaggtgtaattgaggagttcattaaatccgttttcactatcttcatagatttggacttcacttttcttgaaatgaatcctttcacattggtcaatgggaagccttatcctttggatatgagaggggagcttgatgacactgccaccttcaagaatttcaaaaagtggggtagcatagagtttcctttgccatttggaagagttatgagttcgactgaaagctttattcatgggttagatgaaaagactagtgcatcgttgaagttcacagttttgaaccctaaaggacgcatttggacaatggttgctggaggaggtgccagtgtcatctacgcagacacagttggggatcttggttttgcttcagagctcgggaactatgcagagtacagtggagcacccaatgaggaagaggttttgcagtacgctagggttgtaattgattgtgcaacctcagatcctgatggtcgcaaaagggcgcttgtaataggaggaggaattgctaacttcaccgatgttgctgctacattcaatggcataattagagcattgaaggagaaggagtctaagcttaaagctgcaaggatgcatatatatgtaaggagaggtggcccgaattaccaaaggggtctcgcaaggatgcgtcagcttggtgaggagattggcattcctctagaggtctatggacccgaggcaacgatgactggcatatgcaaggaggcgattgattgcatcacagcggctgcttaaaatttcatcgatcatgcttagttgttttactcttttttccgcttttaaatcaaggctttggttttctattttctcgtctccattgaaactgtacccgaacatgagcacttaaaattgtactttcgacactgatacgagaataagattctcgagactgaataagttaagagttgccgtacttgttggagctatgaacattatattgcttgtgcaatagaagggtgtaattgtttggaatttatagtcttggggccgatatgtaatgtttcaaaatcgaggaggcaagatgatattctgtaatattcaagctcgtgtctaaatcgctaaatttaagga

SEQ ID NO: 3076 - DNA, 1592 bp, Fagus grandifolia
ccttctcattttggctactataaatagagcaagccatttacgcaaatatttcagctcctttgtttggaaatttcatcacaaagctcattttagagcctcctctcagcttctctttcaacggtaatttaaaaaggttgagagaaatggcacgcaagaagatcagagagtacgactccaagagattgttgaaggagcacttcaagaggctctctggaagagacttgcctattaaatccgcgcaagtcacagaatcaacagatttcaatgagttagccgaaaaggaatcttggctttcatcgacaaaactggttgtgaaacctgatatgttgtttgggaagcgtgggaagagcggtttagttgccttgaatctagatttggctcaagttgctacattcgtgaaggagcgcctcggcaaagaggtagagatgggtggatgcagaggacctattacaacattcattgtagaacctttcatcccgcacaacgaagagttttatcttaatattgtctcagaccgacttgggaatagcatcagcttttcggaatgtggaggaattgatattgaagagaactgggataaggttaagactatattcgtcccaacaggagtgtctcttactgcagaattatgtgctccacttgttgcaacccttcctatggagatcaaagtcgagattgaggagtttatcaaaacagtttttgcactatttcaagacctggacttcactttccttgagatgaatcctttcgctttggtggatggaaagccttatcctttagatatgagaggcgagttggatgatactgctgctttcaaaaactttaagaagtggggcaatattgaatttccaatgccatttggaagagttatgagtccttcagagaactttattcatggactagatgaaaagacaagtgcttctttgaaatttactgttttgaacccaaagggacgaatttggactatggtagctggaggaggtgcaagtgttatctatgcagatacggttggagatcttggctatgctgctgagcttggaaactacgcagaatatagtggagctcccaatgaagaggaagtgttgcagtatgccagagttgtgcttgattgtgtaactgctgatcctgatggccgtaagagagcccttgtaattggaggaggaatagctaactttactgatgttgctgccacgtttaatggtataattcgtgccctgaaggagaaggaatcgaaacttaaagccgcaagggtgaacatctatgtgaggagaggaggtcctaactaccagaaggggctggcaaaaatgagggcacttggggaggaaattggcatcccaattgaggtttacgggcccgaagcaacaatgaccggaatttgcaaacaggcaattgagtgtatcactgtagctgcataatcaactcttgaatatttgtctctgttgtactttattttcattttcatggcaagtttcaggtgactattaagtctaagttccattgtcctattaccagaaaactcagcaaattgtaattttacttgttaatgggccaaaaataatggtgtccgaagatttagatgtaatctggctgat

SEQ ID NO: 3077 - DNA, 1341 bp, Cucumis sativus
ttcatcctcctcctcctcctccttctacttctaatccaaaggctttacaaaaatggctcgcaagaagatcagagaatacgactctaagagattgttgaaggagcacttcaaacggatctctggtagacaactccccatccaatccgctcaagtcactgaatcaactgatttcaatgagcttgttgagaaggaaccttggctttcttcatcaaaattggtcgtgaagcccgacatgttgtttggaaagcgtggcaaaagtggtttagtcgccttaaatcttgatctggctcaggttgctgcatttgtgaaagagcgccttgggaaagaggtaacaatgggtggatgtaagggacctatcaccacatttattgtggagcccttcataccgcacaaggaagaatactatctcaatattgtctcagagagacttgggtgcagtattagcttctcggagtgtggaggaattgaaatcgaagagaattgggataaggttaaaaccatatttatccccacaggagtgtccctcacttcagaaacatgcgccgagctggtggcaacccttcctttggagatcaaaggagaaatcgaggagtttatcaaggcagtttataccctattccaagatctggactttactttcttggaaatgaatccttttgcgcttgttgatgggaagccctatcctttggatatgaggggtgaactagatgatactgctgctttcaagaacttcaagaagtggggaagtattgaatttccaatgccatttggtagggttatgagtcccactgagagctttatccatggcctagatgaaaagaccagcgcatctttgaaattcacagttttgaaccccaagggacgtatttggaccatggtggctggaggtggtgcaagtgtcatatacgcagacacggttggagatcttggttatgcctctgagctcggaaactatgcagaatatagtggagcgcctaatgaggaagaggtgttgcagtatgccagagttgttattgattgtgcaactgcagatcccgatggccaaaagagagcactcgtgattggaggaggaatagcgaactttactgatgtagctgctacatttaatggcataattcgggccttgaaggagaaggaatcaaggctaaaagcggctaggatgagtatttatgtgaggagaggaggccccaactaccagagagggcttgctaagatgagggcagttggtgaagaacttggtgttcccattgaggtctatgggccagaggcaaccatgacgggcatatgcaagcaagcaattgagtgcataactgcagctgcataaatcgggatacaccatcc

SEQ ID NO: 3078 - DNA, 1520 bp, Cucurbita pepo
aggatttgagaaatggctcgcaagaagatcggagagttcgattcgaagagattgttgaaggagcacttcaaaaggatctctggcagagaactgcccatccaatcagctcaagtcactgaatcaactgatttcaatgagcttgttgagagggaaccttggctttcgtcatcaaaattggtcgtgaagcccgacatgttgtttggaaaacgtgggaaaagtggtctagttgccttaaatcttgatctggctcaggttgctgcatttgtcaaagagcgccttggcaaagaggtatcaattggtggatgtaagggacccatcacaacatttattgtggagcccttcattccgcacagtgaagaatactatcttaatattgtctcagagaggcttgggtgcagcattagcttctcggagtgtggaggaattgaaattgaagagaactgggataaggttaaaaccatatttatccccacaggagtgtctctcacttcagaaatatgcgctgagttggtggcaacccttcctttggagatcaagggagagattgaggagttcatcagggcagtttataccctattccaagatctggactttactttcttggaaatgaatccttttgccattgttgatgggaagccctatcctctggatatgagaggtgaactcgatgatactgctgctttcaagaacttcaagaagtggggaggtattgaatttccaatgccatttggtagggttatgagtcctactgaaagctttatccatggcctagatgaaaagacaagtgcgtctttgaaattcacggttttgaaccccaagggacgaatttggaccatggtggctgggggtggtgcaagtgtcatttatgctgacacggttggagatcttggttatgcctctgagcttggaaactatgcagaatatagcggagcacctaatgaggaggaggtgttgcagtatgccagagttgttattgattgcgcgactgcagaccccgatggtcaaaagagagcacttgtgattggaggtgggatagcgaactttactgatgttgctgctacatttaatggcataattcgggcgttgaaggaaaaggaatcaaggctgaaagcggctaggatgaacatttatgtgaggagaggtggccccaactaccagagaggtcttgccaagatgcggacactgggagaagaacttggagttccaattgaggtttatgggccagaggcaaccatgactggtatatgcaagcaggcaattgagtgcataacggcagctgcataagacagtttcaggatacaccatccgcgtcgagcatgtctgccatagaattctcttatatcattatcaatttgtagttttctttggcttcaaccaatttgtggtgatagttccttcagattttcaattaaaacaatttgtgagcagaaacttttgagtggataagggtgaatgtaatggtcagcaattaatttgaattatttttggatgttgcattattctaatattatttataactt

SEQ ID NO: 3079 - DNA, 1614 bp, Mimulus guttatus
atatttattattacaactcatgtagatcaaacccccaccccacctataaatagatgccatcaaattttccaagatttcagcttttgttgataagtaataactagttttccatctgtctcatctcctctgtttgttcagctgttaaaaaagggggaaaatggcgaggaagaagatcagagagtatgattcgaagagattgttgaaggagcattacaagaggatttctgggtctgaattggaaatcaaatctgcccaagtcactgagtcaaccgatttcaaagaactcgtcgacagcgagccatggatgtcatccacaaaactggttgtgaaaccagatatgctattcggcaaacgtggcaaaagtggtcttgttgctctaaacctagatttggctggagttgctgcttttgtcaaagaccgcctcggtaaagaggttgagatggggggttgcaaagggccgattactactttcattgtcgaaccatttgttccgcacgatgaagagtactaccttaacattgtctctgagagacttggttgtaccattagcttttccgagtgtggaggaatcgatatcgaagagaattgggacaaggtgaaaactatatctgtggcaacgggagtggcttttacatcagaagtatgtgctccacttgtggcgacacttccgttggagatcaaaactgtgattgaggatttcatcaaagtcgtgtatgctttatttttagatttggacttcactttccttgagatgaatcctttcacattggtcaacgggaaaccttaccctttggatatgagaggcgagcttgacgacactgctactttcaaaaacttcaaaaaatggggaaatattgaattcccgttgccatttggaagagtgatgagtcctacagaaagctttattcatggacttgatgaaaagacaagtgcgtctctcaagttcacggtattgaatccgaaaggccgaatttggaccatggttgctggaggaggtgcaagtgtcatttatgcagatacagttggagaccttggctatgcttcggagctcggaaactacgcagaatacagtggggcccccaatgaagaggaagtcttgcaatacgcccgagttgttattgattgtgcaactgcagatcccgatggcaaaaggcgagcccttgtgataggtggtggaatagctaacttcaccgatgtagctgccacatttagtgggattattcgagctttaagagagaaggaggcgaagctcaaggcagctagaatgaatttatacgtgagaagaggaggtccgaattaccaaaaggggctcgagaaaatgaggactcttgcagaagaaatcggcattcccattgaggtttatggaccagaagcaacaatgactggaatatgcaaacaggcaattgagtgcatcagtgcagctgcttgaaaagttgccaatgctgatttaaaccttcatttgctttccactttgaatttcaactttttattttttttagtctaattgttgtttctcattttatttccaaggatttcaatttgtatcctcaacttatttttttcttcttaatatcaaataaatagggattaatcccactttgcacccttgaaacg

SEQ ID NO: 3080 - DNA, 1864 bp, Populus trichocarpa
acaactaaatgatatgcatgtgtgtgtgtgtgtgtaaaaatgaaacagcaaccttccttggaatatattcacagcgttgatttctgaactacaaaatgaaaaacggaaacctcgttttaccttggagttactgttagaatagaaataaaagaaactgagatttgcaactataaatagcagcttgtgcttattaccaaaggcgcacttggcagagattcaaagccttggctactgttgtttctgtcttctctccagttccttcctaccccattgagtcgctttgaagggtaaggaaaagaaaagagattttgaatggcgcgcaagaagatcagagagtacgactccaagagattgttgaaggagcatttcaagaggctttctggacgcgatttgcccatcaaatctgctcaagtgacggaatcgactgatttcaatgagttagcagagaaagaaccgtggctgtcatcagcaaaactggttgtaaaacctgacatgctgtttgggaaacgtgggaagagtggccttgttgctttaaatctggatctggatcaagttgctgattttgtccaacaacgtcttggcaaagaggtcgaaatgggcggatgcaaaggacctataacgacattcatcattgaaccctttatcccccacgaccaagagttctatctaaacattgtctcggagagacttgggtgcagcatcagcttttccgaatgcggagggattgaaattgaagagaattgggataaggttaaaactatatttgttccaacaggggcaacgtttacgtctgaagtttgtgctccacttgttgcgaccattcctttggagataaaaggagagattgaggagttcattcaatcggcttttgctctttttcaagatcttgacttcactttcctagagatgaatcctttcaccttggttgatggaaagccctatcctttggatatgagaggcgagctggacgacactgcggcatttaaaaacttcaaaaagtgggggaacattgaatttccaatgccatttggaagagttatgagctctacagaaagctttgttcatggcctagatgaaaagacaagtgcatctttgaaattcacggtattgaatccagaggggcgaatttggactatggtggctggaggaggtgcaagtgtcatctatgctgatacggtcggagatcttggctatgcttccgaacttgggaactatgcagaatatagtggagcccccaatgaagatgaggtgttgcagtatgccagagttgtaattgattgtgcaacttctgatcctgatggccacaagagagcccttgtaattggaggaggaattgctaactttactgatgttgctgctacatttaatggcataattcgagccctgaaggagaaggaatcgaagctgaaagcagcaaggatgaatatatatgtgaggagaggaggtcctaattaccagaggggccttgcgaaaatgagggcacttggagaggaaattggaatcccaattgaggtctatggcccggaagcaacaatgactggcatatgcaaacaggcaatcgagtgcatcactgcagctgcataagttaatcaactctgggaatcaatttgttttctgccggcagtttcttgctccaagtttctagttttcattagatcttaacactattttctttctactaaatccctctatataaaggtagctatagcagaccagataaggctttgccaaaatgaaaatgtaatctctgacctgatggtgaatgctgtttccataataaagagctgcttatttctctgtttactaccgatcttctgtttttatagcagcgttggaataaactcttgaacaatggactgcacct

SEQ ID NO: 3081 - DNA, 4059 bp, Pinus taeda
aataaaagctcgggttccatctgtgtgggctctgactctggatttacacaaatcaatctggtcaggggtagtcaagaatggtgggcaagggctaaaacgtggtcaggtcgcattttcagactttggaagcccacgtgattcacccaacccaggcatatttaatacccagtgctcggcctaaaaacacaggccataaaatttttgctggttacttcatatttctctaccactttctctagataaacagtgatatcgaaaatggcgaggaagaagattagagaatatgattccaagaggctattgaaagagcatcttaagaggctcactggattgcaggtcgacatcaaatctgcccaggtaacggaatcaaccgatttcaatgaactagcagacagagaaccatggctatcttcgagcagacttgtagttaagcctgacatgttgttcggaaagcggggcaagagtggcttggtagccttgaatctggacctggcccaagttattgcgtttgtcaaggaacgcttgggaaaggaggttgagatgggcggtgcaaaggcacctataacaacattcattgtggagccatttgtacctcatgatgatgaattttatatgtcgatcgtgtcagagcgccttggttcaaccattagcttttcagagtgcggaggcattgaaatcgaagaaaattgggacaaggttaagtcagtctttatcccaacggaacagtccctgacagctgagttatgtgcacccttgattgcaactcttccattggagattcgaggcaaaattgagaccttcataaagggagttttcaatttatttctggatttggacttcactttcttggagatgaatccttttacactggttaatggggagccttaccctctggatatgcgaggggaattggatgatactgctgcatttaagaacttcaaaaagtggggcggtatagaattcccattgccttttggtagagtcatgagtccttcagagagtgcagtacatagcatggatgaaaagacaagctcctctctaaagtttactattctaaatccaaaaggacgcatttggacaatggttgctggaggaggtgcaagtgtgatatatgctgacacggttggagatttgggatttgcaaatgaacttggaaactatgctgaatatagtggagctccaaatgaagatgaggtgttacagtatgcaagagttttaatagattgtgctactgcagatcctgatggacgtaagagagcactagtgataggtggggggatagcaaacttcactgatgttagtgctacgtttagtggaatcattcgagccttgcgtgaaaaggaatccaaactcaaagcagcacggatgcaagtatatgtgagaagaggtggtccaaattatcagaatggtcttgcaaagatgcgtgcccttggtgaggagattggggtcccattccaggtttatggaccggaagctagtatgactggcatttgcaagcaagctatacaataaatttcccaagtaaattgcatcttgtagttggctatcttgtttgagggtggttactttgcttctgtctattaggctgctgggatgttgtctctggaaaaaactgagcccagcctaagtatttcgaagttgattctgtagcctgcttatttgctctcttttgccacgctaataaaagggcaatgttgcatttttatgatcataaatatcatgtcgatcatggttagatttgtgaggaaaattaattgatagcttatttcagtttcatttagaaagttgaggacgagggatgttgtgtagtaataaccttggaataatccttaatatgattccttttctcatgcaagcccgaaagcgaaatcgtgaaggatatgaagaaggacttgcaacaatacggaagataggccttgcttcagattttgtttggtcagataaacctttggaagtcctcggttcagttacttcaatttcatttgaggatccagcatgttcttccttaaaggatcattctcttactactgatgagataaaattactgtgcgatgatttgcgggttttggggaaacaagaattcaagcttttgttgaagtggcgtttgcacatccggaaggccttatctcctcaagtgaaaaatgattctggggtggatgaagtgaacgaaacagttgagggtgatgatgatgagcgaatgttgggtcaaatggaggaattgcattctatttatgaacgaaagaagaagaaaacaaagaaactccttgcaaaaagacgggctaaggctaaagcacgtacccgaacaggaatgaaagtggatgtcatggaagatggctataatgactatgatttgttttctttatcttctattaaggctaagaaggatctattggttgtggattctccagcacaatctgatgatcagattgatgttgcaagtgaagatgaggctaatggcccaaaatcagaagacagtgaagcaagtgacgttgattctgatgaagagaggaggaggtatgatgaagaacttgaaaactgtctggatcgagcttatgagcggtttgttgctgcaaaagaaggcagtacaaagaagcgaaaacgtgcaaaattaattaatgatgctaccgatagcgaagtctggaaggacaaggggacttatcaggataatattcatgaagactattcagatgacagtgctgaggatggtgaggccaatccattggtggtgccactaaccgaggaagaacaaccatctaaagagcagctgactgagcagtggttcagtcaggatctcttcacgggttttcaagacacctgcaataaggaagacagtgattctgacatgtcagaaggaggtcaagatatcaaatcattcccaaaatcatccggtgaaaggagaagtgagcccaacaataaatccaacaaggagaatatttctgtcacatctgagtccaagattctgcaagacaacggatctgagccagagagagatgatggctttgaaatagttcctgctgcatcttctggctcaagtgatgaatcttcttcggaagatgaatcagattatgacactgattccaaagcagaaattttagcttatgcgaagaaaatgttgaggaaaaagcaacgggaagagattctagatgctgcctacaataggtatacttttgatgatgaaggtctgccggaatggtttgtcaaggaagaaaaaattcactgccagcctcagaaacccataacaagagaggagattgaagccatgaaagcacaattcaaagaaattgatgctcggccagcaaagaaggttgcagaggcaaaagcccgtaagaaacgggttgcaatgaagaagttggagggagttcgaaacaaagcaaatgcaatatctaatcaaactgacatctccaatcaatcgaaaaataaaatgattgagcgactatacaagaaggctacgcctaagagaccccagaaggagtatgtggttgccaagaagggagtacaagttaaaggtggtaaaggaaaagtaatagttgaccgtaggttgaaaaaagactcgcgatctagaggaattggtaggcatggtaaaaacatttccaaacaggggaagactagaaagaatacttcaaaaactggaacttctggaggtaaaagacatgcgaaagcaggtcctggtggaggcaaatcgggaaagaggatgtgattgtatatgataagaaaaaatcaacgagttacagatatttcatgtcttgattgactttgtttgagtgaggtgatttttcattataatattagctcctaaattttctgggtgttgcagctgggggcctatttcttactcatttcatcgtgcctgaatattaccttcattcctaagcaagtttaaacactattatcgcttccatattatatgcttgcatttgcagctcaccatacacctacgatgctttttgcatctttagtgagttgaaattttgacgagaagagcgtctctcaattggtcacgagtgtagctcttacagattaacctattagtttcaaatcaatggttttaatatagttaaa

SEQ ID NO: 3082 - DNA, 1339 bp, Secale cereale
ccggcgcgccagtgctacaaaccaccgctaccacagcgtccacctacccgccctccgcctcgagaagcgtcggcgaggccatggcgcggaagaagatccgggagtacgactccaagcgcctcctcaaggagcacctcaagcgcctcgccggcatcgacctcctgatcctctcggcgcaggtcacacaatcaacggatttcacggagctttcaaaccaggagccatggctctcgtcaacgaagttggttgttaaacctgacatgctgttggcagcgtgggaagagcggccttgtagccctcaacctagatcttgctcaagtcgccattgtcaaggagcggttaggagttgaggtcgagatgggtggatggtaaggctccaattacaacattcatagtcgagccatttgtgccacacgatcaagagtattatctctcaattgtgtcagacaggcttggttgcaccattagtttctcagagtgtggggggattgagattgaggagaactgggacaaggttaagacaatctttcttccaacagagaagccaatgacacttgatgcatgtgcaccattgattgccactcttcccttggaagtccgcacgaaaataggcgatttcattagagggtcgttttctgttttccaagacttggatttctcatttatggagatgaacccattcaccctggtaaatggtgaaccataccctctggacatgagaggtgaactggatgacaccgctgctttcaagaactttaagaagtggggtgacattgagttccctctacctttcggaagagtcctgagcccatcagaaagttatatccatgaactggatgagaagacaagcgcatcactgaaattcacagttcttaacccgaaaggtcgcatttggacaatggttgcaggtggtggtgctagtgtcatatatgccgacacggttggagatctgggatatgcttcagagctagggaattatgcagagtacagtggagctcccaaggaggaggaggttttgcattatgctagagttggttttggattgtgccactgctgatcctgatggccggaagagagctcttactcagttgggaggggtatagactaaacttcaccgacgtcgctgctactatttagtggcatcagtccgggtactttaagagaaggaaaggaactacctaaaattaaaggctgcgaagggtgaactatttatgttcgcaggaggtggtaccaaactaccaaactggactcgaccaaaatcgacgtgctcgtaaggatcagagtcgttcggttcttacctaattggaggtctagtcggaccaggacggccaacaatgac

SEQ ID NO: 3083 - DNA, 1628 bp, Vicia sativa
gtttcatttaatattaaaaaaatcaaaacttttcaactataaatacagccatcacacaaacccatatcgttcgttcatctgtttgttagatccaacgacccatcccatcctccgcatcctctttcgattaagaagaaatggcacgcaagaagattagagagtatgattccaagagattgttgaaggagcactttaagagactttctggcaaagacttacctatcaagtctgcacaagttacggagtccactgatttcactcagttgcaagacaaggaaccatggctttcttcttctaaattggttgtgaagcctgacatgttatttgggaagcgtggtaaaagtggtttggttgccttgaatttggatttggcacaagttgcttcatttgtgaaagagcgtctcggtaaagaggttgaaatgggtggatgcaagggaccgataacaactttcattgttgaacctttcatcccacataatgaagagttttaccttaacattgtctctgacagactcgggaacagcataagcttttcagaatgtggaggaatcgacattgaagagaattgggataaggttaagactgtatttgttccaacgggattgtctgttacatcagaaattgttgctccacttgttgcaacccttcccttggagatcaaaggggaaattgaggaatttctcaaggtggttttcactttgtttcaagatttggatttcactttcttagagatgaatcctttcacattggttgatggaaagccttatcctttggatatgagaggcgagcttgatgacactgctgctttcaagaacttcaagaagtggggtgacattgaatttccactaccattcggaagggttatgaatgccaccgagtctttcattcatggattagatgaaaagacaagtgcatctctaaaattcaccgtgttgaacccaaagggccgaatttggacaatggttgctggtggaggtgctagtgtcatctatgctgacacagtaggagatcttggctttgcatccgagcttggaaactatgccgaatacagcggtgcacccaatgaagaggaggttttgcaatacgccagagttgtgattgattgtgcaactgcagatcccgatggccgaaaaagggctctcgttataggaggaggcatagctaacttcaccgacgttgctgctacttttagtggcatcattcgggcactaaaggagaaggaatcaaagttaaaggcagcaagaatgcacatttacgtgaggagaggaggtccaaactaccaaaagggtctagcaaaaatgcgagcactcggagaggaaattggaatccctctcgaggtgtatggacctgaagcaacgatgactggtatatgcaaagaggcgatacactgcattactgcttccgcttaagaatccatttcaggtcgatgcttcattagtattgcaggtttgatttgaagtgaacgttggttcgtaatttcctttcgcattcctggaatttgtaaatttagttacaccatgtgtttataaaatcaagtcatctgaaaagagtggttgagtatgttgtatcatttttctgatgtagaatttgatggtattgtcttgatacaataaagttttttttcaatt

SEQ ID NO: 3084 - DNA, 1532 bp, Cedrus atlantica
agataaaagagtaatatccaaaatggcgaggaagaagattagagaatatgattccaagcgcctattgaaggagcaccttaagaggcttaccggaatgcaggtcgacatcaaatctgcccaggtaacagaatcgaccgatttcaatgaattagcagacagagaaccatggctgtcctcgagcagactcgtagttaagcctgatatgttgtttggaaagcgggggaagagtggcttggtagccttgaatctggacttggcccaggttatggcatttgtcaaggaacgcctgggaaaggaggttgagatgggcggtgcaaaggcacctataacaacattcattgtggagccatttgtacctcatgatgatgagttttatatgtcgatcatgtcagagcgccttggttcaaccattagcttttcagagtgcggaggcattgaaattgaagaaaattgggacaaggttaagtcagtatttgtcccaaccgaaaagcctctgacagctgagctatgtgcacccttgattgcaactcttccgttggaggttcgaggcaaaattgaggccttcataaagggagttttcaatttatttctggatttggacttcactttcttggagatgaatccttttacactggttaacggggagccttaccctctggatatgcgaggagaattggatgatactgctgcatttaagaacttcaaaaagtggggcagtattgaattcccattgccttttggtagcatcctgagtccttcagagagtgcaatacatggcatggatgaaaagacaagtgcctctctaaagtttactattctaaatccaaaaggacgcatttggacaatggttgctggaggaggtgcaagcgtgatatatgctgatacggttggagatttgggatttgcaaatgaacttggaaactatgcagaatatagtggagctccaaatgaagatgaggtgttacaatatgcaagagttttaatagattgtgctactgcaaatcctgatggccgtaagagagtactagtgataggtggagggatagctaacttcaccgatgttagtgctacctttaatggaatcattcgagccttgcgtgaaaaggaatccaaactcaaagcatcacggatggaagtatatgtgagaagaggaggcccaaattatcagaatggtcttgcaaagatgcgtgcccttggtgaggagattggagtcccattccaggtttatggaccagaagctagtatgactggcatctgcaagcaagctatacaaagtataacggcttctgcataaatttctcaagtaaaatgtgtcttgcagtttgctagcttgtttgagaatggttacgttctgtccattaggctgctgggatgttgttgtctggaaagaatgagcacaacctcccatgattctcttaagtattttgaagttgattctgtagtctgcttatttgctctcttttgttactataacaaaagggcaatgttacatttttatgatcataaatatcacgtggatcatggttagattt

SEQ ID NO: 3085 - DNA, 1561 bp, Panax ginseng
gttttactcgcctgttgttaggtagtagtgtctcatttatccgtttgcacatgaattccttgaaatactaaagtactcctatataactgagagagatcgcattgcatctctccattacaaacatttttcagtttcgcaatcgatctaaaagagatcgtttgattccgaaacagatagaaaagaaaagaaatggcgcgcaagaagatcagagagtacgactcaaagaggttgttgaaggagcatttcaagaggatttctggttctgatctggccattaaatcggctcaaattacagaatcaactgatgtcaatgagctcgtagaaacagaaccttggctatcctcctccaaactggttgttaagcctgatatgttatttggaaagcgtggaaaaagtggcctcgttgccttaaatttagatttggctcaagttgctgactttgtgaaagagcgacttggaaaagaggtcgaaatgggaggatgcaaaggacccataacaacattcattgttgaaccattcgttccacataatgaggaattttatctcaacatggtgtcagagcgccttggatgtagcataagcttttcagactgtggtggaattgaaattgaagagaattgggataaggttaaaactatatttgttccaacaggggtgttcttgactccagagatatgtgctcctctagttgcgacccttcccttggagatcaaaggtgtaattgaggagttcatcaaattgatatttaccctatttgcagatctggacttcactttcctagagatgaatccttttactttggtcgagggacacccttaccctttggatatgagaggagagcttgatgacactgctgctttcaagaactttaaaaagtggggcaatattgaattcccattgccttttggaagagttatgagtcctacggagagctttattcatggtctagatgaaaagactagtgcatctttgaagttcacagttctaaatcctaagggacgaatttggactatggttgctggaggaggtgccagtgtcatctatgcagatactgttggagatcttggttatgctgcagagcttggaaactatgctgaatatagtggagcacccaatgaagaggaggttttacagtatgccagagttgtgattgattgtgcaactgcagaccctgatggccgtaagagagcccttgtagttggtggtggaatagccaactttactgatgttgctgctacatttaatggcataattcgtgcgttgaaggagaaggaatcaaagcttaaagctgcaaatatgcacatatatgtgaggagaggcggtccaaattatcaaagaggtcttgcaaaaatgaggaccctcggagaggaaattggcatccctattgaggtttatggacccgaagaaactatgactggaatatgcaagcaggcaattgaatgcatcagtgcagctgcataattaaatgaaccaaacctattgttagtcttattaaatttggctcaccattttctttggtatttccaaatattgctcaatgcctgttagcattatgttgtaa

SEQ ID NO: 3086 - DNA, 1587 bp, Arachis hypogaea
acctctcggttagatctaactatccacacccccctttgttgtttcatctctctgttttggttgagatagaaatggcgcgcaagaagatcagagagtatgactccaagagattgttgaaggagcactttaagagactctctggccgagacttgcagatcaagtctgcacaagttacatcatccactgatttcgctgagcttcaagagaaggaaccttggctttcatcttcaaaattggttgtgaagcctgatatgttgttcgggaagcgtggcaagagtggcttggttgccttgaatttggatttggcacaagttgcttcatttgtgaaagagcgacttggaaccgaggttgagatgagtggttgcaaaggacccataacaactttcattgttgaacctttcgtcccccacaaagaagagttttaccttaacattgtatccgagaggcttgggaacagcataagcttttcagaatgtggaggaattgaaatcgaagaaaactgggataaggttaagactgtatttgttccaactggagcgtctttcacatctgaaactatagccccacttgttgcaacccttcccttggagatcaagggagaaattgaggaatttctcaaggtggttttcaatatatttcaagacctggatttcactttcttagagatgaacccattcacattggttgatggaaagccttatcctttggatatgagaggcgaactagacgacactgctgctttcaagaacttcaagaaatggggagacattgaattcccattgccatttggaagggttatgagtgccactgaagctttcattcatggattagatgaaaagacaagtgcatctttgaaattcacagtgctgaacccaaagggccgaatttggacaatggtagctggtggaggtgctagtgtcatctatgctgatacggttggagaccttggctttgcatctgagcttggaaactatgctgaatatagcggtgcacccaaggaagatgaggtcttgcagtatgccagagttgtgattgatgccgcaactgcagaccctgatggccaaaagcgagctcttgtgataggaggaggcattgctaacttcactgatgttgctgctacatttagtggcataattcgagctctaaaagaaaaggaagccaagttaaaagcagcaaggatgcaaatctacgtgaggcgagggggccccaactaccaaaagggtctggagaaaatgcgagccctcggagaggagcttggcatccccattgaggtttatggacctgaagcaacaatgactggcatatgcaaacaggcaatagagtacatcactgctgcagcttaaatcatttgaggtcaatgcattcttttttatattggcaagtctgaagtcaatgctcaaggctgattcttaatccccgtgttcccatattttgaatattttggttagaacatgtatgtttacagaattcaattcatcaaacaagtgtgggggggaaaaatggataatagaagaggatatggctgaggatgttattttttgtagaattctgttggcactacgttgacaaaaataaaataagattgtt

SEQ ID NO: 3087 - DNA, 1541 bp, Solanum tuberosum
gttttaacgtttaagatctcaactttcttgccctcatattgatctgtgaaacaagatttgatttgggttttcagatctgttgttgggttttgaaaatttctttgctgtttttgttaaagaagaaaaatggccaggaagaagatcagagagtatgattcaaagagattgttgaaggagcatttcaagaggcttggaggttatgatttggctatcaaatctgcacaggtgacagagtctactgacatcaatgagctagcagagaaagagccttggctcaactcaacaaagttggttgtaaagccagatatgttgtttggcaagcgtggaaagagtggacttgttgccttgaatcttgatcttgctcaagttgctacttttgtgaaggagcgtcttggcaaagaggtggagatgggcggatgcaaaggtcccatcacgaccttcattgttgagccattcattccccacaatgaagagttttatcttaatattgtctcggagaggcttggttgcagcgtaagcttttctgaatgtggaggaattgacatcgaagagaactgggacaaggttaagactatctttgtgccgacaggaacttcttttacatcagagatatgtgctccacttgttgccactctaccattggagattaagggtgtcattgaggagttcctcaaagtgatttacactctatttcaagatctggacttcactttcctagaaatgaatcctttcacattggttgaaggaaagccttatcctttggatatgaggggagagcttgatgacactgctgctttcaagaacttcaaaaagtggggaaatattgaatttccattgccatttggaagggttatgagtgcttcagagagcttcattcatgggcttgatgaaaagacaagtgcatctctgaagttcacagtcttgaaccccatggggcgaatttggactatggttgctggtggaggagctagtgtcatctatgcagatactgtaggtgatcttggatatgcttctgagcttgggaactatgcagagtacagcggcgctcccaatgaagaagaggtcttgcagtatgctagagttgtaattgattgtgccactgcaaatcctgatggccgtaagagagccctcgtgattggtggtggaatagccaacttcactgacgttgctgctacatttagtggtattattcgagctcttaaggagaaggagtcaaaacttaaagctgctagtatgaacatatatgttagaagaggaggtccaaactaccaaaaaggtcttgcaaaaatgaggtctcttggcgaggaaattggcatcccaattgaggtttatggacctgaggaaaccatgactggcatctgcaaacaggctattgagtgcatcactgcagctgcataaattaaccaacttcattctccaagttgaacctttttagttgtcttttttcactttgtgttagtgttttgttgtatgccaaccaagtatgagcaatttgatttgtatgtttgacatttcacataaatgggccatgaacaataatg

SEQ ID NO: 3088 - DNA, 1541 bp, Sesamum indicum
atagggagttggccatctgtcccaatctgagtgcagattcttggagcctccgctctgtgttcattcaacagttgagaagaaaatggcaaggaagaagatccgagagtatgattccaagaggttgttgaaagagcatttcaagaggctttctgggtctgagttggaaatcaaatctgctcaagtcacagagtctactgatttcaaggaactagtggacagggaaccctggctctcatcaacaaaactggttgtcaaaccagatatgctattcggaaagcgtgggaagagtggccttgttgctctgaaccttgatttggccggagttgctgcctttgtgaaagagcgactcggcaaggaggtggagatgggaggctgcaaagggcccattaccacgttcattgttgaaccatttgttccacataatgaggaattctacctaaacatcgtctctgagaggcttggttgtagtattagcttttccgaatgtggaggaattgagattgaagagaactgggacaaggtgaaaactatctttgtgccaacaggagttgcctttacatcagagctatgcgctccgcttgtggcgacactccccttggagattaaaggtgtcattgaggagttcatcaaagttatctatgatttattcctagatctggacttcactttcctcgagatgaatccttttaccctggttaacggaaggccttatcctcttgatatgagaggcgagcttgacgacactgctgcttttaagaatttcaaaaaatggggaaatattgaattcccgatgccgtttggaagagtcatgagtcctactgaaagctttattcatggacttgacgaaaagacgagtgcgtcgctcaagttcactgtcttgaaccccaaaggacggatttggactatggttgctggaggaggtgcaagtgtcatctatgcggatacagttggggatctcggctatgcttctgagcttgggaactatgcagaatatagtggagctccgaacgaagaggaggtgttgcagtatgcccgagttgtcattgattgcgcaactgcagaacctgacgggagaaagagagcacttgtaattggtggtggaatagctaacttcaccgacgttgcagccacattcagtggcattattcgggcactaaaagagaaggaggctaagcttaaggctgcaagaatgcacttatacgttagaagaggaggtccaaattaccaaaagggccttgcaagaatgagaagccttgcagaagaaatcggcatccccattgaggtgtatggacccgaggcaacgatgactggcatttgcaaacaggctattgagtgcatcagtgctgctgcatgaagttgctaatgctgatgttcttacctactcttttattgcactgtgatttagtctaatgttgtacccaatattttcaagaacttcaaagtgtactcttgactttttgcataaatgggcctcaaggaaaggcctttaggcttgcaaattaccttcaatccaagtcaaaaggcctttccttgaggcccat

SEQ ID NO: 3089 - DNA, 1718 bp, Trigonella foenum-graecum
tgttttttgttagttaccaaattcttcttagccatcatcttcaccaacccaacaacctcatcattttcttttccttgttttttcttcttctccaaacaacaaaataaaaatcaaagctttcaactataaataaattgagccatcacacaaaaccatatcgttcgttcatcaattcagatccaactactcatctcaccaacctcttcctccttccgattaagaagaaatggcacgcaagaagatcagagagtatgattccaagagattgttgaaggaacactttaagagactctctggcaaggacttgcctatcaagtctgcacaagttacagagtccactgatttcaccgagctgcaagacaaggaaccttggctttcttcttctaaactggttgtgaaacctgacatgttatttgggaagcgtggtaaaagtggtttggttgccttgaatttggatttggcacaagttgcttcatttgtgaaagagcgtctcggtaaagaggttgaaatgggtggatgcaagggaccaataacaactttcatcgttgaacctttcatcccacataatgaagagttttaccttaacattgtctctgatagacttgggaacagcataagcttttcagaatgtggagggatcgatattgaagagaattgggataaggttaggactgtatttgttccgactggagtgtctcttacatcagaaattgttgcaccacttgtggcaacccttcccttagagatcaagggagaaattgaggaatttctcaaggtgattttcactttgtttcaagaccttgatttcactttcttggagatgaatcctttcacattggttgatggaaaaccttatcctttggatatgagaggcgagctagatgacactgctgctttcaagaacttcaagaagtggggtaacattgaatttccactgccatttggaagggttatgagtgccactgagtctttcattcatggattagatgaaaagacaagtgcatctctaaaattcaccgtgttgaacccaaagggccgaatttggacaatggttgctgggggaggtgctagtgtcatctacgctgacacagtaggggatcttggctttgcaaacgagcttggaaactatgcagaatatagcggtgcacccaaagaagaggaggttttgcagtatgccagagttgtaattgattgtgcaactgcagaccctgatggccaaaaaagggctctcgttgtaggaggaggcatcgctaactttactgatgttgctgctacttttagtggcataattcgtgcacttaaggagaaggaatcaaagttaaaggcagcaagaatgcacatttacgtgaggagagggggtccaaactaccaaaagggtctagcaaaaatgcgagaacttggagaggaaattggcatcccaattgaggtttatggacctgaagcaacgatgactggtatatgcaaagaggcaatacagtgcattactgcttccgcttaactatgcatttcaggtcaatgcttccttagtatccatgtcatttgcaagattaaagtgaacttcaatttgtaatttcctttctccttcctggaatttgtaaatttagttacactgtatgtttatataatcgattcatccaaaaagagtcgttgagagtgttgtctcagtttttttttgttagattttgatggtactgtcttgatacaataaagagtttttt

SEQ ID NO: 3090 - DNA, 1789 bp, Citrullus lanatus
ttttgactttcattatccaatttggaatgttgttaaagattctcttcttctgcctttgaaatgtatgagtcggagcacaatgttctgatcggcggtcttctgtgactcactgcaggatttgacaaatggctcgcaagaagatcagagaatacgattctaagagattgttgaaggagcacttcaaacggatctctggtagagaactccccatccaatccgctcaagtcactgaatcaactgatttcaatgagcttgttgagagggagccttggctttcgtcatcaaaattggtcgtgaagcctgacatgttgtttggaaagcgtgggaaaagtggtttagtggccttgaatcttgatctagctcaggttgctgcatttgtgaaagagcgccttggcaaagaggtaacgatgggtggatgtaagggacccatcaccacatttatcgtcgagcccttcattccgcacaatgaagaatactatctcaatattgtctcagagagacttgggtgcagcattagcttctcagagtgtggaggaattgaaatcgaagagaactgggataaggttaaaaccatatttatccccacaggtgtatctctcacttcagaaacatgcggtgagctggtggcaacccttcctttggagattaaaggagaaatcgaggagtttatcaaggcagtttataccctattccaagatctggactttactttcttggaaatgaatccttttgcgattgttgatgggaagccctatcctttggatatgagaggtgaactagatgatactgctgctttcaagaacttcaagaaatggggaagtattgaatttccaatgccatttggtagggttatgagccctactgaaagctttatccatggcctagatgaaaagaccagtgcatctttgaaattcacagttttgaaccccaagggacgaatttggaccatggtggctggaggtggtgcaagtgtcatatatgcagacacggttggagatcttggttatgcctctgagctcggaaactatgcagaatacagtggagcacctaatgaggaggaggtgttgcagtatgccagagttgttattgattgtgcaactgcagaccccgatggccaaaagagagctctcgtgattggaggagggatagcgaactttactgatgtggctgctacatttaatggcataattcgggccttgaaggagaaggaatcaagactgaaagcggctaggatgagtatttatgtgaggagaggaggccccaactaccagagaggccttgccaagatgcgggcacttggtgaagaacttggcgttccaattgaggtttatgggccagaggcaaccatgactggtatatgcaagcaagcgattgagtgcataacggcagctgcataagtcaggatacaccatacgcgtcgagcttgtcataaaaatcttatattatgtgtagttttctttgcctttgaccaaattgtggtgatagttcctcaagttttaaataaaaatctccatttgtgatgcattcgaacaaggacttgtgagcagaaactttagagttgatagtgataaagcagagggatcgtatgtattcaatgtagatgcaagatgggtgtaacgacttgggactatcttgtttcgtttcgtggtcagtatagctcactgcttttcttacatttaagaggggagctattcaattgagttcgtcaatttctcaccactctttcaactattttaatgtaatgatacgtattcctgcttctaagccctattacttctacaaatgttaa

SEQ ID NO: 3091 - DNA, 1442 bp, Beta vulgaris
tttctggagctataaataagcttcagctattgtctgatatctcccacttcacaccagattcacattttctctctcttcttcagctacttgattttacggtataaagatattaaaaaatggcacggaagaagatcagagagtacgattcaaagaggttaatgaaggagcattataaaagaattgctggttctcaacttcccattaaatcagctcaaattacagagtcaaccgacctgaatgaacttgttgcaaatgagccatggctctcatctgaaaagttggttgtgaaacccgacatgttgtttgggaagcgtgggaagagtggcctagttgccttgaatttggacttcgcccaggtcgctgattttgtaaaagagcgtcttggcaaagaggtggagatggggggatgtaaaggacctattacaactttcattgttgagccttttgttccacacaatgaagagttctatctgaacattgtttcagatagacttgggaacagcataagcttttcagagtgtggtgggattgagattgaagagaactgggataaggtcaaaacaatatttgttcccacgggtatttcttttacttctgaaatctgtgctcctctagtcgctactctacctttggaggtcaaaggtgtgattgaggagtttatcaaagtcatcttcaccctgttcttagatctggacttcaccttcctagaaatgaatcctttcacattagtcaacgggaacccctattctttggacatgagaggcgagctagatgatactgctgccttcaaaaatttcaagaagtggggtaatattgagttcccattgccatttggaagagttatgagcccaacagaaagctttgttcacggtctagatgaaaagactagtgcgtctttgaaattcacggttttgaatccaaagggaaggatttggaccatggtggctggaggaggagccagtgttatctatgcggatactgtgggagatcttggttatgcatccgagcttgggaactatgctgaatatagtggtgcgcccaatgaagaggaggtcttacagtatgctagagttgtgattgattgtgcaactgctgaccctgatgggcgcaagagagccctagtagttggaggaggaatcgccaactttactgatgttgctgctactttcaatggaataatccgagctatgaaggaaaaggaatcaaagcttaaagccgcaagaatgcacatttatgtcaggagaggaggtccaaattaccagaaaggtttagctaaaatgcggatgctaggagaggagattggaattcctattgaggtttacggacctgaggcaaccatgaccggaatatgcaaacaggccatcgaatgtatcgaggtagctgcttgattggatccgagcagaactgttctcgtgctctcgtcactcgtattagtgatacaa

SEQ ID NO: 3092 - DNA, 1893 bp, Cannabis sativa
taattatttaaaaaaaaaattattttttcctataaatacagagtgaacaaacaacggtttcagagattcagttgtggtgtttttgtctatctacctcctctcaagaaaactaaaccaaatcttcggagaatttctctctctctctctccatctggtttataaatggctcgcaagaagatcagagagtacgattccaagagattgttgaaagaacatttcaagaggatctctggccgtgatttgccgatcaaatcagctcagattaatgaatcaactgacttcaatgagttagcaaacaaggagacttggctttcatcttccaaactggttgtaaagcctgacatgttatttggaaagcgtgggaaaagtggtttggttgctttgaatctcgattatgctcaagttgctacttttgtcaaggagagacttggcaaagaggtcgagatgggtggatgcaaaggacccattacgacattcattgttgaacctttcatccctcacaatgaggagttttaccttaatattgtctccgaaagacttggatctagccttagcttttccgagtgtggaggaattgatattgaggagaactgggataaggtcaaaactatatttgttccaactggagcaacttttacgtcagaagtatgtgctccactagttgcaacccttccattggagatcaaagcagaaattgaggagttcattaaatctgttttcgctctatttcaagatttggacttcactttcctagagatgaatccttttgcacttgttgatggaaagccatatcctttggatatgagaggcgagctggatgacactgctgctttcaagaatttcaagaagtggggcaacattgaatttccgatgccatttggaagagtcatgagtcctactgaaagctttattcatgggttagatgaaaagactagcgcatcattgaaattcacagttctgaatcctaagggaagaatctggactatggtagctggaggaggtgcaagtgtcatatatgcagacacggttggagatcttggctatgctaatgaactcggaaactatgctgaatacagcggtgcacccaacgaggaggaggtactgcagtacgcaagggttgtcattgattgtgccactgctgaccctgatggccgcaagagagccctggtcgttggaggtggaatagctaactttactgatgttgctgccacatttaatggcataatcagagccttcaaagagaaggaatcaaaacttaaagcagcaagaatgcacatttatgtgagaagaggaggccccaactaccagagaggtcttgcgaaaatgcgggcactcggagacgaaattggcattcctattgaggtttacgggcccgaagcaacgatgactggcatatgcaaagaagcaattcagtgcatcactgctgctgcataagcttctaattcttaggatgtcttcttccctctgtattctttccactaccttttttatttgttaaatttttgtgtcgttttaactttcgttgtactgaaaacctcagaagaatcaaaatgtagtttttattatatccatgagtcaccattaatggagacccctggaatcgatgtatctgtttcacgataataaagatttttaagtgggaattggttaatgttattgactgttctaataagtcttgattaagctggtacaataccagtagctaaaacaagaacaatagcaagaaaatagagggaacttgtgtatgtattgatactaaaatctcttaattcttctataccctccaattctctttagtatatcctatatattgcattccttcactaacccaacccttaatacaaaggcccatatacctttttatttaggtgggataatttcacagatgcacaa

SEQ ID NO: 3093 - DNA, 1812 bp, Cephalotaxus harringtonia
ttgcttatatatatccattattttagctggaactgattgaaagcttttcgttttttaaagtctctttgtattgagctgaggagagattgtagctgaaaatggccagaaagaaaatcagagagtatgattccaagcgcctattgaaagaacatttgaagaggcttgctggtattcagcttgagatcaaatcagctcaggttacagggtccacaaatctgaatgagttggcagacaatgaaccatggttatcggcatcaagactggttgtaaaacctgatatgctgtttggaaagcgagggaagagtggtttggttgccttaaatctggatttagcgcaaggtgcagcatttgtcaaagaacggctagggaaggaggttgaaatgggtggtgcaagggcaccaatcacaacttttatattggagccttttattcctcatgatgaggagtattatctttcaattatttcagatcggcttggtttcacaataagtttttctgcatgtggaggcattgaaattgaagaaaattgggataaggtcaagacaatatttgttccaacagaaaagtctttaacagctgagctttgtgctcccttaattgcgactctcccattggagattcgtggaaaaattgagaatttcatagcaggtgtttacaaagtttttttggatttggactttactttcttagaaatgaatccatttacgtttgtcgatggaaagccttacccgttggatatgcgaggagaattggatgacactgccgcttttaagaacttcaaaaagtggagtaatattgaatttccaatgccttttggtcgagtcatgagccctgcagaagatttggttcacaacatggatgaaaagacaagtgcttcgttgaagttcactattttaaatccaaaagggcgtatctggacaatggttgctggaggaggggctagtgtgatatatgctgatacggttggagatttaggctatgcaagtgaacttggaaattatgcagaatatagtggagctccaaatgaagaggaggtgttatactatgcaagagttctgatagattgtgcaactgcaaatccagatggccgcaagagagcattgttaataggtgggggcattgctaacttcacagatgtcgcggctacatttaatggcatcattcgagctttgcgtgaaaaggaatctaaacttaaagcatcaaggatgaatatatatgtaaggagaggaggcccaaattaccagagtggtctagcaaagatgcgtgctctaagtgaagagattggggtaccaattgaggtctttggaccagaagctagtatgactggaatatgcaagcaggctattgagtacattacagctgctgactgatctataaaaatatcttaatgatctctaattatgttttgatttggacatacacacgggggccatttttggtgagtcaatggcactctcatgggaatctgtgctgtaggtttgcagacaatgaataccatgtgatttttctgtgatatcttaccatgcaaatccacgtagaagataggattctttttttatgtcagtggcttaagttgtggactgttccgcacagtatttataggttgaaaggttgtttcaacttttcagttgtttttaataaaactgaataatgcagacaaagcttccctactttgtttgttttggtaaaaattgtagtttacattgttaaacttatataatcagttttattgagattcaatttttctaaaccacatttcaaatatggtgctgcggatgtctgcagaaatattctgatcatcctatattcaac

SEQ ID NO: 3094 - DNA, 1620 bp, Vitis vinifera
gggaacttgtccatcagaagcccgtacgcctacctttcttacgtctccctcaacggtcaaaaatggcgcgcaagaagatcagagagtacgattccaagaggctgttgaaggagcattttaagaggctctctggtaccgaccttccaattaaatcagctcaaatcacagagtcaactgacttcaatgagctagcagagaaggaaccttggctcttatcagggaaactggtcgtgaaacctgacatgttatttggcaagcgtgggaagagtggtttagttgccctgaatttagatttggctcaagttggtactttcgtgaaagaacgtcttggcaaagaggtagagatggggggatgcagagggcctatcacaacattcattgttgaacccttcatcccacacaatgaagagttttacctaaacatggtttcagagcgacttgggagtagcataagcttttccgaatgtggaggtattgaaattgaagagaactgggataaggttaaaactatatttatcccaaccggggccacttttacctcagaaatttgttctccactagttgccacccttcccttggagatcaaggggaaaattgaggagtttatcaaagtggtttttgctttatttttagatctggacttcactttcctagagatgaatccttttacattggttgatggaaagccttatcctttggatatgagaggcgagctggacgatactgctgctttcaagaacttcaagaagtggggcaatattgaatttccaatgccatttggaagagttatgagtcctacagaaacctttattcatgggctagatgaaaagacaagtgcctctttgaagttcacagttctgaaccccaagggacggatttggactatggtagcaggaggaggtgcaagtgtcatctatgcagatacggttggtgatctcggttatgcttctgagcttgggaactatgcagagtatagtggagcaccaaatgaagaggaagtattgcagtatgctagagttgtaattgattgtgcaactgcaaaccctgatggccttaagagagctcttgtaattggaggaggaatagctaactttactgatgttgctgctacttttaatggcataattcgcgctttgaaagagaaggaatcaaagcttaaagcttcaagaatgcacatatacgttaggagaggaggtccaaattaccagaggggtcttgcaaaaatgcggactcttggagaggaaattggaatccctcttgaggtttatggacctgaggcaaccatgactggcatatgcaaacaggcaattgagtgcatcggtgctgctgcataagtgtaccaaatcttgataaaaatctctgttctcgtcttttcatgtctatggcaaactcagggtgttccattaagtgttcttaccagttcaattgttccagaaaccgtaggacgttaaattgtactttcatataaatgggccactaataatggtctttgagtatcaggttagtgagcttgagactgatgacaccttagcacaatgataaaacagcttacattgatgtccatcttaatctgtcgacctgcttttgtatttgttttttgtcattaaactctcctatttt

SEQ ID NO: 3095 - DNA, 1836 bp, Lupinus angustifolius
gtttacttaatctcttccattttccgctaccctcttcttcctacttgtgttctacgatattccaccaaccaaaaacccattattatttttctctcattgcccccaaagaatatattaattaaaaaaaatcgaagctttcagctataaatagagccatcacacacttaaatcattcgttcacgtgttcgttagatctaacaacccaccccactttctttcttttctctatcttacgattaaggagaaatggctcgcaagaagatcagagagtacgattccaagagattggtgaaggagcactacaagagactttctgggaatgacttgcccatcaagtctgcacaagttacagagtccactgatcttgttgagctacaagagaaggaaccttggctttcctcttctaagttggttgtgaaaccagacatgttatttggaaagcgtggcaaaagtggattggttgccttaaacttggatttggcacaagttgcttcatttgtgaaagagcgcctgggaaatgaggttgaaatgagtggatgcaaaggacccataacaactttcattgttgaacctttcatcccacacaatgaagagttttacctgaacattgtctctgagagacttgggaacagcataagcttttcagaatgtggaggaatcgaaattgaagagaactgggataaggttaagactgtatttgtcccaacaggagtgtctctcacatcagaaattattgccccacttgttgcaactcttcccttggagatcaagggagaaattgaggagtttctcaatgtgattttcaacctatttcaagacctggatttcactttcttagagatgaatcctttcacattggtcaatggaaagccttatcctttggatatgagaggcgagttagatgacactgctgctttcaagaacttcaagaaatggggaaacattgaatttccattgccatttggaagggttatgagtcccactgagtctttcattcatggattagatgaaaagacaagtgcatctttaaaatttacagtgttgaacccaaagggccgaatttggacaatggtagctgggggaggtgcaagtgtcatctatgctgacactgtaggtgatcttggctttgcaaatgaacttggaaactatgcagaatacagtggtgcacccaaagaagacgaggtcctacagtatgccagagttgttattgattgtgcaactgcaaatccggatggtcaaaagagagcccttgtgattggaggaggcatagctaactttactgatgttgctgctacatttagtggcataattcgagcactgaaagagaaggagtccaagttaaaagcagcaaggatgcacatttatgtgaggagaggaggtcctaactaccagaagggtctagcaaaaatgcgagcactcggagaggatattggcatccccattgaggtttatggaccagaagcaacaatgactggtatatgcaaagaggcaatacagtgcatcactgcttccgcttaatcatccatattaggccacaatgcattctttcaaagcatttttatgtctagtctgaagtgaaccttgattcttaattcctagaattggaaaacttagttacagacatctttacaaaatcaagtcttccataaaaatgtatcagagaatgttgtgtctcattttttgtagagttcttctgaggcactgtgttaacaccataaaaatgtcttatttttggatatttatcattgaaatatgaatgattgagatcatggtattgttaagatgttctacgtcttacctagtatatctataatgataagatatcatattttaatg

SEQ ID NO: 3096 - DNA, 1728 bp, Cucumis melo
catcgtgcacctataaatacaaaggttgttggtaaggtaaggcaattcttgtgcaggcgaaccgaattcatcaacttccatcctcctccttctacttctaatccaaaggctttgtaaaaatggctcgcaagaagatcagagaatacgactctaagagattgttgaaggagcacttcaaacggatctctggtagagaactccccatccaatccgctcaagtcactgaatcaactgatttcaatgagcttgttgagaaggaaccttggctttcttcatcaaaattggtcgtgaagcctgacatgttgtttggaaagcgtggcaaaagtggtttagtcgccttaaatcttgatctggctcaggttgctgcatttgtgaaagagcgccttgggaaagaggtaacaatgggtggatgtaagggacccatcaccacatttattgtggaacccttcattccgcacaaggaagaatactatctcaatattgtctcagagagacttgggtgcagcattagcttctcggagtgtggaggaattgaaatcgaagagaactgggataaggttaaaaccatatttatccccacaggagtgtccctcacttcggaaacatgcgccgagctggtggcaacccttcctttggagatcaaaggagaaatcgaggagtttatcaaggcagtctataccctattccaagatctggactttactttcttggaaatgaatccttttgcgattgttgatgagaagccctatcctttggatatgaggggtgaactagatgatactgctgctttcaagaacttcaagaagtggggaagtattgaatttccaatgccatttggtagggttatgagtcccactgagagctttatccatggcctagacgaaaagacaagcgcatctttgaaattcacagttttgaaccccaagggacgtatttggaccatggtggctggaggtggtgcaagtgtcatatatgcagacacggttggagatcttggttatgcctctgagctcggaaactatgcagaatatagtggagcgcctaatgaggaagaggtgttgcagtatgccagagttgttattgattgtgcaactgcagaccccgatggccaaaagagagcactcgtgattggaggaggaatagcgaactttactgatgtagctgctacatttaatggcataattcgggccttgaaggagaaggaatcaaggctaaaagcagctaggatgagtatttatgtgaggagaggaggccccaactaccagagagggcttgctaagatgagggcagttggtgaagaacttggtgttccaattgaggtctatgggccagaggcaaccatgactggcatatgcaagcaagcaattgagtgcataactgcagctgcataaatcgggatacaccatccgcatcgttcttgtcatagaaatcttatattatgtgtagttttctttgcctttgaccaatttgtggtgatagttcgtcaagcttttaataaaaatctcaatctgtgatgcattcggaacaaggatttgagtggataatgataaagcaaagggatggtatgaattgagaatgtagatgcaagatgggtgtaacgacttggggctatttcgtttctttatcagtataagctcactgcttttattacatttaagatggtagctattcaattgagttcgtcaatgtctcacaactctttcaacaatattaatgtaatgatactta

SEQ ID NO: 3097 - DNA, 1770 bp, Nicotiana benthamiana
ttgtcggtgtatgtcttacaactttgtcagatacattcagctcaagattcattgaatcagtgttttctttgtcctcttttttaacggtaaaaaaatggcccgcaagaagatcagagagtatgattcaaagagattgttgaaagagcattttaagaggcttggaggttatgatttggccattaagtctgcacaggtgacagagtctactgatttcaatgagctagcagagaaagagccttggctcaactcgtcaaagttggtcgtaaagcccgatatgttatttgggaagcgtggaaagagtggtctagtcgccttgaatcttgatcttgctcaagttgctacttttgttaaggagcgcctcggcaaagaggtggagatgggcggatgcaaaggtcccatcacaaccttcatcgtcgagccattcatcccccacaatgaagagttttatcttaatattgtctcggacaggcttggttgcagtgtaagcttttctgaatgtggaggaattgacattgaagaaaactgggacaaggttaagactattttcgtgcccacaggaacttcttttacttcagaaatatgtgctccacttgtcgcgacactaccattggagattaagggcgtcattgaggatttcctcaaagtggtttacactctatttcaagatttggactttactttcctagagatgaatcccttcgcattggttgaagggaagccttatcctctagatatgaggggtgagcttgatgacactgctgctttcaagaacttcaaaaagtctggaaatattgaatttccattgccatttggaagggttatgagtgctacagagagctttattcacgggcttgatgaaaagacaagtgcatctttgaagttcacagtcttgaaccccaaggggcgaatttggactatggttgctggtggaggagctagtgtcatctatgcagatactgtaggcgatcttggatatgcttctgaacttgggaactacgcagaatacagtggtgctcccaatgaagaagaggtcttgcagtatgccagagttgtaattgattgtgccactgcaaatcctgatggccgtaagagagcccttgttattggcggtgggatagccaacttcactgatgttgctgctacatttagtggtattattcgagctctgaaggagaaggaatcaaaacttaaagcagcaagaatgcaaatctttgttagaagaggaggtccaaactaccaaaaaggtcttgctaaaatgaggtctcttggcgaggaaattggcatcccaattgaggtttatggacctgaggcaaccatgactggcatatgcaaacaggcaattgagtgcatcactgcagctgcataaaccaaccaacctcgttctccaagctgaactgtttttgttgtctttgtttgtgctatgtactagtagtgtcttgttgtatgccacatttaagtaatttgatttgtatctttgacatttcaaatttaaagggccatgaacaatgatctccagtagtgaattcagttttccaatctcaacatgaagtccatcaaaatccttggttcaagaatccttgtactacatcttgtgagcagagtgcactgaacttcaatccttctttaaatcagaaaggaaacatctcaatgttatactattgccttaaggtgttgtttggatgcttagattcttttacatagtatcagggtcaaacattattaaactcgttagcactacgtggagttgcttggacttctttctctcttaaa

SEQ ID NO: 3098 - DNA, 1566 bp, Lippia dulcis
cacatctaattgtcacgtagatcgaactataaattggggtatcacgggattttgatttggagctcgtgttagccatctgtctcaatctctgaaattcttggcttcgtccgtctctctctgcacattcaacgagaagaaaatggcgaggaagaagatcagagagtacgattccaagagattgttgaaggagcatttcaagaggatttctgggtccgaattggaaatcaaatccgcccaagtgactgaggatactgatttcaaagacctagtggataaagaaccatggctatcctcatcaaggttggttgtcaagccagatatgttatttgggaagcgtggaaaaagtggtcttgttgctttgaacttagatttggccggcgttgctgcttttgtcaaagagagacttggcaaagagatagagatgggaggatgcaaagggcccattactacattcattgtcgaaccatttgttccacataatgaggaatattacctaaacattgtctctgagaggcttggttgtagcattagcttttctgaatgtggaggaattgaaattgaagagaattgggacaaggtgaaaactatctttcttcctacaggctcttctttcacatcagagctatgtgctccacttgtggcaactctccccttggagatcaaacttgtgattgaggagtttctcaagtccgtctatgatatatttttagatttggacttcaccttccttgagatgaatccattcaccttggttaatggaaagccttatcctttggatatgaggggcgagcttgatgatactgctgctttcaagaacttcaaaaaatgggggaacattgaattccctatgccatttggaagagttatgagtcctacagaaagctttattcacgggcttgatgagaagactagtgcatctctgaagttcaccgtgttgaatcccaagggaagaatttggactatggttgctggaggaggagcaagtgtcatctatgccgataccgttggggatcttggctttgcttccgaacttggaaactatgctgagtacagtggtgctccgaatgaagaagaggtcttgcagtatgcccgtgttgttattgattgtgcaactgcagatcccgatggcagaaagagggccctcgtaattggtggtggaattgctaacttcaccgatgttgctgccacattcagcggcattatacgcgctctaaaagaaaaggaatcgaagcttaaggctgcaagaatgcatctatacgtaagacgaggcggtccgaactaccaaaagggccttgcaagaatgagaactcttgcagaagaaattggcctccccattgaggtttatggaccagaggccaccatgactggcatttgcaaacaggctattgagtgcatcagtgctgctgcatgaaatgaagttaccactccttgttatctgcttttattttcatttaatttagtgtattgttgtattcaatatttcccaaggatgtattcttgacataaatgaacctcaattcaaagacagtagccttgtatgtgcaatgacatattgattatgattta

SEQ ID NO: 3099 - DNA, 1784 bp, Cajanus cajan
tgtactttctccaaagcctatgttatatataccatgaagccacccaccaccaatgcactaacacaatccacacccaccattggatccaccaatctctaaccttcttctcctctgatccgtttctctctctaacggagagaggtttctgcttttggtgcgcgtttgaggagaagcaatggcacgcaagaagatcagagagtatgactccaagaggctgttgagagagcactttaagagactctctggccaggacttgcccatcaagtctgcacaagttacagaatgcaccgatttcaatgagctagcagagaaggaaccctggctttcatcttcaaaattggttgtgaaacctgacatgctatttggaaagcgtggcaaaagtggtttggttgccttgaatctggatttggcagaagttgcttcttttgtcaaagagcgtcttggcaaagaggttgagatgagtggatgcaaagggcctataacaactttcattgttgaaccttttatccctcacaaggaggagttttaccttaacattgtgtcagagagactagggaacagtataagcttttctgaatgtggaggaattgaaattgaggagaactgggacaaggtcaagactgtatttattccgacaggcatatctcttacattggagaacattgcaccacttgttgcaacccttcccttggagatcaaggtagaaattgaggaatttctcaaggtgattttcgctctatttcaagatctggatttcactttcttggagatgaatcctttcactttggtcaatggaaagccatatcctctggacatgagaggcgagctagatgacactgctgctttcaagaacttcaagaaatggggaaacattgaatttccaatgccatttggaagagttatgagtaccacagagtctttcattcatggattagatgaaaagacaagtgcatctttaaaattcacggtgttaaacccaaagggccgaatttggacaatggtagctgggggaggtgctagtgtcatctatgctgatacggtaggagatcttggttatgctcctgagcttggaaattatgcagagtatagtggtgcacccaaggaagatgaagtcttgcagtatgccagagttgtgattgattgtgcaacttcagaccctgatggccaaaagcgagcccttgtgatagggggaggaatagctaactttaccgatgttgctgctacattcagcggcataattcgcgctctgaaggagaaggaacaaaagctaaaagaagcaaagatgcacatttatgtgaggagaggaggtcccaactaccaaaagggtctagctaaaatgagggcacttggagaggaaattggcatccccattgaggtttatggacctgaagcaacaatgactggtatatgcaaacaggcaatccagtgtatcactattgctgcttagttatccattattaggtcaatgccttcttctacaagtattttcatggctagtttgaagtgattgttgattcttaattccctttaccactctcggaattgatgagcataggttgttataaattagtcatttagtcatccaataaagtggtcaagagtgttttgtatcgtctagaattctggtagtacagtgttgagacaataaagtgccaaatgtaattgttatatgttaagctgcaatttcattgttccggatttactttcatttagtaaattggttttctttccactccattggaacttaaatttccgttgaaaaggttttctcaataagcttgttt

SEQ ID NO: 3100 - DNA, 1950 bp, Cajanus cajan
aatcacattgctccaaatacaaagtcggatatgtgtacccaacacgcccaactactggttgaatgaaagatgaaacttagacgttgatgataaggaaagagtagtaagtaggtgggtaacccctcatgtgattgtgctgcttgtgtatgcctaattcctcttcaatatctctcttacattccaccaacccaaccaccatttccccaaataaaataatcaaaccccttcacttataaatacacccaccacacactcttatccttcgttcactcgttcgttagatctaactactcacccacttccctctttctcattcttttctctacccaacgaaacagagtaagaacaaatggcgcgcaagaagatcagagagtacgactccaagaggttgttgaaggagcactttaagagactctctggcaaggagttgccgatcaagtctgcacaaattactgtatcaactgatttcactgagctacaagagaaggaaccttggctttcatcatccaaattggttgtgaagcctgacatgttatttggaaagcgtggcaaaagcggtttggttgccttgaatttggattttgcacaagttgtttcgtttgtgaaagagcgtcttggaaaagaggttgagatgagtggatgcaagggacccataacaactttcattgttgaacctttcatcccacacaatgaagagttttaccttaacattgtctccgagagacttgggaacagcataagcttttcagaatgtggaggaattgaaattgaagataactgggataaggttaagactgtatttgttccaacaggcatatctattacgtcagaaatcgttgccccacttgttgcaacccttcccttggagatcaagggagaaattgaggaatttctcaaagtggttttcactctgtttcaagacctggatttcactttcttagagatgaatcctttcacattggttaatggaaagccttatcctttggatatgagaggcgagctagatgacactgctgctttcaagaacttcaagaaatggggagacattgaatttccactaccatttggaagggttatgagtgccactgagtctttcattcatggattagatgaaaagacaagtgcatctttaaaattcacagtgttgaacccaaagggccgaatttggacaatggtagctgggggaggtgctagtgtcatctatgctgatacggtaggagatcttggctttgcatctgagcttggaaactatgccgaatacagcggtgcacccaaagaagaggaggtcttgcagtacgccagagttgtaattgattgtgcaactgcaaaccctgatggccagaagagagctcttgtgattggaggaggcatagccaacttcactgatgttgctgctacgtttagtggtataattcgggcactaaaggagaaggaatcaaaattgaaagcagcaaggatgcacatctatgtgaggagaggtggtcccaactaccagaagggtctagctttaatgcgagcacttggagatgagattggcatccccattgaggtttatggacccgaagccacaatgactggaatttgcaaagaggcaatacagttcattactgctgctgcttaaggtcaacactcaacaccttcatttacggtattttcatgtctagtccgaagtgaacgttgattcttaatttcctttcctgttcctggaatttggaaatttagccagagtacatgtttataaaatcaagccatccaagaaagagtggccgaggatgttgtcacattgtttttgtagaattttgatggcactgtctttacacaataaagagtgtttttcgtttgactgttataatttttccaagcgtcttgatctgctttcttagaagaacatgcatgtttaatagttgaacaatgttcttcacgcatattttactatatttaattttgttt

SEQ ID NO: 3101 - DNA, 1528 bp, Platanus occidentalis
gattctcctttgcatctgctttaaaggttttgcgaaaacaggtgaaaatggcacggaagaagatcagagagtatgattcgaagcggttgttgaaggagcattttaagaggctctccggtacggaaataggcattaaatctgcacaggttacggaatcaactgatttcaatgagctggtagaaagagaaccttggcttttgtcgggaaaattggttgtgaaacctgatatgttgtttgggaagcgtggaaaaagtggtttagtcgcactaaatctagatttggctgaagttgctacatttgttaaacagcgtcttggcaaagaggtcgagatggggggctgcaagggtcctataacaacattcattgttgaaccctttgtaccgcacaatgaagaattttatctcaatattgtctcagagagacttgggtgcagtgtgagcttttcagattgtggtggaattgaaattgaagaaaactgggataaggtcaagaccatatttgtcccaacaggggtgtctttcacatcagaaacatgtgctccattaattgcaacccttccgcttgaggtcaaagacaaagttgaggagtttatcaaagtgatttttgctctatttgtagacctggacttcactttcctagagatgaatccttttactttggtcgatggaaagccttatcctctggatatgagaggcgagctggatgatactgcagcattcaagaattttaagaagtggggtaacattgaatttccaatgccatttggaagagttatgagttctacagaaagctttattcatggactagatgaaaagactagtgcatctttgaaattcactgttttgaacccgaaagggagaatttggacaatggtggctggaggaggtgcaagtgtcatctatgcagacacggttggtgaccttggctatgcttctgagcttgggaactatgcggaatacagtggagccccaaatgaagaagaggtgttgcaatatgctagagtcgtaattgattgtgcaactgcaaatcctgatggctgtaagagagctcttgtaattggaggaggaatagctaactttaccgatgttgctgctacattcagtggcataattcgagctttaagagagaaggaatcaaagcttaaagctgcgcaaatgcatatttatgtgaggagaggaggtccaaattatcagaagggtcttgcaaaaatgcggactcttggagaggaaattggcattcctattgaggtttatgggcctgaggcaacaatgactggcatatgcaaacaagcgatccagtgcattacagtcgccgcataaaactatcaaaaaccaaataacatggtttcttttggcagttatttttcattttcatggcaagtttcaagtaaactatcagcctttagaataaatcttattgtattagaaagctttggaagctgtgttgtacttctatcttcatggtaataaattgtgtttgcattcacagttcttgtgttaaagtaatagtcagtggtctattttgggca

SEQ ID NO: 3102 - DNA, 1670 bp, Sequoia sempervirens
gtttttttaagttgagctctaaagaagagctgaatcctacttatctgttatttcagctggaactggttgaaatccagcgttactaatagtctttgaattgaactgcagagagactataggtaaaaaatggctagaaagaagatcagagagtatgattccaagcgcctattaaaagaacatttgaagaggcttgctgctattcagcttgatatcaaatcagcccaggttacagggtcaacaaatctgaatgagctggcagacaatgagccatggttgtcggcatcaagactggttgtaaaaccagatatgctgtttggaaagcgagggaagagtggtttggttgccttaaatttggatttagcacaagctgcagcatttgtcaaagaacgcctaggaaaggaggttgagatgggtggtgcaaggtccccaatcacaacttttatattagagcctttcattcctcacgaggaggagtattatctttcaattgtttcagaacgccttggttgcacaataagtttttctgcatgcggaggcattgagattgaagaaaattgggataaggtcaagacagtatttgttccaacagaaaagtctttaacatcagagctttgtgctcctttaattgcaacgctccccttggagatccgtgggaaaattgagactttcattacaggtgtttacaaagtttttctggatttagacttcactttcttagagatgaatccatttacacttgttgatggaaatccttaccccttggatatgagaggagaattggatgacactgcagcttttaagaacttccaaaagtggggccagattgaattcccattaccttttggtcgagtcatgagccctgcagaagatttggttcacaacatggatgaaaagacaagtgcttccttgaagttcactattctgaatccaaaagggcgtatctggacaatggttgctggaggaggagccagtgtgatatatgctgatactgttggagatttaggctatgcaagtgaacttggtaactatgcagaatatagtggagctccaaatgaagaagaggtgttatactatgcgcgagttctgatagattgtgcaactgcaaatccagatggccgcaagagagcactgttaataggtggaggaatagctaacttcacagatgttgctgccacatttaatggcatcattcgagctttgcgtgaaaaggaatcaaaacttaaagctgcaagggtgaatatatatgtaaggagaggaggaccaaattaccaaagtggcctagcaaagatgcgagctctaagtgaagagattggggtaccaattgaggtctttggaccagaagctagtatgactggaatatgcaagcaggctattgagtacattacagctgctgactaaattgcggaaatgtcttaatatctctatttatttgttttagacttactcatgggggctatatttagagagtcaaaatcttgctggtgggtttgtgtgctaagtttgcaggcaatcagtaccatgtgaaatttgagatgtcttccatgcaaattcaaggatgtaggattcttcttttatctgggttgtttaagctgtggactgtttcacactttataggttgaattattcttcaaacattgccatttatttaattaaattaataacgcagacaa

SEQ ID NO: 3103 - DNA, 1662 bp, Solanum phureja
aaaccatcttattttttacaattccttttttttctttaatttttttaatttgtccattatttaatagccattgttgaacttatatatataaatagaggtattagagttcccaagattgtcagttgtgtgtctcgtttttaacgtttaagatctcaactttcttgcccttattttgatctgtgaaacaagatttgatttgggttttcagatctgttgttgggttttgaaaatttcttcctgtttttgtttaagaaaaaaaaatggccaggaagaagatcagagagtatgattcaaagagattgttgaaggagcatttcaagagacttggaggttatgatttggctatcaaatctgcacaggtgacagagtctactgacatcaatgagctagcagagaaagagccttggctcaactcaacaaagttggttgtaaagccagatatgttgtttggcaagcgtggaaagagtggacttgttgccttgaatcttgatcttgctcaagttgctacttttgtgaaggagcgtcttggcaaagaggtggagatgggcggatgcaaaggtcccatcacgaccttcattgttgagccattcattccccacaatgaagagttttatcttaatattgtctcggagaggcttggttgcagcataagcttttctgaatgtggaggaattgacatcgaagagaactgggacaaggttaagactatctttgtgccgacaggaacttcttttacatcagagatatgtgctccacttgttgccactctaccattggagattaagggtgtcattgaagagttcctcaaagtgatttacactctatttcaagatctggacttcactttcctagaaatgaatcctttcacattggttgaaggaaagccttatcctcttgatatgaggggagagcttgatgacactgctgctttcaagaacttcaaaaagtggggaaatgttgaatttccattgccatttggaagggttatgagtgctacagagagcttcattcatgggcttgatgaaaagacaagtgcatctctgaagttcacagtcttgaaccccatggggcgaatttggactatggttgctggtggaggagctagtgtcatctatgcagatactgtaggtgatcttggatatgcttcagagcttgggaactatgcagagtacagcggtgctcccaatgaagaagaggtcttgcagtatgctagagttgtaattgattgtgccactgcaaatcctgatggccgtaagagagccctcgtgattggtggtggaatagccaacttcactgacgttgctgctacatttagtggtattattcgagctcttaaggagaaggagtcaaaacttaaagctgctagtatgaacatatatgttagaagaggaggtccaaactaccaaaaaggtcttgcaaaaatgaggtctcttggcgaggaaattggcatcccaattgaggtttatggacctgaggaaaccatgactggcatctgcaaacaggctattgagtgcatcactgcagctgcataaattaaccaagttgaacctttttagttgtcgttttttgctttgtgttagtgttttgtttgatttgtatgtttgacatttcacataaatgggccatgaacaataatgaattttagtttttcaatttcaacat

SEQ ID NO: 3104 - DNA, 1600 bp, Triphysaria pusilla
aatagaagtagcaaatattcaaagatttcagctcgtgtcaataaatagttgcaaaccagtctcaattccacacacaccagaaattcttgcacctaacattcaacagtcgaaaagaaaatggcaaggaagaagatcagagagtatgattccaagagattgctgaaagagcatttcaagaggatttctgggtctgacctcgaaatcaaatctgcccaagtcacagagtcgactaatttcgaggaactagtggataatgaggcatggatatcatcgacaaaacttgtcgtgaaacccgatatgctattcggcaaacgtggcaaaagtggccttgtcgctttaaacctcgatttagctggtgttgctgcttttgtaaaagagcgcctcggcaaagaggtggaaatggggggttgtaaaggacctattactacgtttattgtcgaaccatttgttcctcacaacgaggaatattatttgaacattgtttcggaaagactcggttgtagtattagcttttcggaatgtggtggaattgatattgaagagaattgggacaaggtgaaaactatatttgtgccgactggctcgtcctttacatcggatctttgtgctccacttgtggcaacacttcccttggagatcaaaggtgtacttgaggagttcatcaaatatgtgtacactttatttttagatttggacttcactttcctcgagatgaacccgttcaccttggtcgacggaaagccttatcctctggatatgagaggcgagctcgacgacactgcaacttttaagaacttcaaaaagtggggaaatattgagttcccaatgccgttcggaagagtaatgagtcctacagaaagctttattcatggacttgacgagaagacaagtgcgtcactgaaattcaccgttttgaacccgaaaggacgaatttggactatggttgctggaggaggcgcaagtgttatatatgctgataccgtcggagaccttgggtatgcatccgagctagggaactatgcagaatacagtggtgcccctaatgaagaggaggttttgcaatatgctcgagttgttattgattgtgcaactgcagatcccgatggcagaaagagagcactcgtaattggtggtggaatagctaatttcactgatgttgctgccacattcagtggcattatccgagctttaagagaaaaggaggccaagctgaagtccgcgagaatgcatttatacgtgagacgaggaggcccgaattaccaaaagggcctcgagaaaatgaggactcttgctgatgaaattggcatccctattgaggtatatggaccagaggcaacaatgaccggaatttgcaaacaggccatcgactgcattagtgcagctgcctgaacttgatgcaaaattgcattgttctactcgttttcttttcgtttttcatcattgttttgtaacgcgaaaataaaaatacaattgaaataaattgaagtccaattatatctgatagcttgcaatgatatgaaaaaagtcatttcatgtgctttggtttctcaaaacttttcgatggccaaaaagtatacaaaattctaaaaaaaaaaaaaaa

SEQ ID NO: 3105 - DNA, 1890 bp, Pseudotsuga menziesii
cacatcaatcggtcaggggtagtcaagaagggtgggctagtgccaaacgtggtcaggtagcaattttcaagttttgcgagcccacgtgattcatccaacccaggcatatttaatacccacaactctacccgaagacacaggccgtgaaatttttgttgggttcgtcagatttctcctattactttctccagattaaacagtgatattcacaatggcgagaaagaagattagagaatttgattccaagcgcctattgaaggagcaccttaagaggctcactggaatgttggtcgacatcaaatctgcccaggtaacagaatcgactgatttcaatgaactagcagacagagaaccatggctatcctcgagcagactcgtagttaagcctgacatgttgttcggaaagcggggaaagagtggtttggtagccttgaatctggacctcgcccaggttattgcatttgtcaaggaacgcctaggaaaggaggttgagatgggggtgcaagggcacctataacaacattcatcgtggagccatttgtacctcatgatgatgagttttatatgtcgatcatgtcagagcgcctcggttcaaccattagcttttcagaatgcggaggcattgaaatcgaagaaaattgggacaaggttaagtcagtatttgtcccaactgaaaagtccctgacggctgagttatgtgcacccttgattgcaactcttccattggagatccgaggcaaaattgagaccttcataaagggagtgttcaatttatttatggatttggacttcactttcttggagatgaatccttttacactggttaatggggagccttaccctctggatatgcgaggagaattggatgatactgctgcatttaagaacttcaaaaagtggggcagtattgaattcccattgcctttcggtagagtcatgagtccttcagagagtgcaatacacggcatggatgaaaagacaagttcctctctgaagtttactattctaaatccaaaaggacgcatttggacaatggttgctggaggaggtgcaagtgtgatatatgctgacacggttggagatttgggatttgcaaatgaacttggaaactatgcagaatatagtggagctccaaatgaagatgaggtgttacaatatgcaagagttttaatagattgtgctactgcaaatcctgatggccgtaagagagcactagtggtaggtggagggatagctaacttcacggatgttagtgctacatttagtggaatcattcgagccttgcgtgaaaaggaatccaaactcaaagcagcacggatgcaagtgtatgtgagaagaggtggtccaaattatcagaatggtctttcaaagatgcgtgcccttggtgaggagattggggtcccattccaggtttatggaccggaagctagtatgactggcatctgcaagcaagctatacaaaatataacagccgctgcataaatttctcaagtaaatcatgttatagtttgctgtcttgtttgaggatggttacgttgcttctgtctattaggttacgggatgttgtctctggaaaaactgagcacaacctcccatgattctctgaagtattttgaagctgattctgtagtctgcttatttgctctcttttgttactatagcaaaagggcaatgttacatttttatcataaatatcatgtggatcatggttagattgtgaggaatattaattgatagcttatattaatttcatttagaaagttgattatgagggaggttctgtcctgtaataaacttggaatgatgcttaagatgattcctttttcttatgtaattcttgttcttttgctaattgaatgatatcaatgtaggaccaatggctttgctaga

SEQ ID NO: 3106 - DNA, 1537 bp, Capsicum annuum
gttttttgtgggttcttgctttcaacggtaaagatctcaactatatttgatctgcgtattcagatctattgataaagaaaaatggcacgcaagaagatcagagagtatgattcaaagagattgttgaaagagcatttcaagagactcgcaggttatgatttggccattaagtctgcacaggcaacagagtctactgacatcaatgagctagcagataaagagccttggctccactcaacaaagttggttgtaaagcctgatatgttatttgggaagcgtggaaaaagcgggctagtcgccttgaatcttgatcttgctcaagttgctacttttgtgaaggagcgcctaggcaaagaggtggagatggccggatgcaaaggtcccatcacaaccttcattgttgagccattcatccctcacaatgaagagttttatcttaatattgtctcagagaggcttggttgcagcgtaagcttttctgaatgtggaggaattgacatcgaagaaaactgggataaggttaagactatctttgtgcctacagggacttcttttacatcagagatatgtgctccactagttgccactctaccattggagattaagggtgtcattgaggagttcctcaaagtgatttacactctatttcaagatctggacttcactttcctagagatgaatcctttcacattggttgaaggaaagccttatcctctggatatgaggggagagcttgatgacactgctgctttcaagaacttcaaaaagtggggaaatattgaatttccattgccatttggaagggttatgagtgctacagaaagctttattcacaggcttgatgaaaagacaagtgcatctttgaaattcacagtcttgaaccccaaggggcgaatttggactatggttgctggtggaggagctagtgtcatctatgcagatactgtaggtgatcttggatatgcttctgagcttgggaactatgcagagtacagtggtgctcccaatgaagaagaggtcttgcagtatgctagagttgtaattgattgtgccactgcaaatcctgatggccgtaagagagctcttgtgatcggtggtggaatagccaacttcactgacgttgctgctacatttagtggtattattcgagctcttaaggagaaggaatcaaaacttaaagctgcaagaatgcacatatatgtcagaagaggaggtccaaacttccaaaaaggtcttgcaaaaatgaggtctcttggcgaggaaattggcatcccaattgaggtctatggacctgaggaaaccatgactggcatctgcaaacaggctattgagtgcatcactgcagctgcataaattaaccaacctcatcctccacgctgaacttctttagttgtctttttttgctttgtgttaccatcatgttgtatgccaagtatgagcaatttgttttgtatctttgacatttcacataaatggaccatgaacaatgagctccagcaattaatttagttttccaatttcaacatgaagtccgttg

SEQ ID NO: 3107 - DNA, 2057 bp, Cicer arietinum
acaaaaaaagaaaaaatgagaccaaatagtgagggtaattgttgaatgttgaaagtgtggttgaagttacaggcattggtccgaagtaggatactaggtaggtggtaccctacatgtgcgtgtcttgtgttttgttcttccctttctcttcttctataattcaccaacccaacaacctcatcactttctattccgtttttttttttcttttttttttcttcaccaagcattgaaaaacaaaatcaaatattcatctataaatagatccatcacacaacaaccacatcgttcgttcataaactcttccttagatccaatccaattactcattctctttccgattaagaagaaatggctcgcaagaagatcagagagtatgattccaagagattgttgaaggaacactttaagagactctctggcaaggacttaccaattaagtctgcacaagttacagaggccactgatttcacagcgctgcaagacaaggaaccttggctttcttcttcaaaattggttgtgaaacccgacatgttatttggaaagcgtggtaaaagtggtttggttgccttgaatttggatttggcacaagttgcttcattcgtgaaagagcgtctcggtaaagaggttgaaatgggtggatgcaagggaccaatatcaactttcattgtcgaaccattcatcccacataatgaagagttttaccttaacattgtttctgatagacttgggaacagcataagcttctcagaatgtggaggaattgacattgaagataattgggataaggttaagactgcatttgttccgacaggagtgtctcttacatcagaaatcgttgccccacttgttgcaacccttcccttggagatcaagggagaaattgaggactttctcaaggtgattttcactttgtttcaagacctggatttcactttcttagagatgaatcctttcacattggttgatggaaagccttatcctttggatatgagaggcgagctagatgacactgccgctttcaagaacttcaagaaatggggtaacattgaattcccactaccatttggaagggttatgagtgccactgagtctttcattcatggattagatgaaaagacaagtgcatctctaaaatttaccgtgttgaacccaaagggtcgaatttggacaatggttgctgggggaggtgctagtgtcatctacgctgacacagtaggagatctcggctttgcatctgagcttggaaactatgcagaatatagcggtgcacccaatgaagaggaggttttgcaatacgccagagttgtaattgattgtgcaactgcggatcctgatggccaaaaaagggctcttgttataggaggaggcatagctaactttaccgacgttgctgctacttttagtggcataattcgggcacttaaagagaaggaatcgaagttaaaggccgcaagaatgcacatttacgtgaggagagggggtcctaactaccaaaagggtctagcgaaaatgcgagcacttggagaggaaatcggcatccccattgaggtttatggacctgaagcaacaatgactggtatatgcaaagaggcaatacagtgcattactgcttctgcttaactctccatttctggtcaatgcttcctgggtatcgtgtcattcgcaagttgaagttaatgttgattattgatttactttcccgttcctggagtttgtatatttagttagaccatatgtttataaaatcaagctatctaaaaagagtggttgagaatgttgtctcattttttgtagaattttatggtactgtcttgatacaataaagagattatttttcttttgattgatacctgtttctgtgtgttgaatctgttgatatactttcttctgctctccacacacacacaaaagcatgcttctggtttgctcaaaataagctctttaaactaaataaaaactccacaaaactgacttataaggagactatctaagccttataagccctgtaactccagtcgatgtgtgattctctagagttactcatgtatttttca

SEQ ID NO: 3108 - DNA, 1828 bp, Eucalyptus grandis
ttcaaagatgcctttttttcttgagatgctactgttcgtcacactcggtctgaacagaagaccagaccaaagccaaccaacccatattattctcaattttaactaacacgaaccggagagagagggagagcaaaaacccacctaccactataaatatagaagcaagctagcacgagaattcagcttcaatcgctgaatctacccatctaacctctcgacctgctcgtccagcctcctctttctcttcctctgtctctacccaacagcaaggcgaagggaaaaggagatggcccgcaagaagatcagagagtacgactccaagagactgttgaaggagcatttcaagaggctctccggcaatgatctgcccatcaaatctgcccaggtgacagaatctactgatttcaatgaactagtggagagggagccctggctctcttcagagaaattggttgtgaagccagacatgttgtttggtaagcgtgggaagagcggcctggtcgccttaaatcttgacttagctcaggtcgctgtctttgtgaaagaacgccttggcaaagaggtagagatgggtgggtgtaaaggacccattacaactttcatcgtcgagcctttcataccacacaaagaggagttctacctaaacattctctctgagcgtcttggcagcagcataagtttctccgagtgcggaggcattgaaattgaggagaattgggataaggtcaaaactatatttgtgccaactggttcaccttttacatcagaagtgtgtgctccacttgttgcaactcttcctttggagatcaaggcagaaatagaggagttcatcacagtggtttttaccctcttccaagatttggactttacattcctcgaaatgaatcctttcgcattggttaatgggaaaccttatcccctggatatgagaggcgagctggatgacactgctgctttcaagaacttcaagaaatggggcaagattgaatttcctctgccatttggaagagtgatgagccccacagagaccttcattcatggcctagatgaaaagactagtgcatctctgaaattcacggttttgaacccaaagggaagaatttggacaatggttgctggaggcggtgccagtgtcatttatgcagatactgttggtgatcttggctttgcctccgaacttgggaattatgctgaatatagtggagcccccaatgaagaggaagtcttgcagtatgccagagttgtgatcgattgtgcaactgctgagcctgatggccagaagagggccctggttattggaggaggtatagctaattttactgatgttgctgccacatttaatggcatcatccgtgcactgaaggagaaggaagcaaagcttaaagctgcgagaatccacatttatgtgagaagaggaggccccaattaccagaagggtctcacaaaaatgcgagccctcggagaggaaatcggcattcccattgatgtttatgggccggaggctactatgaccgggatatgcaaacaagccattgagtgcatcaccgcggctgcttgagttatcgacttcgataatctttgttgctcttctgcattttcatggacatttccaattgttcagttgaatcccaatagtcatttgtactggaaacgtttcgatgttatgaatgtaatttcatcaccataatcttgggccacaaccgcggtccctgagaataaaagcagtttccgtctcaaagctcatttatgccgggggacaatccacattgctagagacatcacgtgtacaagaattccgagtctatctacgatgaaatgattgaccaaa

SEQ ID NO: 3109 - DNA, 1554 bp, Lupinus angustifolius
actcatcttcaacaccattggatctacctaccttcttcttcattgatccattaccctttctcacgcacatttaagaagcaatggcacgtaagaagatcagagagtatgactctaagaggttgttgaaggaacacttcaacagaatctctggccaagatttgcctattaagtctgcacaagttacagattccactgatttcaatgagatagcagagaaggaaccctggctttcatcttcaaaattggttgtgaaacctgacatgctgtttggaaagcgcggcaaaagcggtttggttgccttaaatctagatttggcacaagttgcttcttttgtaaacgaacgtctcggcaaagaggttgaaatgggtgggtgcaaaggacccataacaactttcattgttgaacctttcatcccacacaatgaagagttttatctcaacattgtctctgagagactagggaacagcataagcttttcggagtgtggaggaattgaaatcgaagagaactgggataaggttaagactgtatttcttccaacaggagtgtctcttacaccagagaatattgccccccttgttgcaacccttcccttggaggtcaagggagaaattgaggagtttctgaagtcagttttcattctattccaagacttggatttcactttcttagagatgaatcctttcactttggtaaatggaaagccttatcctttggatatgagaggcgagctagatgacactgctgctttcaagaacttcaagaaatggggaaatgttgaatttccattgccatttggaagggttatgagtcctacagagagttttattcatggattagatgaaaagacaagtgcatctttaaaattcacggtgttaaacccgaagggtcgaatttggaccatggtagctgggggaggtgctagtgtcatctatgctgatacggtaggagatcttggttatgcacctgagcttggaaattatgcagaatatagtggtgcacctaaggaagatgaggtgttgcagtatgcaagagttgtaattgattgtgcaacttcgaaccccgacggccaaaaccgggcccttgtgataggtggaggaatagctaacttcactgatgttgctgctacattcagcggcataattcgagctctgaaggagaaggaacaaaagttaaaagaagcaaatatgcacatctatgtgaggagagggggtcctaactaccagagaggtttagcgaaaatgcgagcactcggcgaggagatcggcatccctattcaggtttatggacctgaagaaacaatgactggtatatgcaaacaagcaattcaatgcatcaatgttgcagcttaattaaccatttttagtacaaagtctcattttaatgtatttcatggcaactttgaagtgattgttgattcttaagagtgttttgtatcattatgtagaattctgatagcattgtcttttacacaataaagtaataagtgtaattcatttatgttaagtcaagttgtaatttcatggttctctaatttcagtaaattgatttaat

SEQ ID NO: 3110 - DNA, 1549 bp, Tropaeolum majus
ctgcctcgttgtggttctccaactaactcacacctaattttcatttcattctctctatcaacgaaatggcacgcaagaagatcagagagtatgactcaaagagattgttgaaggagcacttcaagaggctatccggcaatgaactgccgatcaaatccgcacaaattactcaatcaactgacattaccgagctaggggagaaggaaccttggcttttatccggaaaactggttgtgaaacctgatatgttgtttggaaagcgtggaaagagtggtttggttgccttgaatttggatttggctgaagttcacgcgtttgttaaagagcgccttggcaaagaggtagagatgggtgggtgtaaaggacctattacaacattcattgttgaacctttcatcccacacaatgaagagttttaccttaatattgtctctgatagacttgggtgcagcataagcttttcagaatgtggaggaattgaaattgaagaaaactgggataaggtcaagaccatatttgtccccacaggcggttctctcacagcagaaacagttgctccacttgttgcaactcttcctttggagaccaaaggggaaattgaggagttcatcaaagtggtttttaccgtatttcaagatttggacttcacttttctagaaatgaatcctttcgcgttagttgatggaaagccatatcctctagatatgaggggcgagctggatgacactgctactttcaaaaactttaagaagtggggcaatattgagttccctttgccatttggaagagtaatgagtgcaacagaaagctacatccacgggctagatgagaagacaagtgcatctttgaaattcaccgttttgaaccctaagggacgaatttggactatggtagctggaggaggtgcaagtgtcatatatgctgatacggttggagatcttggctatgcttctgagcttggtaactatgcagaatatagtggagcaccaaacgaagaggaggttttgcagtatgcaagagttgtgattgattgtgctacctcggatcccgatggccaaaagagagcacttgtgattggaggaggaatagctaattttacagatgttgctgctacatttaatggcattattcgagcattgaaggagaaagaatcaaggcttaaagcagccaggatgtccatatatgtaaggagagggggtcctaattaccaaaagggtcttgctaaaatgagagcacttggagaggaaatcggcatccctctggaggtttatggaccagaggccacaatgaccggtatttgcaaagaggcaattcaatgcatcaccgcatctgcataaggtacaggcatcatcgtttcaccgctgattcagatacgttcacaccgtaacgactttgaattggtcttgagacctttggtgttatatctacgttgctttcgattttcattatgagctgagttatttgtatcaaatctcacttatgtcgtttttcatttagagttttgttatttaaataggaggattaaaaacattttttatccgcaataata

SEQ ID NO: 3111 - DNA, 1661 bp, Podocarpus macrophillus
tgcatatgcatatacaaagattctcataggttgaaggagatcggaataatcacagagcgtttgattggcgactgaagtgtagttggggaatagctgaatatggcgagaaagaagatcagagaatatgattcgaagcgcctgttgaaacatcacttgaagaggctggcttctatcgagcttaacatcaaatcagcgcaggttacaaggtcaacaaattataatgagttggcagacaatgagccatggctatcctcatcaaggctggttgtcaaaccagatatgctgtttggaaagcgaggaaagagtggtttggttgctttaaatctggacttagcagaggcagcagcattcatcaaagaacgcgtaggaaaggaggttgagatggatgggtcaaaagcaccaatcacaacatttatattggagcctttcattccacatgatgaggagtattatctttcaattgtttcagagcgcctgggtttgacaataagcttctctgcatgtggaggtattgaaattgaagaaaattgggataaggtcaagacaatatttgtcccaacagagaagactttaacacctgagctttgtgctcccctgattgcaactctcccattggagattcgcgggaaaattgagaatttcgttagaggtgtttacaaagttttcttagatttggatttcactttcttagagatgaatccatttacattggttgatggaaaacctttccccttggatatgcgaggagagttggatgacactgctgcttttaagaacttccaaaagtggggggatattgaattcccactgccttttggccgtatcttgagccctgcagaagatttgattcacggaatggatgaaaagacgagtgcttccttgaagttcactattttaaatccaaaagggcggatctggacaatggttgctggagggggggctagtgtgatatatgccgatacggttggagatttgggctatgcaagtgaacttggaaattatgcagaatacagtggagcgcctaatgaagaagaggtcttgtattatgcaagagttctgatagattgcgcaactgcaaatccggatggccaaaagagagctctgttaataggtggaggcatagctaacttcacagatgttgctgctacatttaatggcatcattcgagctttgcgtgaaaaggaatctaaacttaaagcagcaagggtaaatatatatgtaaggagaggaggtccaaattaccagagtggtctagcaaagattcgtgctctaagtgaagagattgggataccaattgaggtctacggaccagaagctagtatgactggaatatgcaagcaagctattgactatattacctttgctgactgatttataaagaagtcctcgtgatatgctattttgtattgagatggctggcacgaggaaaaattcctaaagtcaacggtactaaatggggcctgtgctgcaacttgacaggacttgaaaatcacgacatatgtgatttgtgctatgttgattcatagcagattaggcatccttattatctgggattgtttggctcagtaagcgttggactgtttttacattatatatagaaattgaatatgctgttcaactttccattgttttgggtagtaaatagatattaaggtactagt

SEQ ID NO: 3112 - DNA, 1530 bp, Papaver somniferum
gtaattaagaaatggcaagaaagaagatcagagagtatgattcgaagaggttgttgaaggaacattttaagagattggctggttctgaattagcactcaaatcagctcaggtcacggaatcaactgatttcaatgagctagcgaacaaagaaccatggctttcatccagtaaactggttgtgaagcctgatatgttgtttggtaagcgtgggaagagtggtttagttgccttgaacctcgatttggctcaagttgccagctttgtgaaagagcgtcttggaaaagaggtagagatggggggttgtaaaggaccaatcactacattcatcgtggaacccttcatcccacatgatgaagaattttatctcaatattgtttctgagcgcctaggatgtagcattagcttttcagaatgcggaggaattgatatcgaagaaaactgggacaaggtcaaaaccgtattcatcccaaccagaacaactttttctgcggatttatgtgctcctctggttgcaacactcccgttggagatcaaggagaagatcgaggatttcattaaagtggtgtattctatatttttagatctagatttcaccttcctagagatgaatccttttgctttggtcgatggaaagccatacccattggatatgagaggagagttggatgacactgccactttcaagaactttaagaagtggggtaaccttgaatttccaatgccatttggaagagtaatgagtcctgctgaaagcttcattcatgggctggatgaaaagacaagtgcatctttgaagttcacagttttgaacccaaagggacgaatttggactatggtagcaggaggaggtgctagtgtcatctatgcagacacggttggagatcttggttatgcttctgagctcggaaattatgccgaatacagtggagcaccaaatgaacaagaggtgttgcagtatgccagagttgttattgattgtgcaactgctgaacccgatgacaagaagagagctcttgtgattggaggaggaattgccaactttactgatgtcgctgctacatttagtggcattatccgagctttaagagaaaaggaggaaaagcttaaagctgcaaaaatgcatatatatgtgaggagagggggaccaaactatcagttgggtcttgccaagatgaggagtctcggtgaggaaatcggtattcctcttgaagtgtttggtcccgaagcaactatgactggcatatgcaaacaagcaatagactgcatcactgcatcagcataaacttgtcatgaccaggaaaatgatctgttcttttctcattagattcaaatttctcatttcttatgtgtttttcttcaatgtaataagtacctgagtatgtgatcaattgtcattagcattattgttttccaattagactactactattattttagtgattgtgaaagtcttacctcctaagtacaatgtatttaggcattcatagaaatgtaattcgtttttgttcaacacaagtcagttcatgaaa

SEQ ID NO: 3113 - DNA, 1635 bp, Solanum lycopersicum
aatagatagaggtattagagttcccaagattgtcagtgtgtgcgtgtctcgtttttaacgttaaagatctcaactttgttactatcatattgatctgtgaaactagatttgatttgggttttcagatctgtcactgagatttgaaattttctcctgtttttgttaaagaaaaaaaaatggccaggaagaagatcagagagtatgattcaaagagattgttgaaagagcatttcaagagacttggaggttatgatttggctatcaaatctgcacaggtgacagagtctactgacatcaatgagctagcagagaaggagccttggctcaactcaacaaagttggttgtaaagcctgatatgttgtttggcaagcgtggaaagagtggactagtcgccttgaatcttgatcttgctcaagttgctacttttgtgaaggagcgtcttggcaaagaggtggagatgggcggatgcaaaggtcccatcacaaccttcattgttgagccattcatcccccacaatgaagagttttatcttaatattgtctcggataggcttggttgcagcgtaagcttttctgaatgcggaggaattgacatcgaagagaactgggacaaggttaagaccatctctgtgccgactgggacttcttttacatcagagatatgtgctccacttgtagccactctaccattggagattaagggtgtcattgaggagttcctcaaagtgatttacgctctatttcaagatctcgacttcactttcctagagatgaaccctttcacattggttgaaggaaagccttatcctctcgatatgaggggagagcttgatgacactgctgctttcaagaacttcaaaaagtggggaaatattgaatttccattgccatttggaagggttatgagtgctacagagagcttcattcacgggcttgatgaaaagacaagtgcatctttgaagttcacagtcttgaaccccaaggggcgaatttggactatggttgctggtggaggagctagtgtcatttatgccgatactgtaggtgatcttggatatgcttctgagcttgggaactatgcagagtacagtggtgctcccaatgaagaagaggtcttgcagtatgctagagttgtaattgattgtgccactgcaaaccctgatggccgtaagagagcccttgtgattggtggtggaatagccaatttcactgatgttgctgctacatttagtggtattattcgagctcttaaggagaaggagtcaaaacttaaagctgcaagaatgcatatatatgttagaagaggaggtccaaactaccaaaaaggtcttgcaaaaatgaggtctcttggtgaggaaattggcatcccaattgaggtttatggacctgaggaaaccatgactggcatctgcaaacaggctattgagtgcatcagtgcagctgcataaattaaccaagttgaaactttttagtctctgtcttttttgctttgtgttagtgtgttatttgatttgtatgttttgacatttcacataaatgggcaatgaacaataatgaattttagtttttcaatttcaacaatcattatactaccagatgaaagaaagagatattcattaattacataaagatatg

SEQ ID NO: 3114 - DNA, 1520 bp, Vinca minor
aacaacattttccctagaattctgtgtctaattttctaaactcacacttggactgacctcggactgcagaaactgtctgtttcaacggttgtgaagaaatggctagaaagaagatcagagagtatgattcaaagagattgttgaaggagaatttcaagaggctctctggttatgaacttgcaatcaaatctgcacaagtcacagaggcaactgatttcaatgagctagtagagaaagaaccttggctatcatcaacaaagctcgttgtgaagcctgatatgctatttggaaagcgtggaaagagcggattagttgctttgaacctagatctagccgaagttgccagttttgttatggaccgacttggcaaagaggtggaaatgggtggttgcaaaggccctattactacatttatcgttgaaccatttgttccacataatgaggagttttacctaaatattgtttctgagagacttggctgtagcataagcttttcagagtgtggaggaattgatatcgaggagaactgggataaggtaaaaaccatttttctgccaacaggggcttctttcacatcagaagtctgtgctccacttgtcgccacccttcccttagagatcaaacccgtaattgacaagttcatcaaagtagtttacgctctatttgtagatctggacttcacattcctagagatgaaccctttcacattggtcgacggaaagccttatccattggatatgagaggagagcttgacgataccgctgcctttaagaacttcaagaaatggggaaacatagaatttccattgccatttggaagagttatgagtactactgaaagctttattcatggacttgatgagaagacaagcgcatctctgaagttcacagtcttgaacccgaagggaagaatttggacaatggtggctggaggaggcgccagtgtcatctatgcagatacagttggagatctcggctacgctaccgagcttggaaactatgcagagtatagtggtgcccctaacgaagaagaggttctacaatatgccagagttgtaattgattgcgcaactgcagagcctgatggccgcaagagagcccttgtaataggtggcgggatagccaacttcaccgatgttgctgccacattcaatggcataattcgagctttgaaggaaaaggaatcaaaacttaaagctgcaagaatgagcatttacgtgagaagaggtggtccaaactaccagagaggtcttgcaaaaatgagagctcttggagatgaaattggcatcccaattgaggtctatggccctgaggcgacaatgaccggcatttgcaaagaggcaattgagtgcataactgctgctgctgcttaaaagcttcaatattaccattaatcaaaataaactcatttcttcccctgcttactaccatcattttctttagcaatgttgtaacaaaactgcatggaatttttaatttacttttacataatgatctgctagaaaggatcttcatttcct

SEQ ID NO: 3115 - DNA, 1485 bp, Daucus carota
tttttatacatctctctgtgctcgcctcaacgttgtgaagagagaaatggcgcgaaagaagatcagagagtacgattcgaagaggttgttgaaggagcattataagaggctcactggtggtgatgagctcgggatcaagtccgctcagattacagaatcaactaatatcaatgagctcgtagaaaaggaaccttggctctcctcctccaaactagttgttaagccagatatgttatttggaaagcgtggaaaaagcgggcttgttgctttgaatttggatctggctcaagttgacaactttgtgaaagagcgacttggaaaggaggtcgagatgggaggatgcaaaggacccattacaacattcattgttgaaccatttgttccacacaacgaagaattttatctaaacatggtctcagatcgacttggatgtagcataagcttttcagagtgtggtggaattgatattgaagagaactgggataaggttaaaacaatatttgttccgacaggcatgtccatgacacctgagatttgtgctccactggttgcaactctccccttggagattaaaagtgtaatcgaggagtttatcaaagtgatatttattctatttgcagatttggacttcactttcctagaaatgaatcctttcactctggttgatggaaagccgtatcctttagacatgagaggagagcttgatgacactgctgctttcaagaacttcaagaagtggggcaatattgaatttccattgcccttcggaagagttatgagttctaccgagagctttattcatgggctagatgaaaagactagtgcctctctgaagttcactgttctcaatccaaaaggacgtatttggactatggtcgctggaggaggtgccagtgtcatctatgcagatacggttggagatcttggttttgctgaagagcttggaaactatgcagaatatagtggagcaccaaacgaagaggaggttttgcaatatgctcgagttgtgattgattgtgcaaccgctgatcctgatggccggaagagagcccttgtagtaggtggtggaatagccaactttacagatgttgctgctacatttaacggcatcatccgtgcattaaaggagaaggaatcaaagcttaaggccgcaagaatgcacatatatgttaggagaggaggtccaaactaccaaaaaggtcttgcaaaaatgagggcccttggagaagaaattggcattccaatcgaggtatatggaccggaaaaaacaatgaccggaatatgcaaacaggcaatagagtgcattagcgcagctgcatgaatgtcacaaatcttgtaccactctttatatgagctctcatattggttgtaatctgtgtgtgtttaatcagtattagcgacttgctgtaacctttatgtcggattcgatatgcaaattcttgttcaataaaaatggggcagttcgttttcttcccttattctgtt

SEQ ID NO: 3116 - DNA, 1473 bp, Brassica napus
ccgctctgctcaggtgacagaagctacggatttcactgagttgaccaaccaggagccatggctatcttccacgaagctagttgtgaagcctgatatgctgtttggaaaacgcgggaaaagcgggttggtagctctcaagctggatcttgctgaagttgcagagtttgtcaaagcccgtctcggctctgaggttgagatgggtggatgtaaagctcctatcactacattcattgtggagccctttgtgcctcatgatcaagagtactatctgtctatagtgtctgataggcttggctgcaccgtaagcttctctgaatgtggcggtattgaaattgaagagaactgggacaaggtgaagactgtgtttcttcctgcggaaaagtcaatgacgcttgaagtatgtgctcctttgatagcaacacttcctcttgaggttagaggtaaaataggcagcttcataatgggcgtgtttgctgtatttcaagatttggatttcagtttcatggagatgaatccgtttacgctagtcgatggagagccatatcctttggacatgaggggagagttagatgacacagctgccttcaaaaatttcaacaagtggggagacattgagtttcctctgccatttggaagggtcctgagtccaacagagagcttcatccatggtttagatgaaaagacaagtgcgtctttgaagttcactgttttgaatcctaaaggtcgcatttggactatggtagctggaggcggtgctagcgtcatatatgctgatacggttggagatttaggttacgcatcagagctggggaactacgcagagtatagtggagcacctaatgaggaagaggtgttacaatacgctagagttgtcattgattgtgctactgctgatcctgatgggcgcaaaagagctcttctcattggaggtggcattgctaatttcaccgacgtggcagctactttcaacggtatcatccgcgctctaagagaaaaggaaacaagactgaaagcatcaagaatgcacatttacgtaagaagaggtggtcctaattaccagactggtttggctagaatgcgtgctctgggagaggaactcggtgttcctcttgaggtatatggaccagaagcaacgatgacaggaatatgcaagcgagccattgactgcatcatgctgcctgatgcatgatcaaccaaacctattatgatctcttcttcagttgaaaacagcagaacacaaacgtggagctgacattgtattagtgtgcattgatatccctgttcgtcctcgctctttgtgcatatgaaaatgaaaagctctttgaaacttttgcttgtgtgggtgtaatactgaaaaccaaatcattgtgttgtgtatcgttgcaagttgtaattgtaaactactaaaacggtacaaaacttacaacgtgttgggaggtcaaggtcacaagcggggaatggcccccccccccc

SEQ ID NO: 3117 - DNA, 1883 bp, Phaseolus vulgaris
gtagggaagtagttgaatgaaaactgaagctaagactttggtcgaaaggaaggagtagtaggtgggtaacccttcatgtgtatgccttcttcttgcctaattcctcttcatcctcacacttcaccaacccaaccaccctatcattttcttttcaccatttctttcttctccaacacaaattcaattatattaaattaatcaaattctgcactatatatacacccatcacaaactctccacattcgttcacttctttgttagatctaaccactcacaacgcccttttcctcatctaacgagtaagaaaaatggcgcgcaagaagatcagagagtacgactccaagaggttgttgaaagagcactttaagagactctctggcaaggatttgccaatcaagtctgcacaaattgatgcatcaactgatttcactgagctacaagagaaggaaccttggctttcatcttctaaattggttgtgaaacctgacatgttatttggaaagcgtggcaaaagtggtttggttgctttgaatttggattttgcacaggttgtctcatttgtgaaagagcgtcttggaaaagaggttgagatgagtggatgcaaaggacccataacaactttcattgttgaacctttcatcccacacgatgaagagttttaccttaacatagtctctgagagactcggcaacagcataagcttttctgaatgtggaggaattgaaattgaagataactgggataaggttaagactatattcattccaactggagtgtctattacatcagaaattgttgccccacttgttgcaacccttcccttggagatcaagggagaaattgaggaatttcttaaagtggttttcatgctgtttcaagatctggatttcactttcttagagttgaatcctttcacattggttgatggaaagccttatcctttggatatgagaggcgagctagatgacactgctgctttcaagaacttcaagaaatggggagacattgaatttccactgccatttggaagggttatgagtgccaccgagtctttcattcatggattagatgaaaagacaagtgcatctttaaaattcactgtgttgaaccctaagggacgaatttggacaatggtagctgggggaggtgccagtgtcatctatgctgatacggttggagatcttggctttgcatctgagcttggaaactatgctgaatacagtggtgcacccaaagaagacgaagtcttacaatatgccagagttgtaattgattgtgcaactgcaaaccctgatggccaaaagagagctcttgtgataggaggaggcatagccaactttactgatgttgctgctacatttagtggtataattcgggcactgagggagaaggagtcaaaattgaaagcagcaaggatgaacatttatgtgaggagaggagggcccaactaccagaagggtctaactttaatgcgagcacttggagaggagattggcatccccattgagatttatggacctgaagccacaatgactggtatatgcaaagaggcaatacaattcattactgcttctgcttaaggtcgagaccaccttcatccataatatttttcatggcaagtgtgaagtgaacttgattcttaatttccatccttattccgaaattgggaattttgattagagcatatgtttatgaattcaagccatccaagaaaagtgaccatgaatattgtcatattgtttttgtagaattgatggcatgacaaataataaatagtatttcgttaccatatttagttttaacttccaagagtgttcacatcttcacactttcaactattatctagtatgtcaattttttcatcataccaacaacatttggtt

SEQ ID NO: 3118 - DNA, 1538 bp, Panax ginseng
gtggtatcaacgcagagtacatggggattacaaacatttttcagtttcgtaatcgatctaaaagagatcgtttgattccgaaacagatagaaaagaaaagaaatggcgcgcaagaagatcagagagtacgactcaaagaggttgttgaaggagcatttcaagaggatttctggttctgatctggccattaaatcggctcaaattacagaatcaactgatgtcaatgagctcgtagaaacagaaccttggctatcctcctccaaactggttgttaagcctgatatgttatttggaaagcgtggaaaaagtggcctcgttgccttaaatttagatttggctcaagttactgactttgtgaaagagcggcttggaaaagaggtcgaaatgggaggatgcaaaggacccataacaacattcattgttgaaccattcgttccacataatgaggaattttatctcaacatggtgtcagagcgccttggatgtagcataagcttttcagactgtggtggaattgaaattgaagagaattgggataaggttaaaactatatttattccaacaggggtgttcttgactccagagatatgtgctcctctagttgcgacccttcccttggagatcaaaggtgtaattgaggagttcatcaaattgatatttaccctatttgcagatctggacttcactttcctagagatgaatccttttactttggttgagggacacccttaccctttggatatgagaggagagcttgatgacactgctgctttcaagaactttaaaaagtggggcaatattgaattcccattaccttttggaagagttatgagtcctacagagagctttattcatggtctagatgaaaagactagtgcatctttgaagttcacagttctaaatccaaagggacgaatttggactatggttgctggaggaggtgccagtgtcatctatgcagatactgttggagatcttggttatgctgcagagcttggaaactatgctgaatatagtggagcacccaatgaagaggaggttttacagtatgccagagttgtgattgattgtgcaactgcagaacctgatggccataagagagcccttgtagttggcggtggaatagccaactttaccgatgttgctgctacatttaatggcataattcgtgcgttgaaggagaaggaatcaaagcttaaagctgcaaatatgcacatatatgtgaggagaggcggtccaaattatcaaagaggtcttgcaaaaatgaggaatcttggagaggaaattggcatccctattgaggtttatggacctgaagaaactatgactggaatatgcaagcaggcaattgaatgcatcagtgcagctgcataattaaatgaaccaaacctattgttagtcttattaaatttggctcaccattttctttggtatttccaaatattgctcaatgcctgttagcattatgttgtaaccagaatattggaaatttgataattgcatcttccaattcaataaacatgtgggccacttgaaat

SEQ ID NO: 3119 - DNA, 1579 bp, Panax ginseng
ttaaccatcaaaataaaaatgaatacagaccaattgaagtacaaatagagggagattagcgtagaaattctcactctctttcatttcacctctccccggtacaagcatttttcagttttgtgtcttccagacgataaaaagaaaggatggcacgcaagaagatcagagagtacgactcaaagaggttgttgaaggagcatttcaagaggatttctggctgtgaactggtcattaagtcggctcaaataacagaatcaactgatgtcaatgaactcgtaaaaagggaatcttggctttcctcctccaaactggttgtcaaacctgatatgttatttggaaagcgtggaaaaagtgggctcgttgccttaaatttagatttggctcaagttgctggctttgtgaaagagcgacttggcaaagaggttgagatgggaggatgcaaaggacccataacaacattcattgttgaaccattcgttccacataatgaagaattttatctcaatatggtctcagagcgccttggatgcagcataagcttttcagaatgtggcggaattgaaattgaagaaaactgggataaggttaaaactatatttgttccaactggggtgtcactgacaacagatatttgtgctccactagttgcaacccttcccttggagatcaaaggtgtaattgaggagtttatcaaagtgatttttaccctgttttcagatctggacttcactttcctggagatgaatcctttcactttggttgatgggaagccttatcctttggatatgagaggagagctggatgacactgctgctttcaagaacttcaagaagtggggaaatattgaatttcctttgcccttcggaagagttatgagtcctacagagagctttattcatgggctagacgaaaagactagcgcatctttgaagttcacagtgctaaatccaaagggacgaatttggactatggttgctggaggaggtgccagtgtcatctatgcagatactgttggagatcttggttttgctgcagagcttggaaactatgccgaatatagtggtgcacccaatgaagaagaggttttgcagtatgctagagttgtgattgattgtgcaacttcagatcctgatgggcgcaagagagcccttgtagtgggtggcggaatagccaactttactgatgttgctgctacatttaatggcataatcggtgcattaaaggagaaggaaacaaagcttaaagctgcaaatatgcatatatatgttagaagaggaggtccaaattaccaaagaggtcttgctaaaatgaggaccctcggacaggaaattggcatccctattgaggtatatggacccgaggaaacaatgaccggaatatgcaaacaggcaattgagtgcatcagtgcagctgcataaatgttccaaaacctaatgttatagtcttattgtatttttcagttaaataaaaatgggccacttgaaattggtattttacactgatagtgaaaaggaacatagatatagatactaatggatctggttagcatcatttaagttcacactatcctgctgacaca

SEQ ID NO: 3120 - DNA, 1624 bp, Lotus japonicus
cctcacacaatcatcgttcgttcatctgttcgttagatccaactacaccccccatctacccctcacctcaccctccatcatcttttccatatcttaagattaagaagaaatggcgcgcaagaagatcagagagtatgactccaagaggttggtgaaggagcactttaagagactctctggcaaggagttgccaatcaagtctgcacaagttacagggtccactgatttcagtgagctgcaagacaaggaaccgtggctttcatcttctaaattggttgtgaaacctgacatgttgtttgggaagcgtggcaagagcggtttggttgcattaaatttggattttgcacaggttgcttcatttgtgaaagagcgtcttggaaaggaggttgagatgggtggatgcaaaggacccataacaactttcattgttgaaccattcatcccccacaatgaagagttttaccttaacattgtctctgagagactcgggaacagcataagcttttcagaatgtggaggaattgatattgaagaaaattgggataaggttaagactgtatttattccaacgggagtgtctcttacatcagaaattgttgctccacttgttgcaacccttcccttggagatcaagggagaaattgaggaatttcttaaggtgattttcactctgtttcaagacctggatttcactttcttagagatgaaccctttcacattggttgatggaaagccttgtcctttggatatgagaggcgagcttgatgacactgctgctttcaagaacttcaagaaatggggaaacattgaatttccattgccatttggaagggttatgagtgcgactgagtctttcgttcatgaattagatgaaaagacaagtgcatctttaaaattcacagtgttgaacccaaagggccgaatttggacaatggttgccgggggaggtgctagtgtcatctacgctgatacagtaggagatcttggctttgcatctgaacttggaaattatgccgagtatagtggtgcacccaaggaagatgaggtcttgcagtatgccagagttgtgattgattgtgcaactgcaaaccctgatggccaaaagagagctcttgtgataggaggaggcatagctaactttactgatgttgctgctacatttagcggcataattcgggcactaaaggagaaggaatcaaagttaaaagcggcaaggatgcacatttacgtgaggagagggggtccgaactaccagaagggtctagctttaatgcgagcacttggagaggaaattggcatccccattgaggtttatggacctgaagcaacaatgactggtatatgcaaagaggcaatacagtgcattactgctgccgcttagctttccattataagacaatgccttgttttatggtattttcatggcaagtcatatttcccttcccatcccagaaatttggaaatttagagcgtatgtttgtaaaatcaagccatccaaaaaagagtggctgagaatgttgttcattttttgtacaattctgatggcactgtcttgacacaataaagagtgtgtttttcatttgattgttataatgtttccctgtgttttaatctactatcttct

SEQ ID NO: 3121 - DNA, 1534 bp, Nicotiana benthamiana
tcagtgtatgtcttacaactttgtctgatcattcagctcaagattcattgaatcagttttttctgtgtcctctttattaacggtaaaaaaatggcccgcaagaagatcagagagtatgattcaaagagattgttgaaagagcattttaagaggcttggaggttatgatttggccattaagtctgccaaggtgacagagtctactgatttcaatgagctagcagagaaagaaccttggctcaactcatcaaagttggtcgtaaagcctgatatgttatttgggaaacgtggaaagagtggtctagtcgccttgaatcttgatcttgctcaagttgctacttttgttaaggagcgcctcggcaaagaggtggagatgggtggatgcaaaggtcccatcacaaccttcattgtcgagccattcatcccccacaatgaagagttttatcttaatattgtctcggacaggcttggttgcagcgtaagcttttctgaatgtgggggaattgacattgaagaaaactgggacaaggttaagactattttcgtgcccacaggaacttcttttacttcagaaatatgtgctcctcttgtcgcgacactaccattggagattaagggcgtcattgaggatttcctcaaagtggtttacactctatttcaagatctggactttactttcttagagatgaatcccttcgcattggtcgaagggaagccttatcctctagatatgagaggtgaacttgatgacactgctgctttcaagaacttcaaaaagtctggaaatattgaatttccattgccatttggaagggttatgagtgctacagagagctttattcacgggcttgatgaaaagacaagtgcatctttgaagttcacagtcttgaaccccaagggacgaatttggactatggttgctggtggaggagctagtgtcatctatgcagatactgtaggcgatcttggatatgcttctgaacttgggaactacgcagaatacagtggtgctcccaatgaagaagaggtcttgcagtatgccagagttgtaattgattgtgccactgcaaatcctgatggccgtaagagagccctcgttattggtggtgggatagccaacttcactgatgttgctgctacatttagtggtattattcgagctctgaaggagaaggagtcaaaacttaaagccgcaagaatgcaaatctttgttagaagaggaggtccaaactaccaaaaaggtcttgctaaaatgaggtctcttggcgaggaaattgggatcccaattgaggtctatggacctgaggcaaccatgactggcatatgcaaacaggcaatcgagtgcatcactccagctgcataaatcaaccaacctcattctccaagctgaactgttttagttgtctttttttttgtgctatgcattagtagtgtcttgttgtatgccacatataagtaatttgatttgtatctttgacattccacatttatagggccatgaacaatgatctccagtaatgaattttgttttccaa

SEQ ID NO: 3122 - DNA, 2076 bp, Pinus taeda
catatgtgggtccgccagctctagtttacttaaattatctaaatttgtaaattttgtgtttgtgtcttcatcacgatttctattttgagcggagcatgctaaaacgattttagcggtccatgccaaaaacgattgatagtgcatcacgaacttgagcaggtgtgttttcatggtataggagtgaggccaggcatactatgttacagggacaggctgccataaattcccagcagaaatttcattcgattcccgtctaaatttctgcgttcgaagggatatttacatatattcttaattcgtctccagagagaaatcaaagctcaaaatggctagaaagaagatcagagaatatgattccaagcgcctgctgaaagaacatctgaagaggcttgctgatattgagattgacatcaaatcagcccaggttacaaattcgaccaatttgaatgaattggcagacacgaagccatggttgtcctcgttaagactggttgtgaaaccggatatgctgttcggcaaacgaggaaagagtggtttggttgccctaaatctggacttagctcaggctgcgttatttgtcagagatcgtctaggaaaagaggttgagatgggaaatgcaagggcaccaatcacaactttcatattggagcctttcattcctcatgatgacgagtattatctttccattctctcggaacgtcttggttttacaataagtttttctgcatgtggaggtatagaaattgaagagaattgggataaggttaagacgatatttatcccaacagagaagccgttaacatctgaactctgtgctcccttgattgcaactctgccattggagattcgcggcaacattgagaatttcataagaggtgtatacaaggtcttcttggatttggacttcacattcctagaaatgaatccatttacattacttgatggaaagccttaccccctggacatgcgaggagaattggatgatactgcttctttcaagaacttccaaaagtggggcaatattgaattcccgatgccctttggtagagtcatgagccctgcagaagagttgattcacagcatggatgaaaagacaagtgcctcattgaagttgaccattctgaaccccaaagggcgtatttggacaatggttgctggaggaggagctagtgtcatatatgctgacacggttggagatctgggttatgctagtgaacttggaaattatgcagaatacagtggagctccaaatgaagaggaggtgttatactatgcaagagttctaattgactgtgcaactgcaaatcctgatgggcgcaagagagcattgttaataggtggaggcatagctaacttcacagatgttgctgctacctttaatggcatcattcgagctttacgtgaaaaggaatctaaactcaaagcagcaaggttcaacatttatgtaaggagaggaggcccaaattaccagactggtctagccaagatgcgtgctttaagtgaagagattggggttccgattgaggtgcatggaccagaagctagtatgactggcatatgcaaggatgctattgattatataacagctgcagactaattcatcaaatgttactctgaactattatttaatatcgagttaaacctacacaaggagatcatatttgaataatggggtaggctgtcttgtgagacaatgttgtgctagattggtgacatttacatctaccatgtcaaagaaagtaggatgtaagatttctttgttcatgagtaagttgtctcgctgtgttcagactgttagatgcttaagtttacaatttgatatcttgcttctaatcatttcttggttcaagaaaataattgagactgaagactttcatgagtgtattatactgacttcaaccacattgcagatacaagattgtcaacgtgtgcctaactattctgaaataccaaactaattgtttggaaattatgaaatgctaatctgtttgagaaaaaagaatacgggacgatttcgcgtttctatgaaagaaataaaatttgacagatatttctctccaaaaaaaaaaaaaaaaa

SEQ ID NO: 3123 - DNA, 1739 bp, Papaver somniferum
tctcgattgaatattgatccaaaaattaacaattcccgcgaaaatattattttcattattaaataattcttcggatccataaatagagacaacaacaaacacgggacgtagagatctaattttctttctttctcttcaaccgtaagttctggttgttctttcctctatcttacagtacccaaaaacaaagtttgtagtttgtgaatgtaattaagaaatggcaagaaagaagatcagagagtatgattcgaagaggttgttgaaggaacattttaagagattggctggttctgaattagcactcaaatcagctcaggtcacggaatcaactgattttaatgagctagcgaacaaagaaccatggctttcatccagtaaactggttttgaagcctgatatgttgtttggtaagcgtgggaagagtggtttagttgccttgaacctcgatttggctcaagttgccagctttgtgaaagagcgtcttggaaaagaggtagagatggggggttgtaaaggaccaatcactacatttatcgtggaacccttcatcccacatgatgaagaattttatctcaatattgtttctgagcgcctaggatgtagcatcagcttttcagaatgcggaggaattgatatcgaagaaaactgggacaaggtcaaaaccgtattcatcccaacaggaacaactttttctgcggatttatgtgctcctctggttgcaacactcccattggagatcaaggagaagatcgaggattttattaaagtggtgtattctatatttttagatctagatttcaccttcctagagatgaatccctttgctttggtcgatggaaagccatacccattggatatgagaggagagttggatgacactgccactttcaagaactttaagaagtggggtaaccttgaatttccaatgccatttggaagagtaatgagtcctactgaaagcttcattcatgggctggatgaaaagacaagtgcatctttgaagttcacagttttgaacccaaagggacgaatttggactatggtagcaggaggaggtgctagtgtcatctatgcagacacggttggagatcttggttacgcttctgagctcggaaattatgccgaatacagtggagcaccaaatgaacaagaggtgttgcagtatgccagagttgctattgattgtgcaactgctgaacccgatgacaagaagagagctcttgtgattggaggaggaattgccaactttactgatgtcgccgctacatttagtggcattatccgagctttaagagaaaaggaggaaaagcttaaagctgcaaaaatgcatatatatgtgaggagagggggaccaaactatcagttgggtcttgccaagatgaggagtctcggtgaggaaatcggtattcctcttgaagtttttggtcccgaagcaactatgactggcatatgcaaacaagcaatagactgcatcactgcatcagcataaacttgtcatgaccaggaaaatgatctgttcttttctcgttagattcaaatttctcatttcttatgtgtttttcttcttcaatgtaataagtagccgagtatgtgatcaattgtcattagcattattgttttccgattagactactattattttagttattgtgaaactcttgcctcctaactacggagtatttagcattcatagtaatgtaattcgtttttgttcaacatgagtcagttagtgaaaaaaa

SEQ ID NO: 3124 - DNA, 1555 bp, Papaver somniferum
aaggtaattaagaaatggcaagaaagaagatcagagagtatgattcgaagaggttgttgaaggaacattttaagagattggctggttctgaattagcactcaaatcagctcaggtcacggaatcaactgatttcaatgagctagcgaacaaagaaccatggctttcatccagtaaactggttgtgaagcctgatatgttgtttggtaagcgcgggaagagtggtttagttgccttgaacctcgatttggctcaagttgccagcttcgtgaaagagcgtcttggaaaagaggtggagatgggcggttgtaaaggaccaatcactacattcatcgtggaacccttcattccacatgatgaagaattttatctcaatattgtttctgagcgcctaggatgtagcattagcttttcagaatgcggaggaattgatatcgaagaaaactgggacaaggtcaagaccgtattcatcccaacaggaacaactttttctgcggatttatgtgctcctctggttgcaacactcccattggagatcaaggagaagatcgaggatttcattaaagtggtgtattctatatttttagatctagatttcaccttcctagagatgaatccttttgctttggtcgatggaaagccataccctttggatatgagaggagagttggatgacactgccactttcaagaactttaagaagtggggtaaccttgaatttccaatgccatttggaagagtaatgagtcctactgaaagcttcattcatgggctggatgaaaagacaagtgcatctttgaagttcacaattttgaacccaaagggacgaatttggactatggtagcaggaggaggtgctagtgtcatctatgcagacacggttggagatcttggttacgcttctgagctcggaaattatgccgagtacagtggagcaccaaatgaacaagaggtgttgcagtatgccagagttgttattgattgtgcaactgctgaacccgatgacaagaagagagctcttgtgattggaggaggaattgccaactttactgatgtcgccgctacatttagtggcattatccgagctttaagagaaaaggaggaaaagcttaaagctgcaaaaatgcatatatatgtgaggagagggggaccaaactatcagttgggtcttgctaagatgaggagtctcggtgaggagatcggtattcctcttgaagtttttggtcccgaagcaactatgactggcatatgcaaacaagcaattgactgcatcactgcatcagcataaacttctcatgaccaggaaaatgatccgttcttttctcattagattcaaatttctcgtttcttatgtgtttttcttcaatgtaataagtacctgagtaagtgatcaattgtcattagcattattgtttcccaattagactactattattttagttattgtgaaagtcttacctcccaagtacggagtatttagcattcatagtaatgcaattcgtttttgttcaacatgagtcagttaatgaaatacttctgttctgtttgaagacaacc

SEQ ID NO: 3125 - DNA, 1664 bp, Chenopodium quinoa
attttctctctctcttcagctacctcattttgattttacggtttaacaaagggggaaaatggcaaggaagaagatcagagagtacgattcaaagaggttgattaaggagcattataagagaatttctggttctgaactacccattagatcagctcaaattacagagtcaaccgacctgaatgaacttgttcagaatgagccatggctatcatctgaaaagttggttgtgaagcctgacatgttgtttgggaagcgtggcaaaagtggtctagttgccctcaatttggacttttcccaggttactgctttcgtaaaagaacgtcttggcaaagaggtggagatgggtggatgtaaaggacctattactactttcattgttgagcctttcattccacacaatgaagagttttatcttaacattgtctcagaaagactggggaacagtataagcttttcagagtgtggtggaattgagattgaagagaactgggataaggtcaaaacaatctttgttcccactggtgtttctcttacttctgaagtctgtgctcctctggttgctactttacctttggaggtcaaaagtgttattgaggagtttgtcaaagtcattttcgccctgtttttagatctggatttcactttcctagaaatgaatcctttcacattagtcaatgggagcccctatcctttggacatgagaggcgagctagatgatactgctaccttcaagaatttcaagaagtggggtaatatcgaatttccattgccatttggaagagttatgagcccaacagagagctttgttcatggtctagatgaaaagacaagtgcatccttgaaattcacagttttgaaccccaagggaaggatctggaccatggtggctggaggaggagccagtgtgatctacgcagatactgttggggatcttggctatgcatctgagcttgggaactatgctgaatatagtggtgctcctaatgaagatgaggtcttacagtatgccagagtagtaattgattgtgctactgcagatcctgatggtcgcaagagagccctcgtagttggtggaggtattgctaattttactgatgttgctgctaccttcaatggaataatcagagctctgaaggagaaggaatcaaagcttaaagcagcaagaatgcacatttatgtgagaagaggaggtccaaattaccaaaagggtttggctaaaatgcggctgcttggagaagagattggaattcctattgaggtgtatgggcctgaggcaacaatgaccggaatatgcaagcaggccattgaatgtattagtgctgctgcttaatcgggtctcagcaaattcaaatttgaatcagtccttgcctctacagtgctagtttatagctgatatagatttagcacaaatttaatgatgttttatagatttgttgtgtgctctagagcagatgcatttgttagcacagaatgaagtattcctttttctgttattgatactgatatacaatgtataataccttagaataagtcatttggttcattcaaggtattatgaattaatgaaatgtagaattaaattaccttaaaagaaaaaaaaaaaacctaaaaaaaaaaaaaaaaaaaaaaaaaaaaaaaaaaaaaaaaaaaaaaaaaaaaaaaaa

SEQ ID NO: 3126 - DNA, 1640 bp, Solanum phureja
tactctatgattctattttttgtatgtttctatatactactatactatttttcaattagcccatatgtattttttataatgtagagcagccatctctgaaaatctcatcaatatcacaactataaatatagtgagttgaatcccaatattcttacaagtttcatacagattctttgaatcagctttttaacggaaaatggcccgcaagaagatcagagaatatgattcgaaaagattgttgaaagaacactttaagaggcttgctggttatgatttggccatcaaatctgctcagattacagagtcaactgatttgaatgagcttgtagagaaagagccatggctttcttcaacacaattggtggtaaagcctgatatgttatttgggaagcgtggaaaaagcgggctagttgccttgaattttgatctggctcaagttgcttcttttgtgaaggaacggttaggtaaagaggttgagatgagtggatgcaaagggcctatcacaaccttcatcgttgaaccatttgtaccccacaatgaggagttttaccttaatattgtttcggagagacttggttgtagtgttagcttttctgaatgtggaggaatagatattgaagagaactgggacaaggttaagacaatctttgtgccaacggggacatcttttacatcagagatttgtgcaccacttgttgctactctaccactggagattaaaggtgtaattgaggagttcctcaaagtggtttatactttgtttcaagatctggactttactttcctggagatgaatcctttcacattggtcgaaggaaagccttatccactggatatgaggggagagcttgatgacactgctgcttttaagaacttcaaaaagtggggaaatgttgaatttccattgccatttggaagagtgatgagtgctacggagagctttattcatgggctagatgaaaagacaagtgcgtctttgaagttcacggtcttgaaccccaagggacgtatttggacgatggttgctggtggaggtgccagtgtcatctatgcagatactgtcggtgatcttggatatgcttctgagctcgggaattatgccgaatacagcggtgctccaaatgaagaagaggtcttgcagtatgccagaattgtaattgattgtgcaaccgcagatcctgatggccgtaagagagcccttgtgataggtgggggaatagccaactttactgatgttgctgctacatgtagtggtataattcgagctctgaaggagaaggaatccaagcttaaagctgcaagaatgcacatatatgtcagaagaggtggtccaaactaccaaaagggtctcgcaaaaatgcggtctcttggggaggaaatcggcatcccaattgaggtatatggacctgaggaaaccatgactggcatctgcaaacaggctattgagtgcatcactgcagctgcataaagcaaccaactcttaaattgttttggtttactttttagctttgtgttagcataatgttgtttgtgtctgatgtaaaagagagtgctttgtacttgagacattttacactagcaaatgggctctaataataatctctacatatacagctactgaaagtattttgtggcatatt

SEQ ID NO: 3127 - DNA, 1810 bp, Glycine max
cttttcctaattcatttcctctttcaatctccctcttacacttcaccaacccaacaaccccatcattttcttttcacctttttccttctccaaacaaattaaattaaaattaaaataatcaaagccttcacctatatatacagccatcacacactttaaccattcgtccacccgttcgttagatctaacaaccacttatcccctttctccttctaacgagtgaggaaaaatggcgcgtaagaagatcagagagtatgactcaaagaggttgttgaaggagcactttaagagactctctggcaaggagttgccgatcaagtctgcacaaattaccgcatcaactgatttcactgagctacaagagaaggaaccctggctttcatcttctaaattggttgttaaacctgacatgttatttggaaagcgtggcaaaagtggtttggttgccttgaatttggattttgcacaagttgtttcatttgtgaaggagcgtcttggaaaagaggttgagatgagtggatgcaaaggacccataacaactttcattgttgaacctttcatcccacacaatgaagagttttaccttaacattgtctccgagagacttgggaacagtataagcttttcagaatgtggaggaattgaaattgaagacaactgggataaggttaagactgcatttgttccaactggaatgtctcttacgtcagaaatcgttgccccacttgttgcaacccttcccttggagatcaagggagaaattgaggaatttctcaaagtggttttcactctgtttcaagacctggattttactttcttagagatgaatcctttcacattggttgatggaaagccttatcctttggatatgagaggcgagctagatgacactgctgctttcaagaacttcaagaagtggggagacattgaatttccgctgccatttggaagggttatgagtgccaccgagtctttcattcatggattagatgaaaagacaagtgcatccttaaaattcacagtgttgaaccctaagggccgaatttggacaatggtagctgggggaggtgctagtgttatctatgctgatacggtaggagatcttggctttgcatctgagcttggaaactatgctgaatacagcggtgcacccaaagaagaggaggtcttgcagtatgccagagttgtaattgattgtgcaactgcaaaccctgatggccagaagagagctcttgtgataggaggaggcatagccaactttactgatgttgctgccacatttagtggtataattcgggcattgaaggagaaggagtcgaaattgaaagcagcaaggatgcacatctttgtgaggagagggggtcccaactaccagaagggtctagctttgatgcgagcacttggagaggagattggcatccccattgaggtttatggacccgaagccacaatgactggtatatgcaaagaggcaatacagttcattacagccgctgcttaaggtcaacaacaccttcatttatagtattttcatggtgagtctgaagtgaacgttgattcttaatttccttttccattcctggaatttggaaatttagttagagtatatgtttatgaaatcaagccatccaagaaagagtggccaggattgttgtcacattgtttttgtagaattctgatggcgctgtcttgacacaataaagagtgtttttcatttgactgttactacttttaactgcgttttgatctattttcttaggctttcctgcccctctaaacaatgttcttcgtacatattttaatatacaaa

SEQ ID NO: 3128 - DNA, 1794 bp, Glycine max
gtaccccttgtttttctgtttctttgttctttctccaaagcttatgttatgttatatatatataccatgatgccaccagcaacgtactaacgcaatacacacccaccattggatccaccaatctccaaccttcttctccattgttccgtttctctctccaacgggaagaactttttttttgtgtgtgtttttggtggtgagtttgtaagaagcaatggcacgcaagaagatcagagagtatgactccaagagattgttgaaggagcactttaagagactctctggccaggacttgcccatcaagtccgcacaagttacagaatccaccgatttcaatgagctaacagagaaggaaccctggcttttatcttcaaaattggttgtgaaacctgacatgctatttggtaagcgtggcaaaagtggtttggttgccttgaatctggatttggcagaagttgattcttttgtgaaagagcgtcttggcaaagaggttgagatgggtggatgcaaaggacctataacaactttcatagttgaaccttttatccctcacaatgaggagttttaccttaacattgtctcagagagactagggaatagtataagcttttctgaatgtggaggaattgaaattgaggagaattgggataaggtcaagactgtatttatgccaacaggagtgtctcttacatcagagagtattgccccacttgttgcaacccttcccttagagatcaagggagaaattgagggatttctaaaggtgattttcgctctatttcaagatctggattttactttcttggagatgaatcctttcactttggtcaatggaaagccttatcctctggacatgagaggcgagcttgatgatactgctgctttcaagaacttcaagaaatggggaaacattgaatttccattgccatttggaagggttatgagtactacagaggcttttgttcatggattagatgaaaagacaagtgcatctttgaaattcacagtattaaacccaatgggccgaatttggacaatggtagctgggggaggtgctagtgtcatctatgctgatacggtaggggatctcggttatgctcctgagcttggaaactatgcagaatatagtggtgcacccaaggaagatgaggtcttgcagtatgccagagttgtgattgattgtgcaacttcaaatcctgatggccaaaagcgagcccttgtgataggtgggggaatagctaactttactgatgttgctgctacgttcagtggcataattcgtgctctgaaggagaaggaacaaaagctaaaagaagcaaagatgcacatctacgtgaggagaggaggtcccaactaccagaagggtctagcaaaaatgagggcacttggagaggagattggcattcctatcgaggtttatggacctgaggcaacaatgactggtatatgcaaacaggcaatccaatgcatcactgctgctgcttaattatccattcttaggccaatccctttttttacatgtatttttcatggctagtttgaagtgattgttgattcttggttccctttccaactctcagaattggtaactttggtgagttagagcataggatgttataaaacagtcatttagtcatccaataaagtggtcaagagggttttgtatcgtctagaattctgatagtacagtcttggcacaataaactggaatgtgtaattgttttatgttatgtcaagctggaatttcatggctctcggctttactttcagcaagtaaattgattttctttccac

SEQ ID NO: 3129 - DNA, 1543 bp, Tabernaemontana elegans
tcaatctctccaactataaatacacacaagggactccaagatttctgtgtctttgtagttcaaattgagactgccgaagctttcttgctgtctgttttaacggttgtaaagaaatggctcgcaagaagatcagagagtacgattccaagagattgttaaaggagcatttcaagaggctctctggctatgaacttgacatcaaatctgcccaagttacagaggcaactgatttcaatgagctagtagagaaggaaccttggctgtcctcaacaaagctggttgtgaagcctgatatgctatttggaaagcgtggaaagagcggactagttgctctgaacctagatctggctgaagttgctggttttgtgaaggagcgacttggcaaagaggtggagatgggtggctgcaaaggccccattactacatttattgttgagccatttgttccacataatgaggagttttacctaaatattgtttcggagaggcttggttgtagcataagcttttcagagtgtggaggaattgatatcgaggaaaactgggacaaggttaaaaccatttttctgccaactggggtgtcttttacatcagaagtctgtgctccacttctcgccacccttcccttggagatcaaaagtgtgattgaggagttccttaaagtaatttatgctctatttgtagatctggacttcacattcctagagatgaaccctttcacatttattgatggaaggccttatccactggatatgagaggagagcttgatgacactgctgcctttaagaacttcaagaaatggggcaacctagaatttccattgccatttggaagagttatgagtgctactgagacctttattcatggactggatgagaagacaagtgcatctttgaagttcacagtcttgaaccccaagggaagaatctggaccatggttgctggaggaggtgctagtgtcatttatgcagatactgttggagatctcggctatgctgctgagcttgggaactatgcagaatatagtggtgctcctaatgaagaggaggttctgcagtatgccagagttgtaattgattgtgcaactgcagatcctgatggccgcaagagagcccttgtaataggtggtggaatagccaacttcactgatgtcgccgccacattcaatggcataattcgagctttgaaggaaaaggaatcaaagcttaaagctgcaagaatgagcatttatgtgaggagaggtggcccaaactaccagaagggtcttgcaaagatgagaattcttggagaggaaattggcatcccaattgaggtctatggccctgaggctacaatgacaggcatatgcaaagaggcaattgagtgcataagtgctgctgcttaaagctccaatactacccattcatcaaataaacctatttcttctcccaatcctttgcctaaagcaatgttgtagcaaaactgcattgaattttcattttttatataaatgaccattaagaagggtctccactctagtggaatgaatatcgccacttgggc

SEQ ID NO: 3130 - DNA, 1564 bp, Solanum lycopersicum
cccatttttttttataatgtaatgtaaagcagccatctctgaaaatctcatcaatatcacaactataaatatagtgagttgaatcccaatattcttacaagttccatacagattcagctttttaacgagaaaatggcccgcaagaagatcagagaatatgattcgaaaagactgttgaaagaacactttaagaggcttgctggttatgatttggccatcaaatctgcccagattacagagtcaactgatttgaatgagcttgtagagaaagagccatgggtttcttcaaaaaaattggcggtaaagcctgatatgttatttgggaagcgtggaaaaagcgggctagttgccttgaatcttgatctggctcaagttgctctttttgtgaaggaacggttaggcaaagaggttgagatgagtggatgcaaagggcccatcacaacctttattgttgagccatttgtaccccacaatgaggagttttacctaaatattgtttcagacagacttggttgtagtgttagcttttctgaatgtggaggaatagatattgaagagaactgggacaaggttaagacaatctttgtgccaacagggacatcttttacatcagagatttgtgcaccacttgctgctactctaccactggagattaaaggtgtaattgaggagttcctcaaagtggtttatactttgtttcaagatctggactttactttcctggagatgaatcctttcacattggtcgaaggaaagccttatccactggatatgaggggagagcttgatgacactgctacttttaagaacttcaaaaagtggggaaatgttgaatttccattgccatttggaagagtgatgagtgctacggagagctttattcatgggctggatgaaaagactagtgcatctttgaagttcacagtcttgaaccccaaggggcgaatttggacgatggttgctggtggaggtgccagtgtcatctatgcagatactgtcggtgatcttggatatgcttctgagctcggtaattatgccgaatatagcggtgctccaaatgaagaagaggtcttgcagtacgcgagagttgtaattgattgtgcaaccgcagatcctgatggccgtaagagagcccttgtgataggtgggggaatagccaactttactgatgttgctgctacatttagtggtataattcgagctctgaaggagaaggaatctaaacttaaagctgcaagaatgcacatatatgttagaagaggtggtccaaactaccaaaagggtcttgcaaaaatgcggtctcttggggaggaaattggcatcccaattgaggtatatggacctgaggaaaccatgactggtatctgcaaacaggctattgagtgcatcactgcagctgcataaagcaaccaactctgctaaattgttttggttttctttttagctttgtgttatcataatgatgttgtttgtgtctgatataagaaagagtgctttgtaatttagccatattacattcgcaaatgggctctaataataatatctacatattcatcttctgaaa

SEQ ID NO: 3131 - DNA, 1411 bp, Triphysaria pusilla
gtcgaaaagaaaatggcaaggaagaagatcagagagtatgattccaagagattgctgaaagagcatttcaagaggatttctgggtctgagcttgaaatcaaatctgcccaagtcacagagtcgactaatttcgaggaactagtggataatgaggcatggatatcatcgacaaaacttgtcgtgaaacccgatatgctattcggcaagcgtggcaaaagtggccttgtcgctttaaacctcgatttagctggtgttgctgcttttgtaaaagagcgccttggcaaagaggtggaaatggggggttgtaaaggacctattactacgtttattgtcgaaccatttgttcctcacaacgaggaatattatttgaacattgtttcggaaaggcttggttgtagtattagcttttcggaatgtggtggaattgatattgaagagaattgggataaggtgaaaactatatttgtgccaactgggtcgtcctttacatcggatctttgtgctccacttgtggcaacacttcctttggagatcaaaggtgtacttgaggagttcatcaaatttgtctacgctttattcttagatttggacttcactttcctcgagatgaacccgttcaccttggttgacggaaagccttatcctctggatatgagaggcgagctcgacgacactgcaacttttaagaacttcaaaaagtggggaaatattgagttcccaatgccgttcggacgagtaatgagtcctacagaaagctttattcatggacttgacgagaagacaagtgcatctctgaaattcaccgttttgaacccgaaaggacgaatttggactatggttgctggaggaggcgcaagtgttatatatgctgataccgtcggagaccttgggtttgcatccgagcttgggaactatgcagaatacagtggtgcccctaatgaagaggaggttttgcaatatgctcgagttgttattgattgtgcaactgcagatcccgatggcagaaagagagcactcgtaattggtggtggaatagctaatttcactgatgttgctgccacattcagtggcattatccgagctttaagagaaaaggaggcgaagctcaagtctgcgagaatgcatttatacgtgagacgaggaggcccgaattaccaaaagggcctcgagaaaatgaggactcttgctgatgaaattggcatccctattgaggtatatggaccagaggcaacaatgaccggaatttgcaaacaggccatcgactgcattagtgcagctgcctgaactcatgcaaaattgcattgtactagttttcttttcgtttttcatcattgttttgtaatgcgaaaataaaaatacaattgaaataaattgatgtccaattatatcttctgatagcttgcaatgatat

SEQ ID NO: 3132 - DNA, 1434 bp, Triphysaria pusilla
gttaaaaagaaaatggcaaggaagaagatcagagagtatgattccaagagattgctgaaagagcatttcaagaggatttctgggtctgacctcgaaatcaaatctgcccaagtcacagagtcgactaatttcgaggagctagtggataatgaggcatggatatcatcgacaaaacttgtcgtgaaacccgatatgctattcggcaaacgtggcaaaagtggccttgtcgctttaaacctcgatttagctggtgttgctgcttttgtaaaagagcgcctcggcaaagaggtggaaatggggggttgtaaaggacctattactacgtttattgtcgaaccatttgttcctcacaacgaggaatattatttgaacattgtttcggaaaggcttggttgtagtattagcttttcggaatgtggtgggattgatattgaagagaattgggacaaggtgaaaactatatttgtgccgactggctcgtcctttacatcggatctttgtgctccacttgtggcaacacttcccttggagatcaaaggtgtacttgaggagttcatcaaatatgtgtacactttatttttagatttggacttcactttcctcgagatgaacccgttcacctgggtcgacggaaagccttatcctctggatatgagaggcgagctcgacgatactgcaacatttaggaacttcaaaaaatggggaaatattgagttcccaatgccgttcggaagagtaatgagtcctacagaaagctttattcatggacttgacgagaagacaagtgcgtcactgaaattcaccgttttgaacccgaaaggacgaatttggactatggttgctggaggaggcgcaagtgtcatctatgctgataccgtcggagaccttgggtatgcatctgagcttgggaactatgcagaatacagtggggccccaaatgaagaggaggttttgcaatatgctcgagttgttattgattgtgcaactgcagatcccgatggcagaaagagagcactcgtaattggtggtggaatagctaacttcaccgatgttgctgccacattcagtggcattatccgagctttaagagaaaaggaagcgaagctcaagtctgccagaatgcatttatacgtgagaagaggaggcccgaattaccaaaagggcctcgagaaaatgaggactcttgctgatgaaattggcatccctattgaggtatatggaccggaggcgacaatgaccggaatttgcaaacaggccatcgactgcattagtgcagctgcttgaacttgcgtttgctgctgatgcaaaattgcattgttctactcgttttcttttcgtttttcatcgttgttttgtaacgtgaaaataaaaatacaattgaaataaattgatgtccaattatatcttctgatagcttgcaatgatatgaaaaaa

SEQ ID NO: 3133 - DNA, 1459 bp, Utricularia gibba
cattcgttgaataagcagttgggatctgtctcattaccaggatctcttgctgcgtcttcaaaggatcttgaggaaatggcgaggaagaagatcagagagtatgattccaagagactcctgaaagagcatttcaagaggttatctgggactgaactggaaatcaaatctgctcaagttactgagtccacagatcttaaaaaactagtggacaaggagccatggctgtcctcaacaagactcgttgtaaaaccagatatgctgtttgggaaacgtggaaaaagtggtcttgttgcattgaaccttgatttggctggggtttctgcattcgtggcggaacgacttggcaaagaggtggagatggggctctgcaaaggacctattaccacattcattgtcgaaccatttgttccccacaatgaggagttttatctaaatattgtttctgagagacttggttgcagtatcagcttctcagaatgtggaggaattgaaattgaagagaactgggacaaggtcaaaaccatattcgtgcctacaaatgccatcttaacatcagaagtctgtgctccattagtggcaacactgcctttggagatcaagcctgtgatcgaggattttattaaaattgtctttgctgtatttttggatttggatttcacattccttgagatgaatccattcaccttggtcaatggaaagccatttccattggacatgcgaggcgagcttgatgacactgctgctttcaagaacttcaagaaatgggggaacatcgaattccccatgccatttggaagagtcttgtcccctgcagaaagcttcatccatggacttgatgaaaagaccagtgcttctctgaagttcaccatcttgaacccgaaagggcggatctggaccatggttgctggaggtggagcaagtgtcatctatgcagatacagtaggagatctggggtacgcctctgagcttggaaactatgcagaatacagtggagctcccaatgaagacgaggtcctgcactacgcccgtgtcgtgattgattgtgcaactgcagatccagatgggcgcaagagagccctggtgatcggtggcggcattgctaacttcactgatgttgctgctacattcaacggcatcatccgtgctctgaaggaaaaggaatccaagctcaaggctgctagaatgcacttgtatgtgagaagaggaggacccaactaccagaagggacttgcgaaaatgagaagccttgcagaagaaatcggcatcccaattgaggtgtacggtcccgaggcaaccatgactggaatttgcaagcaggcgattgagtgcatcagcgctgccgcttgaaactgaaagctctgttgattttgatcttctgctgctggttttctactgtttatgctactgttttgtgcgaaatcaacatttaataaagagtcatcaaaagatgtttagtttt

SEQ ID NO: 3134 - DNA, 1622 bp, Cucurbita pepo
tttataaatacatatacagttgaatctgtagatttcaacttcaaatctcgattagatcgcagtttaacccaactcaccaccaatccgtttgagaaatggcgcgcaagaagatcagagagtacgattcgaagagactgttgaaggagcacttcaaaagaatttctggccgtgatttaccgatcaaatcagctcaggtcagagattcaaccgatttcaacgagctagttgagaaggaaccgtggctgtcatcgtcgaaattggttgtgaagcctgacatgttgtttggaaagcgtggtaaaagcggtttagttgcactaaacctagattttgctgaagtaactggttttgttaaggaacgcctagggaaagtggtggagatgggtggatgtaaaggacccattacgacgtttatcgtcgagcccttcgtcacacacaaggaagaattctatctgaatattgtctcagaacggcttggctgtaatctaagcttttcagaatgtggaggaattgatatcgaagagaactgggataaggtcaagaccatatttgttccgacaggagcatcccttacatcggaagtgtgcgccccacttgttgccacgcttcctttagagatcaagggggaaattgaggactttatcaagtctgttttgctctatttcaagatttggacttcacttttctggaaatgaatcccttcacattggttgatgggaagccttatccattggacatgagaggcgaactagatgatactgctacttttaagaacttcaaaaagtggggtgatctcgagtttccgttaccatttggaagggttatgaatgcaacagaaagctttattcatggcctagacgaaaagactagtgcatcattgaaattcactgtcttgaacccaaaaggaagaatatggaccatggttgcaggaggaggtgcaagtgtcatatatgcagacacggttggagatcttggttacgcctccgagctagggaattatgctgaatacagtggagcaccaaatgaagaggaggtcttgcagtatgccagagttgtaattgattgtgcaactgcagatcccgatggtcgtagtagagcgcttgtgattggaggaggaatagctaactttaccgacgtagctgctacttttaacggcataatcagggccttgaaggagaaggaagcaaagcttaaagcagcaagaatgaatatatatgtaaggagaggaggtccaaactaccagagggggttggccaaaatgcgagcactcggagaagaactaggcgttccaatcgaggtgtatggccctgaagcgaccatgactggtatatgcaagcaggccattgaatgcatcactgcagccgcgtaagtttccattatcatctgtgccaatgttggagaatctgatggactttttttttcatttcactgcatcccttgccttcctttctatagttttattctcgaattcgccattgatcttagttaaatcaagattgaacctttgatagtctttgagttgaggcttttgtgggtcacaaaagttctgttgatcttataataaaagtttactcagacatgaaaaatattttaatgaagtattaatagttctaaatcatttcata

SEQ ID NO: 3135 - DNA, 1639 bp, Cucurbita pepo
tactgcagggtcttgagaaatggctcgcaagaagatcagagaatacgattcaaagaaattgttgaaggagcacttcaaacggatctctggtagagaactgcccgtccaatccgctcaggtcactgaatcaactgatttcaatgagcttgttgagagggaaccttggctttcatcatcaaaattggtcgtgaagcccgatatgttgtttggaaagcgtgggaaaagtggtttggtcgccttaaatcttgatctggctcaggttgctgcatttgtgaaagagcgccttggcaaagaggtatcaatgggtggatgtaagggacctatcacaacatttattgtggaacccttcattccgcacaaggaagaatactatctcaatattgtctcagagagacttgggtgcagcattagcttctcggagtgtggaggaatgaaatcgaagaaaactgggataaggttaaaccatatttatccccacaggagtgtctctcacttcagaaacatgcgctgagctggtggcaagccttcctttggaggtcaaaggagaaatcgaggattttatcaaggcagtttatatcctattccaagatctggactttactttcttggaatgaatccttttgcgattgttgatgggaagccatatcctttggatatgagaggtgaactagatgatactgctgctttcaagaacttcaagaagtgggggagtattgaatttcctatgccatttggtagggttatgagtcctactgaaagctttatccatggcctagatgaaaagacaagtgcatccttgaattcactgttttgaatcccaagggacgaatttggaccatggtggctggaggtggtgcaagtgtcatatatgcagacacggttggagatcttggttatgccactgagctcggaaactatgcagaatatagtggagcacctaatgaggaggaggtgttgcagtatgccagagttgttcttgattgtgcaactgctgaccccgatggccaaaagagagcactcgtgattggaggagggatagccaactttactgatgtagctgctacatttaatggcataattcgggccttgaaggagaaggaatcgaggctgaaagcggctaggatgaatatttatgtgaggagaggaggccccaactaccagagaggtcttgccaagatgcgggcacttggtgaagaacttggtgttccaattgaggtttatgggccagaggcaaccatgactggtatatgcaagcaagcaattgagtgcataacggcagctgcctaagtgaggatacaccatccgcgtcgagcttgtcatagaaatcttatattatgtgtgtagttttcttgggtttaaccaattggtggtggtaattcctcaagttttaaataaaaaatatacatttgtgatgcattagaacaagaataagtgagcagagaagttttgagtggataatgttaatgcagaggggaaagtgtggattcaatgtagatgggtgtagcgaccagtggctatcttgtttcgctttcagtatagctcatagcttatcttacatttaagaggggaggtattcaattgagtacgcctatttctcaccacactttcaactatttctatggaatcatacttccctgtc

SEQ ID NO: 3136 - DNA, 1622 bp, Momordica charantia
gggaatctttgagcaattagttgacttcggttgatttcattgttttggttttgctattttttgattggtttcttctctggcgcaatgtaggtattgagaaatggcgcgcaagaagatcagagagaacgattccaagagattgttgaaggagcattttaaaagaatttctggccgtgatttaccgatcaaatcagcgcaggttagtgaatcgaccgatttcaatgagctagctgagaaggaaccctggctgttatcgtcaaaattggttgtgaagcctgacatgttgtttggaaagcgtggtaaaagcggtttagttgcactaaatctagacttggctgaagtaactaattttgtgaaggaacgtctggggaaagtggtggagatgagcggatgcaagggacccattacaacatttatagtggagccttttatcccacacaacgaagaattttatctgaatattgtctcagaaaggcttggctgtagtctaagcttttcagaatgtggaggaattgatattgaagagaactgggataaggtcaagaccatctttgttccaacaggagcatcccttacatcggaaatatgtgctccacttgttgccacccttcctttggagatcaagggggaaattgaggactttctcaagtctgttttttcttctatttcaagatttggacttcacttttctggaaatgaatcccttcacattggttgatggaaagccttatccactggacatgagaggcgaactggatgatactgctagttttaagaatttcaaaaagtggggtgatgttgagttcccattgccgtttggaagagttatgagtgcaacagagagctttattcatggcctagatgaaaagacgagtgcatcattgaaattcactgtcttgaacccaaaaggaagaatatggaccatggttgctggaggaggtgcaagtgtcatttatgcagacacggttggagatcttggttacgcctctgagcttgggaattatgcagaatacagtggagcaccaaacgaagaggaggtgttacagtatgcccgagttgttattgattgtgcaactgcagatcctgatggccgtagtagagcgcttgtgattggtggaggaatagctaactttacggatgtagctgctacatttaatggcataattagggccttgaaggagaaggaagcaaagcttaaggcagcaagaatgaatatttatgtaaggagaggaggtcctaactaccagaggggcttggcaaaaatgcgggcacttggagaagaactcggcattccaattgaggtctatggccctgaagcaacaatgactggtatatgcaagcaagccattgaatgcatcaccgcagctgcgtaagtctccgttggagtattctgactttttcctctaacaactatcatctataccaaagttggagaatctgatagaattcttttttatttccctctatcccatcccttggcttcttaacgatagtttcattcaaaaatttgccatgggtcttttatgacaagagtaggaaaagatactgctaatggcaatgtatggatattaaataaagaaccttttaatgtttagtctgaattgaggctaattttcatggac

SEQ ID NO: 3137 - DNA, 1699 bp, Papaver somniferum
agtcttctttcatctctctattgaatcttgatccaaaaattaacaattcccgcgaaaatatttatttttcattattatattaattcttcggatccataaatagagacaacaacaaacacgggacgtagagatctcattttctttctttctcttcaaccgtaagttctggttgttattccctctatcatacagtaacccaaaaaaacaaggtaattaagaatggcaagaaagaagatcagagagtatgattcgaagaggttgttgaaggaacattttaagagattggctggttctgaattagcactcaaatcagctcaggtcacggaatcaactgatttcaatgagctagcgaacaaagaaccatggctttcatccagtaaactggttgtgaagcctgatatgttgtttggtaagcgcgggaagagtggtttagttgccttgaacctcgatttggctcaagttgccagcttcgtgaaagagcgtcttggaaaagaggtggagatgggcggttgtaaaggaccaatcactacattcatcgtggaacccttcattccacatgatgaagaattttatctcaatattgtttctgagcgcctaggatgtagcattagcttttcagaatgcggaggaattgatatcgaagaaaactgggacaaggtcaagaccgtattcatcccaacaggaacaactttttctgcggatttatgtgctcctctggttgcaacactcccattggagatcaaggagaagatcgaggatttcattaaagtggtgtattctatatttttagatctagatttcaccttcctagagatgaatccttttgctttggtcgatggaaagccataccctttggatatgagaggagagttggatgacactgccactttcaagaactttaagaagtggggtaaccttgaatttccaatgccatttggaagagtaatgagtcctactgaaagcttcattcatgggctggatgaaaagacaagtgcatctttgaagttcacagttttgaacccaaagggacgaatttggactatggtagcaggaggaggtgctagtgtcatctatgcagacacggttggagatcttggttacgcttctgagctcggaaattatgccgagtacagtggagcaccaaatgaacaagaggtgttgcagtatgccagagttgttattgattgtgcaactgctgaacccgatgacaagaagagagctcttgtgattggaggaggaattgccaactttactgatgtcgccgctacatttagtggcattatccgagctttaagagaaaaggaggaaaagcttaaagctgcaaaaatagcatatatatgtgaggagaaggggaccgaaactatcagttgggtcttgctaagatgaggagtctcggtgaggagatcggtattcctcttgaagtttttggtcccgaagcaactatgactggcatatgcaaacaagcaattgactgcatcactgcatcagcatacacttctcatgactaggaaaatgatccgttcttttctcatttcttatgtgtttttcttcaatgtaataagtacctgagtatgtgatcaattgtcattagcattattgtttcccatttagactactattattgtgaaagtcttacctcctaagtacggagcatttagcattcatatagtaatgtaattcgtttttgttcaacatgagt

SEQ ID NO: 3138 - DNA, 1910 bp, Abies balsamea
cgatcgtggatcgctagcttgagcaggtctacttcatgacatagaaggatggcaatgcgtatacttcgatcctgcatcagctgtgcttcatgatatagaaagtaggcaaggcatatactttattccttgtacaaaaagcacaggcttctataaattcccagcagctcgggtcatctagatttcgcttccgcagagatatttttaaattcctgattagttttcagagagaaaccagagcccaaaatggctagaaagaagatcagagaatatgattccaagcgtctcctgaaagaacatctgaagaggctggctggaattgagattgacatcaaatcagcgcaggttacaaattcgaccgatttgaatgaattggcagacacgaagccatggttgtcatcatttagactagttgtgaaaccggatatgctgttcggcaaacgaggaaagagtggtttggttgccctaaatctggacttagctcaggctgcgttatttgtcagagaacgcctaggaaaagaagttgagatgggcaatgcaaaggcaccgatcacaactttcatattggagcctttcataccccatgatgatgagtattatctttcaattctttcggaacgccttggttttacaataagtttttctgcatgtggaggtgtagaaattgaagaaaattgggataaggttaagacgatatttgtcccaacagaaaaacccttaacaactgaactctgtgcccccctgattgcaactctgccattggagattcgtggcaaaattgagaatttcataagaggtgtttacaaagtctttttggatttggacttcactttccttgaaatgaatccatttacatttcttgatggaaatccttacccgctggacatgcgaggagaattggatgatactgcttcttttaagaacttccaaaagtggggcaatattgaattcccaatgccctttggtagagtcatgagccctgcggaacagttgattcacagcatggatgagaagacaagcgcctcattgaagttaaccattctgaacccaaaagggcgtatttggacaatggttgctggaggaggggcgagtgtaatatatgctgatacggttggagatttgggttatactagtgaacttggaaattatgcagaatacagtggagctccgaacgaagaggaggtgttatactacgcaagagttctaatagattgtgcaactgcaaatccagatggacgaaagagagcattgttaataggtggaggcatagctaacttcacagatgttgctgctacctttaatggcatcattcgggctttgcgtgaaaaggaatctaaactcaaagcagcaagggtcaacatttatgtgaggagaggaggcccaaattatcagattggtctagcaaagatgcatgctttaagtgaagagattggggttccgattgaggtgcatggaccagaagatagtatgactggcatatgcaagaatgctattgattatataacagctgctgactaattcatcaaatgttaccgtgaacgattattattatcaagttaaacctacacactgggaccatatttggataattttaggtagtatgtggtatgctgtcttgtgagacaatgagacaatgttgtgttaatttggtgattttacatcaacgatgtcaaactatgtgggatgtaagatgtctttgtttatggtgagttgacttgctgagttttggactgttaggtgctcaagtttacaatttgatatattgttaacaatcatttttcagctcaagtaagtaatcgagactgaagactttcacaagcgtattgtacttgcttaagcgacattgcaaatgcaagattgtgaacgtctgcctaactagtttggagaaatatgaaatgcttaaaaaaacaagg

SEQ ID NO: 3139 - DNA, 1991 bp, Pinus pinaster
tgtcttcatcatattttgagcggagcatgacaaaacgattttagcggcccatgccaaaacgattgatagtgcatcacgaacttcagcaggtgtgttttcattgtataggagcgaggccaggcatactatgttacagggacaggctgccataaattcccagcagtaatttcattcgcttcccgtctaaaatttctgcgttcgaagggatatttacatatattcttaattcgtctccagagagaaatcaaagctcaaaatggctagaaagaagatcagagaatatgattccaagcgcctgctgaaagaacatctgaagaggcttgctgatattgagattgacatcaaatcagcccaggttacaaattcgaccaatttgaatgaattggcagacacgaagccatggttgtcctcgttaagactggttgtgaaaccggatatgctgttcggcaaacgaggaaagagtggtttggttgccctaaatctggacttagctcaggctgcgttatttgtcagagatcgtctaggaaaagaggttgagatgggaaatgcaagggcaccgatcacaactttcatattggagcctttcattcctcatgatgacgagtattatctttccattctctcggaacgtcttggttttacaataagtttttctgcatgtggaggtatagaaattgaagagaactgggataaggttaagacgatatttatcccaacagagaagccattaacatctgaactctgtgctcccttgattgcaactctgccattggagattcgtggcaacattgagaatttcataagaggtgtttacaaagtcttcttggacttggacttcacattcctagaaatgaatccatttacattacttgatggaaagccttaccccctggacatgcgaggagaattggatgatactgcttctttcaagaacttccaaaagtggggcagtattgaattcccgatgccctttggtagagtcatgagccctgcggaagagttgattcacagcatggatgaaaagacaagtgcctcattgaagttgaccattctgaaccccaaagggcgtatttggacaatggttgctggaggaggagctagtgtcatatatgctgacacggttggagatctgggttatgctagtgaacttggaaattatgcagaatacagtggagctccaaatgaagaggaggtgttatactatgcaagagttctaattgactgtgcaactgcaaatcctgatgggcgcaagagagcattgttaataggtggaggcatagctaacttcacagatgttgcagctacctttaatggcatcattcgagctttacgtgaaaaggaatctaaactgaaagcagcaaggttcaacatttatgtaaggagaggaggcccaaattaccagactggtctagccaagatgcgtgctttaagtgaagagattggggttccgattgaggtgcatggaccagaagctagtatgactggcatatgcaaggatgctattgattatataacagctgcggactaattcatcaaatgttactctgaactattatttaatatcgagttaaacctacacaaggagatcatatttaaataatggggtacgctgtcttgtgagacaatgttgtgctagattggtggcatttacatctaccatgtcaaagaaagtaggatgtaagatttctttgttcatgagtaagttgtctcgctgtgttcagactgttagatgcttaagtttacaattcgatatattgcttctaatcatttctcagttcaagaaagtaattgagactgaagactttcacaagtgtattatactgatttaaaccacattgcagatacaagattgtcaacatgtgcctaactattctgaaataccaaactaattgtttggaaatatgaaatgctaatctgttcgaggaaaaagaacaagggacgatttcacatttctatgaaagaaataaaatttgacagatatttctctcgac

SEQ ID NO: 3140 - DNA, 1571 bp, Medicago truncatula
ctttcaactatataaatagagccatcacacaaaaccaaatcgttcgttcatcaattcagatccaaccactcatctcaccaacctcatccattctccttccgattaagaagaaatggcacgcaagaagatcagagagtatgattctaagagactgttgaaggagcactttaagagactttctggcaaggacttacctatcaagtctgcacaagttacagaagccactgatttcactgagctgcaagacaaggaacaatggctttcttcttctaaattggttgtgaaacctgacatgttatttgggaagcgtggtaaaagtggtttggttgccttgaatttggatttggcacaagttgcttcatttgtgaaagagcgtcttggtaaagaggttgaaatgggtggatgcaagggaccaataacaactttcattgttgaacctttcatcccacataatgaagagtattaccttaacattgtctctgacagacttggaaacagtataagcttttcagaatgtggaggaatcgatattgaagagaattgggataaggttaagaccgtatttattccaacgggagtatctcttacatcagaaatcattgccccacttgttgcaacccttcccttggagatcaagggagaaattgaggaatttctcaaggtgattttcactctgtttcaagatctggatttcactttcttagagatgaatcctttcacattggttgatggaaagccttatcctttggatatgagaggcgagctagatgacactgctgctttcaagaacttcaaaaagtggggtaacattgaatttccattgccatttggaagggttatgagtgccactgagtctttcattcatggattagatgaaaagacaagtgcatctctaaaattcactgtgttgaacccaaagggccggatttggacaatggttgctggaggaggcgctagtgtcatctacgctgatacggtaggcgatcttggctttgcaaatgagcttggaaactatgcagaatatagtggtgcacccaatgaagaggaagttttgcagtatgccagagttgtaattgattgtgcaactgccaaccccgatggccaaaaaagggctcttgttataggcggaggcatagccaacttcactgatgttgctgctacttttagtgggataattcgggcactaaaggagaaggaatcaaagttaaaggcagcaagaatgcacctttatgtgaggcgagggggtccaaactaccaaaagggtctagaaaaaatgcgagcacttggagaggaaattggcatcccgattgaggtttatggacctgaagcaacaatgactggtatatgcaaacaggcaatacagtgcattactgcttccgcttaactattcatttcaggtcaatgctttcttatgttcatgtcatctgcaagtttgaagtgaacgttgatggttgattcttaatttcctttcccgttcctggaatttgtaaatttagttacaccgtgtgtttacaaaatgaagtcatccaaaaagagtggttgaaaatgttgtctcagtttttgtagaattt

SEQ ID NO: 3141 - DNA, 1539 bp, Tropaeolum majus
gtgcatctcaactacaattcccgacagtatcctccgattctccctcaacgaaatggcacgcaagaagatcagagagtatgattcaaagagattattgaaggagcacttcaagaggctatctggaaaagaactgcctatcaaatcagctcaaattactgaatcaacagacatcaacgagttagtagagaaggaaccttggctttcatcagaaaagctggttgtgaaacctgacatgttgtttggaaagcgtggaaagagtggtttagttgccttgaaccttgatttggcggaagttgcgagttttgtaaaagagcgtctgggcaaagaggttgagatgagtggatgtaaaggacctattacaacatttatcgttgaacccttcatcccacacaatgaggagttttaccttaatattgtctcagaccgacttgggtgcagcataagcttttcagaatgtggaggcattgaaattgaagaaaactgggataaggtcaagaccatattcgtcccaacaggtgtttctttgacctcggaaacatgtgctccacttattgcaaccattcccttggagatcaaaggggaaattgatcaatttattaaagtggttttcacaatattccaagctctcgacttcactttcctagagatgaatccttttgcattggttgatggaaagccataccctctagatatgaggggcgagctggatgacactgctgcttttaagaactttaagacgtggggcaatatcgagtttcctctacctttcggaagagtaatgagtgcaacagaaagctacatccatggcctagacgagaagacaagtgcatctctaaaattcaccgttttgaatcctaagggacggatttggacaatggtagctggaggaggcgcaagtgtcatctatgctgatacggttggggatcttggttatgcttccgagctggggaactacgcagaatatagtggtgcaccaaatgaagaggaggtgttacaatatgcacgagttgtactcgattgtgctactgcagatcctgatggtcaaaagagagccctggttattggaggaggaatagctaactttacagatgttgctgctacatttaatggcataattcgtgcattgaaggagaaggaatcaaagcttaaagcggctagaatgtcgatatacgttagaagaggaggaccgaattaccagaggggtcttgctaagatgagggcacttggagaggaaatcggcatcccacttgaggtttatggaccggaagcaacgatgaccgggatatgcaaagaagcgatccagtgcatcaccacagctgcataaggtacccgttcattggatcaatctctcctaactcttatgattctatggcgagtttgagttgttctctaaatctcagttttacccattgcatcatgtttaacctcaaaaaaaagtaatgttcgatttcttgtttgaatgcgcgccatttgtattttacgtattgagatcaaagtattgtttttctcgagaacaataataaatgtatctggtatctg

SEQ ID NO: 3142 - DNA, 1840 bp, Pseudotsuga menziesii
catctgcatgactcatgaggaggtgtgaaaatacattggagtgaggcaaggcatgttatattccttgtacaagaacaggcttccataattttccatcagaaatttcattcgaggcccgtggaggtttctgcatccgtggtatatttatatattcttaattcgtcttcggagagaaatcagagctcaagatggctagaaagaagattagagaatatgattccaagcgcctgctgaaagaacatctgaagaggctggctggtattgagatggacatcaaatcggcccaggttacaaattcgacagatttgaatgagttggcagacacgaagccatggttgtcctcattaagactggttgtgaaaccggatatgctgttcggcaaacgaggaaagagtggtttggttgccctaaatctggacttagcacaggctgccttatttgtcagagatcgcctaggaaaagaggttgagatgggcaatgcaaaggcaccaaccacaactttcatattagagcctttcattcctcatgatgacgaatattatctttcaattctttcggaacgccttggttttgcaataagtttttctgcatgtggaggtgtagaaattgaagagaattgggataaggttaagacaatatttgtcccaacagaaaagcctttaacatctgaactctgtgcccccctgattgcaactctgccattggagattcgtggcaacattgagaatttcataaaaggtgtttacaaagtatttctggatttggacttcactttcctagaaatgaatccatttacattgctcgatggaaagccttaccccctggacatgcgaggagaattggatgatactgcttcttttaagaacttccaaaagtggggcaatattgaattcccaatgccctttggtagagtcatgagccctgcagaagagttgattcacagcatggatgaaaagacaagtgcctcgttgaagctgaccattctgaaccccaaagggcgtatttggacaatggttgctggaggaggggctagtgtgatatatgccgatacggttggagatttaggttatgctagtgagcttggaaattatgcagaatacagtggtgctccaaacgaagaggaggtgttatattatgcaagagttctgatagattgtgcaactggaaatccagatggacgcaagagagcattgttaataggtggaggcatagctaacttcacagatgttgctgctacctttaatggcatcattcgagctttgcgtgaaaaggaatctaaactcaaagcagcaagggtcaacatttatgtaaggagaggaggcccaaattaccagactggtcttgcaaagatgcgtgctttaagtgaagagattggggttccgatagaggtgcatggaccagaagctagtatgactggcatatgcaagaaggctattgattatataacagctgctgactaatttatcaaatgttacagtgaactattattcgatactgcattaaacctacacatgagaaccatatgtggataattttaggtggtatgggagaggctgtcttgtgagacaatgttgtttcagattgttacatctacaatgtcaaactatgtaggatgtaatgcccctttctttagaaattatgggggtgttgtcatgctgagtttggactgttaggtgctaaagtttacaatttgatatgttgcttccaatcatttcactgttcaagcaagtaactgagactaaatactttcacaagtgtattacttgcttaaactacatcgcagatacaattttgtaaatgtttgcctaactattctgaaaagatgaattaacgtttggag

SEQ ID NO: 3143 - DNA, 1654 bp, Chenopodium quinoa
agtaaattagtcaattttctgcagttataaataagcttcagccattgtctgtgagttctcccattaaatcgccctgattgacattttctctctcttcagctacctgattttgattttacggtttaacaaagggggaaaatggcaaggaagaagatcagagagtacgattcaaagaggttgattaaggagcattataagagaatttctggttctgaactacccattagatcagctcaaattacagagtcaaccgacctgaatgaacttgttcagaatgagccatggctatcatctgaaaagttggttgtgaagcctgacatgttgtttgggaagcgtggcaaaagtggtctagttgccctcaatttagacttttcccaggttactgctttcgtaaaagaacgtcttggcaaagaggtggagatgggtggatgtaaaggacctattactactttcattgtcgagcctttcattccacacaatgaagagttttatcttaacattgtctcagaaagactggggaacagtataagcttctcagagtgtggtggaattgagattgaagagaactgggataaggtcaaaacaatctttgttcccactggtgtttctcttacttctgaagtctgtgctcctctggttgctactttacctttggagttcaaaagtgttattgaggagtttatcaaagtcacttttgccctgtttttagatctggatttcactttcctagaaatgaatcctttcacattagtcaatgggagcccctatcctttggacatgagaggcgagctagatgatactgctaccttcaagaatttcaagaagtggggtaatatcgaatttccattgccatttggaagagttatgagcccaacagagagctttgttcatggtctagatgaaaagacaagtgcatccttgaaattcacagttttgaaccccaagggaaggatttggaccatggtggctggaggaggagccagtgtgatctacgcagatactgttggggatcttggctatgcatttgagcttgggaactatgctgaatatagtggtgctcctaatgaagatgaggtcttacagtatgccagagtagtaattgattgtgctactgcagatcctgatggtcgcaagagagccctcgtagttggtggaggtattgctaattttactgatgttgctgctaccttcaatggaataatcagagctctgaaggagaaggaatcaaagcttaaagccgcaagaatgcacatttatgtgaggagaggaggtccaaattaccaaaagggtttggctaaaatgcggctgcttggagaagagattggaattcctattgaggtgtatgggcctgaggcaacaatgaccggaatatgcaagcaggccattgaatgtattagtgctgctgcttaatcgggtctcagcaaattcaaatttgaatcagtccttgcctctacagtgctagtttatagctgatatagatttagcacaaatttaatgatgttttatagatttgttgtgtgctctagagcagatgcatttgttagcacagaatgaagatcctttttctgttattgatactgataatcaatgtataataccttgaataaagtcattggtttcattcaaggattatgataatgaaatgtgataaatt

SEQ ID NO: 3144 - DNA, 2025 bp, Fragaria vesca
ggaaatcagttagcattgcagagtcttgcatctgcctacctaactcccacaaacccaacaccaaaaccacacctcttattcttctgagaaatggcacgcaagaagatccgagagtacgactccaagaggctattgaaggaacacttcaagaggctcgctggtcgtgaattgcctctcaaatctgcccaggtgactgaatcaactgatttcaatgagctacttgagaaggagacttggctctctacttccaagttggttgtcaagcctgatatgttgtttggaaagcgtgggaagagtggtttggttgccttgaacctagattttgctcaagttgtcactttcgtgaaggagcgcctaggcaaagaggttgagatgggtggatgcaaaggacccatcacaacattcattgtcgagcccttcattccccacaatgaagagttttacattaacattgtctcagagagacttgggaatagcataagcttctcagagtgtggaggaattgacatcgaggagaactgggataaggttaagaccatatttgtcccaaccggagcttcccttacaccagaagtgtgtgctccacttgttgcaacccttcccatggagattaagagcgaaattgaggagtttatcaagtctgtatttgcactatttcaagatctcgacttcacttttctggagatgaatccttttgcattggttgatggaaagccatatcctttggatatgagaggcgagctggatgacactgctgctttcaagaacttcaaaaagtggggcaatattgaattcccaatgccatttggaagagttatgagttctacagaaaagtttattcatgggctggatgaaaagactagtgcatctttgaaatttacagtcctgaatcctaagggacgaatttggactatggttgctggaggaggtgcaagtgttatttacgcagacacggttggagatcttggctttgctaatgagcttggaaactatgctgaatatagtggagcaccaaatgaagaggaggtcttgcagtatgccagagttgtgattgattgtgcaacttctgatcctgatggccgtaagagagcccttgtaattggaggaggaattgctaacttcactgatgtagctgcaacattcaatggcattattagagccttgaaggagaaggaatcaaagcttaaagctgctaggatgcatctttatgttaggagaggaggtcccaactaccagaggggacttgcaaaaatgagggcacttgcagaggaaattggcctccctattgaggtctatggtcctgaagcaacaatgactggtatttgcaagcaggcaattcagtgcatctctgctgctgcatgataatatagtctgaagattgctgctctctcttgtctatcttatcttttttttttttcttctgcggcaagtgccagtgtctccataccttgtaccaatttcttttgttaagctctttgtaccaatttcattctatcaaaaacctcagcaaagttgatgtagttgtatgtgccaatgagtaatatgatagtgggatggtactatgtgatcttattaccataataaaaagtttaaattggtattcattttctgtatatcagattccttattaataccaaaacctcggcaaatttgagacgcttataacagtcctgaagacttgtagctccctgtaggcctatacacgaggtcgtgaatttgaatcgctcagtgtctcttttcacaagggtttatgctaatggccgatgacaatggtgagctatatatatgcagctcatatcccattgccccttgagttgccttttatagatatacagtccaacttgtttttgttactagccttgtacttctgtttattttccgagttctagatttaaactataaattaagaagactcggtttgacaagaggcttattctaagcttgcagaagctttattgcatacagaaaccactggatcgtcttttattttgagaagagataatggctaacaacagcaaagcctcc

SEQ ID NO: 3145 - DNA, 1834 bp, Taxus baccata
catccacaaataaatcatgcttttctggtttaaggactcgcagatatgatttttctggctgcaccacaatgaatccaccaatctttctcgccaactacttcaactctttaatcataatattctattcctaaaaacttcgcatctcgtgtttccaactacatgtcaaaagaatgtgccaaatataataagttataaccccctttaggcgataatatcacagcacccaatcgtgaagagaaattgaagctgaaaatggccagaaagaaaatcagagagtatgattccaagcggctattgaaagaacatttgaagaggctcgttgatcttcaggttgagatcaaatcagcccaggttacgggttccacaaatctgaatgagttggccgataatgaaccatggttatcggcgtcaaggctggttgtaaaacctgatatgctgtttggaaagcgagggaagagtggcttggtggccttaaatctggatttggcacaagctgcagcatttgtcaaagatcgcttaggaaaggaggttgagatgggtggtgcaagggcaccaatcacaacttttatattggagccttttattcctcatgacgaggagtattatctttcaattgtttcagatcggcttggtttgacaataagtttttctgcatgtggaggcattgaaattgaagaaaattgggataaggtcaagacaatatttgttccaacagaaaagtctttaacggctgagatttgtgctcctttaattgcaactctcccattggagattcgtggaaaaattgagaatttcatagcaggtgtttacaaagtgtttttggatttggacttcactttcttagagatgaatccatttacgtttgtcaatggaaagccttaccctttggatatgcgaggagaactggatgacactgctgcttttaagaacttccaaaagtggaataatattgaattcccaatgccttttggtcgagtcatgagccctgcagaagattcggttcacagcatggatgaaaagacaagtgcttccttgaagttcactattttaaatccaaaagggcgtatctggacaatggttgctggaggaggggctagtgtgatatatgccgatacagttggagatttaggctatgcgattgaacttggaaattatgcagaatatagtggggcgccaaatgaagaggaggtgttgtactatgcaagagttctgatagattgtgcaactgcaaatccagatggccgcaagagagcattgttaataggtgggggcattgctaacttcacagatgttgctgctacatttaatggcatcattcgagctttgcgtgaaaaggaatctaaacttaaagcagcaagggtgaatatatatgtaaggagaggaggcccaaattaccagagtggtctagcaaagatgcgtgctctaagtgaagagattggggtaccaattgaggtatttggacctgaagctagtatgactggaatatgcaagcaggctattgactacatcacagctgccaactgagctataaaaatgtcttaatgatctctaaattatgttctgagttgagctttcacatggggggcatttttggagagtgaaaggtactctcgtgggagtccatgttgtaagtttgcagacaatgaacaccgtgtgatgtttatgtggagtcttaccatgaaaatccatggaggagatatgattcttcttttctcgtgggttggttaggttgtagactgctttgcacagtatttacaggttgaaatatttctttcaactttccagttgtttttaatgaaattgaataatgcagacagaacttatttgattcttg

SEQ ID NO: 3146 - DNA, 1453 bp, Tragopogon dubius
gaatatctgtactgcatctaatatctcacagccttcaaccgatcacacaactggttttcaaggtacgataatggcacgcaagaagatcagagagtatgattccaagaggctggtgaaggagcattttaagaggatttctggttccgaattggctattaaatctgcacaggttacagaatcaaccgacttgaacgagctaatagagaaggaaccctggctatcttcatccaaattggttgtaaaacccgacatgttatttgggaagcgtggcaagagtggactcgttgccctaaatcttgatttggcccaagtttctgaattcgtaaaggcacgacttggcaaagaggttgaaatgggaggatgcaaaggacctataaccacattcattgttgaaccatttgttccacacaatgaagagttttatatcaacattgtttctgagcgattagggtgtagcattagtttttcagaatgtggaggaattgaaattgaagagaattgggacaaggtcaagacaatctttttaccaactggggtgtctttgaatcaagagatatgtgctccacttgttgcaactcttccattggagattaaacctgtaattgaggagttcatcacagctatatattctttatttatagatcttgacttcactttcttagaaatgaatcctttcaccctggtcgataataaaccttatcctcttgatatgagaggagagcttgatgacactgctgctttcaagaacttcaaaaagtggggcaacattgagtttccattgccttttggaagagttatgagtgctaccgaaagctttattcatggactagatgaaaagactagtgcatctttgaagtttacagttcttaatccaaagggaagaatttggaccatggttgctggtggaggtgctagtgtcatatatgctgataccgttggagatcttggatatgcttccgagcttggaaactatgcagagtacagtggtgcaccaaatgaagaggaggttttgcagtatgctcgagttgttattgattgtgcaactgctgatccggatggtaaaaagcgagcattggtagtaggaggtggaattgctaatttcactgatgttgcagccacattcaatggcatcattcgtgcgatgaaagagaaggagtctaagttaaaggctgcaaacatgcacatctatgtaaggagaggaggtccaaattaccaaagaggacttgcaaggatgcgtgcactcggagaggaaattggcatccccatagaggtgtatgggcccgaggcaacgatgacaggaatatgcaaacaagcaattgactgcatcactgcagctgcataaacttggttaatgattgtgtttcattgaattgaaatgtagaatgtaactcaagtgttgtgttttgttttgcttttgtttggtgtgtcttttcttttaaaccacaaattgtag

SEQ ID NO: 3147 - DNA, 1511 bp, Triphysaria pusilla
gtcagcaacttctgctatctctctctccaaacaccaaacttcctttcagtttctctctctaaaggttgaatagaaatggcaagaaagaagattagagaatatgattcaaagagactattgaaagagcatttcaagaggatttctgggtctgagttggaaatcaaatctgcacaaatcgtcgagtctactgatttcaatgaaatagtagaaaaggaaccctggctatcatcaacaaaactggtcgtcaaaccggatatgttattcggaaaacgtggaaaaagtggtcttgtcgctttaaacctcgacttagctggagttgccgcctttgtgaaagaacgcctcggaaaagaggttgagatgggagggtgcaaaggaccgatcacgaccttcattgtcgaaccatttgttccacacagcgaagaatattacctaaacatcgtctccgagaggctcggttgtagcattagcttttccgagtgtggaggaatcgaaatcgaagaaaactgggacaaggtcaaaactatcttcgtgccgacaggtgtatcgtttacacccgagatatgtgctccgcttttggcaacccttcctttagagattaaaagtgttattgaggagttcatcaaatcagtatatgctttgtttttagatttggactttacttttctcgagatgaacccgttcactttggtgaacggaaagccatatccgttggatatgagaggcgagcttgacgatacggctgcttttaagaacttcaaaaaatggggaggtattgaatttccgatgccattcggaaggataatgagtcctaccgaaagcttcattcacggccttgacgaaaagacgagtgcgtctctgaagttcacggttttgaacccgaaaggacgtatttggactatggtcgccggaggaggtgcaagtgtcatatatgccgataccgttggagatcttggctacgcgtccgagctcggaaattacgctgaatatagtggcgctccaaatgaagaggaggttttgcagtatgcccgagttgttattgattgtgcagctgcggagcccgacgggctaagtcgggccctcgtaatcgggggtggcatagctaatttcacggacgtggccgctacatttagtggcatcattcgagcactaagagaaaaggagtcgaaacttaaggctgcaagaatgcatctatatgttagaagaggaggtccaaattaccaaaaagggcttgctagaatgagaagccttgctgaagaaatcggcattccgattgaggtttatgggccagaggcaactatgactgggatatgcaaacaggcgattgagtgtattagcgcagctgcataatatgaagttgcaatttatgctgtttttttttcttatatcagctttttatttccacttttattacagtcttaataattgtgttgttgtgaccaatgttttgtcacgttgtgtgttttaatttggacttaaatgtgtcttaaataaaaagttgcatttacctttgc

SEQ ID NO: 3148 - DNA, 1438 bp, Vinca minor
ggttgtgaagaaatggctagaaagaagatcagagagtatgattcaaagagattgttgaaagagaatttcaaaaggctctctggttatgaacttggcatcaaatcttcccaagttacagagggaactgatttcaatgaactagtagagaaagagccttggctatcaacaacaaagctcgttgtgaagcctgatatgctatttggaaagcgtggaaagagcggattagttgctttgaacctagatctggctgaagtttccagttttgtgaaggaccgacttggcaaagaggttgaaatgggtggttgcaatggccccattactacatttattgttgagccgtttgttccacataatgaggagttttacctaaatattgtttctgagagacttggttgtagcattagcttttcagaatgtggaggaattgatatcgaggaaaactgggacaaggtaaaaaccatttttctaccaacaggggcatttttcacctcagaagtctgcgctccacttgttgccacccttcccttggagataaaaaacgttattgaggagttcatcaaagtaatctatgcactatttgtagatctggacttcacattcctagagatgaaccctttcacgttggtcgatggaaagccttatccattggatatgagaggagagcttgatgacactgcagcctttaagaacttcaagaaatggggcaacatcgaatttccattgccatttggaagagttatgagtgctactgaaagctttattcatggactagatgagaagacaagtgcatctttgaagttcacagtcttgaacccgaagggaagaatttggacgatggtagctggaggaggcgctagtgtcatttatgcagatacggttggagatcttggctacgctactgagctcgggaactatgcagaatatagtggtgcccctaatgaagaagaggttttgcagtacgccagagttgtaattgattgtgcaaccgcggagcctgatggccggaaaagagcccttgtaataggtggagggatagccaacttcaccgatgttgctgccacattcaatggcataattagagctttgaaggagaaggaatcaaaactcaaagctgcaagaatgagcatttatgtaagaagaggcggtccaaactaccagcgaggtcttgcaaaaatgagagctctaggagatgaaattggcatcccaattgaggtgtatggtcctgaggcgacgatgaccggcatttgcaaagaggcaattgagtgcataactgctgctgcttaaagcttcaatgttttcattaatcaaaataaactttatttcttcttcttcccatcctttgctttatcaatgttgtaacacaaactgaattaaattttctatttttttaatatataaatatgatctgtgagaaaggatcttcatttcttctgaaata

SEQ ID NO: 3149 - DNA, 1495 bp, Triphysaria pusilla
aattcttgcacctaacattcaacagtcgaaaataaaataggcaaggaagaagatcagagagtatgattccaagagattgctgaaagatcatttcaagaggatttctgggtctgagctcgaaatcaaatctgcccaagtcacagagtcgactaatttcgaggagctagtggataatgaggcatggatatcatcgacaaaacttgtcgtcaaacccgatatgctattcggcaaacgtggaaaaagtggccttgtcgctttaaacctcgatttagctggtgttgctgcttttgtaaaagagcgtctcggcaaagaggtggaaatggggggttgtaaaggacctattactacgtttattgtcgaaccatttgttcctcacaacgaggaatattatttgaacattgtttcggaaagactcggttgtagtattagcttttcggaatgtggtggaattgatattgaagagaattgggataaggtgaaaactatatttgtgccgactggctcgtcctttacatcggatctttgtgctccacttgtggcaacacttcctttggagatcaaaggtgtacttgaggagttcatcaaatctgtgtacactttatttttagatttggacttcactttcctcgagatgaacccgtttacattggtcgacggaaagccttatcctctggatatgagaggcgagctcgacgacactgcaacttttaagaacttcaaaaagtggggaaatattgagttcccaatgccgttcggacgagtaatgagtcctacagaaagctttattcatggacttgatgagaagacaagtgcatctctgaaattcactgttttgaatccgaaagacgaatttggactatggttgctggaggaggtgcaagtgtcatctatgctgataccgtcggagaccttgggtatgcatctgagctagggaactatgcagaatacagtggtgcccctaatgaagaggaggtcttgcaatatgctcgagttgttattgattgtgcaactgcagatccggatggcagaaagagagcacttgtgattggtggtggaatagctaacttcactgatgttgctgccacgttcagtggcattatccgagctttaagagaaaaggaggcgaagctcaagtctgcgagaatgcatttatacgtgagaagaggaggcccgaattaccaaaagggcctcgagaaaatgaggactcttgctgatgaaattggcatccctattgaggtatatggaccagaggcaacaatgaccggaatttgcaaacaggccatcgactgcattagtgcagctgcttgaacttgcgctgctgatgcaaaattgcattgttctactcgttttcttttcgtttttcatcattgttttgtaacgcgaaaataaaaatacaattgaaataaattgatgtccaattatatcttctgatagcttgcaatgatattgaaaaagtcatttcatgtgcttttgtttctcaaacttttggatggcc

SEQ ID NO: 3150 - DNA, 1368 bp, Triphysaria pusilla
cacacaccagaaattcttgcacctaacattcaacagttaaaaagaaaatggcaaggaagaagatcagagagtatgattccaagagattgctgaaagagcatttcaagaggatttccgggtctgagctcgaaatcaaatctgcccaagtcacagagtcgactaatttcgaagaactagtggataatgagccatggatatcatcgacaaaactggtcgtaaaacccgatatgctattcggcaagcgtggtaaaagtggccttgtcgctttaaacctcgatttagctggtgttgctgcttttgtaaaagagcgcctcggcaaagaggtggaaatggggggttgtaaaggacctattactacgtttattgtcgaaccatttgttcctcacaacgaggaatattatttgaacattgtttcggaaaggcttggttgtagtattagcttttcggaatgtggtgggattgatattgaagagaactgggacaaggtgaaaactatatttgtgccgactggctcgtcctttacatcggagctatgtgctccacttgtggcaacacttcccttggagatcaaaggtgtacttgaggagttcatcaaatctgtgtacactttatttttagatttggacttcactttcctcgagatgaacccgttcaccttggtcgacggaaagccttatcctctggatatgagaggcgagctcgacgatactgcaacatttaagaacttcaaaaagtggggaaatattgagttcccaatgccgttcggaagagtaatgagccctaccgaaagctttattcatggacttgacgagaagacaagtgcatcactgaaattcaccttttgaacccgaaaggacgaatttggactatggttgctggaggaggcgcaagtgttatctatgctgataccgtcggagaccttgggtttgcatccgagctagggaactatgcagaatacagtggtgcccctaatgaagaggaggtcttgcaatatgctcgagttgttattgattgtgcaactgcagatcccgatggcagaaagagagcacttgtaattggtggtggaatagctaatttcactgatgttgctgccacattcagtggcattatccgagctttaagagaaaaggaggcgaagctcaagtctgcgagaatgcatttatacgtgagacgaggaggaccgaattaccaaaagggcctcgagaaaatgaggactcttgctgatgaaattggcatccctattgaggtatatggaccagaggcaacaatgaccggaatctgcaaacaggccatcgagtgcattagtgcagctgcttgaactgatgcaaaattgcattgttctactcgttttcttttcgtttttcatcg

SEQ ID NO: 3151 - DNA, 1517 bp, Cichorium intybus
caactttgaagaaagttagcgatctgatctcggtatttgctgtgtaaacctgagttgagatctgtggtggttttcttgtatcaatagtgaggaagaacagggttttcaagggaagataatggcacgcaagaagatccgagagtacgattccaagaggctggtgaaggagcattataagaggatttctggctccgaattggctattaaatctgcacaggttacagaatcaaccgacttgaacgagctaatagaaagagaaccatggctctcatcatccaaattggtcgtaaaacccgacatgctgttcggaaaacgtgggaaaagtgggctcgttgccctaaatctcgatttggcccaagtttctgaattcgtaaaggcacgccttggcaaagaggttgaaatgggaggatgcaaagggcccataaccacattcattgtcgaaccatttgttccacataatgacgagttttatatcaacattgtttcagagcgattagggtgtagcattagtttttcagaatgtggtggaattgacatcgaagagaattgggataaggtcaagacaatctttttaccaactggggtgtctttgaatcaagagatatgcgctccacttgttgcaacccttccattagagatcaaatctgtaattgaggagttcatcaaatctatatactctctatttacagatcttgatttcacttttctagaaatgaaccctttcacccttgttgatggaaagccttatcctcttgatatgagaggagagcttgatgacactgctgcattcaagaacttcaaaaagtggggcaacattgagtttccattgccttttggaagagttatgagtgctacagaaagctttattcatggactagatgaaaagactagtgcatctttgaagttcacggttcttaatccaaagggaagaatttggaccatggttgctggtggaggtgccagtgtcatatatgcagatacggttggagatctcggttatgcttctgagcttggaaactatgcagaatacagcggtgcaccaaacgaagaggaggttttgcagtatgctcgagttgtaattgattgtgcgactgctgatccggatggtcaaaagcgggctttggtggtaggtggcggaattgctaacttcaccgatgttgcagccacatttaatggcatcattcgtgcaatgaaagaaaaggagtctaagttgaaagccgcaaacatgcacatctatgtaaggagaggaggtccaaattaccaaagaggccttgcaaggatgcgtgcacttggagaggaaattggcatcccaattgaggtgtatgggcctgaggcaacaatgaccggaatatgcaaacaagcgattgactgcatcactgcggctgcgtaaacttggttaatgtttatgtgttgatgtccacctggtctatgtttcattgaattcatatgtaacatgtaacttaagtgttgtgttttttttgtttttgtttttgtttttgttttggtgtgtctttctt

SEQ ID NO: 3152 - DNA, 1528 bp, Aquilegia formosa
agacttgttaatctatcgctctaactaactgactaactactcgtcttcttctttacagagaggtaagaaatggcaagaaagaagattagagagtatgattccaagagattgttgaaagaaaattttaagagaatttctggtggttctgaattacctattaaatcagctcaggtcacagagtctactgattttaacgaggtagcaaacaaagaatcatggctttcatcgggaaaactggttgtgaaacctgatatgttgtttgggaagcgtggaaagagcggtctagttgccttaaatttagatcttgctgaagttgccacctttgtcaaagaacgtcttggaaaggaggtagagatgggaggttgtaagggacctatcactacgttcattgtggaacccttcattccacatacagaagagttttatctcaacattgtttccgagagaattgggtgcagcttgagcttttcagaatgtgggggtattgacattgaagagaactgggataaggttaaaactgtatttatccctacaggatcatctcttacatcagaaatatgtgcaccactgtttgcaacacttcctttggagatcaatgatacgatcaaggaatttgttaaagtggtttacgctatatttttggatcttgactttaccttccttgagatgaatcctttcactttggttgatggaaagccttatcccctggacatgagaggagagctggacgacactgctgcatttaaaaattttaagaagtggagtggtgtagagtttccattgccatttggcagagttatgagtcctacagaaagctttattcatgggctagatgaaaagactagtgcatctctgaaattcacagttctgaacccgaaagggcgaatttggactatggtcgcaggaggaggtgcaagtgttatctatgcagatacggtcggagatcttggatatgcttctgagttggggaactatgcagaatatagtggagcaccaaacgaagaggaagtattgcagtatgccagagtagtccttgattgtgcaacagcagatcctgatggtcgtaagagagcccttgtaattggaggaggaatagctaacttcaccgatgttgctgctacttttagtggcattattcgagcattgagagagaaggagtcaaagctcaaagcggcgaggatgcacatctatgtaagaagaggaggtccaaattatcaaaggggtcttgcaaaaatgcgggatctcggagaggaaattggcattccccttgaggtttatggtcctgaagcaacaatgacaggcatatgcaaacaagcaatcgagtgcataactgcagcagcatgaaagtttcaagattagacaatctgtctcatttccagtttcattctattttttggttctatagtatctatcgttgttgcatttttcatgtagttggtgacttttggcacttattattgtattagtttctgtaagctactgatagtttttggtgtagtaaagttcagagcttgttcattattgcgtt

SEQ ID NO: 3153 - DNA, 1510 bp, Cichorium intybus
taaattatcaaaagaaactcacaactttcaactataaattagttggtcttctcagtgaagatcgtgaatatttgctccgcatctaatcgctcacagccttcgaacaatctcacaacttgaggaagaacagggttttcaagggaagataatggcacgcaagaagatccgagagtacgattccaagaggctggtgaaggagcattataagaggatttctggctccgaattggctattaaatctgcacaggttacagaatcaaccgacttgaacgagctaatagaaagagaaccatggctctcatcatccaaattggtcgtaaaacccgacatgctgttcgggaaacgtgggaaaagtgggctcgttgccctaaatctcgatttggcccaagtttctgaattcgtaaaggcacgccttggcaaagaggttgaaatgggaggatgcaaagggcccataaccacattcattgtcgaaccatttgttccacataatgacgagttttatatcaacattgtttcagagcgattagggtgtagcattagtttttcagaatgtggtggaattgacatcgaagagaattgggataaggtcaagacaatctttttaccaactggggtgtctttgaatcaagagatatgcgctccacttgttgcaacccttccattagagatcaaatctgtaattgaggagttcatcaaatctatatactctctatttacagatcttgatttcacttttctagaaatgaaccctttcacccttgttgatggaaagccttatcctcttgatatgagaggagagcttgatgacactgctgcattcaagaacttcaaaaagtggggaaacattgagtttccattgccttttggaagagttatgagtgctaccgaaagctttattcatggactcgatgaaaagaccagtgcatctttgaagttcacggttcttaatccaaagggaagaatttggaccatggttgctggtggaggtgccagtgtcatatatgcagatacggttggagatctcggttatgcttctgagcttggaaactatgcagaatacagcggtgcaccaaacgaagaggaggttttgcagtatgctcgagttgtaattgattgtgcgactgctgatccggatggtcaaaagcgggctttggtggtaggtggcggaattgctaacttcaccgatgttgcagccacatttaatggcatcattcgtgcaatgaaagaaaaggagtctaagttgaaagccgcaaacatgcacatctatgtaaggagaggaggtccaaattaccaaagaggccttgcaaggatgcgtgcacttggagaggaaattggcatcccaattgaggtgtatgggcctgaggcaacaatgaccggaatatgcaaacaagcgattgactgcatcactgcggctgcgtaaacttggttaatgtttatgtgttgatgtccacctggtctatgtttcattgaattcatatgtaacatgtaacttaagtgttgtgtttttttg

SEQ ID NO: 3154 - DNA, 1572 bp, Cichorium intybus
atttgctccgcatcttatcgctcacagccttcgaacaatctcacaacttgaggaagaacagggttttcaagggaagataatggcacgcaagaagatccgagagtacgattccaagaggctggtgaaggagcattataagaggatttctggctccgaattggctattaaatctgcacaggttacagaatcaaccgacttgaacgagctaatagaaagagaaccatggctctcatcatccaaattggtcgtaaaacccgacatgctgttcgggaaacgtgggaaaagtgggctcgttgccctaaatctcgatttggcccaagtttctgaattcgtaaaggcacgccttggcaaagaggttgaaatgggaggatgcaaagggcccataaccacattcattgtcgaaccatttgttccacacaatgacgagttttatatcaacattgtttcagagcgattagggtgtagcattagtttttcagaatgtggtggaattgacatcgaagagaattgggataaggtcaagacaatctttttaccaactggggtgtctttgaatcaagagatatgcgctccacttgttgcaacccttccattagagatcaaatctgtaattgaggagttcatcaaatctatatactctctatttacagatcttgacttcacttttctagaaatgaaccctttcacccttgttgatggaaagccttatcctcttgatatgagaggagagcttgatgacactgctgcattcaagaacttcaaaaagtggggaaacattgagtttccattgccttttggaagagttatgagtgctaccgaaagctttattcatggactagatgaaaagaccagtgcatctttgaagttcacggttcttaatccaaagggaagaatttggaccatggttgctggtggaggtgccagtgtcatatatgcagatacggttggagatctcggttatgcttctgagcttggaaactatgcagaatacagcggtgcaccaaacgaagaggaggttttgcagtatgctcgagttgtaattgattgtgcgactgctgatccagatggtcaaaagcgggctttggtggtaggtggcggaattgctaacttcaccgatgttgcagccacatttaatggcatcattcgtgcaatgaaagaaaaggagtctaagttgaaagccgcaaacatgcacatctatgtaaggagaggaggtccaaattaccaaagaggccttgcaaggatgcgtgcactcggagaggaaattggcatcccaattgaggtgtatgggcctgaggcgacaatgaccggaatatgcaaacaagcgattgactgcatcactgcggctgcgtaaacttggttaatgtttatgtgttcatgtccacctggtctatgtttcgttgaattcatatgtaacatgtaacttaagtgttgtgtttttttggtgcctttcttttgaacaacattgtagaaaattgaagaaaaagaaataatcaagcggctcgtttaattttaaagacataatatatgtttaaaagattcattgatttgttgaaatatgctaaaacaatcctc

SEQ ID NO: 3155 - DNA, 1528 bp, Fagopyrum esculentum
aacggcgtccgtttacttcaatctatcccgatctcgtcgtcttcccaagcactgtcaatagtcatctcttcttctctcaaagaggtcacgatatggcacgtaagaagatcagagagtacgattccaagaggttgttgaaggagcatttcaagaggctcgctggttatgagctagctatcagatctgcacagatcaacagttccaccgacttgaatgaggtagttgagaaagagccttggctttcatcagagaagttggttgttaagcctgatatgctgtttgggaaacgtgggaagagtggtttggttgcattgaatctggattttgcccaggttgcatcgtttgtcaaagagcgtcttggcaaagaggtggagatgggtggatgcaaaggacctataaccacatttattgttgaaccttttgttccacacaatgaagagttctacctgaacattgtttcagagagacttggatgcaccgtaagcttttcagaatgtggtggaattgacattgaagagaactgggacaaggtcaagactattttcgttcctactggggcgactctcacatccgaagtttgtgctcctcttgtcgcaaccttacccttggaggttaagggtgtaatcgatgagttcctgaaagtaattttctccctatttcaagatttggacttcactttcctagagatgaatcctttcacactagtgaatggaaaaccttatcctttagacatgagaggcgagctagatgacacagcggcattcaagaacttcaagaagtggggagatattgagttcccactgccatttggaagaattatgagccctacagaaagtttcatccacggtttggatgagaagacaagtgcatccttgaagttcaccgtcttgaatccaaagggaagaatttggactatggttgctggaggtggagcaagtgtgatatatgctgacaccgttggggatcttggttttgccaatgagctcggaaactatgctgaatacagtggtgcacctaacgaagatgaagttttgcagtatgccagagttgttattgattgtgcaaccgctaatcctgatgggcggaaaagagcccttgtaattggaggaggaattgccaacttcactgatgttgctgctacattcaacgggattatccgagcactgagggaaaaggaatccaagctgaaagctgcaaggatgcatctgtatgtgaggagaggaggtccaaactaccagaagggccttgccaaaatgcgagctctagcagacgagattggcatccctattgaggtttatggaccagaggctacaatgactagcatttgcaaacaggcaattgactgcatcacctcatctgcttaagttcaagccaatgtcgttgattgaggttcagcgacaatgcctagttgttttttggttaaaatttaatttcagtagtaaaacttggaagtattttgtgtttatctacattgtcatcttgattgtattctatggacatgattacaatctacattgccttgcaactt

SEQ ID NO: 3156 - DNA, 1610 bp, Rosa hybrid cultivar
aggtgagaaatggcacgcaagaagatccgagagtacgactccaagaggttgttgaaggaacacttcaagaggatcgctggccgtgaattgcctctcaaatctgcccagattaccgaatcaactgatttcaatgagctacttgagaaggagacttggctctctacttccaagttggttgtcaagcctgacatgttgtttggaaagcgtgggaagagtggtttggttgccttgaacctggatttcgcccaagtcgtcacctttgtgaaggagcgcctaggcaaagaggttgagatgggtggctgcaaaggacccatcacaacattcattgtcgagcccttcattccccacaatgaagagttttacattaacatcgtctcagatagacttgggaatagcataagcttctcagagtgtggaggaattgacattgaggagaactgggataaggtcaagaccatatttgtcccaacgggagcttcccttacaccagatgtatctgctccacttgttgcaacccttcccttggagattaagagcgaaattgaggagtttatcaagtccgtatttgctctatttcaagatctcgacttcacttttctggagatgaatccttttgcattggttgatggaaagccatatcctttggatatgagaggcgagctggatgacactgctgctttcaagaacttcaaaaagtggggcaatattgaatttccaatgccatttggaagagttatgagtcctacagaaaagtttattcacgggctagatgaaaagacaagtgcatctttgaaatttacagttctgaaccctaagggacgaatttggactatggttgctggaggaggtgcaagtgttatttacgcagacacggttggtgatcttggctttgctaatgagctcggaaactatgctgaatatagtggagcaccaaatgaagaggaggtattgcagtatgccagagttgtgattgattgtgcaacttctgatcctgatggccgtaagagagcccttgtaattggagggggaattgctaacttcactgatgtagctgcaacattcaatggcatcattagagccttgaaggagaaggaatcaaagcttaaagctgctaggatgcatctttatgtcaggagaggaggtcccaactaccagaggggacttgcaaaaatgagggcacttgcagaggaaattggcctccctattgaggtctatggtcctgaagcaacaatgactggtatttgcaagcaggcaattcagtgcatcagtgctgctgcatgataatattgtctgaagattgctgctctctcttcttgtctatctcattttttttttttctgcggcaagtgtcagctccataccttgtaccaatttcttttgttaagctctttgtaccaatttcattctatcaaaaacctcagcaaagttgatgtagttgtatgtgccaatgagtaatatgatagtgggatggtactgtgtgaccttattaccataataaaaagtttaaattggtattcaaaaaaaaaaaaaaaaaaaaaaaaaacaaaaaaaaaaaacaaaaaaaaaacaaaaaacacgacatatctctctctctccgcgcgcgcgcgagc

SEQ ID NO: 3157 - DNA, 1433 bp, Silene vulgaris
agaacacaatcttttaacggtgtagaaagaatttggaagtgaaaaaatggcaaggaagaagattagagagtatgattcaaagaggttgttgaaggaacatttcaagaggatttctgggtctgaattacccattagatctgctcaaatcacagagtcaaccgacttgaataagcttgttgagagagaagcatggctctcatcagaaaagctggttgtgaaacctgatatgttgtttggaaagcgtggaaagagcggtctcgttgctctgaatctggacttcgcccaggttactacttttgtgaaagagcgtctaggcaaagaagtcgagatgggtggatgtaaaggacctataacaactttcattgtggagccctttatcccacacaatgaagagttctacctaaatatcgtttccgaaagacttgggaacagcataagcttttccgaatgtggtggaatcgaaatcgaagagaactgggataaggttaagactgttttcgttcctactggcgtctctttttcttcggatgtttgtgctcctctggtcggcactttacctttggaggtcaaaagtgtgattgaggaatttatcaaagttatctttgccttatttctagatttggactttagcttcctagaaatgaatcctttcacattagtcgaagggaagccttatcctttggacatgagaggagaattggatgataccgctgccttcaagaacttcaagaagtggggcaatattgaattcccattgccatttggacgagttatgagccctacagagagcttcatccacggtcttgatgagaagactagtgcatccctgaaattcactgttctgaacccaaaagggaggatttggactatggtagctggagggggagcaagtgttatctacgcagatacggttggggatctgggatatgcgtctgagcttggaaactatgccgagtacagtggagcacctaatgaagaagaggtgttgcagtatgcccgagttgtgattgattgtgcaactgcaaaccctgatgggcgtacaagagctcttgtaattggtggaggaattgctaattttactgatgttgctgctactttcaatggaataatcagagctctgaaggagaaggaagcaaagcttaaagctgcaaggatgcatatatatgtgaggagaggaggtccaaattaccagaagggtttagctaaaatgcgtttacttggcgaggaaattggaatccctattgaggtatatggacctgaggcaaccatgactggaatatgcaaacaggcgatagaatgtatcagcgtctctgcatagttaattccgactttctttgatggatgtaccagttcttagattgtgttaggtatagctttgtcttctgctttgtttagtaattgaagcctatttgagaataaaaacaaacatgatc

SEQ ID NO: 3158 - DNA, 1727 bp, Glycine max
tgcgtatgtgtttttgcctaattcaattcctctttcaatctccctctaaaacttcaccaacccaacaaccacatcattttcttttctccaaacaaattaaaattaaaataatcaaagccttcatctataaatatagccatcacacactctccccattcgttccactcgttctttagatctatccactcacctgcctcttcctcacccctttctccatctaacgagtaaggaaaaatggcgcgtaagaagatcagagagtatgactcaaagaggttgttgaaggagcactttaagagactttctggcaaggagttgccgatcaagtctgcacaaattactgcatcaactgatttcactgagctacaagagaaggaaccctggctttcatcttctaaattggttgtgaaacctgacatgttatttggaaagcgtggcaaaagtggtttggttgccttaaatttggattttgcacaagttgtttcgtttgtgaaggagcgtcttggaaaagaggttgagatgagtggatgcaaaggacccataacaactttcattgtcgaacctttcatcccacacaatgaagagttttaccttaacattgtctccgagagacttgggaacagcataagcttttcagaatgtggaggaattgaaattgaagacaactgggataaggttaagactgcatttgttccaacaggagtgtctcttacgtcagaaattgttgccccacttgttgcaacccttcccttggagatcaagggagaaattgaggagtttctcaaagtggttttcactctgtttcaagacctggattttactttcttagagatgaatcctttcacattggttgatggaaagccttatcctttggatatgagaggcgagctagatgacactgctgctttcaagaacttcaagaaatggggagacattgaatttccactgccatttggaagggttatgagtgccaccgagtctttcattcatggattagatgaaaagacaagtgcatccttaaaattcacagtgttgaacccaaagggccgaatttggacaatggtagctgggggaggtgctagtgtcatttatgctgatacggtaggagatcttggctttgcatctgagcttggaaactatgctgaatacagtggtgcacccaaagaagaggaggtcttgcagtacgccagagttgtaattgattgtgcaactgcaaaccctgatgaccagaagagagctcttgtgataggaggaggcatagccaactttactgatgttgctgccacatttagtggtataattcgggcattgaaggagaaggagtcaaaattgaaagcagcaaggatgcacatctttgtgaggagagggggtcccaactaccagaagggtctagctttgatgcgagcgcttggagaggatattggcatccccattgaggtttatggacctgaagccacaatgactggtatatgcaaagaggcaatacagttcattactgctgccgcttaaggtcaacaacaccttcatttatagtattttcatggcaagtctgaagtgaacgtttgattcttaatttccttgcccattcctgaaattcggaaatatagttagagaatgtttatgaaatcaatccatacaagaaagagtggccaggcttgtcatattgtttttgtagaattctgatggtgttgtcttgacacaataaagagtgtttttcatttgactgttgc

SEQ ID NO: 3159 - DNA, 1661 bp, Fagopyrum esculentum
actataaattaagctaaccacgcaaccacacaacaaattgcgagctctcacttgactcttccttcggccgccttcttcttcttctctctcacaactcaccagctacaggaaatggcacgcaagaagatcagagaatacgattctaagaggctgttgaaggagcacttttaagaggctttctggatatgaactgcctattagatccgcacagatcacagaatccactgacttgaatgagttagttgagaaggagccatggctttcttcagagaagttggttgtgaaacctgatatgttgtttggtaagcgtggaaagagtggtttggttgctttgaatctggatttcacccaagtttctgcttttgtcaaagaacgtcttgggaaagaggtggagatgagtggatgcaaaggacctatcaccacatttattgttgaaccctttgttccacacaatgaggaattttacctcaatattgtttcagatagacttggatgcagcataagcttttcagaatgcggagggattgacattgaagagaattgggacaaggttaagaccatttttattcctactggagcatctttcacatcagaagtttctgctcctcttgttgctaccttacctttggaggttaagcccgtcattgatgagtttctcagagtaattttctccctatttcaagatttggacttcaccttcctagagatgaaccctttcacattagtgaatggcaagccttatcctctagatatgagaggcgagttggatgacacagctgccttcaagaattttaagaagtggggaaatattgaattcccattgccatttggaagagtaatgagtgtcacagagagttccattcacagtctggatgagaagacaagtgcttccctgaagttcacagtgttgaacccggaaggacgaatttggaccatggtggccggtggaggagcaagtgtcatttatgctgacacagttggggatcttggttttgcttctgagctaggtaactatgctgaatacagcggtgcacccaacgaagatgaggttctgcagtatgctcgagttgtgattgactgtgcaaccgctaaccctgatgggcgcaagagggcccttgtaataggaggaggaattgccaacttcacagacgttgccgctacattcaacggaatcatccgagcactgaaggaaaaggaatcaaagcttaaagctgcgagaatgaacttatacgtgaggagaggaggaccaaactaccagaaaggattggccaaaatgagagctctggccgaggagatcggcattcctattgaggtttacggcccggagaaaaccatgactggcatatgcaagcaggcaattgactgcatcagtgtggctgcttagtgttgcaatggaatcaggaaagagttacatataatgtcagaggccttcattaataatcttgtctgtaccaatgaaacgttatttatcgtctcaatttgtcctaataacatcggccttgcttcatcttgacgttgttggggctcaactatgacccttagcttggatttgttcgtttaagagaacttgaatcaggcccatatctaagggtgttaaaaaatcgttcaaatttaaataaatttatgctacgccatatccataaagaaaaaaacgaaaacaa

SEQ ID NO: 3160 - DNA, 1573 bp, Gnetum gnemon
agtaaatttgcaggattcacggtaaaacatcgaacacacgttctgcccacgtggtatttctgggttctggtctattaaagtgaccccaacgtgcattgataccgacgctgggtctcgcctaccttcccacttgcgtccaggatccacattccggactgcattacattttcggactgaatatttctttgcattcggactgaatcgttggatccggagcaaagaaaatggcacggaagaagatcagagagtatgactctaagcgcctcctcaaggaacatctgagaaggcttgctggtattcagctggatatcaaatccgcccaggttactcagtcgaccgatttcaatgaattagtagacaaagagccatggctgtcatcgaccaaactagttgtgaagcccgatatgttgtttggcaagagaggaaaaagtggtttggtggcgttgaatctagactttgttgaagtggttgcatttatcaaggaacgccttggaaaagaggttgagatgggaggcgcaaaagcaccgataacaacatttattattgagccttttgtgcctcacaatgatgaatattatttatcaatcatgtcagagcgccttggctcaaccataaatttttcagaatgtggaggcatggaaattgaagagaactgggacaaggttaaaactttgtttgttccaactgacaagcaattgacatccgagttatgtgcacctttgatcgcaactcttcctagggagattcgaagcaagattgagaaatttattctggaagtcttcagtgtgtttcaggatctggacttcactttcctagaaatgaatcctttcacatttcttaatggggaaccttatcctcttgatatgcgtggagaactggacgacaccgcagcattcaaaaacttcaaaaaatggggtggcattgaattcccaatgccttttggtagagtcatgagtcctgcagaaagtgcagttcatagcatggatgagaaaacaagtgcttctttaaagttaaccattctaaaccccaaggacggatctggacaatggttgctggaggaggtgcaagtgtgatatatgcagatactgttggagatttaggctgtgcaaaagaacttggtaactatgctgaatatagtggagctcctaatgaggaagaggtgctgcaatatgcaagagtgttgatagattgtgccactgcttctcctgatggtcagaagagagcattagtgataggaggaggcattgccaattttacagatgttgccgccacatttagtggtatcattcgagctttgcgtgaaaaggaagcaaaactcaaagctgcccgaatgcaagtatatgttagaagaggaggtccaaactatgagaaaggtctggagaaaatgcgtgcacttggtcaggaaataggagttcccttccaggtatttggcccagaagctagcatgacagccatttgcaaggaagctatcaattacataactgcggctgcttagtgcttagttttcctctagttcaccatctatagttcattgttaacaatttgcctcaaaaaggaggattttggttatttt

SEQ ID NO: 3161 - DNA, 1157 bp, Avena sativa
cgaaccaccactgccacagcttccacctactcttcccccatcctccgtcttcagagtccagaagcttcggcgaggccatggcgcggaagaagatccgggagtacgactccaagcgcctcctcaaggagcacctcaagcgcctcgctggcatcgacctccagatcctctccgcgcaggtcacacaatcaacggatttcacggagctttcaaaccaggagccatggctctcgtcgatgaagttggttgttaaacctgacatgctgtttggcaagcgtgggaagagcggccttgtggccctcaacctagatcttgctcaagtccgccaatttgtcaaggagcgattaggagttgaggtcgagatgggtggatgtaaggctccaattacaacattcatagtcgagccatttgtgccacacgatcaagagtattatctctcaattatgtcagacaggcttggttgcaccattagtttctcagagtgtggtggtattgagattgaggagaactgggacaaggttaagacaatctttcttccaacagagaagccaatgacacttgatgcatgcgctccattgattgccactcttcccttggaagtccgcacgaaaataggcgatttcattagagggtcattttctgttttccaagacttggatttctcatttatggagatgaacccattcaccctggtaaatggtgaaccataccctctcgacatgagaggtgaactggatgacacagctgctttcaagaactttaagaagtggggtgacattgaattccctctacctttcggaagagtcctgagcccatcagaaagttatatccatgaactggatgagaagacaagcgcatcactgaaattcacagttcttaacccgaaaggtcgcatttggacaatggttgcaggtggtggtgctagtgtcatatatgccgacacggttggagatttgggatatgcttcagagctagggaattatgcagagtacagtggagctcccaaagaggaggaggttttgcattatgctagagtggttttggattgtgccactgctgatcctgatggccggaagagagctcttctcattggagggggtatcgcaaacttcactgatgtcgctgctacattcagtggcatcattcgggctttaagagag

SEQ ID NO: 3162 - DNA, 1329 bp, Flaveria ramosissima
ttgcattgtgtctttcaaccaacaacaccatctatcaccaggtttcaacttttaaaggaacataatggcacgtaagaagatccgagagtttgattcgaagaggttgttgaaggagcatttcaagaggatttcgggttctgaaatgcccatcaaatctgcacaggttacagattcgaccgactttaatgtgctggcgaaaagggaaccatggttatcttcatccaaactggttgtgaaaccggatatgttgtttggaaagcgtggcaagagtggacttgttgccttaaatcttgatttggctcaagttgctgagtttgtgaaggagcgacttggcaaagaggttgtgatgggaggatgcaaaggacccataaccacattcattgttgaaccatttattccacacaacgaagagttttatatcaacattgtttctgagcggttagggtgtagcattagcttttcagaatgtggaggaattgatatcgaagagaattgggacaaggttaagacaatctttttacccacaggggtttcattgaatcaagagttgtgtgctccactggttgccaccctcccgttggagttcaaatctgtaattgaggagttcatcacacacatatattccctattccttgatcttgacttcactttcttggaaatgaatccattcactctggtcaacggaaagccttatcctcttgatatgagaggcgagcttgatgacactgctgctttcaaaaatttcaaaaagtggggcaatattgaattcccaatgccatttggaagagttatgagttctactgaaagctttatccatgaacttgatgaaaagactagtgcatctttgaagttcacagttcttaacccaaaaggacggatttggaccatggttgctggtggtggtgctagtgtcatctatgccgatacagttggagacttaggctatgcttctgagcttggaaattacgcagaatacagtggtgcacccaatgaagaagaagttctgcaatatgctcgagttgttattgattgtgccacttctgacccagatggtcaaaagagggcgcttgtagttggtggtggaattgccaattttactgatgtggcagccactttcaatggcatcattcgtgcgatgaaggagaaggaatcacagttgaaagctgcaaacatgcacatttatgtgcgacgaggaggtccaaattaccaaagagggcttgcaaggatgcgcgcacttggagctgaaatcggcatccctattgaggtatatgggccagaggcaacaatgactgggatatgcaaacaagcaattgaatgcatcatggttgc

SEQ ID NO: 3163 - DNA, 1578 bp, Chrysanthemum coronarium
ttcttgatcacacaacacaactaccaaaccaaacacccacccaagtgtgtagaagaaaaatggcacgtaagaagattagagagtatgattctaagagattggtgaaggagcattttaaaagaatttctggttctgatttgcctatcaaatctgctcaggttacagagtcaacagacttcaatgagcttgtagagagggaaccatggctatcttcatctaagctggttgtgaaacccgacatgttgtttgggaagcgtggtaagagtggacttgtcgcattgaatcttgatttggctcaagttgctgaatttgttaaggagcgacttggcaaagaggttgagatgggaggatgcaaaggacccataaccacatttattgttgagccatttgttccacatagtgaagagttttacatcaacattgtttctgaacggttagggtgcagcattagcttttcagaatgtggaggaatcgacattgaagagaactgggacaaggtgaagacaatctttctggccacaggagtgtcgttgagtcgagagatatgtgctccacttgttgccacactaccgttagagtttaaaaccgtgattgaggacttcatcaaacacacatattccctatttgtagatcttgacttcactttcctagagatgaatccattcaccctagtagaaggaaagccatatcctcttgatatgagaggcgagcttgatgacactgctgcttttaaaaacttcaaaaagtggggtaatcttgagttcccaatgcctttcggtagagttatgagttctactgaaagctttatccatggactcgatgaaaagactagtgcatctttgaagttcacggttcttaatcctaaaggaagaatctggaccatggttgctggtggtggtgcaagtgtcatctatgcagatacagttggagatcttggttatgcttctgagcttggaaattatgcagaatacagtggtgcacccaatgaagatgaagtcctgcaatatgctcgagttgtcattgattgtgcaactgctgatcctgatggtcaaaggagggcacttgttgtcggaggtggaattgccaacttcaccgatgttgcagccaccttcaatggcatcatccgtgcaatgaaggagaaggaatccaagttgaaagctgcaaacatgcacatctatgtgcgacgtggaggtccaaattaccaaagagggcttgcaagaatgcgtgcacttggagctgaacttggcattcctattgaggtatacgggcctgaggcaacaatgacgggaatatgcaaacaagcaatcgagtgcatcacagttgctgcttagatttggtggatctcttttagcttatgttccctcaatgttttacagtttttttctaaaaactaaaagctaataagaatgttctgacagcaacctgtttgtatatgtatttgcgagtttgatgtacttgttcgtctcatggttctttagatttacatacctagggagatcgtgtgtgaaaagaaaaggatattaaacgatgttgtgtttttgcctgacgtatgtgcaggattatattttagcgattttt

SEQ ID NO: 3164 - DNA, 1608 bp, Cichorium intybus
ctcgatcttgagtagtgcatcgattatagcctttaaaatcacaatcctctaacctgaaatcttgagtagtgtaaacccgagttgagatctgtggtggttttcttgtatcaatagtggggaagaacagggttttcaaggaagataatggcacgcaagaagatcaaagagtacgattccaagaggctggtgaaggagcattataagaggatttctggctccgaattggctattaaatctgcacaggttacagaatcaaccgacttgaacgagctaatagaaagagaaccatggctctcatcatccaaattggtcgtaaaacccgacatgctgttcgggaaacgtgggaaaagtgggctcgttgccctaaatctcgatttggcccaagtttctgaattcgtaaaggcacgccttggcaaagaggttgaaatgggaggatgcaaagggcccataaccacattcattgtcgaaccatttgttccacataatgacgagttttatatcaacattgtttcagagcgattagggtgtagcattagtttttcagaatgtggtggaattgacatcgaagagaattgggataaggtcaagacaatctttttaccaactggggtgtctttgaatcaagagatatgcgctccacttgttgcaacccttccattagagatcaaatctgtaattgaggagttcatcaaatctatatactctctatttacagatcttgatttcacttttctagaaatgaaccctttcacccttgttgatggaaagccttatcctcttgatatgagaggagagcttgatgacactgctgcattcaagaacttcaaaaagtggggaaacattgagtttccattgccttttggaagagttatgagtgctaccgaaagctttattcatggactcgatgaaaagaccagtgcatctttgaagttcacggttcttaatccaaagggaagaatttggaccatggttgctggtggaggtgccagtgtcatatatgcagatacggttggagatctcggttatgcttctgagcttggaaactatgcagaatacagcggtgcaccaaacgaagaggaggttttgcagtatgctcgagttgtaattgattgtgcgactgctgatccggatggtcaaaagcgggctttggtggtaggtggcggaattgctaacttcaccgatgttgcagccacatttaatggcatcattcgtgcaatgaaagaaaaggagtctaagttgaaagccgcaaacatgcacatctatgtaaggagaggaggtccaaattaccaaagaggccttgcaaggatgcgtgcacttggagaggaaattggcatcccaattgaggtgtatgggcctgaggcaacaatgaccggaatatgcaaacaagcgattgactgcatcactgcggctgcgtaaacttggttaatgtttatgtgttgatgtccacctggtctatgtttcattgaattcatatgtaacatgtaacttaagtgttgtgtttttttgtttttgtttttgtttttgttttggtgtgtctttcttttgaacaacattgtagaaaattgaaaaaaaaagaaataatcaagcggctcgtttaattttaaagac

SEQ ID NO: 3165 - DNA, 1493 bp, Petroselinum crispum
cttacctatatctctgtgatcgcctaacgttataagagagaaatggcgcgaaagaagatcagagagtatgattcgaagagattgttgaaggagcattataagaggattactggtgctgagcttggaattaaatctgctcaaattacagaatcaactaatatcaatgagctcgtagaaaaggaaccttggctttcctcctccaagttagttgtcaaacctgatatgttatttggaaagcgtggaaaaagtgggcttgttgcattgaatttagatttgtctcaagttgatgcctttgtgaaagagcgccttgggaaagaggtcgagatgggaggatgcaaaggacccatcacaacatttattgttgaaccatttgttccacacaatgaagaattttatctgaatatggtctcagatcgactaggttgtagcataagcttctcagagtgtggtggaattgatattgaagagaactgggataaggttaaaactatatctgtcccgacaggcgtgtccatgacacctgatatttgtgctccactggttgcaactcttcccttggagatcaaaagtgtgatcgaggagttcatcaaagtgatatttattctatttgcagatttggacttcactttcctagaaatgaatcctttcactttggttgatgggaagccttatcctctagacatgagaggagagcttgatgacactgctgctttcaagaacttcaagaagtggggggatattgaattcccattgcccttcggaagagttatgagttctaccgagagctttattcacgggctagatgaaaagacaagtgcctctctgaagttcactgttctcaatccgaaaggacgaatttggactatggttgctgggggaggtgccagtgtcatctatgcagatacggtcggagatcttggttttgctgaagagcttggaaactatgcagaatacagtggagcaccaaacgaagaggaggttttgcaatatgctcgagttgtgattgattgcgcaactgcagatcctgatggccgtaagagagcccttgtagttggcggtggaatagccaactttactgatgttgctgctacattcaatggcatcattcgtgcactaaaggagaaggaatcaaagcttaaagctgccagaatgcacatatatgtgaggagaggaggtccaaactaccaaaaaggtcttgcaaaaatgaggtcccttggagaagaaattggcatcccaattgaggtatatggaccagaagaaacaatgactggaatatgcaaacaggcaatagagtgcattagtgcagctgcatgaatgtcacaaatattgtaccagtctttatatgagctctctttttcgttttaatctgtgtgtgtttaattcagtgttagcgacattctgtaaccatgtgggatttgatatgcaaaattccagttgaataataatgagccagttcattatcttcccttattatcgtattggtatcgaactgt

SEQ ID NO: 3166 - DNA, 1483 bp, Capsicum annuum
attttctactaccattctttattgagttttccaatttggccattatttaatagatctattgataaagaaaaatggcacgcgagaagatcagagagtacgattcaaagagattgttgaaggaacattttaagagactcgcaggttatgatttggccattaagtctgcacaggtgacagagtctactgatatcaatgagctagcagagaaagagccttggctccactcaacaaagttggttgtaaagcccgacatgttatttgggaagcgtggaaagagcgggctagtcgccttgaatcttgatcttgctcaagttgctacttttgtgaaggagcggcttggcaaagaggtggagatgggtggatgcgaaggtcccatcacgaccttcattattgagccatttattccccataatgaagagttctatcttaatattgtttcggagaggcttggttgcagcgtaagcttttctgaatgtggaggaattgacatcgaagaaaactgggacaaggttaagactatctttgtgccgacagggacttcttttacatcagtgatatgtgctccacttgttgccactctaccttcggagattaagggtgtcattgaggagttccttaaagtaatttacgctctatttcaagatttggacttcactttcctagagatgaatcctttcacattggttgaaggcaagccttatcctctggatatgaggggagagcttgataacactgctgctttcaagaacttcaaaaagtggggcaatattgaattcccattgccatttggaagggttatgagtgctacagagagctttattcacgggcttgatgaaaagacaagtgcatctttgaagttcacagtcttgaatcccaagggacgaatttggactatggttgctggtggaggagctagcgtcatctatgcagatactgtaggtgatcttggatatgcttctgagcttgggaactatgcagagtacagtggtgctcccaatgaagaagaggtcttgcagtatgctagagttgtaattgattgcaccactgcaaatcccgatggtcgaaagagagctcttgtgattggtggtggaatagccaacttcactgacgttgctgctacatttagcggtattattcgagctcttaaggagaaggaatcaaaacttaaagctgcaagagtgcacatttatgttagaagaggaggtccaaactaccaaaaaggtcttgcaaaaatgaggtctcttggcgaggaaattggcatcccaattgaggtttatggacctgaggaaaccatgactggcatctgcaaacaagctattgagtgcatcactgcagctgcataaatggaccaaccttcgtgccatttttctctctctctttttttttttttttaatttttatttttttgcaatgtgttagtgtcttgttgtatgccaagtatgagcaatttgatttgtatctttgatattttatataaatggac

SEQ ID NO: 3167 - DNA, 1398 bp, Ambrosia trifida
aactctttagtatcggttacgttgtatctttcaccaggttttaaaggaaagaaatggcacgcaagaagatcagagagtatgattcgaagagattggtgaaggagcatttcaagaggatttctggttctgaattgcccattaaatctgcacaaattacagagtcaactgactttaatgagctggtacaaagggaaccatggctatcttcatccaaactggttgtgaaacctgacatgttgtttggcaagcgcggaaagagtggacttgttgcgttaaatcttgatttggctcaagttgccgaatttgtcaaggagcggcttggcaaagaggtggtgatggatggatgcaaaggacccataactacattcattgttgaaccatttgttccacacaacgaagagttttatatcaacattgtatctgagcggttggggtgtagcattagtttttcagaatgtggaggaattgatatcgaagagaactgggacaaggttaagacaatatttttacccacaggggtagtgttgaatcaagagatatgtgctccacttattgccacgctcccgttggagtacaaatctgtaatcgaggggttcattacaaacatatattccctattcatagatctcgacttcactttcttggagatgaatccattcactctggtcgacggaaagccttatcctcttgatatgagaggcgagcttgatgacactgctgctttcaagaacttcaaaaagtggggcaatatcgaattcccaatgccattcggaagagttatgagccctactgaaagctttatccatgggcttgatgaaaagactagtgcatctttgaagttcacggttcttaaccctaaagggcgcatttggactatggttgccggtggtggtgctagtgtcatctatgcagatacagttggagatttaggttatgcttctgagcttggaaattatgcagaatacagcggtgcacccaatgaagaagaggttctgcagtatgctcgtgttgtcatcgactgtgcaactgctgatccggatggccaaaggagggcgctcgtagttggtggtggaatcgccaattttactgatgttgcagccactttcaatggcatcattcgtgcgatgaaggaaaaggagtcgaagttgaaagccgcaaacatgcacatttacgtgcgacgaggaggtccaaattaccaaagagggcttgcaagaatgcgtgcactcggggctgaaatcggcatccctatagaggtatatgggccagaggcaacaatgacaggaatatgcaaacaagcaattgaatgcatcatggttggtgcatagatttggtgcatgttgttggatttatgtttaatcgtaatgttaaagtttcaaatgagaggttgataagaatgtt

SEQ ID NO: 3168 - DNA, 1778 bp, Vigna unguiculata
ctctgttctttctccaaaagcttatctcatatatatgccatgaagccaccaacatcacactaacactaaacttaccacccttcattggatctatcattcttcaactttcttctccactgattccattctctctctaaagggggggaattttgtttttggtggtgagtttgttaagcaatggcccgcaagaagataagagagtatgactccaagaggttgttgaaggagcactttaaaagactctctggccaggacttgcccatcaagtctgcacaagttacagaatccactgatttcaatgaactacctgagaaggaaccatggcttttatcttcaaaattggttgtgaaaccggacatgctattcggaaagcgtggcaaaagtggtttggttgccttgaatttggatttggcagaagttgcttcttttgtgaaagagcgtcttggcaaagaggttgagatgagtggatgcaaagggcccataacaactttcattgttgaaccttttatccctcacaaggaggagttttaccttaacattgtctcagagagactagggaacagtataagcttttctgaatgtggaggaattgaaattgaggagaactgggataaggtcaagactgtatttatgccaacaggactgtctcttacatctgagagtattgctccacttgttgcaacccttcccttagagatcaggggagaagttgaggaattcctcaaggtgatttacactttattccaagacctggatttcactttcttggagatgaatcctttcactttggtcaatggaaagccttatcctctggacatgagaggggagcttgatgacactgctgctttcaagaacttcaagaaatggggaaacatcgaatttccattgccatttggaagggtaatgagcagtacagaggctttcattcatggattggatgaaaagacaagtgcatctttaaaattcacagtattaaacccgaagggccgaatttggacaatggtagctgggggaggtgctagtgtcatctatgctgatacggtaggtgatcttggttatgctcccgagctaggaaactatgcagaatatagtggtgcacccaaggaagatgaggtcctgcagtatgccagggttgtgattgattgtgcaacttcaaatcctgatgaccaaaagcgagcccttgtgataggtggaggaatagctaactttactgatgttgctgctacattcagcggcataatccgtgctctgaaggaaaaggaacaaaagctaaaagaagcaaaaatgcatatctatgtgaggaggggaggtcccaactaccaaagtggtttagcaaaaatgagggctcttggagaggagattggcattcccattgaggtttatggacctgaagcaacaatgactggtatatgcaaacaggcaattcagtacatcactgctgctgcttaattatccattcttaggacggtgtgaacttcttttacaagtattgtcatggatgattcgaagagattgttaattcttggttctctgtccaactctcagaagttattacttttgtgagttagagtgcaggctgttataaattagtcatccaataaagtggtgaagaatgttttgtatcttccagaattctgatagtacattagtgacattataaaatggtacaagtgtaattgttttatgttaagtcaaactacaatttcatggttcactcatttactttcattaactgaattggttttctttccatttatgtggacttaaatttctgcttg

SEQ ID NO: 3169 - DNA, 1717 bp, Flaveria ramosissima
atccactataaactcaacaagatgcaccaatgcaccattggcaattgtatccttcttcccgcccggcataaaaacaaaatacgaaataaaaaataaataatattcaactataaatctgcagctattcactgtgtacacctgctctgcatccaatctccaacagccttcaaccaaactcacacacaacttgttttcgaggagcgataatggcacggaagaagatcagagagtatgattcaaagaggttggtgaaggagcatttcaagaggatttctggtacggaattggctattaaatcagcgcaggtcacagaaacaacagacttgaatgagctaataaaagaggaaccttggctttcttcatccaaattggttgtgaaacctgatatgttgttcggtaaacgtgggaaaagtggactcgttgctctaaatttggatttggctcaagtttctgaatttgtgaaggcaaggcttggcaaagaggttgagatgggaggatgcaaaggacccataaccacattcattgttgaaccatttgttccacacaatgaagagttttatattaacattgtttctgagagattaggatgcagcattagcttttcagaatgtggaggaattgatattgaagagaactgggacaaggtcaagacgatctttttgccaactggaatgtctttgaatcaagagatatgcgctccacttgttgctacccttccattggagatcaaacccgtaattgaggagttcatcaaagctatatattctttgttcttagatcttgacttcactttcttggaaatgaatccttttaccctggttgatggaaagccctatcctcttgatatgagaggagagcttgatgacactgcagctttcaagaactttaaaaagtggggcaaccttgagttcccattgccttttggaagagttatgagtgctaccgaaagctttattcatggactagatgaaaagactagtgcatctttgaagtttacagttcttaatccaaagggacgaatttggaccatggttgctggtggaggtgctagtgtcatatatgctgatacagttggagatcttggttatgcatccgagcttggaaactatgccgaatacagtggtgcgccaaatgaagaggaggttttgcagtatgctcgagttgtcattgattgtgcaactgctgatccagatggtcaaaagcgcgctcttgttgtaggaggtggaattgccaacttcactgatgttgcagccacattcaatggcatcattcgcgccatgaaagagaaggagtctaagttgaaagctgctaatatgcacatctatgtaaggagaggaggtccaaattaccaaaaagggctagctaagatgcgcgcactcggggaggaaatcggcatcccaattgaggtgtatgggcccgaggcaacaatgaccggtatatgcaaacaagcgatcgactacatcaccgccgctgcctaaactttggctaacgtttgtgttttgcaattgtttatgctttgttgcatttaattggaagtgtcatgtcttgtttgtttttgcatcttttgaaaattcgtagaaaactaaagaaaaaggactagatttctgctcggttgatttcaaaggcatgggtatgtgtttggtagactcattatctgttgaaaatttatgtttttgttcgtatagctataatacacaacaactaggtctttgggtag

SEQ ID NO: 3170 - DNA, 1488 bp, Orobanche aegyptiaca
caagaaagaagattagagagtatgattccaagagattgttgaaagagcatttcaagaggatttctggttctgaattggaaatcaaatctgcccaagtaaccgagtctactgatttcaatgagctagtagaaaaagaagcatggctttcgtcgacaaaactggttgtgaaaccagatatgttattcggaaagcgagggaaaagtggtcttgttgcattgaacctcgacttggctggtgttgctgctttcgtcaaagaccgacttggcaaagaggttgaaatgggagggtgcaaaggacctattacaaccttcatcgttgaaccatttgttccgcacactgaagaatattacctgaacattgtctccgagaggcttggttgtagtattagcttttcagagtgtggaggaattgagattgaagaaaactgggacaaggtgaagactgtctttgtgccaacaggtgtgtcttttacatcagacctatgtgctccacttttggcaaccctgcccttggagattaagggtgttattgaggagttcatcaaagtaatctatgctttatttttagatttggacttcacttttcttgagatgaatcctttcacgttggtcggtggaaagccttatcctttggatatgagaggcgagcttgacgatactgctacctttaaaaacttcaaaaaatggggaaatattgaatttccaatgccatttggaagggtaatgagtccaaccgaaagcttcattcacggacttgatgagaagacaagtgcatctctgaaattcacagtcttgaaccctaaaggacgaatttggactatggtcgctggaggaggtgcaagtgtcatctatgcagatactgttggggatcttggctatgcttctgagctaggaaactatgcagaatacagtggcgctcccagtgaggaggaggttttgcagtatgccagagttgttattgattgtgcaactgcagagcctgatggccggaagagagcccttgtagtaggtggtggcattgctaacttcactgatgttgctgctacatttagtggcatcattagagctctcaaagaaaaggaggcgaagcttaaggctgcaagaatgcatttgtatgttagaagaggaggtcctaattaccaaaagggtcttgcaagaatgagaaatcttgctgcagaaatcggcattcccattgaggtgtatggacctgaggcaactatgactgggatatgcaaacaggctattgagtgtattagtgcagctgcatgaagtttccaatgctggttcacttaaaaaaaataaaaattgtacctgcttttcacttttcttagagcataagttgtaattatactcaacattgtcatggatttcatattgtatttttgtaacattggacgtaaatgagtctcaataatcgcatttttactcttgcaaagctactgttcaagttctcaatgtcaaaattctttactttgtccgtttttcttct

SEQ ID NO: 3171 - DNA, 1442 bp, Phalaenopsis aphrodite
ccttatttttcccctaattacggcatagaagaaaatggcgaggaagaagatccgggaatacgattcaaagcgactcttgaagcagcatctccggcgactctgcggcatcgagcttcacattagatccgctcagataacggaatccaccgaaatcaatgaattggtggagagggaaccgtggcttttgtcagagaagttggtggtgaagccggacatgttgtttgggaagcgcggcaagagtgggctggtggggcttaatcttgatctgaatcaagtcgcttcattcgttaaggatcgtcttgggaaggaggtggagattgggggatgcaaaggcccggtaaccactttcattgtagagccttttgtaccgcactcccaagaattttatctctccatcgtttctgatcgtcttggctgcaatattagcttctcagaatgtggtgggattgaaatcgaagagaattgggacaaggttcggactgttttcattccatgtgagacatcattgacttcagacaactgtgcttctttgatagcaaccctgccgctggagctaaagggaaagattgaagagtttatcaaagctgtcttcattttgttcttagacttggactttacctttctcgagatgaatccttttacattggctaatggaaatccttatccgttggatatgaggggagagctggatgacactgctgcttttaagaactttaagaagtggggtgatattgaattcccaatgccttttggtagggtgatgagtgctacagagacttttatccatggcctggatgagaagacgagcgcatctttgaaattcacagtcttgaaccctcgggggaggatatggacaatggtagctggaggaggtgctagtgtcatttatgctgacacggttggtgatttgggctatgcttctgagcttggaaattatgcagaatacagtggagctccgaaggaggatgaagttttgcaatatgctcgagttgtcattgattgcgcaacttcaaatcctgatggccgcaagagggctcttctgattggaggaggaatagccaactttacagatgttgctgctacattcaatggaattattagagctttaagagagaaggaagccaagctgaaagctgctagaatgcatgtttatgtgagaagaggaggcccaaattatcaggctggtctagcaaaaatgcgaaaacttggggaggaagttggcatccctcttgaagtatatggacctgaggcgactatgactggtatctgcaaacaggcaatcgaatgcatttctgctgctgcataagctccaaaagcacaataattaactcaattatcttcctatgctttagcatatatatatatatatatatatatatatatatatatatatatagtagagagatattagtacagaagaagtagatatagtacttcgttcg

SEQ ID NO: 3172 - DNA, 1781 bp, Populus trichocarpa
aggcagaatattcaagtcttcctctctgcctaccacattcctattttaaagaaaagaaaatggcacgcaagaagatcagagagtacgactccaagagattgttgagggagcatttcaagaggttttctggtcgtgatttgcccatcaaatctgctcaagtaacggaatcgactgatttcaatgagctagcagagaaggaaccctggttggcatcggcaaaactggttgtcaaacctgacatgctgtttgggaaacgtgggaagagtggccttgttgctttggatctggatctggatcaagttgctgagtttatccaagggcgtcttggcaaagaggttgaaatgggtggatgcaaaggacctataacaacattcatcattgagccctttatcccccacaaccaagagttctatctaaacattgtctcggagagacttgggtgcagcatcagcttttcggaatgcggagggattgaaattgaagagaactgggataaggtcaagactatatttgttccaacaagagcaacgtttacgtcgggagattgtgctctacttgttgccacccttccttcagcgataaaaggagaaattgaggagttcattcaagtagtttttgctctttttcaagatcttgacttcactttcctggagatgaaccctttcacttttgttgatggaaagccgtatccgttggatatgagaggcgagctggacgacactgcagcttttaaaaacttcaaaaaatggggtagcattgaatttccaatgccatttggaagagttatgagcccttcagaaagctttgttcatggcctagatgaaaagacaagtgcttctttgaaattcacggtattgaatccaaaggggcgaatttggactatggtggctggaggaggtgcaagtgtcatctatgctgatacggtaggagatcttggctatgctaccgagcttgggaactatgcagagtatagtggagctcccaatgaagaggaggtcttgcggtatgccagagttgtaattgattgtgcgactgctgatcctgatggccataagagagcccttgtaattggtggaggaattgcaaactttactgatgttgctgctacatttaatggcataattcgaaccctgaaggagaaggaatcgaagctgaaagcagcaaggatgagcatatatgtgaggagaggaggtcctaattaccagacgggccttgcaaaaatgagggcacttggagaggagattggaatcccaattgaggtttacgggccggaggcaaccatgactggcatatgcaaacaggcaatcgaatgcatcaccgcagctgcataagtcatcaactctaggaatcaatctgtattttgcctgcagtttcttacaccaagtttcgagtttgcctcatatcatagcaccattttctttctactagaaatcccattatagaaaggtagctataatagaccaggtaaagcttaccaaaatgaaaatgtaatctctgacgttggttctgattccataataaagagctgcttatttctgtgtttgctatcgatcctctgttgttgcgggagcgttgttgaataagctgttgatcaagggctgcctcattcattaattttccgtgaagactgttagaatttgtttatgagaatctgccttattttaagaagatagagataagtgcagaaaagtgtttgaatcagtcttcaatgttattgttttcataacagattctgccacaagatttgctgtaaattctattatttgaagtacaataatctc

SEQ ID NO: 3173 - DNA, 1231 bp, Brassica napus
cgatcttatcttctctaaaacttgtcaccttttctgctaaacacttgctttgaggttgaaactcgatggcgaggaagaagatcagagagtacgactcgaagagacttctcaaggaacacttgaaacgtctcgctaacatcaacctccaaatccgctctgctcaggtgacagaagctacggatttcactgagttgaccaaccaggaggcatggctctcttccacgaagctagttgtgaagcctgatatgctgtttggaaaacgcgggaaaagtggtttggtagctctgaagctggatcttgctgaagttgcagagtttgtcaaagcccgcctcggttctgaggttgagatgggtggatgtaaagctcctatcactacattcattgtggagccctttgtgcctcatgatcaagagtactatctttctatagtgtctgataggcttggctgtactataagcttctctgaatgtggtggcattgaaattgaagagaactgggacaaggtgaagactgtgtttcttccagcggaaaaatcaatgacgcttgaagtatgtgctcctttgatagcaacacttcctcttgaggttagaggtaaaataggcagcttcataatgggcgtgtttgctgtatttcaagatttggatttcagtttcatggagatgaatccgtttacgctagtcgatggagagccatatcctttggacatgaggggagagttagatgacacagctgccttcaaaaatttcaacaagtggggagacattgagttccctctgccatttggaagggtcctgagtccaacagagagcttcatccatggtttagatgaaaagacaagtgcgtctttgaagttcactgttttgaatcctaaaggtcgcatttggactatggtagctggaggcggtgctagcgtcatatatgctgatacggttggagatttaggttacgcatcagagctggggaactacgcagagtatagtggtgcacctaatgaggaagaagtgttacaatacgctagagttgtcattgattgtgctactgctgatcctgatgggcgcaaaagagctcttctcattggaggtggcattgctaatttcaccgacgtggcagctactttcaacggtatcatccgcgctctaagagaaaaggaacaagactaaaagcatcaagaatgcacatatacgtaagagaggtgtcaaattaccagactggtcaggctagaatgcgtgct

SEQ ID NO: 3174 - DNA, 1663 bp, Trifolium pratense
acctcataattccctcttcttgttttttttcttcttcaccaaacaaaaaaaaaaccccgaaactttcaactataaattgagccatcacacaaaccacatcgttcgttcatctcttcgttggatccaactacccatttcactttcctcatcatccttccgaacaaatggcgcgcaagaagatcagagagtatgattccaagagattgttgaaggaacactttaagagactttctggcaaggacttaccgatcaagtctgctcaagttacagaggtcactgatttcaccgagttgcaagacaaggaaccttggctttcttcttctaaattggttgtgaaacctgacatgttatttgggaagcgtggtaaaagtggtttggttgctttgaatttggatttggcacaggttgcttcatttgtgaaagagcgtcttggtaaagaggttgaaatgggtggatgcaagggaccgataacaacttttattgttgaacctttcatcccacataatgaagagttttaccttaacattgtctctgacagacttgggaacagcgtaagcttttcagaatgtggaggaatcgatattgaagagaactgggataaggttaagactgtatttgttccaacaggagtatctcttacttcagaaattgttgctccacttgttgcaacccttcccttggagatcaaaggagaaatcgaggaatttctcaaggtgattttcactctgtttcaagacctggatttcactttcttggagatgaatcctttcacattggttgatggaaagccttatccattggatatgagaggcgagctagacgacactgctgctttcaagaacttcaagaaacgttgtcgtactggttgcaggtggggtaacattgaatttccactgccatttggaagggttatgagtgccaccgagtctttcattcatggactagatgaaaagacaagtgcatctctaaaattcactgtattgaacccaaagggccgaatttggacaatggttgctgggggaggtgctagtgtcatctacgctgacacagtaggagatcttggctttgcaaatgagcttggaaactatgcagaatatagtggtgcacccaatgaagaggaggttttgcagtacgccagagttgtaattgattgtgcaactgcagatcctgatggccgaaaaagggctcttgttataggaggaggcatagctaactttaccgatgttgctgctacttttagtggcataatccgggcactaaaggagaaggaatcaaagttaaaggcagcaagaatgcacatttacgtgaggagaggcggtccgaactaccaaaagggtctagagaaaatgcgagcacttggagacgaaattggtatcccgattgaggtttatggacctgaagcaacaatgactggtatatgcaaagaggcaatacagtgcattactgcttccgcttaaatatccatccaggtcaatgcttctttagcgtccgtgtcatttgcaagtttgaagtgaacattgatttgtaatttcctttctcattctcggaatttgtaaatttagttacaccgtccaaaagagtggttcggaatgttgtctcagtttttttcttatagaattttatggtactgtcttgatacaataaagaggttttttcttttaaa

SEQ ID NO: 3175 - DNA, 1404 bp, Chrysanthemum coronarium
ccgatctcaacaatacaaccaaacaccttacctaacagaaggaagaaaaatggcacgtaagaagatcagagagtatgattcaaagaggttggtcaaggagcattttcagaggatttctggctctgatttgcctatcaaatctgctcaggttacagagtcaacagactttactgagctggtagagagggaaccatggctatcttcatccaagctggttgtgaaacccgacatgttgtttgggaagcgtggtaagagtggacttgttgcattgaatcttgatttggctcaagttgcagaatttgtaaaggaccggcttggcaaagaggttgagatgggaggatgcaaaggacccataaccacattcattgttgagccatttgttccacacaatgaagagttttacatcaacattgtttctgaacggttagggtgcagcattagcttttcagaatgtggagggatcgacattgaagagaactgggacaaggtgaagacaatctttctgcccacaggagtgtcgttgagtcaagagatatgtgctccagttgtcgccacactcccgttggagtgcaaacccgtaatcgaagacttcatcaaacacacatattccctatttgtagatcttgacttcactttcctagaaatgaatccattcaccctagtagaaggaaagccatatcctcttgatatgagaggcgagcttgatgacactgctgctttcaagaatttcaaaaagtggggtaatatagagttcccaatgccctttggtagagttatgagttctactgaaagctttatccatggactcgatgaaaagactagtgcatctttgaagttcacggttcttaaccctaaaggaagaatctggaccatggttgccggtggtggtgcaagtgtcatctatgcagatacagttggagatcttggctatgcttccgagctcggaaactatgcagaatacagtggtgcacccaatgaagatgaagtcctgcaatatgctcgagttgtcattgattgtgcaactgctgatcctgatggtcaaaggagggcacttgttgtcggaggtggaattgccaacttcaccgatgttgcagccaccttcaatggcatcatccgtgcaatgaaggagaaggaatccaagttgaaagctgcgaacatgcacatctatgtgcgacgtggaggtccaaattaccaaagagggcttgcaagaatgcgtgcacttggagctgaacttggcattcctattgaggtatacggacctgaggcaacaatgacgggaatatgcaaacaagcaatcgagtgcatcaccgttgctgcttagatttggtggatctcttttaccttatgttccctcataatgttacattcattttttcaaattaaatgctaataagaatgttctgg

SEQ ID NO: 3176 - DNA, 1587 bp, Cirsium arvense
aatatctcatcgactcctccgcatccaaatctctcccaaccaccaccttcagcgatctcacaccagtgcgatttgaagtagcgataatggcacggaagaagatcagagagtatgattcgaagaggttggtgaaggagcattataagaggatttctggttccgaattggctattagatctgctcaggttacagaatctaccgacttgaatgagctaatagagaaggaaccttggctctcctcatccaaattggttgtaaaaccagatatgttgtttgggaagcgtgggaagagtggcttagttgctctgaatctcgatttggcccaagtttctgaattcgtaaaagcacgtcttggcaaagaggttgagatgggaggatgcaaaggacccataaccacattcatcgttgaaccatttgttccacataacgatgaattttatatcaacattgtttccgagcgattagggtgtagcattagtttttcagaatgtggaggaattgacattgaagagaattgggacaaggtcaagacaatatttttaccaactggggtgtctttgaaccaagagatatgtgctccacttgttgcgacccttccattggagatcaaacccgtaattgaggagttcatcacaaacatatattccctatttattgatcttgacttcactttcctagaaatgaaccctttcaccctggttgatggaaagccttatcctcttgatatgagaggagagcttgatgacactgctgcctttaaaaacttcaagaagtggggcaacattgagttcccattgcctttcggaagagtaatgagtgccaccgaaagctttattcatggactagacgaaaagactagtgcatctttgaagtttacggttcttaatccaaagggacgaatttggaccatggttgccggtggaggtgccagtgtcatatatgctgatacggttggagatcttggttttgcttccgagcttggaaactatgcagaatacagcggtgcacctaatgaagaggaggttttgcagtatgctcgagttgtcattgattgcgcaaccgctgatccagatggtcaaaagagagcccttgtcgtaggaggtggaattgctaacttcactgatgttgcagccacattcaacggcatcattcgtgccatgaaggagaaggagtccaagttgaaagccgcgaacatgcacatctatgtaaggagaggaggtccaaattaccaaaaaggacttgcaaggatgcgtgcgcttggagatgaaataggcatcccgattgaggtgtacgggccggaggcaaccatgaccggaatatgcaaacaagcgatcgagtgcattactgctgctgcttaaattcagccaaccttcgtgtctgcccgcattcagaagaattgttgtcgtttgtatttctgtattgtattgttcattcgcatgacattgtagaaaaccaaagaaaagggaatgattgtggactgcttaaaaaagattcttcattatggtaccaaagacatggctacaagcgaaataacttactctaataacgacttctgatcactctaataatgtctgtgagcgaaaccag

SEQ ID NO: 3177 - DNA, 1538 bp, Gossypium hirsutum
agagaaaaacaaaaaaacactcccgaaatggcacgcaagaagatcagagagtacgattccaagagattgttgaaagaacatttcaagaggctttccggtagagatttgccaatcaaatctgcacaaattacggaatcaactgatttcaatcagctagtagagaaggagccatggctttcgtcacagaaactggttgttaaacctgatatgttgttcggtaagcgtgggaagagtggtttggttggcttaaatctggattttgctcaagttattgctttcgtgaaagagcgccttggcaaagaggtggaaatgagtggatgcaagggacctgttacaactttcattgttgaacctttcatccctcacaatgaagagttctaccttaacattgtctctgaacgacttggttgcagcattagcttttcagagtgtggagggattgaaattgaagagaactgggataaggtcaagaccatatttgtcccaaccgggttgcttttgacatcagaaacttgtgctccacttgttgcaacccttcccttggagatcaaaggagaaatcgaggagttcatcaaagtgatctttaatctgtttcaagatctcgatttcactttcctcgagatgaaccctttcacgctggttgacggaaagccttatcctttagacatgagaggcgagctggatgacactgctgctttcaagaacttcaagaagtggggtaatatcgaattcccaatgccttttggaagagttatgagtgcaaccgaaagctatattcacgggctagacgagaagaccagtgcatcgttgaaatttacggtgttgaaccctaagggacgcatttggacaatggtagctggaggaggtgcaagtgtcatctacgctgatacggttggagatcttggttttgcttctgagctcggaaattatgcagaatacagtggagcacccaacgaagaggaagtattgcagtatgccagagtagttattgattgtgcaaccgcagaccctgatggtcgcaaaagagccctcgtaattggcggaggaatagccaactttactgatgtcggtgctacatttaacggcattatccgagccttgaaggagaaggaatcaaagctcaaagccgctcggatgatgctatacgtgaggagaggaggtccaaattaccagaggggcctcgcgaaaatgcgggcacttggagaggaaatcggaatccctatcgaggtttatggtcccgaagctacgatgaccggtatttgccagcaagctatccaatacatcagtgcagctgcctaagttgtcggttcgggttcatgttcggtctctgttttttttttcctccgtttcaagtgggtcattttcattagatttcccttttgccatgttactgaaacatttggaatttatttgctgaaaagtgaacatgaaatcttaggcataaatggcatttgtcagcaataaagatcttaaaaattttctacatcttttgtctccccatctttattttcttaatgacactaataaaccttgtcttt

SEQ ID NO: 3178 - DNA, 1563 bp, Gossypium raimondii
gcttctagtttagacaaccttccggttcgcctgtcattcaacgagagaaaaacaaaaaaaaacactcccgaaatggcacgcaagaagatcagagagtacgattccaagagattgttgaaagaacatttcaagaggctttccggtagagatttgccaatcaaatctgcacaaattacggaatcaactgatttcaatcagctagtagagaaggagccatggctttcgtcacagaaactggttgttaaacctgatatgttgttcggtaagcgtgggaagagtggtttggttggcttaaatctggattttgctcaagttattgctttcgtgaaagagcgccttggcaaagaggtggaaatgagtggatgcaagggacctgttacaactttcattgttgaacctttcatccctcacaatgaagagttctaccttaacattgtctctgaacgacttggttgcagcattagcttttcagagtgtggagggattgaaattgaagagaactgggataaggtcaagaccatatttgtcccaaccgggttgcttttgacatcagaaacttgtgctccacttgttgcaacccttcccttggagatcaaaggagaaatcgaggagttcatcaaagtgatctttaatctgtttcaagatctcgatttcactttcctcgagatgaaccctttcacgctggttgacggaaagccttatcctttagacatgagaggcgagctggatgacactgctgctttcaagaacttcaagaagtggggtaatatcgaattcccaatgccttttggaagagttatgagtgcaaccgaaagctatattcacgggctagacgagaagaccagtgcatcgttgaaatttacggtgttgaaccctaagggacgcatttggacaatggtagctggaggaggtgcaagtgtcatctacgctgatacggttggagatcttggttttgcttctgagctcggaaattatgcagaatacagtggagcacccaacgaagaggaagtattgcagtatgccagagtagttattgattgtgcaaccgcagaccctgatggtcgcaaaagagccctcgtaattggcggaggaatagccaactttactgatgtcggtgctacatttaacggcattatccgagccttgaaggagaaggaatcaaagctcaaagccgctcggatgatgctatacgtgaggagaggaggtccaaattaccagaggggcctcgcgaaaatgcgggcacttggagaggaaatcggaatccctatcgaggtttatggtcccgaagctacgatgaccggtatttgccagcaagctatccaatacatcagtgcagctgcctaagttgtcggttcgggttcatgttcggtctctgttttttttttctccgtttcaagtgggtcattttcattagatttcccttttgccatgttactgaaacatttggaatttatttgctgaaaagtgaacatgaaatcttaggcataaatggcatttgtcagcaataaagatcttaaaaattttctacatcttttgtctccccatctttattttcttaatgac

SEQ ID NO: 3179 - DNA, 1674 bp, Lactuca sativa
aaaaaacaaaacagtaaagtaattaattgaaaaaaatcacaactttgcaactataaattagttggtgttcttagtgaatatatttgctctgcatctaatctctcacagccatcgaacgatctcacaactgggtttttaaggaacgataatggcacgcaagaagatcagagagtatgattccaaaaggctggtgaaggagcattttaagaggatttctggttccgaattggctattaaatctgcacaggttacagaatcaaccgacttgaatgagctaatcgagagggaaccttggctatcctcatccaaattggttgtgaagcccgatatgttgtttgggaaacgtgggaaaagtggactcgttgctctaaatcttgatttagcccaagtttctgaatttgtaaaagcacgacttggcaaagaggttgagatgggaggatgcaaaggtcccataaccacattcatcgttgaaccttttattccacacaatgatgagttttatatcaacattgtttctgagcgattagggtgtagcattagtttttcagaatgtggaggaattgacattgaagagaattgggacaaggtcaagacaatctttttaccaactgggatatctttgaatcaagagatatgcgctccacttgttgcaactcttccattggagatcaaacctgtaattgaggactttatcaaatccatatacactctatttatagatcttgacttcactttcctagaaatgaaccctttcaccttggttgatggaaaaccttatcctcttgatatgagaggagagcttgatgacactgctgctttcaagaacttcaaaaagtggggcaacattgagttcccattgccttttggaagagttatgagtgccacagaaagctttattcatggactagatgaaaagactagtgcatctttgaagtttacagttcttaatccaaagggaagaatttggaccatggttgcaggtggaggggccagtgtcatatatgccgatacagttggagatcttggttatgcttccgagcttggaaattatgcagaatacagtggtgcaccaaacgaagaggaggttttgcagtatgctagagttgtcattgattgtgcaactgctgatccggatgggcaaaagagagctcttgtagtaggaggtggaattgctaacttcacagatgttgcagccacattcaatggcatcattcgtgcaatgaaagaaaaggagtctaagttgaaagctgcaaacatgcatatctatgtaaggagaggaggtccaaattaccaaagaggacttgcacggatgcgtgcactcggagaagaaattggcatcccaattgaggtgtatggtcctgaggcaacaatgaccggaatatgcaaacaagcaattgactgcattactgcagctgcataaactttgttgtgttttgttgaattcaaatgtagcatgtaactcaagtgttttgttgtgttatgttttgtttttgtatgggtgtgtctttgttttttttttttaaaccacattgtagaaaattgaagaaaaaagaaataatcttgcggctcgtttgatatatttatacgtgtatctgatgatttggtaaaacggaatagcagaagtgtacctgattattaagtaaaatctctaaaaatatcctaaaataatatttg

SEQ ID NO: 3180 - DNA, 1831 bp, Glycine max
caacaacgtactaacacaattcacacccaccattggatccaccaatctccaaccttcttctccactgttccgtttctctctccaacggagagtcttttgttttttgtggcgagtttgttgcacgtttaagaagcaatggcacgcaagaagatcagagagtatgactccaagaggttgttgaaggagcactttaagagaatctctggccaggagttgcccatcaagtctgcacaggttacagaatccaccaatttcagtgagctagcagagaaggaaccctggcttttatcttcaaaattggttgtgaaaccagacatgttatttggaaagcgtggcaaaagtggtttggttgccttgaatctggatttggcagaagttgattcttttgtgaaagagcgtcttggcaaagaggttgagatgggtggatgcaaaggacctataacaactttcattgttgaaccttttatccctcacaatgaggagttttaccttaacattgtctcagagagactagggaacagtataagcttttctgaatgtggagggattgaaattgaggagaattgggataaggtcaagactgtatttatgccaacaggagtgtctcttacatcagagagtattgccccacttgttgcaacacttcccttagagatcaagggagaaattgaggaatttctcaaggtgattttcactctatttcaagacctggattttactttcttggagatgaatcctttcactttggtcaatggaaagccttatcctctggacatgagaggcgaacttgatgacactgctgctttcaagaacttcaagaaatggggaaacattgaatttccattgccatttggaagggttatgagtactacagaggctttcattcatggattagatgaaaagacaagtgcatctttgaaattcacagtattaaacccaatgggccgaatttggacaatggttgctgggggaggtgctagtgttatctatgctgatacggtaggagatcttggttatgctcctgagcttggaaactatgcagaatatagtggtgcacccaaggaagatgaggtcttgcagtatgccagagtagtgattgattgtgcaacttcaaatcctgatggccaaaagcgagcccttgtggtaggtggaggaatagctaactttactgatgttgctgctacattcagcggcataattcgtgctctgaaggagaaggaacaaaagctaaaagaagcaaagatgcacatctatgtgaggagaggaggtcccaactaccagaagggtctagcaaaaatgagggcactcggagaggaaattggcattcctattgaggtttatggacctgaggcaacaatgactggtatatgcaaacaggcaatccaatacatcactgctgctgcttaattatccattcttaggccaatgccttctattacaagtattttcatggctagtttgaagtgattgttgattcttggttccctttccaactctcagaattggtaactttggtgagttagagcataggctgttacaagtagtcatttagtcatcaaataaagtggtcaagagtgttttgtatcgtgtagaattctgatattacagtcttggcacaataaactggaatgtgtaattgttttatgctatgtcaagctggaattttaaggctctcggctttactttcagcaagtaaattgattttctttccactttatgggaacttaaatttctgtttaaaagggtctttcaataaacttgtttatgtactccctccgtttcataatatttgttgtgtaaaaagaaaaaaataaatctaattgttatttta

SEQ ID NO: 3181 - DNA, 1647 bp, Helianthus annuus
aactcacaactaactagggtttttaacgtaacaataatggcacgcaagaagatcagagagtatgattcaaagaggctggtgaaggagcatttcaaacggatttctggttctgatttggctattaaatcagcacagattactgaatctacagacttgaatgagctagtaaatgtggaaccgtggctttcttcatcaaaattggttgtgaaacctgatatgctgttcggtaaacgtgggaaaagtgggcttgttgctttaaatcttgatttggcccaagtttctgagtttgtgaaggcacgtcttggtaaagaggttgagatgggaggatgcaaaggacccataaccacattcattgttgaaccatttgttccacacaatgaagagttttatatcaacattgtttccgagcgattaggatgtagcattagcttttcagaatgtggaggtattgacattgaagagaattgggaaaaggtcaagaccatctttttgccaactggggtgtcgttgaatcaagagatatgcgctccacttgttgctacacttccattggagattaaacctgtaatcgaggagttcatcaaagctatatattctttattcatagatcttgacttcactttcttagaaatgaatccttttactctagttgatggaaagccttatcctcttgacatgagaggagaacttgatgacactgctgccttcaagaactttaaaaagtggggcaaccttgagttcccattgcctttcggaagagttatgagtgctaccgaaagctttattcatggactagatgaaaagactagtgcatctttgaagtttacggttcttaatccaaagggacgaatttggaccatggttgctggtggaggtgctagtgtcatatatgctgatacagttggagatcttggttatgcatccgagctcggaaactatgccgaatacagcggggcaccaaacgaagaagaggttttgcagtatgctcgagttgtcattgactgtgcaactgctgatccagatggtcaaaagcgagctcttgtagtaggaggtggaattgcaaacttcaccgatgttgcagccacattcaatggcatcattcgtgccatgaaagagaaggaggctaagttgaaagctgctaacatgcacatctacgtaagaagaggaggtccaaattaccaaaaaggactagcgaagatgcgggcactaggagaggaaattggcatcccaattgaggtgtacggacccgaagcaacaatgaccggaatatgcaaacaggcgattgaatacatcaccgctgctgcctaaacgttaccgggcttttgtgtttctctggtttgttgcatttaaatggaagtgttgtgtcatgtttgtttttgtggcaatgtgttgttcttttgaaaatttgtagaaaacttaagcaaagggacaaattgcgggtcagttgattttaaagacacgggtatatgtgtagaagactcgtaagttgttgaaaattatggttttgttagaactgttataaatccataagcctattattaataaacaatttaaaagcttgcttcttcgcaattacgccaaaattcaagctcaaataccccagaatcaaaaatcgaaactaaaccatgaaaaacgaacaagccagac

SEQ ID NO: 3182 - DNA, 1575 bp, Chrysanthemum coronarium
acacacaaaaacactcacacacccaccaatctcccaactgattaacgaatggcgagaaagaagatcagagagtatgattcgaagcgattggtgaaggagcattataaaaggattagtggcaatgatttagtcattaaatctgctcaggttacagaatcaaccgacttgaatgaactgatagagagggaaccttggctatcttcgtcgaagttggttgtgaagcccgatatgttatttgggaagcgtggaaagagcgggcttgttgctctaaaccttgatttggcccaagttgctgagtttgttaaggcacgacttggcaaagaggttgagatgggaggatgcaaaggacccataaccacatttattgttgagccatttgttccacatagtgaagagttttatatcaacattgtttctgagcggttagggtgtagcattagcttttctgaatgtggaggaatcgacattgaagagaactgggacaaggtgaagacaatctttctggccacaggagtgtcgttgagtcgagagatatgtgctccacttgttgccacactaccattagagtttaaaaccgtgattgaggacttcatcaaacacacatattccctatttgtagatcttgacttcactttcctagagatgaatccattcaccctagtagaaggaaagccatatcctcttgatatgagaggcgagcttgatgacactgctgcttttaaaaacttcaaaaagtggggtaatcttgagttcccaatgcctttcggtagagttatgagttctactgaaagctttatccatggactcgatgaaaagactagtgcatctttgaagttcacggttcttaatcctaaaggaagaatctggaccatggttgctggtggtggtgcaagtgtcatctatgcagatacagttggagatcttggttatgcttctgagcttggaaattatgcagaatacagtggtgcacccaatgaagatgaagtcctgcaatatgctcgagttgtcattgattgtgcaactgctgatcctgatggtcaaaggagggcacttgttgtcggaggtggaattgccaacttcaccgatgttgcagccaccttcaatggcatcatccgtgcaatgaaggagaaggaatccaagttgaaagctgcgaacatgcacatctatgtgcgacgtggaggtccaaattaccaaagagggcttgcaagaatgcgtgcacttggagctgaacttggcattcctattgaggtatacgggcctgaggcaacaatgacgggaatatgcaaacaagcaatcgagtgcatcacagttgctgcttagatttggtggatctcttttagcttatgttccctcaatgttttacagtttttttctaaaaactaaaagctaataagaatgttctgacagcaacctgtttgtatatgtatttgcgagtttgatgtacttgttcgtctcatggttctttagatttacatacctagggagatcgtgtgtgaaaagaaaaggatattaaacgatgttgtgtttttgcctgacgtatgtgcaggattatattttagcgatttttgttaaaaa

SEQ ID NO: 3183 - DNA, 1697 bp, Trifolium pratense
atcatagattcatcaccaacaacaacacactttcccattcactattcgatctacctatccttcaccttcttctccattgatccattttctctctctaacgggaagaatttgtgttgaagatttaagaagatttaatggcacgtaagaagattagagagtatgattctaagaggttgttgaaggaacattttaagagaatctctggacaagagttgccaattaagtctgcacaaattatagaatcaaccgatatcaatgagctagtagagaaggaaccatggctttcatcttcaaaattggttgtgaaacctgacatgctatttggaaaacgtggaaaaagcggtttggttgccttgaatctggatttggctgaagttgctggttttgtgaaagagcgtcttggaaaagaggttgagatgggtggatgcaaaggacctataacaactttcattgttgaacctttcatcccacataatgaagagtattaccttaacattgtctcagagagactaggaaacagtattagcttttctgaatgtggaggaattgatattgaagagaactgggataaggttaagactgtatttattccaacaggggaatctcttacatcagacaatatatcagcacttattgcaaccctccccttagaggtcaagggagaaattgaggaatttctcaaggtgattttcaatatatttcaagatctggatttcacattcttagagatgaatcctttcactttggtcaatggaaagccttatcctttggatatgagaggagagttagatgacactgctgctttcaagaacttcaagaaatggggaaacattgaatttccattgccatttggaagggttatgagttctaccgaatctttcattcatggattagatgaaaagacaagtgcgtctttaaaattcacagtgctaaacccaatgggccgaatttggactatggtagccggaggaggtgccagtgtaatctatgctgacacagttggagatcttggttatgctccagagcttggaaattatgcagaatacagtggtgcacctaaggaagacgaggtcttacagtatgccagagttgtaattgattgtgcaactgcaaatcaggatggccaaaagcgagctctcgtgattggaggaggaatagctaacttcactgatgttgctgctacattcagtggcataattcgtgctttgaaggagaaggaacaaaagctaaaagaagcaaatatgtacatctatgtgaggcgaggaggtcctaactaccaaaggggtctcgcgaaaatgagggcacttggagaggaaattggaatccctattgaggtttatggacctgaagcaacaatgactggtatatgcaaacaagcaatccagtgcatcacagcttctgcttaatgattatcaattcttatgtcaatgctttgtcttaaagtttaatcatgtgttgttgtttgtagtgattattgattcataattgcatttccaatctatcagaattgataattttgttgagatagagtatagattgttaaaagtttaataatctaataaagtggttaagaatgctttgtatcatcatgtagaattctgatagtgtagtttttactcaatcaataaagtgacatgtgtaattcgtttatgttatgtctagcagcaatttcatggttctcagatttattttcagca

SEQ ID NO: 3184 - DNA, 1753 bp, Ananas comosus
ctcagcagcagcagcaccatataattcctcgttctgcgactctcttccgcctgcttcgtccgttcgtcccttcagctgcagcgagtcagtcttcggctctttcttttcagcccccaaaacctttgcctgcaggcagatagatagataggtgggatcgatggcgaggaagaagatcagggagtacgactccaagcgcctcctcaagcaacatctccagcgcctcttcggcattcacctccccatcagatccgcccagatcacggaagcgacggacttgatggcgctggcagaggcagagccgtggctgtcgtcggagaagctggtggtgaagcctgacatgctgttcgggaagcgcggcaagagcgggctcgtgggcctcaacctcgatctggctcaggtcgccgcattcacgaaagagcgcctggggaagcaggtcgagatcggcgggtgcaagggccccatcactaccttcattgtcgagccctttgttccgcactcccaagagttctatctctccgtcgtctcggagcgtctcggctgcagcattagcttctctgagtgtggagggattgagatcgaagagaactgggataaagtcaaaactgtgttcattccgtcagacacatccctctcgcccgaaacctgtgctcccttgctagcaactttgaccttggagatcaaaggagaaattgaggatttcatcacaaaggtgttcgttacttttctagatcttgacttcacgttccttgagatgaaccccttcactttggttgatggaaagccgtatcctctggatatgagaggggaattggatgacactgctgcttttaagaacttcaagaaatggggagatattgagtttccaatgccatttggtagagtaatgagtcctactgagagctttgtgcataagcttgatgaaaagacaagtgcttctttgaagtttactgtcctgaaccctcaaggacgaatctggacaatggtagctggaggaggcgccagtgttatttatgctgacacggttggggatcttggttatgcttctgaacttggcaactacgcagaatatagtggagctccaaaggaagaggaggtgcttcagtatgcaagagttgttattgattgtgctactgccaatcctgatggccgtaaaagagctcttgtcattggaggagggatagccaactttactgatgttgctgcaacatttagtggcatcattcgggctctaagggaaaaggaatcaaatcttaaggcttcaaggatgcatgtcattgtgaggagaggaggtccaaattatcaaacaggccttaggaaaatgcgacatcttggagaagaaatcggaatccccattgaagtttacggacctgaagctactatgactggcatctgcaagcaggcaatcgagtgtattaccgctgctgcataaaattagataactttgaatgaactttcttcatttgcgtcatttgctttgtttgcgacagttaacttatgtttcgtctgggcagtagattcaatagtactagtggccatcgggcaaagagcggaaatggttgctttaagtcccaatgagcttttgtttaaaatgttcaatcctgatggcttgcctcctatttgaaataagaatgctatctttaaacaatcagaagtttgagatattcagctaattgccgtcagaagtaatgaaaatcgtagacctatccactgctgctatgaaaaatttcacacagctatgctgttagttttatgc

SEQ ID NO: 3185 - DNA, 1624 bp, Malus domestica
gatttcagttgtgagtttgctctgcatctacctctgtacctaaccacttcctctctctctctctctctctctctctcatcacaactaacgcgcatttttcaacggttgagaaatggcacgtaagaagatcagagagtacgactccaagagattgttgaaggagcacttcaagaggctcgccggccgtgaattgccccttaaatctgcccagattaccgaaacaaccgatgtcaatgagctgctggagaaggaatcgtggctttcatcttccaaactcgttgtcaagcctgacatgttgttcggaaagcgtgggaagagcggtttggttgccttgaatcttgattttgctcaagttgtcgactttgtgaaggagcgcctgggcaaggaggttgagatgggtggctgcaaaggacccataacaacattcattgttgaacccttcattccccacaatgaagagttttaccttaacatcgtctcagaccgacttggaaacagcataagcttctccgagtgtggaggaattgatattgaggagaactgggataaggttaagaccatatttgtccctactggagttgcttttacatcagaagtttctgctccacttgttgcaacccttcccttggagatcaaagcagaacttgaggactttatcaaagccgtatttgctctatttcaagatttggacttcacttttctggagatgaatccttttgcattggttgatggaaagccatatcctttggatatgagaggcgagctggatgacactgctgctttcaagaacttcaaaaagtggggcagtattgaatttccaatgccttttggaagagttatgagtcctacagagaaatttattcacgggctagatgaaaagacaagtgcatctttgaaattcacagttctgaacccaaagggacgaatttggactatggtcgctggaggaggtgcaagtgtcatctatgcagacacggttggagatcttggctttgctgatgagcttggaaactacgccgaatacagtggagcacccaatgaagaggaggtgttgcagtacgccagagttgtgattgattgtgcaacttctgaccctgacggccgcaagagagcccttgtaattggaggaggtattgctaactttaccgatgtagctgcaacattcaatggcattattcgtgccttgaaggagaaggaatctaagcttaaagccgcacagatgcatctttacgtcaggagaggaggccctaactaccagagggggcttgcaaaaatgcgggcacttgcagaggaaatcggcctccctattgaggtctatggacccgaagcaacaatgaccggtatttgcaaacaggcaattcagtgcatctccgctgctgcataagttatcgttcagattgctcgcacccttactgtctcatttcctttcattttgatttcttttgtggcaagtttcatgtctccattaaatccttgtaccaattacgttgtttcaaaatcctcgaccgagttaatgtagttattacgtgcaaatgggtaaatggtagcatgatgatgctgtgtgatggtcttgttaccgtaataaacaaataaaataaaaatttatgttggcattcattttgga

SEQ ID NO: 3186 - DNA, 1535 bp, Arabidopsis thaliana
gacaaagaagagtcgtgttggtgagctaactacccaacctgtgaagctacccccattctctctcaacgttttcgttttgaaatggcgaggaagaagatcagagagtatgactcaaagaggttggtgaaggaacatttcaaaaggctttctggcaaagagcttcctatcagatccgttcagattaatgaaacaactgatctaaatgagctagttgaaaaggaaccttggctctcgtctgagaagctggtggtgaaacctgacatgttgtttggaaagcgtggcaagagtggtttggttgccttgaaattagattttgctgatgttgccacttttgttaaagaacgtttgggaaaagaggtagagatgagtggatgcaaaggacccataacaacattcatagttgaaccatttgttccacacaatgaggagtattatctcaatgttgtctcggatcggcttggttgcagcataagcttttctgagtgtggaggaattgagatcgaggagaactgggacaaggtcaagacaatatttttaccaacaggtgcttccctgacacctgaaatatgtgcacctcttgtcgcaactcttcccttagagatcaaagctgaaattgaagaatttatcaaagtcattttcaccctattccaagatcttgatttcactttcttggagatgaatcctttcactctagttgatggaagtccttatcctctggatatgaggggtgagcttgatgatactgctgccttcaaaaactttaaaaaatggggcgacattgaatttcctctgccatttggaagagtaatgagtcctacagaaagctttatccacggactggatgagaagacaagtgcgtctttgaagtttaccgttctgaaccccaagggacggatttggacaatggtagctggtggaggagcaagtgtcatctatgcggatacggttggagatctcgggtatgcatctgaacttggcaactatgctgaatacagtggagcacccaaagaagatgaggttttgcagtacgccagagtcgttattgattgtgctacagcaaacccggatggaaaaagcagagcccttgtcatcggaggcggaattgccaacttcactgacgttgctgctactttcaatggcataatccgcgctcttaaagaaaaggaagcaaagctgaaagcagcaaggatgcatatatttgtgaggagaggaggaccaaactaccaaaagggacttgctaaaatgcgagcccttggagatgatatcggtgtccccatcgaggtctatggcccagaagcaaccatgacaggtatctgcaaggaggcaatccagtacatcacagcagcagcataagcttctctcagtaccttctatgaccaaaactttgtctgtgttttagagcctttatttactgtggttaagattactcaagctataagatacttgcaatttcttgaaaacttctgttgttcgattctctttcccctaacgttttcttcagattcaataaataatcgttacttttttttcccctc

SEQ ID NO: 3187 - DNA, 1776 bp, Phaseolus vulgaris
tctccaaagcttgtgtcatatatataacatgaagccaccaacatcacactaccacaaaacttttcaccctttactggatctaccattctccaaccttcttttccattgatccttctctctctctaaaggcacctgcatcccctttctttctcttcacccacttcagggagacatttggttttggcggtgagtttgttatgcaatggcacgcaagaagataagagaatatgactccaagaggttgttgaaggagcactttaaaagaatatctggccaagacttgcccatcaagtctgcacaagttacagaatccactgatttcagtgaactaccagagaaggaaccctggcttttatcttcaaaattggttgtgaaacccgacatgctatttggaaagcgtggcaaaagtggtttggttgccttgaatttggatttggcagaagttgcttcttttgtgaaagagcttctaggcaaagaggctgagataagtggatgcaaagggcccataacaactttcattgttgaaccttttatcccacacaatgaggagttttatcttaacattgtctcggagagactagggaacagtataagcttttctgaatgtggaggaattgaaattgaggagaactgggataaggtcaagactgtatttatgccaacaggactgtctcttacatctgagagtatcgctccacttgttgcaacccttcccttggagatcaggggagaaattgaggaattcctcagggtgatttacactctattccaagacctggatttcactttcttggagatgaatcctttcactttggtcaatggaaagccttatcctctggacatgagaggcgagcttgatgacactgctgctttcaagaacttcaagaaatggggaaacatcgaatttccattgccatttggaagggtaatgagtagtacagaggccttcattcatggattagatgaaaagacaagtgcatctttaaaattcacagtactaaacccgaagggccgaatttggacaatggtagctgggggaggtgctagtgtcatctatgctgatacggtaggtgatcttggttatgctcctgagctaggaaactatgcagaatatagtggtgcacccaaggaagatgaggtcctgcagtatgccagggttgtgattgattgtgcaacttcaaatcctgatgaccaaaagcgagctcttgtgataggtggtggaatagctaactttactgatgttgctgctacattcagcggcataatccgtgctctgaaggagaaggaacaaaagctaaaagacgcaaagatgcacatctatgtgaggaggggaggtcccaactaccagagtggtttagcaaaaatgagggcccttggagaggagattggcattcccattgaggtttatggacctgaagcaacaatgactggtatatgcaaacaggcaatccattacatcactgctgctgcttaattatccattcttaggcctgtatgaacttcttttacaagtattgtcatggctggtttgaagagattgttgattcctagttctctgtccaactttaagaaatgattactttggtgagttaagagtgtaggccgttataaattagtcatctaataaagtgggcaagagtgttttgtatcttctagaattctgatagtacattagtaataccatgaaatggtacaggtgtaattgttttatgttatgtcatggttctccagatttactttcattaactaaattggttttctttccacttttgctaa

SEQ ID NO: 3188 - DNA, 1540 bp, Centaurea maculosa
tttacaaccaacgaccacctaccatttttttctaccaatatctacacaggggttttagaaggaaggaaaatggcaagaaagaagatccgagagtttgattcaaagaggctggttaaggagcattttaagaggatttctggttctgaattacccattaaatctgcacaggttacagagtcaaccgacttcaatgagctggcagagaaggagccatggctctcttcatctaagttggttgtgaaacctgacatgttgttcggaaagcgtggcaagagtggacttgttgccttgaatcttgatttggctcaagttgctgaattcgtaaaggagcgtcttggcaaagagattgtgatgggaggatgcaagggacccataaccacgttcattgtcgaaccatttgttccacaccacgaagagttctatatcaacattgtttccgagcgtttaggatgtagcattagcttctcagaatgcggaggaattgatatcgaagagaattgggaccaggtgaagacaatctttctacccacaggggtgtcattgactcaagagacatgtgctccacttgttgccaccctcccattggagtttaaatctgtaatcgaggagttcatcacacatgtatactccctattcatagatctcgatttcactttcctagaaatgaatccgttcaccctggtggacaaaaagccttaccctcttgatatgagaggcgagcttgacgacactgccgctttcaagaacttcaaaaagtggggcaatatcgagttccctatgccttttggaagagttatgagtcctactgaaagatttatccatggacttgatgagaagactagtgcctctttaaagtttacagttcttaacccgaagggacgaatttggacgatggttgctggtggaggtgcaagtgtcatctatgcagatactgttggagatctcggctatgcttccgagctgggaaactatgcagaatatagcggtgcgcccaacgaagaggaagttctgcaatatgctcgagttgtcattgattgtgcaacggctgatcctgatggtcaaaggagggcgcttgtagtaggaggtggaatcgccaacttcaccgatgttgcagccaccttcaatggcatcattcgtgccatgaaggagaaggtatccaagttgaaagctgcaaacatgcacatctacgtgcgtagaggaggtccaaattaccaaagaggacttgcgagaatgcgtgcacttggagccgagcttggcatcccaattgaggtatacgggcctgaggcaacgatgacaggaatatgcaaacaagcaatcgagtgcatcacggttgcggcttagatttggtggatcgtattggactttttctagcttttgttttatcataatgttaagatttccggcttaataagtattgttatcgaacgattatgaattgggttcaatgtataatgatgtttgttttcgggatcttggatccacaaaatattcaagtacgatgaactagttcacggcaaaaaagaaaaagtaaccgactgcg

SEQ ID NO: 3189 - DNA, 1529 bp, Cirsium arvense
gtatcggttgcattgcatctttcaagcaacaacaacacagcctaattttctaaccatctcttaccgggttttagaggaacaaaaatggctcgcaagaagatccgagagtttgattcaaagaggttggttaaggagcactttaagaggatatctggttctgaattgcccatcaaatctgcacaggttacagagtcaaccgacttcaatgagcttgtggagaaggaaccatggctctcttcatccaagctggttgtgaaacctgacatgttgtttggaaagcgtggcaagagcggacttgttgccttaaatcttgatttggctcaagttgctgaattcgtaaaggagcgtcttggcaaagagattgtgatgggaggatgcaaaggacccataacaacattcattgtcgaaccatttgttccacaccacgaagagttctacatcaacattgtttctgagcgtttaggttgtagcattagcttttcagagtgtggaggaatcgaaatcgaagagaattgggaccaggtgaagacaatctttctacccacaggggtgtcattgaatcaagagatatgtgctccacttgttgccactctcccattggagtttaaatctgtaatagaggggttcatccaacatgtatactccctattcatagatctcgacttcacttttctagaaatgaatccgttcaccctggtagatggaaagccttaccctcttgatatgagaggcgagcttgatgacactgctactttcaagaacttcaaaaagtggggcagtatcgagtttccaatgccatttggaagagttatgagtcctactgaacgttttattcacggacttgatgagaagactagtgcgtctttgaagttcacagttcttaatccaaaaggacgaatttggacgatggttgctggtggtggtgcaagtgttatctatgcagatactgttggtgatcttggctatgcttccgagcttggaaactatgcagaatatagcggtgcacccaacgaagaggaagttctgcagtatgctcgagttgtcattgattgtgcaactgctgatcctgatggtcaaaggagggcgctagtagtaggaggtggaattgccaacttcaccgacgttgcagccaccttcaatggcatcattcgtgcgatgaaggaaaaggaatccaagttgaaagctgcaaacatgcacatctatgtgcgtaggggaggtccaaattaccaaagaggacttgcaagaatgcgtgcacttggagccgaacttggcatccctattgaggtatacgggccggaggcaacaatgacgggaatatgcaaacaagctatcgagtgcatcacggttgcggcttaaatttggtggatcgtatcagaatcttttgacttttattttcgtcataatgttaagattttcaagctaagcgttaataaaagggttgtgatcaactattatatgtgggttcaatttataatgatgcttgttttcgggatcctggatccataaaatattcgagtatgatgaatgag

SEQ ID NO: 3190 - DNA, 1488 bp, Taraxacum officinale
cggggattcccaactataaattagttggtgttctcagtgaacatcgtcaacattcgatctgcatccatctcacggccttccaccatctcccaactggttttcaaggaaatataatggcacgcaagaagatcagagagtacgattccaagaggttggtgaaggagcattataagaggatttctggttccgaattggctattaaatctgcacaggttacagaatcaaccgacttgaatgagctaatcgagaaggaaccatggctctcatcatccaaattagtcgtaaaacccgacatgctgtttgggaaacgtgggaaaagtggactcgttgccctaaatctagatttggcccaagtttctgaattcgtaaaagccagacttggcaaagaggttgaaatgggaggatgcaaaggtcccataaccacattcattgttgaaccttttgttccacacaatgatgagttttatatcaacattgtttctgagcgattaggatgtagtattagtttttcagaatgtggaggaattgatattgaagagaattgggacaaggtcaagactatctttttgcctactggagtgtctttgaatcaagagatatgtgctccacttgttgcaacccttccattggagattaaatctgtgattgaagagtttatcagatctatatatactctatttatagatcttgacttcactttccttgaaatgaaccctttcaccttggttgatggaaaaccttaccctcttgatatgagaggagagcttgatgatactgctgctttcaagaacttcaaaaagtggggcaacattgagttcccattgccttttggaagagttatgagtgccactgaaagctttattcatggacttgatgaaaagacaagtgcatctttaaagtttacagttctaaatccaaaaggaagaatctggaccatggttgctggtggaggtgccagtgtcatatacgccgatacagttggagatcttggttatgcttcagagcttggaaattatgcagaatacagtggcgcaccaaatgaagaggaggttttgcaatatgcaagagttgtaattgattgtgcgactgctgatccagatggtcaaaagcgggctctggtagtgggaggtggaattgctaacttcacggatgttgcagccacatttaatggcatcattcgtgcaatgaaagagaaggaggctaagttgaaagctgccaacatgcacatttacgtaaggagaggaggtccaaattaccaaagaggacttgcaaggatgcgcgccctaggagacgaaattggcatcccaatccaggtgtatgggcctgaggcaacaatgaccggaatatgcaaacaagcaatcgactgcattactgcatctgcataaactatgtattcggtgtttgacattggattaaaatgtgccatgtaacttgtgttgtgttttgttattgttgtggtgtgtgtttcttttgaattgcaaactgtag

SEQ ID NO: 3191 - DNA, 1567 bp, Flaveria ramosissima
taaggtagtcagttagcctatagagatcactacaactacccttctagtattactcttcttacccgctaaaacaaacacccaatttgtcaaacaaatagtaaccgaataatagaatcaacaaccccaccaaacttcaactataaatttacaatctttaactctctttcggtatcggtcgcaatttgtaatctttcaaccaaccaacaccatctatcaccaggttttagaggaacgataatggcacgtaagaagatccgagagtttgattcgaagagattggtgaaggagcatttcaagaggatttcgggttctgaaatgcccatcaaatctgcacaggttacagagtcgaccgactttaatgagctggcgaaaacggaaccatggttatcttcatccaaactggttgtgaaaccggatatgttgtttggaaagcgtggcaagagtggactcgttgccttaaatcttgatttggctcaagttgctgagtttgtgaaggagcgacttggcaaagaggttgtgatgggaggatgcaaaggacccataaccacattcattgttgaaccatttattccacacaacgaagagttttatatcaacattgtttctgagcggttagggtgtagcattagcttttcagaatgtggaggaattgatatcgaagagaattgggacaaggttaagacaatctttttacccacaggggtttcattgaatcaagagttatgtgctccattggttgccaccctcccattggagttcaaatctgtaattgaggagttcatcacacacatatattccctattccttgatcttgacttcactttcttggaaatgaatccattcactctggtcaacggaaagccttatcctcttgatatgagaggcgagcttgacgacactgctgccttcaaaaactttaaaaagtggggaaatatcgaattcccaatgccatttggaagagttatgagttctactgaaagctttatccatgaacttgatgaaaagactagtgcatctttgaagttcacagttcttaacccaaaaggacggatttggaccatggttgctggtggtggtgctagtgtcatatatgcagatacagttggagacttaggctatgcttctgagcttggaaattacgcagaatacagtggtgcacccaatgaagaagaagttctgcaatatgctcgaattgttattgattgtgcaactgctgatccagacggtcaaaggagggcgcttgtagtcggtggtggaatagccaattttactgatgtggcagccactttcaatggtatcatccgtgcaatgaaggagaaggaatcacagttgaaagctgcaaacatgcacatttatgtgcgacgaggaggtccaaattaccaaagagggcttgcaagaatgcgcgcacttggagctgaaatcggcatccctattgaggtatatgggccagaggcaacaatgactgggatatgcaaacaagcaattgaatgcatcatggttgctagttagatttggtggatcttattgggcttgtgtttcgttgctgatcttaacttttcaaatgaga

SEQ ID NO: 3192 - DNA, 1549 bp, Helianthus annuus
acagccttcaaccaaactcccaactcacaactaactagggtttttaacgtaacaataatggcacgcaagaagatcagagagtatgattcaaagaggctggtgaaggagcatttcaaacggatttctggttctgatttggctattaaatcagcacagattactgaatctacagacttgaatgagctagtaaaagtggaaccttggctttcttcagcaaaattggttgtgaaacctgatatgctgttcggtaaacgtgggaaaagtgggctcgttgctctaaatcttgatttggcccaagtttctgagtttgtgaaggcacgtcttggtaaagaggttgagatgggaggatgcaaaggacccataaccacattcattgttgaaccatttgttccacacaatgaagagttttatatcaacattgtttccgagcgattaggatgtagcattagcttttcagaatgtggaggtattgacattgaagagaattgggaaaaggtcaagaccatctttttgccaactggggtgtcgttgaatcaagagatatgcgctccacttgttgctacacttccattggagattaaacctgtaatcgaggagttcatcaaagctatatattctttattcatagatcttgacttcactttcttagaaatgaatcctttcactctagttgatggaaagccttatcctcttgacatgagaggagaacttgatgacactgctgctttcaagaactttaaaaagtggggcaaccttgagttcccattgcctttcggaagagttatgagtgctaccgaaagctttattcatggactagatgaaaagactagtgcatctttgaagtttacggttcttaacccaaagggacgaatctggaccatggttgctggtggaggtgctagtgtcatatatgctgatacagttggagatcttggttatgcatccgagctcggaaactatgccgaatacagcggggcaccaaacgaagaagaggttttgcagtatgctcgagttgtcattgactgtgcaactgctgatccagatggtcaaaagcgagctcttgtagtaggaggtggaattgcaaacttcaccgatgttgcagccacattcaatggcatcattcgtgccatgaaagagaaggaggctaagctgaaagctgctaacatgcacatctacgtaaggagaggaggtccaaattaccaaaaaggactagcgaagatgcgggcactaggagaggaaattggcatcccaattgaggtgtatggacccgaagcaacaatgaccggaatatgcaaacaagcgattgaatacatcaccgctgctgcctaaacgttaccgggcctttgtgtttctgagttttctctggtttgttgcatttaaatggaagtgttgtgtcatgtttgtttttgtggcaatgtgttgttcttttgaaaatttgtagaaaacttaagcaaagggacaaattgcgggtcagttgattttaaagacacgggtatatgtgtagaagactcgtaacctgttgaaaattatggttttgttagaactgtta

SEQ ID NO: 3193 - DNA, 1566 bp, Chrysanthemum coronarium
atctcacactcacccacccacccaccaatctcccaactgattaacgaatggcgagaaagaagatcagagagtatgattcgaagcgattggtgaaggagcattataaaaggattagtggcaatgatttagtcattaaatctgctcaggttacagaatcaaccgacttgaatgaactgatagagagggaaccttggctatcttcgtcgaagttggttgtgaagcccgatatgttatttgggaagcgtggaaagagcgggcttgttgctctaaaccttgatttggcccaagttgctgagtttgttaaggcacgacttggcaaagaggttgagatgggaggatgcaaaggacccataaccacattcattgttgaaccatttgttccacataacgaagagttctatatcaacattgtttctgagcgattagggtgtagcataagcttttctgaatgcggaggaattgacattgaagagaactgggacaaggtcaagacaatctttttgccaactggggtgtctttgaatcaagagatagttgctccacttgttgcaacccttccgttggagatcaagcctgtaattgaggagttcatcaaatctatatattcgcttttcgtagatcttgacttcactttcctagaaatgaaccctttcacccttgttgatggaaagccatatcctcttgatatgagaggagagcttgatgacactgccgctttcaaaaacttcaagaagtggggcaacattgagttcccattgccttttggaagagttatgagtgctactgaaagctttattcacggactagatgaaaagactagtgcatctttgaagtttacagttcttaatccaaagggaaggatttggactatggttgctggtggaggtgccagtgtcatatatgccgacacagttggagaccttggttttgcttccgagcttggaaattatgcagaatacagcggtgcaccaaatgaagatgaggttttgcagtatgctcgagttgttattgattgtgcaactgctgacccagatggtcagaaacgagcacttgttgttggaggtggaattgccaacttcactgatgttgcagccacattcaatggcatcattcgtgccatgaaggagaaggagtcgaagttgaagaccgcaaacatgcacatctacgtaaggagaggaggtccaaattaccaaaaaggacttgcaaagatgcgtgccctcggagatgaaattggcatcccgatcgaggtgtatgggcctgaggcaacaatgactggaatatgcaaacaagcgatcgagtgcatcactgcctctgcctagtttaacctttcctggcttacatcttatgtttcgtttattcaaattgaagtgttgtgctttgtttcggcgtgtctttctttttgagtatttgtagaaaacccaagaaaatggacatattgcagctcggttaatttcaaaacgtgggtatacatgtagacgactcttattcagattgtaatcttgttgaacaatttataaatcataagcttatttcctttcatataaggtcaaaaacttttatcccgca

SEQ ID NO: 3194 - DNA, 1711 bp, Trifolium pratense
ttcatattcattttcctaagctctataaatatatcatagattcatcaccaacaacaacacactttcccattcactattcgatctacctatccttcaccttcttctccattgatccattttctctctctaacgggaagaatttgtgttgaagatttaagaagaatcaatggcacgtaagaagatcagagagtatgattctaagaggttgttgaaggaacattttaagagaatctctggacaagagttgccaattaagtctgcacaaattatagaatcaactgatatcaacgagctagtagagaaggaaccgtggctttcatcttcaaaattggttgtgaaacctgacatgctatttggaaaacgtggaaaaagcggtttggttgccttgaatctggatttggctgaagttgctggttttgtgaaagagcgtcttggaaaagaggttgagatgggtggatgcaaaggacctataacaactttcattgttgaacctttcatcccacataatgaagagtattaccttaacattgtctcagagagactaggaaatagtataagcttttctgaatgtggaggaattgatattgaagagaactgggataaggttaagactgtatttattccaacaggggaatctcttacatcagagaatatatcagcacttattgcaaccctccccttagaggtcaagggagaaattgaggaatttctaaaagtgattttcaatatatttcaagatctggatttcacattcttagagatgaatcctttcactttggtcgatggaaagccttatcctttggatatgagaggagagttagatgacactgctgctttcaagaacttcaagaaatggggaaacattgaatttccattgccatttggaagggttatgagtcctactgaatctttcgttcatggattagatgaaaagacaagtgcgtctttaaaattcacagtgcttaatccaatgggccgaatttggactatggtagccggaggaggtgctagtgtcatctatgctgacacagtaggagatcttggttatgctccagagcttggaaactatgcagaatacagtggtgcacctaaagaagatgaggtcttacagtatgcgagagttgtaattgattgtgcaactgcaaatccggatggccaaaaacgagctctcgtgatcggaggaggaatagctaacttcactgatgttgctgctacattcagtggcataattcgtgctttgaaggagaaggaacaaaagctaaaagaagcaaatatgcacatctatgtgaggagaggaggtcctaactatcaaaggggtctcgcgaaaatgagggcacttggggaggaaattggaatccctattgaggtttatggacctgaagcaacaatgactggtatatgcaaacaagcaattcagtgcatcacagcttctgcttaattattattatccattcttatgccaatgctttgtcttgaagtttaatcatgtgttgttgcttgtagtgtgattgttgattcataattgcatttccaatctatcagaattgatgatcattttgttgagatagagtatagattgttaaaagtttaataatctaataaattggtcaaaaatgctttgtatcatgtagaattctgatagtgtagtttttactcaatcaataatgtgacatgtgtaactcgtttatgttaagtctagtaagcacctcca

SEQ ID NO: 3195 - DNA, 1574 bp, Malus domestica
gtttgctctgcatctacctctacctacctccctcaccctctctctcatcggaactaacaggcatttttcaacggttgagaaatggcacgcaagaagatcagagagtacgactccaagagattgttgaaggagcacttcaagaggcttgccggccgcgatttgcctcttaaatctgcccaaattaccgaaacaaccgatgtcaatgagctgctggagaaggaatcgtggctttcgtcttccaaactcgttgtgaagcctgacatgttgttcggaaagcgtgggaagagcggtttggttgccctgaatcttgattttgctcaagttgtcgaatttgtgaaggagcgcctaggcaaagaggtcgagatgggtggctgcaagggaccaataaccacgttcattgtcgaacccttcattccccacaacgaagagttttaccttaatattgtctcagaccgacttggaaacagcataagcttctccgaatgtggaggaattgacattgaggagaactgggataaggtaaagaccatatttgtccctactggagttgctttttcatcagaagtgtctgctccacttgttgcaaccctacccttggagatcaaagcagaactcgaggactttatcaaagccgtatttgctctatttcaagatttggacttcacatttctggagatgaatccttttgcattggttgatggaaagccatatcctttggatatgagaggcgagctggatgacactgctgctttcaagaatttcaaaaagtggggcagtattgaattcccaatgccttttggaagagttatgagtcctacagagaaatttattcacgggctagatgaaaagacaagtgcatctttgaaattcacagttctgaacccaaaggggcgaatttggactatggtcgcaggaggaggtgcaagtgtcatctacgcagacacggttggagatcttggctttgctgatgagcttggaaactatgctgaatacagtggagcacccaatgaagaggaggtgttgcagtacgccagagttgtgattgattgtgcaacttctgagcctgacggtcgtaagcgagcccttgtaataggaggaggtattgctaactttaccgatgttgctgcaacattcaatggcattattcgtgccttgaaggagaaggaatctaagcttaaagccgcacagatgcatctttacgtcaggagaggaggccccaactaccagagggggcttgcaaaaatgcgggcacttgcagaggaagtcggcctccctattgaggtctatggacccgaagcaacaatgaccggtatttgcaaacaggcaattcagtgcatcaccgcagctgcataagttatcgttcagattgctcgcaccctcgctctcccctttccttttcttttctttctttagtggcaagtttcgcatcttcattaaatccttgtaccaattacgttctatcaaaaacctaagccaagttaatgtagtttttacgtgctaatgggtgaatggtaacgtgatgatgttgtatgatgatcttattaccgtaataaaaaagtttacgttgttattca

SEQ ID NO: 3196 - DNA, 1340 bp, Arnica chamissonis
gaggaacgaaatggcgcgtaagaagatccgagagtatgattcgaagagattggtgaaggagcatttcaagaggatttctggttctgaattgcccgtcaaatctgcacaggttacagagtcaaccgactttaatgagctggtgaaaagtgaaccatggttatcttcatccaaactggttgtgaaacctgatatgttgtttggaaagcgtggcaagagtggacttgttgccttaaatcttgatttggctcaagttgccgaatttgtaaaggagcgacttggcaaagaggttgtgatggaaggatgcaaaggacccattaccacattcattgttgaaccatttattccacacaacgaagagttctatttcaacattgtttctgagcggttagggtgtagcattagtttttcagaatgtggaggaatcgatattgaagagaattgggacaaggtgaagacaatctttttacccacaggggtactgttgaatcaagagatatgtgctccacttgttgccaccctcccgttgcagtacaaatctgtaattgaggagttcatcacacacatttattccctattcctagatctcgacttcactttcttggaaatgaatccattcactctggtcaacggaaagccttatcctcttgatatgagaggcgagcttgatgacactgctgctttcaaaaacttcaaaaagtggggcaatatcgaattcccattgccatttggaagagttatgagtcctactgaaagctttattcatggacttgatgaaaagactagtgcatctttgaagttcacggttcttaaccctaaaggacggatttggaccatggttgctggtggtggtgctagtgtcatctatgcggatacagttggagatttaggttatgcttctgagcttggaaattatgcagaatacagcggcgcaccgaatgaggaagaggttctgcaatatgctcgagttgtcatcgattgtgcaactgctgatccagatggtcaaaggagggcgcttgtagttggcggtggaatcgccaattttactgatgttgcagccactttcaatggcatcattcgcgcgatgaaggagaaggaatcgaagttgaaagcagcaaacatgcacatttatgtgcgacgaggaggtccaaattaccaaagagggcttgaaagaatgcgtgggctcggggctgaaattggcatccctattgaggtatacgggccagaggcaacaatgacaggaatatgcaaacaagcaattgaatgcatcatggttggcgcttagatctgttgggtcttattggactcatgtttcttcataatgttaaaatttcaaatgaaac

SEQ ID NO: 3197 - DNA, 1490 bp, Centaurea maculosa
atatctccgcatctaatctctctcccaaccaccttcagcgatctcacaccagtacgatttgaagtagcgataatggcacggaagaagatcagagagtatgattcaaagaggttggtgaaggagcattataagaggatttctggttccgaattggctattagatctgctcaggttacagaatctaccaacttgaatgagctaatagagaaggaaccttggctctcctcatccaaattggttgtaaaaccagatatgttgtttgggaagcgtgggaagagtggcttagttgccctgaatctcgatttggcccaagtttctgaattcgtaaaagcacgtctaggcaaagaggttgagatgggaggatgcaaaggacccataaccacattcatcgttgaaccatttgttccacataacgatgaattctatatcaacattgtttccgagcgattagggtgtagcattagtttttcagaatgtggaggaattgacattgaagagaattgggacaaggtcaagacaatatttttaccaactggggtgtctttgaaccaagagatatgtgctccacttgttgcgacccttccattggagatcaaatccgtaattgaggaattcatcacaaacatatacgccctatttattgatcttgacttcactttcctagaaatgaaccctttcaccctggttgacggaaagccttatcctcttgatatgagaggagagcttgatgacactgctgcctttaaaaactttaagaagtggggcaacattgagttcccattgcctttcggaagagtaatgagtgccaccgaaagctttattcatggactagacgaaaagactagtgcatctttgaagtttacggttcttaatccaaagggccgaatttggaccatggttgccggtggaggtgccagcgtcatatatgctgatacggttggagatcttggttttgcttccgagcttggaaactatgcagaatacagcggtgcacctaacgaagaggaggttttgcagtatgctcgagttgtcattgattgtgcaaccgctgacccagatggtcaaaagagagcccttgtcgtaggaggtggaattgccaacttcactgacgttgcagccacattcaacggcatcattcgtgccatgaaggagaaggagtccaagttgaaagccgcgaacatgcacatctacgtaaggagaggaggtccaaattaccaaaaaggacttgcaaggatgcgtgcgcttggagatgaaataggcatcccgattgaggtgtacgggccggaggcaaccatgacgggaatatgcaaacaagcgatcgagtgcattaccgctgctgcttaaatttggtcagccttcgtgtctgtctgcattcagaagaattgttgttgtctgtttctctgtattgttcattcgaatgacattgtagaaaaccaaagaaaagggaatgattgtggactgtttaaatttcaaatacaagattgtcttaa

SEQ ID NO: 3198 - DNA, 1489 bp, Centaurea maculosa
cgcggggatgcaatatctcctcgactcctccgcatcaaatctctcccaaccaccaccttcagcgatctcacaccagtacgatttgaagtagcgataatggcacggaagaagatcagagagtatgattcgaagaggttggtgaaggagcattataagaggatttctggttccgaattggctattagatctgctcaggttacagaatctaccgacttgaatgagctaatagagaaggaaccttggctctcctcatcaaaattggttgtaaaaccagatatgttgtttgggaagcgtgggaagagtggcttagttgctctgaatctcgatttggcccaagtttctgaattcgtaaaagcacggcttggcaaagaggttgagatgggaggatgcaaaggacccataaccacattcatcgttgaaccatttgttccacataacgatgaattttatatcaacattgtttccgagcgattagggtgtagccttagtttttcagaatgtggaggaattgacattgaagagaactgggacaaggtcaagacaatatttttaccaactggggtgtctttgaaccaagagatatgtgctccacttgttgcgacccttccattggagatcaaacccgtaattgaggagttcatcacaaacatatatgccctatttattgatcttgacttcacgttcctagaaatgaaccctttcaccctggttgatggaaagccttatcctcttgatatgagaggagagcttgatgacactgctgcctttaaaaacttcaagaagtggggcaacattgagttcccattgcctttcggaagagtaatgagtgccaccgaaagctttattcatggactagatgaaaagaccagtgcatctttgaagtttacggttcttaatccaaagggacgaatttggactatggttgccggcggaggtgccagtgtcatatatgctgatacggttggagatcttggttttgcttccgagcttggaaactatgcagaatacagcggtgcacctaacgaagaggaggttttgcagtatgctcgagttgtcattgattgcgcaaccgctgatccagatggtcaaaagagagcccttgtcgtgggaggtggaattgccaacttcactgacgttgcagccacattcaacggcatcattcgtgccatgaaggaaaaggagtccaagttgaaagccgcgaacatgcacatctatgtaaggagaggaggtccaaattaccagaaaggacttgcaaggatgcgtgcgcttggagatgaaataggcatcccgattgaggtgtacgggccggaggcaaccatgaccggaatatgcaaacaagcgatcgagtgcattactgctgctgcttaaattcagccaaccttcgtgtctgcccgcattcagaagaattgttgtcgtttgtatttctgtattgtattgttcattcgaatgacattgtagaaaaccaaagaaaagggaatgattgtggact

SEQ ID NO: 3199 - DNA, 1701 bp, Cichorium intybus
attactcttcttcccgctaaagaaatgcccaatattctctaaaaaaaattaattaaaaaacaaataaattaagcccaccaaattcaactataaattgtttaagtgttagactgttggttcaacattctcagtatccgttgcattgcatctttcaaccaacaaacacacagccttctatccatctctcaccgggttttagacaaacagaaatggctcgcaagaagatccgagagtatgactccaagaggttggtgaaggagcattacaagagaatctctggttccgagttaccaatcaaatctgcacaggttacagaatcaaccgacttcaatgagctagtagagagggaaccatggttatcttcatccaaactggttgtgaaacccgacatgttgtttggaaaacgtggcaagagtggacttgttgccttgaatcttgatttggctcaagttgctgaattcgtaaaggaacgactcgggaaagaggttgtaatgggaggatgccaaggacccataaccacattcattgttgaaccatttgtcccacataacgaagagttctacatcaacattgtttctgagagattaggttgtagcattagcttttcagaatgtggtggaattgacattgaagaaaattgggacaaagtgaagacaatctttttacctacaggggtatctttaaatcaagaaatatgtgcaccacttgttgccactctcccattggagttcaaacctgtgatcgagcagttcatcacacacatatattccctattcgtagatcttgatttcactttcctagaaatgaatccgttcacattggtggatggaaagccttatcctcttgacatgagaggcgagcttgatgacactgctgctttcaagaacttcaaaaagtggggcaatatcgaattcccaatgccatttggaagagttatgagtgctactgaaagctttattcacggactagatgaaaagacaagtgcatctttgaagttcactgttcttaacccaaaagggcgaatttggacaatggtggcaggtggtggtgcgagtgtcatttatgcagatactgttggagatcttggttatgcttctgagcttggaaactatgcagaatacagtggtgcaccaaatgaagaggaagttcttcaatatgctcgagttgtgattgattgtgcaactgctgaccctgatggtcaaaggagggcacttgtggttggaggtggaattgcaaacttcactgatgttgcagccactttcaatggcatcattcgtgcaatgaaagagaaggtgtccaagttgaaagctgcgaacatgcacatttatgtgcgaagaggagggccaaattaccaaagaggacttgcaagaatgcgtgcacttggagccgaacttggcattcctattgaggtatacgggcctgaggcaacgatgacgggaatatgcaaacaagcaattgagtgcatcacggtttcagcttaaatttggtggatcttattggactcttttagtatatgtttcattatgatgttaaaatcttgaaattagaagtcaataagagtgttgtaagtggaatattgtggtttgtatgtttgggttaggtgtatgatgatgtgtttgctcatctctatttttggggtctattgttctttggatccacatttggggtgaaataaaagaaatcttttttttttgtgcgaaa

SEQ ID NO: 3200 - DNA, 1707 bp, Cichorium intybus
attactcttcttcccgctaaagaaatgcccaatattctctaaaaaaaattaattaaaaaacaaataaattaagcccaccaaattcaactataaattgtttaagtgttagactgttggttcaacattctcagtatccgttgcattgcatctttcaaccaacaaacacacagccttctatccatctctcaccgggttttagacaaacagaaatggctcgcaagaagatccgagagtatgactccaagaggttggtgaaggagcattacaagagaatctctggttccgagttaccaatcaaatctgcacaggttacagaatcaaccgacttcaatgagctagtagagagggaaccatggttatcttcatccaaactggttgtgaaacccgacatgttgtttggaaaacgtggcaagagtggacttgttgccttgaatcttgatttggctcaagttgctgaattcgtaaaggaacgactcgggaaagaggttgtaatgggaggatgccaaggacccataaccacattcattgttgaaccatttgtcccacataacgaagagttctacatcaacattgtttctgagagattaggttgtagcattagcttttcagaatgtggtggaattgacattgaagaaaattgggacaaagtgaagacaatctttttacctacaggggtatctttaaatcaagaaatatgtgcaccacttgttgccactctcccattggagttcaaacctgtgatcgagcagttcatcacacacatatattccctattcgtagatcttgatttcactttcctagaaatgaatccgttcacattggtggatggaaagccttatcctcttgacatgagaggcgagcttgatgacactgctgctttcaagaacttcaaaaagtggggcaatatcgaattcccaatgccatttggaagagttatgagtgctactgaaagctttattcacggactagatgaaaagacaagtgcatctttgaagttcactgttcttaacccaaaagggcgaatttggacaatggtggcaggtggtggtgcgagtgtcatttatgcagatactgttggagatcttggttatgcttctgagcttggaaactatgcagaatacagtggtgcaccaaatgaagaggaagttcttcaatatgctcgagttgtgattgattgtgcaactgctgaccctgatggtcaaaggagggcacttgtggtaggaggtggaattgcaaacttcactgatgttgcagccactttcaatggcatcattcgtgcaatgaaagagaaggtatccaagttgaaagctgcgaacatgcacatttatgtgcgaagaggagggccaaattaccaaagaggacttgcaagaatgcgtgcacttggagccgaacttggcattcctattgaggtatacgggcctgaggcaacgatgacaggaatatgcaaacaagcaattgagtgcatcacggtttccgcttaaatttggtggatcttattggactcttttagtatatgtttcattatgatgttaaaatcttgaaattagaagtcaataagagtgttgtaagtggaatattgtggtttgtgtctttggcttaggtgtatgatgatgtgtttgctcatctctatttttggggtctattgttctttggatccacatttggggtgaaataaaagaaatcttttttttttgtgcgaaaaaacaa

SEQ ID NO: 3201 - DNA, 1449 bp, Cirsium arvense
aatatatcagttgcattgcatctttcaaccaacaaccaccaccaccaccaccacaaacccttttctctaccaatatctctcacagcagggttttagaggaaggaaaatggcaagaaagaagatcagagagtttgattcaaagaggctggttaaggagcattttaagaggatttctggttctgaattgcccatcaaatctgcacaggttaccgagtcaaccgacttcaatgagctggcagagaaggaaccatggctctcttcatcgaagctggttgtgaaacctgacatgttgttcggaaagcgtggcaagagtggacttgttgccttgaatcttgatttggctcaagttgctgaattcgtaaaggagcgtcttggcaaagagattgtgatgggaggatgcaagggacccataaccacgttcattgtcgaaccatttgttccacaccacgaagagttctatatcaacattgtttccgagcgtttaggatgtagcattagcttctcagaatgcggagggattgatatcgaagagaattgggaccaggtgaagacaatctttctacccacaggggtgtcactgaatcaagagacatgtgctccacttgttgccaccctcccattggagtttaaatctgtgattgaggagttcatcacacatgtatactccctattcatagatctcgacttcactttcctagaaatgaatccattcaccctggtagacaaaaagccttaccctcttgatatgagaggcgagcttgacgacactgctgctttcaagaacttcaaaaagtggggcaatatcgagttcccgatgccttttggaagagttatgagtcctactgaaagatttattcatggacttgatgagaagactagtgcgtctttgaagtttacggttcttaacccaaaaggacgaatttggacgatggttgctggtggtggtgcaagtgtcatctacgcagataccgttggagatctcggctatgcttccgagcttggaaactatgcagaatatagcggtgcacccaacgaagaggaagttctgcaatatgctcgagttgtcattgattgtgcaactgctgatcctgatggtcaaaggagagcgcttgtagtaggaggtggaatcgctaacttcaccgatgttgcagccaccttcaatggcatcattcgtgccatgaaggagaaggtatccaagttgaaagctgcaaacatgcacatctatgtgcgtagaggaggtccaaattaccaaagaggacttgcgagaatgcgtgcacttggagccgagcttggcatccctattgaggtatacgggcctgaggcaacgatgacgggaatatgcaaacaagcaatcgagtgcatcacggttgctgcttagatttggtggatcgtattggactttttctagcttttgttttatcataatgttaagatttccagcttaataaa

SEQ ID NO: 3202 - DNA, 1720 bp, Citrus clementina
ctcatttttcggatttcttttaaaaatttatttaaaaaaaaaagttctcgttgatataaatactcgaacaagttcgcttctaacaccaaatcaacattcaagcttcaagcgttgtgttctccgcttcctacctgctcagaaaaatatatctgttgcgctgtcgtttttgcctattttcgaaagacttgtcgttttggtgaaaatcaggcctgagaaatggcacgcaagaagatcagagagtatgattcgaagagattgttgaaggagcacttccagaggctctctggtcgcgagttgcctatcaaatccgcacaagttaccgagtcaactaatttcgatgagctggcacaaaaggaaccctggcttacatcatgtaaactagttgtgaaacccgacatgttgtttggaaagcgtgggaagagtggtttggttgctttaaatctggatttagctcaagctgctacttttgtgaaagagtgccttgggaaagagatggagatgagtggatgtaaaggacctataacaacattcatcattgaacctttcatcccgcacaatgaggagttttaccttaatattgtctcagagcgacttggatgcagcgtaagcttttcagaatgcggaggaattgaaattgaggagaactgggataaggttaagactatctttgtcccaacaggtgcatgccttgcttctgaaacctcggctccgcttgttgctacccttcccttggagatcagaggagaaattcaggagttcattaaatcagttttcactctttttcaagatcttgacttcactttccttgagatgaatccttttacattggttgatagaaagccttatccattggatatgagaggagagctggatgacactgctgctttcaagaacttcaaaaagtggggcaatattgaatttcccttgccgtttggaagagcaatgagtgctacagaaagctttatacatgatctagatgaaaagacaagtgcatctttgaaattcacagttttgaacccaaaaggacgaatctggactatggtagctggaggaggtgcaagtgtcatctatgctgatacggttggagatcttggctatgcctcagagctcggtaactatgcagaatacagtggagcacccaacgagggggaggtcttgcaatatgccagagttgtaattgattgtgcaactgcagatcctgatggtcgcaagagagcccttgtgattggaggaggaatagctaacttcactgatgttgcagctacattcaatggcataatccaagccctgaaggaaaaggaatcgaagctgaaagcagcaagaatgcacctatatgtgaggagaggaggtcctaattaccagaggggccttgcaaaaatgcgagcactcgcagaggaaattggccttcccattgaggtttatgggcccgaagcaacaatgactggcatatgcaaacaggctattgagtgcattagcgctgctgcatgagctatcaactcctttcttcaatgcttcacactcacgccattgtcattgcaaatttctagtatccatcatcattactttgtaccaattttgctgtatcagatacctcagtatgtaatgttagttcaaaatatggttaatgaggatgaaaaactgatctctgtctgtagtgtcaccataataaaagatttaagtagccttctaactcgtattggtcttcatgcttgaatgaatg

SEQ ID NO: 3203 - DNA, 1768 bp, Prunus mume
gtgtgagtgagtggtacatctaaaaataatacgttgccgctaaaattaaatttaagcccacaccaacctacccctttcaaattaaacccccaccaaaaaaaagaataaattagaaaaaggccaaaaacatttgcctttgtttttggtagctataaatagacgagtccattggcacaaggatttcagttgtgagttgctctgcatctacctacctaactcttgttcgtagaaccagcacgcactcctctccccttctctgttattcaacgatatggcacgcaagaagatcagagagtacgactccaagaggttgttgaaggaacacttcaagaggctcggtggccgtgaattgccccttaaatcagcccaaattactgaatcaaccgatctcaatgagctagttgagaaggaatcttggctttcatcttccaaactggttgtgaaacctgacatgttgtttggaaagcgtgggaagagtggtttggttgctttgaaccttgacttcgctcaagttgccacctttgtgaaggagcgccttggcaaagaggtggagatgggtggttgcaaaggacccataacaacattcattgttgaacccttcattccccataatgaggagttttaccttaatattgtctcagaccgacttgggaacagcataagcttctccgagtgtggaggaattgatattgaggagaactgggataaggtcaagaccatatttgtccctacaggaactcctttcacatcagaagtatctgcaccacttgttgcaacccttcccttggagatcaaaggagaacttgaggactttatcaaagtcgtttttactctatttcaagatctggacttcacttttctggagatgaatcctttcgcactggttgatggaaagccatatcctttggatatgagaggcgagctggatgacactgctgctttcaagaacttcaaaaagtggggcagtattgaatttccaatgccatttggaagggttatgagttctacagaaaaatttattcatggcctagatgaaaagactagtgcatctttgaaattcacagttctcaacccaaagggacgaatttggactatggtagctggaggaggtgcaagtgtcatctatgcagacacggttggagatcttggctttgctgatgaacttggaaactatgccgaatacagtggagcacctaatgaagaggaggtattgcagtatgccagagttgtgattgattgtgcaacgtcagaccctgatggccgtaagagagcccttgtaattggaggaggaatagccaactttaccgatgtagctgcaacattcaatggtatcattcgagccttgaaggagaaggaatcaaagcttaaagccgcaaggatgcatctctatgtcaggagaggaggtcccaactaccagaggggcctcgcaaaaatgcgggcacttggagaggaaatcggcatcccaattgaggtctatggacccgaagcaacaatgacgggtatttgcaaacaggcaattcagtgcatcagtgttgctgcataagtcgttcttcagattgctcgctcttctcctttcttttcttttcttttctggcaagtttccatgtctccattaaatccttgtaccaatttcgttctatcaaaaacctcagcgaagttaatgtagtttgtacgtgctaatgggtaatggtagcgtgattgtactgtgtgaccttgttactgaaataaaaagtttacattggcgtactcatttctctgcattttgaga

SEQ ID NO: 3204 - DNA, 1484 bp, Trigonella foenum-graecum
gaaataatttgtattgaaaatttaagaagaaccaatggcacgtaagaagatcagagagtatgattctaagaggttgttgaaggagcattttaagagaatctctggacaggacttgccaattaagtctgcacaagttatagaatcaaccgatatcaatgaactagtagagaaggaaccatggctttcatcttcaaaattggttgtcaaacctgacatgctatttggaaaacgtggcaaaagtggtttggttgccttgaatcttgatttggctgaagttgctggttttgtcaaagaacgtcttggaaaagaggttaagatgggtggatgcaaaggacctattacaactttcattgttgaaccttttatcccacataatgaagagttttacctgaacattgtctcagatagactagggaacagtataagcttttctgaatgtggaggaattgacattgaagagaactgggataaggttaagactgtatttattccaacaggggaatctcttacatcagagactatttctccacttattgcaaccttacccttggagatcaagggagaacttgaggattttctcaaagtggttttcaatatttttcaagatctggatttcacattcctagaaatgaatcctttcactctggtcgatggaaagccttatcctttggatatgagaggagagttagatgacacggctgctttcaagaacttcaagaaatggggaaacattgaatttcctttgccattcggaagggttttgagttctaccgaatctttcattcatggattagacgaaaagacaagcgcgtctttaaaattcacggtgttaaacccaatgggccgaatttggactatggtagctggaggaggtgccagtgtaatctatgccgatacggtaggagatcttggttatgctccagagctgggaaattatgcagaatacagcggtgcacccaaggaaggcgaggtcttgcagtatgccagagttgtaattgattgtgcaactgcaaatcctgatggccaaaagcgagcccttgtaatcggaggaggaatagctaacttcaccgatgttgctgcaacattcagcggcataattcgagctctgaaggaaaaggaacaaaagctaaaagaagcaaatatgcacatttatgtgaggagaggaggtcccaactaccaaaggggtctagcaaaaatgagagcacttggggaggaaattggcattccaattgaggtttatggacctgaagcaacaatgactggtatatgcaaacaagcaatccagtgcatcactgcttctgcttaattatcaatttcatgccattgctttgtcttgaagtataatcatgtgtagtttgtagtgattgttgattcatagttttatttccaatctaccagaattgagatatttggtgagatagagcataaattgttaaaaatttaataatttaataaagtgacatgtgtcattcgtttatgttatg

SEQ ID NO: 3205 - DNA, 799 bp, Zea mays
caaccaccactcccaccaccctccgcctccgcctgcgccacagctgccgattcgaaagccctcgtcctgacccctcgcaaaaccctagctccaaccaccatgaagggcaaggccaacgcctccaagaaggatgaggccaggctccgggccggcggcggcggcgccggaaagcgcaagaaggccgccgcgagcggcaagcccaagcgccctccctccgccttcttcgtcttcatgtctgaattcaggcaggagtaccaggcgcagcaccctggcaacaagagcgttgcggccgtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggataacgacgacgacgagtaaatagtatttccgctgttgtgaggtagcaaatcgattgttaggtccccaattagctcactggtttgctatctttaatgttaagttgtttggaacaggtgtttatgaaggggatctattagtttcgtgaggttgttagtttagtgcattagcaaagaaaaagccgaatgctgctagctattatgttgcttttcttttgctaatcacttgtgtcacaactttctgtacctgtttcattgactaatctagtgactagtcagttatgggtttaatgtttggtttt

SEQ ID NO: 3206 - DNA, 561 bp, Sorghum bicolor
aaaaaccctagctccagccaccaccaccatgaagggcaaggccgacacctccaagaaggatgagggcaggctccgggccggcggcggcgccggaaagcgcaagaaggccgctgcgagcggcaagcccaagcgcccgccctccgccttcttcgtcttcatgtctgaattcaggcaggagtaccaggcacagcaccctggcaacaagagcgttgcggccgtgagcaaggcagcaggggaaaagtggcgtgctatgtcagagcaagagaagcaaccatatgtggaccaagctgggcagaagaagcaggactatgagaagactaaggcgaactttgagaagaaggagagcacaagctcaaagaaggctaagactgatgatgacgatggctcaaagtctgaggttgacgatgaggatgacgaggacgatgagtaaatactgtctccgcagtcatgagatagcaaatcgagtgttaggtccccaactagcttaccggcttgttatctttaatgttaagttgtttggaacaggtgtttatgaaggggatctattagtttcgtgaggtt

SEQ ID NO: 3207 - DNA, 1158 bp, Panicum virgatum
ctattttctacgtcaaggtaagcagcactaactggcggcccattaacgcgtgtaaagtttcccgggcctaatttaggtgcaccctgaagcgcgaacccagcacacggcccgcttcttcgacgttccacaactcacacgaatccaccgacccaaccacgcgtcgcggatgccgcacccacccggtcgctgtccctgcttttccccgttcacgcacacccacgcggccgcgcaccccgcaaaacggcaaaacccaaccaccattccactttccaccaccctccgcctccgctcccccgggattcgaaagccaccgtcctgtccccccgcaaaaccctagctccagccaccatgaagggcaaggccgacgcctcgaagaagggcgagggcaggctcaaggccggcggtggcgccggcaagcggaagaaggccgctgccagcggcaagcccaagcgcccgccctccgccttcttcgtcttcatgtctgaattcaggcagcagtacaatgcacagcaccctgataacaagagcgtcgccgccgtgagcaaagcagcaggggaaaagtggcgttctatgtcagacgaagagaagcaaccctacgtggaccaagctgggcagaagaagcaggactatgagaagaccaaggccaactttgataagaaggagagcacaagctcaaagaaggctaagactcaggatgacgatggctctgacaaatcaaagtctgaggttgatgatgaggatggcgggagtgatgaggaaaatgatgaagatgagtaaatagcgtctccattgtcatgagatagcaaatggagtgttagcttgttaggtccccgattagcttaattgtttgctatctttaatattaagttgtttggaacaggtgtgtatgaaggggatctatcagacttgtgtttcatgaggttgttagtttattgcattagcaaagaaaaagccgaatgctgttagctgttctgttgcttttcttttgctaaccacttgtggctcaacttgctgtgcctgtttcattcactaatctaatgactagtcagttattagtctgatgttttggttttatatgtttctttgatgtgtggtgcgtgccctgcataagttgaagcgatccgccatatgctgtgaatctctgtttgtggctcattc

SEQ ID NO: 3208 - DNA, 865 bp, Echinochloa colona
ttcacgcacacccacgcggccacgcaccgcataaacgcgctcccacaaaaaaggcaaaccaacaaccaggccaccacccccctccgcctccgctccccgattcgaaagcgcagcctcccccgtcctgtccccccgcaaaaccctagctccagccaccgccatgaaggggaaggccgacacctcgaagaagggcgagggcaggctcaaggccggcggcggcgccggcaagcggaagaaggccgccgcgagcggcaagcccaagcgcccgccctccgccttcttcgtcttcatgtctgaattcaggcagcagtacaatgcggagcaccctaacaacaagagcgtcgcgaacgtgagcaaggcggcaggggaaaagtggcgttctatgtcagaggaagagaagcaaccatacgtggaccaggctgggcagaagaagcaggattatgagaagaccaaggctaacttcgacaagaaggagagcacaagctctaagaaggctaagactgaggatgatgatggctctgacaagtcaaagtctgaggtcgatgatgaggatgccggcagcgacgaggagaacgaggaagatgagtaaatagtgtctccatggtcatgaggtagcaaatggagtgttagatccccgattagcttgctggtttgctatctttaatattaagctgtttggaacaggtttgtatgaaggggatctgttagacttgtgtttcatgaggttgttagtttagtgcattagcaaagaaaaagccgaatgctgctagctgttctgttgcttttcttttgctaaccacttgtgtctcaaacttgctgtacctgtttcattcactaatctaatgactagtcagctattcgcttt

SEQ ID NO: 3209 - DNA, 744 bp, Setaria italica
ctgattcgaaagccccccctccgtcctgtccccccgcaaaaccctagctccacccaccatgaagggcaaggccgacacctcgaagaagggcgacggcaggctcaaggccggcggcggcgccggcaagcggaagaaggccgccgcgagcggcaagcccaagcgcccgccgtccgccttcttcgtcttcatgtctgaattcaggcaggagtaccaggcgcagcaccctgataacaagagcgtcgcggccgtgagcaaggcagcaggggaaaagtggcgtgctatgtcagaggaagagaagcaaccatacgtggaccaggctgggcagaagaagcaggactatgagaagaacaaggccaactttgataagaaggagagcacaagctcaaagaaggctaagactcaggatgatgagggctctgacaagtcaaagtctgaagttgatgatgaggatggtggcagcgacgaggaaaatgaggaagatgagtaaatagagtctccatggtcatgaggtagcaaatggtgtgttaggtccccgattagcttactggtttgctatctttaatattaagttctctggaacaggtttgtatgatggggatctattagacttgtgtttcatgaggttgttagtttagtgcattagcaaagaaaaagccggatgctgctagctgctccgttgcttttcttttgctaaccacttgtgtctcaacttgctgtacctgtttcattcactaatctaatgac

SEQ ID NO: 3210 - DNA, 951 bp, Setaria italica
ggtcgctgtccctgcttttcccgttcacgcacacccacgcggccacgcaccgcatcaacgcgctcccccaaaaaggcaaccaaaaccaaccaccaggccaccaccctccgcctccgctccctgattcgaaagccccccctccgtcctgtccccccgcaaaaccctagctccacccaccatgaagggcaaggccgacacctcgaagaagggcgacggcaggctcaaggccggcggcggcgccggcaagcggaagaaggccgccgcgagcggcaagcccaagcgcccgccgtccgccttcttcgtcttcatgtctgaattcaggcaggagtaccaggcgcagcaccctgataacaagagcgtcgcggccgtgagcaaggcagcaggggaaaagtggcgtgctatgtcagaggaagagaagcaaccatacgtggaccaggctgggcagaagaagcaggactatgagaagaacaaggccaactttgataagaaggagagcacaagctcaaagaaggctaagactcaggatgatgagggctctgacaagtcaaagtctgaagttgatgatgaggatggtggcagcgacgaggaaaatgaggaagatgagtaaatagagtctccatggtcatgaggtagcaaatggtgtgttaggtccccgattagcttactggtttgctatctttaatattaagttctctggaacaggtttgtatgatggggatctattagacttgtgtttcatgaggttgttagtttagtgcattagcaaagaaaaagccggatgctgctagctgctccgttgcttttcttttgctaaccacttgtgtctcaacttgctgtacctgtttcattcactaatctaatgactagtcagctattagcttaatgttttggttttatatgttcctttggtgtgaggcgcgtgccctgcataaattgagatgttttggtttt

SEQ ID NO: 3211 - DNA, 1228 bp, Panicum virgatum
ccctttttctacgtcaatgtaagcaacactaactggcggcccattaacgcgtgaacacagcagcacacggcccgcttctctttcttcgacgttcacgaactcacacgatcctccgaatcaaccacgcgtcgcggatgccgcaccctcccggtcgcggtcgctgtcgctgcttttccccgttcacgcacagtcgcacacccacgcggccgcgcgcaccccacaaaaggcaaacccaaccaccagcccaccaccctcctccgcctccgctccccgattcgaaagccaccgtcctgccccccgcaaaaccctagctccagccaccatgaagggcaaggccgacacctcgaagaagggcgacggcaggctcaaggccggcggcggcgccggaaagcggaagaaggccgccgccagcggcaagccgaagcgcccgccctccgccttcttcgtcttcatgtctgaattcaggcagcagtacaatgcacagcaccctgacaacaagagcgtcgccgccgtgagcaaagcagcagggggaaagtggcgttcaatgtcagacgaagagaagcaaccatacgtggaccaagctgggcagaagaagcaggactatgagaagactaaagccaactttgataagaaggagagcacaagctcaaagaaggctaagactcaggatgacgagggttctgacaaatcgaagtctgaggttgatgatgaggatggcagcagtgatgaggaaaacgatgaagatgagtaaatagcgtctccattgtcgtgaggtagcaaatggagtgttaggtccccgattagcttacttgtttgctatctttaatattaagttgtttggaacaggtgtgtatgaaggggatctatcagacttgtgtttcatgaggttgttagtttagtgcattagcaaagaaaaagctgaatgctgttagctgttctgttgcttttcttttgctaaccacttgtggctcaacttgctggtacctgtttcattcaccaatctaatgactagtcagttattagcttgatggtttggttttatatgtttctttgatgtgtggtacgtgccctgcattgttgaagcgatctattgtaccatatgctgtggatctctgtttgcggctcattccatttattagtctgtttgctactggacctctctatgtgagttatttgttgacatttctgtagcaattttgttgatatctgtggtggaaattctgttgcc

SEQ ID NO: 3212 - DNA, 839 bp, Oryza sativa
cgctccgccccaaaaggccagacaacgcccgttgcgccgcctcccaaactccgcctcctcctcctccgctgcacccccgcaaaaaccctagcgcaccgacttcgcgatctccgcgccgcagccatgaagggcaaggccgacgcctccaagaagggcgagggcaggctcaaggccgccggcggcgccgggaagcggaagaaggccgccgctagcggcaagccgaagcgcccgccgtctgctttcttcgtcttcatgtctgagttcaggcaggagtaccaggcagcgcatcctggcaacaagagtgtcgccgccgtgagcaaggctgcaggggagaagtggcgagctatgtctgagcaagagaaggcaccttatgtggacaaggctggccaaaagaagcaggactacgagaagaccaaggccaacttcgataagaaggagagcacaagctcaaagaaagctaagacccatgatgatggagaaggctctgacaagtccaagtctgaggtcgacgatgaccaggatggtggtagcgatgaggaaaatgaggacgatgaagagtaaatagtgtatccgggggcatgaggtagcaaactgtgtcttaggtcccctattagctttactagtttgctatcttcgaccctaagatgttgggaataggcgtgcgtgggtgtgaaggggaccgtttagaattatggtactcagaatgttttcctacagtggattagcaaagaaaaagcctgaatgccgcctgctgttctgttgcttttcttttgctaaccacttgtcacagaactttgtttcatttgctaatctagtagcaattcagttagctttctttt

SEQ ID NO: 3213 - DNA, 636 bp, Echinochloa colona
ctagctccagccaccgccatgaaggggaaggccgatacctcgaagaagggcgacggcaggctgaaggccggcggcggcgccggcaagcggaagaaggccgccgcgagcggcaagcccaagcgcccgccctccgccttcttcgtcttcatgtctgaattcaggcagcagtacaatgcggagcaccctaacaacaagagcgtcgcgaacgtgagcaaggcggcaggggaaaagtggcgttctatgtcagaggaagagaagcaaccatacgtggaccaggctgggaagaagaagcaggattatgagaagaccaaggctaacttcgacaagaaggagagcacaagctcaaagaaggctacgactgaggatgatgagggctctgacaagtcaaagtctgaggtcgatgatgaggatgccggcagcgatgaggagaacgaggaagatgagtaaatagtgtctccatggtcatgaggtagcaaatggagtgttagatccccgattagcttgctggtttgctatctttaatattaagctgtttggaacaggtttgtatgaaggggatctgttagacttgtgttcgaggttgttagtttagtgcattagcaaagaaaaagccgaatgctgctagctgttctgttg

SEQ ID NO: 3214 - DNA, 794 bp, Cenchrus ciliaris
ggcaaccaaaaccaaccaccaggccaccaccctccgcctccgctccctgattcgaaagccccccctccgtcctgtccccccgcagaaccctagctccagccaccatgaagggcaaggccgacacctcgaacaaggtcgacggcaggctcaaggccggcggcggcggcgcaggcaagcggaagaaggccgctgcgagcggcaagcccaagcgcccgccgtccgccttcttcgtcttcatgtctgaattcaggcaggagtacaatgcgcagcaccctgataacaagagcgtcgcggccgtgagcaaggcagcaggggaaaagtggcgcgctatgtcagaggaagagaagcaaccatacgtggaccaggctgggcagaagaagcaggactacgagaagaacaaggccaactttgataagaaggagagcacaagctcaaagaaggctaagacccatgatgatgagggctctgacaagtcaaagtctgaagttgaagatgaggatggtggcagcgacgaggaagatgagtaaatagggtcgccatggtcatgaggtagcaaatggtttgttaggtccccgattagcttactggtttgctatctttaatatgaagttctctggaacaggtttgtatcatggggatctattagacttgtgtttcatgaggttgttagtttagtgctttagcaaagaaaaagctgaatgctgctagctgctctgttgcttttcttttgctaaccagtacttgttgtacctgtttcattcactaatctaatgactatagtcagctattagctt

SEQ ID NO: 3215 - DNA, 758 bp, Pennisetum glaucum
agaaccctagctccagccagcatgaagggcaaggccgacagctcgaagaagggcgatggaaggctcaaggccggcggcggcgccgccaagcggaagaaggccgccgcgagcggcaagcccaagcgcccgccgtccgccttcttcgtcttcatgtctgaattcaggcaggagtacaatgcgcagcaccctgataacaagagcgtcgcggccgtgagcaaggcagcaggggaaaagtggcgtgctatgtcagaggaagagaaacaaccatatgtggaccaggctgggcagaagaagcaggactatgagaagaacaaggccgactttgataagaaggagagcacaagctcaaagaaggctaagacccatgatgatgatggctctgacaagtcaaagtctgaagttgaagatgacgatggtggcagcgacgaggaagatgagtaaatagtgtctccatggtcatgaggtagcaaatggcgtgttaggtccccggttagcttactggtttgctatctttaatttaagttctctggaacaggtttgtatgatggggatctgttagacttgtgtttcatgaggttgttaatttagtgcattagcaaagaaaaagctgaatgctactagctgctctgctgcttttcttttgctaaccacttgtgtctcaacttgatgtacctgtttcattcactaatctaatgactagtcagctattatcgagaaacaaaaaaaaaaaaaaaaagaaaacgtactcgtgtcgttag

SEQ ID NO: 3216 - DNA, 1437 bp, Brachypodium distachyon
gaaagaagagaacagccctcgacatggaatggaagcccaacaggaggagtctgacactgacgagcatcttcggcccgaactaggtttgccacgcggtctcaactctcaagcctgcgcacgccacggcctgcttcctgcgcaacgcaaatcttaccgcacccacgcgtcgcgcgggtcctgcaccgaccgtcccatcgctcaaccttttccccctgtttcacgcacacacacgcggccccgcaccgcacaacggctcaccccaaaagccaacaaacccagccagcgctccctttccgcctccccaaaccaaagcacctccccggcctccgtcctgtccccccgcaaaaccctagcaccgaacccgcgtcggctccaacaacatgaagggcaaggccgacacctccagcaagggcgagggcaggctcaaggccgccggcggtgccagcaagcggaagaaggccgctgctgccagcggcaagcccaagcgcccgccctccgccttcttcgtcttcatgtctgaattcaggcaggagtaccaggcagagcaccctaacaacaaaagcgtcgccaacgtgagcaaggcggcaggcgagaagtggcgatctatgtccgatgcagacaaggcaccttatgtggagaaggctggacagaagaagcaggactatgagaagaccaaagccacatttgataaaaaggagagcacaagctccaagaagaccaagactcaggatgacgagggctctgacaagtccaaatctgaggtcgatgatgaggacgctggtagcgacgaggaaaatgatgaagatgacgagtaaatagtgtatctcagcatgaggtagcaaattgggtgttgggtccccggttagtttactagtttgctattctcaatgttagatgttggaacttgaagtaggagtgtgtttctgcgtgaaggggcccctcttagagttgtactcagtttgagaagatgttttagtagtgtattagcaaagaaaaagccgaatgctactagctgttctgttgcttttcttttggtaaacgctggtgtaaaacttgtttcgttcgctaatcccattactatccggccattggcttttagttaattattatatctcacattcgactgtatatgcgtgattgtttaatttttgtgcgctcctttgcatgccatactgcaatgtccatgtcatgatcttagcagtgcaatgcattgtgttaaatgaaatctatctgatctgttttgctttatgcgacttcatcatcccagttcttgtggagtaacagtcacaatcaccccagttgttgtttgctggagctattttggagctgcagggtattacggagattagtaggtttcgtgatgtagtcctcatgagctatccagatttaagatgattattatgtttttttgacagggagatgattgtcgtgtttgtg

SEQ ID NO: 3217 - DNA, 1608 bp, Sorghum bicolor
cggcaagctgcagcagccttctgaaatctgaactctaacgaaaagaaagcacgggagacggggaccccggtgggcgcgccgagccgagagccgagtcgagtccactccgccacgcccacgcccacgcccacgccccgtcctcgcttccgtctcccacaatccaaggagaccgagcagcaggcggcggaagcaacccgctgggggcggcggcgtggagtccagttttgctcggctcgccgctgtgatccgccggccggcgaagcggggtagagaaggggggcggcggggattggagagtaggagcagggagagatgtcagacgcgctgatcaacggcctcgccggcgccggcggcgggatcatcgcccagctccttacctacccgctgcagaccgtgaacgcgcggcagcagacggagcgcgacccctccaagccggcgttcaaggacggtgccgctcgccagttgtacctggttgtgaagaatgaggggtgggagcgcctgtacggcgggcttatgccctcgcttgtcggcaccgctgcctcccagggtgtctactactacttctaccaaatattcaggaacagagccgaggcaaaggcccttgagcgatcccggagaggactaggcgatgggtctgtcgggatgctgcagtctctcactgtcgctgcgttgtctggctgtgtcaatgtactgctcacaaacccgatttgggttgttgttacacgaatgcaaactcacagaaaggcaaacaaacagcaaagtcctcagggtttgacatgtgctcttgacaagccccttgaagcttctgcaactgaaaacactccatacaaaacaattgatgtttttcaggaactgcacaaagaagctggagttctcggcttctggaaaggggtaattccggctcttatcatggttagcaatcctgcaattcagttcatgctgtatgagactcttctgaagaaactgaagaagagacgggcctctaatttgaagggagctgatggactaactgctcttgaaatttttcttcttggtgccgttgcgaaacttggtgcaactgttgttacatacccccttctagttgttaaggcaagacttcaggcgaagcaaatgattaatgatgacaagaggcatcggtacaaaggtacatttgatgcgttcacaaagttggtacaatatgagggtctgacagggatgtataaaggaatgggcacaaaaattgtgcagagtgtttttgcttctgctttgctttttatgattaaggaggagctggtgaagggtgctcgactattggtgactggtaacactagtctggttaagaaactaccatcaaagccatcaagatgacctacgtctgtcagccatcggaagcgttagtatatcttcctaaaaggccattattattcgcataaaccgcaaaacagagtcgacaagatatagaggtcacctctgctttggagatatcaactgtaggttacacaatagccagtatgaatattgtagggaccaaagactatgttggatagattatttgtatcatttatgtaaaatgtatcctggaagatcggaacaaaaggaaataaataagcatgataatttggacttggg

SEQ ID NO: 3218 - DNA, 1533 bp, Saccharum officinarum
cgggagacggcggaccccggtgggcgcgccgaaccgagagccgagtcgagtccactccgccacgcgcccacgccgggtcctcgcttccgtctcccacaatccaaggagaccgagcagcaggcggcggaagcaacccgttgcggggcggcgtggagcccagttttgctcggctcgccgcggtgatccgccggccggcgaagcggggaagagaagggggcggtggggattggagagtacgagcagggggagatgtcagacgcgctgatcaacggcctcgccggcgccggcggcgggatcatcgcccagctccttacctacccgctccagaccgtgaacgcgcggcagcagacggagcgcgacccctcgaagccggcgttcaaggacggcgccgctcgccagttgtacctggttgtgaagaatgaggggtgggagcgcctgtacggcgggcttatgccctcgcttgtcggcaccgctgcctctcagggtgtctactactacttctaccaaatattccggaacagggccgaggcaaaggcccttgagcgatccaggagagggctgggcgatgggtccgtcggcatgctccagtctctcactgtggctgcgctgtctggctgcgtcaatgtactgctcacaaacccgatttgggttgttgttacccgaatgcaaactcatagaaaggcaaacaaacagcaaaatcctcagggtttgacatttgctcttgacaagccccttgaagctgctacaactgaaaacactccatacaaaacagttgatgtttttcaggaactgtacaaagaagctggagttctcggcttctggaaaggggtaattccggctcttatcatggttagcaatcctgcaattcaattcatgctgtatgagactcttctgaagaaactgaagaagagacggtcctctaatttgaagggcgctgatggactaactgctcttgaaatttttcttcttggtgccgttgcgaaacttggtgcaactgttgttacatatccccttctagttgttaaggcaagacttcaggtgaagcaaatgattaatgatgacaagaggcatcgctacaaaggtacatttgatgcgttcacaaagatggtacaatatgagggtctgacagggatgtataaaggaatgggcacaaaaattgtgcaaagtgtttttgcttctgctttgctttttatgatcaaggaggagctggtgaagggtgctcgactattggtgactggtaacactagtctggttaagaaactaccatcaaagccatcaagatgacctacggccgtcgcaagcgttagtatatcttcctaaaaagccgctattattcacataaacgcaaaacagagtcgacaagctatagaggtcgcctctgctttggagatatcaactgtaggttacacaatagccagtatgattcttgtagggaccaaagactatgttggatagattatttgtatcatttgtgtaaaatgtatcctggaagattgaaacagaaggaaataaataagcatgataatttgaact

SEQ ID NO: 3219 - DNA, 1551 bp, Panicum virgatum
cgcgccgagccgagccgagccgagcgctcggagtcgatccccccccccccccccccccgggcccacggcctcgcttccgtctcccacaatccaaggagaccgagcaggcggcggcggaagcaacccgttggggggcggcggcgtggagtcctgctttgctcgctcggctcgccgccgtcatccgccggccggcgaagcgcggaggaggggaggtcggtggggggttggagagtgcggcgagcaggcggggagatgtcggacgcgctgattaatggcctcgcgggcgccggcggcgggatcatcgcccagctcctcacctacccgctccagaccgtaaacgcgcggcagcagacagagcgcgaccctaccaagccggcgtttaaggacggcgccgcgcgccagttatacttggttgtgaagagtgaggggtgggagcgcctgtacggcgggctcatgccctcgctcgtcggcaccgccgcctcccagggtgtctactactacttctaccaaatattccggaacagggccgaggccaaggcccttgagcgatccaggagagggcttgtcgatgggtctgtcgggatgctccaatctctcactgtcgctgccctgtctggctgcgtcaatgtactgctcacaaacccaatttgggtggttgttacccgaatgcaaactcacagaaaggccaacaaacaacaaagcccgcagggtttgacatgtgctcttgacaaggccatggaagctgctattactgaaaccaccccttacaaaactatcgatgtttttcaggaactgtacaaagaagctggagtgttgggcttctggaaaggggtaatcccagctcttattatggttagcaatcctgcgatgcagttcatgttgtatgagactcttctgaagaagctgaagaagagacgggcctctaatctcaagggagctgatggtctaactgctcttgaaatttttcttcttggtgctgttgcaaaacttggtgcaactgttgttacatatcctcttctagttgttaaggcaagacttcaggtgaagcaaaggattgacgatgacaagaggcatcggtacaaaggtacatttgatgcgttcacaaagatggtacattatgagggtctgaaaggcatgtataaaggaatgggcacaaaaattgtgcaaagtgtttttgcttctgctttgctttttatgatcaaggaggagttggtgaagggtgctcgattattggttactggtaacatcagtctggttaagaaattaccatcaaagccatcaagataaataggtctttgcaagtgttagtataccctgcccatagatccgattattattcacataaatcgtagtcgacaagggatggagctcgcctctgttaagagagatccaattgtaggttccacaacagccagtatgattcttgtagcgaacaaaaactctatatattggatagatcatttgtaccatttatgtaaaatgtattctggaagatttaacagaaggaaataaataagcacggtaattaaaacttcaatcatctgttctaaa

SEQ ID NO: 3220 - DNA, 1522 bp, Panicum virgatum
cccacggcctcgcttccgtctcccacaatccaaggagaccgagcaggcggcggcggaagcaacacgttgagggggcggagcggagtcctgttttgctcgctcggctcgctgccgtgatccgccggccggcgaagcggggaggaggggagggcggtgggggattggggagtacgagcgggcggggagatgtcggacgcgctgatcaacggcctcgcgggcgccggcggcgggatcatcgcccagctcctcacctacccgctccagaccgtgaacgcgcggcagcagacggagcgcgaccctaccaagccggcgtttaaggacggcgccgcgcgccagttatacttggttgtgaagaatgaggggtgggagcgcctgtacggcgggctcatgccctcgctcgtcggcaccgccgcctcccagggtgtctactactacttctaccaaatattccggaacagggccgaggctaaggcccttgagcgatccaggagagggcttggcgatggatctgtcgggatgctccaatctctcactgtcgctgccctgtctggctgcgtcaatgtactgctcacaaacccaatttgggtggtggttacccgaatgcaaactcacagaaaggcaaacaaacaacaaagcccagagggtttgacatgtgctcctgacaaggtcatggaagctgctataactgaaaacaccccttacaaaactatcgacgtttttcaggaactgtacaaagaagctggagtgttgggcttctggaaaggggtaatcccagctcttattatggttagcaatcctgcgatgcagttcatgttgtatgagactcttctgaagaagctgaagaagagacgggcctctaatctcaagggagctgatggactaactgctcttgaaatttttcttcttggtgctgttgcaaaacttggtgcaactgttgttacatatcctcttctagttgttaaggcaagacttcaggtgaagcaaaggattgacaatgacaagaggcatcactacaaaggtacatttgatgcgttcacaaagatggtacatcatgagggtctgaaaggcatgtataaaggaatgggtacaaaaattgtgcaaagtgtttttgcttctgctttgctttttatgatcaaggaggagttggtgaagggtgctcgactattggttactggtaacaccagtctggttaagaaattaccatcaaagccgtcaagaaaataggtctttgcaagtgttagtataccctgcccatagatccgattattattcacataaatcgtagtcgacaagctatggagctcgcctctgttaggagatatctaattgtaggttacacaacggccagtatgattcttgtatggaacaaaaactctatatattggatagatcatttgtaccatttatgtaaaatgtattctggaagatttaaacagaaggaaataagtaagcactaaactgaaagaaataaataagcacggtaattaaaacttcctccatctgttctaaattcatgaacttc

SEQ ID NO: 3221 - DNA, 1588 bp, Setaria italica
gtgggatactctgggatcacacggcacggcacggtcagggtcagctgcagcggtctgaactccagggaaagcacggcaccggagggggcgccgagccgagccgagtgcccgagtcgactccactccgcccccgcctcggcctcgctcgcttccgtctcccacaatccaaggagaccgaggagacagcggcggaagcaacccgttgggggcggcggcggggagtcttgtttcgctcggctcgccgctgtgatccgccggccggcgaagcggggagaagaggatgtcggacgcgctgatcaacggcctcgcgggcgccggcggcgggatcatcgcccagctcctcaccttcccgctccagaccgtgaacgcgcggcagcagacggagcgcgacccttccaagccggcgtttaaggacggcgccgcgcgccagttatacctggtagtgaagaatgaggggtgggagcgcctgtacggcgggctcatgccctcgctcgtcggcaccgccgcctcacagggtgtgtactactacttctaccaaatattccggaacagggccgaggcgaaggcccttgagcgatccaggagagggcttggcgatgggtctgtcgggatgctccaatctctcactgtcgctgccctgtctggctgcgtcaatgtactgctgacaaacccaatttgggttgctgttacacgaatgcaaactcacagaaaggcaaacatacagcaaagccctcaggatttgatatgtgccaatgacaaggctctcgaagcttctacaactgaaaacaccccttacaaaactatcgatgtttttcaggaactgtacaaagaagctggagtgttgggcttctggaaaggggtaattccgtctcttattatggttagcaatcctgcgattcagttcatgctgtatgaaactcttctgaagaggatcaagaagagacgggcctctaatttgaagggagctgatggactaactgctcttgaaatttttcttcttggtgccgttgcaaaacttggtgcaactgtccttacatatcctcttctagttgttaaggcaagacttcaggtgaagcaaagaattgatggtgacaagaggcatcactacaaaggtacatttgatgctatcacaaagctggtacagtatgaaggtctgagaggcatgtataaaggaatgggcacaaaaattgtgcaaagtgtttttgcttctgctttgctttttatgatcaaggaggagctggtgaagggtgctcgactattggttactggtaacaccagtctagttaagaaattaccatcaaagccatcatgatgatctaggtctttgcaagtgttagtatatcctgcctataaatcaattattattcacacaaatcgtaaacagagtgtacaagctatggagcccgcctctgttaggagatatccaattgtaggttacacaacagccagtatgattcttgtaggcaacacaagctctatatattcgttagatcatctgtaccatttatgtaaaatgtattatggaagattgacacaataaaataaataaggacggtaatggaaacttctgtcatctgttctgatttca

SEQ ID NO: 3222 - DNA, 1573 bp, Setaria italica
gatcacacggcacggcacggtcagggtcagctgcagcggtctgaactccagggaaagcacggcaccggagggggcgccgagccgagccgagtgcccgagtcgactccactccgcccccgcctcggcctcgctcgcttccgtctcccacaatccaaggagaccgaggagacagcggcggaagcaacccgttgggggcggcggcggggagtcttgtttcgctcggctcgccgctgtgatccgccggccggcgaagcggggagaagaggatgtcggacgcgctgatcaacggcctcgcgggcgccggcggcgggatcatcgcccagctcctcaccttcccgctccagaccgtgaacgcgcggcagcagacggagcgcgacccttccaagccggcgtttaaggacggcgccgcgcgccagttatacctggtagtgaagaatgaggggtgggagcgcctgtacggcgggctcatgccctcgctcgtcggcaccgccgcctcacagggtgtgtactactacttctaccaaatattccggaacagggccgaggcgaaggcccttgagcgatccaggagagggcttggcgatgggtctgtcgggatgctccaatctctcactgtcgctgccctgtctggctgcgtcaatgtactgctgacaaacccaatttgggttgctgttacacgaatgcaaactcacagaaaggcaaacatacagcaaagccctcaggatttgatatgtgccaatgacaaggctctcgaagcttctacaactgaaaacaccccttacaaaactatcgatgtttttcaggaactgtacaaagaagctggagtgttgggcttctggaaaggggtaattccgtctcttattatggttagcaatcctgcgattcagttcatgctgtatgaaactcttctgaagaggatcaagaagagacgggcctctaatttgaagggagctgatggactaactgctcttgaaatttttcttcttggtgccgttgcaaaacttggtgcaactgtccttacatatcctcttctagttgttaaggcaagacttcaggtgaagcaaagaattgatggtgacaagaggcatcactacaaaggtacatttgatgctatcacaaagctggtacagtatgaaggtctgagaggcatgtataaaggaatgggcacaaaaattgtgcaaagtgtttttgcttctgctttgctttttatgatcaaggaggagctggtgaagggtgctcgactattggttactggtaacaccagtctagttaagaaattaccatcaaagccatcatgatgatctaggtctttgcaagtgttagtatatcctgcctataaatcaattattattcacacaaatcgtaaacagagtgtacaagctatggagcccgcctctgttaggagatatccaattgtaggttacacaacagccagtatgattcttgtaggcaacacaagctctatatattcgttagatcatctgtaccatttatgtaaaatgtattatggaagattgacacaataaaataaataaggacggtaatggaaacttctgtcatctgttctgatttc

SEQ ID NO: 3223 - DNA, 1309 bp, Echinochloa colona
gggtggagattggagagtgcgagcaggcggggagatgtcggacgcgctgatcaacggcctcgcgggcgccggcggcggcatcatcgctcagctcctcacctacccgctccagaccgtgaacgcgcggcagcagacggagcgcgacccttccaagccggcgtttaaggacggcgccgcgcgccagttgtacctggtggtgaagaatgaggggtgggagcgcctgtacggcgggctcaagccctcgctcttcggcaccgctgcctcccagggtgtctactactacttctaccaaatattccggaacagggccgaggcgaaggcccttgagcgagctaggagagggcttggcgatgggtctgtcgggatgctccaatctctcactgtcgctgctatgtctggctgtgtcaatgttctgatcacaaacccaatttgggttgccgttacacgaatgcaaactcacagaaaagcaaacaaacagcaaagccctaagggtttgacatgtgctcttgacaaggcccttgaagatgccacaactgaaaacaccccctacaaaaccattgatgtttttcaggaactgtacaatgaagctggtgtgttgggcttctggaaaggagtaattccagctcttattatggttagcaatcctgcaattcagttcatgttgtatgaaactcttctgaagaagctgaaaaagaaacgggcctctaaattgaagggagctgatggactaactgcccttgaaatttttcttcttggcgccgttgcaaaacttggtgcaactgtcgttacatatcctcttctagttgttaaggcaagacttcaggtaaagcaaaagattgatgatgacaagaggcatcgctacaaaggtacatttgatgcgatcacaaagctggtacagtatgagggtctgacaggcatgtataagggaatgggcacaaaaattgtgcaaagtgtttttgcttctgctttgatttttatgatcaaggaggagctggtgaagggtgctcggctattggttactggtaacacccgtctggttaagaaattaccatcaaagccgtcaacatgatctaggtctttgcaaatgttagtaaacctacctataaatccaattattattcacataaagtgtaaacagagtcgacaagctatggaacttgcctctgttaggagatgtccaattgtaggttacacagcaggcactatgattcttgtagggaacaaaatctctaaatattggatagattatttgtaccgtttatgtaaaatgtattctggaagattgaaacagaaggaaataaataagcat

SEQ ID NO: 3224 - DNA, 1484 bp, Echinochloa colona
gccggccgagtcgactccactccgccctgccccggcctcgcttccggtcttccacaatccaaggagaccaagttggcggcggcggaagcaacccgttgcggggcggcgtggagtcctgtttcgctcggctcgccgctgtgatccgccggccggcgaagcggggagaagaggacggggtggagattggagagtgcgagcaggcggggagatgtcggacgcgctgatcaacggcctcgcgggcgccggcggcggcatcatcgcccagctcctgacctacccgctccagaccgtgaacgcgcggcagcagacggagcgcgacccttccaagccggcgtttaaggacggcgccgcgcgccagttgtacctggtggtgaagaatgaggggtgggagcgcctgtacggagggctcatgccctcgctcgtcggcaccgctgcctcccagggtgtctactactacttctaccaaatattccggaacagggccgaggcgaaggcccttgagcgatctaggagagggcttggcgatgggtctgtcgggatgctccaatctctcactgtcgctgccctgtctggctgcgtcaatgtactgatcacaaacccaatttgggttgccgttacacgaatgcagactcacagaaaagcaaacaaacagcaaagccctaagggtttgacatgtgctcttgacaaggcccttgaagattccacaactgaaaacaccccctacaaaactatcgatgtttttcaggaactgtacaatgaagctggtgtgttgggcttctggaaaggagtaattccagctcttattatggttagcaatcctgcaattcagttcatgttgtatgaaactcttctgaagaagctgaaaaagaaacgggcctctaaattgaagggagctgatggactaactgcccttgaaatttttcttcttggcgccgttgcaaaacttggtgcaactgtcgttacatatcctcttctagttgttaaggcaagacttcaggtaaagcaaaagattgatgatgacaagaggcatcgctacgaaggtacatttgatgcgatcacaaagctggtacagtatgagggtatgaaaggcatgtataagggaatgagcacaaaaattgtgcaaagtgtttttgcttctgctttgatttttatgatcaaggaggagctggtgaagggtgctcggctattggttactggtaacacccgtctggttaagaaattaccatcaaagccgtcaacatgatctaggtctttgcaaatgttagtaaacctacctataaatccaattattattcacataaattgtaaacagagtcgacaagctatggaacttgcctctgttaggagatgtccaattgtaggttacacagcagccaatatgattcttgtagggaacaaaatatctaaatattggatagattatttgtaccgtttatataaaatgtattatggaagactgaaacagaagggaataaatacgcaag

SEQ ID NO: 3225 - DNA, 1564 bp, Pennisetum glaucum
agatcacacggcacgggccgacgggcgcacggcacgggcagggtcagctgtagcggtctgaactctgagctccaacggaaagcacggcaccggagggggacgcgccgagccgagccgagtgcgcgagtcgactccactccgcccccgcctcgcttccgtctcccacaatccaaggagaccgaccgagcagagcaggcggcggcggaagcaacccggttggggggcggtggcgtggagtcctgtttcgctcggctcgcccctgtgatccgccggcccggcgaagcgggcagaagaggaggggggatgtcggacgcgctgattaacggcctcgcgggcgccggcggcggcatcatcgcccagctcctcaccttcccgctccagaccgtgaacgcgcggcagcagacggagcgcgacccttccaagccggcgtttaaggacggcgccgcgcgccaattatacctggtagtgaagaatgagggatgggagcgcctgtacggcgggctcatgccctcgctcgtcggcaccgccgcctcacagggtgtgtactactacttctaccaaatattccggaacagggccgaggcgaaggctcttgagcgatccaggagagggcttggtgatgggtctgtcgggatgttccaatctctcactgtcgctgccctggctggctgcgtcaatgtactgatcacaaacccaatttgggttgctgttacacgaatgcaaactcacagaaaggcaaacaaacaacaaagccctcagggtttgacatgtgccaatgacaaggctctcaaagcttctacaactgaaaacaccccttacaaaactatggatgtttttcaggaactgtaccaagaatctggagtgtttggcttctggaaaggggtaattccgtctcttatcatggttagcaatcctgcgattcagttcatgctgtatgaaactcttctgaagaggatcaagaagagacgggcctctaagttgaagggagctgatggactaactgctcttgaaatttttcttctcggcgccgttgcaaaacttggtgcaactgtccttacatatcctcttctagttgttaaggcaagacttcaggtgaagcaaagaattgatggtgacaagaggcatcactataaaggtacatttgatgcaatcacgaagctggtacagtatgaaggtctgacaggcatgtataaaggaatgggcacaaaaattgtgcaaagtgtttttgcttctgctatgctttttatgatcaaggaggagctggtgaagggtgctcgactattggttactggtaacaccagtttggttaagaaattaccatcaaagccatcatgatgatctaggtctttgcaagtattagtatatcctgcctataaatcaattattattcacacaattcgtaaacagaatgaacaagctatggagcttgcctctgttaggagatatccaattgtaggttacacaacagctggtatgattcttgttgggaacaaaagctctatatgttcgttagatcatctgtaccatttatgtaaaatgtattatggaagattgacacaataaa

SEQ ID NO: 3226 - DNA, 1500 bp, Oryza sativa
gaaacacggcccgagtctagtcgaccacgccccgcgtccgtcttcccccccaaaacttcagcaaaagcaaacgaagtcttctcagattaattctcgcgtcgtgtcagaccacgctgccgcgggggatctgccgggtggcgaggctgcggagatgtcggacgcgctgatcaacggcgtcgccggcgccggcggcgggatcatcgcccagctcctcacctacccgctccaaaccgtgaacgcgcggcagcagacggagcgcgacccctccaagccggcgttcaaggacggcgccgtccgccagatgtgcctggtggtgaagcatgaagggtgggagcggctgtacggcggcctcatgccctcgcttgttggcactgcggcctcccagggtgtctactattacttctaccagatattccggagcagggcggaggccgcggctctccagcgatccaggagaggaatcggcgatggatccgtcgggatgctccaatccctcactgtcgctgcgctttctggatgtgttaatgtacttctcacaaacccaatttgggtaattgttacacgaatgcaaactcaccggaaggcaaacaaacagcagagtcctctggatttgacgtgtgttcttgacaaggccctacaagctcccgctgttgaaaacatacctcacaagactatccatgttattcaggacctttacaaagaagctggatttttgggcttctggaaaggtgtagttccagctcttattatggttagcaaccctgcaatccaattcatgttgtacgagactcttttgaagaagttgaaaaagagacgtgcctctaatttgaagggagctgatggactgactgctcttgaaattttccttcttggtgctgttgcaaaactgggtgcgactgttgttacatatcctcttctagttgtgaaggcaagacttcaggtgaagcaaataattgatgatgacaagaggcaccgctacaaaggcacatttgatgcgatcacaaagatgatacgttatgaaggtttgtcagggctttataaaggaatgagcacaaaaatcgtacaaagtgtttttgcttctgctctcctttttatgattaaggaggaactggtgaagggcgctcgattattggtaaccggcaacaccagccttgttaagaagttaccatcgaagccattaagatgatctaggttgtacaagagttagttccctacttataccacaattgtttccataaagcgatggacagagttgccaagcgcccctgttaggagatatcaagttatctgtgagactctgatcgactgtaggctctccaaaaaaaggagattaaagatgtagtacaattaccactgtgattcttgtaggaaccaataatgatggtatatattgggtaggctatctctgttgctcgtgtaaagtatactgttatggaagattgaaacactagaaaataagttggcaatgagaatcgcaagcgctagtcatctgttcagatt

SEQ ID NO: 3227 - DNA, 1436 bp, Secale cereale
cgggaggaccacgcctcctcccggccctctctcccacggcaacaatccagcgacgccccgcaagcaagcaaccagcggctgaggcggcgggggtcttcgggaagcccaccacgccgcggcggcgatccaccggggtggcggggcggagatgtcggacgcgctgatcaacggcctcgccggcgccggcggcgggatcgtcgcccagctcctcacctacccccttcagaccgtgaacgcgcggcagcagacggagcgggacccctccaagccggcgttcaaggacggcgccgtccgccagttgtgcctggtggtgcagaacgaggggtgggagcgactctacggcggcctggcgccctcgctcgtcggcaccgcggcctctcagggtgtctactacttcttctaccaaatattccggagcagggcggaggcagcatcccttcggcgatccattagaggaattggggatggatccgtcgggatgttccaatcacttactgtcgctgcactttctggatgcgttaatgtacttctcacgaacccaatttgggtcgttgttacgcgaatgcaaactcacagaaaggcaaacaaacagcaaggccctcaggatcagggtttgacatctgctctcgataaggccctgcaacctgccccagtggaaaacgtccctcataaaactatcaatgttattcaggatctttacaaggaagctggagtgtttggcttctggaaaggggttattccagctcttattatggtcagcaatcccgcaattcagttcatgctgtacgagactcttcttaagaagctgaagaagagacgtgcctctaattttaagggggcccagggaccgactgctattgaagtttttcttctcggagctgttgcaaaactgggtgcaactcttgttacatatcctcttctagttgtgaaggcaagacttcaggcgaagcatatgattgatgatgacaagaggcatcgatacaaaggcacatttgatgcaatcacaaaaatgatgcattatgaaggcctatcagggctttataaaggaatgggcacaaaaatcgtgcagagtgtttttgcttctgctctcctttttatgatcaaggaggagctggtgaaaggtgctcgattcttggtaaccggtgacaccagcctggtaaagaagttgccttcaaagccctcaagatgatctaggtctgcgcagaagtgttagttgctgattatatcataaattgcagacagagtgggcaaaaagagctcgcctctgaggtatcaggttacagatggtagacacaatgggtatgtaaacttgagattatacggtgaccactatgattcttgtaggtactggaaaaaaatatacattggataggatatttaagccattcatgtaatgtaaaatatattcaggaacgttgaatcatcaaaaataagtt

SEQ ID NO: 3228 - DNA, 1751 bp, Triticum aestivum
atgcagacgtctgaacttgaaggggaagcagggcagtaccagtaaagcacgggaccgaaccgaggagaccacgcctcctccgtctctcccactcccacggcagcaatccagcgacgcccggcaagcaaccagcggccgaggcggcgggggcctcgggtcttcgggcagcccaccacgccgcggcggcgatccaccggggtggcggggcggagatgtcggacgcgctgatcaacggcctcgccggcgccggcggcgggatcgtcgcccagctcctcacctaccccctccagaccgtgaacgcgcggcagcagacggagcgggacccctccaagccggcgttcaaggacggcgccgtccgccagttgtgcctggtggtgcagaacgaggggtgggagcgactctacggcggcctggcgccctcgctcgtcggcaccgcggcctctcagggtgtctactacttcttctaccaaatattccggagcagggcggaggcagcatcccttcggcgatccattagaggaattggggatggatccgtcgggatgttccaatcactcactgtcgctgcactttctggatgcgttaatgtacttctcacgaacccaatttgggttgttgtcacacgaatgcaaactcacagaaaggcaaacaaacagcaaggccctcaggatcagggtttgacatctgctcttgataaggccctacaacctgccccagtggaaaacgtccctcataaaactatcaatgttattcaggatctttacaaggaagctggagcgtttggcttctggaaaggggttattccagctcttattatggtcagcaatcccgcaattcagttcatgctgtacgagactcttcttaagaagctgaagaagagacgtgcctctaattttaagggggctcaaggactgactgctattgaagtttttcttctcggagctgttgcaaaactgggtgcaactcttgttacatatcctcttctagttgtgaaggcaagacttcaggcgaagcagatgattgatgatgacaagaggcatcgctacaaaggcacatttgatgcaatcacaaaaatgatgcattatgaaggcctatcagggctttataaaggaatgggcacaaaaattgtacagagtgtttttgcttctgctctcctttttatgatcaaggaggagctggtgaaaggtgctcgattcttggtaaccggtgacaccagcctggtaaagaagttgccttcaaagccctcaagatgatctaggtctgcgcagaagtgttagttgctgattatatatcataaattgcaaacagagtaggcaaaaagagctcgcctctgaggtatcaggttacagatggtagacacaatgggtatgtaaacttgagattatacggtgaccactatgattcttgtaggtactgggataaattacacattggataggatatttaagccattcatgtaatgtaaaatatattcaggaacgttggaacatcaaaaataagttggtagtgagaattgcaactgtctcatgtgctcgggtctcttggttttctttagcttgtgtttgtttcatgaaaggatgtcttgtagtatatctgaaaatcagcaattacttcagcttatcgatattggaaagtatctataacaccagtgagtgagcagtgagcctggtactctagggactagagctgactttggaaactaaagtgtaaactaactacctgataggagaaagaactccagatggaattta

SEQ ID NO: 3229 - DNA, 1503 bp, Avena sativa
ggtacaggatgtagtagtctgaacttggagcaaggggaagcagagcagtacagcacgggaccgaaggagacccgcgcctccgtctctcccacggcaacccaaggaggccggccaagcaacagcgtctgtcttaagttttctggtagcctacgacggccgcggcggcgatccaagggtggcgaggtaggcgcgcgccgcggaggagatgtcggatgcgctgatcaacggcctcgccggcgccggcggcgggatcgtcgcccagctcctcacctaccccctcagaccgtgaacgcgcggcagcagacggagcgcgacccctcaagccggcgttcaaggacggcgccgtccgccagatgtgcctggtggtgaagaacgaggggtgggagcgcctgtacggcggcctggcgccttcactcgtcggcaccgccgcctcccagggtgtctactactacttctccaaatattccggagcaggcggaggcggcgcccgtaggcgcttcattagtggagttggcgatggatccgtcgggatgcttcagtcgctcactgtcgctgcaatttctggatgcgtcaatgtacttctcacaaacccaatctgggttactgttacacgaatgcaaactcacagaaaagcaaacaaacagcaaagccccgagggtttgaattctgctcttgacaaggccatacaaactgccccagctgaaaacatccctcataaaaccatcaatgttattcaggatctttacaaggaagctggagtgttgggcttctggaaaggggttattccagctcttattatggtcagcaatcccgcaatccagttcatgttgtacgagtctcttctgaagaagctgaagaagagacgggcctctaatttgaagggtgctcagggactgactgctcttgaaatttttcttcttggagctgttgcaaaactgggcgcaactcttgttacatatcctctactagttgtgaaggcaagacttcaggcgaagcaaatgattggcgatgacaagaagcatcgctacaaaggcacatttgacgcaatcacaaaaatgatgcgttacgaaggcctgtcagggctttacaaaggaatgggtacaaaaattgtgcaaagtgtttttgcttccgctctcctttttatgatcaaggaggagctggtgaagggtgctcgattgttggtaactggtgacaccagtctggttcagaagctgccttcaaagccctcaagatgatctaggtcttcgcagcagtattagtcgctgattataccataaacggtgaacggggtcggcacctctgttaggaggtataccaagttacaaaatgtaggttctagtgaataatggcgaggcatgaagtcgagattatacaatgaaaactacgattgttgaagcgaccggaaactattggatagggtatttaagatattcatgtaaaatatatttaggaatgttaaacattcaaaataagctctggtaatatgaattgctagtatctaat

SEQ ID NO: 3230 - DNA, 1499 bp, Brachypodium distachyon
agaagtctgaagagtacttcaaggtgggggaaacagagaagagcacgggaccgaaggagaccacgcctcccccgtctccctcccactacgatccaaggaggccagcgaaggccgccggagtccaaaattttcgggtaacctaacgtacagccgcggcgattcacgggctggcgaagcggagcgaagggaagcaggcgcagagatgtcggacgcgctgatcaacggcctcgccggcgccggcggcgggatcgtcgcccagctcctcacctaccccctccagaccgtgaacgcgcggcagcagacggagcgcgacccctccaagccggcgttcaaggacggcgccgtccgccagatgtgcctggtcgtgaggaacgaggggtgggagcgcctgtacagcggcctgccgccctcgctcgtcggcaccgcggcctcccagggtgtctactactacttctaccaaatattccggagcagggcggaggccgcggcccttcggcgatcaattggagggtttggagatggatccgtcgggatgcttcaatcgctcactgtcgctgcactttctggatgcgttaatgtacttctcacaaacccaatttgggttgttgttacacgaatgcaaactcacagaaagactaacaaacagcaaagccctgctcttgacaaggccatacaaactgccccagttgaaaacatccctcataaaactatcaacattattcaggatctttacaaagaagctggagtgttgggcttctggaaaggggttgttccagctcttattatggtcagcaatcccgcaatccagttcatgttgtacgagtctcttttgaagaagctgaagaagagacgtgcctctaatttgaagggggctgatggactgactgctattgaaatttttcttcttggagctgttgcaaaactgggcgcaactcttgttacatatcctcttctagttgtgaaggcaagacttcaggcaaagcaaatgattaccgatgataagaggcatcgctacaaaggcacatttgatgcactcacaaaaatgatgcattatgagggtctatcagggctttacaaaggaatgggcacaaaaattgtgcaaagtgtttttgcttctgctttgctttttatgattaaggaggagctggtgaagggtgctcgcttattggtaaccggtaacaccagtctggttaaaaagttgccttcaaagcagtaaagatgatctaggtctttgcaagtgttactgactgattgtatcataaatcacgaacagagtcagcaaatagagccatttgttaggagagacgttatcaaaatgtaggtcctcaaaaaagaagggggaggtttgaactctaggtttacggtgaccactattgttcttgtcggaaaccggaagattatatagtcaattacatatattgaataggatgtttaagtcactcgtgtaaaacatattcccagatgttgaaaagtcggaaaataagttggtaatgagaggg

SEQ ID NO: 3231 - DNA, 1513 bp, Brachypodium distachyon
aagaagtctgaagagtacttcaaggtgggggaaacagagaagagcacgggaccgaaggagaccacgcctcccccgtctccctcccactacgatccaaggaggccagcgaaggccgccggagtccaaaattttcgggtaacctaacgtacagccgcggcgattcacgggctggcgaagcggagcgaagggaagcaggcgcagagatgtcggacgcgctgatcaacggcctcgccggcgccggcggcgggatcgtcgcccagctcctcacctaccccctccagaccgtgaacgcgcggcagcagacggagcgcgacccctccaagccggcgttcaaggacggcgccgtccgccagatgtgcctggtcgtgaggaacgaggggtgggagcgcctgtacagcggcctgccgccctcgctcgtcggcaccgcggcctcccagggtgtctactactacttctaccaaatattccggagcagggcggaggccgcggcccttcggcgatcaattggagggtttggagatggatccgtcgggatgcttcaatcgctcactgtcgctgcactttctggatgcgttaatgtacttctcacaaacccaatttgggttgttgttacacgaatgcaaactcacagaaagactaacaaacagcaaagccctgctcttgacaaggccatacaaactgccccagttgaaaacatccctcataaaactatcaacattattcaggatctttacaaagaagctggagtgttgggcttctggaaaggggttgttccagctcttattatggtcagcaatcccgcaatccagttcatgttgtacgagtctcttttgaagaagctgaagaagagacgtgcctctaatttgaagggggctgatggactgactgctattgaaatttttcttcttggagctgttgcaaaactgggcgcaactcttgttacatatcctcttctagttgtgaaggcaagacttcaggcaaagcaaatgattaccgatgataagaggcatcgctacaaaggcacatttgatgcactcacaaaaatgatgcattatgagggtctatcagggctttacaaaggaatgggcacaaaaattgtgcaaagtgtttttgcttctgctttgctttttatgattaaggaggagctggtgaagggtgctcgcttattggtaaccggtaacaccagtctggttaaaaagttgccttcaaagcagtaaagatgatctaggtctttgcaagtgttactgactgattgtatcataaatcacgaacagagtcagcaaatagagccatttgttaggagagacgttatcaaaatgtaggtcctcaaaaaagaagggggaggtttgaactctaggtttacggtgaccactattgttcttgtcggaaaccggaagattatatagtcaattacatatattgaataggatgtttaagtcactcgtgtaaaacatattcccagatgttgaaaagtcggaaaataagttggtaatgagagggagtttcgtatgta

SEQ ID NO: 3232 - DNA, 2177 bp, Sorghum bicolor
cgaaccacaccactcgacacctcacctgatcaccctctctctgatctctgacaaaaaccccaaacccctcgacccgacccgcctccacacccatcccacttcccagccgccatggcggcgccgtcccagaccaccgctgccgccacgacccaccaccgcgcgctcctcccgtccccgcgcggcacccgcgccgccgccgcgccctccgccgtccgcctcccgctccgcgcgcagccccacgcccacgcccagcgcgcgcgcctctccgccccggtcgccgccgcggcccccgcggcgtcgacggcctcccccgagtcccccgccgcgggagccgtcgcggggaagcccacggtgctcgtggccgagaagctcggcgccgcggggctcgcgctgctgcgggagttcgccaacgtcgactgctcctacggcctctcccccgaggacctccgcgccaagatctcgctctgcgacgcgctcatcgtcaggtccggcaccaaggtcggccgcgacgtcttcgaggcgtccgggggaaggctccgcgtcgtcggccgcgccggcgtcgggatcgacaacgttgacctcgccgccgccaccgagcatgggtgcctcgtcgtcaacgcgcccaccgctaataccgtcgccgccgccgagcatggtatcgcgctgctcactgccatggccaggaacatcgcgcaggcggacgcctcactcaaggctggtcaatggcagcgcaacaagtatgttggtgtatctcttgtgggaaaaactctcgctattcttggatttggaaaggttggatcagaagttgctcgtcgtgctaaaggcttgggaatgcatgtgattgcacatgatccatatgcttctgctgatcgggctcgtgcaatcggggtcgagctagttagcatggaggaggccatgacaactgctgactttatctcgttacacatgcctcttacgcctgcaacaaacaagatgctcaatgatgaggcctttgctaagatgaagaagggtgttcgcattataaatgttgcacgtggtggtgtaattgatgaagaagctctagtcagagcacttgattcaggaatagtagcacaggctgctcttgatgtgttcactaaagaacccccagcacctgacaacaagttggtactgcacgagaatgttactgtcacacctcaccttggtgctagcacagtggaggcacaggaaggagtggctattgagatagctgaagctgtcattggagctctgaaaggggagcttgcagcttctgcagtcaacgcgccaatggttcctgctgaggtgctgtcagagcttgcaccttttgttgtgcttgcagaaaagcttgggcgcttggctgtgcaactagttgctggtggtggtggtatcaagtctgtgaaagtgacctatgcatctgcacgggcacctgatgatcttgacactagacttctccgtgcaatgatcaccaagggattgattgaaccaatctccagtgtttttgtcaatctggtaaatgctgacttcaccgcaaagcagaggggagttcgcatcaccgaggagaggatcctgttggacggctcacctgagacacctattgattacattcaagttcagattgccaatgtcgagtccaaatttcccagtgcgatatctgagagtggagagatcactgtggaggggagagtgaaggatggtgttcctcatctaacaaaggttggagcattccaggtggatgtgagcttggaaggaagcctgatcctttgcaggcaggttgatcaacctggtatgattgggtcagttggaagtgtcttgggtgaagagaacgtcaatgtcagtttcatgagtgttggaagaattgctcctcgcaagcatgctgtcatggctatcggtgttgatgaggaaccaagcaaggccacgctgacaaagatcggggagattccagcgattgaggagtttgttttcctcaaactctaggcgcaaagcgcaaatgtatgtttgaagttgcaagcatggtgtgcaattttgatgtagctagcaatctagaggacttatggttctccttgaaataagcttttaggagtatttttgtagtggtgctcttgaatttggtgcagtattgctgcctccttttgaacgggggtgtttattaataaaaacttgtctccatatttggctca

SEQ ID NO: 3233 - DNA, 2338 bp, Setaria italica
tcgacacctcacccctccctttcctgaccaaaaccccaaaccccccgacccgagccgccaagcccaacaccatggcggcgccgaccccgaccccgaccgccgccgccgccgccgccgccgccacccaccaccgcatcctcctcccgtccccgcgcggcgccctcgcgcccgccttcctccgcctgcccctccgcgcgcatcagccccaatcccacgcccagcgcgcggcgcgcctccccgccgccccggtcgcggccgcggcccccgcggcgtccaccgcgtcccccgacgcgccgtcctcgggggccgtcccggggaagcccacggtcctcgtcgccgagaagctcggcgccgcggggctcgctctgctgcgggagttcgccaacgtcgactgctcctacggcctctcccccgaggagctccgcgccaagatctcgctctgcgacgcgctcatcgtcaggtccgggaccaaggtcggccgcgacgtcttcgaggcgtccgggggaaggctccgcgtcgtcggccgcgcgggtgtcgggatcgacaacgtcgacctcgccgccgccaccgagcacggatgcctcgtcgtcaacgcgcccaccgctaacaccgtcgccgccgcggagcacggcatcgcgctgctcaccgccatggcaaggaacatcgcgcaggctgacgcgtccctcaaggctggtacatggcagcgcaacaagtatgttggtgtgtctcttgtgggcaaaactcttgctattcttggatttggaaaggtcggttcagaagttgcacgtcgtgctaagggtttaggaatgcacgtgattgcacatgatccgtatgcttctgctgaccgggctcgtgcaattggagtcgagctagttagcatggaggaggccatgacaactgctgacttcatctcactgcacatgcctcttacccctgcaacaaacaagatgctcaacgatgaggccttcgctaagatgaagaagggtgttcgcattattaatgttgcacgtggtggtgtaattgatgaagaagctctggtcagggctcttgattcaggagtagtagcacaggctgctcttgatgtgttcactaaagagcccccagcacctgacaacaagctggtgctgcacgagaatgttactgtcacgccgcacctgggtgccagcacagtggaagcacaggaaggagtggctattgagatagctgaagctgtcattggagctctgaaaggggagcttgcagcttctgcggtcaatgctccaatggttcctgctgaggtgctgtcagagcttgcaccttttgttgtgcttgcagaaaagcttgggcgcctggctgttcaactagtggctggtggtggtggcatcaagtctgtgaaggtgacctatgcatctgcacgggctcctgatgatcttgacacaagacttctccgtgcaatgatcaccaagggattgatcgaaccaatctccagtgtttttgtcaacctggtgaatgctgacttcactgcaaaacaaaggggagttcgcatcaccgaggagagaatcctgttggacggctcaccagagacacctattgattacattcaagttcagatcgccaatgttgagtccaaatttcccagtgcgatatccgagactggagagatcaccgtggaggggagggtgaaggatggcgtccctcatctaacaaaggttggagcgttccaggtagatgtgagcttggaaggaagcctgatcctttgcaggcaggttgatcagcctggcatgattggatcagtaggaagtgtcctgggagaggagaatgtcaatgtcagtttcatgagtgtcggaagactcgctcctcgcaagcatgctgtcatggcaattggtgttgatgaagaaccaagcaagggcacactgacaaggattggggagattcctgcaatcgaagagtttgttttcctgaagctctagacgcaaatgtatgtttgaagttgcaagaatggtgtgcaattttgatgtagttagcgttctagaggacggatggttctcgttggaataagctttctaggggtatttttgtagtgttcatgaatttggtgcagcatcgatgccttcttttgaacgcggtgtttattaataagctctcttctcaatacttgcctgctttgctatgaacatgagcgcgatgttaagcctgcactgtttggtggcctggaagacaggagtttgaaagcgaggattgtacctgatggagtttttagctagtgtttccaaagtcataagaaaataattctgtatatatctatgtactgaaatatcatctggtatgttttgccgagatcagtaatcttcacattcac

SEQ ID NO: 3234 - DNA, 2355 bp, Setaria italica
gcaccaaaaccactcgactcgacacctcacccctccctttcctgaccaaaaccccaaaccccccgacccgagccgccaagcccaacaccatggcggcgccgaccccgaccccgaccgccgccgccgccgccgccgccgccacccaccaccgcatcctcctcccgtccccgcgcggcgccctcgcgcccgccttcctccgcctgcccctccgcgcgcatcagccccaatcccacgcccagcgcgcggcgcgcctccccgccgccccggtcgcggccgcggcccccgcggcgtccaccgcgtcccccgacgcgccgtcctcgggggccgtcccggggaagcccacggtcctcgtcgccgagaagctcggcgccgcggggctcgctctgctgcgggagttcgccaacgtcgactgctcctacggcctctcccccgaggagctccgcgccaagatctcgctctgcgacgcgctcatcgtcaggtccgggaccaaggtcggccgcgacgtcttcgaggcgtccgggggaaggctccgcgtcgtcggccgcgcgggtgtcgggatcgacaacgtcgacctcgccgccgccaccgagcacggatgcctcgtcgtcaacgcgcccaccgctaacaccgtcgccgccgcggagcacggcatcgcgctgctcaccgccatggcaaggaacatcgcgcaggctgacgcgtccctcaaggctggtacatggcagcgcaacaagtatgttggtgtgtctcttgtgggcaaaactcttgctattcttggatttggaaaggtcggttcagaagttgcacgtcgtgctaagggtttaggaatgcacgtgattgcacatgatccgtatgcttctgctgaccgggctcgtgcaattggagtcgagctagttagcatggaggaggccatgacaactgctgacttcatctcactgcacatgcctcttacccctgcaacaaacaagatgctcaacgatgaggccttcgctaagatgaagaagggtgttcgcattattaatgttgcacgtggtggtgtaattgatgaagaagctctggtcagggctcttgattcaggagtagtagcacaggctgctcttgatgtgttcactaaagagcccccagcacctgacaacaagctggtgctgcacgagaatgttactgtcacgccgcacctgggtgccagcacagtggaagcacaggaaggagtggctattgagatagctgaagctgtcattggagctctgaaaggggagcttgcagcttctgcagtcaatgctccaatggttcctgctgaggtgctgtcagagcttgcaccttttgttgtgcttgcagaaaagcttgggcgcctggctgttcaactagtggctggtggtggtggcatcaagtctgtgaaggtgacctatgcgtctgcacgggctcctgatgatcttgacacaagacttctccgtgcaatgatcaccaagggattgatcgaaccaatctccagtgtttttgtcaacctggtgaatgctgacttcactgcaaaacaaaggggagttcgcatcaccgaggagagaatcctgttggacggctcaccagagacacctattgattacattcaagttcagatcgccaatgttgagtccaaatttcccagtgcgatatccgagactggagagatcaccgtggaggggagggtgaaggatggcgtccctcatctaacaaaggttggagcgttccaggtagatgtgagcttggaaggaagcctgatcctttgcaggcaggttgatcagcctggcatgattggatcagtaggaagtgtcctgggagaggagaatgtcaatgtcagtttcatgagtgtcggaagactcgctcctcgcaagcatgctgtcatggcaattggtgttgatgaagaaccaagcaagggcacactgacaaggattggggagattcctgcaatcgaagagtttgttttcctgaagctctagacgcaaatgtatgtttgaagttgcaagaatggtgtgcaattttgatgtagttagcgttctagaggacggatggttctcgttggaataagctttctaggggtatttttgtagtgttcatgaatttggtgcagcatcgatgccttcttttgaacgcggtgtttattaataagctctcttctcaatacttgcctgctttgctatgaacatgagcgcgatgttaagcctgcactgtttggtggcctggaagacaggagtttgaaagcgaggattgtacctgatggagtttttagctagtgtttccaaagtcataagaaaataattctgtatatatctatgtactgaaatatcatctggtatgttttgccgagatcagtaatcttcacattca

SEQ ID NO: 3235 - DNA, 2206 bp, Panicum virgatum
cttcctccgcctgccccaccgcgcgcaggcccacgcccacgcccagcgcgcgcgcctccccgcgcccctcgcggcggcggcgcccgcggcctccaccgcgtcccccgaggcgccggcctcgggggccgtcccggggaagcccacggtgctcgtcgccgagaagctcggcgccgcggggctcgcgctgctgcgcgagttcgccaacgtcgactgctcctacggcctctcccccgaggagctccgcgccaagatctcgctctgcgacgcgctcatcgtcaggtccgggaccaaggtcggccgcgacgtcttcgaggcctccgggggcaggctccgcgtcgtgggccgcgcgggggtcgggatcgacaacgtcgacctcgccgccgccaccgagcacggctgcctcgtcgtcaacgcgcccaccgccaacaccgtcgccgccgcggagcatggcatcgcgctgctcaccgccatggcgaggaacatcgcgcaggccgacgcgtccctcaaggctgataaatggctgcgcaacaagtatgtcggggtatctcttgtgggaaaaactcttgctattcttggattcggaaaggttgggtcagaagttgcacgtcgtgctaaaggtttaggaatgcacgtggttgcacacgatccatatgcttcagctgaccgggctcgtgcaattggagttgagctagttagcatggaggaggccatgacaactgctgacttcatctcattgcacatgcctcttacccctgcaacaaacaagatgctcaacgatgaggccttcgctaagatgaagaagggtgttcgcattattaatgttgcacgtggtggtgtcattgatgaagaagctctagtcagggctcttgattcaggaatagtagcacaggctgctcttgatgtgttcactaaagagccaccagcacctgataacaagctggtgctgcacgagaatgttactgtcacaccgcacctgggtgccagcacagtggaagcacaggaaggagtggcaattgagatagctgaagctgtcattggagctctgaaaggggagcttgcagcttctgcagtcaatgctccaatggttcctgctgaggtactgtcagagcttgcaccttttgtcgtgcttgcagaaaagcttggacgcctagctgttcaactggttgctggtggtggcggtatcaagtctgtgaaggtgacctatgcgtccgcacgggctcctgatgatctcgacacaagacttctccgtgcaatgatcaccaaggggttgattgaaccaatatccagtgtttttgtcaacctggtaaatgctgatttcactgcaaagcagaggggagttcgcatcactgaggagagaatcttgttggacggctcacctgagacgcctattgattacattcaagttcagatcgccaatgtcgagtccaaatttcccagtgccatatctgagactggagagatcactgtagaggggagggtgaaggatggtgtccctcatctaacaaaggttggagcattccaggtagatgtgagcttggaaggaagcctgatcctctgcaggcaggttgatcagcctggcatgattggggcagtaggaagcgtcctgggcgaggagaatgtcaatgtcagtttcatgagtgttggaagaatcgctcctcgcaagcatgctgtcatggcaattggggttgatgaagaaccaagcaagagcacactgaaaaagattggggagattcctgcaatcgaagagtttgttttcctcaagctctaggcgccaaatgtatgtctgaagttgcaagcatggtgtgcaattttgatgtagctagtgatctagaggatggattgttctcgttggaataagctttctaggggtatttttgtagtggtgatcttgaatttggtgcagtatcgatgcgttcaaaataagctttctaggggtatttttgtagtggtgatcttgaatttggtgcagtatcgatgcgttcttttgaacgcagtgtttatcaataagctctcttctgaatattatgcctgctttgctctgaacatgaaggcgatatgcctctgtactgtttgatggcctataagacttgagtctgatagcgaggacttgcaactgacgagtttttagttggtgtttcccaggccgtaagaaaatagttctgtacctactgaaatattatctggtatattttgccgagatctcagt

SEQ ID NO: 3236 - DNA, 2491 bp, Panicum virgatum
aagccgccaagcccaagccccccactggcggcgccgaccccgacccaccgccgccgccaccccaccaccgccactcctcctcccgtccccgtccccgtccccgtccccgcgcggcgccctcgcgcctgccttcctccgcctgccccaccgcgagcaggcccacgcccgcgcccagcgcgcgcgcctccccgcgcccctcgcggccgcggcgcccaccgcatcccccgaggcgccggcctcgggggccgtcccggggaagcccacggtgctcgtcgccgagaagctcggcgccgcggggctcgcgctgctgcgcgagttcgccaacgtcgactgctcctacggcctctcccccgaggagctccgcgccaagatctcgctctgcgacgcgctcatcgtcaggtccgggaccaaggtcggccgcgacgtcttcgaggcctccgggggcaggctccgcgtcgtcggccgcgcgggggtcgggatcgacaacgtcgacctcgccgccgccaccgagcacggctgcctcgtcgtcaacgcgcccaccgcaaacaccgtcgccgccgcggagcatggcatcgcgctgctcaccgccatggcgaggaacatcgcgcaggccgacgcgtccctcaaggctggtaaatggctgcgcaacaagtatgttggggtatctcttgtgggcaaaactcttgctattcttggattcggaaaggttgggtcagaagttgcacgtcgtgctaaaggtttaggaatgcacgtggttgcacacgatccatatgcttcagctgaccgggctcgtgcaattggagttgagctagtcagcatggaagaggccatgacaactgctgacttcatctcattgcacatgcctcttacccctgcaacaaacaagatgctcaacgatgaggccttcgctaagatgaagaagggtgttcgcattattaatgttgctcgcggtggtgtcattgatgaagaagctctagtcagggctcttgattcaggaatagtagcacaggctgctcttgatgtgttcactaaagagccaccagcacctgataacaagctggtgctgcacgagaatgttactgtcacaccgcacctgggtgccagcacagtggaagcacaggaaggagtggctattgagatagctgaagctgtcattggagctctgaaaggggagcttgcagcttctgcagtcaatgctccaatggttcctgctgaggtactgtcagagcttgcaccttttgttgtgcttgcagaaaagcttggacgccttgctgttcaattggttgctggcggtggcggtatcaagtctgttaaggtgacctatgcgtctgcacgggctcctgatgatcttgacacaagacttctccgtgcaatgatcaccaaggggttgattgaaccaatatccagtgtttttgtcaacctggtaaatgctgatttcaccgcaaagcagaggggagttcggatcactgaggagagaatcttgttggatggctcacctgagacgcctattgaatacattcaagttcatatcgccaatgtcgagtccaaatttcccagtgccatatccgagactggagagatcactgtagaggggagggtgaaggatggtgtccctcatctaacaaaggttggagcattccaggtagatgtgagcttggaaggaagcctgatcctctgcaggcaggtcgatcagcctggcatgatcggggcagtaggaagtgtcctgggtgaggagaatgtcaatgtcagtttcatgagtgttggaagaatcgctcctcgcaagcatgctgtcatggcaatcggggttgatgaagaaccaagcaagagcacgctggcaaagattggggagattcctgcaatcgaagagtttgttttcctcaagctctaggcgccagatgtatgtttgaagttgcaagcatggtgtgcaattttgatgtagctagcaatctagaggacggatggttctcgttggaataagctttttaggggtatttttgtagtggtgctcttgaatttggtgcagtatcgatgtgtcttttgaacgtggtgtttatcaataagaagctctcttctgaatatttgctgggtttgctctgaacatgaacgcgatgtgcctgtctgtactgtttggtggtctatgacttgagtctgagagcgaggatttgcagctgacgagtttttagttggtgtttcccaggccataagaaaatagttctgtatctactgaaatattatctggtaaattttgccgagatctcagtaaccttcgcattcacctgccgaaagttggtacccataggttcagcacaagtgatcttctttctctggattcagcacaagtgatctttctctggattcacgcacataatacatgacattacgtagtcgaagcgcctgactactttactggctgctgcactataggattaatttatactatcgatgttgtgtttgaaaggcgtggatttcatttcacgggggaaaaaaccag

SEQ ID NO: 3237 - DNA, 2309 bp, Brachypodium distachyon
ccgaacacccaccgcagaacaacaacaacaagctccgccttctcctctgccaaaaccccaaacaaagccctcggtcccaaggaacccgttctagattccactccacccagccatggcggcgccgtccccgaccaccgccgccgccgcgggcaccaccacgcaccgcagcgtcctcctccccgcctcgcaccaccgcgccgcctcctcgctccgcctccccgtccgcgcccgcgccgcccccggcgcgcgcagcatccgggcctccgccgccaccgcgccccccgccgcgaccgcgtccccgccttcctcggcctccggggccgtggaggggaagccgacggtgctcgtggccgagaagctgggtgcggcggggctggcgctgctgcgggagttcgccaacgtcgactgctcctacgggctctcccccgaggagctccgggccaagatctcgctctgcgacgcgctcatcgtgcggtcgggtaccaaggtgggccgcgacgtgttcgaggcgtccgggggcaggctccgcgtcgtgggccgcgccggcgtcgggatcgacaacgtcgacctcgccgccgccaccgagcacggctgcctcgtcgtcaacgcgcccaccgccaacaccgtcgccgccgccgagcacgggatcgcgctgctcgcgggcatggccaggaacatcgcgcaggcggatgcctcgctcaaggctggtaaatgggcacgcaacaagtatgttggtgtatctcttgttggtaaaaccctcgctatccttggatttggaaaggttgggtcagaagtcgcacgccgtgctaaaggtttaggaatgcatgtgattgcacatgatccatatgcttccgctgaccgtgctcgtgcaattggagttgagctagtaagcatggaagaggctatgacaaccgctgactttatctcattgcatatgccccttacccctgcgacaaacaagatgctcaatgatgaagcctttgctaaaatgaagaagggtgttcggattgtaaatgttgcacgtggtggtgtcattgatgaagaagcacttgtgagggctctcgatgcagggatagttgcacaggctgcccttgacgtgttcactaaagagcctccagcagcagacgacaaattagtgctgcacgaaaatgttactgtgacaccccaccttggtgctagcacagtggaagcacaggaaggagtggctattgaaatagctgaagcagtcactggagctctgagaggggagcttgcagcttctgcggtcaatgcaccaatggttcctgccgaggtgctgtcagagcttgcaccttttgttgtacttgctgaaaagcttgggcgcctagctgtgcaactagtggctggtggtggtggtatcaagtctgtgaaagtgacgtacgcatctgcaagggcacctgatgatctagacacaagacttctccgtgcaatgatcaccaagggggtgatcgaaccaatctccgatgtttttgtcaatcttgttaatgctgacttcactgccaagcagagggggattcgcatcagtgaggagagaatcctgatggatggctcgcctgagacacctcttgatcacattcaagttcagattgccaatgttgagtccaaattccccagtgctatatctgagactggagagatcacagtagagggaaaggtgaaggatggtgtccctcacctaacgaaggttggagcgttcgaggttgatgtgagcatggaaggcagcctgattctttgtaggcaggttgaccaacctggtatgattggttcagttggaagtgtcctgggtgaggagaatgtcaatgtcagcttcatgagtgtcgggagaattgctcctcgcaagcgtgctgtcatggcaattggtgtcgacgaggagcctagcaaggccacactgaccaagattggggagattccggcaattgaagagtttgttttcctcaagctctaggctcatatctatggtgcgaacatgtttgtgcaattttgatgtagctagctaattaatcaggggcctaggggacagatggttgtcgttggaataaggtttttcgtgcgtatttttatggtggtgcccgagtttggtccgtgttttggttaatccacgcacatggtgcaattaataaggagattgctgtcaattcttctctgctttactttctgaacattaacgtgacgatacatggtagtctatgtttgtgctgtcctagatctgttctgcaaggcgccgtgtcacgctagaagttactaactgaagttcgtgctaacagatatgaagttataaagaccatcggggg

SEQ ID NO: 3238 - DNA, 2294 bp, Brachypodium distachyon
gaacacccaccgcagaacaacaacaacaagctccgccttctcctctgccaaaaccccaaacaaagccctcggtcccaaggaacccgttctagattccactccacccagccatggcggcgccgtccccgaccaccgccgccgccgcgggcaccaccacgcaccgcagcgtcctcctccccgcctcgcaccaccgcgccgcctcctcgctccgcctccccgtccgcgcccgcgccgcccccggcgcgcgcagcatccgggcctccgccgccaccgcgccccccgccgcgaccgcgtccccgccttcctcggcctccggggccgtggaggggaagccgacggtgctcgtggccgagaagctgggtgcggcggggctggcgctgctgcgggagttcgccaacgtcgactgctcctacgggctctcccccgaggagctccgggccaagatctcgctctgcgacgcgctcatcgtgcggtcgggtaccaaggtgggccgcgacgtgttcgaggcgtccgggggcaggctccgcgtcgtgggccgcgccggcgtcgggatcgacaacgtcgacctcgccgccgccaccgagcacggctgcctcgtcgtcaacgcgcccaccgccaacaccgtcgccgccgccgagcacgggatcgcgctgctcgcgggcatggccaggaacatcgcgcaggcggatgcctcgctcaaggctggtaaatgggcacgcaacaagtatgttggtgtatctcttgttggtaaaaccctcgctatccttggatttggaaaggttgggtcagaagtcgcacgccgtgctaaaggtttaggaatgcatgtgattgcacatgatccatatgcttccgctgaccgtgctcgtgcaattggagttgagctagtaagcatggaagaggctatgacaaccgctgactttatctcattgcatatgccccttacccctgcgacaaacaagatgctcaatgatgaagcctttgctaaaatgaagaagggtgttcggattgtaaatgttgcacgtggtggtgtcattgatgaagaagcacttgtgagggctctcgatgcagggatagttgcacaggctgcccttgacgtgttcactaaagagcctccagcagcagacgacaaattagtgctgcacgaaaatgttactgtgacaccccaccttggtgctagcacagtggaagcacaggaaggagtggctattgaaatagctgaagcagtcactggagctctgagaggggagcttgcagcttctgcggtcaatgcaccaatggttcctgccgaggtgctgtcagagcttgcaccttttgttgtacttgctgaaaagcttgggcgcctagctgtgcaactagtggctggtggtggtggtatcaagtctgtgaaagtgacgtacgcatctgcaagggcacctgatgatctagacacaagacttctccgtgcaatgatcaccaagggggtgatcgaaccaatctccgatgtttttgtcaatcttgttaatgctgacttcactgccaagcagagggggattcgcatcagtgaggagagaatcctgatggatggctcgcctgagacacctcttgatcacattcaagttcagattgccaatgttgagtccaaattccccagtgctatatctgagactggagagatcacagtagagggaaaggtgaaggatggtgtccctcacctaacgaaggttggagcgttcgaggttgatgtgagcatggaaggcagcctgattctttgtaggcaggttgaccaacctggtatgattggttcagttggaagtgtcctgggtgaggagaatgtcaatgtcagcttcatgagtgtcgggagaattgctcctcgcaagcgtgctgtcatggcaattggtgtcgacgaggagcctagcaaggccacactgaccaagattggggagattccagcaattgaagagtttgttttcctcaagctctaggctcatatctatggtgcgaacatgtttgtgcaattttgatgtagctagctaattaatcaggggcctaggggacagatggttgtcgttggaataaggtttttcgtgcgtatttttatggtggtgcccgagtttggtccgtgttttggttaatccacgcacatggtgcaattaataaggagattgctgtcaattcttctctgctttactttctgaacattaacgtgacgatacatggtagtctatgtttgtgctgtcctagatctgttctgcaaggcgccgtgtcacgctagaagttactaactgaagttcgtgctaacagatatgaagttataa

SEQ ID NO: 3239 - DNA, 2261 bp, Brachypodium distachyon
gcaccgattcagttctccactctctctgaacctgacctcgctataaagaaaagcagaagcgccgccgcacaccaaccgcagtaccgcagccgccgcaccacgacagctccctcggcgccgccctctcccaaacccccaaacaaacccctcgacgccagggaactcaccatggcggcgccgtccccgaccaccgccgcagcagccaccacgcaccaccgcctcctcctccccacctcgcaccgcgccctcgccccttcctcctcctcgctccgcctccccgtccgcgccagcaccaccccgggcgcgcgcatccgcgtctccgctgccaccgcacccgccgccgcggcgtcgaccgcgtccccgccttcctccgcatccggggccgtcgaggggaagcccacggtgctcgtggccgagaagctgggcgccgcggggctggcgctgctccgggagttcgccaacgtcgattgctcctacggcctctcccccgaggagctccgcgccaagatctcgctctgcgacgcgctcatcgtgcggtcggggaccaaggtcggccgcgacgtcttcgaggcctccgggggcaggctccgcgtcgtgggccgcgccggcgtcgggatcgacaacgtcgacctcgccgccgccaccgagcacggctgcctcgtcgtcaacgcgcccaccgccaacaccgtcgccgccgccgagcacgggatcgcgctgctcactgccatggccaggaacatcgcgcaggccgacgcctcgctcaaggctggtaaatgggcgcgcaacaagtatgttggtgtatcccttgttggtaaaactcttgctatccttggatttggaaaggttgggtcagaagtcgcacgtcgtgctaaaggtttaggaatgcaagtgattgcacatgatccatatgcttctgctgatcgtgctcgtgcaattggagttgagctagtaagcatggaagaggctatgacaaccgctgactttatctcattgcatatgccccttacccctgcaacaaacaagatgctcaacgatgaagcctttgctaagatgaaaaagggtgttcggattataaatgttgcacgtggtggtgtaattgacgaagaagctctagtcagagctcttgatgcaggaatagttgcacaggctgctcttgatgtgtttactaaagagcctccaacagcagatgacaaattagtactgcatgagaatgttactgtgacaccacaccttggtgccagcacagtagaagcacaggaaggagtggctattgaaatagctgaagctgtcactggagctctgagaggggagcttgcagcttctgcagtcaatgcaccaatggttcctgctgaggtgctgtcagaacttgcaccttttgttgtacttgcggaaaagctagggcgtctggctgtgcaactagtcgctggtggtggtggtatcaagtctgtgaaagtgacctacgcatctgcaagggcacctgatgatctagacactagacttctccgcgcaatgatcaccaagggtgtgatcgaaccgatctccgacgtttttgtcaatctggttaatgctgacttcactgcaaagcagagggggattcgcatcagtgaggagagaatcctgatggatggcttgcctgagacacctcttgatcacattcaagttcagattgcaaatgttgagtccaaattccccagtgcgatagctgagactggagagatcacagtagagggaaaggtgaaggatggtgtccctcacctaacaaaggttggagccttcgaggttgatgtgagcatggaaggcagcctgattctttgtaggcaggttgaccaacctggtatgattgggtcagttggaagtgtcttgggtgaggagaatgtcaatgtcagcttcatgagtgtcgggagaattgctcctcgcaagcgcgctgtcatggcgattggtgtcgatgaggagcctagcaaggcgacgctgaccaagatcggggagattccggcgatcgaagagtttgttttcctcaagctgtaggggcatatgtatgtttggggttgcaaacatggttgtgcaattttgatgtagctagctaattaattagggacctagggggcagatggttgtcgttggaataaggttttcttagaagatcagggatatctccccggttccattattgaaaatgaaaccaaacaaacccagttcacatgttccagtttaatctccggatttatacataaaaactgaaacgtatactgcctgttggcgaa

SEQ ID NO: 3240 - DNA, 2517 bp, Brachypodium distachyon
tgccgtttggttgtttgctttgagtgaaccagatcgtggcttccatgaggattaagcagttttctcggggcgagcgtttcttgcggccggaggcgagccgatctggtttttctggccccttggggatagcttgccttcaaaagtcaggataaattgacagatcgaaacgctgggccttgctgggctagaccgttgagcttttgcctggaaaccaaacgaaccaacttggtaggtgggtaggttgtgatggaaagctgcaccgattcagttctccactctctctgaacctgacctcgctataaagaaaagcagaagcgccgccgcacaccaaccgcagtaccgcagccgccgcaccacgacagctccctcggcgccgccctctcccaaacccccaaacaaacccctcgacgccagggaactcaccatggcggcgccgtccccgaccaccgccgcagcagccaccacgcaccaccgcctcctcctccccacctcgcaccgcgccctcgccccttcctcctcctcgctccgcctccccgtccgcgccagcaccaccccgggcgcgcgcatccgcgtctccgctgccaccgcacccgccgccgcggcgtcgaccgcgtccccgccttcctccgcatccggggccgtcgaggggaagcccacggtgctcgtggccgagaagctgggcgccgcggggctggcgctgctccgggagttcgccaacgtcgattgctcctacggcctctcccccgaggagctccgcgccaagatctcgctctgcgacgcgctcatcgtgcggtcggggaccaaggtcggccgcgacgtcttcgaggcctccgggggcaggctccgcgtcgtgggccgcgccggcgtcgggatcgacaacgtcgacctcgccgccgccaccgagcacggctgcctcgtcgtcaacgcgcccaccgccaacaccgtcgccgccgccgagcacgggatcgcgctgctcactgccatggccaggaacatcgcgcaggccgacgcctcgctcaaggctggtaaatgggcgcgcaacaagtatgttggtgtatcccttgttggtaaaactcttgctatccttggatttggaaaggttgggtcagaagtcgcacgtcgtgctaaaggtttaggaatgcaagtgattgcacatgatccatatgcttctgctgatcgtgctcgtgcaattggagttgagctagtaagcatggaagaggctatgacaaccgctgactttatctcattgcatatgccccttacccctgcaacaaacaagatgctcaacgatgaagcctttgctaagatgaaaaagggtgttcggattataaatgttgcacgtggtggtgtaattgacgaagaagctctagtcagagctcttgatgcaggaatagttgcacaggctgctcttgatgtgtttactaaagagcctccaacagcagatgacaaattagtactgcatgagaatgttactgtgacaccacaccttggtgccagcacagtagaagcacaggaaggagtggctattgaaatagctgaagctgtcactggagctctgagaggggagcttgcagcttctgcagtcaatgcaccaatggttcctgctgaggtgctgtcagaacttgcaccttttgttgtacttgcggaaaagctagggcgtctggctgtgcaactagtcgctggtggtggtggtatcaagtctgtgaaagtgacctacgcatctgcaagggcacctgatgatctagacactagacttctccgcgcaatgatcaccaagggtgtgatcgaaccgatctccgacgtttttgtcaatctggttaatgctgacttcactgcaaagcagagggggattcgcatcagtgaggagagaatcctgatggatggcttgcctgagacacctcttgatcacattcaagttcagattgcaaatgttgagtccaaattccccagtgcgatagctgagactggagagatcacagtagagggaaaggtgaaggatggtgtccctcacctaacaaaggttggagccttcgaggttgatgtgagcatggaaggcagcctgattctttgtaggcaggttgaccaacctggtatgattgggtcagttggaagtgtcttgggtgaggagaatgtcaatgtcagcttcatgagtgtcgggagaattgctcctcgcaagcgcgctgtcatggcgattggtgtcgatgaggagcctagcaaggcgacgctgaccaagatcggggagattccggcgatcgaagagtttgttttcctcaagctgtaggggcatatgtatgtttggggttgcaaacatggttgtgcaattttgatgtagctagctaattaattagggacctagggggcagatggttgtcgttggaataaggttttcttagaagatcagggatatctccccggttccattattgaaaatgaaaccaaacaaacccagttcacatgttccagtttaatctccggatttatacataaaaactgaaacgtatactgcctgttggcgaa

SEQ ID NO: 3241 - DNA, 2164 bp, Oryza sativa
aagcgccgcacgcacccaccaaagcccacccacatcgccgccgcctcctccttcctcggtttcccccaaaaaccccaaacccctcctcctcctcgccatggcggcgccgtcccagaccaccgccaccaccacccaccaccgcgtcctcctcccgtcccaccaccaccaccgagcggtgcctccctcgctcctccgcctcccgctccgcgccgcgcgccggggccgcctctccgccgccgccgcggccgcggcgcccgccgcgtcgaccgcggcgccgtcggagcccgccgcgggtgccgtaccggggaagccgacggtgctcgtggccgagaagctcggcgccgcggggctcgagctgctccgggggttcgccaacgtggactgctcctacggcctctcccccgaggagctccgcgccaagatcccgctctgcgacgcgctcatcgtgcggtcggggaccaaggtggggcgcgacgtgttcgaggcatccgggggaaggctccgcgtcgtggggcgcgccggggtcgggatcgacaacgtcgatctcgccgccgccaccgagcacgggtgcctcgtcgtcaacgcgcccacggcgaacaccgtcgccgcggccgagcacggcatcgcgctgctcaccgctatgtccaggaacatcgcccaggccgacgcgtcgctcaaggctggtaaatggcagcgcaacaagtatgtgggtgtatctctcgttggtaaaactcttgcaattcttggatttggaaaggttgggtcagaagtcgctcgtcgtgctaaaggtttgggaatgcatgtgattgcacacgatccatatgcttctgctgatcgtgcccatgcaattggagttgagctagtgagcatggaagacgctttgacaactgctgactttatctcgttgcatatgcctcttacccctgcaacaaacaagatgctcaatgatgaaactttcgctaagatgaagaagggtgttagaattataaatgttgcgcgtggtggtgtaattgatgaagatgctctagtcagggctcttgattcaggaatagttgcacaggctgctcttgatgtgttcactaaagagccaccggcaccagacagcaaattagtgctgcatgagaatgttactgtaacaccacaccttggtgccagcacagttgaagcacaggaaggagtggctattgaaatagctgaagctgttattggagctctgaaaggggaacttgcagcttcagcagtcaacgcaccaatggttcctgctgaggtgctgtcagagcttgcaccttatgttgtgctcgcagagaagcttgggcgcctggctgtgcagctagtggctggtggcggtggtatcaagtccgtgaaagtgacctatgcttctgcaagggctcctgatgatcttgacacgagacttcttcgtgcaatgatcaccaaggggttgatcgaaccaatctccagtgttttcgtcaatctggtcaatgctgacttcactgcgaaacagaggggagttcgtatcactgaggagagaatcttgttggatggctcacccgagacacctattgactacatccaagttcatattgcccatgttgagtccaaatttcccagtgcaatatcggagagtggagagatcactgttgaggggaaggtgaaagatggcatcccccatctgacaaaggttggatcattccaggttgatgtaagcttggaaggaagcctgatcctttgcaggcaggtcgatcaacctggtatgatcggcgcagtaggaagtgtccttggtgaggagaatgttaatgtcagtttcatgagtgttggaagaatcgctcctcgcaagcatgccgtcatggcgattggtgttgatgaggaacctaaaaagagcacactgacaaagattggggagattccggcgattgaagaattcgttttcctcaagctctagattcatgcgttgtatgtttgaagctgcaaacatggtgtgcaattttgatgtagctagctatttaatcaggatctagaggactgatggttctcgttggaataagccttttttgggttatggtgctgtttgtcgagtttgatgcagtgtcttgattaatctggcttaggtttgaacatggtgcttattaataagaagccctctgttaatctatgtttactgtgttct

SEQ ID NO: 3242 - DNA, 2127 bp, Triticum aestivum
gcacgaggcagagcccagagccagcccgcactcccctccccaaaaccccaaaccccacccaccatggcggcgccgtccccgaccaccgccgccgccacccaccaccgcgccctcctcccggccccggcccgccgcgcggccctctccctcgcccgcgccagccgcggccgcatctgcgtctccgcgcccgccgcccccgccgcgtcgaccgcgtccccgcccgcgacggccgcggtggccgtcgagggcaagcccacggtgctcgtggccgagaagctcggcgccgcggggctggcgctgctccgggagttcgccaacgtcgactgctcctacggcctctcccccgaggagctccgcgccaagatctcgctctgcgacgcgctcatcgtgcgctccgggaccaaggtcgggcgcgacgtcttcgaggcctcggggggccggctccgcgtcgtcggccgcgcgggggtcgggatcgacaacgtcgatctcgccgccgccaccgagcacggctgcctcgtcgtcaacgcgcccaccgccaacaccgtcgccgccgccgagcacggcatcgcgctgctctgcgccatggcccggaacgtcgcccaggccgacgcctccctcaaggctggcaaatgggcgcgaaccaagtatgttggtgtgtctcttgttggcaaaactcttgctatccttggatttggaaaggtcgggtcagaggtcgcacgccgtgccaagggtctaggaatgcacgtgattgcacacgatccatatgcctctgctgatcgtgctcgcgctattggagttgacctagtaagcatggaagaggccatgacaactgctgactttatctcattgcatatgccccttaccccttcaacaaacaagatgctcaacgatgaagcctttgcgaagatgaagaagggtgttcggattataaatgttgcccgtggtggtgtgattgatgaagatgctctagtcagggctcttgatgcaggaattgttgcacaggctgctcttgatgtgttcactaaggagcctccagcagcagacagcaagttagtgctgcatgagaatgttactgtgacaccacatcttggtgccagcacagtagaagcacaggaaggagtggctattgaaatagctgaagctgtcactggagctctgaaaggggagcttgcagcttctgccgtcaatgcaccaatggttcccgctgaggtgctttcagagcttgcaccttatgtcatgctcgctgaaaagcttgggcgcctagctgtccagcttgttgctggtggtggcggtatcaagtctgtgaaggtgacctatgcatctgcaagggctcccgatgatcttgacacgagacttctccgtgcaatgatcaccaagggtgtgatcgaaccaatctccgacgttttcgtcaatctggtcaacgccgactttaccgcgaagcagaggggcatccgtgtcagcgaggagaaaatcgtgatggatggctcacccgagacacctctcgagtacattcaggttcagatagccaatgtggagtccaaattccccagtgcgatatccgactccggactggtcacggtggaggggcgggtgaaggacggcatccctcaccttaccaaggtcggagcgttcgaggtggacgtgagcatggagggcagcctgatcctgtgcaggcaggtcgaccagcccggcatgatcgggtcggtcggaagcgtcctgggcgaggagaacgtcaacgtcagcttcatgagcgtcgggaggatcgctccccgcaagacggctatcatggcgataggcgtcgatgaggagcccagcaaggccacgctgaccaagatcggggagatccctgcgatcgaagagtttgtcttcctcaagctctaggcgcaatatgtatgtttggatttgaaattttgatgtagctagctggttggttgatcaggggtctagatgtcagatgggtcgtcgtcggtgcaataagtttgttcgtggggattcttgtggtggttgtcgagtttggtttggtattttggttaatccatcttatgtttcagcatgatgctattaattaataaggaggtcgctgtcaattctctctctgctttactttgtgaacatgggcgtggtggt

SEQ ID NO: 3243 - DNA, 1838 bp, Pennisetum glaucum
cccgcctcgggggccgtcccggggaagcccacggtcctcgtcgccgagaagctcggcgccgcgggcctcgccctgctgcgggagttcgccaacgtcgactgctcctacggcctctcccccgaggacctccgcgccaagatctccctctgcgacgcgctcatcgtcaggtccgggaccaaggtcggacgcgacgtcttcgaggcgtccgggggtaggctccgcgtcgtcggccgcgcgggcgtcgggatcgacaacgtcgacctcgccgccgccaccgagcacgggtgcctcgtcgtcaacgcgcccaccgccaacaccgtcgccgccgcggagcacggcatcgcgctgctcaccgccatggccaggaacatcgcgcaggccgacgcggccctcaaggctggtcaatggcagcgcaacaagtatgttggggtgtctcttgtgggcaaaactcttgctatccttggatttggaaaggtcgggtcagaagttgcacgtcgcgctaaaggtttaggaatgcacgtgattgcacacgacccgtatgcttctgctgaccgggcccgtgcaattggagttgagctagtcagcatggaggaggccatgacaactgctgatttcatctcactgcacatgcctcttacccctgcaacaaacaagatgctcaacgatgaggccttcgctaagatgaagaagggtgttcgcattattaatgttgcacgtggtggtgtgattgatgaagaagctctggtcagggctcttgattcaggagtcgtagcacaggctgctcttgacgtgttcaccaaagagcccccagcacctgacagcaagctggtgctgcacgagaatgttactgtcacaccgcatttgggtgcaagcacagtggaagcacaggaaggagtggctattgagatagctgaagctgtcattggagctctgaaaggggagcttgcagcttctgcagtcaatgctccaatggttcctgctgaggtgctgtcagagcttgcaccttttgttgtgcttgcagaaaagcttgggcgcctggctgttcaactagttgctggtggcggcggcatcaagtctgtgaaggtgacctatgcgtctgcacgggctcctgatgatcttgacacaagacttctccgtgcaatgatcaccaagggattgattgaaccaatctccagtgtttttgtcaacctggtgaatgctgacttcactgcaaaacaaaggggagttcgcatcactgaagagagaatcatgttggatggctcaccagagacaccaattgattacattcaagttcagatcgcccatgttgagtccaaatttcccagtgcgatttccgagactggagagattactgtggaggggagggtgaaggatggtgtccctcatctgacaaaggttggagcattccaggtagatgtgagcttggaaggaagcctgatcctttgcagacaggttgaccagcctggcatgatcgggtcagtaggaagtgtcctgggtgaggagaatgtcaatgtcagtttcatgagtgtcggaagaatcgctcctcgcaagcatgctgtcatggcaattggcgttgatgaagagccaagcaagggcacactgacaaagattggggagattcccgcaatcgaagagtttgttttcctcaagctctaggcgcaaaatgtatgtttgaagttgcaaacatggtgtgcaattttgatgtagctagctttaataataagctcgttggaataagctttctagggctatttttgtagtgttcttgaatttggtgcagcagggatgccttttgaacgcggtgttttaataataagctctgtgctgtcttctcaata

SEQ ID NO: 3244 - DNA, 2065 bp, Secale cereale
cgccgtccccgaccaccgccgccgccggccaccacccaccacccgccgtcctcctcccggcctcggcccgccgcgcggccctcgcccggccatccgcgctccgcctcccgcgcgcgcccgcaccaggcggccgcatctgcgtctccgcgcccgcgcccccgccgcgtccaccgcgtccccgcccgcgacggccgcggtggccgtcgagggcaagcccacggtgctcgtggccgagaagctcggcgccgcggggctggcgctgctccgggagttcgccaacgtcgactgctcctacggcctctcccccgaggagctccgcgccaagatctcgctctgcgacgcgctcatcgtgcgctccgggaccaaggtcggccgcgacgtcttcgaggcctccggcggcaggctccgcgtcgtcggccgcgccggcgtcgggatcgacaacgtcgatctcgccgccgccaccgagcacggctgcctcgtcgtcaacgcgcccaccgccaacaccgtcgccgccgccgagcacggcatcgcgctgctctgcgccatggcccggaacgtcgcccaggccgacgcctcgctcaaggctggcaaatgggcgcgcaccaagtatgttggtgtatctcttgttggcaaaactcttgccatccttggatttggaaaggttggatcagaggtcgcacgtcgtgccaaaggtctaggaatgcacgtgattgcacacgatccatatgcttcagccgatcgtgctcgtgcaattggagttgacctagtgagcatggaagaggccatgacaactgctgactttatctcgttgcatatgccccttaccccttcaacaaacaagatgctcaatgatgaagcctttgccaagatgaagaagggtgtacggattataaatgttgcacgtggtggtgtaattgatgaggatgctctagtcagggctcttgatgcgggaatcgttgcacaggctgctcttgatgtgttcactaaggagcctccggcagcagacagcaagttagtgctgcacgagaatgttaccgtgacaccacatcttggtgccagcacagtggaagcacaggaaggagtggccattgaaatagctgaagctgtcaccggagctctgaaaggggagcttgcagcttctgcggtcaatgcaccaatggttcctgctgaggttgctgtcagagcttgcaccttatgttatgctcgcagaaaagcttgggcgcctagctgtccagctagttgctggcggtggcggtatcaagtctgtgaaggtgacctatgcatccgcaagggctcccgatgatcttgacacgagacttctccgtgccatgatcaccaagggtgtgatcgaaccaatctccgatgtctttgtcaatctggtcaatgctgacttcactgcaaagcagaggggcatccgtgtcagcgaggagaaaatcgtgatggacggctcacccgagacacctctcgagtacattcaggttcagatagccaatgtggagtccaaattccccagcgctgtatccgactcgggattggtcacggtagaagggagggtgaaggatggcatcccccaccttaccaaggtcggagcattcgaggtggacgtgagcatggagggcagcctgatcctgtgcaggcaggtcgaccagcccggcatgatcgggtcggtcggaagcgtcctgggcgaggagaacgtcaatgtcagtttcatgagcgttgggaggatcgcgccccgcaagacggccatcatggcgatcggtgttgatgaggagcccagcaagactacgctgaccaagatcggggagatccccgcgatcgaggagttcgtcttcctcaagctctaggcgcatctgtatgtttggatttgaaattttgattgatatagctagctggttggttgatcaggggtcggatgggtcgtcgtcggtggaataagtttgttcgtcggggttcttgtggtgggtgctcgagtttggtttggtgttttggttaatccgccttctgtttcaacatgatgctattaattaataatgagatcgctgtcgatgcctctctgctttactta

SEQ ID NO: 3245 - DNA, 1844 bp, Echinochloa colona
acggtccccgtcgccgagaagctcggcgccgcggggctcgagctgctgcgggagttcgccaacgttgactgctccctacggcctctccccccgaggagctccgcgccaagatctcgctctgcgacgcgctcatcggtcaggtcaggggaccaaggtcggccgcgacgtcttcgagggcgtccgggggcaggctccgcgtcgtcggccgcgcgggcgtcgggatcgacaacgtcgacctcgccgccgccaccgagcacggatgcctcgtcgtcaacgcgcccaccgccaacaccgtcgcggccgcggagcatggcatcgcgctgctcaccgccatgtccaggaacatagcccaggctgacgcgtccctcaaggctggtaaatggctgcggaacaagtatgttggagtatctctcgtgggcaaaactctggctattcttggatttggaaaggttgggtcagaagttgcacgtcgcgctaaaggtttaggaatgcacgtgattgcacatgatccgtatgcttctgctgatcgggctcgtgcaattggagttgagctagttagcatggaggaggccatgacaactgctgacttcatctcattgcacatgcctcttacccctgcaacaaacaagatgctcaacgatgaggccttcgctaagatgaagaagggtgtccgcattataaatgttgcacgtggtggtgtaattgatgaagaagctctagtcagggctcttgattcaggaattgtagcacaggctgctcttgatgtgttcactaaagagcccccagcacctgataacaagctggtgctgcacgagaatgttactgtcacaccgcatctgggtgccagcacagtggaagcacaggaaggggtggctattgagatagctgaagctgtcattggagctctgaaaggggagcttgcagcttctgcagtcaacgctccaatggttcctgctgaggtgctgtcagagcttgcaccatttgttgttcttgcagaaaagcttgggcgcctggctgttcaactagttgctggtggcggtggtatcaagtctgtcaaagtgacctatgcatctgcacgggctcctgatgatcttgacacaagacttctccgtgcaatgatcaccaaggggttgattgaaccaatctccagtgtttttgtcaacctggtaaatgctgatttcactgcaaaacagaggggtgttcgcatcaccgaggagagaatcatgttggacggttcaccagagacccctattgattacatccaagttcagattgccaatgttgagtccaaatttcccagtgcgatatctgagactggagagatcactgtggaggggagggtgaaggatggtgtccctcatctaacaaaggttggagccttccaggtagatgtgagcctggaaggaagcctgatcctttgcaggcaggttgatcagcctggcatgattgggtcagtaggaagcgtccttggcgaggagaatgtcaatgtcagtttcatgagtgtcggaagaatagctcctcgcaagcatgctgtcatggcgatcggtgttgatgaagaaccaagcaagggcacactgaccaagattggggagattcctgcaattgaagagtttgttttcctcaagctctaggcgcaaatgtatgttttaagttgcaagtttggtgtgcaattttgatgtagctagcggtctagaggaaatggttctcgtctgaataagcttatcaggggttttgttgtagtgctgctcttgaactcgtgcagtattgatgccttcttttgaacgcggtgtttattaataagagctcctttctcaatacttcctcctttaccatcaacatcaaca

SEQ ID NO: 3246 - DNA, 1922 bp, Secale cereale
gactcccgcacccagggcggccgcatctgcgtctccgcgcccgccgcccccgccgcgtccaccgcgtccccgcccgcgacggccgcggtggccgtcgagggcaagcccacggtgctcgtgaccgagaagctcggcgccgcggggctggccctgctccgcgagttcgccaacgtcgactgctcctacggcctctcccccgaggagctccgcgccaagatctcgctctgcgacgcgctcatcgtgcgctccgggaccaaggtcggccgcgacgtcttcgaggcctccggcggcaggctccgcgtcgtcggccgcgccggcgtcgggatcgacaacgtcgatctcgccgccgccaccgagcacggctgcctcgtcgtcaacgcccccaccgccaacaccgtcgccgccgccgagcacggcatcgcgctgctctgcgccatggcccggaacgtcgcccaggccgacgcctcgctcaaggctggtaaatgggcgcgcaccaagtatgttggtgtatctcttgttggcaaaactcttgctatccttggatttggaaaggttggatcagaggtcgcacgtcgtgccaaaggtctaggaatgcacgtgattgcacacgacccatatgcttctgctgatcgtgctcgtgcaattggagttgacctagttagcatggaagaggccatgacaactgctgactttatctcgttgcatatgccccttaccccttcaacaaacaagatgctcaacgatgaagcctttgccaagatgaagaagggtgtccggattataaatgttgcacgtggtggtgtaattgatgaagatgctctagtcagggctcttgatgcgggaatcgttgcacaggctgctcttgatgtgttcactaaggagcctccggcagcagacagcaagttagtgctgcacgagaatgttaccgtgacaccacatcttggtgccagcacagtggaagcacaggaaggagtggctattgaaatagctgaagctgtcactggagctctgaaaggggagcttgcagcttctgcggtcaatgcaccaatggttcctgctgaggtgctgtcagagcttgcaccttatgttatgctcgcagaaaagcttgggcgcctagctgtccagctagttgctggcggtggcggtatcaagtctgtgaaggtgacctatgcatccgcaagggctcccgatgatcttgacacaagacttctccgtgccatgatcaccaagggtgtgatcgaaccaatctcggatgtctttgtcaatctggtcaatgctgacttcactgcaaagcagaggggcatccgtgtcagcgaggagaaaatcgtgatggacggctcacccgagacacctctcgagtacattcaggttcagatagccaatgtggagtccaaattccccagcgctgtatccgactcgggattggtcacagtagaggggagggtgaaggatggcatcccccaccttaccaaggtcggagcattcgaggtggacgtgagcatggagggcagcctgatcctctgcaggcaggtcgaccagcccggcatgatcgggtcggtcgggagcgtcctgggcgaggagaacgtcaacgtcagcttcatgagcgtcgggaggatcgctccccgcaagacggctatcatggcgattggcgttgatgaggagcccagcaagactacgctgaccaagatcggggagatccccgcgatcgaggagtttgtcttcctcaagctctaggcgcatctgtatgtttggatttgaaattttgattgatgtagctagctggttggttgatcaggggtctaggtgtcggatgggtcgtcgtcggtggaataagtttgttcgtcagggttcttgtggtgggtgctcgagtttggtttggtgttttggttaatccgccttctgtttcaacatgatgctattaa

SEQ ID NO: 3247 - DNA, 1836 bp, Avena sativa
cgccctcctccgccgcggttgccgtcgagggcaagcccacggtcctcgtcgccgagaagctcggcgccgcggggctcgcgctgctgcgggagttcgccaacgtcgactgctcctacggcctctcccccgaggagctccgcgccaagatctcgctctgcgacgcgctcatcgtgcgctccgggaccaaggtcggccgcgacgtcttcgaggcctccggcggcaggctccgcgtcgtgggccgcgcgggggtcgggatcgacaacgtcgatctcgccgccgccaccgagcacgggtgcctcgtcgtcaacgcgcccaccgccaacactgtcgccgccgccgagcacgggatcgcgctgctctgcggcatggccaggaacatcgcccaggccgacgcctcgctcaaggctggtaaatgggcacgcaacaagtacgttggtgtatcccttgttggcaaaactctcgctatccttggatttgggaaggtcgggtcggaagttgcacgccgtgctaaaggtcttggaatgcacgtgattgcacatgatccatatgcttctgctgatcgtgctcgcgcaattggagttgagctagtaagcatggaagaggccatgacaactgctgactttatctcactgcatatgccccttacccctgcaacgaacaagatgctcaacgatgaaacctttgctaagatgaagaagggtgttcggattataaatgttgcccgtggtggtgtgattgatgaagatgctctagtcagggctcttgatgcgggaatagttgcacaggctgctcttgatgtgtttaccaaggagcctccagcagcagacagcaagttggtgctgcatgagaatgttactgtgacaccacatcttggtgccagcacagtagaagcacaggaaggagtggctattgaaatagctgaagctgtaactggagctctgaaaggggagcttgcagcttctgcggtcaatgcaccaatggttcctgctgaggtgctatcggagcttgcaccttttgttgtgcttgctgagaagcttgggcgcctagcggtccaactagttgctggcggtggcggtatcaagtctgtgaaggttacctatgcatctgcaagggctcctgatgatcttgacacaagacttctccgtgcaatgataaccaagggtgtgatcgagccaatctctgatgtttttgtcaatctggtcaatgctgacttcactgcaaagcagaggggcattcgcatcagcgaggagagaatcttgatggacggctcacctgagacacctctggattacattcaggtacagattgccaatgtggaatccaaattccccagtgcgatatcagagtctggagagatcacggtagaggggaaggtgaaggacggtgtgcctcacctaacaaaggtgggagcattcgaggtagatgtgagcatggagggcagcctgatcctctgcaggcaggttgaccaacctggcatgattggggcagttggaagcgtcttgggcgaggagaatgtcaatgtcagcttcatgagcgtcgggaggatcgctcctcgcaagcgcgctgtcatggcgattggtgttgatgaggagcctagcaaggccacgctgaccaagatcggcgagatcccagcgatcgaggagtttgtcttcctcaagctctaggcgcatatgtatgttaggggatgcaaaacatggttgtgcaattttgatgtagctaggtgtttaatcaggggtctagaggacagatggttgtcgttggaataaggttttctttgtgtatctttgtggtcgtgctcttgggtttgggtttgggtttaggtttggttcggtattt

SEQ ID NO: 3248 - DNA, 2120 bp, Secale cereale
gactcgtcacgacaccctaccacagagcccagaccgcactacccacccccaaaaaccccaaaccccaccatggcggcgccgtccccgacaccgccgccgcggccaccacccaccaccgcgtcctcctcccggcctcggcccgccgcgcggccctcgcccggccgtccgcgctccgcctccccgcgcgcgcccgcacccagggcggccgcatctgcgtctccgcgcccgccgcccccgccgcgtccaccgcgtccccgcccgcgacggccgcggtggccgtcgagggcaagcccacggtgctcgtggccgagaagctcggcgccgcggggctggccctgctccgcgagttcgccaacgtcgactgctcctacggcctctcccccgacggagctccgcgccaagatctcgctctgcgacgcgctcatcgtgcgctccgggaccaaggtcggccgcgacgtcttcgaggcctccggcggcaggctccgcgtcgtcggccgcgccggcgtcgggatcgacaacgtcgatctcgccgccgccaccgagcacggctgcctcgtcgtcaacgcgcccaccgccaacaccgtcgccgccgccgagcacggcatcgcgctgctctgcgccatggcccggaacgtcgcccaggccgacgcctcgctcaaggctggtaaatgggcgcgcaccaagtatgttggtgtatctcttgttggcaaaactcttgctatccttggatttggaaaggttggatcagaggtcgcacgtcgtgccaaaggtctaggaatgcacgtgattgcacacgatccatatgcttcagccgatcgtgctcgtgcaattggagttgacctagtgagcatggaagaggccatgacaaccgctgactttatctcgttgcatatgccccttaccccttcaacaaacaagatgctcaacgatgaagcctttgccaagatgaagaagggtgttcggattataaatgttgcacgtggtggtgtaattgatgaagatgctctagtcagggctcttgatgcgggaatcgttgcacaggctgctcttgatgtgttcactaaggagcctccggcagcagacagcaagttagtgctgcacgagaatgttaccgtgacgccacatcttggtgccagcacagtggaagcacaggaaggagtggctattgaaatagctgaagctgtcaccggagctctgaaaggggagcttgcagcttctgcggtcaatgcaccaatggttcctgctgaggtgctgtcagagcttgcaccttatgtcatgctagcagaaaagcttgggcgcctagctgtccagctagttgctggcggtggcggtatcaagtctgtgaaggtgacctatgcatccgcaagggctcccgatgatcttgacacgagacttctccgtgccatgatcaccaagggtgtgatcgaaccaatctccgatgtctttgtcaatctggtcaatgctgacttcactgcaaagcagaggggcatccgtgtcagcgaggagaaaatcgtgatggatggctcacccgagacacctctcgagtacattcaggttcagatagccaatgtggagtccaaattccccagcgctgtatccgactcgggattggtcacggtagaggggcgggtgaaggatggcatcccccaccttaccaaggtcggagcattcgaggtggacgtgagcatggagggcagcctgatcctctgcaggcaggtcgaccagcccggcatgatcgggtcggttggaagcgtcctgggcgaggagaacgtcaacgtcagcttcatgagcgtcgggaggatcgcgccccgcaagacggctatcatggcgatcggcgttgatgaggagcccagcaagactacgctgaccaagatcggggagatccctgcgatcgaggagttcgtcttcctcaagctctaggcgcgtctgtatgtttggatttgaaattttgattgatgtagctagctggttggttgatcaggggtctaggtgtcggatgggtcgtcgtcggtggaataagtttgttcgtcggggttcttgtggtgggtgctcgagtttggtttggtgttttggttaatcagccttctgtttcaacatgatgctattaattaataatgaga

SEQ ID NO: 3249 - DNA, 3154 bp, Cocos nucifera
ggaggaggagcagcggcagccgccgccgccctcccccgtcttcccctccgccgcagcggccgccttgtcttcgtctccgcgcagcacggcggcgtaggcgccaagcccacggtcctagtcgcggagaagctcggcgaggccggtctcgagctgctcaaggatttcgccaacgtcgactgctcctataacctcagccccgaggagctctgcaccaagatctcgctgtgtgatgccttgattgtccgcagcggcaccaaggtcggccgcgaggtcttcgagtccgctagcggccgcctccgggtggtcggccgcgccggggttggcatcgacaacgtcgatcttgccgccgccaccgagcatggttgtcttgttgtgaatgcccccacggctaacacggttgctgctgccgagcatgggattgctctgctcactgccatggctcgaagcattgctcaggctgatgcctcccttaaagctggtaagtggcagcgcagcaaatatgttggtgtatcacttgttgggaaaacacttgctgtattgggatttggaaaggttggatcggaagttgcacggcgtgctaaagggctgggaatgcatgtgattgcacatgatccatatgccgctgcagaccgtgctcgtgctatcggagtggagttggtaaccttcaatgaagccatttcaaccgctgacttcatttcactgcatatgcctcttactccttccacatccaagattcttaatgatgaagcttttgcaaaaatgaagaaaggagtacgaattgtaaatgttgctcgtggtggtgttattgatgaagaagctctagtcagagcccttgattctggcattgtggcacaggctgctctcgatgtcttcactgaagagcctccatctgctgacaacaaattagtgctgcatgaaaatgtaactgtaacaccacatcttggtgccagcacaatggaagcacaggaaggagtagccatcgaaatagctgaagctgttgtgggtgccttgaaaggggaacttgctgctactgcagtaaatgcaccaatggttcctgctgaggtcctctcagagctagcaccatttgtggtattggcagaaaagctaggcaggcttgccgtccagcttgtggccggaggtagtggagtgaaattagtgaaggtgacctacgcatctgccagaggtcctgatgatcttgacactagggtacttcgtgccatgatcacgaagggtctgattgagcccatctctagtgtgtttgtaaatcttgtgaatgctgatttcacagccaaacaaagggggatccgcattgcagaagagagaattgtgttggatggctcacctgagaaccctttagaattcatacaggttcagattgccaatgtggagtcgaagtttgcaagtgcaatgtctgagactggagaaataagggtggaagggagagtaaaggatgggatacctcatctaaccaaggttggatcattccaagtggatgtaagcgtggaaggaagcttgattctctgcaggcaggttgatcagccagggatgattgggacagtggggaccatcttgggtgagcagaatataaatgttagttttatgagtgttggaagggttgcccctcggaagcatgcagttatggcaatcggtgttgatgaggagccagacaaagaaactctaactaagattggggagataccagccattgaagaatttgttttcctcaagctttagcaaagccattgccatcttcagcaattccaaccccaattttgatgctcagcaacttatggtagtaatctagagtatttcagagaactcggaataaattagttacattctcaggcttttcttagtggtgttggatgcaaaccttcactttgattgtgtttgctgttaattgaatgagcatgtgtcattcaatactagcgtacttcatcatattttcatgcagaatgcttttgtaattctgaaatccttgattttgatgtttgatacaaaagccatggacctcatctggaccttcgaggacctagaatggtttccatttgagctgaagttcacagttaatgaaccattgagacagctggggaccgaacaacatttcaatgagattgatgaatttgttgagaactcgatctttgaactcgatattcctagtgaacctgcccgtactggtgagtgatcccgggtggtgctggaggaccgggagcagctgcctggccatgaacgccaggcttgctggtcatcattcttctgccagtgacatccgctgcacctcttcaccacttccactcactggttccatcttcagttttcaagtgtcagcaggaaagttttgtttatcatgatgttattccaattctgtatcctttctgatatctgttctgcactatatttctccaaagaagttcattgctctaggatataagagatgtttgggtaaacaactgtgacaatgctgaggccaagaaacatgaaacttctcctgtggtatttgtgcttctcccaattcactacatgcaggcctcactttatagtcaccagtgtatgatgcatgaagaggtgtcttggatgctgctctcaatcagcattagcaagaagatcattcgctagtcctcttcatccctttttcaattgttccggcctgtggttgttgttcgatcggtgcggccgacttgtttttcgtgatgaggaaggcaatttgtacttcagtgtgaacaactttctggggatctcgccgctcatggttgccctcatttggttggtattgttttttgtgacgaggaaggcatgatgcattcgagtatgatcaacttgctgcggatcttcactgcaggcaattgagtcttttcttgaagaaaccttggaagccattcctgactctgtttctgtggattggcaagggaattttgccgatattgatgatgtgttacctccatataaatcaagaggacagcaatcggtgagtgctgatgatcctgtagaattatcagtttgtctgtgcatgtcaaatttaacatttgatccaccagcaaatgtcaagcttgcatttgtatgttaaattttgtatcgtccaatcatttgaaatgccggcaacggtgtaaacaaagatcgtactctgggtacattgccgtaggtattgtcaccgaac

SEQ ID NO: 3250 - DNA, 2020 bp, Cocos nucifera
cgccgccgccctcccccgtcttcccctccgccgcagcggccgccttgtcttcgtctccgcgcagcacggcggcgtaggcgccaagcccacggtcctagtcgcggagaagctcggcgaggccggtctcgagctgctcaaggatttcgccaacgtcgactgctcctataacctcagccccgaggagctctgcaccaagatctcgctgtgtgatgccttgattgtccgcagcggcaccaaggtcggccgcgaggtcttcgagtccgctagcggccgcctccgggtggtcggccgcgccggggttggcatcgacaacgtcgatcttgccgccgccaccgagcatggttgtcttgttgtgaatgcccccacggctaacacggttgctgctgccgagcatgggattgctctgctcactgccatggctcgaagcattgctcaggctgatgcctcccttaaagctggtaagtggcagcgcagcaaatatgttggtgtatcacttgttgggaaaacacttgctgtgttgggatttggaaaggttggatcagaagttgcacggcgtgctaaagggctagggatgcatgtgattgcacatgatccatatgctgctgcagaccgagctcgtgcaataggagtggagttagtaacctttgatgaagctattttggctgctgacttcatttcattgcatatgcctcttactccttccacatccaagattctcaatgatgaggcttttgcaaaaatgaaaaaaggagtacgaattgtaaatgttgctcgcggtggtgtcattgatgaagaagctctagtcagggcccttgattctggcattgtcgcacaggctgctctcgatgtcttcacagaagagcctccatctgctgaccacaagttagtgctgcatgaaaaagtaactgtgacaccgcatcttggtgccagcacgatggaagcacaggaaggagtagccattgaaatagctgaagctgttgtgggtgccttgaaaggcgagcttgctgctactgcagtaaatgcaccaatggttccagctgaggtcctctcagagcttgcaccatttgttgtattggcagaaaagcttggcaggcttgctgtccagcttgtggctggaggtagtggagtgaaatcggtgaaggtgacctatgcatcggccagagctcctgatgatcttgacactaggcttcttcgtgccatgatcaccaagggcctgattgagcccatatctagcgtgtttgtaaatcttgtaaatgctgatttcacagccaagcaaagaggggtccgcattacagaggagagaattgtgttggatggttcacctgagaaccctctagaattcatacaggtccagattgccaatgtggagtcgaagtttgcaagtgcaatgtctgagactggagaaataagagtcgaagggagggtaaaggatgggatacctcatctgaccaaggtaggatcattccaagtggatgtaagcttggagggaagtctgatcctctgcaggcaggttgatcagccagggatgattgggaccgtggggagcatcttgggcgagcggaatgtaaatgttagttttatgagtgttggaaggattgccccacggaagcatgcagtcatggcaatcggtgttgatgaggagccaaacaatgaaaccctgaagaagattggggagataccagccattgaagaatttgttttcctcaagctctaaggaaatcattgccgtcttcagcaatcacaacccccaattttgatgcaaggcaacttatggtagtaagctagagtatctcagagaacttgggaaaaattaattaagttgtcaggattttattagtattattagatacaaccctccatttggattggttatttgattaaacatgtatgcgagtccgagtactgtactttatcatatatgcatatggaatgttttttgtagtttctgaaatcctagtgtatacatcagtggaagaaaaatgatagcggttttagttctctagcgcgttacttggtttac

SEQ ID NO: 3251 - DNA, 3135 bp, Cocos nucifera
ccgccgccgccctcccccgtcttcccctccgccgcagcggccgccttgtcttcgtctccgcgcagcacggcggcgtaggcgccaagcccacggtcctagtcgcggagaagctcggcgaggccggtctcgagctgctcaaggatttcgccaacgtcgactgctcctataacctcagccccgaggagctctgcaccaagatctcgctgtgtgatgccttgattgtccgcagcggcaccaaggtcggccgcgaggtcttcgagtccgctagcggccgcctccgggtggtcggccgcgccggggttggcatcgacaacgtcgatcttgccgccgccaccgagcatggttgtcttgttgtgaatgcccccacggctaacacggttgctgctgccgagcatgggattgctctgctcactgccatggctcgaagcattgctcaggctgatgcctcccttaaagctggtaagtggcagcgcagcaaatatgttggtgtatcacttgttgggaaaacacttgctgtgttgggatttggaaaggttggatcagaagttgcacggcgtgctaaagggctagggatgcatgtgattgcacatgatccatatgctgctgcagaccgagctcgtgcaataggagtggagttagtaacctttgatgaagctattttggctgctgacttcatttcattgcatatgcctcttactccttccacatccaagattcttaatgatgaagcttttgcaaaaatgaagaaaggagtacgaattgtaaatgttgctcgcggtggtgtcattgatgaagaagctctagtcagggcccttgattctggcattgtcgcacaggctgctctcgatgtcttcacagaagagcctccatctgctgaccacaagttagtgctgcatgaaaaagtaactgtgacaccgcatcttggtgccagcacgatggaagcacaggaaggagtagccattgaaatagctgaagctgttgtgggtgccttgaaaggcgagcttgctgctactgcagtaaatgcaccaatggttccagctgaggtcctctcagagcttgcaccatttgttgtattggcagaaaagcttggcaggcttgctgtccagcttgtggctggaggtagtggagtgaaatcggtgaaggtgacctatgcatcggccagagctcctgatgatcttgacactaggcttcttcgtgccatgatcaccaagggcctgattgagcccatatctagcgtgtttgtaaatcttgtaaatgctgatttcacagccaagcaaagaggggtccgcattacagaggagagaattgtgttggatggttcacctgagaaccctctagaattcatacaggtccagattgccaatgtggagtcgaagtttgcaagtgcaatgtctgagactggagaaataagagtcgaagggagggtaaaggatgggatacctcatctgaccaaggtaggatcattccaagtggatgtaagcttggagggaagtctgatcctctgcaggcaggttgatcagccagggatgattgggaccgtggggagcatcttgggcgagcggaatgtaaatgttagttttatgagtgttggaaggattgccccacggaagcatgcagtcatggcaatcggtgttgatgaggagccaaacaatgaaaccctgaagaagattggggagataccagccattgaagaatttgttttcctcaagctttagcaaagccattgccatcttcagcaattccaaccccaattttgatgctcagcaacttatggtagtaatctagagtatttcagagaactcggaataaattagttacattctcaggcttttcttagtggtgttggatgcaaaccttcactttgattgtgtttgctgttaattgaatgagcatgtgtcattcaatactagcgtacttcatcatattttcatgcagaatgcttttgtaattctgaaatccttgattttgatgtttgatacaaaagccatggacctcatctggaccttcgaggacctagaatggtttccatttgagctgaagttcacagttaatgaaccattgagacagctggggaccgaacaacatttcaatgagattgatgaatttgttgagaactcgatctttgaactcgatattcctagtgaacctgcccgtactggtgagtgatcccgggtggtgctggaggaccgggagcagctgcctggccatgaacgccaggcttgctggtcatcgttcttctgccagtgacatgcgctgcacctcttcaccacttccactcactggttccatcttcagttttcaagtgtcagcaggaaagttttgtttatcatgatgttattccaattctgtatcctttctgatatctgttctgcactatatttctccaaagaagttcattgctctaggatataagagatgtttgggtaaacaactgtgacaatgctgaggccaagaaacatgaaacttctcctgtggtatttgtgcttctcccaattcactacatgcaggcctcactttatagtcaccagtgtatgatgcatgaagaggtgtcttggatgctgctctcaatcagcattagcaagaagatcattcgctagtcctcttcatccctttttcaattgttccggcctgtggttgttgttcgatcggtgcggccgacttgtttttcgtgatgaggaaggcaatttgtacttcagtgtgaacaactttctggggatctcgccgctcatggttgccctcatttggttggtattgttttttgtgacgaggaaggcatgatgcattcgagtatgatcaacttgctgcggatcttcactgcaggcaattgagtcttttcttgaagaaaccttggaagccattcctgactctgtttctgtggattggcaagggaattttgccgatattgatgatgtgttacctccatataaatcaagaggacagcaatcggtgagtgctgatgatcctgtagaattatcagtttgtctgtgcatgtcaaatttaacatttgatccaccagcaaatgtcaagcttgcatttgtatgttaaattttgtatcgtccaatcatttgaaatgccggcaacggtgtaaacaaagatcgtactctgggtacattgccgtaggtattgtcaccgaac

SEQ ID NO: 3252 - DNA, 2300 bp, Elaeis guineensis
ccgcaggctcaaaccccagccccactcaccaaccccgaaatcggattccccggatccctaaacccctgctcctgctccttctcctctctctataaataccacagaagcgtcccgtgctctgctcacagactataacacagcgaaaaaagcgagtccaaaataagtaaagaatggcggcgtccactgctccatccaacctcatctcctccccatccctccaccccccctcctccctctcccgccgcctccttcaccccgccgccgccgccctcccccgccttcccctccgccgcagcggccgccttgtcttggtcgccgcccagcacggtggtgtaggcgccaagcctacggtcctagtcgcggagaagctcggcgaggccggtcttgagcttctcaaggatttcgccaacgtcgactgctcctataacctcagccccgaggagctctgcaccaagatctcgctgtgtgatgccttgattgtccgcagcggcaccaaggtcgtccgcgaggtcttcgagtcctctggcggccgcctccgggtagtcggccgcgccggggttggcatcgacaacgttgatcttgccgccgccaccgagcatggttgtcttgttgtgaatgcacccacggctaacacggttgctgctgccgagcatgggattgctctgctcactgccatggcccgaaacattgctcaagctgatgcctcccttaaagctggtaagtggcagcgcagcaaatatgttggtgtatcacttgttgggaaaacacttgctgtgttgggatttggaaaggttggatcagaagttgcacggcgtgctaaagggctaggaatgcatgtgattgcacacgatccatatgctgctgcagaccgagctcgtgctataggagtggagttagtaacctttgatgaagctatttcagccgccgacttcatttcattgcatatgcctcttactctttccacatccaagattctcaatgatgatgcttttgcaaaaatgaagaaaggagtacgaattgtaaatgttgctcgtggtggtgtcattgatgaagaagctctagttagggcccttgattctggcattgttgcacaggctgctctcgatgtcttcacagaagagcctccatctgctgaccacaagttagtgctgcatgaaaaagtaactgtgacaccgcatctgggtgccagcacgatggaagcacaggaaggagtagccattgaaatagctgaagctgttgtgggtgccttaaaaggcgagcttgctgctactgcagtaaatgcaccgatggttccggctgaggtcctctcagagcttgcaccatttgttgtgttggcagaaaaacttggcaggcttgctgtccagcttgtggctggaggtagtggagtgaaatcggtgaaggtgacgtatgcatccgctagagctcctgatgatcttgacactaggcttcttcgtgccatgatcaccaagggcttgattgagcccatatctagcgtgtttgtaaatcttgtgaatgctgatttcacagccaagcaaagaggggtccgcattacggaggagagaattgtgttggatggttcacctgagaaccctctagaattcatacaggttcagattgccaatgtggagtcgaagtttgcgagtgcaatgtctgagactggagaaataagagttggagggagggtaaaggatgggatacctcatctgaccgaggtaggatcattccaagtggatgtaagcttggagggaagtctgatcctgtgcagacaggttgatcagccagggatgatcgggaccgtggggagcatcttgggcgagcagaatgtaaatgttagttttatgagtgttggaaggattgccccacggaagcatgcagttatggcaattggtgttgatgaggagccaaacaaagaaaccctgaaaaagattggagagataccagccattgaagaatttgttttcctcaagctctagtgaaatcattgccatcttcagcaatcacaacccccaattttggtgcaaggcaacttatggtagctcgcttgagtatttcagagaactcgggaaaaaataattaagttgtcgagattttattaatattattagatgcaacctccatttggattggttatttgattagacatgtgtgcgagtccgaataccgtattttatcatatttgcatgagaaatattttttctagtttctgaaatcctagtgtatacatcagtggagaaaaatgatagcggttttagttctctagtgaaaaaaaaaaaactaagtagactagtcaacgacgaacc

SEQ ID NO: 3253 - DNA, 1827 bp, Amorphophallus konjac
ccgacctcgccctcgtccatgaggctgtctgcgccggccgcctcgtccctcccctcctccctctcccgccgcatctccttccaccccgcggtcctcgtcacccggcgtgccggggcgcgccggggccgcctggtggtcatggcggcggcggggggcgggatggacgcgaagccgacggtgctggtggcggagaagctcggggaggccgggctggagctcctcaaggggttcgccaacgtggactgcacctacaaccttacgcaggaggagctctgcaccaagatctccctctgcgacgccctcatcgtgcgcagcggcaccaaggtcgggcgcgaggtcttcgagtcctccggcgggcgcctccgggtcgtcggccgcgccggggtcgggatcgacaacgtcgacctcgccgccgccaccgagcacggctgcctcgtcgtcaacgcgcccacggctaacacggtcgccgccgccgagcacggcatcgccctgctcgccgccatggcgcgcaatattgcccaggccgacgcttctctgaaagctggaaattggcaacggaataagtatgttggtgtttcacttgttggtaaaacacttgctgttatgggatttggaaaggttgggtctgaagttgcaaggcgtgccaagggcttgggaatgcatgtgattgcacatgatccatatgctgctgcagaccgggctcgcgcaataggagtcgcccttgtaacatttgatgaagccatatcgactgcagatttcatctcgttgcacatgcctcttacgccatcaacattgaagatccttaatgatgaagcttttgcaaaaatgaagaagggtgtgcgaattgtcaatgtggcccgtggtggggttattgatgaggatgctctggtcagagcactagactctggaatggttgctcaggctgcccttgatgttttcactgaggaacctccagctccagacaacaagctggttttgcatgaaagagtgactgtgacaccacatctgggcgccagtaccatggaagcacaggaaggtgtggcaattgaaatagccgaggctgttgttggagccttaaagggggagcttgctgctaccgctgtgaatgcaccaatggtacctgccgaggttctctctgagctagcaccatttgttgtactggcagagaagcttggcagattggctgtacaacttgtggcagggggcagcggcgtgaaatcggtgaaagtgacatatgcctctgcaagggcgcctgatgatctcgacaccaggcttctccgagccatgataaccaagggtctgatcgaacctatatccagcgtgttcataaatcttgttaatgccgacttcactgccaaacaaagaggtgttaggatcaccgaggagaggatactgctcgatggatctcctgagaaccctctggattacatacgggttcaaattgcaaacgtggagtctaaatttgccagtgccatgtcagattctggggagatcacagtggaaggtagggtgaagggcggggtaccttatctaaccaaggcaggatctttccaagtggatatcagcttggaaggtagcatcattctctgcaggcaggttgatcagcctgggatgatcgggaaagttgggagcatcttagccgagcaaaatgtgaacgtgagcttcatgaccgtcgggaggatcgccccaaggaagcacgccgtcatggcaatcggcgtggatgatgagcctacaaaggaaccctgaagaaattgggaaatatcagccattgaagagtttgtgttcctcaaactgtagcggcatgttgcaatcatcatcagttttgac

SEQ ID NO: 3254 - DNA, 1841 bp, Sorghum bicolor
cattttcttttgtaatgtatgatcgatgtggttttagaaaagccaagatccatcatgcctagaagatggggatctcctgttgctaattaagcaataagacacgacaagcttctttgtcccctccgtgcgctgtcttgtgtgtctctctcactctcaccaagtctagctagtctagtctagtcctacattacactagctagctctccctagcacagcgagcagcacagccacgcacagcggtcagtcgcctcgaggagcttgtcgagagcgcgaccgcgaggaggagggagcatcaagcaagcaagcaagcgccatggcggcggcgtccaacggcgagggcggccacggccaaggccggttcgacgtgatcgtggtgggcgcgggcatcatgggcagctgcgcggcgtacgcggcgtcctcccgcggcgcgcgcgtgctgctcctggagcggttcgacctgctccaccacaggggctcctcgcacggcgagtcgcgcaccatccgcgccacctacccgcaggcgcactacccgcccatggtgcgcctgtcgcgccgcctctgggacgaggcccaggccgacgccgggtacgccgtgctcacgcccaccccgcacctcgacctgggcccggcggacgacccggcgctcgtcgccgccatcaggaacggcggcgccaccgaggtcgccctcgccgccgccgcagccggggatgatgagtcggcgtcggcgtcctggccctgggcgggcgtgttcagggtccccgacgggtggacggcggcgccgagcgagctgggcggggtcatgaaggccaccaaggccgtggccatgttccaggcgctcgccgtcaagaagggcgccgtcctcagggacagggctgaggtggtggacgtcaccaccagctccaagcgaggtgaaggagaggggtcaataatctcggtgaggacgtcgagcggcgaggagttccatggcaccaaatgcatagtgacagtgggcgcttggacgagcaagctgatcaggtcggtaagcggcctggaccttcccgtgcagccggtgcacacgctcatctgctactggaaggtgaagccggggcacgagcaggagctgaccccggaggccggcttcccgacgttcgccagctacggcgacccctacatctacggcaccccgtcgatggagttcccggggctgatcaagatcgccatgcacggcgggccgccctgcgacccggacggcagggactggtccacgggcggcctggtggagcccgtggcgcggtggatcgacgccgtcatgccggaccacgtcgacaccgccggcgggccggtcatccggcagtgctgcatgtactccgtcacccccgacgacgactacgtggtcgacttcctcggcggggagttcggcaaggacgtcgtcgtcggcgccgggttctctggccatggcttcaagatgggcccggccgtcgggaggatcctggccgagatggccttggacggggtggccaggacggcggccgacgccggagtagacctccgccccttaaggatcggccggtttgcggaaaatcccaaaggaaacctgtaggactcgttcaaggctgatggcaaccgcgggtggcttgctggatcggcgacggggctccatttcatgtttttatgtcagaaaaagtgtgttcttgccatctcgttcccttgtttattgtccttttggattcttggattttcaaagattgaagtgggcgcatctcctcagtttgttgtagtcttgcagacgaatgttaataaactggtctgatcagctgtattatattattgatagcaaatcaagttcgttattgtgcagaatc

SEQ ID NO: 3255 - DNA, 1661 bp, Panicum virgatum
ctcgctttcaccaagtccgctccctcgcagagtcgcagtgcacgcacacggcagcaggacagccgaggagagagcagagcgagtgaggggggccggagcaaggaccatggcggcgtccaacggcggaggcgatgcccccgggcggttcgacgtgatcgtggtgggcgcgggcatcatgggcagctgcgcggcgtacgcggcgtcctcccgcggcgcgcgcgcgctgctcctggagcggttcgacctgctccaccaccggggctcctcgcacggcgagtcccgcaccatccgcgccacctacccgcaggcgcactacccgcccatggtgcgcctgtcgcggcgcctctgggaggaggcccaggccgacgccgggtaccgcgtgctcacgcccacgccgcacctcgacctgggcccgcgggacgaccccgagctccgcgccgccatcaggaacggcggcgccgccgtggtcgccggcggctcttcctggccgtgggcgggcgtgttcagggtgccggacgggtgggcggcggcgagcagcgagctcggcggggtgatgaaggcgaccaaggcggtggccatgttccaggcgctcgccgtcaagaagggcgccgtcgtgagggaccggatggaggtggtcgacgtcgccaagcgaggagaaggatcaatcttggtcaggacagcgagcggcgaggaattccatggcgccaagtgcattgtaacggtcggcgcctggacaagcaagctggtcaagtcggtcgtcggcatggacctgccggtgcagccggtgcacacgctcatctgctactggaaggtgaagcccggccacgagagcgagctcaccgcggaggccggcttcccgacgttcgccagctacggcgatccctacatctacagcacgccgtcgatggagttccccggcctcatcaagatcgccaagcacggcggcccgccgtgcgacccggacagcagggactggtccacgggcgccgccgacctggcggagcccgtagcccggtggatcgacgccgtcatgccgggccacgtcgacaccgccggcgggccggtcatccggcagtcgtgcatgtactctatgacgcccgacgaggactacgtgattgacttcctgggcggggagtttgggaaggacgtcgtcgtcggcgcggggttctccggccacgggttcaagatggggccggcagttgggaggatcctggccgagatggccatggacggggagtcgagttcggcggtggaggccggcgtggatctcaaacccctcaggatcgacaggttcgtgggcaatcccaagggaaacctcagtagtcctggagatcagggccaatgatgaacaccttcgatctacttgattgagatcatatattcaaccattcgtgatcaaatcaaagtgtgcgcatgtcaattgctttgtttgcttggaataatctgttgaaaattgcattgtgaaactttccttcgttctgttggagtgtcaggactcaggaaactgaagtgcatctcctttgtacctgtaccaaaattaaaagctaccagctcaactgcattcagttgcagatgaacgtttcagtattaactggtctgttgactctgttgagaacttgcgaagcacctcttgtgtatagttctgaatactccttgtgtgc

SEQ ID NO: 3256 - DNA, 1222 bp, Echinochloa colona
gcggcgtccacggcgaggccccgggcggttcgacgtcatcgtggtgggcgcgggcatcatgggcagctgcgcggcgtacgcggcggcctcccgcgccgcgcgggtgctcctcctggagcggttcgacctgctccaccaccggggctcctcccacggcgagtcccgcaccatccgcgccacctacccgcaggcgcactacccgcccatggcgcgcctgtcgcggcgcctctgggaggaggcccaggccgaagccgggtaccgcgtgctcacccccacgccgcacctcgacctgggcccgcgggacgaccccgacttcctcgccgccgtcaggaacggcggcgccgccgaggtcgccgccggcggcggggagggggagccgtggccgtgggcgggcgtgttcagggtgccggacgggtgggcggcggcgaccagcgagctcggcggcgtgatgaaggcgaccaaggcggtggccatgttccaggcgctcgccgtcaagaagggcgccgtcgtcagggaccggacggaggtggtcgacgtcgccaagcgaggggaaggatcaatcttggtgaggacagcgagtggcgaggaattccacggcgccaagtgcatcataaccgtcggcgcctggacgagcaagctggtcaagtcggtcaccggcatggacctgccggtgcagccggtgcacacgctcatctgctactggaaggtgaggcccggccacgagcgcgagctcaccacggaggccggcttcccgacgttcgccagctacggcgacccctacatctacagcacgccgtcgatggagttcccgggcctcatcaagatcgccaagcacggcggcccgccgtgcgacccggacggcagggactggtccacgggcgccgccggcctggcggaccccgtggcccggtggatcgacgccgtcatgccggcccacgtcgacaccgccggcgggccggtcatccggcaggcgtgcatgtactccatgacgcccgacgaggactacgtcgtcgacttcctcggcggcgagttcggcaaggacgtcgtcgtcggcgccgggttctccggccacgggttcaagatgggcccggccgttgggaggatcctggccgagatggccatggacggggaggcgagaacggcggcggaggccggagtagacctgaagccattaaggatcggcaggttcgtggacaatccaaagggaaacctcaagaattca

SEQ ID NO: 3257 - DNA, 2057 bp, Setaria italica
gagcgccaagaggcctagctgccaagcttttgtccgtgctcaagccaccaaacgcttgcagctcaaccctcggcacggcaagagtatttgcacgctagcttcattcgttcattggactctcttactccctccgtccctcgcacacccggccacacggcaacaaaacagtcaaagaaattaagagcagagcgagcgagagcgagaagcaagcaagcaagcgccatggcggcgtccaacggcgaggccgtccacggccggttcgacgtgatcgtggtgggcgcgggcatcatgggcagctgcgcggcgtacgcggcgtcctcccgcggcgcgcgcgcgctgctcctggagcggttcgacctgctccaccaccggggctcctcgcacggcgagtcccgcaccatccgcgccacctacccgcagccgcactacccgcccatggcgcgcctctcgcggcgcctctgggaggaggcccaggccgacgccggctaccgcgtgctcacgcccacgccgcacctcgacctgggcccgcgggacgaccccgcgctccgcgcctccatcagaaacggcggcgccgccgaggtcgccgcgtcctggccgtgggcgggcgtgttccgggtgccggaagggtggacggcggccaccagcgagctcggcggggtgatgaaggcgaccaaggcggtggccatgttccaggcgctcgccgtcaggaagggcgccgtcgtcagggaccggacggaggtggttgacatcgccaagccagcggatggatcaatcttggtgaggacagcgagtggcgaggaattccatggcgccaagtgcatcgtaacggttggcgcatggacaagcaagctggtcaagtcagtcatcggcatggacctgccggtgcagccggtgcagacgctcatctgctactggaaggtgaagcccggccacgagagcgagctcaccacggaggccggcttcccgacgttcgccagctacggtgacccctacatctacagcacgccgtcgatggagttcccgggcctcatcaagatcgccaagcacggcggcccgccgtgcgacccggacagcagggactggtccacgggcgccgccgacctggcggagcccgtagcccggtggatcgacgccttcatgccgggccacgtcgacaccgccggcgggccggtcatccggcagtcgtgcatgtactccatgacgcccgacgaggactacgtgattgacttcctcggcggggagttcgggaaggacgtcgtcgtcggcgcggggttctccggccacgggttcaagatggggccggctatcgggaggatcctggcggagatggccatggatggggaggcgaggacggcggcggaggctggagtagacctccagcccttaaggatcgatcggtttgttgacaatccaaagggaaacctcaagaatcctggagatcaggacaaataacgagcaccgtccctctatgggagatcagatcttcaaccattcatgatcaagtcaaaatgtgtgtatggcatggcaattgctttgtctggaataatctgtcgaacattgcattgtaaaactttcctttgttctgttggagtgtcaggaaattgaagtgcatcgcctttggatgtgtaccaaaagccaccagctcaactgcattcagctgtggatacatgtttcagtattaactggtttgttgagaacttgcgatgcctcttgtgtagttctgaattctgatgatcataggctggcaatcaaatcccttgagcagattttgttttagttctaaggaatcccttgtgaggattcctttttttttcactcttttactttggcacagatcttagcatgcaccctcacatgtggagttggtaaccaaagtgcccctagtcgtgttcatgcatggaatctaaacgaaagagacctgcctcccaaccatttgccagatgctgatggtacattattgcaaggtcactgcaggaatatggtagaactcaggtacctccaaaaacgcagaactagctcgaacagctcgggggtcagttctactactgattgctgtt

SEQ ID NO: 3258 - DNA, 2051 bp, Setaria italica
gagcgccaagaggcctagctgccaagcttttgtccgtgctcaagccaccaaacgcttgcagctcaaccctcggcacggcaagagtatttgcacgctagcttcattcgttcattggactctcttactccctccgtccctcgcacacccggccacacggcaacaaaacagtcaaagaaattaagagcagagcgagcgagagcgagaagcaagcaagcaagcgccatggcggcgtccaacggcgaggccgtccacggccggttcgacgtgatcgtggtgggcgcgggcatcatgggcagctgcgcggcgtacgcggcgtcctcccgcggcgcgcgcgcgctgctcctggagcggttcgacctgctccaccaccggggctcctcgcacggcgagtcccgcaccatccgcgccacctacccgcagccgcactacccgcccatggcgcgcctctcgcggcgcctctgggaggaggcccaggccgacgccggctaccgcgtgctcacgcccacgccgcacctcgacctgggcccgcgggacgaccccgcgctccgcgcctccatcagaaacggcggcgccgccgaggtcgccgcgtcctggccgtgggcgggcgtgttccgggtgccggaagggtggacggcggccaccagcgagctcggcggggtgatgaaggcgaccaaggcggtggccatgttccaggcgctcgccgtcaggaagggcgccgtcgtcagggaccggacggaggtggttgacatcgccaagccagcggatggatcaatcttggtgaggacagcgagtggcgaggaattccatggcgccaagtgcatcgtaacggttggcgcatggacaagcaagctggtcaagtcagtcatcggcatggacctgccggtgcagccggtgcagacgctcatctgctactggaaggtgaagcccggccacgagagcgagctcaccacggaggccggcttcccgacgttcgccagctacggtgacccctacatctacagcacgccgtcgatggagttcccgggcctcatcaagatcgccaagcacggcggcccgccgtgcgacccggacagcagggactggtccacgggcgccgccgacctggcggagcccgtagcccggtggatcgacgccttcatgccgggccacgtcgacaccgccggcgggccggtcatccggcagtcgtgcatgtactccatgacgcccgacgaggactacgtgattgacttcctcggcggggagttcgggaaggacgtcgtcgtcggcgcggggttctccggccacgggttcaagatggggccggctatcgggaggatcctggcggagatggccatggatggggaggcgaggacggcggcggaggctggagtagacctccagcccttaaggatcgatcggtttgttgacaatccaaagggaaacctcaagaatcctggagatcaggacaaataacgagcaccgtccctctatgggagatcagatcttcaaccattcatgatcaagtcaaaatgtgtgtatggcatggcaattgctttgtctggaataatctgtcgaacattgcattgtaaaactttcctttgttctgttggagtgtcaggaaattgaagtgcatcgcctttggatgtgtaccaaaagccaccagctcaactgcattcagctgtggatacatgtttcagtattaactggtttgttgagaacttgcgatgcctcttgtgtagttctgaattctgatgatcataggctggcaatcaaatcccttgagcagattttgttttagttctaaggaatcccttgtgaggattcctttttttttcactcttttactttggcacagatcttagcatgcaccctcacatgtggagttggtaaccaaagtgcccctagtcgtgttcatgcatggaatctaaacgaaagagacctgcctcccaaccatttgccagatgctgatggtacattattgcaaggtcactgcaggaatatggtagaactcaggtacctccaaaaacgcagaactagctcgaacagctcgggggtcagttctactactgatt

SEQ ID NO: 3259 - DNA, 1639 bp, Panicum virgatum
caagtctgctccctcgcagagtcgcagtgcacgcacacggcagcaggacagccgaagcaagagcagagccggtgagggggtcggagcagcaagcgccatggcggcgtccaacggcggcgatgcccccgggcggttcgacgtgatcgtggtgggcgcgggcatcatgggcagctgcgcggcgtacgcggcgtcctcccgcggcgcgcgcgcgctgcttctggagcggttcgacctgctccaccaccggggctcctcgcacggcgagtcccgcaccatccgcgccacctacccgcaggcgcactacccgcccatggtgcgcctgtcgcggcgcctctgggaggaggcccaggccgacgccgggttccgcgtgctcacgcccacgccgcacctcgacctgggcccgcgggacgaccccgagctccgcgctgccatcaggaacggcggcggcgccgtggtcgccggcggcggcgcggagtcggcgtcatcctggccgtgggcgggcgtgttcagggtgcctgacgggtgggcggcggcgagcagcgagctcggcggggtgatgaaggcgaccaaggcggtggccatgttccaggcgctcgccgtcaagaagggcgccgtcgtgagggaccggatggaggtggttgacatcgccaggcgaggagaaggatcaatcttggtcaggacagcgagcggcgaggaattccatggcgccaagtgcattgtaacggtcggcgcctggacaagcaagctggttaagtcggtcgtcggcatggacctgccggtgcagccggtgcacacgctcatctgctactggaaggtgaagcccggccacgagagcgagctcaccgcggaggccggcttcccgacgttcgccagctacggcgacccctacatctacagcacgccgtcgatggagttccccggcctcatcaagatcgccaagcacggcggcccgccgtgcgacccggacagcagggactggtccacgggcgccgccggcctggcggagcccgtggcccggtggatcgacgccgtcatgccgggccacgtcgacaccgccggcgggccggtcatccggcagtcgtgcatgtactccatgacgcccgacgaggactacgtgatcgacttcctgggcggggagtttgggaaggacgtcgtcgtcggcgcggggttctccggccacgggttcaagatggggccggctgttgggaggatcctggccgagatggccatggacggggagtcaagatcggcggtggaggccggcgtggatttcgaacccctcaggatcggcaggttcgtggacaatcccaagggaaacctcaatactcgtggagatcagggccaaaaatgaacaccttcttcgtctacttgagatcacatatttattcaaccattcgtgatcaagtcaaagtgtgcgcatgtcaattgctttgtttggaataatctgttgaacattgcattgtgaaactttcctttgttctgttggagtgtcaggaaattgaaatgcatgcatctgtaccaaaattaaaagttacaactgcattcagttgtagatgaacgtttcagtattaactcgcgagaacttgcgaaacacctcttgtgtatagttctgaatacacaagttcctcgtgcagatttt

SEQ ID NO: 3260 - DNA, 1440 bp, Sorghum bicolor
gaggcgcccctcccccgccacgtcaccgatccgcgtgctcgccccctcccgcgccgtccgatctcgccggcccaattgatcctagccgtccgcccgccccgcgtccccatctgctcactctcctcccacacccacactctccctgcagacacaaccgaaaaaccaaggggaaaaaatagtaaagaaacggagcgaggcgaggcgaggctccgctcctcctccccggtctatcctgcctgatccaaatcctccctcgcttcatatatcctcctccgacgaaaataattccattcattccttccgcaccggcacccgcatctgggcaaggagggctcgtcgtcgtcccttgctcgtctccgtcctgcgccgccgccgccgccatggccaccgaggaagctgccaagccgtccccgatcccgccctaccctgagatgatcctggcggcgatcgaaggtctgggagacaaaaacgggtcgaacaaatcggccatctccaagttcatcgaggacaagtacggcgagctgcccccggcgcacgcgtcgctgctgaccgcgcacctggcgcggatgaaggagtccggggagctcatcttcctgaaaaacaactacttccgcgccgacgcccccgacgcgccgcccaagcgcgggcgcgggcgcccgcccaaggcgcgggacccgaacgctcccccgccaccgcccaagtcgccggcttccgcggggacgggccgcggccgcggccgcccgcccaaggccaagagcgcgctcgacgccgccgtcaagcaggccaccgcggggatgcccaaggcccgcggccgcccgcccaagaaggccaagacctccgaggacggcgcgtccccggctcccaagcccgcgccaacccctgcccccgccggcgacggctccacccccgtcaagcgtggccgcggtaggccccccaaggtacgccccgtcgtgcctagcgagacggccgcggcttgacgccgccgctgctgcttgcggttagtgcttcccgccgtgaggacggggctggttctggttggttaggaggtagcaattcgtcgttgccgctgctgctgctgccgtattaatgttggtagacttgaggtttcgttgcttcatctaattgtcgtcgtcgtcgtcgctgttgttcgtctctggattaattaatggagtaattaggaggatttgatggcgctgcctgtgttctgtgttgctgttcagttgaggtcacccgtgtgttctatgttatgtgctgctggatctgttgtaaaactgatgagctaggtgagcttgagtgatgcctgtgttgattaagtattgttaagctgctaatgtggatgatgtgtacaattaaattaaattagcggatggtggtgatgttcctgacgttgatttgagggttcggccttgtttagtttccaaaaattttcaagattcccaa

SEQ ID NO: 3261 - DNA, 1182 bp, Setaria italica
acacactcgcagacacaaccgaaaaaccaaggggaaaaaatagtaaagaaacggaggcgcggctcccctccctcctcctccccgtttcttatctatcctgatccaaatccgcctcgcttcttttatatcctcctccgaggaaaataattccattccccaccaccgcatcgcgtcctgctcgcctccgtcgccgtcgtcgccgtcgccatggccaccgaggaagccgccaagccgtccccgctcccgccctacccagagatgatcctggcggcgatcgaggggctgggcgacaagaacgggtcgaacaagtcggccatctccaggtacatcgagggcaagtacggcgagctcccgcccgcgcacgcgtcgctgctgacggcgcacctggctcgcatgaaggagtccggcgagctcatcttcctcaagaacaactacttccgcgccgatgcccccgacgcgccgccgaagcggggccgcgggcgcccgcccaaggtgcgggaccccaacgcgccgccgccgccgcccaaggcaccgtccaccggctcgccgcggccccgcgggcgcccgcccaagcccaaagacccgctcgacgctgccgtcgcgcaggccaccgcggggatgcccaaggcccgcggccgcccgcccaagaaggccaagatcgatgccactgccgccgccgcgccctcccccgccgccgccgcgccagccggcggcgacggctccgcccccgtcaagcgcggccgcggcaggccccccaaggtacgccccgccgtgcccagcgagacggccgcggcctagtcgtcgtcgtgagagaggttattagggcgtagcgatccgtcctccgcgcgtcacctgctgctgcttcgccgtgttggttaatcttagggttcggttccttgcttggtctaattgttcgtcgtggcttaattaattaatggagtaattaggggagggatttgatgtgccgtggtttctttcgctgttcagttcgtgctgctggtgtgttgtaagctagtaagctctaaagctagggatctgcttctgctgagactgagagtgctgttctggtcgattaatcaggctgctaatgtggatgtgtacaatttaattaattagcggatgatggtgatgttaatgatgttgatttaaggcagggttcttccaagtgccccctagtttgac

SEQ ID NO: 3262 - DNA, 1367 bp, Setaria italica
acacactcgcagacacaaccgaaaaaccaaggggaaaaaatagtaaagaaacggaggcgcggctcccctccctcctcctccccgtttcttatctatcctgatccaaatccgcctcgcttcttttatatcctcctccgaggaaaataattccattccccaccaccgcatcgcgtcctgctcgcctccgtcgccgtcgtcgccgtcgccatggccaccgaggaagccgccaagccgtccccgctcccgccctacccagagatgatcctggcggcgatcgaggggctgggcgacaagaacgggtcgaacaagtcggccatctccaggtacatcgagggcaagtacggcgagctcccgcccgcgcacgcgtcgctgctgacggcgcacctggctcgcatgaaggagtccggcgagctcatcttcctcaagaacaactacttccgcgccgatgcccccgacgcgccgccgaagcggggccgcgggcgcccgcccaaggtgcgggaccccaacgcgccgccgccgccgcccaaggcaccgtccaccggctcgccgcggccccgcgggcgcccgcccaagcccaaagacccgctcgacgctgccgtcgcgcaggccaccgcggggatgcccaaggcccgcggccgcccgcccaagaaggccaagatcgatgccactgccgccgccgcgccctcccccgccgccgccgcgccagccggcggcgacggctccgcccccgtcaagcgcggccgcggcaggccccccaaggtacgccccgccgtgcccagcgagacggccgcggcctagtcgtcgtcgtgagagaggttattagggcgtagcgatccgtcctccgcgcgtcacctgctgctgcttcgccgtgttggttaatcttagggttcggttccttgcttggtctaattgttcgtcgtggcttaattaattaatggagtaattaggggagggatttgatgtgccgtggtttctttcgctgttcagttcgtgctgctggtgtgttgtaagctagtaagctctaaagctagggatctgcttctgctgagactgagagtgctgttctggtcgattaatcaggctgctaatgtggatgtgtacaatttaattaattagcggatgatggtgatgttaatgatgttgatttaaggcagggttcttccaagtgccccctagtttgactctacctgcatctctgatcgctttggtgatgacgacgtctgtttcttgctgctattaagcgtgttcgcgtgctaatcactgtcactaaactgctagctgagctgctggggtgttggtttgactagtagtggttgttgtactagcaccagaccttatcctcctcgcactctctcacactccgggcg

SEQ ID NO: 3263 - DNA, 1066 bp, Zea mays
acccacacacacacactctctctcttcgcagacacaaccaaaagaccaaggtggaaaaatagtaaagaaacggagcgaggctcctccgcatttcttatctatcctgatccaaaccctccgagggggaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcgccgccatcggggcgcgggcgcgggcgcccgcccaagcccaaggacccgctggacgccgccgtgaagcaggccaccgcgggcatgcccagggcccgcggccgcccgcccaagaaggccaagaccgagggcggcgcgtccccggcccccgccggcgacggctccacccccgtcaagcgcggccgcggccgcccccccaaggtacgccccgtcgtgcccagcgagacggccgcggcttgacggacgctgctgcatggggttagtgcgtagcgattcgtcccgccgccaccgccgcagggttgatgtttgtaggcttcgttttccttcatctaattgtcgtcgtagtcgtcgtcgtcgcgcaattaattaatggagtaagtaggaggatttgatgtgctgtgttcggttcagttcagctcacggtgctgtcttgttcgtatgtgctggatggatctgtctgttgtaagctaaactagggaggctgagtgctgtgttggtcggttcattattaagctgctaatttggatgtgtacaatacattagtggatgatgctgatgttcgtgatgttgatttgagggttt

SEQ ID NO: 3264 - DNA, 1248 bp, Saccharum officinarum
cgcatccccgcagtccacttccactagcgcagctgcctcttctctccttcgcgagccccgaaggaagccggagcagagagcgccactagccagcccgccaccggcaccgaggaggcatggcgggggccggggacaaggtggactacgtcttcaaggtggtgctgatcggcgactcggcggtgggcaagtcgcagatcctcgcccgcttcgcccgcaacgagttcagcctcgattccaaggccaccatcggcgtcgagttccagacccgcaccctcgtcatcgaccacaggagcgtcaaggcccagatctgggacaccgccggccaggagaggtacagagctgtgacaagcgcttattacagaggtgcactgggagctttgctggtctatgacatcactagacgccagagcttcgatcatataccccgctggctagatgaactccgagcccatgctgacaagaacattgtgataatgctggttggcaacaagagtgatctcgaggagcagcgagccgtgagcactgaagatgccaaggagtttgccgagaaggagaatctcttcttcctagagacctctgcgctccaggcaacaaacgtagagagtgcttttcaaactgtcttgacagagatcttcaaaattcacagcaagaagaacatggtgtcggagccaaagagcaatggagctgccccagcaatgccagggacgaaggtccttgtcccaggtccggcgcaggaaatcccaaagagcaagtgctgcagttccatgtgatgcttctatgtttggtgttgggtgtgttcgaaatattcacgcaatattgttttggttgtaaatccctgatgaaatgcttggattttggtggggattgtgttggaacattggtgtattttagatatttgtcacaattgtgacatgagggaaggatgtgctgatgtatttgggtcttttgttcttaaatgggaacgggttatccccgctgaaaaattttgtaaaatggttggttttgaaaaaaaaaaaaaaaaaaagaggcgggccgtttagaggaaccaactttaccttcccgtggttgcgaaatatataattttttatgggccactaaaattaattcacgtgccggggtttaaaccgctggatggagaaaccttgggttacccaaattaaaggcgtgagaacaatccctttctccaaggggtaatatcaaaagagccccacgaaccctctcaaaaatggccgacttgaggggaagggg

SEQ ID NO: 3265 - DNA, 1034 bp, Zea mays
tgctttgaaaaatcatacaacaaccaactaaaataagcgcacgcgcacacgcatcccggcagtcctgtccagtggtgcagctgcctgccttcagccttccctctctttcgcgacccccccggagccggagcagagatcgccagctctaccggcgcggaggcatggcgggggccggagacaaggtggactacgtcttcaaggtggtgctgatcggagactcggcggtgggcaagtcgcagatcctcgcccgcttcgcccgcaacgagttcagcctcgactccaaggccaccatcggcgtcgagttccagacccgcaccctcgtcatcgaccacaggagcgtcaaggcccagatctgggacaccgccggccaggagaggtacagagccgtgactagtgcttattatagaggcgcactgggagctttgctggtctacgacatcaccagacggcagagcttcgatcacataccccgctggctagatgagctccgagcccatgctgacaagaacattgtgataatgctggttggcaacaagagcgatctcgaggagcagcgggccgtgagcactgaagacgccaaggagtttgccgagaaggagaacctcttcttcttggagacctctgcgctccaggcaacaaatgtggagagttcttttcagaccgtcttgacagagatcttcaaaatccacagcaagaagaacatggtgtcggagccaaagagcaacggagccgcgccagcaatgccggggacgaaggtcctcgtcccaggtccggcgcaggaaatcccgaagagcaagtgctgcagttccatgtgacgcttctgcgtttggtgctgggtgtgtcgaaaatattcacgaaatattgttttttttttgctgtaaatccctgctgttatgcttggatttttggaggggttgtgttggaacaccggtgtatttttagatatttgacacaactgtgacacgagggaaggatgtgctgatgtgtattggttctcttgttctctaattgatatgttttatccctgctgcaaa

SEQ ID NO: 3266 - DNA, 967 bp, Setaria italica
tctcgcccgctttcaaaaatcataaaaccaaagcactctctccactagcgcccccgctgcctcctctccttttcccgacccccggagccgaagcagagccagagcgacgcgccaccaccggcgggcgagagggcatggcgggggccggggagaaggtggactacgtcttcaaggtggtgctgatcggcgactcggcggtgggcaagtcgcagatccttgcccgcttcgcccgcaacgagttcagcctcgactccaaggccaccatcggggtcgagttccagacccgcaccctcgtcatcgaccacagaagcgtcaaggcccagatctgggacaccgccggccaggagaggtacagggctgtgacaagcgcatattacagaggggcactgggagctcttctagtctatgacatcaccaggcgccaaagctttgatcatatacctcggtggctagatgaactccgtgcccacgccgacaagaacatagtgataatgctagttggcaacaaaagcgatcttgaggagcagcgagccgtgagtactgaggatgccaaggagttcgccgagaaggagaacctcttcttcctggagacctccgcactccaggcaacaaacgtagagagtgctttccaaactgtcttgacagaaattttcaaaatccacagcaagaagaacatggtgtccgagccaaagagcaatggggctgccccagcaatgccaggcaagaaggtccttgtcccaggtccggcgcaggaaatccctaagagcaagtgttgtagttccatgtgatgcttctgtatttggtgttatgtgtgctgaatatattcctgcaatattgtttttgttgtaaatccctgtcgaaatactcagatttgggctggttgaaacactgttgtattttatatttttgtcacaattgtgacatgaggggaagcatgtgctaatgtcttaccgttcttgacttcttg

SEQ ID NO: 3267 - DNA, 1133 bp, Setaria italica
cggcagtaccggccgctggccggcaccagcttccgagctcctcctcggtcacgctgcacttccggcctactagtactaggctactacgacttgggagaccggtgtcgtctcgcccgctttcaaaaatcataaaaccaaagcactctctccactagcgcccccgctgcctcctctccttttcccgacccccggagccgaagcagagccagagcgacgcgccaccaccggcgggcgagagggcatggcgggggccggggagaaggtggactacgtcttcaaggtggtgctgatcggcgactcggcggtgggcaagtcgcagatccttgcccgcttcgcccgcaacgagttcagcctcgactccaaggccaccatcggggtcgagttccagacccgcaccctcgtcatcgaccacagaagcgtcaaggcccagatctgggacaccgccggccaggagaggtacagggctgtgacaagcgcatattacagaggggcactgggagctcttctagtctatgacatcaccaggcgccaaagctttgatcatatacctcggtggctagatgaactccgtgcccacgccgacaagaacatagtgataatgctagttggcaacaaaagcgatcttgaggagcagcgagccgtgagtactgaggatgccaaggagttcgccgagaaggagaacctcttcttcctggagacctccgcactccaggcaacaaacgtagagagtgctttccaaactgtcttgacagaaattttcaaaatccacagcaagaagaacatggtgtccgagccaaagagcaatggggctgccccagcaatgccaggcaagaaggtccttgtcccaggtccggcgcaggaaatccctaagagcaagtgttgtagttccatgtgatgcttctgtatttggtgttatgtgtgctgaatatattcctgcaatattgtttttgttgtaaatccctgtcgaaatactcagatttgggctggttgaaacactgttgtattttatatttttgtcacaattgtgacatgaggggaagcatgtgctaatgtcttaccgttcttgacttcttgttctccaattgatacttttttttcctgatggaaatatctatagcactgattgtctttca

SEQ ID NO: 3268 - DNA, 1022 bp, Sorghum bicolor
gcgcacacgcatcccgggcactctacttccactagcgcagccgctggccgctgcctcttctctccttcgcgacccccgaaggaaagccggagcagagagcgccaccactagccagctgaggaggcatggcgggggccggagacaaggtggactacgtcttcaaggtggtgctgatcggcgactcggcggtgggcaagtcgcagatcctcgcccgcttcgcccgcaacgagttcagcctcgactccaaggccaccatcggcgtcgagttccagacccgcaccctcgtcatcgaccacaggagcgtcaaggcccagatctgggacaccgccggccaggagaggtacagagctgtgacaagtgcttattacagaggtgcactgggagctttgctggtctatgacatcaccagacgccagagcttcgatcatataccccgctggctagatgaactccgagcccatgctgacaagaacattgtgataatgctggttggcaacaagagtgatctcgaggagcagcgagccgtgagcactgaagatgccaaggagtttgccgagaaggagaatctcttcttcctggagacctctgcgctccaggcaacaaacgtagagagtgctttccaaactgtcttgacagagatcttcaaaattcacagcaagaagaacatggtgtcggagccaaagagcaatggagttgccccagcaatggcagggacgaaggtccttgtcccaggtccggcgcaggaaatcccaaagagcaagtgctgcagttccatgtgatgcttctacgtttggtgttgggtgtgttcaaaatattcatgtaatattgttttggttgtaaaccccggctgaaatgcttggattttggcgggattgtgttggtacactggtgtattttagatatttgtcacaattgtgacatgagggaaggatgtgctgatgtattggtcctcttgttctctaattgatatgttttatccctgctgcaaatatctgtagcactgattgtttttgagataccag

SEQ ID NO: 3269 - DNA, 1180 bp, Panicum virgatum
aacgcttatacgcaccgcgttttctggtacgcagtacgacttgcgagaccggtgtcgtctcgcccgctttcaaaaaaccataaaccaaagcacgctgctctgtccagtccccactagcgccgcggcagtgctgcctcctctcttttcccgatccccggagccgaagcagagccggggcggagcggcaccggcggcgagagggcatggcgagggccggggagaaggtggactacgtcttcaaggtggtgcttatcggcgactcggcggtgggcaagtcgcagatcctggcccgcttcgcccgcaacgagttcagcctcgactccaaggccaccatcggggtcgagttccagacccgcaccctcgtcatcgaccacaggagcgtcaaggcccagatctgggacaccgccggccaggagagatatagggctgtgacaagcgcgtattacagaggtgcactgggagctcttctggtctatgacatcaccaggcgccagagctttgatcatataccacggtggctagatgaactccgtgcccatgctgacaagaacatagtgataatgctagttggcaacaagagcgaccttgaggagcagcgagcggtgagtactgaggatgccaaggagtttgccgagaaggagaacctcttcttcctggagacttctgcacttcaggcaacaaacgtggagagtgctttccaaaccgtcttgacagagatcttcaaaatccacagcaagaagaacatggtgtccgagccaaagagcaatgggtctgccccagcaatgccagggaagaaggtccttgtcccaggtccggctcaggaaatcccgaagagcaagtgctgtagttccatgtgatgcttctatattctgtgttgagtatattcctgcaatattgtttgatcgtatatccctgccgaaatgctcagattttggcgggttgattgtgttgaaccactgctgtatctaattgtgacatgagggggaaggatgttctgatgtcttgggtgttattgttctccgattgatacacatttttttcctgctggaaatatcgtgattgtttttgagatatcagtcggtttctgatgaatgcaagtgtatttttgccttactcagggaccattctcctgacatgatgcgtaatagggaaaaaagaaaatgaaatgccatgcaagaaa

SEQ ID NO: 3270 - DNA, 821 bp, Cynodon dactylon
gggggacactccaccactagctgccgcttcctctcttctttcccgacacccgacgaagcccgaagcagagagagcaccaccggtcggccgcggcgtggaggcatggcgggggccgcggagaaggtggactacgtgttcaaggtggtgctgatcggggactcggcggtgggcaagtcgcagatcctcgcccgcttcgcgcgcaacgagttcagcctcgactccaaggccaccatcggcgtcgagttccagacgcgcaccctcgtcatcgacagccgcagcgtcaaggcccagatctgggacaccgccggccaggagaggtacagagctgtgacaagcgcgtattacagaggtgcacttggtgctctgttggtctatgacataaccaggcgccaaagctttgaccacataccacgctggctggatgaactccgtgcccatgctgacaagaacatcgtgataatgctagtgggcaacaagagcgaccttgaggagcagcgcgctgtgagcaccgaagatgccaaggagtttgctgagaaggaaaacctcttcttcctcgagacttccgcactccaggcaaccaacgtagagagtgcttttcaaactgtcctgacagagatcttcaagatccacagcaagaagaacatggtgtccgaacctaagagcaatggcgctgccccagcaatggcagggaagaaggtcctggtcccaggtccagcgcaggaaattcccaagagcaagtgctgcagttccatgtaatgcttctacgcctgggttatgtgtgctgaatataccaatactgttttttgtgtaaatccttgttg

SEQ ID NO: 3271 - DNA, 798 bp, Pennisetum glaucum
ccggggagaaggtggactacgtcttcaaggtggtgctgatcggcgactcggcggtgggcaagtcgcagatcctcgcccgcttcgcccgcaacgagttcagcctcgactccaaggccaccatcggggtcgagttccagacccgcaccctcgtcatcgacaacaggagcgtcaaggcccagatctgggacaccgccggccaggagaggtatagggctgtgacaagcgcatactacagaggggcactgggagctcttctagtttatgacatcaccaggcgccaaagctttgaccatataccgcggtggctagatgaactgcgtgcccacgccgacaagaacatagtaataatgctagttgggaacaagagcgatcttgaggagcagcgagccgtaagtactgaggatgccaaggagtttgctgagaaggagaacctgttcttcctggagacttctgcacttcaggcaacaaacgtcgagagtgctttccaaaccgtcttgacagagatctttaaaatccatagtaagaagaacatggtgcccgagccaaagagcaatggggctgccccagcaatgccagggaaggtccttgtgccaggtccggtgcaggaaatcccgaagagcaagtgttgtagttctatgtgatgcttctatgtttgttgttggggtgtgtcaaatatagtcctgcaacattgtttttgttgtaaatccctacccaaatactaagattttggaacagttgatgcattgttgtattttacatttttttggcacaattgtggcacgagggggatgatgggca

SEQ ID NO: 3272 - DNA, 1344 bp, Setaria italica
agcccgggcgcagaggccgacagagcagtgtccaccgtcgcgtctcccccgcgtcctcctccgtctcatctcaaatcaaaaaaatccaaaccaaacgcccccacgcgcactccgccgcctcactcctccctccgagcctccgccgaccgccgccttcgtgcgcgcgcgcgagcgagccagcgacccagcgacccagcgaccccaggaagcgaggaaggaggccatggcggggggcgcggacaaggtggactacgtcttcaaggtggtgctcatcggcgactccgcggtcggcaagtcgcagatcctggcccgcttcgcccgcaacgagttcagcctcgactccaaggccaccatcggggtcgagttccagacgcggacgctcgtcatcgaccacaaatccgtcaaggcgcagatctgggacaccgccgggcaggagaggtaccgagctgtcacaagcgcgtactacagaggtgctttgggagctctgctagtatatgatatcaccaaacgccagagcttcgaccacattcctcgttggttggaagagctccgtgggcatgctgacaagaacattgtcatcatgctggtcggaaacaagagcgacctcgaggaggagcgtgctgtgagcactgaggatgccaaggagtttgcagagaaggaaaacctcttcttcctggagacctctgcgctgcaggccaccaacgtggagaatgcattccagaccgtcttgacagagatcttcaagatccacagcaagaagaacatggcggcggacccgaaggccaatggtgctgccccgtccctggcagggaagaaggtccttgtcccaggcccggcccaggagatccctaagagcaaatgctgcagttccatgtgatatcttgcctgggtcgggtttgtgtgcgtcgaaaatattcatgtgatgtttctggatgtacatctagactggaataggcctaggtttgaattactggttattttgatgtgcggattgaaggggtcgatatcatagtttagatttgtcaccgtctccatggtgacacgaggatagggagcgaggagaagagcactatttgcatagacttgtggaattaattacaaatagcaatgtatgccgattgtttaatgtcgtcttgaagcccttgtgtaccgagatagactactcatacgcatcgtatcgacctgcatgtatgatactgttacgatgcgcatggaccttcggctcatgcgggtaagtgccaagaaattgtggaactgtaatgctattagcccgtttctttcgggcaaacatggttcttttgaactattgagtcgagataagcagtataagttcaataacatatt

SEQ ID NO: 3273 - DNA, 1342 bp, Setaria italica
ccagcccgggcgcagaggccgacagagcagtgtccaccgtcgcgtctcccccgcgtcctcctccgtctcatctcaaatcaaaaaaatccaaaccaaacgcccccacgcgcactccgccgcctcactcctccctccgagcctccgccgaccgccgccttcgtgcgcgcgcgcgagcgagccagcgacccagcgacccagcgaccccaggaagcgaggaaggaggccatggcggggggcgcggacaaggtggactacgtcttcaaggtggtgctcatcggcgactccgcggtcggcaagtcgcagatcctggcccgcttcgcccgcaacgagttcagcctcgactccaaggccaccatcggggtcgagttccagacgcggacgctcgtcatcgaccacaaatccgtcaaggcgcagatctgggacaccgccgggcaggagaggtaccgagctgtcacaagcgcgtactacagaggtgctttgggagctctgctagtatatgatatcaccaaacgccagagcttcgaccacattcctcgttggttggaagagctccgtgggcatgctgacaagaacattgtcatcatgctggtcggaaacaagagcgacctcgaggaggagcgtgctgtgagcactgaggatgccaaggagtttgcagagaaggaaaacctcttcttcctggagacctctgcgctgcaggccaccaacgtggagaatgcattccagaccgtcttgacagagatcttcaagatccacagcaagaagaacatggcggcggacccgaaggccaatggtgctgccccgtccctggcagggaagaaggtccttgtcccaggcccggcccaggagatccctaagagcaaatgctgcagttccatgtgatatcttgcctgggtcgggtttgtgtgcgtcgaaaatattcatgtgatgtttctggatgtacatctagactggaataggcctaggtttgaattactggttattttgatgtgcggattgaaggggtcgatatcatagtttagatttgtcaccgtctccatggtgacacgaggatagggagcgaggagaagagcactatttgcatagacttgtggaattaattacaaatagcaatgtatgccgattgtttaatgtcgtcttgaagcccttgtgtaccgagatagactactcatacgcatcgtatcgacctgcatgtatgatactgttacgatgcgcatggaccttcggctcatgcgggtaagtgccaagaaattgtggaactgtaatgctattagcccgtttctttcgggcaaacatggttcttttgaactattgagtcgagataagcagtataagttcaataaca

SEQ ID NO: 3274 - DNA, 877 bp, Pennisetum glaucum
tggcggggagtggggacaaggtggactacgtcttcaaggtggtgctcatcggcgactccgcggtcggcaagtcgcagatcctcgcgcgcttcgcccgcaacgagttcagcctcgactccaaggccaccatcggggtcgagttccagacgcggacgctcgtcatcgaccacaagtccgtcaaggcgcagatctgggacaccgccggccaggagaggtacagagctgtcacaagtgcatactacagaggtgcgttgggagctctactagtctatgacatcaccaaacgccagagtttcgaccacattcctcgttggctggaagagctccgagggcatgccgacaagaacattgtcatcatgctggtcggaaacaagagtgaccttgaggaggagcgtgccgtgagcaccgaggatgccaaggagttcgccgagaaggagaacctcttcttcctggagacctcagcgctgcaggccactaacgtggagaatgccttccagaccgtcttgacagagatattcaagatccacagcaagaagaacatggcggcggacccgaaggccaatggtgctgccccgtccctggcagggaagaaggttctcgttccaggcccagcccaggagatcccgaagagcaagtgctgcagttccatgtgatatcttgcttgcccggattgggtttgtgtgcctcaaaaatattcatgtgatgtttctggatgtacatctcgactggaataggcctaggtttgaattaccggttattttgatgtgcggattgggttgttttgtcaccgtcgccgtggtgacactgaggatagggagcgacaagagctctatttgcatagactcgtggaattaattacaaatagcaatgtatgccg

SEQ ID NO: 3275 - DNA, 1147 bp, Saccharum officinarum
aaccgagcccctcgcccaaccttcacccacgcgcactccgccgccgctttcgttgctcacgagcgagacagccggagctagcaagggagggaggaggcgatggcggggggcggggataaggttgactacgtcttcaaggtggtgctcatcggcgactccgctgtcggcaagtcgcagatcctggcgcgcttcgcccgcaacgagttcagcctcgactccaaggccaccatcggggtcgagttccagacccggacgcttgtcatcgaccacaagtccgtcaaggcgcagatctgggacaccgccgggcaggagaggtatagagctgtcacaagtgcctactacagaggtgctttgggagctctgctagtctatgatatcacgaaacgccagagcttcgaccacatacctcgctggctggaagagcttcggggccatgctgacaagaacattgtcatcatgctggttggcaacaagagtgacctcgaagaggagcgtgctgtaagcactgaggatgccaaggagtttgccgagaaggagaacctcttcttcctcgagacctccgcgctgcaggcgaccaatgtcgaaaatgccttccagaccgtcttgacagagatctttaagatccacggcaagaagaacatggcagcagacccaaaagccaatggggctgcaccatcgctggcagggaagaaggtcattgtcccaggcccagctcaggagatccccaagagtaagtgctgcagttccatgtgacatgttgcctgaatttatttgggtttgtttgtgtccaaaatattctcgatatctttgtggatgtacatctatactggaataggcttagatttgaattgttggttatctttatgttcggattgaagggaacgatatcatagtttagatttgtcacccgtctccaaggtgacacgaggatagggaccgaggagaaaagctctgtttgcatagacttgttggattaattacaaaaatataagtgtatgcagattatttttacgatgccttgaaaccttagtgtacagtgagacactgatacaattgtatcaacctgcttgtgtgataccctttggtgtgcatggaacgtctgcaccatatgggtttaataacacgaaagtgtctggattatagtgcc

SEQ ID NO: 3276 - DNA, 1025 bp, Echinochloa colona
atcctggaaagtagaaatcaagaaacccgctttcttgatgccaagatcctcctagctggactaaccgagagaggaagggcatcgttcttgttctcgcacgggagaaaacaattctagggagagacagaaagccaggaggatcgcatctatctgtgtgagtttggggacagccggcgagagaagatgtctcggggcgggagccatggcgagctggggcagaggatcgactacgtcttcaaggtggtgctcatcggcgactccgcggtgggcaagtcgcagctgctcgcgcgcttcgcccgcaacgagttcaacctcgactccaaggccaccatcggggtcgagttccagacccgcaccctcgtcatcgacaaacgcagcgtcaaggcccagatctgggacaccgccggccaggagaggtatagggctgtaacaagcgcgtactatagaggagcactgggagctcttctggtctatgacatcactaggcgccagagcttcgatcatatacctcggtggctagatgaactccgtgcccatgctgacaagaacatagtgataatgctagttggcaacaagagcgaccttgaggagcagcgagccgtgagtactgaggatgccaaggagtttgcggagaaggagaacctcttcttcttggagacctctgcactccaggcaacaaacgtggagagtgctttccaaaatgtcctgacagagatcttcaaaatccacagcaagaagaacatggtgtctgagccaaagagcaatggggctgccccagcaatgccagggaagaaggtccttgtcccaggtccggcgcaagaaatcccgaagagcaagtgctgcagttccatgtgatgcttctacgttcagtgttgggtgtgttgaatatattcacgcaatattgttttggttgtacatccctgctgaaatacccagattttagcagggttgattgtgttgtattttagatatttgtcaccattgtgacatgaggggaaggatgtgctgatatcttggtgttcttg

SEQ ID NO: 3277 - DNA, 1100 bp, Leymus cinereus x Leymus triticoides
ccgttgctgtcgaaaccccaaactccgacaccctccgcccacgcgcaccacctccacgacccacacgcctcgctcgctcactcctccggccgccaccaacgccgccgttctgcacgagcgaagacgatggcgagcggggagaaggtggactatgtgtttaaggtggtgctgatcggggactcggccgtcggcaagtcgcagatcctggcgcggttcgcgcgcaacgagttcagcctcgactccaaggccaccatcggtgtcgagttccagacgcgcacgctcgtcatcgaccacaagtccgtcaaggctcagatctgggacaccgccggccaggagaggtacagagctgtcacgagcgcatattacagaggcgctttgggagctctgctagtgtatgatatcaccaagcgccagagctttgaccacatacctcgctggctggaggaactccgaggtcacgcagacaaaaacattgtcatcatgctggttggcaataagagcgaccttgaagatgagcgggctgtaagcaccgaggatgccaaagagtttgccgagaaggagaacctcttcttcctggagacgtccgcgctgcaggccaccaatgtcgaaagcgccttccagactgtcttgtcagagatcttcaagatccacagcaagaagaacatagtgaccgacccaaaggccaatggtgctgcgccgccgctggccggcaagaaggttcttgtcccaggcccagcacaggagatcccgaagagcaagtgctgcagttctatgtaatctctgctaccagatttgttggatttgtgtgtgttttgagaatattcacgctgtctggatatagatccctactgatatagtcttaggtttcaagtattggttcatttggtgagacggatggggtcggtggcagagcaagattttgcactcatctccagagactatgaggttagggagtgagcagatgagctcccttttcgtaggtccgagctgtgggattgattatcaattgccgtgtatgatgactcaggacaccgcgaagcctttatgtaatgttatacatatataccccatactggcacacatgccgatgcgttgcaaaa

SEQ ID NO: 3278 - DNA, 1169 bp, Sorghum bicolor
ccctcgcccgaccttcgcccacgcgcattccgctgcctcactccgtgcctccgccgccgctttcgttgctcacgagcgagatagccggagctagcaagggagggaggaggcgatgaaggggggcggggataaggttgactacgtcttcaaggtggtgctcatcggcgactccgccgtcggcaagtcgcagatcctggcgcgcttcgcccgcaacgagttcagcctcgactccaaggccaccatcggggtcgagttccagacccggacgcttgtcatcgaccacaagtccgtcaaggcgcagatctgggacaccgccgggcaggagaggtatagagctgtcacaagtgcctactacagaggtgctttgggagctctgctagtctatgatatcacgaaacgccagagctttgaccacatacctcgctggctggaagaacttcggggccatgctgacaagaacattgtcatcatgctggtcggcaacaagagtgaccttgaagaggagcgcgctgtaagcagcgaggatgccaaggagtttgctgagaaggagaacctcttcttcctcgagacatctgcgctgcaggcgactaatgtcgagaatgccttccagaccgtcttgacagagatctttaagatccacagcaagaagaacatggcagcagacccaaaggccaatggggctgcaccttcgctggcagggaagaaggtcatcgtcccaggcccagctcaggagatccctaagagcaagtgctgcagttccatgtgacatgttctgaatttatttgggtttgtttgtgtccaaaatattctcgatatctttgtggatgtacatctatactggaataggcttagatttgaaatactggttatctttgtgttcggaacgaagggaacgatatcatagtttagatttgtcacccgtctccaaggtgacacgaggaggatagggaccgaggagaaaagctctgtttgcatagacttgttggattaattacaaaaaatagaagtgtatgcagaattattatttttacgatgccttgaaacctttgtgtacagtgagacaccgatacaatacaactgtatcaacctgcttgtgtgataacctttggtgtgcatggaccgtctgcaccgtatgggtttataattacacaaaactgtctgtattatag

SEQ ID NO: 3279 - DNA, 1068 bp, Triticum aestivum
gatcgggctaaacttcggcaaagggtaaaacacgaaatttggcctcgcttcgactcaaatcaaaagcccaaactccgacacgcagcgctccgcccacgcgcacttcagctccacgacccacacgcctcgctcgctcactcctccggctgccgccaacgccgccgttctgcacgagcgaagacgatggcgagcggggagaaggtggactatgtgtttaaagtggtgctgatcggggactcggccgtcggcaagtcgcagatcctggcgcggttcgcgcgcaacgagttcagcctcgactccaaggccaccatcggtgtcgagttccagacgcgcacgctcgtcatcgaccacaagtccgtcaaggcccagatctgggacaccgccggccaggagaggtacagagctgtcacgagcgcatattacagaggcgctttgggagctctgctagtctatgacatcaccaagcgccagagctttgaccacatacctcgctggctggaggaactccgaggtcatgcagacaaaaacattgtcatcatgctggttggcaataagagcgaccttgaagatgagcgggctgttagcactgaggatgccaaagagtttgccgagaaggagaacctcttcttcctggagacgtccgcgctgcaggccaccaatgtcgaaagcgccttccagactgtcttgtcagagatcttcaagatccacagcaagaagaacattgtgaccgacccaaaggccaatggtgctgcgccgccgctggccggcaagaaggttcttgtcccaggcccagcacaggagatcccaaagagcaagtgctgcagttctatgtaatctctgctaccagatttgttggatttgtgtgtgttttgagaatattcacgctgtctggatatagatccctactgagatagtcttaggtttcaagtattggttcatttggtgagacggatggggtcggtggcagagcaagattttgcactcatctccactgactatgaggttagggagtgagcagatgaactcccttttcataggtccgagccgtgggattgattatcaattacc

SEQ ID NO: 3280 - DNA, 1231 bp, Zea mays
gtcgtccgtcccaggctcccagccccggcgccccgtctcaaatcaaaaaaattcgtctcaaatctcaaacccataaaaaatactgtattttccaaccaagccactcgcccgaccttcatccgcattccacgcgcactccgctgcctcactccgagactccgccgctgcttccaacttccgttgcgcacgagcgaaacatccggagctagcaagggaggaggaggaggaggcgatggcggggggcggggataaggtggactacgtcttcaaggtggtgctcatcggcgactccgctgtcggcaagtcgcagatccttgcgcgcttcgcccgcaacgagtttagcctcgactcgaaggccaccattggggtcgagttccagactcggacgctcgtcatcgaacacaagtccgtcaaggcgcagatctgggacaccgccgggcaggagaggtatagagctgtcacaagtgcctactacagaggtgctttgggagctctgctagtctatgatatcacaaaacgccagagcttcgaccacatacctcgctggctggaagagcttcggggccatgctgacaaaaacattgtgatcatgctggttggcaacaagagcgacctcgaagacgagcgtgccgtaagcaccgaggacgccaaggagtttgccgagaaggagaacctcttcttccttgagacctccgcgctgcaggcgaccaatgtagaaaatgccttccagaccgtcttgacagagatctttaagatccacagcaagaagaacatggcagcggacccaagggccaatggggccgcaccatcgctggcagggaagaaggtcatcgtcccaggcccagctcaggagatccctaagagcaagtgctgcagttccatgtgacatgttgcctgaattttatttgggtttgttcgtgtccgaggtattctcagcatctttgtggatgtataatactggaataggcttagatttgaattgctggttaacttgattttcggttttgaagggaccgatatcgtagtttagatttgtcacccgtcttcaagatgacgaggatagggagcgagaagaaaacatatgtttgcatagactttgttggattttacaaaaatagcagtgtaagcacattattttttccccgatgccttgaaacccttgtgtacagtagagatggatcctaaacatcttaattacaggataaatttaatatttgaaatagatatgtat

SEQ ID NO: 3281 - DNA, 1220 bp, Panicum virgatum
ggcgactcggcggtcggcaagtcgcagatcctggcccgcttcgcccgcaacgagttcagcctcgactccaaggccaccatcggggtcgagttccagacccgcaccctcgtcatcgatcacaggagcgtcaaggcccagatctgggacaccgccggccaggagagatatagggccgtgacaagtgcatattacagaggtgcgctgggagctcttctggtctatgacatcaccaggcgccagagctttgatcatataccacggtggctagatgaactccgtgcccatgctgacaagaacatagtgataatgctagttggcaacaagagcgaccttgaggagcagagggcggtgagtactgaggatgccaaggagtttgctgagaaggagaacctcttcttcctggagacctctgcacttcaggcaacaaacgtagagagtgctttccaaaccgtcttgacagagatcttcaaaattcacagcaagaagaacatggtgtccgagccaaagagcaatgggtctgccccagcaatgccagggaagaaggtccttgtcccaggtccggcgcaggaaatcccgaagagcaagtgctgtagttccatgtgatgcttctatattgtgtgttgaatatatccctgcaatattgtttggtcgtatatccctgccgaaatactcagattttggcgggttgattgtgttgaaccactgttgtatcttagattttgtcacaattgtgacatgaggggaaggatgttctgatgtcttggtgttgctgttctctgattgatacacattttttcctgctggaaatatccatagcactgattgtttttgagatatcagtcggtttctgatggtgcaagtgtttttttttttttgccttgctcaggaccatcctcctgacatcatgtgcaatccatatttgaggactgtaggtaatagtagggacaggaaagagacgaaatgaaaatcagctgacaaaaaaaagaatagaaacgctgggtgcaccaaaattagctcagcagggaaaaaaaagtggtggtctgttgtagtagggatccctgggcctgagaagtgggcccatggtgcagcggcctgttatccttccaccgttggaagcgggcagtgatcgctgctctgttaaaccagcctcacgccgtttctgccaacttcaggtccagggaggcccaaatctttcgatcaagccccccgcaggccactac

SEQ ID NO: 3282 - DNA, 1265 bp, Brachypodium distachyon
ccttggtctcgcagtcctgctcttctcccccgcttccttcgcttcgacgccaaaccccaaactcccaccgatccatctacgcgcacctgacctccccggcccccacgccaagctcgctcgctcgctcatccggccacagccaccgccgccccgcacgagcgaagccgatggcgggcggggacaaggtcgactacgtgttcaaggtggtgctgatcggggactcggccgtcggcaagtcgcagatcctggcgcggtttgcgcgcaacgaattcagcctcgactccaaggccaccatcggggtcgagttccagacgcgcacgctcctcatcgaccacaagtccgtcaaggctcagatctgggacaccgccggccaagagaggtacagagctgtcactagtgcatactacagaggcgcgttgggagctctgctagtctatgacatcaccaagcgccagagctttgaccacatacctcgctggctggaggaactacgagggcatgcagacaagaacattgtcatcatgctggttggcaacaagagcgaccttgaagacgagcgggctgttagcactgaggatgccaaggagtttgctgagaaggagaatgtcttcttcctggaaacatctgcactgcaggccaccaatgttgaaaatgctttccagactgtcctgtcagagatcttcaagatccacagcaagaaaaacattgcggctgaaccaaaggccaatgggtccgctccgtcgctggcaggcaagaaggtccttgttccaggacctgcgcaggagatcccgaagagcaagtgctgcagctctatgtaactttgattcatttgtctgtgttttgagaatattcacgtggattggatatagattcctactgagatagtcttaggttttgagtattcattgatttggtgaggcggatggggttggtatcatagctagatctgtcacttgtctcaactgtgacaatgaggtcaggaagtgagcagatgagctcttcttaggtctgagctgtggatcgatagctcataaccgtgtatgacgattgcttcatgacacctcgaagcctttgtgtaatggtatgcctattatatgggctcgttgctactgtttaggctttactgtatcggtgcctctgtatcaagtagcattcatgtagcggatttgccacactttattattttaaaaccatttttggagatgtaaaacacacgaacatgtattcctgatcctgaaccaatataccctgcccatgtatcagtc

SEQ ID NO: 3283 - DNA, 1297 bp, Brachypodium distachyon
gccgcctaccaaccggacccgctccttggtctcgcagtcctgctcttctcccccgcttccttcgcttcgacgccaaaccccaaactcccaccgatccatctacgcgcacctgacctccccggcccccacgccaagctcgctcgctcgctcatccggccacagccaccgccgccccgcacgagcgaagccgatggcgggcggggacaaggtcgactacgtgttcaaggtggtgctgatcggggactcggccgtcggcaagtcgcagatcctggcgcggtttgcgcgcaacgaattcagcctcgactccaaggccaccatcggggtcgagttccagacgcgcacgctcctcatcgaccacaagtccgtcaaggctcagatctgggacaccgccggccaagagaggtacagagctgtcactagtgcatactacagaggcgcgttgggagctctgctagtctatgacatcaccaagcgccagagctttgaccacatacctcgctggctggaggaactacgagggcatgcagacaagaacattgtcatcatgctggttggcaacaagagcgaccttgaagacgagcgggctgttagcactgaggatgccaaggagtttgctgagaaggagaatgtcttcttcctggaaacatctgcactgcaggccaccaatgttgaaaatgctttccagactgtcctgtcagagatcttcaagatccacagcaagaaaaacattgcggctgaaccaaaggccaatgggtccgctccgtcgctggcaggcaagaaggtccttgttccaggacctgcgcaggagatcccgaagagcaagtgctgcagctctatgtaactttgattcatttgtctgtgttttgagaatattcacgtggattggatatagattcctactgagatagtcttaggttttgagtattcattgatttggtgaggcggatggggttggtatcatagctagatctgtcacttgtctcaactgtgacaatgaggtcaggaagtgagcagatgagctcttcttaggtctgagctgtggatcgatagctcataaccgtgtatgacgattgcttcatgacacctcgaagcctttgtgtaatggtatgcctattatatgggctcgttgctactgtttaggctttactgtatcggtgcctctgtatcaagtagcattcatgtagcggatttgccacactttattattttaaaaccatttttggagatgtaaaacacacgaacatgtattcctgatcctgaaccaatataccctgcccatgtatcagtcagttacaaa

SEQ ID NO: 3284 - DNA, 1082 bp, Secale cereale
cccccctggtctcgctcgcctctccctcgcttccttcgcttcgactcaaatcaaaacctccacgacccacacgcctcgctcgctcactcctccggccgccgccaccgctgccgttctgcacgagcgaagacgatggcgagcggggagaaggtggactatgtgtttaaggtggtactgatcggggactcggccgtcggcaagtcgcagatcctggcgcggttcgcgcgcaacgagttcagcctcgactccaaggccaccatcggtgtcgagttccagacgcgcacgctcgtcatcgaccacaagtctgtcaaggcccagatctgggacaccgccggccaggagaggtacagagctgtcacgagcgcatattacagaggtgctttgggagctctgctagtctatgatatcaccaagcgtcagagctttgaccacatacctcgctggctggaggaactccgaggtcacgcagacaaaaacattgtcatcatgctggttggcaataagagcgaccttgaagatgagcgggctgtaagcactgaggatgccaaagagtttgccgagaaggagaacctcttcttcctggagacgtccgcgctgcaggccaccaatgtcgaaaattccttccagactgtcttgtcagagatcttcaagatccacagcaagaagaacattgtgactgacccaaaggccaatggtgctgcgccgccgctggccggcaagaaggttcttgtcccaggcccagcacaggagatcccaaagagcaagtgctgcagttctatgtaatctctactaccagatttgttggatttgtgtgtgttttgagaatattcacgctgtctggatatagatccctactgagatagtcttaggtttcaagtattggttcatttggtgagatggatggggtcggtggcagagcaagattttgcgctcatctccactgactatgaggttagggatgagcagatgaactcccttttcataggtccgagctgtgggattgattatcaattgccgtatatgatggctcaggacaccgtgaagccttgatgtaatgttttatatatatatatccctccgtt

SEQ ID NO: 3285 - DNA, 1118 bp, Festuca arundinacea
cctccctcgctcactcctccggccgccaccaccgccgccgccgttccgcaagagcgacggccatggcgggaggggagaaggtagactacgtgttcaaggtggtgctgatcggggactcggccgtcggcaagtcgcagatcctggcgcggttcgcgcgcaacgagttcagcctcgactccaaggccaccatcggggtcgagttccagacgcgcacgctcgtcatcgaccacaagtccgtcaaggcccagatctgggacaccgccggccaggagaggtatagggctgtcacaagtgcatactacagaggcgcgctgggcgctttgctagtctatgatatcaccaagcgccaaagctttgaccacatacctcgctggctggaggaactacgtgggcatgcagacaagaacattgtcatcatgctggttggcaacaagagtgacctcgaagacgagcgtgctgtgagcaccgaggatgccaaggagtttgcggagaaggagaacctcttcttccttgagacatccgcgatgcaggccaccaatgtcgagaattccttccagactgtcctgtcagagatcttcaagatccacagcaagaagaacatcgcggctgacccaaaggttaatggggccgccccatcgctggcaggcaagaaagtccttgtcccaggtcctgcgcaggagattccaaagagcaagtgctgcagttccatgtaaccgatttggcttgtttgtgtttttgagaatattcacgtggtctggatatagatccctactgagatagtcttaggtttcgagaattggttgatttggtgagacgttgatgtcatagctacatttgtcacttatcatgactgtgacaatgaggttagcgagtgagcagatgagctctctttcatagttctgagctgtggagtcgattacctgtagctgtgttttaacgattgttctatgacacctcgaagcctttatgtaatatcattcatattatatcaacccgttgctattgtttaggcttttctgtatcgataatctgaagtcagtgagacggtcttgttgtgatttgctgagcaatgctacttttcagacattaactttttcaaaaaaaaaaaaaaaaaaaaa

SEQ ID NO: 3286 - DNA, 1235 bp, Oryza sativa
ttccacgcgagcccgagttgcacggcaccaccaccgccttcttccttcactcgacccgaccgccgtctcgtccgtcttccccgcttcctccgcctccaaaaccccccatcccaacccgacctcctcactcgccctcccctcgcgcttcgcttcgctccgatccgaccgccgccgccgccgccgccacagcgagaagagagagagggagatggcgggcggggagaaggtggactacgtgttcaaggtggtgctgatcggggactccgccgtcggcaagtcccagatcctcgcccgcttcgcccgcaacgagttctccatcgactccaaggccaccatcggcgtcgagttccagacccgcaccctcctcatcgaccacaagtccgtcaaggcccagatctgggacaccgccggccaggagaggtatagagctgtcacgagtgcatactacagaggagcattgggagctctcctagtctacgatatcaccaagcgccagagctttgatcacatccctcgctggctggaggagctccgtggccatgcggacaagaacatagtcatcatgctggttggcaacaagagtgatcttgaagacgagcgggccgtgagcaccgaggatgccaaggagtttgctgagaaggagaacctcttcttcctggagacctccgctctgcaggccaccaacgtcgagaacgccttccagaccgtcctgtcagagatattcaaaattcacagcaagaagaacatggcagcggacccaaaagcaaacggcgctgccccatcgctagcagggaagaaggtcgtcgtcccgggcccagcgcaggagatccccaagagcaagtgctgcagttccatgtgatcttactctactcagattcagctgtatttgtgtgcctctttttgagaattttcacgcgatctttctggatgtacatccctgctcaaatagctctaggctgcgagtattgttggactattggttgtttcggtgatcaggtggacgggatagcttagaatttgtgacattttgtcacttctctcagctggagtagggtgcgagcagaggagctctatttttcataggagtgggttaatttgtgggggttaattaccaatagccatgtatgccgattgttttacatttcttaaatcctttatgtattgttacacgtattactattaatatctacttgctgctatgacaccgtactaagtgtggcattgccttaccgaat

SEQ ID NO: 3287 - DNA, 888 bp, Avena sativa
gacgagagtattccgcaccgcacgccgcctaccaacccgacctgtttttccccttggtctctctcgctcgtccctaccccgcttccttcgctagactcgaagcaaaaccccagactcccacacgctccattcacacgacgcctcgctcgctcgctcacctctccggctgccaccaccgcggccgtgccgcacgagcgaaggcgatggcgggcggggagaaggtagactatgtgttcaaggtggtgctgatcggggactctgccgtcggaaagtcgcagatcctggcgcggttcgcgcgcaacgagttcagcctcgactctaaggccaccatcggggtcgagttccagacgcgcacactcgtcatcgaccacaagtctgtcaaggcccagatctgggacaccgccggccaggagaggtatagagctgtcacaagcgcatactacagaggtgcgctgggagctttgctagtctatgatatcaccaagcgccaaagctttgaccacatacctcgctggctggaggaactccgggggcatgcagacaagaacattgtcatcatgctggttggcaacaagagtgacctcgaagacgagcgtgctgtgagcaccgaggatgccaaggagtttgcggagaaggagaacatattcttccttgagacgtctgcgatgcaggccaccaatgttgagaattccttccagactgtcctgtcagagatcttcaagatccacagtaagaaaaacatcacggctgacccgaaggccaacggggctgccccatcgttggcaggcaagaaagtccttgtcccaggccctgcacaggagatcccaaagagcaaatgctgcagttccatgtaaccgatttgatttgcttctgttttgagaatattca

SEQ ID NO: 3288 - DNA, 1034 bp, Lolium multiflorum
cccgccaccaccaccgccgccgccgttccgcaagagcgacgcccatggcgggaggggagaaggtagactacgtgttcaaggtggtgctgatcggggactcggccgtcggcaagtcgcagatcctggcgcggttcgcgcgcaacgagttcagcctcgactccaaggccaccatcggggtcgagttccagacgcgcacgctcctcatcgaccacaagtccgtcaaggcccagatctgggacaccgccggccaggagaggtatagggctgtcacaagtgcatactacagaggcgcgctgggtgctttgctagtctatgatatcaccaagcgccaaagctttgaccacatacctcgctggctggaggaactacgtgggcatgcagacaagaacattgtcatcatgctggttggcaacaagagtgacctcgaagacgagcgtgctgtgagcaccgaggatgccaaggagtttgcggagaaggagaacctcttcttccttgagacatccgcgatgcaggccaccaatgtcgagaattccttccagactgtcctgtcagagatcttcaagatccacagcaagaagaacatcgcggctgacccaaaggttaatggggccgccccatcgctggcaggcaagaaagtccttgtcccaggccctgcgcaggagattccaaagagcaagtgctgcagttccatgtaaccgatttggcttgtttgtgtttttgagaatattcacgtggtctggatatagatccctactgagatagtcttaggtttcgagaatcggttgatttggtgagacgttgatgtcatagctacatttgtcacttatcatgactgacaatgaggttagcgagtgagcagatgagctctctttcatagttctgagctgtggagtcgattacctgtagctgtgttttaacgattgttctatgacacctcgaagcctttatgtaatatcattcatattatatcaacccgttgctattgtttaggcttttctgtatcgataatctgaagtcaggtgagacggtcttgt

SEQ ID NO: 3289 - DNA, 811 bp, Echinochloa colona
gactacgtcttcaaggtggtgctcatcggcgactccgcggtcggcaagtcgcagatcctggcccgcttcgcccgcaacgagttcagcctcgactccaaggccaccatcggggtcgagttccagacgcggacgctcgtcatcgaccacaagtccgtcaaggcgcagatctgggacaccgccggccaggagaggtatagagctgtcacaagtgcgtactatagaggtgctttgggagctctgctagtttatgatatcaccaagcgccagagctttgatcacattcctcgttggctggaagagctccgcggccatgcggacaagaacattgccatcatgctagttggcaacaagagtgacctcgaggaggagcgagccgtgagcaccgaggacgccaaggagtttgctgagaaggagaacctcttcttcctggagacttctgcgctgcaggccaccaatgtcgagaatgcctttcagaccgtcttgacggagatcttcaagatccacagcaagaagaatatggcaccagacccaaaggccaatggtgctgccccgtccctggcagggaagaaggtactcgtcccaggtccggcccaggagatccccaagagcaaatgctgcagttccatgtgatacgttgcccggaattctttgggtttgtgtgcgtcgaaaatattcatgcaatcttaatggatgtatatctcgactggcataggcttagatttgaattactggttattttgttgtgcggattgaagggatcgatatcatagtttagatttgccacccgtctccatggtgaggatagggagcg

SEQ ID NO: 3290 - DNA, 903 bp, Avena sativa
cgcttccttcgctagactagaagcaaaaccccgaactcccacacgctccattcacacgaacttacgcctcgctcgctcgcttctccggccgccaccaccgccgccgtgccgcacgagcgaaggcgatggcgggcggggagaaggtagactatgtgttcaaggtggtgctgatcggggactcggccgtcggaaagtcgcagatcctggcgcggttcgcgcgcaacgagtttagcctcgattccaaggccaccatcggggtcgagttccagacgcgcacactcgtcatcgaccacaagtctgtcaaggcccagatctgggacaccgccggccaggagaggtatagagctgtcacaagcgcatactacagaggtgcgctgggagctttgctagtctatgatatcaccaagcgccaaagctttgaccacatacctcgctggctggaggaactccgggggcatgcagacaagaacattgtcatcatgctggttggcaacaagagtgacctcgaagacgagcgtgctgtgagcaccgaggatgccaaggagtttgcggagaaggagaacatattcttccttgagacgtctgcgatgcaggccaccaatgttgagaattccttccagactgtcctgtcagagatcttcaagatccacagtaacaaaaacatcatggctgacccgaaggccaacggggctgccccatcgctggcaggcaagaaagtccttgtcccaggccctgcacaggagatcccaaagagcaaatgctgcagttccatgtaaccgatttgatttgcttctgttttgagaatattcatgcggtctggatatacatccctagtgagatagtcttaggttttgagtattggtttatttggcgagatgtcgatctcagagcttatcttgactg

SEQ ID NO: 3291 - DNA, 771 bp, Avena sativa
ctaccccgcttccttcgctagactagaagcaaaaccccgaactcccacacgctccattcacacgaacttacgcctcgctcgctcgcttctccggccgccaccaccgccgccgtgccgcacgagcgaaggcgatggcgggcggggagaaggtagactatgtgttcaaggtggtgctgatcggggactcggccgtcggaaagtcgcagatcctggcgcggttcgcgcgcaacgagtttagcctcgattccaaggccaccatcggggtcgagttccagacgcgcacactcgtcatcgaccacaagtctgtcaaggcccagatctgggacaccgccggccaggagaggtatagagctgtcacaagcgcatactacagaggtgcgctgggagctttgctagtctatgatatcaccaagcgccaaagctttgaccacatacctcgctggctggaggaactccgggggcatgcagacaagaacattgtcatcatgctggttggcaacaagagtgacctcgaagacgagcgtgctgtgagcaccgaggatgccaaggagtttgcggagaaggagaacatattcttccttgagacgtctgcgatgcaggccaccaatgttgagaattccttccagactgtcctgtcagagatcttcaagatccacagtaacaaaaacatcatggctgacccgaaggccaacggggctgccccatcgctggcaggcaagaaagtccttgtcccaggccctgcacaggagatcccaaagagcaaatgctgca

SEQ ID NO: 3292 - DNA, 1136 bp, Echinochloa colona
cgcagactccaccacctgctcctcctcctcttcttctccaaccttgtgatcctggaaagtagaaatcaagaaacccgctttcttgatgccaagatcctcctagctggactaaccgagagaggaagggcatcgttcttgttctcgcacgggagaaaacaattctagggagagacagaaagccaggaggatcgcatctatctgtgtgagtttggggacagcgggcgagaggagatgtctcggggcgggagccatggcgagctggggcagaggatcgactacgtcttcaaggtggtgctcatcggcgactccgcggtcggcaagtcgcagatcctggcccgcttcgcccgcaacgagttcagcctcgactccaaggccaccatcggggtcgagttccagacgcggacgctcgtcatcgaccacaagtccgtcaaggcgcagatctgggacaccgccggccaggagaggtatagagctgtcacaagtgcttattatagaggtgctttgggagctctgctagtctatgatatcaccaaacgccagagctttgaccacattcctcgttggttggaagagctccgtggccatgccgacaagaacattgtcatcatgctagtcggcaacaagagtgaccttgaggaggagcgagccgtgagcactgaggacgccaaggagtttgccgagaaggagaacctcttcttcctggagacttctgcgctgcaggccaccaatgtcgagaatgcctttcagaccgtcttgacggagatcttcaagatccacagcaagaagaatatggcaccagacccaaaggccaatggtgctgccccgtccctggcagggaagaaggtactcgtcccaggcccggcccaggagatccccaagagcaaatgctgcagttccatgtgatacgttgcccggaattctttgggtttgtgtgcgtcgaaaatattcatgcaatcttaatggatgtatatctcgactggcataggcttagatttgaattactggttattttgttgtgcggattgaagggatcgatatcatagtttagatttgccacccgtctccatggtgaggatagggagcgagcagaagagctgtatttgcatagacttgtggaattaattacaaatagcagc

SEQ ID NO: 3293 - DNA, 883 bp, Musa acuminata
gagggatcgggtcactcgccagtgtttgcttctagctctactcttgccgacggaacggaagaggcccgtcgagcgcggtgtcggtagtggtgggagcagcggcgggaatggcgggcgggagcgacaagatcgactacgtgttcaaggtggtgctgatcggggactcggcggtggggaagtctcagatcctggcgcggttcgcgcgcaacgagttcagcctcgactccaaggctaccatcggggtggagttccagacgcggaccctcgtcatccagcacaagagcgtcaaggcccagatctgggacaccgccggccaagagaggtacagagccgtcaccagtgcatactatagaggtgcagttggggcgttaatggtttacgatatcacgagacgtcaaagcttcgaccacatttctcggtggctcgaggagctgcggagccatgccgacaggaacattgtgatcatgttggtaggcaacaagaccgatctcgaggaccagagagcagtgaccaccgaagacgcccgcgagtttgctcaaaaggaaaacctattcttcctggaaacatcagcactggaggccaccaatgtggagaacgcgttccaaatggtgctcaccgagatcttcaacattgtcaacaagaagaacctgacttctgatccccagagcaataacagtgcaccagcactgcctgggaagaaggtcatcatccctggcccagctcaggagataccaaagagtaagacatgctgtaagacttcctaagccttgctcgccttcggtctcgagtcatttgagctgtgtcacagtaataacaatgtttcttttattggcaaaatgttttgtaggggaacagctttataaactttgaagcgtcaattcga

SEQ ID NO: 3294 - DNA, 2026 bp, Cocos nucifera
aaaaaatacccttctcgttgacggagtcttctagcttcgtccaagatcccgtcacctacccatggcctggcgtgccccaagcaaatgaccatccccaaaatccttaaaccagccgtgtaagcccgtcatgttagcttatcctcacttaaggtggcgaaaaaccagtacagctagcctccagcaaacacccgtcggtggtattttcgtcctttaatttatcggttcaagtgctttgccgactctcctcctctgaggtcgtattagactactccactctcggccagaaacgaaagggagagcgagccccgatcgggatccggtcactctcctccatttctttctctctctcatctccgctccttccttctactgctctcgcggttacagcggcggcggaagcgatggcggctgtcggtgagaagatcgactacgtgttcaaggtggtgctcatcggagactcggcggttgggaagtcccagatcttggcccgctttgcgcgcgacgagttcagcctcgactccaaggccactatcggggtcgagttccagacccggacccttgtcatccagcacaagagcgtcaaagcccagatctgggacaccgctggtcaagaaaggtatagggctgtcacaagtgcttactatcgaggcgctgtaggggctttgctggtttacgacataaccaagcgtcagagctttgatcatataccacggtggctggaggagctacgaagtcatgctgacaagaacattgtgatcatgctagtgggcaacaagagcgatcttgaggaccagagggccgtgtccacagaagatgccagcgagtttgcacagaaggaaaaccttttcttcctcgaaacatcggcactggaagctagaaatgtggagactgccttccaaactgttctgaccgagatttttaacatcatcaacaagaagaacgtggtttcggaacctcaaggcaatggcaatgcaccaacactatctgggaaaaagattgtcatccctggaccagcacaggagattccgaagaagaagatgtgctgtcaggcatcttgattttgcatccgtaggcttggattacagtttggaattgtgtgctagaatcagttgggctgtctttgtaatagctgtatatcctattggtatagtttaagggaatcaatattggacttcgagagaattgttttgtggctaaatggatttgagttgtgataaattaaatagctttctggtgcttttttagctatatgatatagatcatatagatgatagttatacagaacgaacatgtgttgatcgtgattcaaagattacagcagaatgggctacatctgacccgaagcttataattgggctgagaatatgcgatgataatggattagaattaaaggcaagattttaggtgccattttccctgagttgttgttgaataggatcactcgatcggatcggtgtttaggattgtgtaaatcaggggtcattccaagcctgccgcaaaccccgcttttgtgcacctttactgttatctgggctaagaattgcgcatggatattccttccgctgctgctgctgctgaaagaaaaaggtattcttgttggaactattgctaactttcggcttttgagttggcatgtagagttattgaggtgtcagctaggttctgcgtaccactcaaccaggagaaattattgcgtgcaccaggtggcgagcatatgcacggtgaaagcaatcgggaattggtgaaacgcaaggggcaacgtcgcctgttatctaccttgggatttggcgcggtccgattgcacctggtgcatgcgatactgagacctcaaccagtcactaactttcgcgtggtagactggccagcaaaactttttcccattatcactacccacggtccaacgtccccagccctcccaaggcctagaggactcattccaaaggttaaaaccaaacatgcatatgtacaagtttcagaaaaaagaaatccagaagagcggagtactttatcataatacacattttaa

SEQ ID NO: 3295 - DNA, 928 bp, Musa acuminata
ggactcagtaacacagtccttaagaagtacgccttgcagactacggaagctacagcgaaagtgatcgggtcgctccgtggtgttacattcgctctactctgccggtggaaacaggggaagccctcgagcgcggtggtggtgctcggggaatggcgggcggcggcagcgagaaaatcgactacgtgttcaaggtggtgctgatcggggactcggcggtggggaagtcgcagatcctggcgcgattcgcgcgtgacgagttcagcctcgactccaaggccaccatcggggtggagttccagacgaggaccctcgtcatccagcacaagagcgtcaaggcccagatctgggacactgccggccaggagaggtacagagctgtcaccagtgcgtactaccgaggggcagtgggcgcattgttggtttacgatatcaccaagcgccaaagctttgaccatattcctcggtggcttgaagagctgcggagccatgccgacaggaacatcgtgatcatgttggttggcaacaagaccgatctcgaggaccagagagctgtaaccacggaagatgcccgagaattcgctcagaaggagaacctcttctttctggaaacctcggcactcgaagcgacgaatgtcgagaacgccttccaaactgtgctgaccgagatcttcaacatcgtcaacaaaaagaacctgacatccgaccctcagagcaacaatgccgcacctacgcagccaggaaagaagatcatcgtccctggcccggctcaggagatacccaagaacaagacatgctgtaacacttcctaagttttgtttccttgtggtagtttgtgtgtagagttgtcgtccgtaattgctatatgtcttcttgattggtaatatcttagcggaattctggatttggtaagaattgattcagtttgtgt

SEQ ID NO: 3296 - DNA, 723 bp, Ananas comosus
cctcctcgatctcgacctcttcctcctcgatctcgacctcttcggcgaggccatgggggacagggtcgactacgtgttcaaggtggtgctcatcggggactcggcggtggggaagtcgcagatcctggcgcggttcgcgcggaacgagttcgccctcgactccaaggctacgatcggggtcgagttccagacgcggaccctcgtcatcgaccacaagagcgtcaaggcccagatctgggacaccgcgggacaagagaggtacagggcggtgacgagcgcatactaccgcggcgcggtgggggctctgctggtctacgacataaccaggcggcagaccttcgaccacataccgcggtggctggacgagctgcgggcgcatgccgacaagaacatcgtcatcatgctggtgggcaacaagaccgacctcgtcgaccagcggaccgtgccaaccgaggatgccagagagttcgccgaaaaggagaacctcttcttcctcgagacgtcggcgctcgaagccacgaacattgagaacgctttccaaaccgttctaaccgagatattcaatatcgtcaataagaagaaccttgcctctgattcgcagagtaacggaaatgggagcgcgccgatctcggggaagaagattatcgtgccggggccagcgcaggagataccgaagagcaaggcctgctgcaaaagtttgtaagtttctttctcttttccccc

SEQ ID NO: 3297 - DNA, 681 bp, Musa acuminata
ggcgggaatggcgggcgggagcgacaagatcgactacgtgttcaaggtggtgctgatcggggactcggcagtggggaagtctcagatcctggcgcggttcgcgcgcaacgagttcagcctcgactccaaggctaccatcggggtggagttccagacgcggaccctcgtcatccagcacaagagcgtcaaggcccagatctgggacaccgccggccaagagaggtacagagccgtcaccagtgcatactatagaggtgcagttggggcgttaatggtttacgatatcacgagacgtcaaagcttcgaccacatttctcggtggctcgaggagctgcggagccatgccgacaggaacattgtgatcatgttggtaggcaacaagaccgatctcgaggaccagagagcagtgaccaccgaagacgcccgcgagtttgctcaaaaggaaaacctattcttcctggaaacatcagcactggaggccaccaatgtggagaacgcgttccaaatggtgctcaccgagatcttcaacattgtcaacaagaagaacctgacttctgatccccagagcaataacagtgcaccagcactgcctgggaagaaggtcatcatccctggcccagctcaggagataccaaagagtaagacatgctgtaagacttcctaagccttgctcgccttcgg

SEQ ID NO: 3298 - DNA, 1133 bp, Elaeis guineensis
caacaccgtcggtagtattttcgtcctttaatttctcgggtcaagtgtctcgccgagtctcgtgtgaggtcccaataggccactccacagacagctggaaactagagggagagcgagcaccgagcgggatccggtcactctcctcgattgcttcgctcttctccgctccttccttctactgctctcgtggtgtcggcggcggcggaggcgatggcggctgtcggtgagaagatcgactacgtgttcaaggtggtgctcatcggagactcggcggttgggaagtctcagatcttggcccgctttgcgcgcgatgagttcagcctcgactccaaggccactatcggggtcgagttccagacccggacccttgtcatccagcacaagagcgtcaaggcccagatctgggacaccgctggccaagaaaggtatagggccgtcacaagtgcttactatcgaggcgctgtaggggctttgctggtctacgacataaccaagcgtcagagctttgaccacataccacggtggcttgaggagctgcgaagtcatgctgacaagaacattgtgatcatgctggtgggcaacaagagtgatcttgaggaccagagggctgtgtccacagaagatgccagcgagtttgcgcagaaggaaaaccttttcttcctggaaacgtcggcactggaagctagaaatgtggagactgctttccaaactgttctgactgagattttcaacatcatcaacaagaagaccgtcgtttctgaccctcaaggcaatggcaatgcaccaacactatctggaaaaaagatcgtcatccctggaccagcacaggagattccgaagaataagatgtgctgtcagacatcttgattttgcgtccgcgtaggcttggattacagtttggaattgtgtgctagaatcggttgagctgtctttgcaatagctgtatatcctattcgtatactatcggtatagttttaagggaatcaatattggacttggagagaattgttttgtggctaaatggatttgagttgtgataaattaaatagctttcaggtgcttctttttagttatatgatatagataatatagatcatagttatacagaatgggctacatgtaacacgaagcgt

SEQ ID NO: 3299 - DNA, 1186 bp, Phalaenopsis aphrodite
aaaagttgctcctcggcccagatcgtgcgttgcagcgttctacacttcgctggtctctcaagtcagagagggtttccttcatttcccaggtagggagatatttcggctccacacacactctctttctcagtggagactttgatcgtcggtgctgtgacgagtagaaatggcggccggtggcgataagattgactacgttttcaaggtggtgttaatcggggactcagcggtcgggaagtctcaaatcctggctcggtttgccagaaacgagttcagcctcgactccaaggccaccataggggtcgagttccagacgcggacccttgtcatccagcacaagagcgtcaaggctcagatctgggatactgccggtcaggaaaggtatagagcagtgacaagcgcatactaccgaggtgctgtcggtgctctgctggtctacgacattaccaaacgccagagctttgatcacataccacgatggttggaggaactacggagccatgctgacaaaaacattgttatcatgcttgtcggaaacaaatctgacctggaggatcagagggctgtgtcaaccgaggatgctaaggactttgctcagaaggaaggcctcttcttcttagagacttcagccctggaagccaccaatgtagaggctgctttcatgactgttcttaccgagatattcggcattgtcagcaagcgaaacctgactgctgatgggcaatcaaacggtggtgctgctccgccgttagcggggaagaaaattgtcgtcactggtcccgcgcaggtgattcccaagagcaggacttgctgccagtcttcctgattctatcactgagtatgtcatccgcttcagtatacatctgtgttttatttaagccatattttgattgtatttttctttacttaaatatttagttttgtcagagtctaaggcttaaagcaatatctacctgacttctggaagatatagtaattggttttgtctatggatctgtagaatacaccttttctctgccatttgtgttggcgttcattgttttggtgtctctgcatttatttatgtaattggtatcgtatgtatgtgagctagaatttttatttacctcatttgatcatggccgtcaattttatcatctagtactgtgttgaattggctcacgatctggctcaaagtgtcgtctgt

SEQ ID NO: 3300 - DNA, 1065 bp, Musa acuminata
cgctcacagatggtgagcggactcggcaaaaagtatcctgacttttgacccctgtcctgcctggcgtcggacgcaaccgtgtgagctgaccgggtgctctactcttctaccggaacggaagagagcaggtcgagcgcggcgtcggtggcggtggagcattggcgggaatggcgggcggaggcagtgacaagatcgactatgtgttcaaggtggtgctgatcggggactcggcggtggggaaatcgcagatcctggcgcggttcgcgcggaacgagtttagcctcgactccaaggccaccatcggagtggagttccagacgcgaaccctcgtcatccagcacaagagcgtcaaggcccagatctgggacaccgccggccaagagaggtatagagctgtcacaagtgcatactacagaggagcagttggggccttgattgtttacgatatcaccagacgtcaatgctttgaccacattcctcggtggcttgaggagctgcggagccatgctgacaaaaacattgtgatcatgttagttggcaacaagactgatctcgaggaccagagagctgtaccgatggaagatgcccgggaatttgctcagaaagaaaacctcttctttctggaaacatcagcgctagatgctaccaatgtggagaacgccttccagactgtgctgactgagattttcaacatcgtcaacaagaagagcctgacctctgaccctcagagcaacaacagtgcaccgacactgcctgcaaagaagatcatcatccctggcccagcgcaagagattccaaagagtaagatgtgctgtaaggcttcctagatgatgctttgcctcttcagtagtcgttgctggaagcatccgagttgtcacagtaattgccatatgtctttattgttgaaatcttgatggaggggataagcttctgaacttggaagaattgattcaatcttgtatgtggtttgggtttggtggatcaagtgaaagatccgatgatactttctgtctataccataccacaggctacaacaactaaatagctttccctggcactgtgttt

SEQ ID NO: 3301 - DNA, 960 bp, Musa acuminata
agaagtccgccttgcagattagtcggtgaagggactcagtaacacagtccttaagaagtacgccttgcagactacggaagctacagcgaaagtgatcgggtcgctccgtggtgttacgttcggctctactctgccggtggaaacaggggaagccctcgagcgcggtggtggtgctcggggaatggcgggcggcggcagcgagaaaatcgactacgtgttcaaggtggtgctgatcggggactcggcggtggggaagtcgcagatcctggcgcgattcgcgcgtgacgagttcagcctcgactccaaggccaccatcggggtggagttccagacgaggaccctcgtcatccagcacaagagcgtcaaggcccagatctgggacactgccggccaggagaggtacagagctgtcaccagtgcgtactaccgaggggcagtgggcgcattgttggtttacgatgtcaccaagcgccaaagctttgaccatattcctcggtggcttgaagagctgcggagccatgccgacaggaacatcgtgatcatgttggttggcaacaagaccgatctcgaggaccagagagctgtaaccacggaagatgcccgagaatttgctcagaaggagaacctcttctttctggaaacctcggcactcgaagcgacgaatgtcgagaacgccttccaaactgtgttgaccgagatcttcaacatcgtcaacaaaaagaacctgacatccgaccctcagagcaacaatgccgcacctacgcagccaggaaagaagatcatcgtccctggcccggctcaggagatacccacgaacaagacatgctgtaacacttcctaagttttgtttccttgtggtagtttgtgtgtagagttgtcgtccgtaattgctatatgtcttcttgattggtaatatcttagcggaattctggatttggtaagaattgattcagtttgtgt

SEQ ID NO: 3302 - DNA, 1240 bp, Musa acuminata
tgctcggctgctcaccgctcacagatggtgagcggactcggcaaaaagtatcctgacttttgacccctgtcctgcctggcgtcggacgcaaccgtgtgaggtgaccgggtgctctactcttctaccggaacggaagagagcaggtcgagcgcggcgtcggtggtggtggagcattggcgggaatggcgggcggaggcagtgacaagatcgactatgtgttcaaggtggtgctgatcggggactcggcggtggggaaatcgcagatcctggcgcggttcgcgcggaacgagtttagcctcgactccaaggccaccatcggagtggagttccagacgcgaaccctcgtcatccagcacaagagcgtcaaggcccagatctgggacaccgccggccaagagaggtatagagctgtcacaagtgcatactacagaggagcagttggggccttgattgtttacgatatcaccagacgtcaatgctttgaccacattcctcggtggcttgaggagctgcggagccatgctgacaaaaacattgtgatcatgttagttggaaacaagactgatctcgagggccagagagctgtaccgatggaagatgcccgggaatttgctcagaaagaaaacctcttctttctggaaacatcagcgctagatgctaccaatgtggagaacgccttccagactgtgctgactgagattttcaacatcgtcaacaagaagagcctgacctctgaccctcagagcaacaacagtgcaccgacactgcctgcaaagaagatcatcatccctggcccagcgcaagagattccaaaaagtaaggtgtgctgtaaggcttcctagatgatgctttgcctcttcagtagtcgttgctggaagcatccgagttgtcacagtaattgccagatgcctttattgttgaaatcttgatggagggtataagcttctgaacttggaagaattgattcaatcttgtatgtggtttgggtttggtggatcaagtgaaagatccgatgatactttctgtctataccataccacaggctacaacaactaaatagctttccctggcactgtgtttaatcaagttaatttgtgcactaaaggttctttacgagtaaactctcttaatccctgtttgatacttacaaacgcaaatgcatttctcgtgtttctagaaccaatcttttgttattttcagctcactgtccacaacaataatgtagttttatacaatcaat

SEQ ID NO: 3303 - DNA, 971 bp, Zingiber officinale
cgtcgcgtattccagctcgggagggatcgagtcactcgccgtggttgctgcgatcgcggggctctggtctccatccgcaagccgcggccgcaggaatggcgggcggcagcgacaagatcgactacgtcttcaaggtggtgctgatcggagactctgcggtggggaagtcgcagatcctggcgcgattcgcccgcgacgagttcagcctcgactccaaggccaccatcggggtggagttccagacgaggacgctcgtcatccagcacaagagcgtgaaggcacagatctgggacaccgctggccaagaaaggtatagagctgtcaccagtgcctactaccgtggggcagttggggccttgcttgtttatgacattaccaagcgtcaaagctttgatcatattcctcgatggctcgaggagcttcggagccatgccgacaggaacatagtcatcatgttagtgggcaacaagaccgacctcgaggaccagagaaccataaccacagaagatgcccgggagtttgctcagaaggagaatctcttctttctcgaaacatcagctctagaagctacaaacatcgagaatgccttccagactgtgctgactgagatattcaacatcgtcaacaagaagaacctgacttctgatcctcaaagcaacaacactgcaccaacattgccaggaaagaaaataatcgtccctggccctgcacaggagattccgaagagtaagacctgttgtacaacttcctagcttgtgttcatcttctatgtagctgttcgttacagcggagtagttggctagtcgccttaccctcaaaagcagtagctgtttgttttgaattgtgacatcttggtggaattggaaagaatgagtgggtgaacatgggaagatgtggttcggtgtatggtttaattatatttggttgatatgaaacactttcgatgcttctcttgccaaacccaaaaaaaa

SEQ ID NO: 3304 - DNA, 1074 bp, Elaeis guineensis
ctcgtcagcgagaaacaagagcctagtgggcgagctccatacgggatccggtcactctcccccgctgctctcgctcatctcgcctcctctcttttactactatcgtggtgtgtcgtcgacggcggcgatggcggctggtggcgagaagatcgactacgtgttcaaggtggtcctcatcggggactcggcggtggggaagtcccagatcctggcccgcttcgctcgcaacgagttcagcctcgactccaaggccaccattggggtcgagttccagactcggacactcgtcatccagcacaagagcgtcaaggcccagatctgggacaccgccggccaagagaggtacagggctgtcacaagtgcttactatcgaggtgctgtcggggctttgctggtttatgacattaccaagcgtcagaccttcgaccacatacctcggtggcttgaggagctgcgaagccatgctgacaagaacattgtgatcatgctggtgggcaacaagactgatctagaggaccagagggctgtaaccacagaagatgccagcgagtttgctcagaaggaaaatcttttcttcctggaaacatcagcactggaggctacaaatgttgagaccgccttcgaaactgttctgactgaaatttttaccattgtcaacaggaagaacctggtttctgaacctcaaggcaatggcaatggaccagcactgtctggcaaaaagctcctcatccctggaccagcacaggcgattcctaagaataagatgtgctgtcagacatcttgattttgcattctctggcttggattacggtttggagtcgtgtgctggaatcagttgagctgtctttgtaatagatgtatatcctattggtatagtttaggtttaagggaatcaacattgaacttggagagaattgttttgtctagtggattgagttgcgataaattaaaaagtttcaggtgcttctttgttatataatatagatcatgtagatagtaaataagtattcagaatgaaagagtatgttgtaaggattgggttgcggtgaatcaaatagtttcaggtgcttcttt

SEQ ID NO: 3305 - DNA, 1206 bp, Amaranthus tuberculatus
ttttctcttgttccaaccactaagtagcagcaagttttccatcaacaagtgagagagagaaacaaggaaacatggcgggctatggagattcaagccaaaaggtggactatgtgtttaaggtagtgcttataggagattcagcagtgggaaagtctcagattttggctaggtttgcaagagatgagtttagtttggattcaaaagctactattggtgttgaatttcagactcgaactctagtcattcagcataaaagtgtcaaagctcagatctgggatactgctggccaagaacggtacagagctgtcacaagtgcatattacagaggtgcagttggtgcattattggtttatgacataacaaaacgccaaacctttgagcacataccacgatggctggatgagttacgaggccatgctgacaagaacatcgtcatcatgcttgttggaaacaaatctgatctcgaggatcaacgggcagttgcaacggaggatgctaaagagttcgctgaaaaggaaggccttttctttctcgagacttcagctctcgaagcaacaaatgtggaaacagcttttattacggtcttgaccgagattttcaatattgtaaacaggaaaaccttggctgccaatgaagatcagagtaacggcaatgctgcattattacccggaaagcagatcttagttcctggccctgcccaagaaatcccagctaagaaaggaatgtgctgtagttcataacattcttataaaattttggtcatgtcttgatccctctatcagtttatgttttgccttttgattgttagtttgttactatatttgcgaacgaagattggggaggtgttttttgacgatgaaggagtgttaatggttgctgaattcggaatgaaaaaacaaagctcggaggtatatgcatagctagtctttcttacggatgatatagttgtgtttcgtattacatagaaattggaagtcgaaagtgtggcgttgatatcgtttcttcaatcgcttgttcttatgcttctaccttattcaaccatgcctgattttgaacaatgtagcaaatttgaactttaattaaaaagatatggagtataacattgtggaacattttgatttcatttgaatagtgtgaatatgtcaagtctattatttttagtagcatcacccaaattattgcaattccgatataatggttctctgt

SEQ ID NO: 3306 - DNA, 1212 bp, Amaranthus tuberculatus
ccccccaaatcaattcacactttcctcaaatcacacaactcattcttaccaaaaattgaaactcacaaaaaagtttgcaccaattttctttcccacttcaagatctaccccttaaattttctcttgtttcaacccactcagtagcagcaagttttccatcaactaagtgaggagagagaaacaaggaaacatggcgggctatggagattcaagccaaaaagtggactatgtgtttaaggtagtgcttataggagattcagcagtgggaaagtctcagattttggctaggtttgcaagagatgagtttagtttggattcaaaagcaactattggtgttgaatttcagactcgaactctggtcattcagcataaaagtgtcaaagctcagatctgggatactgctggccaagaacggtacagagctgtcacaagtgcatattacagaggtgcagttggtgcattattggtttatgacataacaaaacgccaaacatttgagcacataccacgttggctggatgagttacgaggccatgctgacaagaacatcgtcatcatgcttgttggaaacaaatctgatctcgaggatcaacgggcagttgcaacggaggacgctaaagagttcgccgaaaaggaaggccttttctttctcgagacttcagctctcgaagcaacaaatgtggaaacagcttttattacggtcttaaccgagattttcaatattgtaaacaggaaaaccttggctgccaatgaagatcagagtaacggcaatgctgcgttattacccggaaagcagatcttagttcctggccctgcccaagaaatcccagctaagaaaggaatgtgctgtagttcataacattctagtaaaattttggtgatgtcttgatccttctatcattttatgtcttgccttttgattgctagttcgatactatatttgcgaacgaagattggggaggtgtttttggacgatgaaggagtgttgatggttgctgaatttggaatgaaaaaacaaagctcggaggtataggcatagctagtcttcagatgatatagttatgtttcgtatttcatagaaattggaagtcgaaagtgtggcattgatatcgtttcttcaatcgcttgttcttatggttttaccttattcaaccatgcctgatttctaaacaatgtagtaaaatttgatatttaatcaaaaaattatggagt

SEQ ID NO: 3307 - DNA, 1042 bp, Amaranthus tuberculatus
tcccctcgttgtcgccttgcctcccacgacctctccccccaaactcaattcacactttcctcaaatcacacaactcattcttaccaaaaattgaaactcacagaaaagtttgcaccatttttctttcccacttcaagatctacccttaaattttctcttgttccaacccactaagtagcagcaagttttccatcaactaagtgaggagagagaaacaaggaaacatggcgggctatggagattcaagccaaaaggtggactatgtgtttaaggtagtgcttataggagattcagcagtgggaaagtctcagattttggctaggtttgcaagagatgagtttagtttggattcaaaagctactattggtgttgaatttcagactcgaactctagtcattcagcataaaagtgtcaaagctcagatctgggatactgctggccaagaacggtacagagctgtcacaagtgcatattacagaggtgcagttggtgcattattggtttatgacataacaaaacgccaaacatttgagcacataccacgttggctggatgagttacgaggccatgctgacaagaacatcgtcatcatgcttgttggaaacaaatctgatcttgaggatcaacgggcagttgcaacggaggacgctaaagagttcgctgaaaaggaaggccttttctttctcgagacttcagctctcgaagcaacaaatgtggaaacagcttttattacggtcttaaccgagattttcaatattgtaaacaggaaaaccttggctgccaatgaagatcagagtaacggcaatgctgcgttattacccggaaagcagatcttagttcctggccctgcccaagaaatcccagctaagaaaggagtgtgttgtagttcataacattcttgtaaaattttggtcatgtcttgatccttctatcattttatgtcttgccttttgattgctagttcgatactatatttgcgaacgaagattggggaggtgtttttggacaatgaaggagtgttgatggttgctgaattcggaat

SEQ ID NO: 3308 - DNA, 1345 bp, Amaranthus tuberculatus
agattcatccctgtcagctttcaccttcatcccaccagtaatacgaacaagtgtttcccttccggacaaatcagttacatggatgaaagtatcattgaaactcacaaaaaagtttacaccaatttttctttccaacttcaagatctaccccttaaattttctcttgttccaaccactaagtagcagcaagtttaccatcaactaagtgaggagagagaaagaaggaaacatggcgggctatggagattcaagccaaaaagtggactatgtgtttaaggtagtgcttataggagattcagctgtggggaagtctcagattttggctaggtttgcaagagatgagtttagtttggattcaaaagcaactattggtgttgaatttcagactcgaactctgctcattcagcataaaagcgtcaaagctcagatctgggatactgctggccaagaacggtacagagctgtcacaagtgcatattacagaggtgcagttggtgcattattggtttatgacataacaaaacgccaaacatttgagcacataccacgatggctggatgagttacgaggccatgctgacaagaacatcgtcatcatgcttgttggaaacaaatctgatctcgaggatcaacgggcagttgcaacggaggacgctaaagagttcgctgaaaaggaaggccttttctttctcgagacttcagctctcgaagcaacaaatgtggaaacagcttttattacggtcttgaccgagattttcaatattgtaaacaggaaaaccttagctgccaatgaagatcagagtaacggcaatgctgcgttattacccggaaagcagatcttagttcctggccctgcccaagaaatcccagctaagaaaggaatgtgctgtagttcataacattcttataaaattttggtcatgtcatgatccctctatcagtttatgtcttgccttttgattgttagtttgttactatatttgcaaacgaagattggggagttgttttttgacgatgaaggagtgttgatggttgctgaatttggaacgaaaaaacaaagcttggaggtataggcatagctagcctttcttacggatgatagttatgtttcgtattacatagaaattggaagtcgaaagtgtggcgttgatatcgttttgttcaatcgcttgttcttatggttctaccttattcaaccatgcctgattttaaacaatgtagcaaatttgaactttgatcaaaaagatatggagtataacattgtggaacattttgatttcatttgaatagtgtgaatatgtcaagtctattatttttagtagcatcacccaaattattgcaattcc

SEQ ID NO: 3309 - DNA, 1133 bp, Amaranthus tuberculatus
ggcgggctatggagattcaagccaaaaagtggactatgtgtttaaggtagtgcttataggagattcagcagtgggaaagtctcagattttggctaggtttgcaagagatgagtttagtttggattcaaaagcaactattggtgttgaatttcagactcgaactctggtcattcagcataaaagtgtcaaagctcagatctgggatactgctggccaagaacggtacagagctgtcacaagtgcatattacagaggtgcagttggtgcattattggtttatgacataacaaaacgccaaacctttgagcacataccacgatggctggatgagttacgaggccatgctgacaagaacatcgtcatcatgcttgttggaaacaaatctgatctcgaggatcaacgggcagttgcaacggaggacgctaaagagttcgctgaaaaggaaggccttttctttctcgagacttcagctctcgaagcaacaaatgtggaaacagcttttattacggtcttgaccgagattttcaatattgtaaacaggaaaaccttggctgccaatgaagatcagagtaacggcaatgctgcattattacccggaaagcagatcttagttcctggccctgcccaagaaatcccagctaagaaaggaatgtgctgtagttcataacattcttataaaattttggtcatgtcttgatccctctatcagtttatgttttgccttttgattgttagtttgttactatatttgcgaacgaagattggggaggtgttttttgacgatgaaggagtgttaatggttgctgaattcggaatgaaaaaacaaagctcggaggtatatgcatagctagtctttcttacggatgatatagttgtgtttcgtattacatagaaattggaagtcgaaagtgtggcgttgatatcgtttcttcaatcgcttgttcttatgcttctaccttattcaaccatgcctgattttgaacaatgtagcaaatttgaactttaattaaaaagatatggagtataacattgtggaacattttgatttcatttgaatagtgtgaatatgtcaagtctattatttttagtagcatcacccaaattattgcaattccgatataatggttctctgt

SEQ ID NO: 3310 - DNA, 882 bp, Actinidia deliciosa
ctgtttctctctccactctgcttgaagagagagagagagaaagaaatggcgagcgggtatggggatgctagccagaagatcgactacgtgttcaaggtggtgctcatcggcgactccgccgtcggcaagtcgcagattctggcgcggttcgctcggaacgagttcagcttggactcgaaggccacaatcggggtcgagtttcagactcggaccttagtcatccagcacaagtccgtcaaggctcagatctgggacaccgccggccaagaacgatatagagcagttactagtgcctactacagaggtgctgttggggctatgttggtttatgacataaccaaacgacagaccttcgaccacataccccggtggctggaagagttgcgggcccatgctgacaagaacattgtcatcattctgatcggaaacaaaaccgatctcgaagaacagcgggcagtccccaccgaggacgccaaagaattcgccgagaaggaagggctgttcttcttggagacgtccgcactggaagcaacaaatgtggagactgcattcatgaccgtgttgactgagatcttcaacatcgtgaacaaaaagaacctcgttgcgagtgaggatcaagcgaacggcaacccagcgtcgctggctggcaagaagattcttatccctggccccgcgcaagaaatcccggccaagagcaagatgtgctgtacatcgtaaggactcgtttggatttttgagtttgcagatttggaagtttgattcatgtcctcggtaatttttggcgtctgatatatgtttgttgtacatctttcttttactatacctcgcgtgaattacatttggggaggatgagagaatggttgcggattgtctcttactggt

SEQ ID NO: 3311 - DNA, 1273 bp, Populus trichocarpa
atgcgttgcaccggattatcgccacactcactgattgtcttattagccttcgccttcaattccacaccaagcaaagcaaaacaccactgctaagatctactagctagccatagcaaagcatagcaagaatcgctctcttctttagaagaaacaaaggaaacccatttgaagagagggtgagaaaatggctagtgggggtggatacggagatgcgagccagaagatagactatgtattcaaggtggtgttgataggggactcagcagttgggaaatcacaaatacttgctcgatttgctagaaacgagtttagtcttgactctaaagctactattggggtcgagtttcaaactcggactcttgttattgatcataagagtgttaaggcccagatctgggatactgctggtcaagaacggtatagagcagtcacaagtgcatactacaggggtgctgttggggcaatgctggtgtatgacataaccaagcgtcagacctttgatcacataccacgctggctggaagagctgcgaaaccatgctgacaagaacatagttatcattttgattgggaacaaaagtgatcttgaggaccagcgggctgtacccactgaggatgccaaagaatttgcccagaaggaaggactattcttcttagagacctctgcattgcaagcaactaatgttgagaacgcctttatgactgtgctgacagagatcttcaacattgtaaacaagaagaacctggttgctggtgaagatcaaagcaatggtaaccccgcatcgctatctggcaagaagattatcattccaggccctgcacaagaaattccagcgaagagcaagtgttgtagctaattgtgatctctgatcagtcttggctttgaaaccgcgtgcttccccttaattcctaatagcaattttttgaaaggtgtgatgtagttctttgtaaattttacattcttataatttagcttgcatgagcagctgattagtttcttattttgaggaaaatctgagtcgcgtattatcttctcctcaatctcattcggaaagaaaaaaattcataatgtcgatgaatgttttgaatactttaaataccttgctttgtagtgtggaaattgaagatggaagtggagatgtttctggagaattttctgttgcctgagaggctttttagctgttgctacctattttgaacagaagtttctttaactatttgatatatggtgcctgtcggtcctcagaccacaagattttagcatggactctatt

SEQ ID NO: 3312 - DNA, 1119 bp, Allium cepa
gaaagttggttgaatccaagaatagtttcggtatattcatacttcaatctttgtatacattttaaaatcctatttcagtcttcaaaaagcgatcgaggtccctttctttctctcttctcctctcgtcggcggactattgacaaaagagagctctcagcttacagcaaaaggaaagagagaagttagtgtgcataatggcggagaagatcgattatgttttcaaagtggtgctgataggtgattcagcagtcgggaagtcgcaaattcttgctagatttgctcgcaacgagttcagcttggactcaaaggcgacaattggtgttgagttccagactcgtactcttgtaattagtcataagagtgtaaaagctcagatctgggatacagctggtcaggaaaggtaccgagccgtgaccagtgcatactacagaggcgcagtgggcgcactcctagtctacgacataacaaaacgccaaaccttcgaccacattccacgctggctggaagagctccgcagccatgcagacaaaaacatagtaatcatgctcatcggcaataagtccgacctcgaagaccaaagagccgtacccacagacgacgccaaggaattcgctcaaaaggaaaacctcttcttcctcgagacctccgccttggaatcgaccaacgtcgagcctgcattcaacaccgtcttgaccgaaatcttcaacattgtcaacaagaaaaacctcgtagctgaagggctgggtaatggcaatggtgctgcacctgcgttgcctgggaagaaaatcattgtgcctggacctgatcaggtcattcctaagaccaggccttgctgctcctccttttgagcttgtgtggatgtcagaatttgataatttttttagggggttcattgtgatatttgtatatcctagattagtactatatttttatgggattatgtgaagaatttactgtgcccacgggaaccttgttctgacttgttttctttgatggcaagtgtgaaagattgtttgtgaaactattgtatgcagatttgtctacagtaaattcttcacataatctcatgaaaatataatatagcttaccattcacatcattagtgaactagtaaaccaa

SEQ ID NO: 3313 - DNA, 1078 bp, Amorphophallus konjac
caccgcacccctgcttctgcggccggctttgtcgcttgcatgccccaatagctggcggcaagtagtggacagtacagcgaaggggcggcccttcccgttgccgcatcccggtagcagcgagcggcgtaggctggtggacgggtggggaaggggccagctgcaggggccgggtgggagggctctggtgcagttggtggtggtggtggaggggagagtagaggggagatggcggggggcagcgtgggggacaaggtggactacgtgttcaaggtggtgctgattggggactcggcggtggggaagtcgcagatcctggcgcgattcgcccgcaacgagttcagcctcgactccaaggccaccatcggcgtcgagttccagacgcgtaccctcgtcatccagcacaagagcgtcaaggcccagatctgggacaccgccggccaggagagatacagggcagttacaagtgcttactatcggggtgctcttggagcaatgctggtctatgacataaccaagaggcagacctttgatcatatagcaaggtggcttgaagaactacggagtcatgctgacaagaacctagtgataatgctgattggaaacaagagcgaccttgaggaccagagagtcgtatccacagaagatgcaacggagtttgctcagaaggaagggctgttcttcttggaaacttcagcactgcaagctacgaatgttgaaactgcctttacaaccgttctaaccgagatttttgatgttatgaccaagaagactcttgcttcagataatccagctgacaacaatgcgccagcactttcaggaaagaagattatcatccccggtcctgcccaggaaatccccaagagtaaggcatgctgtagcgctcattgatataactactcggttgtgataagttgtgatatgttggatttttgcttgcaatatctgcatatcttgattacttttgtttggtttggttgatagattcaggacattggaagaaaaattgggacaattaaatgaatttatgttgtgtaaataacttcgggttatgaatatttttgatcacgtaatatttcta

SEQ ID NO: 3314 - DNA, 1186 bp, Cajanus cajan
tcttttttaattcgaacaaatcaagcgcattgggaccttcacccaatagaattctgccacgtgtcacacaaggtccactcatgagtcataacagtcctcctccaaattaaatctgaaccaaaaccgtttcttaattaatccatcattcattattgttcaatttcaatccgaaccaaaccagattcaaaactgaaagagcagagaaattttggtgagtgtgtgaagaagaagtggattggagaaaaacaatggctagcggaggaggttacggagacgcgaaccagaaggtagattacgtgttcaaggtggtgctaataggcgattccgcggtggggaagtcgcagattcttgcgcgcttcgccagaaacgagttcagtttggactcgaaggccacaatcggcgtcgagttccaaacgcgcactctggtaatccagcacaagagcgtcaaggctcagatctgggacactgcgggccaagaacgatatagagcggtcacaagtgcatactacaggggtgctgttggggcaatgttggtttatgacatcacaaaacgtcaaagctttgatcacatacctcgttggttagaagaactgcgtaaccatgctgataagaatatagttatcattcttataggaaacaaaagtgatcttgagaaccagcgtgcagtatccacagaggatgcaaaagaatttgccgagaaagaagggttatttttcttagagacctcagcactggaagcaactaacgttgaaacagcctttatgactgttttgacagaaatattcaacattgtcaacaaaaagaacctagctgctgatgataatcagggaaatggcaactcagcatctctgtctggtaagaagattattgttcctggtcctgcacaagaaatccccaagaggagcatgtgttgtcagtcctgacttttctttataatttgtttaaatttactagatttcatggttattatcaccaatttttaatggtttggtgcatttccttttgtatatttttacattatttaaaatttattttgcatgagttgctgattaagagttaagaccagcatagggaagtacttacaatttgcttggtataacgtacgtaagagataaaactttaagtgtgttgttttaggtatttttttgtattattttcagttaaatttaaaactttcatctcatta

SEQ ID NO: 3315 - DNA, 1123 bp, Cocos nucifera
agcgtttcgtctcctcctgcaaggttttacttgactccacgctcgtcagcgagagacaagaccccagagggcgagcttcaagcgggatccggtcactctcctccgctgctctcgctgatctccactcctgtgttctactactatcgtggtgcgtcggcagcggcgtcgacggcggcaatggcagctggcggcgagaagatcgactacgtgttcaaggtggtccttatcggggactcggcggtggggaagtcccagatcctggcccgcttcgcccacaacgagttcagcctcgactccaaggccaccatcggggtcgagttccagacccggacactcgtcatccagcacaagagcgtcaaggcccagatctgggacaccgccggccaagagaggtacagggctgtcacaagtgcttactatcgaggtgctgtaggggctttgctggtttatgacattaccaagagtcagagcttcgaccacatacctcggtggctcgaggagctgcgaagccatgctgacaagaacattgtgatcatgctggtgggcaacaagactgatctagaggaccagagggctgtaaccacagaagatgccagcgagcttgctcagaaggaaaacctttccttcctggaaacatcagcactggaggctacaaatgttgagaccgccttccaaactgttctaacggaaatttttaacattgtcaacaggaagaacctggtttctgaacctcagggcaatggcaatggaccagcactgtctggcaaaacgatcgtcgtccctggaccggcactggtgattcctaagaataaggtgtgctgtcagacatcttgattttgcattctttgccttgcgctacggtttggagtcgtgtgctggaatcaattgagctgtctttgtaatagatgtttatcctattggtataggttacatctaagggaatcaatattgaacttggagagaattgttttatgtctagtggattgagtggtgataaattaaaaagtgttcaggtgcttctttgttatataatattcattgtgtagatactaaataattattcagaatgaaagagtatgttgtaaggattgagttgcaatggattaaatagttttcaggtgca

SEQ ID NO: 3316 - DNA, 1007 bp, Allium cepa
tcgtcggcagactactgacagaagagagcgctaagcttacagtaaaagaaaagtgagtggagcgtgcataatggcggagaagatcgattatgttttcaaagtggtgctgataggtgattccgccgtcgggaaatcgcagattcttgctagattcgctcgcaacgagttcagcttggactcaaaagcgacaatcggtgttgagttccagactcgaactcttgttattagtcataagagtgtaaaagcgcagatctgggatacagctggtcaggaaaggtaccgagcagtgacaagcgcatactacagaggcgcagtgggtgcactcctagtctatgacataacaaagcgccaaaccttcgaccacatcccacgctggctcgaagagctccgcagtcacgcagacaaaaacattgtaatcatgctcatcggcaacaagtccgacctcgaagaccaaagagccgtacccacagacgacgccaaggaattcgctcagaaggagaacctcttcttccttgagacctctgccttggaatcgaccaacgtcgagcctgcattcaacaccgtcttgaccgaaatcttcaacattgtgaacaagaaaaacctcgtagctgaagggcagggcaatggcaatggcgctgcacccactttgcctgggaagaagatcatcgtgcctggacctgatcaggtcattcctaagaccaggccttgctgctcctccttttgagcctttgtgtggacgtcgaaattgattttttttttagggggttcattgtgatatttgtatatcctagattagtactatattgttatgagattatgtgaagaagttaccatgctcacggaaaccttgttctgacttgttttctttgatagtaagtaagaaggattgtttgcgaaagctatagccttttctgagtgattctctcaagtgtaaactatagttttggttcatttttatgtaatcagattcgtctacggatgtatcatatgcagattgttttcctttg

SEQ ID NO: 3317 - DNA, 1875 bp, Sorghum bicolor
acatcgcccggcacatgcctctgcctttcctctgcttctcttccactgcaccaatggtgaccagcgttctgctgatactgcgggaaacctctccgtgggcgctggtcggcgcggcggcgtccgtggcgctgctgtggctggtcgcctggacactggagtgggcgtggtggacgccacggcggctagaccgagccctacgggcccagggcctcaagggcaccaagtaccgcctcctcaccggcgacgtgagggagaacgcccggctcaaccgagaagcccgcacgaagccgctggcgcttgggagtcacgacatcatcccccgcgtgctacccatgctccacaacgttgtaaaggaatatgggacaaattcattcacttggttcggcccggttccgagggtgataattccagatccggagttagtgagagaggttttgtctaacaagtttggccacttcggcaaaccacggtttagccgtcttggcaagttactagccaacgggctcgcaaatcatgaaggagagaaatgggcaaaacacaggagaattctcaatcctgcattccaccatgagaaaataaagcggatgctgcctgtatttgctacctgttgcactgatatgattaacagatgggaaaattcaatgtcttccgagggatcttctgagatagacgtctggcctgagttccaaaatcttaccggagatgttatctcaagaaccgcatttggtagcaactatcaggagggcaggaacattttccagctgcaaggagagcaggctgaacgccttatacaatcttttcaaacaatatttatccctggctactggttcttgcccaccaaaaataacagaaggatgaaagaaattgatcgggagatctgtaaagttctgcatggaataatcaggaaaagagagagggcttttatagatggtgaaggaagtaatgatgacttgctaggcttattggttgagtctaatatgagagaatcaaatgggaatgcgaaactgggaatgagtaccaaagatattatcgaggaatgcaagttgttttactttgcaggtatggagaccacatcagtcctgcttacatggacgttaattgtgctaagcatgcaccccgaatggcaagagcgggcaagagacgaagttttaaaccactttggaagaggtagaccagattttgatagcttgaaccgcctgaagattgtaaccatgattctatatgaggtgcttaggttgtacccaccagtgatcttactaaccagaagaacttacaaggaaatggagctaggtggcatcacatatccttcaggtgtgagccttctactgcctatcattttcattcaccatgatcctaacatctggggaaaagacgctagcgagttcaatccacagaggtttgaggatggcatttccaatgcgaccaagcatcaggctgctttctttccatttggatggggtcccaggatctgcataggccagaactttgcgttgctagaagcaaagatggcactgtgcaccatccttcaacgcttctcctttgagctctcgccatcctacactcatgcgccatacaccgtgataactttgcaccctcagcatggtgctcaaatcaggttgaagaagctttgaccatgatggtcatactgaatggcaaaacatatactgctagtaacatatagtgattgtgcatgcatgtagttttaaattcaccttgcatatgaacaataagaagaaagtgtgtatgaatggagacatgggttgatggatggtttgaaaaataatgatctgctttgtctggtaatgcgtgcatggtttgaaaaaaaaatgatgttgcagccatagtttattggcaaaatttgctgttggacatgct

SEQ ID NO: 3318 - DNA, 1842 bp, Setaria italica
atcaccaccaccaagtgcgccctctcaaaaagaaaaagaaaaacaagcgcgccaagaagccaatggcgactcgagctctgctgctgctacgagaggccccgccgtgggccgtggctggcgcggcggcggccgtggcgctgctgtggctagcggcctggactctcgagtgggcgtggtggactccgcggcggctcgaccgggccctgcgtgcccagggcctcaagggcaccaggtaccgcctcttcaccggcgatgtgagggagaacgcccggctcaaccgcgaggcgcggacgaagccgctcccgcttggatgtcacgacatcatcccccgcgtgctgccgatgctccacaaggtcgtaaaggagaacgggactgtgtcattcacttggtttggcccaaccccgagggtgatgattccagacccagaatcagtaaaagaggttttgtctaacaagtttggccactttggcaaacaacagtttagccgtgctggcaagttactaggagacggggtcgcgaatcatgaaggcgagaaatgggcaaagcacaggagaattctcaatcctgcattccaccatgagaaaataaagaagatgctgcctgtatttgctacctgttgcgtcgatgtgattaacagatgggaaaattcaatgtcttccgagggatcttctgagatagacatctggcctgagttccagaatcttaccggcgatgttatctcacgaaccgcatttggcagcagctatcaggagggcaggagaattttccagcttcaaggagagctagctgaacgccttatacaatcatttcaagcaatatttatcccaggctactggttcttgcccaccaaaaataacagaaggatgagagaaattaatcgagagatccacaaaattctgcgtgaaataattgggaaaagagagaaggctatgaaaaatggcgaaacaaataatgatgacttgctgggcttgttactggagtcaaacatgaggcaatcaaatgggaatgcaaagctaggattgacaacagaacatgtgattgaggaatgcaagctcttttactttgctggtatggagacaacatcagtcctgcttacttggactcttgttgtgctaagcatgcacccagaatggcaagagcaagcaagagaagaagtattgaaccacttcggaagagctagaccagactttgagagcttgaaccgcttgaagattgtaaccatgattttgtacgaggtcctcagattgtacccacctgtagtcctattaagcagaagaacttacaagggaatggagctcggtggcatcaaatatccagcaggcgtgaaccttctcctgcccataatcttcattcaccatgatcccaacatctggggaaaagacgcaggcatgttcaatccagagaggttcgccgacggcatttccaatgccaccaagcaccaagccgccttcttcccatttggaggcggtccccggatctgtattggccagaacttcgcgttgctggaagcgaagatggcgctgtgcaccatactccagcgcttctcatttgagctctcgccgtcctacactcacgcgccgtacactgtgataactttgcaccctcagcatggtgctccaatcaggctgaagaagctttgaccacggtgatcatgctggatggcaaagtctcaataccactaccatatagtgactgtacatgtatatgatgtttaaaattcgacgcttgatctgaattacgagtgcagagtgtgtatgaatggagaaattggttgatgtacatattgcagctctcagtttaattgatggaacagttataccctgcccatatcctttctaatgg

SEQ ID NO: 3319 - DNA, 2052 bp, Setaria italica
agctggctgctgctgctcggtagcagagagcaagcagctgcaccagcaggcagcggcggtagcagcatgcaccagccgaacagcaagtggtcgagacgcacacgtatagacttgcagtccaatcgctttaagaggacgctcagcagtctgccaacccattccttcgtgctgcttccttgctatcaccaccaccaagtgcgccctctcaaaaagaaaaagaaaaacaagcgcgccaagaagccaatggcgactcgagctctgctgctgctacgagaggccccgccgtgggccgtggctggcgcggcggcggccgtggcgctgctgtggctagcggcctggactctcgagtgggcgtggtggactccgcggcggctcgaccgggccctgcgtgcccagggcctcaagggcaccaggtaccgcctcttcaccggcgatgtgagggagaacgcccggctcaaccgcgaggcgcggacgaagccgctcccgcttggatgtcacgacatcatcccccgcgtgctgccgatgctccacaaggtcgtaaaggagaacgggactgtgtcattcacttggtttggcccaaccccgagggtgatgattccagacccagaatcagtaaaagaggttttgtctaacaagtttggccactttggcaaacaacagtttagccgtgctggcaagttactaggagacggggtcgcgaatcatgaaggcgagaaatgggcaaagcacaggagaattctcaatcctgcattccaccatgagaaaataaagaagatgctgcctgtatttgctacctgttgcgtcgatgtgattaacagatgggaaaattcaatgtcttccgagggatcttctgagatagacatctggcctgagttccagaatcttaccggcgatgttatctcacgaaccgcatttggcagcagctatcaggagggcaggagaattttccagcttcaaggagagctagctgaacgccttatacaatcatttcaagcaatatttatcccaggctactggttcttgcccaccaaaaataacagaaggatgagagaaattaatcgagagatccacaaaattctgcgtgaaataattgggaaaagagagaaggctatgaaaaatggcgaaacaaataatgatgacttgctgggcttgttactggagtcaaacatgaggcaatcaaatgggaatgcaaagctaggattgacaacagaacatgtgattgaggaatgcaagctcttttactttgctggtatggagacaacatcagtcctgcttacttggactcttgttgtgctaagcatgcacccagaatggcaagagcaagcaagagaagaagtattgaaccacttcggaagagctagaccagactttgagagcttgaaccgcttgaagattgtaaccatgattttgtacgaggtcctcagattgtacccacctgtagtcctattaagcagaagaacttacaagggaatggagctcggtggcatcaaatatccagcaggcgtgaaccttctcctgcccataatcttcattcaccatgatcccaacatctggggaaaagacgcaggcatgttcaatccagagaggttcgccgacggcatttccaatgccaccaagcaccaagccgccttcttcccatttggaggcggtccccggatctgtattggccagaacttcgcgttgctggaagcgaagatggcgctgtgcaccatactccagcgcttctcatttgagctctcgccgtcctacactcacgcgccgtacactgtgataactttgcaccctcagcatggtgctccaatcaggctgaagaagctttgaccacggtgatcatgctggatggcaaagtctcaataccactaccatatagtgactgtacatgtatatgatgtttaaaattcgacgcttgatctgaattacgagtgcagagtgtgtatgaatggagaaattggttgatgtacatattgcagctctcagtttaattgatggaacagttataccctgcccatatcctttctaatggagccgagctcacggggctgcattttctgt

SEQ ID NO: 3320 - DNA, 1587 bp, Avena sativa
ccgatggcgacccgagctctccagatgctgtgggaggcctctccctggagcctagccggcgcggtggcggccatgacactgctgtggctggccgcctggattctggagtgggcatggtggaccccgcggcggttgggtcgggccctgcaggctcagggactcaggggcacccggtaccgcctcttcaccggcgacgtgccagagaacgcccggctcaacagagaggcccggtccaagcccctacccctcggctcccacgaaatcatccctcgcgtgcagcccatgttcgacaaagcaatcaaggagaacgggaaaatgtcattcacttggtttggcccaacgccgagggtgttgattcctgacccggaatttgtgagagaagttctttccaacaagtttggacactatggaaaacaaaagcctagccgtatggggaagctgcttgccaacggggttgtaaatcatgaaggcgagaaatgggcaaagcaccggagaatcctgaatcctgcttttcaccatgagaagataaagaggatgctgccagtcttttctacctgttgcgaagaaatgattacaagatgggagaattcgatgtccgccgaaggattatctgagattgacatctggccggagttccagaatcttactggagatgtcatttcgcgaacggcatttggtagcaattatcaggaggggatgaaaatattccagctgcaaggggagctagccgaacgcctgatacagggttttcagacactttttattccaggctattggttcctacctacaaaaaacaacagaaggatgagagcaattgaccgtgagatccgctcaattctgcgagggattatcgcaaaaaaagacagagctattaaaaatggtgaagctagcagtgatgacttgctaggattgcttttggagtcaaatgcgcgggaatcgaatgggaaagcggatctaggaatgagtactgaagatataatcgaggaatgcaagctattttactttgcaggtatggagacaacatcagtcttgctcacatggacactaattctgctaagcatgcacccagagtggcaagagcaggcaagagaggaggtgctgcaccattttggaagaaccacaccagattttgacaacttgagtcgcctgaagattgttacaatgatactatatgaggttcttaggttgtacccgccagtagtctttattacgagaagaacatacaaggcaatggagcttggtggcatcaaatatccggcaggagtgaaccttatgttgcctatcctcttcatccaccatgatcccaatatatggggaaaagatgcaagcgaattcaacccacagaggtttgctgatggcatctcgaatgcggcgaagcatccggccgcgttcttcccatttggagggggtcctcggatctgcatcggccagaactttgcattgctcgaagccaagatggctctcagtaccatcctccagcgcttctcccttgagctatcgccgtcctacacccacgcaccatacacggtgataaccctccacccgcaacacggtgctcaaattaggctgaagaagatatgaccattg

SEQ ID NO: 3321 - DNA, 2012 bp, Sorghum bicolor
agccgtatccgtcctctgctttttcttgtgcttctctttcactgcgccaagccgtcacaaatggcgacccgcgttctgctgatgcttcgcgaaacctctccgtgggcgctggccggcgcggcggcgtccgtggcgctgctgtggctggtggcctggacgctggagtgggcctggtggacgcctcggcggctcgaccgggccctgcgggcccagggcctcaagggcaccaggtaccgcctcttcaccggcgacctgagggagaccgcccgggttaaccgggaggcccgcaagaacccgctgccgctcggctgccacgacatcgccccccgcgtgcagcccatgcttcacagcgccatgaaggaatacgggaaattatctttcacttggttcggcccaacaccaagggtgatgattccagacccggagttagtcaaagaggtgttgtctaataagtttggccactttggcaaaccacggagcagccgcattgggaagttgctagccaatggggtagtaaatcatgatggtgaaaaatgggcaaagcacaggagaattcttaatcctgcctttcaccatgagaaaataaagcggatgctgccagtattttcgacctgttgtattgaaacgattattagatgggagaattcaatgccttctgagggatcttctgagatagatgtctggcctgagttccagaatcttactggagatgttatctcaagaaccgcttttggcagcaactatcaagaagggaggagaattttccagctgcaaggagaactagctgaacgccttattcagtctattcagacaatatttatcccaggctattggttcttgcctaccaaaaacaacagaaggatgaaagaaatcgatctagagatccgcaaaattctccgtgaaataattgggaaaagagagaaggctactagaaatggcgaaacaaataatgatgacttgctgggcttattactggagtcaaacacaaggcaatcaaatggaaatgcaagcctgggactgacaacagaagatgtgattgaggaatgcaagctattttactttgcaggtatggagacaacatcagtcctgcttacttggacacttattgtgctaagcatgcacccagaatggcaagagcgagcaagagaagaagtgttgagccactttgggagaaccagaccagattttgatagcttgagccgcctgaagattgtaaccatgattctacatgaggtcctcaggttatacccaccggcaacctttctaaccagaagaacttataaggaaatggagctcggtggaattaaatatcctgcaggagtgaaccttcttctgcccatcatcttcattcaccatgatcccgacatttggggaaaagacgcaagtgagttcaatccagagaggtttgccaatggcatctccaacgccaccaggcatcaggcggctttctttccgtttggaggggggcccaggatctgcatcggccagagctttgcgttgctggaagccaagatggcgctatgcaccatcctccagcgcttctcctttgagctctcgccatcctacacccacgcgccctacaccgtgataacactgcaccctcagcacggtgctcagataaggctgaaaaagctctgactgtgatgctcatatgctcgctggcagtggcagcagcagcagctcctacgctgctgctaccgaatactccctccattccgaactatgtcagaacgtcttacaacttggatcgggggaagtagttgttttgtattaatacgttggttagaatatgaataataaaaagagggtgtgtattaatagggaataggttactgtcgatgcaattttgtgaagatttggcaaagaacttaattatacaatatgtagttcttttttatagggtgcactagtactcgaaagtagtctttgcatgtaggagtatatacatttggcttttcatttttcttcctgtatatatatattaccaatcgctgaaaggtcaatattatact

SEQ ID NO: 3322 - DNA, 1775 bp, Avena sativa
tcctctagttcaccgccccgatggcgacccgagctctccagatgctgtgggaggcctctccctggagcctagccggtgcggtggcggccatggcactgctgtggatggccgcctggattctggagtgggcatggtggaccccgcggcggctgggtcgggccctgcaggctcagggactcaggggcacccggtaccgcctcttcaccggcgacgtgccagagaacgcccggctcaacagagaggcccggtccaagcccctacccctcggctcccacgaaatcatccctcgcgtgcagcccatgttcgacaaagcaatcaaggagaacgggaaaatatcattcacttggtttggcccaacgccgagggtgttgattcctgacccggaatttgtgagagaagttctttccaacaagtttggacactatggcaaacaaaagcctagccgtatggggaagctgcttgccaacggggttgtaaatcatgaaggcgagaaatgggcaaagcaccggagaatcctgaatcctgcttttcaccatgagaagataaagaggatgctgccagtcttttctacctgttgcgaagaaatgattacaagatgggagaattcgatgtccgccgaaggattatctgagattgacatctggccggagttccagaatcttactggagatgtcatttcacgaacggcatttggtagcaattatcaggaggggatgaaaatattccagctgcaaggggagctagccgaacgcctaatacagggttttcagacactttttattccaggctattggttcctacctacaaaaaacaacagaaggatgagagcaattgaccgtgagatccgcacaattctgcgagggattatcgcaaaaaaagacagagctattaaaaatggtgaagctagcagtgatgacttgctaggattgcttttggagtcaaatgcgcgggaatcgaatgggaaagcggatctaggaatgagtactgaagatataatcgaggaatgcaagctattttactttgcaggtatggagacaacatcagtcttgctcacatggacactaattctgctaagcatgcacccagagtggcaagagcaggcaagagaggaggtgctgcaccattttggaagaaccacaccagattttgacaacttgagtcgcctgaagattgttacaatgatactatatgaggttcttaggttgtacccgccagtagtctttattacgagaagaacatacaaggcaatggagcttggtggcatcaaatatccggcaggagtgaaccttacgttgcccatcctctttatccaccatgatcccaatatatggggaaaagatgcaagcgaattcaatcctcagaggtttgctgatggcatctcgaatgcagcgacgcacccaggtgcgttcttcccatttggagggggtcctcggatctgcatcggccagaactttgcattgctggaagccaagatggctctcagcaccatcctccagcgcttctcgctcgagctgtcgccgtcctacacccacgcaccatacactgtgataaccctccacccgcagcacggtgctcaaattaggatgaagaagatatgaccatatatgcttcgagtcgggtagtgaatgtgctcactatgttgtgtgtaaattaaagtggaagctttgagctgaataaacagagcaccgggtttacacgttgtataatgttttttgaaagttgtgaacaaattgaaatacactttcagtttaactacaagctctgcaactgtcatt

SEQ ID NO: 3323 - DNA, 1774 bp, Brachypodium distachyon
cagcacctaagcctttcctctcctctcataccctgcgccgatggcgacccaagctctgctgatgctgagcgaggcatccccgtggagccttgcgggtgcggcggcggccgtggtgcttctatcgctggccgcctgtattctggagtgggcatggtggaccccccggcggctgggccgggccctgcaggcccagggcctacggggcacccggtaccgcctcttcaccggcgacgtgacggagaacgtccggctgaacaaagaggcccggtccaagcccctgccgctcggctcccacgacatcatccctcgcgtgcagcccatgttctgcaaaaccgttaaggagaacgggaaagtatcattcacttggtttggcccaacaccaagggtgatgattccagaccccgaattagtgagagaaattttgtccaacaagtttggacactatggcaaaccaaagagtagccgcatcgggaagctgctagccgacggggttgtaaatcatgaaggcgagaagtgggcaaagcaccgcagaatcctcaatcccgccttccaccatgagaagataaagaggatgctgccagttttttctatctgttgcgaagaaatgattgcgagatgggagaattcattgtcctccaaaggattatctgagattgacgtctggcctgagttccagaatcttactggagatgtcatctcaagaacagcattcggtagcaattaccaggaggggatgaaaatattccagttgcaagaagagctagctgaacgcctaatacaagcttttcagacgctatttatcccaggctattggttcttaccaactaaaaacaacagaaggatgagagcaattgatcgtgagatccgcacaattctgcgaggaataattggaaaaaaagacagagctattaaaaatggtgaagctagcagcgatgacttgctaggattactggtggagtcaaatatgcgggaatcaaatgggaaagcagctctaggaatgagtactgaagatataattgaggagtgcaagctattttactttgcaggaatggagacaacatcagtgttgctcacatggacactaattctgctaagcatgcacccagagtggcaagatcaggcaagggaggaagtgttgcaccactttggaagaaccacaccagattttgagaacttgggtcgcctgaagatcgtaacaatgattctatacgaggttcttaggttgtatccaccggtagtctttcttaccagaagaacatacaaggaaatggagctgggcggcatcaaatatccggcaggagtgaaccttatgttgccccttctgtttatccaccacgatcccaatctatggggaaaagacgcgggcgaattcaatccaaagaggttttctgacggtatctcaaatgcggcgaagcatccaggcgcgttcttcccgtttggaggaggtcctcggatctgcatcggccagaactttgcattgttggaagccaagatggctctgagcaccatcctccagcgcttctccttcgagctctcgccgtcctatacacatgcgccttacaccgtgataaccctccacccgcagcatggtgctccaatcaggatgaagaaaatatgatcatgcttcacatcttggccatcgacactatagcgaattttacttacacgccatgtatatttaaagtttgagctgaataaacagagcaccctgtttacatgttatgtctttttttttgtaagaagtaaatgaatgcaaagagttgtttcagttgaa

SEQ ID NO: 3324 - DNA, 1781 bp, Brachypodium distachyon
acagcacctaagcctttcctctcctctcataccctgcgccgatggcgacccaagctctgctgatgctgagcgaggcatccccgtggagccttgcgggtgcggcggcggccgtggtgcttctatcgctggccgcctgtattctggagtgggcatggtggaccccccggcggctgggccgggccctgcaggcccagggcctacggggcacccggtaccgcctcttcaccggcgacgtgacggagaacgtccggctgaacaaagaggcccggtccaagcccctgccgctcggctcccacgacatcatccctcgcgtgcagcccatgttctgcaaaaccgttaaggagaacgggaaagtatcattcacttggtttggcccaacaccaagggtgatgattccagaccccgaattagtgagagaaattttgtccaacaagtttggacactatggcaaaccaaagagtagccgcatcgggaagctgctagccgacggggttgtaaatcatgaaggcgagaagtgggcaaagcaccgcagaatcctcaatcccgccttccaccatgagaagataaagaggatgctgccagttttttctatctgttgcgaagaaatgattgcgagatgggagaattcattgtcctccaaaggattatctgagattgacgtctggcctgagttccagaatcttactggagatgtcatctcaagaacagcattcggtagcaattaccaggaggggatgaaaatattccagttgcaagaagagctagctgaacgcctaatacaagcttttcagacgctatttatcccaggctattggttcttaccaactaaaaacaacagaaggatgagagcaattgatcgtgagatccgcacaattctgcgaggaataattggaaaaaaagacagagctattaaaaatggtgaagctagcagcgatgacttgctaggattactggtggagtcaaatatgcgggaatcaaatgggaaagcagctctaggaatgagtactgaagatataattgaggagtgcaagctattttactttgcaggaatggagacaacatcagtgttgctcacatggacactaattctgctaagcatgcacccagagtggcaagatcaggcaagggaggaagtgttgcaccactttggaagaaccacaccagattttgagaacttgggtcgcctgaagatcgtaacaatgattctatacgaggttcttaggttgtatccaccggtagtctttcttaccagaagaacatacaaggaaatggagctgggcggcatcaaatatccggcaggagtgaaccttatgttgccccttctgtttatccaccacgatcccaatctatggggaaaagacgcgggcgaattcaatccaaagaggttttctgacggtatctcaaatgcggcgaagcatccaggcgcgttcttcccgtttggaggaggtcctcggatctgcatcggccagaactttgcattgttggaagccaagatggctctgagcaccatcctccagcgcttctccttcgagctctcgccgtcctatacacatgcgccttacaccgtgataaccctccacccgcagcatggtgctccaatcaggatgaagaaaatatgatcatgcttcacatcttggccatcgacactatagcgaattttacttacacgccatgtatatttaaagtttgagctgaataaacagagcaccctgtttacatgttatgtctttttttttgtaagaagtaaatgaatgcaaagagttgtttcagttgaaccggtc

SEQ ID NO: 3325 - DNA, 2409 bp, Avena sativa
cgaccatacactacgactcgtcgactcctacaaaacctgagaggctgagccacgcctctgctctcctctagttcaccgccccgatggcgacccgagctctccagatgctgtgggaggcctctccctggagcctagccggtgcggtggcggccatggcactgctgtggatggccgcctggattctggagtgggcatggtggaccccgcggcggctgggtcgggccctgcaggctcagggactcaggggcacccggtaccgcctcttcaccggcgacgtgccagagaacgcccggctcaacagagaggcccggtccaagcccctacccctcggctcccacgaaatcatccctcgcgtgcagcccatgttcgacaaagcaatcaaggagaacgggaaaatgtcattcacttggtttggcccaacgccgagggtgttgattcctgacccggaatttgtgagagaagttctttccaacaagtttggacactatggcaaacaaaagcctagccgtatgggaaagctgcttgccaacggggttgtaaatcatgaaggcgagaaatgggcaaagcaccggagaatcctgaatcctgcttttcaccatgagaagataaagaggatgctgccagtcttttctacctgttgcgaagaaatgattacaagatgggagaattcgatgtccgccgaaggattatctgagattgacatctggccggagttccagaatcttactggagatgtcatttcacgaacggcatttggtagcaattatcaggaggggatgaaaatattccagctgcaaggggagctagccgaacgcctaatacagggttttcagacactttttattccaggctattggttcctacctacaaaaaacaacagaaggatgagagcaattgaccgtgagatccgcacaattctgcgagggattatcgcaaaaaaagacagagctattaaaaatggtgaagctagcagtgatgacttgctaggattgcttttggagtcaaatgcgcgggaatccaatgggaaagcggatctaggaatgagtactgaagatataatcgaggaatgcaagctattttactttgcaggtatggagacaacatcagtcttgctcacatggacactaattctgctaagcatgcacccagagtggcaagagcaggcaagagaggaggtgctgcaccattttggaagaaccacaccagattttgacaacttgagtcgcctgaagattgttacaatgatactatatgaggttcttaggttgtacccgccagtagtctttattacgagaagaacatacaaggcaatggagcttggtggcatcaaatatccggcaggagtgaaccttacgttgcccatcctctttatccaccatgatcccaatatatggggaaaagatgcaagcgaattcaatcctcagaggtttgctgatggcatctcgaatgcagcgacgcacccaggtgcgttcttcccatttggagggggtcctcggatctgcatcggccagaactttgcattgctggaagccaagatggctctcagcaccatcctccagcgcttctcgctcgagctgtcgccgtcctacacccacgcaccatacactgtgataaccctccacccgcagcacggtgctcaaattaggatgaagaagatatgaccatatatgcttcgagtcgggtagtgaatgtgctcactatgttgtgtgtaaattaaagtggaagctttgagctgaataaacatagcaccgggtttacacgttgtataatgttttttgaaagttgtgaacaaattgaaatacactttcagtttaactacaggctctgcaactgtcattcaaagaaacccctttcatttcataacgctgtcaccacagaacgtctgcataataaccgtgctcaattcagagcctgtgcagcctaacggggacaccatgctgcgggtgcagggtaaggacggtacatggcgcgtgcacgtaggacggcgagagctcgaaggcgaagcgctgtaggatcatgctgatggccaccttggcctcgagcagcgcaaagttctggccgatgcagttcctcggcccggagctgaaggggaagaaggcccctgggtcgctgcacgccttgctcacgccctccgcaaacctccccgggttgaactcgtgggagtcgtctccccagatgccggggtcacggtggatggacatgatgtccagcgtgagcatcacttccggagggtacgtgacgcctcccagctctatcttcttgtacgttcggcggttgatgcgcaccaccggcgggtacagacgcaggacctcgaagaacaccatcgaaacaacttttaggcggttaagaccatttagatcgggtttgttttgcccaaacacccgcagaacctcctccctggcacgatcc

SEQ ID NO: 3326 - DNA, 3109 bp, Panicum virgatum
ttttgaaaaaatatctaaatgtgtaatttctatgagtagtgtctatgtgacatgacaaatatagaaatcactagtatatgatgatcctataacctcaagacctactggactagcatggcgaccatttcaccattggtggactagcaagcaaagccttctcgaagacgacggacgaaatactcataatgttatggattttttttatcttggattgggaaaaaaaaacacacgaagacttccaagtacaaccgggaggagaagggggcaagacgcacacgtgtccgcccatcctccagtattaagcagacgacacgaacctcgctcccaatcacaattcacacatacacaaacagattcctctgatccgctctccttttctgcttctcttccaccgcgccaagccacaccaatggcggcgcgcgctctcttgatgctgcgggaggcctccccgtgggcgctggccggcgcggcggcggccgtggcgttgctgtggctggtggcctggacggcggagtgggcctggtggacgcctcggcggctcgaccgggccctgcgggcccagggcctcaagggcacccggtaccgcctcttcaccggcgacctggcggagaacgcccggatcaaccgggaggctcgcaccaagccgctgccgctcggctgccacgacatcgccccacgcgtgcagcccatgctccacagagccatcaaggaatacgggaaaatgtcgttcacctggttcggtccaataccgagggtgatgataccagacccggagttagtcaaagaggttttatccaacaagtttggccactttggaaaaccaaggagtagtcgtatcgggaagctgctagccgatggggttgtcaatcatgacggcgagaagtgggcaaaacacaggagaattctcaatcctgccttccaccatgagaagataaagcggatgctgccggtattttccacttgttgcgccgaaaccattactaaatgggagaattcaatgccttctgaggggtcttttgaggtagatgtctggccggagttccagaatctcacgggagatgttatctcaagaaccgcatttggtagcagctatcaagaggggatgaaaattttccagctgcaaggagagctagctgaacgccttgtacagtctttccaaacaatatttatcccaggatattggtttttgcccaccaaaaataatagaaggatgcgagaaattgatcgggagatccggaaaactctgcgcgaaataattagaaaaagggagaaggccattaaagatggcaaaacaaataatgatgacttgctgggcttattactggagtcaaacatgaatgaatcgaaagggaatgcaaagctgggattgtcaacggaagatgtgattgaggaatgcaaactattttactttgccggtatggagacaacatcagtcctgcttacttggactctcattgtgctaagcctgcacccagaatggcaagagggggcaagagaagaagttctgaaccactttggtagagccaaaccagattttgatagcttgaaccacctgaagacggtaaccatgattttgtacgaggtccttaggttgtacccgccggcaacctttatagtcagaagaacatacaaggagatggagctcggcagcatcatatatcctgccggagtgaaccttcagctgcccattctcttcatccaccatgatccggagatttggggaaaagatgcgagcgagttcaatcctgcaaggttcgctgacggcgtctccaacgctaccaagcaccagggcgccttctttccgttcggagggggtccccggatctgcatcggccagaacttcgcgttgctggaagcgaagatggcgctgtgcaccatcctccagcgcttctccttcgagctctcaccatcctacacccatgcgccgtacaccgtgatcaccctgcaccctcagcacggcgctcagatcagactgaagaagctctgacgaccatgacgctcatgccgggtagatgccatcatatactgtcaatttgcatgatgtatgtaaattagattttaacctttgaaatgaataaagcagggagaaaatgtacatggatagagaaatttaggtactcattcaaacagttataccatgtatcgtttgctaatgggtgaacttgtatgtctctatcaacgctttgcggtgtggcctcgtcttcttctttttctttttgcgaagaaactttgcatatgaaactatgtataaattttgcacaagtttcttaagagttttactggaaatggtatacgccaatgctgtagattacttaaaaattttgctgatattgatgatgtaaattttgcacaagttgcatccgagcgtgagccaagacatcatggtgactaagaaagtcgagaaaagaccacgcgtgtcgccctcgtgacgcaacgtgatacatcatttggcagaacgtaatgtacagactagctagatttattattctaaaataaaaaattttgtggcgagaacttcgcgctgctcgaggctaagatggcgctgagcatgatccttctccttctccttcagcttcgagttcgagctcgcgccggcgtatacccatgcgccccatacagtgataaagctgcggccgatgcatggtgcccagatcaagcccaaagcaatatgatttgcctgtgtatctatcaaggttttaaatcgccgactaaaacacttagcggcagagctgtcgtcacggcatttagcggggtatagccggaatttagcgggcttatagcggaagctataacctgctatttaaaatcttggtatctatccgtcagtgtgtatgacactattacttttgtccaacgggctttgggctttcacgtcagcccatagagttgtgtgccattgggcctttagccttttcacgtgttttcttttatttgattcagtaaccggtgtcgtgtccattgtatcctaggctacctcacaaaaggataaatgaagaaaaaaaatgattccatcggtatgtgaatatttattttaacgttcattgtttctatcacgacatgagatgaatcaaagaaatggacaccgcagaacttacaaagcgtctgaata

SEQ ID NO: 3327 - DNA, 1910 bp, Avena sativa
gatacgatcatacgactactacaaaacctgaacggctgtgcccgccttcctctagttcaccgccccgatggcgacccgggctctccagatgctcagagaggcctctccatggagtctagccggcgcagcggcggccatggcactgctgtggctggccgcctggattctggagtgggcatggtggatcccgcggcggctgggtcgggcccttcaggctcagggcctcaggggcacccggtaccgcctattcaccggcgacgtgccggagaactcccggctcaacagagaggcgcggtccaagcccctgccgctcggctcacacgatatcatgccccgcgtgcagcccatgctcagcaacaccattaaagataacggaaaattatcattcacttggtttggcccagaaccaagggtgctcattcctgacccagaattagtgagagaaatcctgtccaacaagtttggacactatggcaaaccaaagagtagccgttttggtaggctgctagccaacgggcttgtcaatcatgaaggcgagaaatgggcaaagcaccggagaatcctgaatcctgcctttcaccatgagaagataaagaggatgctgccagttttttctacctgtagtgaagaaatgattacgagatgggagaattcaatgtcctccggaggattatctgaggttgatgtctggcctgagttccagaatcttactggagatgtcatctccagaacagcgttcggcagcagttatcaggaggggatgaaaatattccagctgcaaggggagctaggtgaacggctaatggaagcttttcagacacttttcatcccaggctattggttcttgccaactaaaaacaacagaagaatgagagcaatcgatcgtgagatctgcacaattctgcgaggaattattggaaagaaagacagagctattaaaaatggtgaaactagcagcgatgacttgctaggattgctggtggagtcaaatatgcgagaatccgacgggaaagcagatctaggaatgactactgaagatataattgaggaatgcaagctattttactttgcaggcatggagacaacatcagtgttgctcacatggacactgattctgctaagtatgcacccagagtggcaagagcaggcaagaaaggaagtgttgcaccacttcggaaaaaccaggccagactttgaaaacttgagtcggctcaagacagtaacgatgattctatatgaggttcttaggttgtacccgccagcagtttttcttaccagaagaacatacaaggcaatggagcttggtggcatcaaatatccggcaggagtgaaccttatgttgcctatcctcttcatccaccatgatcccaatatatggggaaaagatgcaagcgaattcaacccacagaggtttgctgatggcatctcgaatgcggcaaagcatccggccgcgttcttcccatttggagggggtcctcggatctgcatcggccagaacttcgcgttactggaagctaagatggctctcagcaccatcctacaacgcttctcgttcgagctctctccatcctatacccacgctccgtacaccgtgttaaccctccacccacaacatggtgctccaattatgctcaagaagatatgaccatgcttcccattgggtagtaaatttgctcacatgttgtgtataatttaaaattggaacactgagctgaataaacacaacaacgggtttacacgtgtgtgttttgtaagttgggaatggattaaatagtatagttatctaaaggaaatatgccctagagaaaaataataaaaggtttattattgtcatatcccaataagttcgtaatcgttttatattgtgctataactgtatcaagtagacacattgatacatgtgtgatacg

SEQ ID NO: 3328 - DNA, 1910 bp, Avena sativa
gatacgatcatacgactactacaaaacctgaacggctgtgcccgccttcctctagttcaccgccccgatggcgacccgggctctccagatgctcagagaggcctctccatggagtctagccggcgcagcggcggccatggcactgctgtggctggccgcctggattctggagtgggcatggtggatcccgcggcggctgggtcgggcccttcaggctcagggcctcaggggcacccggtaccgcctattcaccggcgacgtgccggagaactcccggctcaacagagaggcgcggtccaagccccttccgctcggctcacacgatatcatgccccgcgtgcagcccatgctcagcaacaccattaaagataacggaaaattatcattcacttggtttggcccagaaccaagggtgctcattcctgacccagaattagtgagagaaatcctgtccaacaagtttggacactatggcaaaccaaagagtagccgttttggtaggctgctagccaacgggcttgtcaatcatgaaggcgagaaatgggcaaagcaccggagaatcctgaatcctgcctttcaccatgagaagataaagaggatgctgccagttttttctacctgtagtgaagaaatgattacgagatgggagaattcaatgtcctccggaggattatctgaggttgatgtctggcctgagttccagaatcttactggagatgtcatctccagaacagcgttcggcagcagttatcaggaggggatgaaaatattccagctgcaaggggagctaggtgaacggctaatggaagcttttcagacacttttcatcccaggctattggttcttgccaactaaaaacaacagaagaatgagagcaatcgatcgtgagatctgcacaattctgcgaggaattattggaaagaaagacagagctattaaaaatggtgaaactagcagcgatgacttgctaggattgctggtggagtcaaatatgcgagaatccgacgggaaagcagatctaggaatgactactgaagatataattgaggaatgcaagctattttactttgcaggcatggagacaacatcagtgttgctcacatggacactgattctgctaagtatgcacccagagtggcaagagcaggcaagaaaggaagtgttgcaccacttcggaaaaaccaggccagactttgaaaacttgagtcggctcaagacagtaacgatgattctatatgaggttcttaggttgtacccgccagcagtttttcttaccagaagaacatacaaggcaatggagcttggtggcatcaaatatccggcaggagtgaaccttatgttgcctatcctcttcatccaccatgatcccaatatatggggaaaagatgcaagcgaattcaacccacagaggtttgctgatggcatctcgaatgcggcgaagcatccggccgcgttcttcccatttggagggggtcctcggatctgcatcggccagaacttcgcgttactggaagctaagatggctctcagcaccatcctacaacgcttctcgttcgagctctctccatcctacacccacgctccgtacaccgtgttaaccctccacccacaacatggtgctccaattatgctcaagaagatatgaccatgcttcccattgggtagtaaatttgctcacatcttgtgtataatttaaaattggaacactgagctgaataaacacaacaacgggtttacacgtgtgtgttttgtaagttgggaatggattaaatagtatagttatctaaaggaaatatgccctagagaaaaataataaaaggtttattattgtcatatcccagtaagtacataatagtttcatattgtgctataactgtatcaagtagacacattgatacatgtgtgatacg

SEQ ID NO: 3329 - DNA, 2105 bp, Panicum virgatum
gaccacgccatacatgcacagggagcaaggatcaggccttctagaagacgacggacgaacactcataatgttacggatttttctttcttttgaagaaaaatgttgtggattttgtctaggaaaaataacacggagatttccaggtacagcaaggaggaggcaagacgcacacgtgtcggcccaatcctccagtatttaagcagaagcaggagcctcgcccgcaatcacacacacactgtccgtccatccctctgatcagctctgctcttctgcttctcttcgacctcgccaagccacaccaatggcggcgcgcgctctcttgatgctgcgggaggcctccccgtgggcgctggccggcgcggcggcggccgtggcgctgctgtggctggtggcctggacggcggagtgggcctggtggacgccgcggcggctcgaccgggccctgcgggcccggggcctcaagggcacccggtaccgcctcttcaccggcgacctggcggagaacgcccggatcaaccgggaggctcgcaccaagccgctgccgctcggctgccacgacatcgccccacgcgtgcagcccatgctccacagagccatcaaggaatacgggaaaatgacgttcacctggtttgggccaataccgagggtgatgataccagacccggagttagtcaaagaggttttgtctaacaagtttggccactttggcaaacagagtagccgtatcgcgaagctgctagccgaaggggttgtcagtcatgagggcgagaagtgggcaaaacacaggagaattctcaatcctgccttccaccatgagaagataaagcggatgctgccggtattttccacttgttgcgcccaaaccattactaaatgggagaattcaatgccttccgaggggtcttttgaggtagatgtctggccggagttccagaatctcacgggagatgttatctcaagaaccgcatttggtagcagctatcaagaggggatgaaaattttccagctgcaaggagagctagctgaacgccttgtacagtctttccaaacaatatttatcccaggatattggtttttgcccaccaaaaataatagaaggatgcgagaaattgatcgggagatccggaaaattctgcttgaaataattacgaaaagggagaaggccattaaagatggcaaacctagtaatgatgacttgctgggcttattactggagtcaaacatgaatgaatcgaaagggaatgcaaagctgggattgtcaacggaagatgtgattgaggaatgcaaactattttactttgccggtatggagacaacatcagtcctgcttacttggactctcattgtgctaagcatgcacccagaatggcaagagagggcaagagaagaagtgctgaaccactttggaagagccaacccagattttgatagcttgagccgcctgaagactgtaaccatgattttgtacgaggtccttaggttgtacccgccagtaacccttatagtcagaagaacatacaaggagatggagctcggcagcatcacatatcccgccggagtgaaccttgtgctgcccattctcttcattcaccatgatccggagatttgggggaaagacgcgagcgagttcaatcctgcaaggtttgctgacggcgtctccaacgctaccaagcaccagggcgctttttttccgttcggagggggtccccggatctgcatcggccagaacttcgcgttgctggaagcgaagatggcgctgtgcaccatcctccagcgcttctccttcgagctctcgccatcctacacccatgtgccgtacaccgtgctcaccctgcaccctcagcacggcgctcagatcagactgaagaagctctgatgaccatgacgctcatgcctggctgatatgatggcatgcatctgtatactgccaccctgtacagtcattttgcatgatgtatgtagattagattttgacctttgaaatgaataaagcagggagaaaatgtgcatggatatagaaattttggtcctcgtttagtcaaaactgttcaaacagttatagctctcttccatttatcgttcctaatgggtgaacttgtatgtct

SEQ ID NO: 3330 - DNA, 1952 bp, Setaria italica
tccgtcctctgcttttctgcttctcttcacttcaaccggcgcaaaagccaccacttctgcaagatgctgtgggaggcctccccgtgggcgctggccggcgcggcggcggccgtggcgctgctgtggctggtggcctggacggtggagtgggcctggtggataccgcggcggctcgaccgggccctgcgggcccaggggctcaagggcaccgcgtaccgcctcttcaccggcgacctgagggagagcgcccggatcaaccgggaggctcgcgcgaagccgctgcctctgggctcccacgaaatcgccgcccgcgtgcagcccttgctctacagagccaccaaggaatacgggaaagtgtcgttcacttggttcggcccagtacccagggtgatgataccagacccggagttagtcaaagaggttttgtctaacaagtttggccacttcggtaaaccaaggagtacccgtattgggaagttgctagccaatggggttgtaaaccatgaaggcgagaagtgggcaaagcacaggagaattctcaatcctgcatttcatcatgagaaaataaagaggatgctgcctgtattttctacgtgttgcgacgaaaccattactagatgggagaattcaatgccttctgagggatcttcagagatagacgtctggccagagttccagaatcttacgggagatgttatctcaaaaaccgcatttggtagcagctatcaggaggggaggaaaattttccagctgcaaggagagctagctgaacgccttgtacagtctttccaaacaatatttatcccaggctattggtttttgcccaccaaaaataacagaaggatgagagaaattgatcgggagatccgcacaattctgcatgagataattgggaaaagagagaaggccatgaaaaatggcgaaacaaataatgatgacttgctgggcttattgctggagtctaacatgaagcaatcaaatgggaatgcaaagttgggattgacaacagaagatgtgattgaggaatgcaagctattttactttgccggtatggagacaacatcagtcctgcttacttggactctcgttgtgctaagcatgcacccggaatggcaagagcgggcaagagaagaagtactgagccactttggaagagccaaaccagattttgatagcttgagccgcctgaagactgtaaccatgattttgtacgaggtccttaggttgtacccgccggcaacctttctaacaagaagaacatacaaggacatggagctcggcggcatcagataccctgcaggagtgaaccttctgctgcccattctcttcattcaccatgatccggacatttggggaaaagacgcgagcgagttcaatcctgcaaggttctctgacggcatctccaacgctaccaaacaccagggcgcgttcttcccgttcggagggggtccccggatctgcatcggccagaacttcgcgttgctggaagccaagatggcgctgtgcaccatcctccagcgcttctccttcgagctctcgccatcctacacccatgcgccgtacaccgtgatcaccctgcaccctcagcacggtgctccgatcagactgaagaagctctgatcatgactttcatgctggctgatagcatctgtatactgcgcgctacctatatagccaattttgcatgatcgatgtatgtagctcagattttgacctttgaaatgaataaagggagagactgtacatgaatttagaaatttggtacttgtttcagtcaaaactgttccaacaattatagttctcttttgtatgttgttgctaatgggtgtgaaagaattcagaggtgctggaagcgtgcagttcgtctctgccgcctgcgtgtttatatagggactagataagatttacaacagacttgatacacaagatacaggaatatctactcagcaaca

SEQ ID NO: 3331 - DNA, 1891 bp, Setaria italica
ccgtcctctgcttttctgcttctcttcacttcaaccggcgcaaaagccaccacttctgcaagatgctgtgggaggcctccccgtgggcgctggccggcgcggcggcggccgtggcgctgctgtggctggtggcctggacggtggagtgggcctggtggataccgcggcggctcgaccgggccctgcgggcccaggggctcaagggcaccgcgtaccgcctcttcaccggcgacctgagggagagcgcccggatcaaccgggaggctcgcgcgaagccgctgcctctgggctcccacgaaatcgccgcccgcgtgcagcccttgctctacagagccaccaaggaatacgggaaagtgtcgttcacttggttcggcccagtacccagggtgatgataccagacccggagttagtcaaagaggttttgtctaacaagtttggccacttcggtaaaccaaggagtacccgtattgggaagttgctagccaatggggttgtaaaccatgaaggcgagaagtgggcaaagcacaggagaattctcaatcctgcatttcatcatgagaaaataaagaggatgctgcctgtattttctacgtgttgcgacgaaaccattactagatgggagaattcaatgccttctgagggatcttcagagatagacgtctggccagagttccagaatcttacgggagatgttatctcaaaaaccgcatttggtagcagctatcaggaggggaggaaaattttccagctgcaaggagagctagctgaacgccttgtacagtctttccaaacaatatttatcccaggctattggtttttgcccaccaaaaataacagaaggatgagagaaattgatcgggagatccgcacaattctgcatgagataattgggaaaagagagaaggccatgaaaaatggcgaaacaaataacgatgacttgctgggcttattactggagtctaacatgaagcaatcaaatgggaatgcaaagttgggattgacaacagaagatgtgattgaggaatgcaagctattttactttgccggtatggagacaacatcagtcctgcttacttggactctcgttgtgctaagcatgcacccggaatggcaagagcgggcaagagaagaagtactgagccactttggaagagccaaaccagattttgatagcttgagccgcctgaagactgtaaccatgattttgtacgaggtccttaggttgtacccgccggcaacctttctaacaagaagaacatacaaggacatggagctcggcggcatcagataccctgcaggagtgaaccttctgctgcccattctcttcattcaccatgatccggacatttggggaaaagacgcgagcgagttcaatcctgcaaggttctctgacggcatctccaacgctaccaaacaccagggcgcgttcttcccgttcggagggggtccccggatctgcatcggccagaacttcgcgttgctggaagccaagatggcgctgtgcaccatcctccagcgcttctccttcgagctctcgccatcctacacccatgcgccgtacaccgtgatcaccctgcaccctcagcacggtgctccgatcagactgaagaagctctgatcatgactttcatgctggctgatagcatctgtatactgcgcgctacctatatagccaattttgcatgatcgatgtatgtagctcagattttgacctttgaaatgaataaagggagagactgtacatgaatttagaaatttggtacttgtttcagtcaaaactgttccaacaattatagttctcttttgtatgttgttgctaatgggtgtgaaagaattcagaggtgctggaagcgtgcagttcgtctctgccgcctgcgtgtttatataggg

SEQ ID NO: 3332 - DNA, 2040 bp, Panicum virgatum
agtcggccatcattccctgacccgcttgctttgcactgctcgctcaccgttcactccaagaagccgatggcaactcgagctctgccgctgctacgggagtccccgccgtgggccgtggcttgcgcggcggcggcgctgttgtggctggtggcctggacgctggagtgggcgtggtggacgccacggtggctcgaccgggccctgcgtgaccaggggctcaagggcaccaggtaccgcctcttcaccggcgacctgagggagaacacccggctcaaccgcgaggcgcgggcgaagccgctgccgcttgggtgtcacgacatcatcccccgcgtgctgcccatgctccacaacgccgtaaaggagaacggggcagcgtcattcacttggtttgggccaaacccgagggtgatgattccagacccagaatcagtaagagaggttttgtctaacaagtttggccactttggcaagcaacgttttagccgtgttggcaagttactaggcaatggggtggcgaatcatgaaggtgagaaatgggcaaagcataggagaatcctcaatccagcattccaccatgagaaaataaagcggatgctgcctgtatttgctacctgttgcatcaatgtgattaacagatgggaaaaaataatgtcttccgagggatcttctgagatagacatctggcctgagtttcagaatcttactggagatgttatctcgagaactgcgtttggtagcagctatcaagaggggatgaaaattttcgagctgcaaggagagctagctgaacgccttgtacagtctttccaaccagtatttatcccaggatattggttcttgccgaccagaaataacagaaggatgagagaaatcagtcgagaaatccacaaaattctgtgtgatataattgggaaaagagaaaaggctatgaaaaatggcgaaacaaatagtaatgatttgctgggcttattactggagtcaaacatgaggcaatcaaatgggaatgcaaagctaggattgacaacagaagatgtcattgaggaatgcaagctattttactttgccggtatggagacaacatcagtcctgcttacttggactctcattgtgctaagcatgcacccagaatggcaagagaaggcaagagaagaagtattaaaccactttggaagagatagaccagattttgaaaacttgaaccgcctgaagactgtaaccatgattctgtacgaggtcctcagattgtacccacctatagtcttattcagcagaagcacgtacaaggaaatggagctcggtggcatcaaatatcctgcaggcgtgaacctcatcctgcccgtcatcttcattcaccgcgatcccagcatctggggagaagacgcaggcaagttcaatccagagaggttcgccgatggcatttccaacgcgtccaagcatcaggccgccttcttcccatttggaggcggtcccaggatctgcatcggccagaacttcgcgttgctggaagcgaagatggcgctgtgccccattctccaacgcttctccttcgacctctcgccgtcctacattcacgcgccgtacaccgtgataacgttgcatccccagcatggtgctcagatcaggctgaagaagctttaatttaactatggtgatcttgctggatggcaaaacctcaataccattatcatatagtgactgtgcatctacgttgtttaaaattcatgatcaaggccggaactttccatattccaaaaaaaaggttgtttaaaagtcgatgtttgatctgaattacaagtacagtgtgtgtatgaatggagaaattggttgatggacatgttgcagttcattgttttttttcgtttgaacctcagttcagtttaattgaggaacagtagtgttggtgtattgttgtaatcagtaaatgtataaggaccattgtgtaaagtggaggagataaagaaaagagaagggctatgggggagaaacaacccagccacaaaatttcccaattccaacatggtatacagagctagggttagg

SEQ ID NO: 3333 - DNA, 1841 bp, Avena sativa
atacgactactacaaaacctgaacggctgtgcccacagcctctgccttcctctagttcaccgcctcgatggtgacccgggctctccagatgctgcgggaggcctctccgtggaatctagccggcgcagcggcggccatggcactgctgtggctggccgcctggattctggagtgggcatggtggaccccgcggcggctgggtcgggccctgcaggctcagggactcaggggcacccggtaccgcctcttcaccggcgacgtgccagagaacgcccggctcaacagagaggcccggtccaagcccctgccgctcggctcacacgatatcatgccccgggtgcagcccatgctcagcaacaccattaaagataacggaaaattatcattcacttggtttggcccagaaccaagggtgctcattcctgacccagaattagtgagagaaatcctgtccaacaagtttggacactatggcaaaccaaagagtagccgttttggtaggctgctagccaacgggcttgtcaatcatgaaggcgagaaatgggcaaagcaccggagaatcctgaatcctgcctttcaccatgagaagataaagaggatgctgccagttttttctacttgtagcgaagaaatgattacgagatgggagaattcaatgccctccggaggattatctgaggttgatgtctggcctgagttccagaatcttactggagatgtcatctccagaacagcgttcggcagcagttatcaggaggggatgaaaatattccagctgcaaggggagctaggtgaacggctaatggaagcttttcagacactttttatcccaggctattggttcttgccaactaaaaacaacagaagaatgagagcaatcgatcgtgagatctgcacaattatgcgaggaattattggaaagaaagacagagctattaaaaatggtgaaactagcagcgatgacttgctaggattgctggtggagtcaaatatgcgagaatccgacgggaaagcagatctaggaatgactactgaagatataattgaggaatgcaagctattttactttgcaggcatggagacaacatcagtgttgctcacatggacactgattctgctaagtatgcacccagagtggcaagagcaggcaagaaaggaagtgttgcaccacttcggaaaaaacaggccagactttgaaaatttgagtcggctcaagacagtaacgatgattctatatgaggttcttaggttgtacccgccagcaatctttcttaccagaagaacatacaaggcaatggagcttggtggcatcaaatatccggcaggagtgaaccttatgttgcctatcctcttcatccaccatgatcccaatatatggggaaaagatgcaagcgaattcaacccacagaggtttgctgatggcatctcgaatgcggcgaagcatccggccgcgttcttcccatttggagggggtcctcggatctgcatcggccagaacttcgcgttactagaagctaagatggctctcagcaccatcctacaacgcttctcgttcgagctctcgccatcctacacccacgctccgtacaccgtgttaaccctccacccacagcatggtgctccaattatgctcaagaagatatgaccatgcttcccattgggtagtaaatttgctcacatcttgtgtataatttaaaattggaacattgagctgaataaacacaacaacgggtttacatgtgtgtgttttgtaagtcgggaatgaattgaatagtatagttatctgaagggaatatgccctagagtaaaataataaaaggtttattattgtcatatcccaa

SEQ ID NO: 3334 - DNA, 2182 bp, Lolium multiflorum
ctacgatctacgactacaacaaaacctgagcggctgaggcaagcctctggtttcctctagttcaccgccccgatggcgacccgggctctccagatgctgggggaggcctctccgtggaacctagcatgtgcggcggcggccatggcggtgctgtggctggccgcctggattcttgagtgggcatggtggaccccgcggcggctgggtcgggccctggaggctcagggcctcaagggcacccgataccgtctgttcaccggcgacgtgccggagaacgcccggctcaacaaagaggcccggtccaagcccctgcctctcggctcgcacgacatcatccctcgcgtgcagcccatgatcagcaacgccatcaaagagaacggaaaattgtccttcacttggtttggccccgaaccaagggtgaccattcttgacccagaatcagttagagaaattctgtccaacaagtttggacactatggcaaaccaaggagtagccgttttggcaagctgctagccaacgggcttgtcaatcatcaaggagaaaaatgggcaaagcacaggagaatcctaaatcctgcctttcaccatgagaagataaagaggatgttgccagttttttctgcctgtagcgaagaaatgattacgagatgggagaattcaatgtcctcccaaggagtatctgaggttgacgtctggcctgagttccagaatctgaccggagatgtcatctcgagaacagcgttcggtagcagttatcaggaggggacgaaaatattccagctgcaaggggagcaagctgaacggctaatgcaagcttttcagacactttttatcccaggctattggttcttaccaactaaaaacaacagaagaatgagagcaattgaccgtgagatctgcaccattctgcgaggaattattgagaaaaaagacagagctattaaaagtggtgaagctagcagtgatgacttgctaggattgctgttggagtcaaatagacgggaatccaatgggaaagcagacctaggaatgagtaccgaagacataattgaggaatgcaagctattttactttgcaggtatggagacaacatcagtattgctcacatggacactaattctgctaagcatgcacccggagtggcaagagcaggcaagaaaggaagtgttgcaccactttggaagaaccacaccagactttgagaacttgagtcggctgaagatagtaacgatggttctatatgaggttcttaggttgtacccgccagcaatctttgttaccagaagaacatacaaggaaatggagcttggtggcatcacatatccggcaggagtgaaccttatgttgcccattctctttatccaccatgaccccaatatatggggaaaagatgcaagcgagttcaatccagagaggtttgctgatggtatctcaaatgccgtgaagcatccagctgcgttcttcccatttggagggggtcctcgtatttgcatcggccagaactttgcactactggaagccaagatggctctcagcaccatcctccagcgcttctccttcgagctatcgccgtcctacacccatgctccgtacaccgtgttaaccctccacccacagcatggtgctccaattgtgctgaggaagatatgatcattcttctcatcggggagtgaatttgcccacctgttgtgtgcaattttaaattgaagctttgatcttaataaactagcaccgggtttgcatgtgtgtttatttggaagttatgattgaattggaacagtattgttatttgccgtaggcacataatcgatctaccgaataccaagaaatcacaattcaccacacaatgacgacattgaggttggggtttcactgagggcttggttaacgcctgggtgggtggcagggttcttgacccgagtcttgagctgcttcacttgttcatacccttaccccagagtactgtcggagactgtaatgctataggatatcgcaaaggcggcgcactttgagattgtggcttggagaagggatgattgtgatcccattgttagagatataggactagtatacgcataggactagtatatgattctattagacaaaccgaattgtaaggaaagtcggtgttcctgatcttgtacgatcggttgtgcctcaagccctcgatcatctgtctaat

SEQ ID NO: 3335 - DNA, 1774 bp, Festuca arundinacea
ggcacgaggctgaggcaagcctctgctttcctctagttcaccgccccgatggcgacccgggctctccagatgctgggggaggcctctccgtggaacctagcatgtgcggcggcggccatggcggtgctgtggctggccgcctggattcttgagtgggcatggtggaccccgcggcggctgggtcgggccctggaggctcagggcctcaagggcacccgataccgtctgttcaccggcgacgtgccgcagaacgcccggctcaacaaagaggcccggtccaagcccctgcctctcggctcgcacgacatcatccctcgcgtgcagcccatgatcagcaacgccatcaaagagaacggaaaattgtccttcacttggtttggccccgaaccaagggtgaccatccctgacccagaaccagtgagagaaattctgtccaacaagtttggacactatggcaaaccaaagagtagccgttttggcaagctgctagccaacgggcttgtcaatcatcaaggagaaaaatgggcaaagcacaggagaatcctaaatcctgcctttcaccatgagaagataaagaggatgttgccagttttttctgcctgtagcgaagaaatgattacgagatgggagaattcaatgtcctcccagggagtatctgaggttgacgtctggcctgagttccagaatctgaccggagatgtcatctcgagaacagcgttcggtagcagttatcaggaggggacgaaaatattccagctgcaaggggagcaagctgaacggctaatgcaagcttttcagacactttttatcccaggctattggttcttaccaactaaaaacaacagaagaatgagagcaattgaccgtgagatctgcaccattctgcgaggaattattgagaaaaaagacagagctattaaaagtggtgaagctagcagtgatgacttgctaggattgctgttggagtcaaatagacgggaatccaatgggaaagcagacctaggaatgagtaccgaagacataattgaggaatgcaagctattttactttgcaggtatggagacaacatcagtattgctcacatggacactaattctgctaagcatgcacccggagtggcaagagcaggcaagaaaggaagtgttgcaccactttggaagaaccacaccagactttgagaacttgagtcggctgaagatagtaacgatggttctatatgaggttcttaggttgtacccgccagcaatctttgttactagaagaacatacaaggcaatggagcttggtggcatcacatatccggcaggagtgaaccttatgttgcccattctctttatccaccatgaccccaatatatggggaaaagatgcaagcgagttcaatccacagaggtttgctgatggcatctcaaatgccgtgaagcatccggctgcgttcttcccatttggagggggtcctcggatttgcatcggccagaactttgcactactggaagccaagatggctctcagcaccatcctccagcgcttctccttcaatctatcgccgtcctacacccatgctccgtacaccgtgttaaccctccacccgcagcatggtgctccaattgtgctgaggaagatatgatcattcttctcatcggggagtgaatttgcccacctgttgtgtgcaatttaaattgaagctttgatcttaataaacatagcaccgggtttgcatgtgtgtttatttggaagttatgattgaattggaacagtattgttattgccgtagc

SEQ ID NO: 3336 - DNA, 2723 bp, Setaria italica
tgatcccaacatctggggaaaagacgcaggcatgttcaatccagagaggttcgccgacggcatttccaatgccaccaagcaccaagccgccttcttcccatttggaggcggtccccggatctgcattggccagaacttcgcgttgctggaagcgaagatggcgctgtgcaccatactccagcgcttctcatttgagctctcgccgtcctacactcacgcgccgtacactgtgataactttgcaccctcagcatggtgctccaatcaggctgaagaagctttgaccacggtgatcatgctggatggcaaagtctcaataccactaccatatagtgactgtacatgtatatgatgtttaaaattcgacgcttgatctgaattacgagtgcagagtgtgtatgaatggagaaattggttgatgtacatattgcagctctcagtttaattgatggaacagttataccctgcccatatcctttctaatggagccgagctcacggggctgcattttctgtttgatacgcagagattataaagttttattgattccaaaataagtcaaattcactctcagtaaggtccattggctgctattattaggcttggcaacaaaacatctgaaaaatagacccagcccaaaatataaaaaataataattcggacaactgaaattcgggtgtgagctttttatcggcctggcccggcccatgctcaggtccacctccaagacgaagcatgaatttatactttgatgtagtgggtaacatactgacatcatattcgtagttgcattattaacgagatacgtacaagtaggggcgagcgaagagtcagacagtgattcgtgaagccataaaagtacagcacaaattgcattcatgacgagctctgctgacgctgcaagaagcgaatggcgactcgagctctgctgacgctgcgggaggcctccccgtggaccctggctggcgcggcggcggccgcagcgctgctgtggctggtggcctggacgctggagtgggcctggtggacgccgcggcggctggagcgggccctccgggcgcagggcctcaggggcaccaggtaccgcctcttcaccggcgatgtgagggagaacgcgcggcgcaaccgggaggcgcggacgaagccgctgccgctcggctgccatgacatcatcccccgcgtgcagcccttgttccacgacctcgcaaaggagaacgggaaattgtcattcagttggtttggcccgacgccaaggatgatgattccagacccggaattagttagagaagttttgtctaacaagtttggccactttggcaaaccgaagactattcgtgttgtgaagttgatctccaacgggctttttaatcatgaaggcgagaaatgggcaaagcacaggaggatcctcaatcctgcctttcaccatgagaaaataaagcggatgctacctgtattttctacctgttgcatagaaatgattacaagattggaaaatgcaatgtcgcctgaggggtcttctgagattgatgtctggcctgagttccagaatcttactggagatgccatctcaagaaccgcgtttggcagcagctttcatgagggtaggagaattttccagcttcaagaagagctagctgaacgtgttatacaatcttttcggacaatatttatcccaggctattggttcttgcccaccaaaaataacagaaggataggacaaattgatcaggagatcagcaaacttctgcgtggaataattgagaaaagagacaaggttattaaagatcgcgaaactaataacgatgacttactgggcttattggtagagtccaacatgagggaatcaaatgggaaagtaaatctaggaatgactacagaagatataattgaggaatgcaagctattttacttcgcaggtatggagacaacatcagtcctgctaacttggactatagtcgtgctaagcatgcacccaaaatggcaagagctggcaagagaagaagtgttgaattattttggaagagctagaccagattttgatagcttgagccgcctgaagattgtaacaatgattctatacgaggtccttaggttgtacccaccagtaattttcctaaccagaagaacttacaaggaaatagagctcggtggcatcaaataccctgcaggagtcaaccttctgctgccccttcttttcattcaccatgatccgatcatctggggaaaagatgcaagtgagttcaacccagagaggtttgccgacggcatctctaatgcgaccaagcaccagactgccttctttccattcggatggggtcccaggatctgcatcggccagaacttcgcgttgctggaagcgaagatggcgctgtgcaccatcctccagcacttctcctttgagctctcgccgtcctacactcacgcgccctacaccgtgataatcttgcaccctgagcacggtgctcagatcaagctgaagaagctctgacatgatgatcatgctgagctgcaacaactatagatccggtgattaagtatgtagtttagagctgaataaacagaatttgtatgattgtgtgaagtgtgaacagataaagtgctcattttgcctattggccatgtgctatactggcaaagctctacagtgctgtaattgtagttatttattgtgtaactttatacttctctctccgtcgggaattttcattgattttaatgatgtag

SEQ ID NO: 3337 - DNA, 2937 bp, Setaria italica
tgaccctctgtttggtttctgcaggtaaccatgattttgtacgaggtcctcagattgtacccacctgtagtcctattaagcagaagaacttacaagggaatggagctcggtggcatcaaatatccagcaggcgtgaaccttctcctgcccataatcttcattcaccatgatcccaacatctggggaaaagacgcaggcatgttcaatccagagaggttcgccgacggcatttccaatgccaccaagcaccaagccgccttcttcccatttggaggcggtccccggatctgcattggccagaacttcgcgttgctggaagcgaagatggcgctgtgcaccatactccagcgcttctcatttgagctctcgccgtcctacactcacgcgccgtacactgtgataactttgcaccctcagcatggtgctccaatcaggctgaagaagctttgaccacggtgatcatgctggatggcaaagtctcaataccactaccatatagtgactgtacatgtatatgatgtttaaaattcgacgcttgatctgaattacgagtgcagagtgtgtatgaatggagaaattggttgatgtacatattgcagctctcagtttaattgatggaacagttataccctgcccatatcctttctaatggagccgagctcacggggctgcattttctgtttgatacgcagagattataaagttttattgattccaaaataagtcaaattcactctcagtaaggtccattggctgctattattaggcttggcaacaaaacatctgaaaaatagacccagcccaaaatataaaaaataataattcggacaactgaaattcgggtgtgagctttttatcggcctggcccggcccatgctcaggtccacctccaagacgaagcatgaatttatactttgatgtagtgggtaacatactgacatcatattcgtagttgcattattaacgagatacgtacaagtaggggcgagcgaagagtcagacagtgattcgtgaagccataaaagtacagcacaaattgcattcatgacgagctctgctgacgctgcaagaagcgaatggcgactcgagctctgctgacgctgcgggaggcctccccgtggaccctggctggcgcggcggcggccgcagcgctgctgtggctggtggcctggacgctggagtgggcctggtggacgccgcggcggctggagcgggccctccgggcgcagggcctcaggggcaccaggtaccgcctcttcaccggcgatgtgagggagaacgcgcggcgcaaccgggaggcgcggacgaagccgctgccgctcggctgccatgacatcatcccccgcgtgcagcccttgttccacgacctcgcaaaggagaacgggaaattgtcattcagttggtttggcccgacgccaaggatgatgattccagacccggaattagttagagaagttttgtctaacaagtttggccactttggcaaaccgaagactattcgtgttgtgaagttgatctccaacgggctttttaatcatgaaggcgagaaatgggcaaagcacaggaggatcctcaatcctgcctttcaccatgagaaaataaagcggatgctacctgtattttctacctgttgcatagaaatgattacaagattggaaaatgcaatgtcgcctgaggggtcttctgagattgatgtctggcctgagttccagaatcttactggagatgccatctcaagaaccgcgtttggcagcagctttcatgagggtaggagaattttccagcttcaagaagagctagctgaacgtgttatacaatcttttcggacaatatttatcccaggctattggttcttgcccaccaaaaataacagaaggataggacaaattgatcaggagatcagcaaacttctgcgtggaataattgagaaaagagacaaggttattaaagatcgcgaaactaataacgatgacttactgggcttattggtagagtccaacatgagggaatcaaatgggaaagtaaatctaggaatgactacagaagatataattgaggaatgcaagctattttacttcgcaggtatggagacaacatcagtcctgctaacttggactatagtcgtgctaagcatgcacccaaaatggcaagagctggcaagagaagaagtgttgaattattttggaagagctagaccagattttgatagcttgagccgcctgaagattgtaacaatgattctatacgaggtccttaggttgtacccaccagtaattttcctaaccagaagaacttacaaggaaatagagctcggtggcatcaaataccctgcaggagtcaaccttctgctgccccttcttttcattcaccatgatccgatcatctggggaaaagatgcaagtgagttcaacccagagaggtttgccgacggcatctctaatgcgaccaagcaccagactgccttctttccattcggatggggtcccaggatctgcatcggccagaacttcgcgttgctggaagcgaagatggcgctgtgcaccatcctccagcacttctcctttgagctctcgccgtcctacactcacgcgccctacaccgtgataatcttgcaccctgagcacggtgctcagatcaagctgaagaagctctgacatgatgatcatgctgagctgcaacaactatagatccggtgattaagtatgtagtttagagctgaataaacagaatttgtatgattgtgtgaagtgtgaacagataaagtgctcattttgcctattggccatgtgctatactggcaaagctctacagtgctgtaattgtagttatttattgtgtaactttatacttctctctccgtcgggaattttcattgattttaatgatgtagggatgctttggtaaataattagctccacaatagctcatgcatggcaa

SEQ ID NO: 3338 - DNA, 2385 bp, Panicum virgatum
cttaaaacaatctagtttaataataatgatatcaaatggcgcgccaaaagattgatgagttttatgatgatcccataacctcaggatctactggacctaaagacccttatagaagccgggtatatatggatatgttcctagagaaaaaagaaaatttgagagcagggccgcaagcaggagctgcgccgtgatcattcaccattgttgaactaccgcgacccaagttcgaaaacaacgtagactacgccatacatacctggggagcaaggaacgggccttctagaagacgatgaacgaaacactcataaattcatgatgttatatcttatatggattttgtctaggaaaagaaaaaaacacggagacttccgagtacaccaaggagaagggggcaagacgcacacgtaatgccccaatcctccactatttaagcagacgacacgagcctcgcccccaatcacacacacacccccctgatccgctctgctttgctgcttcctttcgaccgcgccaagccacaccaatggcggcgcgcgctctgttgatgctgcgggaggcctccccgtgggcgctggccggcgcggcggcggccgtggcgctgctgtggctggtggcctggacggcggagtgggcctggtggacgccgcggcggctcgaccgggccctgcgggcccagggcctcaagggcacccggtaccgcatcttcaccggcgacctttgggagaacgtccggatcaatcgggaggctcgcaccaagccgctgccgctcggctgccacgtcatcgccccacgcgtgcagcccatgctccacagggccatcaaggaatacgggaaaatgtcgttcacctggttcggtccaataccgagggtgatgataccagacccggagttagtcaaagagattttgtctaacaagtttggccactttggtaaaccaaggagtacccgtatcgggaagctgctagccaatggggttgtcaatcatgagggcgagaagtgggcaaaacacaggagaattctcaatcctgccttccaccatgagaagataaagcggatgctgccggtattttccacttgttgcgccgaaaccattactaaatgggaggattcaatgccttccgaggggtctttggaggtagatgtctggccggagttccagaatctcacgggagatgttatctcaagaaccgcatttggtagcagctatcaggaggggatgaaaattttccagctgcaaggagagctagctgaatgctttgtacagtctttaaaaacaatatttataccaggatattggtttttgcccaccaaaaataacagaaggatgcgagaaatttatcaggagatccgaaaaattctgcgtgaaataattgggaaacgggagaaggccattaaagatggcaaacctaataatgatgacttgctgggcttattactggagtcaaacatgaatgaatcgaaagggaatgcaaagctgggattgtcaacggaagatgtgattgaggaatgcaagctattttactttgccggtatggagacaacatcagtcctgcttacttggactctcattgtgctaagcatgcacccagaatggcaagagagggcaagagaagaagtgttgaaccactttggaatagccaaaccagattttgatagcttgagccgcctgaagactgtaaccatgattttgtacgaggtccttaggttgtacccgccggtaacccttatggtcagaagaacatacaaggagatggagctcggcagcatcagatatcccgccggagtgaaccttctgctgcctattctcttcattcaccatgatccggagatttgggggaaagacgcgagcgagttcaatcctgcaaggtttgctgacggcgtctccaacgctaccaagcaccagggcgcattctttccattcggagggggtccccggatctgcatcggccagaacttcgccttgctggaagcgaagatggcgctgtgcaccatcctccagcgcttctcctttgagctctcgccatcctacacccatgcgccgtacaccgtgatcaccctgcaccctcagcacggcgctcagatcagactgaagaagctctgatgaccatgacgctcatgccgggctaatggcatctgttgtatgttgccgccatatacggtcattttgcatggtgtatgtagattagattttgacctttgaaatgaataaagcagggggagaatgtgcaaacagttatagctctctttcatatatgttgctaatgggtgaagttgtatgtctctgtcaacgctttgcggtgtggctccatcttcttctttttgcgaagaatttttgcatctgaaaacgatgtcgaatttttacacaattttcttaagaattttaca

SEQ ID NO: 3339 - DNA, 3039 bp, Sorghum bicolor
gccggcaacattggacgtaccggcgcgcagcctggaacccaaaaacccatggtcgcaccgcctgcctttgttttctccgaacaagcaaaacctcagtggaagtggaagccgctaaaatccattcggcctcttctagtttctctctctgccgccgtccgccggcctcgcgcaccccgccggcaaccgatcccaggacgccgccgccggccgtcaatcgtgccccactggactcgacccggggagtccgttcaggtcctccaccgaacgcgcactgctctccgttgtttctgttaaaaacatgactgctcagacaaagaagaggggcgctgcggaaaatggggatggtggtgttagtttgggccttgctgccttcattgcaaacaatgaggatgtgggtcccatagtccggcatgcttttgagtctgggaagcctgaagccctcttgcacagcctccacaacatcgtgaagatgaaggaggttgagattgaagagatttgtagactccactatgaggaattcatccttgcggtcgatgagcttcgtggtgtcctggttgatgctgatgagcttaagggcacattgtctgatgagaacctgcggttacaagaggttgctagtgccttgctactgaagcttgatgagcttcttgagatctattctgtaaacagtaatgttggggaagccctagctacattgaagatttgtctgcaagtaaccaatctctgcaagatatgcaacagggacattgccgaagcaaaattgctttctgcattgaaaacattggagttgattgagaaggactacctgcaaaatattccactgaagcttctgaaaaaggttattcataaacaagttcctatggtaaagctgtacattgagaagaaagtttgtagtgagtttaatgagtggcttgtgtatatcagaaggactgctaaggagattgggcaagttgcaatagaccagacatctctgactcatcagaaagatgagggaatgtgtgcccgacagagggaagcagaagaatctagccgtgttgggttcgacgtgaatgcttacaccttggacgtggagcacatgtctgaggaagcaatgctggaatttgatcttgcgccagtgtacagagcacaccatatccacataggccttggtcttggggagaagtttcgagaatattactataataacagactcatgcaactcaatttggacttacaaatttctacgtcacaaccctttgttgagtcctatcaacctttccttgctcaggtagctggcttttttattattgaggaccgtgtccttcgaactgcagatgggcttctatctgagagtcaggttgatacaatgttggaaacagccatttctaaagttactcaaatcttagaggaacagttctcccgcattgatgctgccaaccacctcctcctcataaaaggatatgtcagtctttttggtgcaaccctgaagaaatacggataccgatccatgtcacttgttgaaattcttgacaaaactagggataaatatcttgaacttcttctttctgactgccggaagaagctcaactatgccttttctaaggactcatatgagaggatggttataaagaaggaaaatgaatatgacacaaatatagcagcattccaacttgaacccgttgaaggagtaccaaatttgccatatgttgctccattttcctcctctgttcccaatgcttgtcgtattgtgcgttctttcattgaagagttggtcagctacttgtcacacagtggtagcacaaacatctatgatgtggtgaaaagttacttagacaagttcttgattgagacgttgaatgatggttttctgaacctgatacatggtggttccctggaatttccacaggtagtgcagattgcaggaaatattgccattcttgagcagtcctgtgatatgttcctttggcatgctgctcgactttgtggtgtccctaggggcctccttgagaagccccattctggtttggctgctagagctgtgctgaaagcctcccagaatgcagcatacagtggattgattactttggtcaattccaagattgatgagtttatgttgcagttgactagcatcaattggactctggaggaaaccccagagcacgcaaatgactacatgaacgaagttattatctatcttcatgaggtggtatcttctgggcagcagattgtaccaagagatgccttattcaaggttgtatctggtgcactaagccacatctcagattctataacaacggtacttcttagtgaccgggtgaaaaggttcaatgcaaatgctgttgctagtattgacattgatttgaaagtgttggaggggtttgctgatgacacctaccgcatgactgggttttcggacctgagaaaggaaacaagtttcagagattgtctagttgaaataaggcagctaataaatcttctgctaagcaaccaacctgaaagcttcgtgaatcctgtaaccagggagcagagttatggagccttagaccataagaaggtggcaataatttgtgacaagttcaaggatgccccagacagtttgtttgggagcctttcaagccgagccacagtgcagatgcagagcgcccggaagaaatccctggatgtgctgaagagaagattaaaggattttagctgagattagttgtgctacatcattaaataagctagtactcagttttaggaaaaaaatggtccagtgcaagtcttaccatttcagacttctttccatccttctttatgccctttttaatcaactcccgtttcgcatctgctcgaaatccttggatgtgctgaagagaaggttaaaagattttagctgtgattagctgagctagataattaaataagctagtactctgcctaggaagacaatggttcgatgtaagtcttagccatttcaaatttctttccatccatatttattccctttttaatctggttccgtctcgcattctttttggtgctaatgtagctgtagtgatatgtatagatgaaatattt

SEQ ID NO: 3340 - DNA, 4290 bp, Setaria italica
aatggcacagagttacaggccgtgtcaaagttccccagttctcccatatgagagtgtgctctgtagtcaacttaagataagacaaatatgtgctccattttcctcctgcttttctttccaaggacgacatgaaagagatcttttgcctcccttcagtagctcagtatcagtgtcaccaccaccaaaccagcctgagacgccacacgtctctggtgcatgacgtgcttgtctcaaggtaggtgaggagtagaagcagcctcaccctcacacatgtcgtcaccgtcgagaggtggtggcggcgcaccggaggatcagggggcgggcggtgaggccggcgtggagcggggagggagaggcacgtggcgccacgcggcgttccacgtcgccacgacgatcgccacgccggcggcctacgcccccttgcccttcgccgttgcctcccttggctggcctcttggtgtttgcagcttggttatcgggacactggttacatggtgctcaagcttggctgtggcctcgctgtggcagtggaatggagagaagcacaccagctaccggctcctcgcaaagagcatcttcggtccatggggctactggtatgtgtcctccttccagcaggtggcatcagtgggcaacaacattgcaatccagatcgcagccggcagcagcctcaaggctgtgtacaagcactactacgccgccgacgaccgcgcaatgaccctgcagcagttcatccttctcttcggcgcattcgagctgctcctctcccagctccctgacatccattctttacggtgggtcaatgctatctgcactgccagcaccgttggatttgcagcgacaaccattggtgtcacagttcatgatgggtatcggatcgacagaaaggaagtcagttacagccttcaaggaaccactgctaccaagatcttcagagctttcaacgcgttgggcacgatagcattctcctttggtgatgccatgctgccagaaattcagagcactgtgcgtgaaccggtgagggcaaacatgtacagaggtgtctcggctgcgtacacgatcatcgtcgtgtcctactggaccctggcattcagtggctactgggcattcggttctcaagtccagtcctacatcctgtcctccctgactgctccaagatgggcaattgtaatggcaaacctttttgcagtcattcagattgcaggttgctttcagatatactgcaggccaacgtttgcgcactttgaagagcaggttcgggcgaagaacaggagctgcagatcctgcctgtggcggctgatgtacacttctgcatacatggcagcgatcaccctcgtctccgcagcaatgccattctttggggactttgtatcaatctgtggagcagttgggttcacccctctggactttgtgctgccaacattggcacttatgaagactagtaagctgcctgataacctaggattgcggtatgctgcgaaggcgctcagctctgctgtcgccatcttgttctccatcataggagcacttgcatgcatcggcgcggtcagatcgatcgcaattgatgtcaagacctacaagttcttccatgatatgtgatgacagttttgcagcatcaagtagccttttgcatcaattcatgtgctgtagccccccatgagcattactttaaccggagggcataacatgaagagagaacatcgcaacaagtgcactgctcataagtatagcggatatttgatctatacaaaccattactgctacattagctccaaaacggatgcaaacaaagtagatcaaaaaggaaattaaaaagaaaaagatgaaaggaatttgaaatggctaggacagatactgaactagttctctcctaagggggtactagcttatttaacgatgcagcacggatactctcagctaaaatcctttaaccttctcttcagcacatccaaggacttcttccgggcgctctgcaccgtggctcggcttgaaaggctaccaaacaagctgtctggcgcatccttgaacttgtcacaaatgattgccaccttcttgtggtccaaggatccataattcttctccctggttacagggttcatgaagctctcaggctggttgctgagaagaagattgatcagctgccttatttccactaggcaatctttgaaacttgtttcttttctcagttctgacaacccagtgctgtgatatgtgtcatctgcaaagccctccaacattttcaggtcaatgtcaataccagctacggcatttgcattgaaccttttgactctgtcactaagaagtactgttattatagagtctgcaatgtggcttagtgcaccggagacaaccttgtacagggcatcccttggtacaatctgctgcccagaagataccacctcatgaagatagataacgacttcattcatgtagtcatttgcgtgttctggagcttcctccacagtccaattgatgctagtcaactgcaacataaactcatcaaccttggaattgaccaaagtaattaatccattgtatgctgcattctgggtggctttgagcacagctttagcagtcaaaccagaatggggcttctcaagaatacgcctaggaacaccacaaagttgagcagcatggcaaaggaacatatcacaggaccgctcaaaaactgcaatatttcctgcaatctgcaccatttgttgaaattccagggagccaccatgtataaggttcagaaaaccctcatttaatacctcaattaagaacttgtctaagtaactcttcaccacatcatagaagttcatgctgctaccatatgacaagtatctgaccaagtcctcgatgaaagcacgcacaatacggcaagcagtgggaacagaagaggaaaacggagccacatatggcaaatctggtactacatcaatgggttcaagttgaagtgctgcaacattcatgtcatattcattttccttctttataaccatctgctcatatgagtctttagacaagacattctttatctgcttacggcaatcagagataagcagctcaagatacttgtccctatttttgccaagaatttcaaccaacgatgtagcttggtatccatatttcttcatggtggtacccaaaagactgatataacctttgacattgaggaggtggttcgcagtatccatgagagataactgttgctctaagatcgatgtgaccttagatatagctgtttcccacattgtctccacctgactctcagatagaagcccatctgcagttcgaaggacacggtcctcaataatgaaaaaaccagctatctgagcaaggaaaggttgatgggactcaacaaagggctgcgatgtagaaatctgcaagtccgaattgagttgcatgagcctattgttaaagtaatattctcgaaacttttccccaagaccaaggccaatgtggatatggtatgctctgtacactggtgcaagatcaaattctagcattgcttcctcatccatgttctccacatccaagatgtaagcatgctcattaaacccaacacggctacattcctctgcttccctctgtcgggcacacatccccgcatctttctgacgagccaggttgacctggcctattgcagcatgcccaatctcctttcctatccttctgatgtatacaagccactcattgaactcaccacaaactttcttctcgatgtacagctttacaataggaatttgtttctgaataacctttttcagaagttccagaggaatattttgcatgtagtccttctcaatcaactccaaagttttcaatgcagaatgtaacttggcttctgcaatgtccctgttgcatatcttgcacagactagtgacttgaagacagatcttcaatgtcgctagggcctccccaacactcctatttactgaatacaactcaagaagcttgtcaagcttcagcagcaaggcactagcaacctcttgcagtcgcaggttctcatcagacaatgttcccttaagctcatcagcatcaaccagcacaccacggagttcgtcgacagcaagtatgaattcctcatagtgaagtctacaaatctcttcaatctcaacctccttcatcttcacgatgttcctgaggctgtgcaagagagcttcaggcttcccggattcaaaagcatgccgcacaatgggacccaaatcctcattgttcgcgatgaaggctgcaaggcccaaaccaataccaccatccccattttccgcggcacccctcttctttgtctgagcagtcatggctcaa

SEQ ID NO: 3341 - DNA, 2791 bp, Setaria italica
cctcgcctctccgccgccggcgaccgaccccaggacgccgccgccggccgccaatcgcgctctcgcggcgcggggaatctgccagtcctccccccgatcccggactgcagtccgtcgggtcagttgagccatgactgctcagacaaagaagaggggtgccgcggaaaatggggatggtggtattggtttgggccttgcagccttcatcgcgaacaatgaggatttgggtcccattgtgcggcatgcttttgaatccgggaagcctgaagctctcttgcacagcctcaggaacatcgtgaagatgaaggaggttgagattgaagagatttgtagacttcactatgaggaattcatacttgctgtcgacgaactccgtggtgtgctggttgatgctgatgagcttaagggaacattgtctgatgagaacctgcgactgcaagaggttgctagtgccttgctgctgaagcttgacaagcttcttgagttgtattcagtaaataggagtgttggggaggccctagcgacattgaagatctgtcttcaagtcactagtctgtgcaagatatgcaacagggacattgcagaagccaagttacattctgcattgaaaactttggagttgattgagaaggactacatgcaaaatattcctctggaacttctgaaaaaggttattcagaaacaaattcctattgtaaagctgtacatcgagaagaaagtttgtggtgagttcaatgagtggcttgtatacatcagaaggataggaaaggagattgggcatgctgcaataggccaggtcaacctggctcgtcagaaagatgcggggatgtgtgcccgacagagggaagcagaggaatgtagccgtgttgggttcaatgagcatgcttacatcttggatgtggagaacatggatgaggaagcaatgctagaatttgatcttgcaccagtgtacagagcataccatatccacattggccttggtcttggggaaaagtttcgagaatattactttaacaataggctcatgcaactcaattcggacttgcagatttctacatcgcagccctttgttgagtcccatcaacctttccttgctcagatagctggttttttcattattgaggaccgtgtccttcgaactgcagatgggcttctatctgagagtcaggtggagacaatgtgggaaacagctatatctaaggtcacatcgatcttagagcaacagttatctctcatggatactgccaaccacctcctcaatgtcaaaggttatatcagtcttttgggtaccaccatgaagaaatatggataccaagctacatcgttggttgaaattcttggcaaaaatagggacaagtatcttgagctgcttatctctgattgccgtaagcagataaagaatgtcttgtctaaagactcatatgagcagatggttataaagaaggaaaatgaatatgacatgaatgttgcagcacttcaacttgaacccattgatgtagtaccagatttgccatatgtggctccgttttcctcttctgttcccactgcttgccgtattgtgcgtgctttcatcgaggacttggtcagatacttgtcatatggtagcagcatgaacttctatgatgtggtgaagagttacttagacaagttcttaattgaggtattaaatgagggttttctgaaccttatacatggtggctccctggaatttcaacaaatggtgcagattgcaggaaatattgcagtttttgagcggtcctgtgatatgttcctttgccatgctgctcaactttgtggtgttcctaggcgtattcttgagaagccccattctggtttgactgctaaagctgtgctcaaagccacccagaatgcagcatacaatggattaattactttggtcaattccaaggttgatgagtttatgttgcagttgactagcatcaattggactgtggaggaagctccagaacacgcaaatgactacatgaatgaagtcgttatctatcttcatgaggtggtatcttctgggcagcagattgtaccaagggatgccctgtacaaggttgtctccggtgcactaagccacattgcagactctataataacagtacttcttagtgacagagtcaaaaggttcaatgcaaatgccgtagctggtattgacattgacctgaaaatgttggagggctttgcagatgacacatatcacagcactgggttgtcagaactgagaaaagaaacaagtttcaaagattgcctagtggaaataaggcagctgatcaatcttcttctcagcaaccagcctgagagcttcatgaaccctgtaaccagggagaagaattatggatccttggaccacaagaaggtggcaatcatttgtgacaagttcaaggatgcgccagacagcttgtttggtagcctttcaagccgagccacggtgcagagcgcccggaagaagtccttggatgtgctgaagagaaggttaaaggattttagctgagagtatccgtgctgcatcgttaaataagctagtacccccttaggagagaactagttcagtatctgtcctagccatttcaaattcctttcatctttttctttttaatttcctttttgatctactttgtttgcatccgttttggagctaatgtagcagtaatggtttgtatagatcaaatatccgctatacttatgagcagtgcacttgttgcgatgttctctctgcatgttatgccctccggttaaagtaatgctcatggggggctacagcacatgaattgatgcaaaaggc

SEQ ID NO: 3342 - DNA, 2984 bp, Setaria italica
cgctacagacgacagacacatccaaaacccctctaatctctctctctctctctctctccgccgtccgccgacctcgcctctccgccgccggcgaccgaccccaggtacgggccgtcgccccccatcttctattcgggttcctccgccattccccctcgtatctctagcttcgcccctctgtctctctctcatagcactccgtgcctgctcacaggacgccgccgccggccgccaatcgcgctctcgcggcgcggggaatctgccagtcctccccccgatcccggactgcagtccgtcgggtcagttgagccatgactgctcagacaaagaagaggggtgccgcggaaaatggggatggtggtattggtttgggccttgcagccttcatcgcgaacaatgaggatttgggtcccattgtgcggcatgcttttgaatccgggaagcctgaagctctcttgcacagcctcaggaacatcgtgaagatgaaggaggttgagattgaagagatttgtagacttcactatgaggaattcatacttgctgtcgacgaactccgtggtgtgctggttgatgctgatgagcttaagggaacattgtctgatgagaacctgcgactgcaagaggttgctagtgccttgctgctgaagcttgacaagcttcttgagttgtattcagtaaataggagtgttggggaggccctagcgacattgaagatctgtcttcaagtcactagtctgtgcaagatatgcaacagggacattgcagaagccaagttacattctgcattgaaaactttggagttgattgagaaggactacatgcaaaatattcctctggaacttctgaaaaaggttattcagaaacaaattcctattgtaaagctgtacatcgagaagaaagtttgtggtgagttcaatgagtggcttgtatacatcagaaggataggaaaggagattgggcatgctgcaataggccaggtcaacctggctcgtcagaaagatgcggggatgtgtgcccgacagagggaagcagaggaatgtagccgtgttgggtttaatgagcatgcttacatcttggatgtggagaacatggatgaggaagcaatgctagaatttgatcttgcaccagtgtacagagcataccatatccacattggccttggtcttggggaaaagtttcgagaatattactttaacaataggctcatgcaactcaattcggacttgcagatttctacatcgcagccctttgttgagtcccatcaacctttccttgctcagatagctggttttttcattattgaggaccgtgtccttcgaactgcagatgggcttctatctgagagtcaggtggagacaatgtgggaaacagctatatctaaggtcacatcgatcttagagcaacagttatctctcatggatactgcgaaccacctcctcaatgtcaaaggttatatcagtcttttgggtaccaccatgaagaaatatggataccaagctacatcgttggttgaaattcttggcaaaaatagggacaagtatcttgagctgcttatctctgattgccgtaagcagataaagaatgtcttgtctaaagactcatatgagcagatggttataaagaaggaaaatgaatatgacatgaatgttgcagcacttcaacttgaacccattgatgtagtaccagatttgccatatgtggctccgttttcctcttctgttcccactgcttgccgtattgtgcgtgctttcatcgaggacttggtcagatacttgtcatatggtagcagcatgaacttctatgatgtggtgaagagttacttagacaagttcttaattgaggtattaaatgagggttttctgaaccttatacatggtggctccctggaatttcaacaaatggtgcagattgcaggaaatattgcagtttttgagcggtcctgtgatatgttcctttgccatgctgctcaactttgtggtgttcctaggcgtattcttgagaagcctcattctggtttgactgctaaagctgtgctcaaagccacccagaatgcagcatacaatggattaattactttggtcaattccaaggttgatgagtttatgttgcagttgactagcatcaattggactgtggaggaagctccagaacacgcaaatgactacatgaatgaagtcgttatctatcttcatgaggtggtatcttctgggcagcagattgtaccaagggatgccctgtacaaggttgtctccggtgcactaagccacattgcagactctataataacagtacttcttagtgacagagtcaaaaggttcaatgcaaatgccgcagctggtattgacattgacctgaaaatgttggagggctttgcagatgacacatatcacagcactgggttgtcagaactgagaaaagaaacaagtttcaaagattgcctagtggaaataaggcagctgatcaatcttcttctcagcaaccagcctgagagcttcatgaaccctgtaaccagggagaagaattatggatccttggaccacaagaaggtggcaatcatttgtgacaagttcaaggatgcgccagacagcttgtttggtagcctttcaagccgagccacggtgcagagcgcccggaagaagtccttggatgtgctgaagagaaggttaaaggattttagctgagagtatccgtgctgcatcgttaaataagctagtacccccttaggagagaactagttcagtatctgtcctagccatttcaaattcctttcatctttttctttttaatttcctttttgatctactttgtttgcatccgttttggagctaatgtagcagtaatggtttgtatagatcaaatatccgctatacttatgagcagtgcacttgttgcgatgttctctctgcatgttatgccctccggttaaagtaatgctcatggggggctacagcacatgaattgatgcaaaaggctacttgatgctg

SEQ ID NO: 3343 - DNA, 3283 bp, Panicum virgatum
acccgactcgtttccgttttctccaacgggaacacgcccaaacatcatgtgggacccggaaacccctaaaatccattccgaaaccgctcccagacacatccaaaacccctctctctccgcgccgtccgccggcatcgcctccccgccgccggcgatcaagaccacaggacgccgccgccggccgccaatctgcgccgctcctcctcctcgatccgggctgcactccgtcgggtcagttgagccatgactgctcagacaaagaagaggggtgccgccgaaaacggggatggtggtatcggtttgggccttgcagccttcatcgccaacaatgaggacttgggtcccattatacggcatgctttcgaatctgggaagcctgaagctctcttgcacagcctcagtaacattgtgaagatgaaggaagttgagattgaagagatttgtagacttcactatgaggaattcatacttgcggttgacgaacttcgtgctgtgctggttgacgctgatgaccttaagggcacattgtctgatgagaatctgcaattgcaagaggttgctagcgccttgctgctgaagcttgatgagcttcttgagttgtattcggtaaataggagtgttggggaggcccttgctacattgaagatttgtctgaaagtcaccagtctgtgcaagatatgcaacagggacattgcacaaggcaagttatattctgcattgaaaactttggagttgattgagaaggactacttgcaaaatattcctctgaaacttctgaaaaaggttattcagaaacaaattcctgttatgaagctgtacattgagaaaaaagtttgtagtgagttcaatgagtggcttgtatatgttagaaggataggaaaggagattgggcaggctgcaatagaccaggcctccctggctcgacagaaggatgaggggatgtgtgcccgacagagggaagcagaggaatgtagtcatgttgggtttgatgggcatgcttattccttggatgtggagaacatggatgaggaagcaatgctagaatttgatcttgcaccagtgtacagagcacaccatatccacattggccttggtcatggggaaaagtttcgagaatattacttcaacaataggcttatgcagctccatttggacttgcagatttctacatcgcaaccctttgttgagtctcatcaacctttcctttctcagatagctggcttttttattattgaggaccgtgtccttcgaactgcagatgggcttctatctgagagtcaggtggcgacaatgtgggaaacagctatctctaaggtcacatcaatcttagagcaacagttctctctcatggatactgctaaccacctcctcaatgtaaaaggttatatcagtcttttgggtaccaccatgaagaaatatggataccaaactacattgttggttgaaattctcggcaaaaatagggacaagtatcttgagctgcttatctctgattgccgcaagcagattaagaacatcttgtctaaggactcgtatgaacggatggttataaagaaggaaaatgaatacaacatgtacgtttcagcgcttcaacttgaacccactgatgtggcaccagatttgccatatgtcgctccgttttcctcttctgttcccaatgcttgccgtattgtgcgatctttcatcgaggacttggtcagatacttgtcatatggtagcagcatgaactcctacgatgtggtgaagagttacttagacaagttcttaattgaggtattaaatgatgcttttctgaaacttatacatggtggctccctggaatttcaacagatggtgcagattgcaggaaacatagcagttcttgagcaatcctgtgatatgttcctttgccatgctgctcaagtttgtggcattcctaggcgtcttcttgagaagccccattctggtttgactgctaaagctgtgctcaaagcctccaggaatgcagcatacagtggattaattactttggtcaattccaaggttgatgagtttatgttgcagttgcctagcatcaattggactgtggaggaagctccagaacatgcaaatgactacatgaacgaagtcattatctatcttcatgatgtggtatcttctgggcagcagattgtaccaagagaagccctatacaaggttgtctctggtgcactaagccacatcgcagattctataataacagtacttcttagcgacagagtcaaaaggttcaatgcaaatgctgtagctggtattgacattgacctgaaaatgttagaggggtttgcagatgacacatatcacagcactgggttgtcagacctgagaaaggacgcaagtttcaaagattgcctagtcgagataaggcagctcatcgatcttctgctcagcaatcagcctgagagtttcatgaatcctgtaaccagggagaagaattatggatccttggaccacaagaaggtggcaatcatttgcgacaagttcaaggatgcaccagacagcttgtttggtagcctttcaagccgagcaacggtgcagagtgcccgaaagaagtccttggatgtgctgaagagaaggttaaaggattttagctgagattatccgtgctaaatctttaaataagctagtaccccctttaggagagaactagttcagtgtctatcctagccattccaaattcctttcatttccttttcaatcactttgttccgcattcgttttggagcctagctgtaatggtatgtatagatctaatcttcactattgttatgagtagtgcactttgttgtgatgtctctcgtcatgttacgactccggtaaagtaatgcccatggatggctacagcacataaattgacgcacgaggctacttgatgctgcaaaactgtcatcacatatcatggaagaacttataggttctgacatcaagtgtgatcgatctgatggcgccgatgcatgcaagcacacctatgattgagaacatgacggcggcagcagcgctgagcaccttcacagcgtactgcgatcctaggttatcaggcagcttactagtcttcagaagtgccaatccaggcagcacgaagtccagaggggtgaacccaactgctccacagatagatacaaagtccccaaagaatggcattgctgcggagacgagggtgatcactgccatgtatgcggaagtgtacatcagccgctgcaggcaggatctgcagctcctgttcttcgcctgaacccgctcttcaaagtgcgcaaacgttggcctg

SEQ ID NO: 3344 - DNA, 2626 bp, Sorghum bicolor
ctcccgactcccccctagcctatttcaaaacatttcaaaccactgtacgcctccttcctctcctctcctctcccccagtcccccctccactctctcgtggtctcgctcctgaagcgtctgatcgcatcacctcgtcccggcgacagtccgccgcccgtccccgccccgcccagccccgcccgctcgacgaggccgcgccgggtggtgaagagggtgctgctgcggtgtcccccctctcgctatgagtagcgccgtgaaggaccagctgcagcagatgtcgacgacgtgcgattcactcctgttggagctcaacgtgatttgggatgaggtcggtgagccagacatggcgagggaccggatgctgctggagctcgagcaggagtgcctcgacgtctacaggaggaaggtcgaccaggccaatcggtgcagggcccagttgcggcaggccattgcggaggcagaggctgaactcgctggcatctgctcggccatgggcgagccaccgatacatgttagacagtcaaataagaagttacatggtttacgagaggaattgaatgcgattgtcccatacttggaggagatgagaaagaagaaagttgaaagatgggaccaatttcttgatgtcatagagcaaattaagaaggttgcatctgaaatcaggcctgcagattttgtaccctttagaattcctgtggatcagtctgatctgtcattaagaaagctggaggagctaacgaaagagctacaatcccttcagaaggagaagagtgatcggctgaaacaagtgatggaacatcttaacactttgcattcgttatgcgaggtgcttggtgtagacttcaaacaaacagtatatgaggtgcaccctagcctgggtgagactgatggatcaaagaacctaagcaacagtacaattgagagtcttgcatctgctgtaaacagattgcgtgaattgaaagtccagaggatgcaaaagcttcaagatttggcatctagcatgcttgaactttggaatctcatggatacaccacttgaagagcagcagatgttccagaatgtaacatgcaatattgctgcttcagaacatgaaataactgagcctaacaccctctctaccgacttcctcagctatgtggaatctgaagttttaaggcttgaacaacttaaagcgagcaagatgaaagaccttgttctgaaaaagaagacagaactggaagagcataggagacgtgctcatttgattggcgaggagggttatgcagccgaatttagtgatgaggctattgaggcaggagctgttgatcctgcgctggtgctggaacaaattgaggctcacattgccacagtgaaagaggaagcttttagccggaaggatatcctcgagaaggttgaaaggtggctgaatgcatgtgaggaggaagcttggctggaagattacaacaaagatgacaatcgttataatgctgggagaggggcccacttgacactcaaaagggctgagaaagctcgtattttggttaacaagatcccaggactggtagatgttttgaccacaaaaattgtagcttgggagacagaaagaggaaaagagttcacatatgatggtgtccgccttctgtcaatgcttgaagagtacatgattgttcgccaggagaaagagctagagaagaagaggcagagggaccagaagaagatccaggatcaactcaaagctgagcaggaagcgctgtatggatcaaaaccaagtccatctaagccacaaagcacgaagaaggcacctaggcactccatgggtggtgcgaaccgaaggctgtctcttggtggacccacaacgcatgcccccaaaacagacataatgcactccaagacagctcgtgctgccaagaaggctgaagatttgggcgctttatctcctagtagtagaggcttggacattgccggtcttcccgttaagaagttatgtttcaacgcaagcactctgcgagaggcagaaacaccacgcaagccttttgcccagatcatgccaggaaacaatgtctcatcgattcctgcgcggcctatctccaatgacacagaggaagagaacaaaacccccaagacatttgcagggctcaatccaaaaacaccggcgacagtgacggctcctatgcagatggcggcgacaccagctgtggctaacaaggtcgtagccactcctgaaacccttttccagaaggcagagttaccagcactgccagcagacatcgagtactcgttcgaagagaggcggctcgccctttacgtggccaggcaagtggcttaactcggtcattcaccttcgctcaggtgtcctaagacccagttattacgtagttaacagctgaactgacccatttctcgtcagaggccaatgttacctgttggtcgatactcgatagtagtcggcctcgttcgtattttgcagtactattctgattcaaagccatatttgctacagctagtaaagggagtatttagacttgagcttgtgctccgtatcctaagttgtatagcttcatctggtcgcattgcatcggcgatgacctgttattgttattattgtttattactgttatccaaatatctcgtcgcatgttatgttgtg

SEQ ID NO: 3345 - DNA, 3216 bp, Zea mays
aactgcaaacgtacgggcacatgcaaagggcacagctggtgcagtacgggcacatgcaaagggcgcagctggcgcaatagatctgcacagcaaacggagtaaagtaaaagaaaataatataatatatggtagttgatatagagttgatatatagagtaaatatgaccgcggaagattgtgatatagagtagataatattgctgaataggatagaatattccttttggagtacgaatttagggtagcatgagtgcggatagcctaaagcattgccgttaacggctctctgccgctgtcccagacttcccaaatctactccaccattgttgcctctcccgacgcccctccctaccctacttcaaaacatttcaaaccactctacgcgactacgcctccttcctctcctcaccccctccccctccactcgctcgccactgaggcgcctgaccagtgatcgtaccatctcccctcgaccacagtccaccgcccgtcaccgccccgccccgcccgctcgacgaggccgcggccgccgcgccgggtggtgaagagggtgctgctatgagtagcgctgtgaaggaccaactgcagcagatgtcgacgacgtacgattctctcctgttggagctcaacatgatttgggatgaggtcggtgagcccgacatggcgagggaccggatgctgctggagctcgagcaggaatggctcgacgtctacaggaggaaggtcgaccaggccaatcggtgcagggcccagttgcggcaggccattgcggatgcagaggccgagctcgctggcatctgctcggccatgagcgagccaccgatacatgttagacagtcaaatcagaagttacatggtttaagggaggaattgaatgcgattgtcccatacttggaggagatgagaaagaagaaagttgaaagatgggaccaatttgttgatgtcatagagcaaattaagaaggttgcatctgaaatcaggccttcagattttgtacccttcataattcctgtggatcagtctgatctgtcattaagaaagctggatgagctaacgaaagagctacaatcccttcagaaggagaagagtgatcggctgaagcaagtgatggaacatcttagcactttgcatttgttatgcgaggtgcttggtgtagatttcaaacaaacggtatacgaggtgcaccctagcctgggtgaggctgatggatcaaagaacctaagcaacagtacaattgagagacttgcatcagctgtaaacagattgcgtgaattgaaagtccagaggatgcaaaagcttcaagatttggcatctagcatgcttgaactttggaatctcatggatacaccgcttgaagagcagcagatgttccagaatttaacgtgcaatattgctgcttcagaacatgaaataactgggcctaacaccctctctactgacttcctcagctacgtggaatctgaagttttaagacttgaacagcttaaagcgagcaagatgaaagacctcgttcttaaaaagaagacagaactggaagatcataggagacgtgctcatttgattggtgaggaaggttatgcagccgaatttagcgatgaggctattgaggcaggagctgtcgatcctgcgctggtgctggaacaaattgaggctcacattgccacagtgaaagaggaagcttttagccgtaaggatattcttgagaaggttgaaagatggctgaatgcatgtgaggaggaagcttggctggaagattataacaaagacgacaatcgttataatgccgggaggggggcccacttgacactcaaaagggctgagaaagctcgtattttggttaacaagatcccaggactggtagatgttttgaccacaaaaattgtagcttgggagacagaaagaggaaaggagttcacatatgatggtgtccgcctgcggtcaatgcttgaagactacataatcattcgccaggagaaagagctagagaagaagaggcaaagggatcagaagaagatccaggatcaactcaaagctgagcaggaagcgctgtatggatcaaaaccaagtccatctaagactcaaagcacgaagaaggtgcctagacaatccatgggtggtgcgaaccgaagactgtctcttggtggagccacaacgcaagcccccaaaacagatataatgcactccaagacagctcgtgctgcgaagaaggctgaagatttgggcgctttatctcctagtagcagaggcttggacattgccggtcttcccatcaagaaactatctttcaacgcaagcactctgcgagaggcagaaacaccacgcaagccttttgcccagatcatgccaggaaacaatgtctcgtcgatgcctgcgcggcccatctccaacgacacagaggaagagaacaaaacccccaaaacatttgcagggctcaatccaaaaacgccggtgacagtgacggctcctatgcagttggcggtgacaccagctgtggccaacaaggtcatagccactcctgcaacccttttccaggagaaggcagagtcgccagcgctgcctggggacatcgagtactcgttcgaagagaggcgactcgccgtttacctggccaggcaagtggcattttttgttcattcaccttctcccagttgcgctaatacccagctattacttagttgaaagctgagctgactgcgatttctcggcagaggccaatgttacctgttggtcgatactcgatagtagtgggcctcggtcttactttgcactactattcattcatagccatattgctactagccagtaaagggagtttttagtcttgagagcttgtggtctgcatcgtaagttgtatagctttatacggtgcatcgtcgatgacctgttattgttattatatggtttattactgttatccaaatatcttgtctcatgttaagttcctcatcgtaaatctttaggataatctgatttgatcgccaggaataatcgtcatcctggaatctgtcgtagtgtgggtgtgttcaatctttcagagctgcagtgtctgctgcggtgtgcccgatatcaataagcatcaagcaccttttgcaagaggccagagcagcacagaaatacagaattactatactgtcagtgtggtccaagtcgggtttaaaaggctatgataatggcattgacctatgcttccgtataataggtacccatgcacgaacg

SEQ ID NO: 3346 - DNA, 2481 bp, Echinochloa colona
tcaaacactctccgccccttcctttcatcccaatcccatcccctccccattccgctctccacggcgacagccagccgcccgccccctcgacgaggccgcgccgggcggtgaagagggtgctgctgcggtcgctcgccttgtttcgatgagtagcaccgtgaaggaacagctccaacagatgtcgacgacgtgcgattcgctcctgctggagctcaacgtgatttgggatgaggtcggggagccccacacagcgagggacaggatgctgctggagctcgagcaggagtgtctcgaggtctacaggaggaaggtcgacctggccaatcgctgcagggcacagcttcggcagtccattgctgaggcagaggctgagctcgccggaatctgctcggccatgggtgagccgccgatacatgttagacagtcaaatcagaagctgcatggtttaagggaggaattgaacgcaattgtcccatacttggaggagatgagaaagaagaaggtggaaagatgggaccaatttgttgatgtcatggatcaaattaagaaggttgcatctgaaatcaggcctgcagattttgtgccctttaaagttcctgtggatcagtctgatctatcattaagaaagcttgaggagttatcaaaggagttacaatcccttcagaaggagaagagtgatcggctgaagcaagtgatggaacatttgagcactttgcattccttgtgcgaggtccttgggatagacttcaaacaaacagtatatgaggtgcatcctagcctgggtgaacctgatggatcaaagaacctgagcaacagtacaatcgagagactcgcatcagccgtaaatggattacgtgaaatgaaagtccagaggatgcaaaagcttcaagatttggcatctagcatgcttgaactttggaatctgatggatacaccgcttgaagagcagcagatgttccagaatgtaacgtgcaatattgctgcttcagaacaggaaataactgagcccaacaccctctctattgacttcctgagctatgtggaatctgaagttctaaggcttgaacaattgaaagcgagcaagatgaaagatctggttctgaaaaagaagacagaactggaagagcataggagacgtgctcatctgattggtgaggaaggttatgcagctgaatttagcactgaggctattgaagcaggagctgttgatcctgcactggtgctggaacaaattgaggctcatattgccacagtgaaagaggaagctttcagccgaaaggatgttcttgagaaggttgaaagatggctgaatgcatgtgaggaggaagcctggttggaagattacaacaaagatgacaatcgttataatgctgggaggggagcccatctgacactcaagagagcggaaaaggctcgtattttggttaacaagatcccaggaatggtagatgttttgaccacgaaaattctagcttgggagaaagaaagagaaaaggagttcacatatgatggtgttcgccttctgtcaatgcttgaagagtacatgatcgttcgccaggagaaagagctagaaaagaagaggcaaagggatcagaaaaagatccaggatcaactcaaagctgagcaggaagcgctctatggatcaaaaccaagtccatcaaagcctcaaagtacaaagaaggtgcctaggaactccatgggtggtgcaaaccgaaggctgtctcttggtggagccacaattcaagccccgaagacagacatactgcattcgaagactgctcgtgctgccaagaagactgaagatttgggcactttatctcctagtagtagaggcctggacattgctggtcttcccatcaagaagttaactttcaacgcaagtactctgcgtgaggcagaaacacctcgcaagccttttgcccagataatgccaggaaacaatgtctcatcaatgcctgcacggcccatctccaaagacaccgaggaagagaacaaaacccccaagacatttacagcgtttgatcccaaaacgccgatgacggatacggctccgatgcagctgaccatgacgcctgctgtggctaacaaggtcatagccacacctgtctcccttttccaggagaaactagggcacccagcgctgccagaggagatagagtactccttcgaagagaggcggctcgctgtttacctggccaggcaaatggcttagctcagtcatttgcccatggcgtcctaagagacccagtcatcacctagttgaaagtcgaactgactgccatttctcgtcaaggccaatggtacatccgtacctgtctgttggtcgacaatagtcggcctttttcgtagtttacctactgttctgattcacagccatatttgttacaactagcaaagaagttctacacttgtgagcttgtgctccctactgccattggttatcttaagttgtatagcttcatccggctgcattgttgatga

SEQ ID NO: 3347 - DNA, 2594 bp, Echinochloa colona
ttcgagcgtgagcacttccttatcgtctcctcctttcctccccgcaaccccgatcgaatcgctcgaaccattccaggtttgtgcatcgatctaggtctgcgcgaggatcccatccaatcccatcccatcccctcccctccccatttcgctctctccacggcgacagcctgacgcccgcctcctcctcgcctagccccctcgacgaggccgcgccgggcggtgaagagggtgctgctgcggtcgctcgccttgttgcgatgagtagcgccgtgaaggaacagctccaacagatgtcgacgacgtgcgattcgctcctgctggagctcaacgtgatttgggatgaggtcggggagccccacacagcgagggacaggatgctgctggagctcgagcaggagtgtctcgaggtctacaggaggaaggtcgacctggccaatcgctgcagggcacagcttcggcagtccattgctgaggcagaggctgagctggccggaatctgctcggccatgggtgagccgccgatacatgttagacagtcaaatcagaagctgcatggtttaagggaggaattgaacgcaattgtcccatacttggaggagatgagaaagaagaaggtggaaagatgggaccaatttgttgatgtcatggatcaaattaagaaggttgcatctgaaatcaggcctgcagattttgtgccctttaaagttcctgtggatcagtctgatctatcattaagaaagcttgaggagttatcaaaggagttacaatcccttcagaaggagaagagtgatcggctgaagcaagtgatggaacatttgagcactttgcattccttgtgcgaggtccttgggatagacttcaaacaaacagtatatgaggtgcatcctagcctgggtgaacctgatggatcaaagaacctgagcaacagtacaatcgagagactcgcatcagccgtaaatggattacgtgaaatgaaagtccagaggatgcaaaagcttcaagatttggcatctagcatgcttgaactttggaatctgatggatacaccgcttgaagagcagcagatgttccagaatgtaacgtgcaatattgctgcttcagaacaggaaataactgagcccaacaccctctctattgacttcctgagctatgtggaatctgaagttctaaggcttgaacaattgaaagcgagcaagatgaaatatctggttctgaaaaagaagacaggactggaagagcataggagacgtgctcatctgattggtgaggaaggttatgcagctgaatttagcactgaggctattgaggcaggagctgttgatcctgcactggtgctggaacaaattgaggctcatattgccacagtgaaagaggaagctttcagccgaaaggatgttcttgagaaggttgaaagatggctgaatgcatgtgaggaggaagcctggttggaagattacaacaaagatgacaatcgttataatgctgggaggggagcccatctgacactcaagagagcggaaaaggctcgtattttggttaacaagatcccaggaatggtagatgttttgaccacgaaaattctagcttgggagaaagaaagagaaaaggagttcacatatgatggtgtccgccttctgtcaatgcttgaagagtacatgatcgttcgccaggagaaagagctagaaaagaagaggcaaagggatcagaaaaagatccaggatcaactcaaagctgagcaggaagcgctctatggatcaaaaccaagtccatcaaagcctcaaagtacaaagaaggtgcctaggaactccatgggtggtgcaaaccgaaggctgtctcttggcggagccacaattcaagccccgaagacagacatactgcattcgaagactgctcgtgctgccaagaagactgaagatttgggcactttatctcctattagtagaggcctggacattgctggtcttcccatcaagaagttaagtttcaacgcaagtactctgcgtgaggcagaaacacctcgcaagccttttgcccagataatgccaggaaacaatgtctcatcaatgcctgcacgacccatctccaaagacagcgaagaagagaacaaaacccccaagacatttacagtgttcgatcccaaaacgccaatgacggatacagctccgatgcagttgaccatgacgcctgctgtggctaacaaggttatagccacacctgtctcccttttccaggagaaactagggcacccagcgctgccagaggagatcgagtactccttcgaagagaggcggcttgctgtttacctggccaggcaaatggcttagctcagtcatttgcccatggcgtcctaagagacccagtcatcacctagttgaaagtcgaactgactgccatttctcgtcaaggccaatggtacatccgtacctgtctgttggtcgacaatagtcggcctttttcgtagtttactgtactgttctgattcacagccatatttgttacaactagcaaagaagttatacacttgtgagcttgtgctccctactgccattggttatcttaagttgtatagcttcatccggctgcattgttgatga

SEQ ID NO: 3348 - DNA, 2644 bp, Setaria italica
caacggatttccaaaccccaaatctcctccgcccttcttgcctcctcctactccccctaccctatttcaaaacatttcaaacactctccgcctccttcctcccatccaatccccttcccattccgttctctcctctcgcccctgaggcgccggatcgcgcgattccctccacggcgacagccggccgccccctccccgtcccgcccgctcgacgaggccacgccgagcggtgaagagggagccactggggtcgctcgccctcacgcgatgagtagcgccgtgaaggaacagctccaacagatgtcgacgacgtgcgattcgctcctgctggagctcaacgtgatttgggatgaggtcggggagccccactcggcgagggaccggatgctgctggagctcgagcaggagtgtctcgaggtctacaggaggaaggtcgacatggcaaaccgctgcagggcacagctgcggcaggccatcgccgaggcagaggccgagctcgcaggtatctgctcggccatgggtgagccgccgatacatgttagacagtcaaatcagaagttgcaaggtttaagggaggaattgaacgcgattgtcccatacttggaggagatgagaaagaagaaagttgaaagatgggaccaatttgttgatgtcatagatcaaattaagaaggttgcatctgaaatcaggcctgcagattttgtgccctttaaatttcctgtggatcaatccgatctgtcagtaagaaagcttgaggagttaacaaaggagctacaatcccttcagaaggagaagagtgatcggctgaagcaagtgatggaacatttgaacactttgcattccttgtgcgaggtgcttggtatagacttcaaacaaacagtacatgatgtgcatcctagcctgggcgaggctgatggatcaaagaacctgagcaacagtacaattgagagactcgcatcagctgtaaatggattacgtgaaatgaaagtccagaggatgcaaaagcttcaagatttggcatctagcatgcttgaactttggaatctcatggatacaccacttgaagagcagcagatgtttcagaatgtaacatgcaatattgctgcttcggaacatgaaataactgagcccaacaccctctctgttgactacctcagctacgtcgaatctgaagttttaaggcttgaacaattgaaagcgagcaagatgaaagacctggttctgaaaaagaagacagaactcgaagaacataggagacgtgctcatctgatcggtgaggaaggttatgcagctgaatttagcactgaggctattgaagcaggagctgttgatcctgcgctggttctggaacaaattgaggctcacattgctacagtgaaagaggaagcttttagccgaaaggatattcttgagaaggttgaaagatggctgaatgcatgtgaggaggaagcctggttggaagattataacaaagatgacaatcgttataatgctgggaggggggcccatctgacactcaagagagcagaaaaggctcgtattttggttaacaagatcccaggaatggtagatgttttgaccacgaaaattttagcttggcagaaagaaagagaaaaggaattcacatatgatggtgtccgccttctgtcaatgcttgaagagtacatgatcgttcgtcaggagaaagagctagagaagaagaggcaaagggatcagaagaaaatccaggatcaaatcaaagctgagcaggaagcactctacggatcaaaaccaagtccatccaagcctcaaagtacaaagaaggtgcctaggaactccatgggtggtgcaaaccgaaggctgtctcttggcggagccacaatgcaagccccaaagacagacatactgcattcaaagactgctcgtgctgccaagaagactgaagaattgggcactttatctcctagtagtagaggcttggacattgctggtcttcccatcaagaagttaactttcaatgcaagtactctgcgtgagacagaaacaccgcgcaagccttttgcccagatcatgccaggaaacaatgtctcatcgacacctgcacggccaaccttcaatgacaacaccgaggaagagaacaaaacccccaagacatttaatgcagcgcttgatctcaaaacgccgatgacggtgacggctccgatgcagctggcgatgacgccttctgtgggtaacaaggtcatagccactcctgtctcccttttccaggagaaaccagagcagccgatgctgccggaggagatcgagtactcgttcgaagagaggcggctcgccgtttaccttgccaggcaaatggcttagctcagccatttgccccgtcattacatagttgaaagtcgaactgactgccatttctcgtcagaggccaatggtacctgtttgctggtcgacaatagtcggcctttttcgcactttgccgtactgttctgattcacagccatatttggtacaattagttaaggagttccacacttgtgagcttgtgctccgtgccgccattggttatcttaagttgtatagcttaatccggtttgcattgtcgatgacctgctactctaattattatttctgtttacagttatccaactgtccagtactcctgtca

SEQ ID NO: 3349 - DNA, 2520 bp, Setaria italica
tccgttctctcctctcgcccctgaggcgccggatcgcgcgattccctccacggcgacagccggccgccccctccccgtcccgcccgctcgacgaggccacgccgagcggtgaagagggagccactggggtcgctcgccctcacgcgatgagtagcgccgtgaaggaacagctccaacagatgtcgacgacgtgcgattcgctcctgctggagctcaacgtgatttgggatgaggtcggggagccccactcggcgagggaccggatgctgctggagctcgagcaggagtgtctcgaggtctacaggaggaaggtcgacatggcaaaccgctgcagggcacagctgcggcaggccatcgccgaggcagaggccgagctcgcaggtatctgctcggccatgggtgagccgccgatacatgttagacagtcaaatcagaagttgcaaggtttaagggaggaattgaacgcgattgtcccatacttggaggagatgagaaagaagaaagttgaaagatgggaccaatttgttgatgtcatagatcaaattaagaaggttgcatctgaaatcaggcctgcagattttgtgccctttaaatttcctgtggatcaatccgatctgtcagtaagaaagcttgaggagttaacaaaggagctacaatcccttcagaaggagaagagtgatcggctgaagcaagtgatggaacatttgaacactttgcattccttgtgcgaggtgcttggtatagacttcaaacaaacagtacatgatgtgcatcctagcctgggcgaggctgatggatcaaagaacctgagcaacagtacaattgagagactcgcatcagctgtaaatggattacgtgaaatgaaagtccagaggatgcaaaagcttcaagatttggcatctagcatgcttgaactttggaatctcatggatacaccacttgaagagcagcagatgtttcagaatgtaacatgcaatattgctgcttcggaacatgaaataactgagcccaacaccctctctgttgactacctcagctacgtcgaatctgaagttttaaggcttgaacaattgaaagcgagcaagatgaaagacctggttctgaaaaagaagacagaactcgaagaacataggagacgtgctcatctgatcggtgaggaaggttatgcagctgaatttagcactgaggctattgaagcaggagctgttgatcctgcgctggttctggaacaaattgaggctcacattgctacagtgaaagaggaagcttttagccgaaaggatattcttgagaaggttgaaagatggctgaatgcatgtgaggaggaagcctggttggaagattataacaaagatgacaatcgttataatgctgggaggggggcccatctgacactcaagagagcagaaaaggctcgtattttggttaacaagatcccaggaatggtagatgttttgaccacgaaaattttagcttggcagaaagaaagagaaaaggaattcacatatgatggtgtccgccttctgtcaatgcttgaagagtacatgatcgttcgtcaggagaaagagctagagaagaagaggcaaagggatcagaagaaaatccaggatcaaatcaaagctgagcaggaagcactctacggatcaaaaccaagtccatccaagcctcaaagtacaaagaaggtgcctaggaactccatgggtggtgcaaaccgaaggctgtctcttggcggagccacaatgcaagccccaaagacagacatactgcattcaaagactgctcgtgctgccaagaagactgaagaattgggcactttatctcctagtagtagaggcttggacattgctggtcttcccatcaagaagttaactttcaatgcaagtactctgcgtgagacagaaacaccgcgcaagccttttgcccagatcatgccaggaaacaatgtctcatcgacacctgcacggccaaccttcaatgacaacaccgaggaagagaacaaaacccccaagacatttaatgcagcgcttgatctcaaaacgccgatgacggtgacggctccgatgcagctggcgatgacgccttctgtgggtaacaaggtcatagccactcctgtctcccttttccaggagaaaccagagcagccgatgctgccggaggagatcgagtactcgttcgaagagaggcggctcgccgtttaccttgccaggcaaatggcttagctcagccatttgccccgtcattacatagttgaaagtcgaactgactgccatttctcgtcagaggccaatggtacctgtttgctggtcgacaatagtcggcctttttcgcactttgccgtactgttctgattcacagccatatttggtacaattagttaaggagttccacacttgtgagcttgtgctccgtgccgccattggttatcttaagttgtatagcttaatccggtttgcattgtcgatgacctgctactctaattattatttctgtttacagttatccaactgtccagtactcctg

SEQ ID NO: 3350 - DNA, 2587 bp, Panicum virgatum
atttcaaaacatttcgaacactctccgcccccttcctctcatcccatccccttcccattccgctctctctcgcccccgaggcgccggatcgcgcgactccccacggcgacagcccgccgccaccctccccgtcccgcccgctcgaccaggtcgcgccgagcggtgaagagggtgccgctgcggttgctcgccctctcgcgatgagtagcgccgtgaaggaccagctccaacagatgtcgacgacgtgcgattcgctcctgctggagcttaacgtgatttgggatgaggtaggggagccccactctgcgagggaccggatgctgctggagctcgagcaggagtgtctcgaggtctacaggaggaaggtcgacctggccaatcgctgcagggcacagctgcggcaggccattgccgaggcagaggccgagctcgccggcatctgctcggccatgggtgagcctccggtacatgttagacagtcaaatcagaagttgcatggtttaagggaggagttgaacgcaattgtcccatacttggaggagatgagacagaagaaagtcgaaagatgggaccaatttgttgatgtcatggatcaaattaagaaggttgcatctgaaatcaggcctgcagattttgtgccctttaaagttcccgtggatcagtccgatctgtcattaagaaagcttgaggagttaacgaaggagctacaatcccttcagaaggagaagagtgaaaggctgaagcaagtgatggaacatttgaacattttgcattccttgtgcgaggtgcttggtatagacttcaagcaaacattatatgaggtgcatcctagcctgggtgaggctgatggatcaaagaacttgagcaacagtacaatcgagagactcgcatcagctgtaaatggattgcgcgaaatgaaggtccagaggatgcaaaagcttcaagatttggcatctagcatgcttgaactttggaatctcatggatacaccacttgaagagcagcagatgttccagaatataacgtgcaatattgctgcttcagaacatgaaataactgagcccaacactctctccattgacttcctcagctacgtggaatctgaagtattaaggcttgaacaattgaaagcgagcaagatgaaagaccttgttctgaaaaagaagacagaactggaagagcataggagacgtgctcatctgattggtgaggaaggttatgcagctgaatttagcactgaggctattgaggctggagctgttgatcctgcgctggtgctggaacaaattgagtctcacattgctacagtgaaagaggaagcttttagccgaaaggatattcttgagaaggttgaaagatggttgaatgcatgtgaggaggaagcgtggttggaagattacaacaaagatgacaaccgttataatgctgggagaggggcccatctgacactcaagagagcggagaaagctcgtattttagttaacaagatcccaggaatggtagatgttttgaccacgaaaatccatgcttgggagaaagaaagagaaaaggagttcacctacgatggtgtccgcctactgtcaatgcttgaagagtacatgattgttcgccaggagaaagagctagagaagaagaggcaaagggatcagaagaaaatccaggatcaaatcaaagctgagcaggaagcactctacggatcaaaacctagtccatccaagcctcaaagtacaaagaaggcgcctaggaactccattggtggtgcaaaccgaaggcaatctcttggtggagccacaatgcaagccccgaagacagacatactgcattctaagactgctcgtgctgccaagaagactgaagatttgggatctttatctcctagtagtagaggcttggatattgctggtcttcccgtcaagaagttaactttcaatgcaagtactctgcgtgaggtagaaacacctcgcaagcctttttcccagatcatgccaggaaacaatgtcccttcaacgcctgcacgacccatctccaatgacgaggaagagaacaaaacccccaagacatttgcaacgctcaatcacaaaacgccggtgacgatgacggctccgatgcaggtggcgatgacacctgcagtggctaacaaggtaatagccactcctgtctcccttttccaggagaagccagaacagccgatgctgccggaggagattgagtactcgtttgaagagaggaggctcgccgtttacctggccaggcaagtgacttagctccgtcacttgcccagggcatcctaaaatcccagtcattacgtagttgaaggtcgaactgactgccatttctcgtcagaggccaatggtacctgtctgttggtcgacaatagtcggccttttcgcactttgccgttctgttctgattcacagccatatttggtacaactagtaaagaagttatacacttgtgagcttgtgctccgtgccgccattctttatcctaagttgtatagcactatagcttcatccggttgcatcgtcgatgacctgttactctaattattatttctgtttacagtcatccaaatgtcgtgtccccc

SEQ ID NO: 3351 - DNA, 2811 bp, Oryza sativa
gcccaattcaaaacgtaggcccggagatgcgatcgctgcggggagccggcccaataaaggctccctcgctaacgtctctctgccgctgtccccttctccggatcccttcgaattctgaaatccccaaattcttctccgcctctcctcccctccccctacagtatttcaaaatatttcaaatcacactacactctccgtcgtctcctctcctctcctctcctccccctctcctccgcctctctcgcatctgaggctccgatcgccggcgaccccagccagaatccgccgccccgtctcgccctccccgctcgacgagaccgcgcccagcggcgaagaggcctagtgttcttcgcacctcgcgatgagtagcgcggtgaaggaccagcttcaccagatgtcgacgacatgcgattcgcttctactggagctcaatgtgatttgggatgaggtcggtgagcccgacacgacgagggacaggatgctgctggagctcgagcaggagtgcctggaggtctacaggcggaaggtcgaccaggcgaaccggagccgcgcccagctgcggaaggccatcgccgagggcgaggcagagctcgccggcatctgctcagccatgggcgagccgcccgtgcacgttagacagtcaaatcagaagcttcatggcttaagagaggagttgaatgcaattgttccgtatttggaagaaatgaaaaagaaaaaggtcgaacgatggaaccagtttgttcatgtcatagagcagattaagaaaatttcgtctgaaataaggccagccgattttgttccctttaaagttccggttgatcagtctgacctgtcattaagaaagcttgatgagttgacgaaggacctggaatcccttcagaaggagaagagcgatcggctaaagcaagtgatagaacatttgaattctttgcattccttatgtgaggtgcttggcatagacttcaagcaaacagtatatgaggtgcaccctagcttggacgaagctgaaggatcaaagaacctgagcaacactacaattgagaggcttgctgctgccgcaaacagactgcgtgaaatgaagatccaaaggatgcaaaagcttcaagattttgcttctagcatgctcgagctatggaatctcatggatactccacttgaagagcagcagatgtttcagaatataacatgcaatattgctgcttcagaacaagagataactgaaccaaacaccctctccacagatttcctgaattatgtcgaatctgaggtgttaaggcttgaacaactgaaagcaagtaagatgaaagatcttgttttaaaaaagaaagcagaacttgaagagcatagaagacgtgctcatcttgttggcgaggaaggttatgcagaggagtttagcattgaagctattgaagctggagctattgatccctcactagtacttgaacaaattgaagctcacattgcaacagtgaaagaggaagcttttagccggaaggatattcttgagaaagttgaaagatggcaaaatgcttgtgaagaggaagcctggctggaagattacaacaaagatgataatcgttacaatgctgggaggggagcacatctaacactaaagagggctgaaaaggctcgtactttggtcaacaagattcctggaatggtagatgttttgagaacaaaaattgctgcatggaaaaatgaacgaggaaaggaggatttcacatatgatggtgttagcctttcgtcaatgcttgatgaatatatgttcgttcgtcaggagaaagagcaagagaagaagagacaaagggatcagaagaagctccaggatcagctcaaagcggagcaggaagctttgtacggatcaaaacccagtccatccaagcccctaagtacaaagaaggcacctaggcactctatgggtggtgcaaaccgaaggctatctcttggtggagccaccatgcaacccccgaagactgatatactgcattcaaagtctgttcgtgctgccaagaaaactgaagaaatcggcactttgtcccctagtagtagaggtttggacattgccggattgcctatcaagaagttgtctttcaatgccagtactctacgtgagacggagacacctcgtaaaccttttgctcagatcacaccaggaaacagtgtctcgtcgacgcctgtgcgccctatcaccaataacactgaggatgatgagaacaggactccgaagacatttacagcactgaatcccaagactccgatgactgttacggctccaatgcagatggcaatgactccctctctggccaacaaggtttcagcaactccagtttcccttgtttacgacaagccagaggtaacattgcaggaggacatcgactactcctttgaagaaaggcggctcgccatctatctggccaggcaaatggtttaactgttgatcaatttatgtacgtagttgaaatctgactgcattttcttgtcggtggccattgcgtatgttggtcaacaatagtcggcctttccagtagcactattctgatttactgcaattgttttaatgttttctacaaccagtaaaacagctctatacattagcttgctcactactcagtacagctttctcggcagcacgaaacatttctgttctctttgatgaatacttcttgctgtggatagggatagttactgttacatatactgtatgccctccagaatagaaacctgttagtacgggaggtattataggaaggatcgttttggaattttggtggttagcctgcacagtaagttccatcagtttctggattgtcc

SEQ ID NO: 3352 - DNA, 2534 bp, Brachypodium distachyon
ctccacttttcttgcccccttccccatttcaaaacatttcaaatcactctctcctgctctccgccatcttctccgttctctcgctcgccccgaggaccccatccgcgcgatcccttcagcggccatccccggcgtacccaccgtctataccgcgccgaccggcgaagagatttccgctcctcgcgatgggtagcgcggcgaaagaccagctcctcccatgtgataagctcctcctcgagcttaaggtgatttgggatgaagtcggggagcccgacacggcgcgggacaagaccctgctggagcttgagcaggaatgcctggatgtctacaggaggaaggttgaccaggccaaccgctgccgggcacagctgcggcaatccattgcagaggctgaggctgagctcgccggtatctgttcggccataggggagccgccagttcacgtcaggcagtcaaaccagaagttacatggtttaagggaggagttgaatgcaattgtaccgtatttggaggagatgaagactaagaaggtcgagcgatggaaccagtttgttcatgtcatagaggagattaaaaagatttcatctgaaatcaggccttcagactttttaccatttaaaaagcctgtggatcagtcggatctgtcattaagaaagcttgaggagttaacgaaggagttagaatcccttcagaaagagaagagtgatagggtgaagcaagtaatggaacatttgaatacattgcattccttatgtgaggtgcttggcatagacttcaaacaaacaatacatgaggtgcaccctagcctggatgaggctgacgggtcaaagaacctgagcaacactacaatcgacagacttgcatcagctgtaaatagactgcgtgaaatgaaaattcagaggatgcaaaagcttcaagattttgcgtcgacaatgctagaactatggaatctcatggatacaccaattgaagaacaacagatgttccagaatgtaacgtgcaatattgctgcttcagagcatgaaattacggaacccaacatcctgtcaattgacttcctcggttacgtggaatctgaggttataaggcttgaacaactgaaaggaagcaaaatgaaggaccttgtattgaaaaagaaatcagaattagaagagcacagaagacgtgcacatctaattggtgaggaaggatattcagatgaatttaacatcgaggctattgagtccggagctattgatcctgcactggtgctggaacaaattgaggctcacattgcaacagttaaagacgaagctttcagtcgaaaggatatcctcgagaaggtcgaaagatttctgaatgcatgtgaggaggaagcctggctggaagattacaacaaagatgacaatcgttacaatgctggaaggggggcacatcttacgcttaagagggctgaaaaagctcgcattttggttaacaagattccaggaatggtagatgttttgtcctcgaaaatcatagcttgggagaatgaaagaggaaaagagttcacatacgatggtgtacgccttatctcgatgcttgacgaatacatgattgttcgccaggagaaagagcaagagaagaagagacaaagggatcagaaaaaggtccaggatcaactgaaagctgagcaggaagctctctacggttcaaaaccaagtccatccaagcctcaaagtacaaagaaggcacctagaaactcgataggtggcgcaaaccgcaggttgtcagttggtggagccccgttccaggtgcccaaaacagatatattgcattcgaagactgtacgtgccgcaaagagaaccgaagacattgccactttgtcccctggcagtagaggcatagacattgccgatcttcccatcaagaagttatctttcaatgccagtgctctgcgtgagacggagacgcctcgtaagccttttgctcagatcatgccagcaagcagtgtcccgtctacgcctgtgcggccaatcaccaatgacatggaggacgagaaccggacccccaacccaaagacatttggggcattgaatcctaagacgccgatgactgtggcagctccgatgcagttggcaatgacgcctgctgtgggcaacaaggttgctgctactcctgtttcccttgtttacgagaaaccagagctggcattgccggaggagattgagtattcattcgaagaaaggcggctggctgcctatctggcaagagagaaattgcttagctgttgagaggcgccgagatctccacatttggctattgttggtcgacgacagtcggccagtgctcttcagattcaccgcaaccttttcattgttttccatactcttagtaaggaagtttacactttgacaacttccgttcagttcggtacccccattggttagcttattgagttgtataggttcctcagcactgaatcttctcaagtcagtttgattaaacggatcagcagtgtcgcaaagattaaccgttatatatttctgttctttatgcgtgatccaaattgcata

SEQ ID NO: 3353 - DNA, 2550 bp, Brachypodium distachyon
gaattttccattccttctccacttttcttgcccccttccccatttcaaaacatttcaaatcactctctcctgctctccgccatcttctccgttctctcgctcgccccgaggaccccatccgcgcgatcccttcagcggccatccccggcgtacccaccgtctataccgcgccgaccggcgaagagatttccgctcctcgcgatgggtagcgcggcgaaagaccagctcctcccatgtgataagctcctcctcgagcttaaggtgatttgggatgaagtcggggagcccgacacggcgcgggacaagaccctgctggagcttgagcaggaatgcctggatgtctacaggaggaaggttgaccaggccaaccgctgccgggcacagctgcggcaatccattgcagaggctgaggctgagctcgccggtatctgttcggccataggggagccgccagttcacgtcaggcagtcaaaccagaagttacatggtttaagggaggagttgaatgcaattgtaccgtatttggaggagatgaagactaagaaggtcgagcgatggaaccagtttgttcatgtcatagaggagattaaaaagatttcatctgaaatcaggccttcagactttttaccatttaaaaagcctgtggatcagtcggatctgtcattaagaaagcttgaggagttaacgaaggagttagaatcccttcagaaagagaagagtgatagggtgaagcaagtaatggaacatttgaatacattgcattccttatgtgaggtgcttggcatagacttcaaacaaacaatacatgaggtgcaccctagcctggatgaggctgacgggtcaaagaacctgagcaacactacaatcgacagacttgcatcagctgtaaatagactgcgtgaaatgaaaattcagaggatgcaaaagcttcaagattttgcgtcgacaatgctagaactatggaatctcatggatacaccaattgaagaacaacagatgttccagaatgtaacgtgcaatattgctgcttcagagcatgaaattacggaacccaacatcctgtcaattgacttcctcggttacgtggaatctgaggttataaggcttgaacaactgaaaggaagcaaaatgaaggaccttgtattgaaaaagaaatcagaattagaagagcacagaagacgtgcacatctaattggtgaggaaggatattcagatgaatttaacatcgaggctattgagtccggagctattgatcctgcactggtgctggaacaaattgaggctcacattgcaacagttaaagacgaagctttcagtcgaaaggatatcctcgagaaggtcgaaagatttctgaatgcatgtgaggaggaagcctggctggaagattacaacaaagatgacaatcgttacaatgctggaaggggggcacatcttacgcttaagagggctgaaaaagctcgcattttggttaacaagattccaggaatggtagatgttttgtcctcgaaaatcatagcttgggagaatgaaagaggaaaagagttcacatacgatggtgtacgccttatctcgatgcttgacgaatacatgattgttcgccaggagaaagagcaagagaagaagagacaaagggatcagaaaaaggtccaggatcaactgaaagctgagcaggaagctctctacggttcaaaaccaagtccatccaagcctcaaagtacaaagaaggcacctagaaactcgataggtggcgcaaaccgcaggttgtcagttggtggagccccgttccaggtgcccaaaacagatatattgcattcgaagactgtacgtgccgcaaagagaaccgaagacattgccactttgtcccctggcagtagaggcatagacattgccgatcttcccatcaagaagttatctttcaatgccagtgctctgcgtgagacggagacgcctcgtaagccttttgctcagatcatgccagcaagcagtgtcccgtctacgcctgtgcggccaatcaccaatgacatggaggacgagaaccggacccccaacccaaagacatttggggcattgaatcctaagacgccgatgactgtggcagctccgatgcagttggcaatgacgcctgctgtgggcaacaaggttgctgctactcctgtttcccttgtttacgagaaaccagagctggcattgccggaggagattgagtattcattcgaagaaaggcggctggctgcctatctggcaagagagaaattgcttagctgttgagaggcgccgagatctccacatttggctattgttggtcgacgacagtcggccagtgctcttcagattcaccgcaaccttttcattgttttccatactcttagtaaggaagtttacactttgacaacttccgttcagttcggtacccccattggttagcttattgagttgtataggttcctcagcactgaatcttctcaagtcagtttgattaaacggatcagcagtgtcgcaaagattaaccgttatatatttctgttctttatgcgtgatccaaattgcata

SEQ ID NO: 3354 - DNA, 2633 bp, Hordeum vulgare
cctccccctcccctgtttcaaaacatttcaaatcactctccatctcctcctctcacccccctcctccgcactctctcgctcgcatcccaggacccagccgcgcgaccacgacccctccggcgctcccaccgccgcgtctcgccggcgaatcgccgataccgcgcagagagattgcccatggcgatgggtggcgcggtgaaagaccagcagcagcagctccacccgtgcgactcgcttctcctcgagctcaacgtgatctgggacgaggtcggcgagcccgactcggtgcgggacaagacgctgctggagctagagcaggagtgtctcgacgtctacaggaggaaggtcgaccaggccaaccgctgcagggctcagctgcggcaatccatcgccgaggccgaggccgagctcgccggtatctgttcggccataggcgagccaccggttcacatcaggcagtcaaaccagaatttacatggtttaagggaggagttgaatgcaattatcccatatttggaggagatgcgaactaaaaaggttgaaagatggaaccagttcgttcgtgtccttgaggagattaagaagatttcatccgaaatcaggcctgcagactttgtgccatttaaaactcctgtggatcagtctgatttgtcattaagaaagtttgaggagttaacgaaggagctagaatcccttcagaaagagaagagggaaaggttacagcaagtgatggatcatttgaatacattacattccatatgtgaggtgcttggtattgactttaaacaaacagtgcatgaggtgcaccctagcctggacgaagctgaagggtcaaagaacctgagcaacactacaatcgagagactagcatcggctgtgaatagactgcgtgaaatcaaaattcagaggatgcaaaagcttcaagattttgcttcgacaatgctagaactatggaatcttatggatacaccaattgaagaacagcagatgttccagaatgtaacgtgcaatattgctgcctcggagcatgaaataacggaacccaacaccctgtcgatcgacttcctcagctatgtggaagctgaggttttaagacttgagcaactgaaaggaagcaaaatgaaggaccttgttttgaaaaagaaatcagaactggaggagcaccgaagacgcgcacatctaattggcgaggatggatattcagatgaatttaacattgaggctattgagtccggagctattgatcctgcattagttctggaacaacttgaggctcacattgcaacagtgaaagatgaagctttcagtcggaaggatattcttgagaaggttgaaaggtttctgaatgcatgtgaggaggaagcctggctggaagattacaacaaagatgacaatcgttacaatgctgggaagggggcacatctgacgctcaagagggccgagaaagcacgcattttggttaacaagattccgggaatggtagatgttttgaccacaaaaatcattgcttgggagaatgaaagagggaaagagttcacatatgatggtgtacgccttctctcaacgctggacgaatacatgatagtacgccaggagaaagaacaagagaagaagagacaaagggatcagaagaagctccacgatcaactcaaagctgagcaggaagctctctatggttcgaaaccaagcccatccaagcctcagagtataaagaaggcgcctagacactcgatgggtggtgtaaaccgcagggtgtctattggtggagccacgatgcaagcaccgaaaacagacatattgcactccaagaatgttcgtgctgccaagagaactgaagacattgcccatttgtcccctgccagtagaggcctagacattggcgatcttcccatcaagaagctatctttcaatgccactgctctacgtgaaacagagacacctcgcaagccttttgcccagatcatgccgccggcaagcagtgtcccctccactcctgcacgctccgtgaccaatgacacggaggacgaaaaccgaacccccaaccccaagacatatggagcagcactgaatctcaagacgccgaccgtggcggctccgatgcagttggcgatgacgcccaccgtggctaacaaggtcacagccgcccctgtttcccttgtctacgagaaaccggagccagcattgccggaggcggtcgagtattccttcgaagaaaagcggctggccgtctatttgtccagagaagttgtttagctgtcaagacatgtcaagatctccactctgtgggtaggtgaaagttgaaaacctgactgcagttacttgtgagagactagctgtttgcctatgttggtcgacgacagtcgcccagcgctgttatgattgtttctctgccatatttgattgtttccatactcagcaaaggaagctcgcacttcagcagcttccgttcagtactgccatttggttagctaattaaggtatgtataggtttctttctcggcactggatcatcttgaatctgtttgattaaatactagatcagcactgtttttaatccacatgattatgggtgaaccgtatcaagggtgagaatctttggaagttatgggtagtggatttgtgcgggttacggc

SEQ ID NO: 3355 - DNA, 3286 bp, Sorghum bicolor
cgcgcaatcccctccattttcccgccgctggccttgccttccctttcccccaaaatccaaaccctagagagtgagagagatttcgaagcgaaggcagcggagtagcggaggcggaggaggaggaggaatccgtcgaggaggaacgcccgatcggcggagcccatccagcactccacaacaagatgcggggcgggacgctgcagatcaactggcacgaccagcagccggtgctcagcctcgacttccaccccgcctcccgccgcctcgccaccgccggcgccgaccacgacatcaagatctgggaggtagcatcggatggttcggacgacaagctccccaccgccaccttcaagtacgccctcgtccccaataacaccgcccacagctccgcggtcaacgtcctccgcttctccccttcaggggagtatctcgcctctggtgctgacggtggcggcatcatcctctggaaactgcaccccgctgatgacggtgaggcatggaaaattcacaagacgttgctattccatcacaaggatgttcttgacctccagtggtcgcatgacagcgcattccttgtttctgcatcagttgacaacacttgcataatttgggaagctagtaaaggcacggtgcaccaaaagatagagggtcatctgcattatgttcagggtgtggcgtgggatcctttgggccagtatattgcttcactgagttctgacagaacctgtaaaatatatgcaaataagcctcagggcaaatccaagaacgcggagaggttgaactttgtttgccagcatacactagtgaaaatagaatatcagaatcatgatgaatctaagccaccaattaaatctcatttgtttcatgacgagacactaccatctttcttccggaggttggcatggtcacctgatggatcttttctagtattgccagcaggcctttccaaacactcttctgaagtgattaataccgcttatataatgtccaggcgtgacctctcaaggcctgcaatacaactccctggggccagtaaagctatagtagcagtacgcttctgcccagtgctattcaaaccacgtggttctaacccagatggtctcttcaagcttccttatagagttgtttttgctgttgccactttgaactctctgtatgtctatgatacagaaagtgttcctccaattctagtccatgctggtctacactatgctgccattactgatattgcatggtcttctgatgctaagtacttggcagcgtcatcacgagatggctactgtactataatagagtttgagaatgaggaactgggagagcttcacatcctccctggatcaaaagaagttgctaaagggaatttgacacctgagaccaagaaacctgtatctgcagatagcatgaaggttgatattagtgccagcacgcttaagatggaagccagccctgtggctgtaggagttagagcaccactgctgccaaccgagaacatcacgagaacaggggagcttgctgaaggaaatgtgacctgtgaaaacaagaagccggtaacagtagacagtatggaagtagatgtcgatgataacaaagtcaaggaggcaaccattcccgtggtggctgaagtgacaccgccgccagtaccgaccaagaacagcgcatcgagtaagcctgctaagaggcgaattactcctatcgcaatcaactaagtagctgaagcagttagtgttatgatgtgttatgtagtgatgacaagtaccagatattatggttaggctaccctgtaaagtcgtttgtgctgccttgttcaccttctaccctagtcccataggtcttctttctgctcttaacacaattggggagattttgaacagaaaggctatgtgtatgagcaaactttgttatgatgcaacatgcagccactaaccgtcttcttacacagtggtgttcagtgaaatttctgaggaatttttttcacacaaactgctcatatacaaatactggcatataattacactttgaatccaatcaggtgggtctgtgacacccttatttcgttcacatgaaagaacatagaatcttatcaaaatactcaaatgcatgcgagggtagtatgtatatgtgtgtatgggtatggtaattgccccaagttgaagggccttcagtgtgggcagacaatatatctgaatatggcatcatccatcttaggacttggttatgcgtgcctcggaattttcatactcttcttcgttctcgccagcctcttcaaatctgatatcttcatcttctgaaaggacctcaatcttttcgccatgtggcccaggtatgatcttctcgtcgacatgcttgtgctttgtgacgttgatgacctctgccttcttatcttctctgctctcatgtttcttgtgccaggtccaagggaggtggtgatgcgccgtcttccccgctgctgcggtgctcgaggattcaccaatggcgtcctgcttcttgaccgcctcttggaacttgacgtcctcgtctactgtcagcctgacaacgttggcacccccgggccctggcatggtatccttgtggacatggacatggtcactgaagttgagcacctcagccttggtctctgtcttcctccccctcttcttgtgccaacagaggagcgcggcgaggcatgccagcagcagcaagccgcccagtgagacgaacaccacgatgatgacaatgtggtgcggagggctaggcggaggcggcactggcattggcggcggaggctggatatgtggcgggggcggtgcgagcgggcgaggcggtggtggggcttgaggccgaggagttggtggtggcggtgggcgaataggcggtgacggtggagggggagcacggcgtggtggcggcgggggctgagtaggaggtgggggagcacggcgcggtggcggtggcggcattgtgggtggtggcggagcacggcgtggtggtggaggcggcagagctggtggtgggggagcgcggcgtggaggcggtggtggtagggtgggtggtggtggagcgcgtcgcggcggtggaggctgaggcggcggcggggcacgctgtggcggtggaggggctcgcatcggcggtgggaagcgctgcggtggtggcggggcttgtggccgcggcggtggccttggaaggtatgggtttggagggaagtaagggaagcccagtcctggagggctagggttgaacgccattgctgctagctagatcaaaggagagctgggagctgggcgcaactgtgctgctgtagtgaggtgag

SEQ ID NO: 3356 - DNA, 1934 bp, Setaria italica
tgacaacctcccccaaaaccaaaccaaaccctagagagagagagggagagagcgcgcgcgcgccgagaagcaggaggagagagagattgggggcgaacgcgacgcggcggaggaatccatccatcgatcgaggagaaggaagaggagagcaagatgcggggcgggacggtgcagatcaactggcacgacctgcagccggtgctcagcctcgacttccaccccgcctcccgccgcctcgccaccgcaggcgccgaccacgacgtcaagatctgggtcatatcgtcggatggttccgagagcaagctccccaccgccaccttccagagcggcctcgtcccaaacggcaccgcccacagctccgcggtcaacgtcctccgcttctccccttccggggaatatctcgcctctggtgctgacggtggcggtattatcctgtggaaattgtattccactgaggatggcgaggcatggaaaatccacaagacattactgttccatcacaaggatgttcttgacctacagtggtcgcgtgatagcgcgttccttgcttctgcttcagttgacaacacttgcataatctgggacgcagttaaaggcacggttcagcaaaagttagagggacatctacattatgttcagggtgtggcatgggatcctctgggccagtatatagcttcactgagttctgacaggacctgtaagatatacgcaaataagcctcaaggcaaatcaaagaatgccgagaaggtgaactttgtttgtcagcatacgctggtgaagatagaatatccaaatcatgatgaatctaagccgccagttaaatctcatctgtttcatgatgagacgctaccatctttctttcggaggttggcatggtcacctgatggatcttttctagtactgccagcaggtctttctaaacactcgtctgaagtgattaacactgcttatgtaatgtcaaggcgtgacctctcaaggcctgcgatacaactacctggggcaagtaaagctatagtagcagtgcgcttctgccctgttctattcagaccacgtggttctaactcagatggtttcttcaagcttccttatagagttgtttttgctgtcgctactttgaactctgtgtatgtctatgatactgaaagtgttcctccaattctaatacatgctggtctacactatgctgcaattaccgatattgcatggtcttttgatgctaaatacttagcagtgtcatcacgggatggctactgtactataatagagtttgagaacgaggaactgggacaacctcacatcctccctggatcaaaggaagttgctaaaggaaatatgacatgtgaaaagaagcctttacctgtagatagcatggaggttgatgttagtgccagcaagcttaagatggaagtcaaccctgtggctgcaggagttacggtgccaccgatgttggccgagaacgtcacattgaggacaggggagcttgctgaaggaaatgtgacctgtgaaaacaaaaagccagtagcagtagacattatggaagtggatgtcagtgataaagttaagacggtaaccagtcctgtggctatcgaagtaacaccgccaccagtgtcgaccaagaacaatgcatcgagtaagcctactaagaagcggattactcctatcgcaatttgactaagtagctgaaagcaattaggataatgatgcgttatgtagtgataacaagcactggatattatgtttaagctaccctgtaaagttgagtgtgcagtcgtgttcaccttctaccctagtagtagcccccatgtattctcttcctgctcttgacacaattggtaatgtggacacataggttgtgtatgatcacactttattatgaagcaacatgcagccactaacaggcatttacacaatggacttttgtgaaaattcctgtt

SEQ ID NO: 3357 - DNA, 625 bp, Saccharum officinarum
acctacccagatgcggacagcccaccttcccgtagctctcacgctcttcgcgcccgccgcctgccctattctcgtgcttgtctgacgaacatggcctccatcgccggatcttccgcgctctccttcgccaggcccgtcaaggcaatcaacacaaactctctagctttctccacggcgaggaagggaaatgcattcctccgactgcaaccaatgactatgagatctgcttcctgcgctgacaagaaggatacagtgggacacgcgccgtgaaattgtgaagaagcagcttgctcttcctgaccacactgaagtttgaggtgactccaaattctctgaacttggcgcggattcactggacacggctgagattgtgatgggccttgaggagcacttcgatataagcgtggaggagtccagcgcccagacgatcgcaacagttgaagacgctgctgacctcatcgacaaacttgttgctgagaagggatacgtcttgatctcctttaatcattgacccacgcctcttctgtcttttccttgatctaaggttctatggactgaagaacttgtgattttctccgcacttaaagtgatacgcccgtggtgggataattcgagaatgtttggt

SEQ ID NO: 3358 - DNA, 348 bp, Triticum aestivum
gacgcacatggcctccatcgccggatcttcggccctctccttcgccaggcccgtcaaggcaatcaacacaaattctctagctttctccccggcgaggaagggcaacacattcctccgcctgcaaccaatgcctatgagatctgtttcctgcgctgccaagaaggatacaacagacaaggtttgtgagattgtgaagaagcagttgctcttcctgaccatactgaagtttgcggtgaatcgaaattctctgaactcggtgcagattcactgggacacggttgagattgtgatgagtctcgaggagcacttcgatattagcgtggaggagtccagcgcacaaacaatcgc

SEQ ID NO: 3359 - DNA, 745 bp, Setaria italica
agcagcctgccgtgcccgtgccgtccagcgcccccacctcccccggtcgctctcacgcgcttcgtgcccgccgcctccccccgttccgcatcgcgtgcgtcgcgccccgatggcctccatcgccggatccgccctctccttcgccaggcccgtcaaggcagtcaacacgagctcgctctctttctctgctgcgaggaagggcaatgcattcctccgcctgcattcagtgcccaagagatttgctgtttgctatgcagctaagaaggatacagtggacaaggtttgtgaaattgtgaagaagcagctcgctgttccagagggcactgaagtttgtggtgcctctaagttctctgatcttggtgcagattcacttgatacggttgagatcgtgatgggccttgaggaggagttcgacatcagcgtcgaggaatcaagcgcgcagtcaattgcgacagttgaggatgctgccgagctcattgacaagcttgttgctgagaaatcaccctgaagtcacaaggcatgatgttgggatctcgcaaactagttctaccttgttcctgcccagcccactctccccatatctaggtttctatgctctgaaggattggcgatcttctcagcattgttctccactgtgtctgtaataataccgagatgattttaagctgttgaacattacggtggtgcgcattctgtcagttcattgttgtatgaatggttcttcctcgaagaaaatgggatcttg

SEQ ID NO: 3360 - DNA, 1041 bp, Setaria italica
gggcccgcccgtacccggcctcgcggaccccgccgccccgtcgatacaaccgatgcgcgcggcggcgtcgccaccccgccctgtatataaaaccctcggctccggccaggccaagccactgctccgacctacccagcagcagcagcctgccgtgcccgtgccgtccagcgcccccacctcccccggtcgctctcacgcgcttcgtgcccgccgcctccccccgttccgcatcgcgtgcgtcgcgccccgatggcctccatcgccggatccgccctctccttcgccaggcccgtcaaggcagtcaacacgagctcgctctctttctctgctgcgaggaagggcaatgcattcctccgcctgcattcagtgcccaagagatttgctgtttgctatgcagctaagaaggatacagtggacaaggtttgtgaaattgtgaagaagcagctcgctgttccagagggcactgaagtttgtggtgcctctaagttctctgatcttggtgcagattcacttgatacggttgagatcgtgatgggccttgaggaggagttcgacatcagcgtcgaggaatcaagcgcgcagtcaattgcgacagttgaggatgctgccgagctcattgacaagcttgttgctgagaaatcaccctgaagtcacaaggcatgatgttgggatctcgcaaactagttctaccttgttcctgccctgcccactctccccatatctaggtttctatgctctgaaggattggcgatcttctcagcattgttctccactgtgtctgtaataataccgagatgattttaagctgttgaacattacggtggtgcgcattctgtcagttcattgttgtatgaatggttcttcctcgaagaaaatgggatcttgggagcatgtagcaaaggttgccaaattgatgatgttcgcggtgttataactagcaatgcggaatagcagttatttgtttatatgttccattgcagcgttctgtgaacaccgtggccatctaaggccgagctgtatactcattttcagacggctaag

SEQ ID NO: 3361 - DNA, 768 bp, Pennisetum glaucum
ggctccgacctacccagcagcagcagcagcagcctgccgtgcccgtgccagccaacctccccccggcccggtcgctctcacgcgcttcgtgcccgccgcctcccccagaagcaccccatggcctccatcgccggatccgccctctccttcgccaggcccgtcaaggcggtcaacacgagctcgctctctttctccgctgcgaggaagggcaatgcattcctccgcctgcattcggtgcccaagagatttgctgtttgctatgctgctaagaaggatacagtggacaaggtttgtgaaattgtgaagaagcagcttgctgttccagagggcactgaagtttgcggtgactctaagttctctgatcttggtgcagattcacttgatacggttgagattgtgatgggccttgaggaggagttcgacatcagcgtcgaggaatcgagcgctcagtcaattgcgacagttgaggatgctgcggagctcattgacaagcttgttgctgcgaaatcgccctgaagtcacaaggcatgatgttgggatcttgcatgctagttctaccttgttcctgccctgcccactctccccttatctaggtttctatgctctgaaggattggtgattttctcagcattgttctccactgtgtttgtaataataccgagatgattttaagctgttgaacattacggtggcgcgtattctatgagttcattgttgtatgaatggttcttcatggaaggaaatggggtcttgggagcttgtagcaaa

SEQ ID NO: 3362 - DNA, 3590 bp, Sorghum bicolor
gtctctactcttcttccccccactaccccagcacgccactgctcacacacccctactcggaggtggagtggaggagctccaatccaatccaatccatcccaaatccgccgaattcggacactgcagatggacgccgtccccccgattcgcccgctctgagcagttggaccctgttccagccgccgcctcgtctcattccggcgataaaaaacttgacttccgctgaaagattcagctccgtgcttccggccgccggagtgcggtaatggcggggttctagcgcggcggacttaaagatctagcctttttttttcatttgccttttctgttttgctgctgctcactcccgcggcgatggtgactgagatggcggcgcgtggcggcgaggcggcggcgttcggggcctcggaggcggaccgcggcgacttcgaggtgttccgcagcggctccgcgccgcccaccgtcgagggtgccctgggcgccgccgctgcagccgccgccggcggcctgctcgtggacgatgagctccgctctgacccggcgtatcagagctattactactccaatgcgcacctcaacccgcgcctcccgccgccgctcctctccaaggaggactggcggtcctcgcaccaccgcctccgctcctccgcgggcttcggcgggatcggggacggcaggaggcagcagcagcagcaggcgtcggctgccgaagggacggtcggactgcccgggatcgatctcggtcgccagaggagcttctcttcagtctttcaggaggactcgtatcagcgtgatatggataggcagactgctagccacaatactaatgacttactaggttcttctggaatacagtatggtctaaatcgtggacctggaactattggaggcctgcactctagcaatagtttacggagcttggatgaatttcagaacactgatctgccatcaaatacatttgcttctattttagggtcatctctttctaggagtgcatctccagatcctgagcttgtgaggagggcccctagtccatctctgcctccaattggtgtgaaagttagtaacactgataagaagatcaatggtggttcctcttctttccgtcgtagttcatccgcaatcggtgaatctgatgatctggtggctgctttatctgggatgaacttatcatctagggcaatgagtgggcaaactatggaccagtctcagctgtatcaggatgtcgataatgtccagaagttcctttttgatcgacagggtgaccagacaaatggcaatcagcagcactacatgagacgtcctgagcatgggcaatctaagttaccagatggatattcttccaatttggtcaattcatctacgatgaggaaccagattaatgctggaagtttcacatcttttgacagtttgtctcttggatctggctttgcttcccctaggattggttctagatcccctggagggactgtatcttctcgacaaaatttagctggtatgtctaacatgctaaactataatggaattggaagtccaactgcatcaccttctcttcagacctctattgatccagcgtatatccagtaccttgcccaacttgcagctacctgtgatgatcctctaatggacaggggccatctgggaaattcttacatggacttacttggtactcagaaagctaaccttggccctttactccagtcgcaaaagcaatatggttactatggtaatcttggatttaaccttggatatgctggaagtccattgacaagtcctgttcttccctcttcacctattgcgccaggaagtccacttaggcatggtgagcgcaacatgcgctttccatcaggcatgagaaacttcggtaattcctttggttcatggaattcaggcatgggtggaaagatggatgccaatttgatgccctcacttctggaggagttcaagagcaacaaaagtaaatcatatgagctctcggaaatagctggccatgttgttgagtttagtgctgatcaatatgggagtcggttcatacaacagaagctagagacagccagtactgaagaaaaggacatggttttttcagaaatcatgcctcaagctctcacattgatgactgatgtatttggaaattatgttgttcaaaagttttttgagcatggaagcactgcccagataaaggaattggctggtcagcttattggacgtgtccttgctcttagtcttcagatgtatgggtgccgggttatacagaaggctatagaagttgttgatttggatctgcagactaaaatggttgcagagctggagggccatgtcatgcgctgtgtacgtgatcaaaatgggaaccatgttatacagaaatgcatagagtgcattcctcagcatgctatcgagtttattgtctcgacattctatggtcaagttgtaatgctatccactcatccatatggttgtcgagttattcagagggttctagagcattgtgatgatcctaagacacagcaaataatgatggatgagattctccagtctgtttgcttgctagctcaggaccagtatggcaactatgttgttcagcatgttctggaacatggcaaaccacatgagagatcggctattattgagaagctaattggccaaattgtgcaaatgagccagcaaaagtttgcctcaaatgtcatcgagaagtgcttagcctttggaaatcctgtagagcgtcaggttctgattggtgagatgcttggatccactagtgaaagcgaacctcttgaggtaatgatgaaagaccagtttgcaaactatgtggtgcagaaggtgttagaaacttgtgatgatcagcagagagagatgatcctaacaaggataaagacacacctgaacaccctcaagaagtacacatacgggaagcacatagtagcacgtgtagagaagcttgttgctgctggagagaagcgccttgggcttcaaccagcatgcaccgctgcctgaagggcaaactctctagttgtacagctaacagttgctaggtttgcactcacctttttttctctactaaaaccttatatgaaggccccttttggcctcgccggaaaaataaatactgtatgtttgcgcggaagagtgtacattaattctgtagcagaagtgatgaggcggaatcaagggaggagtgatgcgtgcgagtccgatctgaaggctgctgtaaagaggaagaagatggaaggagtgagaagcatgtcagttactctgctgctgtacaaattaaacttagctattagagtgaggagaaagtaagctgttagctgtctgtctaaaaagaaaaagaagctgaggccatcagcaccctgtttcatctcttggtatagctgctgtggctctcctgttgtctggcctttgttgtaacataaagctgaggcgcactagcctttgtttttacagttaagctgaagttattagtatcagctttcctgaactgtttgatatgtaatgtgactttgttccttgtgctaatggttgagtctcatgtaatccaggtccctgatgtctgaatgttttaatctcaattttcactgcagataaacagtttt

SEQ ID NO: 3363 - DNA, 3542 bp, Zea mays
cactcttcccccactcccccagcacgccactgctcacacagaccaccccccactcggaggcggagtggagctcctccaatccgtcccgaatccggacgccgctcgcaccgcccgcaccgcccgcagatggacgcccgccccccgatccgcccgctctgaccagacgaacccggtccccgcccccgccgccgccgctggagcgcggtaatggcgggcttctagcgcgtcggacttaaagatctagcctttctattttgtttcctctctgcctcttttctttcgctggcaccgatggtcaccgagatggcggcgcgcggcggcgaggcggcggcgttcggcgcggaggccgaccgcggcgacttcgaggtcttccgcagcggctccgcgccgcccaccgtcgagggcgccctgggcgccgccgcggccgctgccgacctgctcgtggatgacgacctccgcgccgacccggcgtaccagagctactactactccaatgcgcacctcaacccccgcctcccgccgccgctcctgtccaaggaggactggcgctcctcgcaccaccgcctccgctccgcggccttcggcgggatcggggacggcaggaggcagcagcagccggctgcccaagggacggtcggcctgcccgggatcgatcttgcccgccagaggagcttctccaccgtctttcaggaggattcgtatcagcgtgatatggataggcagactgccagccacaatagtagtgaatcattatgttcttctggaatacagtatggtctaaatcgtggacctggaactattggaggcctgcactctagcaatagtttacgaagcttggatgaaattccgaacaatgatctgccatcaaatacatttgcttctcttttagggtcatctctttctaggagtgcatctccagatcctgagcttgtgaggagggcccctagtccatcccttcctccaatcggtgtgaaagttggcaacactgataagatgaatggtggttcctcttctttccgtcgtagttcatccgcaatcggtggatctgatgatctggtggctgccttatctgggatgaacttatcatctagggcaatgagtgggcaaactatggaccagtctcagctctatcaggatgttgataacgtccagaagtttctttttgatcgacagggtgaccaaccaaatggcaatcagcagcactacatgaggcgtcctgagcatggacaatctaagttatctgatggatattctgccaatttggccaattcatccacgatgagaaaccagattaattctggcagtttcacatcttttgacagtttgtctcttggatctggctttccttcccctaggattggttctagatcccctggagggactgtatcttctcgacaaaatttagctggtatgtctaacatgctaaactataatggaattggaagtccaactgcgtcaccttctcttcagacttctattgatccagcgtatatccagtaccttgctcaaattgcagctacctgggatgatcctctaatggacaggagccatctgggaagttcttacatggacttacttggtacacagaaagctaaccttggccctttacttcagtcacaaaagcaatatggttactgtggcaatcttggatttaaccttggtggttatgctggaagtccattggcaagtcctgttcttccctcttcacctattgcaccaggcagtccacttaggcatggtgaccgcaacatgcgctttccatcaggcatgagaaacttcggtaattcctttggttcatggaattcaggcatgagtggaaagatggatgctaatttgatgccctctctcctggaggaattcaagagcaacaaaagtaaatcatatgagctctccgaaatagctggccatgttgttgagtttagtgctgatcaatatggaagccggttcatacaacagaagctagaaacagccagtactgaagaaaaggacatggttttttcagaaattatgcctcaagctctcacattaatgactgatgtatttggaaattatgttgtccaaaagttttttgagcatggaagcactgcccagataaaggaattggctggtcagcttattggacgtgtccttgctcttagtcttcagatgtatgggtgccgggttatacagaaggctatagaagttgttgatttggatctgcagactaaaatggttgcggagctggagggccatgtcatgcgctgtgtacgtgatcaaaatgggaaccatgttatacagaaatgcatagagtgcattcctcagcatgctatcgagttcattgtctcgacattctatggccaagttgtaatgttatccactcatccatatggttgccgagttattcagagggttctagagcattgtgatgatcctaagacacagcaaataatgatggatgagattctccagtctgtttgcttgctagctcaggaccagtatggcaactatgtggttcagcatgttctggaacatggcaagccccatgagagatcagccattattgagaagctaattggccaagttgtgcaaatgagccagcaaaagtttgcctcaaatgtcattgagaagtgcttagcctttggaaatcctgtagaacgtcaggttctgattggtgagatgcttggatccactagcgaaagcgaacctcttgaggtaatgatgaaagaccagttcgcaaactatgtggtgcagaaggtgctagaaacttgtgacgatcagcagagggagatgatcttaacaaggataaagacacacttgaacacactcaagaagtacacatacgggaagcacatagtagcgcgtgtagagaagcttgttgctgctggagagaagcgccttgggcttcaaccagcatgcaccgccgcctgaagggcaaactctctaagttgtacagctaacagttgctaggtttgcctcatgtttttttctctactaaaaaccttatatgaaggccccttttggcctcgccaggaaaaaaaataaatactgtatgtttgcggggaagagtgtacattaattctgtagcagaaagaccccctacccatgtggcggaatcaagggaggagtgatgcgtgtgagtccgatcgatctgaaggctgctgtaaagaggaagatggaaggggaaggagtgagaagcatgtcagttactctgctgctgtacaaattaaacttagctcttagagtgaggagaaagtaagctgttagctgtctgcctaaaggaaagaaaggaaaaaaaaaagaagctggaggccattggcaccctgtttcatgtgttggtatagctgctgtggctctcctgttgtctgtctggcctttgttgtaacataaagctgaggcgcactagcctgccttcgttttcacagttaagctgaagttattagtatcagctttcctgaactgcttggtatgtaatgtgactctgtttcttccttgtactaatgcttgtctcatgtaatccaggcccctaatgtctgaatgttttaatctcatttttcacctctgat

SEQ ID NO: 3364 - DNA, 3849 bp, Setaria italica
cacgcaggtaggagagtagagtacctccaagtttccatttctaaacaacaaaaaagagagcaggtcaagcttggcatctctcttctctctcatacacccacaccccagcaacaaaaccctaggacccaaagccctctgggcgatctcgcccgtccaaccccggatccgacgacccaaatcgctccggccgttgtacttaatcgagccgcaaccaggcctcctttcttctccagtctctacgcttcttcccccactaccagcacgccactgctcacacttgcagcggagaaggggagcctccaatccaatccctcgcaaatccgaaccatttcgccgaattcgaacaccgactcccccgtagatggccgctcgctccccgattcgtccattctgagcagccggaatcggttcttgccgctccccgatctcggctactgctcattccgtggataaattttgttaaaagctgcaactttctcggttttgcttgagggagcacggtaatggcgggattctagcgcgctaaaccctaaagatcttggcttttcttgcggcccccgcgatggtgacggagatggcggcgcgcggcggcgaggcgttcggcgcggaggcggaccgggacttcgaggtcttccgcagcggctccgcgccgcccaccgtcgagggcgccatgggcgccgccgccgccgccggcagcctcttcctcgacgacgacctccgcgccgacccggcctaccagagctactactactccaatgcgcacctcaacccgcgcctcccgccgccgctgctctccaaggaggactggcgctcctcgcaccaccgcctccgctcctccggcctcggcgggatcggggacggcaggaggcagcagcagccggcggcggctgcagaagggacggtggggctgcccgggatcgatcttggtcgtcataggagcttctccaacgtctttcaggatgattcataccaacgggatatggataggcagactgccaaccacagtagtaatgacttgctaggttcttctggaatacagtatggcctccatcgtggatctggagctatgggaggcctgcactctagtaataattcacgaggcttggatgaaattcagaacaatgatttatcatcaaatacatatgcttctattttagggtcatcgctttctcgaagtgcatctccagatcctgagcttgtgaggagggcccctagtccatctctgcctccaattggtgtgaaagttggtgctaatgacaagaagattaatggtggttcatcttctttccgccgtagttcatctgctataggtgaatctgatgatcttgtggcagctttatctgggatgagcttatcatctagggcaatgagtgggcaaactatggaccagtctcagctctatcaggatgttgataatgtccagaaatttctgtttgatcgacagggtgaccaatcaaatggcaatcagcagcactcctacatgagacgtcctgagcatggacagtctaaagtacctgatggctattctccaaacttggccaattcatctacgatgagaaaccagattaatgctggcagtttcacatcatttgacaatttgtcacttggatctggctttgcttcccctagaattggttccagatcccctggcgggactatatcttctcgacaaaatttagctggtatgtctaacatgctaaactacagtggaattggaagtccaactgcatcaccttcccttcagactcctatcgatccagcgtatatccagtaccttgctcaacttgcagctagctgtgatgatcctctcatggacaggggccatctgggaaattcttacatggacttacttggtcctcagaaagctaaccttggccctttacttcagtcacaaaagcaatatggttactatggcaatcttggatttaaccttggttatgctggaagtccactgacaagtcctgttcttccctcttcacctattgcgccaggcagtccgcttaggcatggtgatcgtagcatgcgctttccatcaggcatgagaaactttggtggctcctttggttcatggaattcaggcatgggtgggaagatggatgccaatttgatgccctcgcttctggaggaattcaagagcaacaaaagtaaatcatatgagctctcagaaatagcaggccatgttgttgagtttagtgcggatcaatacgggagccggttcatacaacaaaagctagaaacagccagtactgaagaaaaagatatggttttctcagaaatcatgcctcaagctctcacattgatgactgatgtatttggaaattatgttgttcaaaagttttttgagcatggaagcactgcccagataaaggaattggctggtcaacttattggacgtgtccttgctctcagtcttcagatgtatgggtgccgggttatacagaaggctatcgaggtcgttgatttagatctgcagactaaaatggttgcggagctggagggacatgtcatgcgttgtgtacgtgatcaaaatgggaaccatgtaatacaaaaatgcatagagtgcattcctcagcatgctatcgagtttattgtctcaacgttctatggccaagttgtaatgctatccactcatccatatggttgtcgagttattcagagggttctagagcactgtgatgatcctaaaacacagcaaataatgatggatgagattctccagtctgtttgcttgctagctcaggaccagtatggcaattacgttgttcagcatgttctggaacatggcaaaccccatgagagatctgctattattgagaagttaattggccaaattgtgcaaatgagccagcaaaagtttgcttcaaatgtcattgagaagtgcttagcctttggaaatcctgtagagcgccaggttctgattggcgagatgcttggatccactagtgaaagcgaacctcttgaggtaatgatgaaagaccagtttgctaactatgtggtgcagaaggtgttagaaacttgtgatgatcagcagagagagatgatccttacaaggataaaaacacatctgaacaccctcaagaagtacacctacgggaagcacatagtagcacgcgtagagaaacttgttgctgctggagagaagcgccttgggcttcaaccagcatgcactgctgcctgaagggcaaacaatctagttgtacagctaacagttgctaggtttgcactcacgttttttctctactaaaaaccttatataaggcccttttggccttgccggaaataaatactgtacgtttgcgccgaagagtgtacattgattctgtagctgaagaccctacgcagaatcaagggaggagagtgatatgcatgcaagtttgatctgcaagctgctgtaaagaggaggaaggtggaggactaagaagcacgttaattactctgctgctgtacaaattaaatttagatcttagagtgagagaagtaagctgttagctgtctaaaaagaaaagctgaagccattagcccccctgttttcatctgttgatatagtagcggcttcctgttgtttggcctttgttgtaacataagccgaggcgcactggcctttgtttacagttaagctgttgttattagtatcagctttcctggactgtttgttatgtatcttgtgctaatggagtcccatgtaatccaggtctaagatgtcgtgaatgtttttcttgcgacagacataacttttaaggtgatttataggcaggcatgcctatttcacaatgcctcgctctttgagatgccttctttttggtggatgagaatgatggttcttgtttgtgtttgaattttgaaagaagg

SEQ ID NO: 3365 - DNA, 5434 bp, Setaria italica
accaaattgtttttctcataaatggaagaagcaaaaggtgacgagttttagatggtagtactccactagtataagagaaagcaactcttgtcgggctcgaacttgctatttgcggcggcggttatccattccagggaagctgcgtgcaaactgtcgccgtcgtcagcaactgatctgatctggggggtgtaatgcagcgtagataggctggtttattccattttgtacagtgaatactacgatggagaggtgactgaaaatgtacgtgtggggagctatcatcctgattctctctctctctctgacactgccatcaccctgaattcctaattgatcgattggacagtagaaattcaggagacgacgcatgttgggctgttgagatagatgatactgttgggctgcaaacggcagatagtgaatttagcccatgtcacgtgcagtcgcttctgctgggccgggatcctgctgaatgactgaatgaggtagatggatggtgggctgcatccacaagattgtctcgtcgtcatcaccgcaactaatagttctaggcccgctttgtcgaagcttcgtgcgagggtcggtctatgataatcaccattaagaaaacaatggagcgaagaccggttgctgtgttagggatctttctttatcttattttatttttttttcctgaaaggagcttgccttggcctcactccttattttactgccctagcctttggccggctcatcgtctctgtcattgattaagtcacatccatactaacccttttcctgttttgtgttgttataagtaaaatatgttgaccatattttttgtgtgttcttgaataaaaggtaggatgaaaaagaaaccctaaatagatgagtggacgagagaggttgggagggcctgagttttcgtggactgacggcctcgagatgcatgcatgggcagatgggctgttggtgtttggcacgccatctttcttcacctttccttcctcctctcctcgcctcactccctctgcttagtggtaacagttggtttggagtagttaatccactgttggagcacgctcgatccgtcacgtgctctccatattccatcttcttcctccggtccactgcccttgcgacagcacgcacgcgagcagcagcggcctgcccgcaccgtgcacgtactcatcactacccctactctacttactacctctactcgccatctcctgcactttgacagtttcaccccacggttacttcttactacaccactctttggtctcaggattccacagtatcacaaactgatccatcattaacgatgctgagttccatggggattattgttcgtccagacaagagaggggcagacgaagcgaatgcacaacggtgccagtaccccaatgcacgcaaatcttatctctagggaaaagggggcctacggagcttgctgtaaaatctggtcttaccgtaccatgccaggaacaaagcagagtgctgctatattcatcttttttgtaacacaagcttaagctggtaatctgactgaacaacaaacattgccaaatttggcttaaagggcatcagaagagagaaggggtggaatctgcctggagaagaatggactttttggagaaactgacctgaaaacatctctttcaatcaccaatggagtaagcacgcaggtaggagagtagagtacctccaagtttccatttctaaacaacaaaaaagagagcaggtcaagcttggcatctctcttctctctcatacacccacaccccagcaacaaaaccctaggacccaaagccctctgggcgatctcgcccgtccaaccccggatccgacgacccaaatcgctccggccgttgtacttaatcgagccgcaaccaggcctcctttcttctccagtctctacgcttcttcccccactaccagcacgccactgctcacacttgcagcggagaaggggagcctccaatccaatccctcgcaaatccgaaccatttcgccgaattcgaacaccgactcccccgtagatggccgctcgctccccgattcgtccattctgagcagccggaatcggttcttgccgctccccgatctcggctactgctcattccgtggataaattttgttaaaagctgcaactttctcggttttgcttgagggagcacggtaatggcgggattctagcgcgctaaaccctaaagatcttggcttttcttgcggcccccgcgatggtgacggagatggcggcgcgcggcggcgaggcgttcggcgcggaggcggaccgggacttcgaggtcttccgcagcggctccgcgccgcccaccgtcgagggcgccatgggcgccgccgccgccgccggcagcctcttcctcgacgacgacctccgcgccgacccggcctaccagagctactactactccaatgcgcacctcaacccgcgcctcccgccgccgctgctctccaaggaggactggcgctcctcgcaccaccgcctccgctcctccggcctcggcgggatcggggacggcaggaggcagcagcagccggcggcggctgcagaagggacggtggggctgcccgggatcgatcttggtcgtcataggagcttctccaacgtctttcaggatgattcataccaacgggatatggataggcagactgccaaccacagtagtaatgacttgctaggttcttctggaatacagtatggcctccatcgtggatctggagctatgggaggcctgcactctagtaataattcacgaggcttggatgaaattcagaacaatgatttatcatcaaatacatatgcttctattttagggtcatcgctttctcgaagtgcatctccagatcctgagcttgtgaggagggcccctagtccatctctgcctccaattggtgtgaaagttggtgctaatgacaagaagattaatggtggttcgtcttctttccgccgtagttcatctgctataggtgaatctgatgatcttgtggcagctttatctgggatgagcttatcatctagggcaatgagtgggcaaactatggaccagtctcagctctatcaggatgttgataatgtccagaaatttctgtttgatcgacagggtgaccaatcaaatggcaatcagcagcactcctacatgagacgtcctgagcatggacagtctaaagtacctgatggctattctccaaacttggccaattcatctacgatgagaaaccagattaatgctggcagtttcacatcatttgacaatttgtcacttggatctggctttgcttcccctagaattggttccagatcccctggcgggactatatcttctcgacaaaatttagctggtatgtctaacatgctaaactacagtggaattggaagtccaactgcatcaccttcccttcagactcctatcgatccagcgtatatccagtaccttgctcaacttgcagctagctgtgatgatcctctcatggacaggggccatctgggaaattcttacatggacttacttggtcctcagaaagctaaccttggccctttacttcagtcacaaaagcaatatggttactatggcaatcttggatttaaccttggttatgctggaagtccactgacaagtcctgttcttccctcttcacctattgcgccaggcagtccgcttaggcatggtgatcgtagcatgcgctttccatcaggcatgagaaactttggtggctcctttggttcatggaattcaggcatgggtgggaagatggatgccaatttgatgccctcgcttctggaggaattcaagagcaacaaaagtaaatcatatgagctctcagaaatagcaggccatgttgttgagtttagtgcggatcaatacgggagccggttcatacaacaaaagctagaaacagccagtactgaagaaaaagatatggttttctcagaaatcatgcctcaagctctcacattgatgactgatgtatttggaaattatgttgttcaaaagttttttgagcatggaagcactgcccagataaaggaattggctggtcaacttattggacgtgtccttgctctcagtcttcagatgtatgggtgccgggttatacagaaggctatcgaggtcgttgatttagatctgcagactaaaatggttgcggagctggagggacatgtcatgcgttgtgtacgtgatcaaaatgggaaccatgtaatacaaaaatgcatagagtgcattcctcagcatgctatcgagtttattgtctcaacgttctatggccaagttgtaatgctatccactcatccatatggttgtcgagttattcagagggttctagagcactgtgatgatcctaaaacacagcaaataatgatggatgagattctccagtctgtttgcttgctagctcaggaccagtatggcaattacgttgttcagcatgttctggaacatggcaaaccccatgagagatctgctattattgagaagttaattggccaaattgtgcaaatgagccagcaaaagtttgcttcaaatgtcattgagaagtgcttagcctttggaaatcctgtagagcgccaggttctgattggcgagatgcttggatccactagtgaaagcgaacctcttgaggtaatgatgaaagaccagtttgctaactatgtggtgcagaaggtgttagaaacttgtgatgatcagcagagagagatgatccttacaaggataaaaacacatctgaacaccctcaagaagtacacctacgggaagcacatagtagcacgcgtagagaaacttgttgctgctggagagaagcgccttgggcttcaaccagcatgcactgctgcctgaagggcaaacaatctagttgtacagctaacagttgctaggtttgcactcacgttttttctctactaaaaaccttatataaggcccttttggccttgccggaaataaatactgtacgtttgcgccgaagagtgtacattgattctgtagctgaagaccctacgcagaatcaagggaggagagtgatatgcatgcaagtttgatctgcaagctgctgtaaagaggaggaaggtggaggactaagaagcacgttaattactctgctgctgtacaaattaaatttagatcttagagtgagagaagtaagctgttagctgtctaaaaagaaaagctgaagccattagcccccctgttttcatctgttgatatagtagcggcttcctgttgtttggcctttgttgtaacataagccgaggcgcactggcctttgtttacagttaagctgttgttattagtatcagctttcctggactgtttgttatgtatcttgtgctaatggagtcccatgtaatccaggtctaagatgtcgtgaatgtttttcttgcgacagacataacttttaaggtgatttataggcaggcatgcctatttcacaa

SEQ ID NO: 3366 - DNA, 3563 bp, Panicum virgatum
tctccactcttctccccccactaccagcacggcactgctcacacttgcaggggaaaaggggagctccaatccctcgcaaatccgcaccatttcgccgaattcgaacgcctgctctccggcagatggaagctctgaacccgattcgtccactctgagcagccaaaatcggttcttgccgcttcccgatctcggctagtgctcattccgcggataattcttgttaaaagctgcggctttctcggttttggtcgcgggagcacggtaatggcgggattctagcgcgctaaaccctaaagatcttggcttttcttgcgccccccgcgatggtgacggagatggcggcgcgcggcggcgaggcgttcggcgcggaggcggaccgggacttcgaggtcttccgcagcggctccgcgccgcccaccgtcgagggcgccatgggcgccgccgccgccgccggcagcctcttcctcgacgacgagctccgcgccgacccggcctaccagagctactactactccaatgcgcacctcaacccgcgcctcccgccgccgctgctctccaaggaggactggcgctcctcgcaccaccgcctccgctcctctggtctcggtgggatcggggacggcaggaggcagcagccgcaggcggcggctgcagaagggacggcgggactgcccgggatcgatcttggtcgccagaggagcttctccaacgtctttcaggaagactcgtaccaacgggatatggataggcagactgccaaccacaatagtaatgacttgctaggttcttctggaatacagtatggcctacatcgtggacctggagctatgggaggcctgcactctagtaataattcgcgaggcttggatgaaattcagaacaatgatttatcatcaaatacatatgcttctattttagggtcatctctttctcgaagtgcatctccagatcctgagcttgtgagaagggcccctagtccgtctctgcctcctattggtgtgaaagttagtgctaatgacaagaagattaatggtggttcatcttctttccgccgtagctcatctgctataggtgaacctgatgatcttgtggcagctttatctgggatgagcttatcatctagggcaatgagtgggcaaactatggaccagtctcagctctatcaggatgttgataatgtccagaagttcctgtttgatcgacagggtgaccaagcaaatggcaatcagcagcactcctacatgagacgtcctgagcatggacagtctaaagtacctgatagctattctgcaaatttggccaattcatctacaatgagaaaccagattaatgctggcagtttcacatcatttgacaatttgtcacttggatctggctttgcttcccctaggattggttctagatcccctggtgggaccgtatcttctagacaaaatttagctggtatgtctaacatgctaaactacagtggaattggaagtcccactgcatcaccttctcttcagactcctattgatccagcatatatccagtaccttgctcaacttgcagctacgtgtgatgatcctctcatggacaggggccatctggggaattcttacatggacttacttggtcctcagaaagctaaccttggccctttacttcagtcacaaaagcaatatggttactatggcaatcttggatttaaccttggttatggtggaagtccattgactagtcctgtgctcccctcttcacctattgcaccaggcagcccgcttaggcatggtgatcgcaacatgcgctttccatcaggaatgagaaactttggtagctcctttggttcatggaattcaggcatgagtgggaagatggatgccaatttgatgccctctcttctggaggaattcaagagcaacaaaagtaaatcgtatgagctcttagaaatagctggccacgttgttgagttcagtgcggatcaatatgggagtcggttcatacaacaaaagctagaaacagcaagtactgaagaaaaagacatggttttttcggaaatcatgcctcaagctctcacattgatgactgatgtatttggaaattacgttgttcaaaagtttttcgagcatggaagcactgcccagataaaggaattggctggtcaacttattggacgtgtccttgccctcagtcttcagatgtatgggtgccgggttatacagaaggctatagaggttgttgatttagatctgcagactaaaatggttgcggagctggagggacatgtcatgcgctgtgtacgtgatcaaaatgggaaccatgtgatacaaaaatgcatagagtgcattcctcagcatgctattgagtttattgtctcaacattctatggccaagttgtaatgctatccactcatccatatggttgtcgagttattcagagggttctggagcactgtgatgatcccaaaacacagcaaataatgatggatgagattctccagtctgtctgcttgcttgctcaggaccagtatggcaattatgttgttcagcatgttctagaacacggcaaaccccatgagagatctgctattattgagaagttaattggccaaattgtgcaaatgagccagcaaaagtttgcttcaaatgtcattgagaagtgcttagcctttggaaatcctgtagagcgccaggttcttattggtgagatgcttggatctaccagtgaaagtgaacctcttgaggttatgatgaaagaccagtttgctaactatgtggtgcagaaggtgttagaaacttgtgatgatcagcagagagagatgatccttacaaggataaaaacacacctgaacaccctcaagaagtacacttatgggaagcacatagtagcacgcgtagagaaacttgttgctgctggagagaagcgccttgggcttcaaccagcatgcactgctgcctgaagggcaaacaatctagttgtacagctaacagttgctaggtttgcactcacgttttttctctactaaaaaccttataaaagggcccttttggcctttgccggaaataaatactgtatgtttgcgccgaagagtgtacattaatcctgtagctgaagaccccacgcagaatcaagggaggagtgatgcatgcaagtttgatgtgcaagctgctgtaaagaggaggaagatggaggggagtaagaagcacgtttattaatctggtgctgtacaaattaaatttagcactagagtgagagaaagtaagctgttagctgtctaaaagaaaagccgcgaagccattggccctctggttgtatctgttgatatagtagtggcttcctgttgtttgtcctttgttgtaacataagcagaggcgcactagccttcgtttacagttaagctgaattattagtaccagctttcctggactgtttggtatgtaatatgacttgtttcttgtgcaaatggagtctcatgtaatccaggtctaagatgtgaatgtttcatttctagttttgcttgagacaaacatgacttccaaggtgaacataggcaggcatgcctgtttcacaatgtcgcactctt

SEQ ID NO: 3367 - DNA, 3840 bp, Panicum virgatum
acaccaatggagtaagcacgcaggttctagtgtagtaccaccaagtttccatttctaaacaacaaaaaagagagcaggtcaagcttggcatctcactttctctctctctctcacatcctgccccagcaacaaaaccctaggacccaaagccctcggagagatctctcccgtccaaccccgaatccaacgacccaaatcgctccggccgttgtacttaatcgagccgcaaccaggcccgactcccttcttctccagtctctactcttcttcccccactaccagcacgccactgctcacacttgcagcggaaagggggagctccaatccctcgcaaatccgcaccatttcaccgaattcgaacgccttctctcccgcagatggaagctctgtccccgatttgtccatcctgagcagccaaaatcggttcttgccgcttcccgatctcggctagtgctcattccgcggatagttttttgttaaaagctgtggctttctcggttttggtcgcgggagcacgataatggcgggattctagcgcgctaaaccctaaagatcttggcttttctgcgcccaccgcgatggtgacggagatggcggcgcgcggcggcgaggcgttcggcgcggaggcggaccgggacttcgaggtcttccgcagcggctccgcgccgcccaccgtcgagggtgccatgggcgctgccaccgccgccggcagcctcttcctcgacgacgaggtccgcgccgacccggcctaccagagctactactactccaatgcgcacctcaacccgcgcctcccgccgccgctgctctccaaggaggactggcgctcctcgcaccaccgcctccgctcctccggccttggcgggatcggggacggcaggaggcagcagccgcaggcggcggctgccgaagggacggtggggctgcccgggatcgatcttggtcgccagaggagcttctccaacgtctttcaggaagactcataccaacgggatatggataggcagactgccaaccacaatagtaatgacttgctaggttcttctggaatacagtatggcctacatcgtggacctggagctatgggaggcctgcactctagtaataattcacgaggcttggatgaaattcagaacaatgatttatcatcaaatacatacgcttctattttagggtcacctctttctcgaagtgcatctccagatcctgagcttgtgaggagggcccctagtccatctctacctccaattggtgtgaaagttagtgctaatgacaagaagattaatggtggttcatcttctttccgtcgtagttcatctgctataggtgaacctgatgatcttatggcagctctatctgggatgagcttatcgtctaggacaatgagtgggcaaactatggaccagtctcagctctatcaggacgttgataatgtcaagaagtttctgttcgatcgacagggtgaccaagcaaatggcaatcagcagcactcctacatgagacgtcctgagcatggacagtctaaagtacctgatggctattcggcaaatttagccaattcatctacgatgagaaaccagattaatgctggcagtttcacatcatttgacaatttgtcacttggatctggctttgcttcccctgggattggttctagttcccctggagggactgtatcttctcgacaaaatttagctggtatgtctaacatgctaaactacagtggaattggaagtccgactgcatcaccttctcttcagactcctattgatccagcgtatatccagtaccttgctcaacttgcagctacctgtgatgatccactgatggacaggggccatgtggggaattcttacatggacttacttggtcctcagaaagctaaccttggccctttacttcagtcacaaaagcaatatggttactatggcaatcttggatttaaccttggttatggtggaagtccattgactagtcctgttctcccctcttcacctattgcaccaggcagtccgcttaggcatggtgatcgcaacatgcgctttccgtcaggaatgagaaactttggtagctcctttggttcatggaattcaggcatgggtgggaagatggatgccaatttgatgccctctcttctggaggaattcaagagcaacaaaagtaaatcgtatgaactctcagaaatagctggccatgttgttgagttcagtgcggatcaatatgggagtcggttcatacaacaaaagctagaaacagccagtactgaagaaaaagacatggttttttcagaaatcatgccccaagctctcacattgatgactgatgtatttggaaattacgttgttcaaaagttttttgagcatggaagcactgcccagataaaggaattggctggtcaacttattggacgtgtccttgctctcagtcttcagatgtatgggtgccgggttatacagaaggctatagaggtcgttgatttagatctgcagactaaaatggttgcggagctggagggacatgtaatgcgctgtgtacgtgatcaaaatggtaaccatgtaatacaaaaatgcatagagtgcattcctcagcatgctattgagtttattgtctcaacattctatggccaagttgtaatgctatccactcatccatatggttgtcgagttattcagagggttctggaacactgtgatgatcccaaaacacagcaaataatgatggatgagattctccagtctgtctgcttgcttgctcaggaccagtatggcaattacgttgttcagcatgttctggaacacggcaaaccccatgagagatctgctattattgagaagttaattggccaaattgtgcaaatgagccagcaaaagtttgcttcaaatgtcattgagaagtgcttagcctttggaaatcctgtagagcgccaggttcttattggtgagatgcttggatccactagtgaaagtgaacctcttgaggttatgatgaaagaccagtttgctaactatgtggtgcagaaggtgttagaaacttgtgatgatcagcagagagagatgatccttacaaggataaaaacacacctgaacaccctcaagaagtacacttacgggaagcacatagtagcacgcgtagagaaacttgttgctgctggagagaagcgccttgggcttcaaccagcatgcactgctgcctgaagggcaaatgatctagttgtacagctaacagttgctaggtttggactcacgttttttctctactgaaaaccttataaaagggccattttagccttgccggaaataaatactgtatgtctgcgccgaagagtgtacattaatcctttagctgaagaccccacgcagaatcaagggaggagtgatgcatgcaagtttgatctgcaagctgctgtaaagaggaggaagatggaggggagtaagaagcacgtttattactctgccgctgtacaaattaaatttagctctagagtgagagaaagtaagctgttagctgtctaaaagaaaagccgtctggttgtatctgttgatatagtagtggcttcctgttgtttggcctttgttgtaacataagcagaggcgcactagccttcttttacagttaagctgaattattagtaccagctttcctggactgtttggtatgtattatgacttgtttcttgtgctaatggagtctcatgtaatccaggtcgaagatgtgaatgtttcatttctagttttgcttgagacaaacatgatttccaaggtgatttataggcataggcagcatgcatatttcacaatgccacactcttggagatactttgttttttttggtcgatgagaa

SEQ ID NO: 3368 - DNA, 3847 bp, Oryza sativa
ctcttcttcttcttctcgcctcttctcttctcttctcttcccccacactctctcactagcttagcttagctaaaaaaaaagaagaataaataaactaaaatgggagcttgaatccctcccaaatccgcaccattacgcgcaatccgtacacctgctcgacccgcacatggacctttcttctccgattcgcccgctctgagcaaccgggatccgtttctgctgcccattttttgttctgtttttgtttttggtttcttgggggtggaaatcttggccatctttcttgcgactgaaatggcgggggttttagcttggtgagacactgtagatctcgtcgtcttttttgatttgggtttttcggatggtgacggagatggcgacgcgcggggaggcggcggcggcggcggcggcggaccgggacatggagctcttccggagcgggtccgcgccgccgacggtggagggcgcgatggccagcgccgccgcggccgccggcgacgtgttcctggacgatgagctccgggccgacccggtgtaccagagctactactactccaatgcgcacctcaacccgcgcctcccgccgccgctgctctccaaggaggactggcgctcggcgcagcaccgcctccgctcctccgccctcggcgggatcggcgacggcaggaggcagccggccgcggcggcgcagggggatgggctcgtggggttgcccgggatcgacctcgatcggcaggggagcttctccagtatcttccaggagagctcgtatcagctggacatgggtaagcagggcgccgaccgcaacagtagtgactttctggattcttctcggccacagtatgctctgcatcgtgagactagtagagctatgggtggtctgcagagtgacagcaatatacaaagcttggctgaagttcagaacaatgattcatcagcacatacatatgcctctcttttaggatcatctctttctagaagcgcatctccagatcctgagcttgttaggagggtccccagtccttgcctccctccaattggtgtgaaagtcagtgctgatgataagaagaacaatggtggttcatcttccttccgtcgaagttcgtctgctattggtgaatctgataatctgatagctgctttatctgggatgaatttatcatcatctggagcagctagtggacagcaaactgtgacccagtctgagctctaccaggatgttgataatgtccgtaagtttctatttgatcgtcagggtgatcaatcaaatggcaaccagcaacactcctacatgaaacatcccgaacaaggacattttaaggcacctgatggttactctgcaaactcgcctaattcttctatgataagaaatcaaattaatgctgctagtttcacatcgtttgacaatctgtctgctggatcaggctttgcttctcctaggatcggttctaggtccccaggtgggactttatcttcaaggcagaatttggttggtggatctaactttctgaattacaatggaattggaagtccaaatgcagcaacttctcttcaaacagccattgatccgtcatatattcagtaccttcaggcagctgagattgctgcccaactcgcagctagctgtgatgatcctctcatggccagtggccatctgggaagttcttatatggatttacttggtcctcagaaagcttatgctagtccattgcttcagtcacagaagaactgtggctactatggaaaccttggatttggccttggttattctggaagtcctttgatgagtcctgttcttccctcttcccctgctgcacctggtagtccacttaggcatggtgaacgcagcatgcgcatgcaatcaggtataagaaactttggtggttcctttggttcatggaatcctgacctaggtggaaagatgaacatcaatatgatgccttcactcctggaggaattcaagagcaacaaaagcaaatcttatgagctctcagaaattgctggtcatgttgttgagttcagtgctgatcaatatggaagccgattcatacagcaaaagctagaaacggccagtactgaagagaaggacatggtcttttcagaaatcatgcctcaagctctcacgttgatgaccgatgtatttggaaattatgttgttcagaagttctttgagcacggaagccctacccagataaaggaattggccgaccagcttattggacgtgttcttgctctcagtcttcagatgtatggatgccgggttatacagaaggctatagaggttgttggtttagatcagcagactaaaatggttgctgagctggatggacacgtcatgcgctgtgtacgtgatcaaaatgggaaccatgtaatacagaaatgcatagaatgcatccctcaacatgctatccagttcattgtctcaacattctatggtcaagttgtgatgttatccactcatccatatggttgtcgggttatacagagggtgctggagcattgtgatgatcctacaacacagcaaataatgatggatgagattctccagtccgtttgcttgctggctcaagatcaatacggcaactacgttgttcagcatgtactggagcacggaaaaccacatgagagatctgctattatcgagaagttaattggacaaatagttcaaatgagccagcaaaagtttgcctcaaatgtcattgagaagtgcttagcctttgggaatcctgtagaacgacagattttgatcggtgaaatgcttggatccactaatgagagtgaacaccttgaggtaatgatgaaagatcagtttgcaaactatgtggtgcagaaggtgctagagacttgtgatgatcagcagagggaggcgatccttacaaggataaaagcacatctgaacacgctgaagaagtatacctatgggaagcacatagtagcacgcgtagagaagcttgttgctgctggagagaagcgactagggcttcaaccagcatgcaccagtgccgcctgaagggcaagcaatgctgtacagctaacagtggctaggtttggtttgcactcacgttttcgttttttgcaactaaaaacgtaggccagtatggcctatttgagaaataataaaaatacgcatcttaaaatcgcttgcactggagagtgtatattatgtagttgaggagcacgccgcaggcagcagggatggatgatggattgagtgagtgagtgatgtgtgcaagtgctaatccaatatggaaggaagaagctgtaaagatgaggaggaagaagaagatgagtatacgtactctgctgtacaaattttatttagcactagagagatgaaaagaaaagagagaggaagctgttagctgtcaatatgagtgagtgatgggttgttgttgatgctgtaacataactagagtactactcagggcacaaaactagcctaagccctaagccttgtttttagtttttacagtttaagctgaagttattagtatcagctttgctgaactgtttgttaatttgttgtgtctgccgtgtcattgtgtgttgttaatccagtcatgtgtactgtactatggtgtaatgtaatgtaatccaggatgatgttgatgcactgttaattcggtgcaagtaagtttctttcttttacttgtctctgatctgatgatggaaagtgttatatatgtacttttgttttttattttgtgcttgaacatgcattactgttttctgtgcagattacgtgagttataggtgtcacaaaaaaaaaaggaggattgggcctgccacctgaaggcccatatcctgcccaccatgacagaaccacccggcatcagagaaagcatat

SEQ ID NO: 3369 - DNA, 1158 bp, Trifolium pratense
gatggcttcttctgagaattccgtcgaaagcaagagttctctcaccaagcttgctccacttgaagcagtgctctttgatatagatggaactctttgtgattctgatccactccactattatgctttccgtgaaatgcttcaggagattggtttcaatggaggtaatcctataacagaggagttttttattgctactgttgctggcaagcacaatgatgacattgccgcggatctctttcctggtgatcgggagcgaggtttaaagtttgtagatgataaggaagccatgtttcggagattagcggctgagcaactgaagcctttaaatggccttgctaaagtgaggaaatggattgaagatcgtgggttgaagcgggctgcagttaccaatgctccaagaccaaatgcagaactcatgctctcaatacttggtctcacagatttctttgaggctgttattattggtggtgaatgtgaacatgccaagcctcatccagaaccctacttgaaaggtcttgaagctctgaaagcatctaaggatcacacatttatatttgaggattctgtttcaggaatcaaagctggagtggctgctgggatgcctgttataggtatatctaccagaaatccagaggatttactgatgggagcaaaacctgcctttctgattaaggattatgatgatccaaaattgtgggcagctttggaagaacttgacaagtctggttctcattaaaattttgaattactagtgtcactgacaaaatttcttggtaaaaacaagtagcagttttcatattaaattaaattcaccagatcacctgtataagtttgttgcaggaggccaatattatttatactggtccataatcattgttgcttaggaatggagcaaacagtaatgttttaatttttactgtaataatgtgacttggctatgaaagttaacaccaaggaaattgcaggacgtgtgagagagagcggagggaggagggaattcaacacacttacattattcatatacttcagatagatcatgatttttgctcataactctttgtccgcatgttatttgatgatcaatactcattgccagcaactttgtgctattttaatttgtttgatatgcatagacaggggacaaatcacaaatatgat

SEQ ID NO: 3370 - DNA, 1040 bp, Trigonella foenum-graecum
gctaactttggtaaaccatccatggcttcttctgagaattctatcgacagcaagaattctctcatcaaacttgctccaattgaagccgtgctctttgatatagatggaacactttgtgattctgatccactccactattatgctttccgtgaaatgctccaagaggttggtttcaatggaggtaatcctataacagaggaattttttattgcgactgttgctggcaagcacaatgatgacattgccttggatctcttccctggtgatcgggagcaaggtttaaagtttttagttgataaagaagccatgtttcggagattagcggctgagcaactgaagcctttaaatggccttgataaagtgaggaaatggattgaagatcgtgggttgaagcgagctgcagttaccaatgctccaagacctaatgcagaactcattctctcaaaacttggtctctcagatttctttgaagctgttattattggtgatgaatgtgaacatgccaagccgcatccagaaccctacttgaaaggtcttgaagctctgaaagcatctaaggatcacacatttatatttgaggattctgtttcaggaatcaaagctggagtggctgctgggatgcctgttataggtatatctacccgaaacccggaggatttactgatgggagcaaagcctgcctttctgattaaggattatgatgatccaaaattgtgggcagctttggaagaacttgacaagtctggttctcattaaaattttgaattactagtccaattgacagaatttcttgataaaaacaagtagcagctttcatattaaattcactggatcacctgcataattttttgcaggggtcatattattatactagtccataattagtgttgctttgaaatcgagcaaacaatagttttatttgtatttgtaataatgtgatagttggttatgaaggtcaatgccaaggaattgcaatacgtgtgaaagagagtgagggaggaagggagggatttcaacactcttacataattcattatacg

SEQ ID NO: 3371 - DNA, 1120 bp, Trifolium pratense
gttctcgtctaaaaagtattaatcacttctctctctgtttcacatcacacacccgatggcttcttctgagaattgcgtcgaaaggaagagttctctcaccaagcttgctccactcgaagcagtgctctttgatatagatggaactctttgtgattctgatccactccactattatgctttccgtgaaatgctccaggagattggtttcaatggaggtaatcctataacagaagagttttttattgcgactgttgctggcaagcacaatgatgacattgccaaggatctctttcctggtgatctggagcgaggtttaaagtttgtagatgataaggaagccatgtttcggagattagcggctgagcaactgaagcctttaaatggccttgctaaagtgaggaaatggattgaagatcgtgggttgaagcgggctgcagttaccaatgctccaagaccaaatgcagaactcatgctctcaatacttggtctcacagatttctttgaggctgttattattggtggtgaatgtgaacatgccaagcctcatccagaaccctacttgaaaggtcttgaagcactgaaagcatctaaggatcacacatttatatttgaggattctgtttcaggaatcaaagctggagtggctgctgggatgcttgttataggtatatctatcagaaatctggaggatttactgatgggagcaaaacctgcctttctgattaaggattatgatgatccaaaattgtgggcagctttggaagaacttgacaagtctggttctcattaaaattttgaattactagtgtcactgacaaaatttcttggtaaaaacaagtagcagttttcatattaaattaaattcaccaggaggccaatattattatactggtccataatcattgttgcttaggaatggagcaaacagtaatgttttacttgtattttgtaataatgtgacttggctatgaaagttaattccaaggaaatctcacgatgtgtgagagagagtgagggaggagggaattcaacactcttacattattcatatactccggatagatcatgattcttgctcataactctttgtccgtatattatttgacgatcaatgctcatt

SEQ ID NO: 3372 - DNA, 1231 bp, Cicer arietinum
cataaagtaacgtatttataataactacctctctctctctctctcactcacatgacattcatacatacgaaccaaactttgggaaagcatatggcttcttcggagaatggcgtcgatagcaagagttctctcaccagacttgttccacttgaagcagtgctctttgatatagatggaactctttgtgattctgatccactccactattatgccttccgtgaaatgctccaagagattggtttcaatggaggtacccctataacagaggaattttttattgcaactgttgctggcaagcacaataatgacattgctttggctctctttcctggtgatttggagcgaggtttaaagtttctagatgataaggaagccatgtttcggagattagcgtctgaacaactgaagcctttaaatggccttgaaaaagtgaggaaatgggttgaaagtcgcgggttgaagcgagctgccgttaccaatgctccaagaccaaatgcagaactcgctctctcaaaacttggcctctcagatttctttgatgcggttattattggtgatgaatgtgaacatgccaagcctcatccagatccctacttgaaaggtcttgaagctctgaaggcatctaaggaccacacatttgtatttgaggattcggtttcaggaatcaaagctggagtagcggcggggatgcctgttataggtatatctacccgaaacccagaggatttactgatgggagcaaagcctgcctttctgattaaggattatgatgatccaaaattgtgggcagctttggaagaacttgacaagtctagttctcattaaaattttgagtggctagtgcaactgacagaatttcttggtaaaaacaagtagcagttttcatattaagttcattggatctcctgtgtaattttgttgcagggggaaatattattatagtagtccataatcagtgttagctttggagtcgagcaaacaatactgctttatttgtattttgtaataatgtgatagttggctatgaaggtcatgccaaggaaaatgcaataagtgaaagagagatggagatagggaggaatttcaacactcttacattattcattacttatatagattttgatttttgttcacaacactgtgtcagaatgttacttgatgattaatgctcagtgcaataaattttgtactttaaattcttttttatttatttcaaagcgtactttaaatt

SEQ ID NO: 3373 - DNA, 1660 bp, Trifolium pratense
ggcgttaacaagaagacattctttttgggcatcctgtaaataaaatagaacataaaaatcaacatgtgtgcataagaagctatacgtctcacaaaccacagtacataaagaactgatcaataagtatccctaaaaagtgcatctttcaacacaataatttcgaaagctacatttttcaacaaagaaaacatttaattctgattggagaagtcacactcatcccctgacgtatgcttaaatagcatcatcactcttattagtttatgacctccgtgttgtgtctgcagcaagagtactctcaccaagcttgctccacttgaagcagtgctttttgatatagatggaactctttgcgattctgatccactccactattatgctttccgtgaaatgctccaggagatcggtttcaatggaggtaatcctataacagaagagttttttattgcgactgttgctggcaagcacaatgatgacattgccaaggatctctttcctggtgatctggagcgaggtttaaagtttgtagatgataaggaagccatgtttcggagattagcggctgagcaactgaagcctttaaatggccatgataaagtgaggaaatggattgaagatcgtgggttgaagcgggctgcagttaccaatgctccaagagcaaatgcagaactcatgctctcaatacttggtctcacagatttcttcgaagctgttattattggtggtgaatgtgaacatgccaagcctcatccagaaccctacttgaaaggtcttgaagctctgaaagcatctaaggatcacacatttatattcgaggattccgtttcaggaatcaaagctggagtggctgctgggatgcctgttataggtatatctaccagaaatccagaggatttactgatggaagcaaaacctgcctttctgataaaggattacgatgatccaaaattgtgggcagctttggaagaacttgacaagtctggttctaattaaaattttgaattactagtgtgagtgtgactgacaaaatttcttggtaaaaacaagtagcagttttcatattaaattaaattcaccagatcacctgtataagtttgttgcaggaggccaatattatttatactggtccagaatcattgttgcttaagaatggagcaaacagtaatgttttatttgtattgtaataatgtgacttggctatgaaagttaacaccaaggaaattgcaggacgtgtgagagagagcggagggaggagggaattcaacacacttacattattcatatacttcagatagatcatgatttttgctcataactctttgtcagcatgttatttgacgatcaatgctcatttccggcatgttgtttgatatgcatagacagtggacaaatcacaaatgtgatgattattacaataccttgtgctttttgttttgcacaaaaagacacttagacaattaagttttggcattttaaaaatagttgaatatttgtgatgcaaattagttaatacttaatagtactattttttaaaatggagtcatccatttcttttgaaaaataaagaggatttcaacttatctgatagatgacaatcaacgctgctatatggcatgacagccaatagcacgactattgcacgagcgtgttttatttcttt

SEQ ID NO: 3374 - DNA, 1116 bp, Lotus japonicus
cattattcttgctgcaaagccaagtgccaaggaagtaactacctccatctccatccatctctctctcgctctcctttcatctggcaggtaaaccatgacggcttcttctgcgaatcgcgttgaaagccagagttctctcacaagacttgctccgcttgaagcagtgctctttgatatagacgggaccctttgtgattctgatcctctccactattatgcttttcgtgaaatgcttcaggagattggtttcaatggaggtgttcccataacagaggaattttttattgagactgttgctggcaagcacaatgatgatattgcagcggctctctttcccggtgacctggaacgaggtttgaagtttgtagatgataaggaagccatgtttcggagattggcggctgagcaagtaaagcctttaaatggtcttgataaagtgaggaaatggatcgaagatcgtggattgaagcgagctgcagttactaatgctcctagagcaaatgcagaactcatgctctcaatattaggtctcacagatttctttgaggctgttattattggtggtgaatgtgaacatgccaagcctcatccagaaccctacttgaaaggtcttgaagctctgaaggcatcaaaggatcacacatttgtatttgaggattctgtctcaggaatcaaagctggagtggcagctgggatgccagttataggtatagctacccgaaacccagaggatttactgatggaagcaaagcctgcctttctgataaaggattatgccgatcctaaattgtgggcggctttggaagaacttgacaagactaatgcttcttagaattttgaattacactgacacaattcttagtaaagcaattaagtagcaagtttcatattgaagtcacaggatcagctgcataatattgttgtagggacgatatcacaatactagttcattaacaatgttgctttgaaaaggcaaacaattatattctataagcgatttgtaataatttcattgttggctatgaaatcgcgggccgagaccaatgaaatagcaatacatatgtgtactatttttttatactctataaaatattagaatcacatctataacaaata

SEQ ID NO: 3375 - DNA, 1210 bp, Cajanus cajan
aagaataacatgaggagtgatgttatgtaaatatatatgcctcttctttttttctttctctctataccacaggcacggccttcaccaataaatctatgacggcttcttctgaaaattgcatctcaagccagagttctcttaccaaactcgctccacttgaagcagtgctctttgatatagatggaacactttgtgattctgatccgctccactactatgccttccgtgaaatgcttctagagattgggtttaatggaggtgttcctatagatgaggaattctttattgagactgtagctggtaaacacaatgatgatatagccttggctctctttcctggtgatcttgaacgaggtttaaagtttgtagatgataaggaagccatgttccggagattggcagcagagcaattgaagcctttaaatggccttgacaaagtgaagaaatggattgaaaatcatgggttgaagagagctgcagttaccaatgctccaagagcaaatgcagaactcatgatctcactacttggtctctcagatttctttgaggctattattattggtggtgaatgtgaacatgccaagcctcacccagacccctacctgaaaggtcttgaagctctgaaggcatcaaaggatcacacatttgtatttgaggattctgtttcagggatcaaagctggagttgcagctgggatgcccgttattggtttagctactcgaaacccagaaagcttattgatggaagcaaagcctgcctttctgattaaggattatgatgatccaaaattgtgggctgctttggaagaacttgacaaggctggtgccccttcggtttgaattattagtgcaactgacagaatttcatgataaaaacaagtagaaggattcatattaaattcacaggttcgcctgcataattttgttgtaggtgggccacattataatattagtccataattgttgttgctttgcaaccgagagcaaacagttatattctatttgtatttgtaataatgtcattgtttagttatgaacccgtgggtctagccaatgaaattgcagtgtccgagtgtaacatttttatactttacagaatccaatccctcgcaaataatttagagtatataatttacattaagtgctcatatttgttagacgagagtgcagtgaaataagaggactccttacattagttagcaatgcaaaaa

SEQ ID NO: 3376 - DNA, 928 bp, Lotus japonicus
gagagcttcttctgagaattgcgttgaaagtaagaattttctcaccaaacttgctccacttgaagcagttctctttgatatagatggaactctttgtgattccgatcccctccactacgatgctttacgtgaaatgctccaggagattggttttaatggaggtattcctattacagaggagtttttcattaagaactttgctggcaagcacagtaatgatacagccttgtttgtttttcctggtgatcttgaacgaggtttaaagtttgtagaagaaaaggaagccatgtttcggagattggcggctgagcaactgaagcctttaagtggtcttgataaagtgatgaaatggattgaaaatcatggattgaaacgagctgccgttaccaatgctccaagagaaaacgcagaactcattatctcaaaacttggtctctcatatttctttgatgctgttattcttggtgatgaatgtgaacatgccaagcctcatccagaaccctatttgaaaggtcttgaagctctgaaggcatcaaagaatcacacatttgtatttgaggattctgtgtcaggaatcaaagctggagtggcagctgggatgcctgttataggtttagctacccgaaaccccgaggatttactcatggaagcaaagcctgcttttctgattaaggattatgacgatccaaaattgtgggcagctctggaagaacttgacaatgctggtactagttaaaattttgaattactagtgcacaaaatgtattcaagtagcgtgttcatcgtaaagttaaaggatcatgagaataatgtttataagggttggcattataatactagtccttaatcaatgttgcttttgaaagagagagcaaacagtcgtatacttatattctgtttgtgttttgtaataatatcattttttgct

SEQ ID NO: 3377 - DNA, 1191 bp, Glycine max
actttctttatgcttttttggcagattccattacattaacattaacatgctcaactgactcttccctttctccgtttcctctgttctttctctctctctctctctgtacacaccacatctttcagtttcactaacaatgacggtttcttctgagaattgcgtctctagccagagttctctcactagacttgctccacttgaagcagtgctctttgatatagatggaactctttgtgattctgatccactccattactatgccttccgcgaaatgcttctagagattggttttaatgaaggtgttcctataacagaggaattttttattgagactgttgctggcaaacacaatgatgatatagcctcggttctctttcctggtgatctggaacgaggtttaaagtttgttgatgataaggaagccatgttccggagattggccgcagagcaagtgaagcctttgaatggccttgataaagtgaggaaatggattgaaaatcatgggctgaagagagctgcagttaccaatgctccaagggcaaatgcagaactcatgatctcaatacttggtctctcagatttctttgatgctgttattattggtggtgaatgtgaacgtgccaagcctcatccagacccctacctgaaaggtcttgaagctctgaaggcatcaaaagatcacacatttgtatttgaggattctgtttcagggatcaaagctggagttgcagctgggatgcctgttattggtatagctactcgtaacccggaaaatttattgatggaagcaaaacctgcctttctgattaaggattatgaggatccaaaattgtgggctgctttggaagaacttgacaaggctggtgcatttagtttgaattactagtgcaactgacataattttctgataaaaacaaatagcgggattcatattaaattcataggttagcctgcataattttgttgtaggtggcccccattataatactagtccataattagtgttgctttgcaacctagagcaaatagttatattctatttgtattttgtaataatgtgattgttatctatgaacccgcatggtcaaggcaaggaaattgcagtgcccaagtgtactattgtttttactttacaaaatcaaatccctcacaaataatttacggtttatattttttgtagggtcaatgcat

SEQ ID NO: 3378 - DNA, 1177 bp, Phaseolus vulgaris
ggcatatccgccatttattattcttgttatgcttttgtgcagattcgattcgattccattaacatgctattgttattgaaattgcgcacgtgactctttctgctttctctctttcatacctacctttctcttctttctctgcattcagttacaatgactgcttcttcagattgcatctccagccagagttctctcaccagacttgctcctctcgaagcagtgctctttgatatagatggaacactctctgattctgatcctctccactaccatgccttccgtgaaatgcttctagagattggttttaatggtggtgctcccataaccgaggaattctttattgaaactgttgctggcaaacacaatgatgatatagccttggctctctttcctgatgatctgccacgaggtttaaagtttgtggaagataaggaagccatgttccggaaattggcagcagagcaactgaagcctttgaatggccttgataaagtgaggaaatggattgaaaatcgtgggttgaagagagctgcagttaccaatgctccaagagaaaatgcagagctcatgatctccgtacttggcctctcagatttctttgaggctgtcattattggtggtgaatgtgaacatgccaagcctcatccagacccctacctgaaaggtcttgaagctctgaaggcatcaaaggatcacacatttgtatttgaggattctttttcagggatcaaagctggagttgcagctgggatgcctgtcattggtttggctactcgaaatccagaaaatctattgatggaagcaaaacctgcatttctgattaaggattatgatgatgcaaaattgtgggctgctttggaagaactagacaaggctagtagcactctttcagtttgaattactagtgcaactcgcagaatttcttgacaagaacctgtaggggtattaaattcataattcataggttcgcctgcataatattgttgtaggtggccacattataatacaagtccattattagtgtttgcagcaacaaatctttcttgtaataatttcattgctagctatgaactcgtgggtcaagccaaggaaagtgcaatgtgcgcaagtgtatcctcaaataattcataatttacataaagtaacaagactgaatatttaatttttaagtctctta

SEQ ID NO: 3379 - DNA, 1138 bp, Lupinus angustifolius
attcacagtacttgttgtttattaccttcatgttgtggcagcatcaagagttctctcaccaaacttgctccacttgaagcagtgctgtttgatatcgatggaactctttgtgattctgatccattccactaccaggctttccgcgtgatgctccaagagattggtttcaatggaggtgttcctataacagaggaattttttattgcaactgctgctggcaagcacaacgatgatgttgcattggctctctttcctgatgatatcgaacgaggtttaaagtttctagaggataaggaagccatgttccggaaattggctgcagagcaagtgaagcctttgagtggtcttgataaagtcaggaaatggattgaagatcgtgggttgaagcgggctgctgttaccaatgctccaagaccaaatgcagaacttctgctctcagtacttggtctctcagatttttttgaagctgttattattggtgatgaatgtgaacatgccaaacctcatccagatccctacttgaaaggtcttgaagctctaaaggcatcaaaggatcacacacttgtatttgaggattctgtttcagggatcaaggctggagtagcagctgggatgcctgttataggtttagcaacccgaaacccagagcatttactgatggaagccaagcctgcttttcttattaaggattatgaggatccaaaattgtgggcagctttggaagaacttgacaaggctggtgcacattaagtttgagttactagcttaactggcgaaatttcttacaaagacaagtagcaggttaaataagttgcaaatatgcccttgtcattaacttgctgcaagtactattactaaggggtgcacatcggttgaagatgaattactagctcaactgacaaaatattttgataaaaaagagtagcaggttttatgcaaaattcaattctgggattccatgatcctgtttgttgaaatgtgtataatgggttgcaggcagagaaattattaattggtcttgatcactaagtcaatctcttgtattaatttataaatataacaatactaattaagcctcaagtttactatgtgggatgagttgaatcataacacaaatatttagtctttttttttggca

SEQ ID NO: 3380 - DNA, 884 bp, Arachis hypogaea
attgatccgttcccgttttttctcacttccaacaaacttttctattgcctttctgattcttacaaccatgaccgtctcctctgaaagcaagaattctctcacccaactagctccacttgaggcagtgctctttgatatagatggaactctctgtgactctgatccactccactactacgctttccgtgaaatgctcaaagagattggtttcaatggaggtgttcctataacagaggaatttttcattgagactgttgccggcaagcacaatgatgatattgccttggctctctttcctggtgatcttgaacgaggcttaaagtttgtagatgacaaggaagacatgttccggaaattggcaaaagagcaagtaaagccattgaatggccttgataaagtgagggaatggattgaaagtcatgggctgaagcgagcggcagtgaccaatgctccaagagctaatgcagaactcatgatctcattgcttggtctctcagacttttttcatgctgtcattattggtggagaatgtgaacatgccaagcctcatccagacccctacttgaaaggtcttgaagctctgaaagcatcaaaggatcactcatttgtatttgaggattctgtttctgggatcaaagctggagtggcagctgggatgcctgttgtaggtttagctactcgaaacccggagcatctactgatggaagcaaagcctgcctttctgattaaggattatgcagacccaaaattgtgggaagctttggaagaacttgacaaggctggtactaaaaaagtatgaagagtacaactgaaagaatatattggtaaattcaagtagctggtttgatctaataagctcacatgattacctctataattttgtt

SEQ ID NO: 3381 - DNA, 978 bp, Vigna unguiculata
ggatgctattgccattgaaattgttcacgtaactctttctgttctctctctactcctcttctttctctgcattcagtaacaatgactgcttcttcagagaattgcaattcaagccagagttctctcaccaaacttgctcctcttgaagcagtgctctttgatatagatggaactctctgtgattccgatcctctccactaccttgccttcagtgaaatgcttcaacagattggtttcaatggtggtgctcccataaccgaggaattctttattgagattgttgctggcaaacacaatgatgatatagcacggtctctctttcctgatgatctgccacgaggtttaaagtttgtggatgataaggaagccatgttccggagattggcagctgatcaactgaagcctttgaatggccttgataaagtgaggaaatggatcgaagctcgtgggttgaagagagctgcagttaccaatgctccaagagcaaatgcagagctcatgatatccttacttggcctctcagatttctttgatgctgttattatcggtagtgaatgtgaacatgccaagcctcatccagacccctaccttaaaggtcttgaagctctgaaggcatcaagggatcactcatttgtatttgaggattctttttctgggatcaaagctggagttgcagctgggatgcctgttgttggattggctactagaaacccagaaaatcttttgatggaagcaaaacctgcatttctgattaaggattatgatgatccaaaattgtgggctgctttggaagaacttgacaaggctagcagtgctccttcagtttgaattactagtgaaactggcagaatttatttctctttcttagcaataatttcattgctagctagctatgaacccgtgggtcaagccaaggacattgtagtgctaaagtgtaccgtagtttttgctcaacataatcaaatccttcaaataatt

SEQ ID NO: 3382 - DNA, 1267 bp, Cajanus cajan
attaagagagcaatggtggtaccttttcatgagcttgaaacaacggatggtagccagtgagattcattttggcagattcgataagtactatgcttcttctcgtgaagtaaaactttgtcctccacaaattcacctcgcttgcgtcaaaacaaattttaaacaaacagtcacgaaggcttgttctcagaattgcgtcgaaagcatgagttctctgactagactggctccactcgaggcagtgctctttgatgtagatggaactctttgtgattctgatccactccactactatgctttgcgtgaaatgctccaacagattggttttaatggtggtgctccaataacagaggagtattttattgagactttttctggcaaacacagcgatgatactgccttgattgtctttcctggtgatctggaacgaggtttgaagttcgtagaagataaggaagacatgttccggagagtggcagcagatcaactgaatcctttgaaaggccttgataaagtgaggaaatgggttgaaaatcatggtctgaagagagctgcagttacaaatgctccaagagcaaatgcagaactcatgatctcaaaacttggtctcttagatttctttgatgccgtaattattggtgatgaatgtgaacatgccaaacctcacccagacccctacctgaaagctcttgaagttctgaaggcatcaaaggatcatgcatttgtatttgaggattctgtttcagggatcaaagccggggtagcagctgggatgcctgttataggtttagctactcgaaacccagagcatttgctgatggaagcaaagcctgcctttctgattaaggattatgaggatccaaaactgtgggcagctttggaagaacttgacaaagctggtgcgcgttaaatttgaattactagtgtgactgacagaatttcttcataaaattataaaaatatgtagcaaggagtttcatattaaattcccggcttccctaaaataattttgttctggggggcattataatactagtccttgaataaataaaaaaaaatatattaatccacaatcaatcttgctttgggaaccattattaggatttaccttaatgatggtggttgagataatatacatgtgatactaagtttgagtcctattatcatcattgtgattcctatggataaaaaaaaaatcttgctttagaacaaatgacaaatactcttattttatttgtactttttgtacataaaaacaataggacagaaa

SEQ ID NO: 3383 - DNA, 2423 bp, Trigonella foenum-graecum
atcttcattgctacgttgagttcacaattcagatctctttcgccaaaaatcaatgatttggcgttgaatgcatcattagagtgttaattaatcaaatgcaaatggaattagcaactatgagaatgagaaaatctttgatttgttggatttgttttttggttattgggtttgttcaaattagcaaaagcaatggtttttatcttcctggaagttacatgcatacatatgcaaatggagatccaatatatgccaaagttaattcattgacttctattgaaactgagttaccctttagttactatagtcttccttattgtcagcctctcggcggcattaagaaaagtgccgagaatctcggtgagcttctaatgggtgatcagattgataactcgccgtatcttttcaaaatgaatgttaatcagtcgagttatttatgtactacggcaccgttgaatgagcatgaggttaagctgtttaaacagagaacccgcaatttgtatcaggtgaatatgattcttgataatttgccggttatgagatttgcgaatcaaaatggggttaagattcagtggacggggtttcctattgggtatacgccgtctgatggaagtgctgattatgttattaatcatcttaagtttacggttttggttcatgaatatgaaggaaatggtgttgagattattggtactggcgaggaaggtatgggtgttattgctgaaagtgataagaagaaggaatctggatttgaaattgttggttttcatgttgttccttgtagtgttaaacgcgatccggaagttatgacaaagctacatatgtatgataatatttcttcgacaaactgtcccaatgagttggagaagtatcaaccgataagagagcaagagaggatatcgtttacttatgaagttgaatttgtcaaaagtgatataagatggccgtctcgttgggatgcttatctaaagatggagggttcccggtgcattggttctcgattctaaattcacttatggtgattttttcctagccggtattgtttttgtcattttcttaagaacagtgagaagggacttggcaaggtatgaggaattggacaaagagacacaggctcagatgaatgaggagctttctggatggaagcttgttgtgggtgatgtatttagggaacctggttgctcaaagcttctctgtgtgatggttggagacggggttcagattctcggaatggctggtgttactattgtttttgcagccctgggtttcatgtcaccagcttcccgaggaatgctacttacagggatgataattttgtatcttttccttgggattgcttccggatatgtaagtgtacgtctctggaggacaattaagggaacttcagaagggtggaggtccatttcctggtttgctgcatgcttttttcctggaatttcttttacgattctaacagcactgaattttgttctctggggaagcaagagtaccggcgctattcccatctccttgtatttcgagttgtttttcctctggttctgcatttcagtgccactcactctcattggaggatttctggggacaaaagctgagcaaattgaatatcccgtgcgaactaaccagattccaagagaaattccggcacgcaaatatccatcgtggcttcttgttcttggtgctggaactcttccatttggaacccttttcattgaacttttctttatcctttctagcatctggcttgggaggttctattatgtttttggtttcctgttggttgttcttttattgttgattattgtctgtgctgaagtgtcggtggtcctcacatatatgcatctctgtgtcgaagattggcggtggtggtggaaggcatactatgcatcaggctctgttgccgtttatgtctttttgtactccattaactacttggttttcgacttgcagagtttgagcggacctgtctctgctatactttatattggctattcgctgctcatggcaattgcaatcatgctgtcaactggaaccattggtttccttgtctcattctactttgtgcattacttgttctcatcagtgaagatagattaagggtggtgatctctttgctatctctcatcaactgaacaaaaggcatgctggagggggaattttctcaattgatatggcttctgcttgattctttttgtagctcgattgctttgcggcatattgagtaggggaaaacagatgctttgcttatcgcgttaaatagttgtctaataattttttattgcaatgtaatctgcactttgttccccttcaactagcgtttttatacctaccattttgtttcatgcgctttagtttagtcaagttacttgaggaagttgtaattgcttaaattctgataaccaaaattaatgttacttttggatttcttc

SEQ ID NO: 3384 - DNA, 2337 bp, Trifolium pratense
aaacagcttctcttgcatggaattagcaactatgagaatgagaaaccctttgatctgctggatttttgtcgtcgttgcgtttgttcgaattagtaatgctttttatttacctggaagttacatgcatacttattcaaatggagattccatatttgcaaaagttaattcattgacttctatcgaaaccgagcttccgtttagttactatagtctgccttattgccagcctctcggcggtattaagaagagtgcagagaatcttggtgaactccttatgggagatcagatcgataattctccgtacctttttaaaatgaatgttaatcagtcaacttatctatgtactactccgccattgaatgagcatgaggttaagctattgaaacagagaactcgcgatctctatcaagtaaatatgattcttgacaatttgcctgttatgaggtttgcgagtcaaaatggggttaagattcagtggacggggttccctattgggtacacaccgtctgatggaagtgctgattacattattaaccatctcaagtttacggttttggttcatgaatatgaaggaaatggtgttgagattatcggtactggggaggaaggtatgggtgttattgctgaaagtgataagaagaaggaatctggttttgaaattgttggttttcatgttgttccttgcagtgtcaaacgcgatcctgaagttatgacaaagctccatatgtatgataatatctcttcgataaactgtccatctgagttggacaagtatcaacctataaaagagcaagagaggatatcatttacatatgaagttgaatttgtgaaaagtgatataagatggccgtctcgttgggatgcttatttaaagatggagggttcccgggtacattggttttcaatcctaaattcacttatggttatctttttcctagccggtattgtttttgtcattttcttaagaacagtgagaagggacttggcaaggtatgaggaattagacaaagagacacaggcacagatgaatgaggagctttctggatggaagcttgttgtgggtgatgtatttagggaaccttgttgctcaaatctcctctgtgtgatggttggagatggggttcagattcttggaatggctgctgttactatagttttcgcagccttgggtttcatgtcaccagcttcccggggaatgctactaacagggatgataattttatatcttttcctggggattgcttccggatatgtaagtgtacgtctttcgaggaccattaagggaacttcagaagggtggaagtcgatttcctggtttgctgcatgcttctttcctggaattgcttttacgattctaacagcactgaattttgttctctggggtagcaacagtactggcgctcttcccatttccttgttttttgagttgttcttcctctggttctgcatttcggtgccactcaccctcattggaggatttctggggacaaaagctgagcaaattgaatatcccgtgcgaactaaccagattccaagagaaattcctgcacgtaaatatccatcatggcttcttgttctcggtgccggaacacttccatttggaacccttttcattgagcttttctttatcctttctagtatctggcttgggaggttctactatgtatttggtttcctgttggttgtgcttttattattaactattgtttgtgctgaagtgtcagtggtcctcacatacatgcatctctgtgtcgaagattggcgatggtggtggaaggcattctatgcatcaggctctgttgctctttatgtctttttgtactctattaactacttggttttcgacctgcagagtttgagtggacctatctctgctatactttatattggctattcgctcctcatggcaattgcaatcatgctgtcaactggaactattggcttccttgtctcattctacttcgtgcattacttgttctcatccgtaaagatagattaaggctgatatctttgctatctctcatcaactgaacaaaaggcatactggaagtggaagggggatttttctcaattgatataacttctgcttgattatttttgtaactcgattgctttgcagcatattgagtaaggaaaacagatgctttgcttattgttaaatagttgtcaaatgattttatattgcaatgtaatctgcactttgttccccttcaactatcgtttttataccattttgtttcatgtactttagtttagtcaagttgcttgaggaagttgtaattgctcagactgtctactcccttattcatttcaattatgataacaaaaattaaacag

SEQ ID NO: 3385 - DNA, 2499 bp, Trifolium pratense
ctcttttcttcgcaacaaatcgtaattctccattttccaccttctacgttcatttcagaacaattcagatctctttcgccaaaatcaatgatttggcgttgaatgcaacataaaagttagcttaatattcaaatttcaaacagcatctcttgcatggaattagcaactatgagaatgagaaaccctttgatctggtggatttgtattttcgttgtcgttgcgtttgttcgaattagtaatgctttttatttacctggaagttacatgcatacttattcaaatggagattcaatatatgcaaaagttaattcattgacttctatcgaaaccgagcttccgtttagttactatagtttgccttattgcaagcctctcggcggtattaagaagagtgccgagaatcttggtgaacttcttatgggagatcagatcgataactctccgtaccttttcaaaatgaatgttaatgagtcaagttatctatgtactactccgccgttaaatgagcatgaggttaagctgttgaaacagagaagtcgcgatctctatcaagtaaatatgattcttgacaatttgcctgttatgaggtttgctagtcaaaatggggtgaagattcagtggacggggtttcctattgggtatacaccgtctgatggaagtgttgattacattattaaccatcttaagtttacggttttggttcatgaatatgaaggaaatggtgttgagattatcggtactggggaggaaggtatgggtgttattgctgaaagtgataagaagaaggaatctggttttgaaattgttggttttcatgtcgttccgtgtagtgtcaaacgcgatcctgaagtcatgacaaagctccatatgtatgataatatctcttcgataaactgtccctctgagttggacaagtatcaacctataaaagagcaagagaggatatcatttacatatgaagttgaatttgtgaaaagcgatataagatggccgtctcgttgggatgcttatttaaaaatggagggttcccgggtacattggttttcaatcctaaattcacttatggttatctttttcctagccggtattgtttttgtcattttcttaagaacagtgagaagggacttggcgaggtatgaagaattggacaaagagacacaggcacagatgaatgaggagctttctggatggaagcttgttgtgggtgatgtatttagggaaccttgttgctcgaatctcctctgtgtgatggttggagatggggttcagattcttggaatggctgctgttactattgttttcgcagccttgggtttcatgtcaccagcttcccggggaatgctactaacagggatgataattttatatcttttcctggggattgcttccggatatgttagtgtacgtctttcgaggaccattaagggaacttcagaagggtggaaatcgatttcctggtttgctgcatgcttctttccgggaattgctttttcgattcttacagcactgaattttgttctctggggtagcaacagtactggcgctcttcccatttccttgttttttgagttgttcttcctctggttttgcatttcggtgccactcaccctcattggaggatttctggggacaaaagctgagcaaattgaatatcccgtgcgaactaaccagattccaagagaaattcctgcacgtaaatatccatcatggcttcttgttctcggtgccggaacacttccatttggaacccttttcattgagcttttctttatcctttctagtatctggcttgggaggttctactatgtatttggtttcctgttggttgtgcttttattgttgactattgtttgtgctgaagtttcagtggtcctcacatacatgcatctctgtgttgaagattggcggtggtggtggaaggcattctatgcatcaggctctgttgctctttatgtctttttgtactccattaactacttggttttcgacctgcagagtttgagtggacctatctctgctatactttatattggctattcgctcctcatggcaattgcaatcatgctgtcaactggaactattggcttccttgtctcattctactttgtgcattacttgttctcatccgtaaagatagattaaggctatatctctgctatctctcatcaactgaacaaaatgcatactggaagtggaagggggatttttctcaatagatataacttctgctcgattatttttgtaacttggtttgctttgcagcatattgagtaaggaaaacagatgctttgcttattgtgttaaatagttgttagatgattttatactgcaatgtaatctgcactttgttccccttcaactatcgtttttataccattttgtttcatgtactttagtttagtcaagtttcttgaggaagttgtaattgctcaaactgtctactcccttattcatttcaattatgataacaaaaatcaaacagttacttatacaaaaaag

SEQ ID NO: 3386 - DNA, 2670 bp, Cicer arietinum
attgtttttccttcgtaaatcgtaattcccattcccaaccatcttcgttttccatttccacccgctacgttcagttcacaattcaattcagatctctttccccaaaatcaatgatttggcgctgaatacatcattagagttattagcttaatattctccaaaatctctttgcatgaaagcaaatggaattagcaactatgagaatgagaaaacctttgatctggtggatttgtcttttcttcttcgtcgcgtttgttcaaattcaaattaccaatgctttttatcttcctggaagttacatgcacacttactcaaatggagatcccatatatgccaaagttaattcattgacttctattgaaactgaacttccatttagctactacagtctcccttattgtcagcctctcggcggcattaagaagagtgccgagaatcttggagagctccttatgggagatcagatcgataattctccttacctttttcggatgaatgttaatcagtcaatttacctttgtacaacaacctcattgaaggagcatgaggtcaagttattgaaacagagaactcgcgatctttatcaagtaaacatgatccttgataatttacctgttatgagatttgccaatcaaaatgggattaagatccagtggacggggtaccctattgggtacacgccgcctgatggcaatgctgattatattattaaccatctcaaattcacggtcttggtacatgaatatgaaggaaatggtgttgagatcattggtactggggaggaaggcatgggtgttattgctgaaactgataagaataaggcatctggatatgaaattgttggttttcatgttgtcccttgcagtgtaaaacgtgatcctcaagtcatgacgaagctccacatgtatgacaatatctcttccataaactgcccctctgagctggacaagtatcaaccgataaaagagcaagagaggatatcatttacatatgaagttgaatttgtgaaaagtgacataagatggccatctcgttgggatgcttatttaaagatggagggtgctcgagtacattggttttcaatcctcaattcacttatggtgatttttttcttagccggaattgtttttgtcattttcttgagaacagtgagaagggacttggcaaggtatgaggaattggacaaagagacacaagctcaaatgaatgaggagctttctggatggaagcttgttgtgggtgatgtatttagggagccttgttgctcaaagctcctctgtgtgatggttggagatggggttcagattcttggaatggctggtgttactattattttcgcagccctaggtttcatgtcaccagcatcccgaggaatgctactaacagggatgatacttttatatctattcctaggaattgcttccggatatgtaagtgtacgtctctggaggaccattaagggaacttcagaagggtggaggtcaatttcctggtttgctgcatgcttttttcccggaatcgcttttacaattctaacagctcttaattttgttctctggggaagcaacagtactggcgccctcccgatttccttgtattttgagttattcttcctctggttctgcatttcagtgccactcaccctcattggaggatttatggggacaaaagctgagcaaattgaatatcctgtacgcactaatcagattccaagagaaattcctgcacgtaaatatccatcatggcttcttgttcttggtgccggaactcttccatttggaacccttttcattgagcttttctttatcctttctagtatctggcttgggaggttctattatgtatttggtttcttgttggttgttcttctattgttgactattgtttgtgccgaagtgtcagtggtcctcacatatatgcatctctgtgtcgaagattggcggtggtggtggaaggcattctatgcatcgggctctgttgctctttatgtctttttgtactccattaactacttggttttcgacctgcagagtttgagtggacctgtctctgctgtactttatctcggctattcgctgctcatggcaattgcaatcatgctgtcaactggaactattggcttccttgtctcgttctattttgtgcattacttgttctcatcagtaaagatagattaaggttgatttatttgctatctctcatcaactgaacaaaagacatgctagaaggggaatattctcaattgatataacttttgcttaattctttttgtagctcaaatgctttgcggcatattgagtagggaaaacagattatttgcgtattgcattaaatagttgtcaaatgattttatattgcaatgtaatctgtactatgttccccttctatctgtcttttgtgagtggtttattcattcaactagcttttttataccattttgtttcatgtgctttagtttagtcaagttatttgaggaagttgtaattgctcagaccgtctcataccttattcatttcaattctgataacaaacattaatcggttacttctagatttatgttcttctgtgtgtataattttgctcctcttcaaggataagaagagtgactttttagttgcctgtattttgctaccttaattatattattattattgttgattattgactcgg

SEQ ID NO: 3387 - DNA, 2599 bp, Cajanus cajan
atttccatctccatctgcatctgcatctgcatctgctacgttgtgttgagcattgagatctgtatcgccaaaatccatgatttcgtgttgaatgcatcgtcagagttaggttatttttcgacatttgcttgctgataaatggaggtgccaactaggagaaaaccgttgatctactggctttgcctttccgtcattgtcaatgtgtttgttcaattcagcaatgcattttatcttccgggaagctacatgcacacttactcaaatggagatcagatatatgcgaaggttaattcattgacttctattgagactgagcttcccttcggctactacactctcccttattgccagccccttggtggcgtaaagaaaagcgctgagaatctcggagaactcctcaggggagatcagatcgataactctccctaccttttccgaatgaatgttaaccaatcaatctacctctgtactacgaaccccttgaatgagcacgaggtaaagctactgaaacataggactcgtgatttgtatcaagtaaatatgatccttgacaatttgcctgttatgaggtttgccaatcaaaatggggttaaaatccagtggacggggttccctgttgggtacacaccgcctgatggtagtgcagattacatcattaaccatctcaaattcacagtcttggttcatgaatatgaaggaaatggtgttgaaatcattgggactggggaggaaggtatgggcgttatttctgaagctgacaagaagaaggtatccggatatgaaattgttggctttcaggttgtcccttgcagtgttaagcgtgatcctgaagccatgacaaagcttcatatgtatgacaatatctctgtgacaaactgcccagctgagctagacaagtatcaaccaataagagagcaagagaggatatcatttacatacgaagttgagtttgtgaaaagtgatataagatggccatcacgttgggatgcttatttaaagatggagggttcccgggtgcattggttctccattctaaattcacttatggtgatttttttcttagctggtattgtctttgtcattttcttgagaactgttagaagggacttgacaaggtatgaggagttggacaaagaggcacaggcacagatgaatgaggagctttctggatggaagcttgttgtgggtgatgtatttagagagcctgatcatccaaagcttctctgtgtgatggttggggatggagttcagattcttggaatgtctgctgttactattgtttttgcagccttgggtttcatgtcaccggcttccaggggaatgctactaacagggatgataattttatatcttttcctgggaattgctgctggatatgtcagtgtacgtctatggagaaccattaagggaacttcagaagggtggagatcgatttcctggtcatctgcatgcttttttcctggaattgcttttattattctaacagcactgaattttcttctctggggcagcaaaagcactggtgctattcccatttccatgtattttgagttgctcttcctctggttctgcatttcagtgccacttacactcattggaggatttatgggcacaaaagctcctcaaattgattatcctgtgcgaactaaccagattccaagggagattcctgcacggaaatatccatcatggcttcttgttcttggtgcaggaactcttccatttggaacccttttcattgagcttttctttatcctctccagtatctggcttgggagattctattatgtatttggtttcctgttggtagttcttctattgctggttattgtttgtgctgaagtgtcagtggttctcacatatatgcatctttgtgtggaagattggcggtggtggtggaagtcattctttgcttcaggctctgttgctctttatgtcttcttgtactccattaactacctggttttcgaccttcagagtttgagtggacctatctcagctatactttatcttggctattcactgctcatggccattgcaatcatgttgtcaaccggaaccattggcttccttatgtcattttactttgtgcactacttgttctcatcagtgaagatagattgaagttcgctttgctatctctcaccaactaagcaaaatgcatgctggaagaggaatttttcttaatcggtataacatttgcttaattcttttgtagtttgatttctttgcagcatattgagtggggaaatagatgccttgctgattgcagtaaatagttgtgatcaattttatgttgctatgcaaactacagtttgttcccctttcaacatgtctatcgtaagtggtttactcattcaactagtgtttggtatcattttgtttcatgtgatttagttttgtcaagtttcttgaggaagttgtaattgcagagattgtctcattccttattcattcaaatactgattaagaaaaattaaatggatacttctagatttcttcaagatttccatggtgctttcgagtgttcaaggatagcccttttcattaactttatttattcttagttatcttatctggcttggtaatatatatatgc

SEQ ID NO: 3388 - DNA, 2931 bp, Glycine max
tgtgaggtgcaggaagcaaaaatctagattcacctgagaacaaaaactataaagcaggccaggcgatccacgaaagggtcaaacaattaactaaaaacagaatatgaagcgaaggtgggcttgagtgggccaagcgttcagcaagagcaagtagtaaagtatcattttcattttggcgaacgagtgcgaatcttttttctcttgtgttgttattttatttcatctgcatctgcatctgctacgttgtgttgagcagtgagatctgtatcgtcaaaattcatgatttcgtgttgaatgcatcgtccgagttaggttaatttttcgacattttttggtgtaaaatggaggtgccaactaggagaaaacccgtgatctactggatttgccttttcgtcattgtcaatgcgtttgtacaaattagcaatgcattttatcttccgggaagctacatgcacacttactcaaatggagataatatatatgccaaggttaattcattgacttctattgagactgagcttccctacagctactacagtctcccttactgcaagccccttggtgacataaagaaaagtgctgagaatcttggagagctcctcaggggagatcatattgatagctctccctaccttttccgcatgaacgttaatcagtcaatctacctctgtacttcgaccgccttgaaagagaatgaggtaaagctactgaaacaaagaactcgtgatctgtatcaagtaaatatgatccttgacaatttgcctgttatgaggtttgccaatcaaaatgggattaagatccagtggacggggttccctgttgggtacacaccccctgatggcagtgctgattacatcattaaccatctcaaattcaaagtcttggttcatgaatatgaaggaaatggtgttgaaatcattgggactggggaggaaggtatgggtgttatctctgaagctgaaaagaagaaggtatctggatatgaaattgttggctttcaggttatcccttgcagtgttaagcgtgatcctgaagtcatgacaaaactccacatgtatgacaatatctcttcaacaaactgcccatctgagctagacaagtaccaaccgattaaagagcaagagagaatatcatttacatatgaagttgagttcgtgaaaagtgatataagatggccatcgcgttgggatgcttatttaaagatggagggttcccgggtgcattggttctccatcctaaattcactgatggtgatctttttcttagctggtattgtctttgtcattttcttgagaactgtgagaagggacttgacacggtatgaggagttggacaaagaggcacaagcacagatgaatgaggagctttctggatggaagcttgttgtgggtgatgtatttagagagcctgatggttcaaggcttctctgtgtgatggttggggatggggttcagattcttggaatggctgctgtgactattgtttttgcagccctgggtttcatgtcaccagcttccagaggtatgctgcttactgggatgataattttatatcttttcctgggaattgctgctggatatgtcagtgtacgtctatggaggaccattaagggaacctcagaagggtggagatccatttcctggttatctgcttgtttttttcctggaattgcttttattattctgacaggactgaattttcttctctggggcagcaaaagtactggtgctattcccatttccctgtattttgagttgctcttcctctggttctgcatctcagttccacttaccctcattggaggatttatggggacaaaagctcagcaaattgaatatcccgtgcgaactaaccagattccaagggagattcctgcacgtaaatatccatcatggcttcttgttcttggggcaggaactcttccgtttggaacccttttcattgagcttttctttatcctttccagtatctggcttgggaggttctattatgtatttggtttcctgttggttgttcttctattgctggttattgtttgtgctgaagtgtcagtggtcctcacatatatgcatctttgtgtggaagattggcagtggtggtggaagtcattctttgcttcaggctctgttgctctttatgtcttcttgtactccattaactacttggttttcgacctgcagagtttgagtggacctgtctcagctatactttatctcggctattccctgctcatggcaattgcaatcatgttgtcaactggaaccattggcttccttatgtcattttactttgtgcactacttgttctcatcagtaaagatagattgaagtttgctttgctatctctcaccaactaagcaaaaggcatgctggaagatgaatttttcttaaatagtataacttttgcttaattcttttttgtagctctattgctttgcagcatgttgagtggggaaatagatgccttgctgattgcagtaaatagttgccactcaattttatgttgctatgcgaactacagtttgttcccctttctatctgtctctcccgtaagtggtttactcattcaactagtgtttggtatcattttgtttcatgtgatttagtttgttcaagttgcttgaggaagttgtaattgcacagactgtcttattccttattctttcaaatatcaagaaaaattaaagggatacttctagatttcttgacggtatccactgtgcttttgggagttcgaatattttgctttcaaggattggaaagtgacttcttcgtttacatgatttttcttagttttccacatatccggcttggcattatattactacttccagtccttattaaaaggtctgaatcaaaagtttcttggttctttttataagggttaatctaaaatgtctcttacggtaattatttttttacaataagtcag

SEQ ID NO: 3389 - DNA, 3322 bp, Glycine max
gagtccgttagacaatcaaatcaaatgatatggacttaaacaagcagagatgtcagtgttgtgttggtccattagggggtaatgagaaccctagtaggttaatacactataaaaagactatggtccccaagccgtcagatatagtttctcttcttcccataggtcctattaaccaataaagaggttctggctgaggaagaatcatgaagtcactggttacctatggattcagattccgcttgcatttgttgatcaatgatccaagtattcctaaaactcttccatctaatgtaatgtgttcttggtggttattgatattttataaggatcccctaaaattccaacattgtgttcttagggaatgttatatcttcatttcaagcaaattctattcccaagaccaagaggaggatggatatataatattctcaagggaataaaagttattttctacaataactatctattttcattacattctaatattgttgttttacttttacattctaatattgttctacaattactaaatgccaagcaaacatgtctttgagaataatatgattatgtgaggttcaggaagcaaaagcccggatttgcctaagagccaaaaaatgaaatgcaggccgggagattcactagagggcccaacaaataactaaaaacagagtattgaggcgaaggtgggcttgagtgggccataccgtacagaaaacaagtatcattttcattttggcgaacgagtgcgaatctttttctcttacgttgttattttatttccttactatctccatctgcatctgctacgttgtgttgagctttgagatctgtctcgccaaaattcatgatttcgtgttgaatgcatcatcagagttaggtttattttttgacatttggtgtaaaatgggggtgccaacttggagaaaaccagtgatctactgggtttgccttttcgtcattatcaatgcgtttgtacaaattagcaatgcattttatcttccgggaagctacatgcatacttactcaaatggagatccgatatatgccaaggttaattcattaacttctattgagaccgagcttccctacagctactacagtctcccttactgcaagccccttggtaaaataaagaaaagcgctgagaatcttggagagctcctcaggggagatcagattcataactctccctaccttttccacatgaatgttaatcagtcaatctacctctgtattacgaccgccttgaatgagaatgaggtaaagctactgaaacaaagaactcgtgatctgtatcaagtaaatatgatccttgacaatttgcctgttatgaggtttgccaatcaaaatgggattaagatccagtggacggggttccctgttggctacacaccacctgatggtagtgcagattacatcattaaccatctcaaattcacggtcttggttcatgaatatgaaggaaatggtgttgaaatcattgggactggggaggaaggtatgggtgttatttctgaagctgacaagaagaaggtatccggatatgaaattgttggctttcaggttaccccttgcagtgttaagcgcgaccctgaagtcatgacaaaactccacatgtatgacaatatctactcgacaaactgtccatctgagctagacaagtaccaaccgattaaagagcaagagaggatatcatttacatatgaagttgagttcgtgaaaagtgatataagatggccatcgcgttgggatgcttacttaaagatggagggctcccgggtgcattggttctccatcctaaattcattgatggtgatctttttcctagccggtattgtctttgtcattttcttgagaactgtaagaagggacttgactcggtatgaggagttggacaaagaggcacaagctcagatgaatgaggagctttctggatggaagcttgttgtgggtgatgtatttagagagcctgatggttcgaagcttctctgtgtgatggttggggatggggttcagattcttggaatggctgctgtgactattgtttttgcagccctgggtttcatgtcaccagcttccaggggtatgctgcttaccgggatgataattttatatcttttcctgggaattgctgctggatatgtcagtgtacgtctatggaggaccattaagggaacctcggaagggtggagatccatttcctggttatctgcatgcttttttcctggaattgcttttattattctaacaggactgaattttcttctctggggcagcaaaagtactggtgctattcccatttccctgtattttgagttgctcttcctctggttctgcatatcagttccacttaccctcatcggaggatttatggggacaaaagctcagcaaattgaatatcctgtgcgaactaaccagattcctagggagattcctgcacgtaaatatccgtcatggcttcttgttcttggtgcaggaactcttccatttggaacccttttcattgagcttttctttatcctttccagtatctggcttgggaggttctattatgtatttggtttcttgttggttgttcttctattgctggttattgtttgtgctgaagtgtcagtggtcctcacatatatgcatctttgtgtggaagattggcagtggtggtggaagtcattctttgcttcaggctctgttgctctttatgtcttcctgtactccattaactacttggttttcgacctgcagagtttgagtggacctgtctcagctatactttatctcggctattccctgctcatggcaattgcaatcatgttgtcaactggaaccgttggcttccttatgtcattttactttgtgcactacttgttctcatcagtaaagatagattgaagtttgctttgctatctctcaccagctaaagcaaaaggcatgctggaagaggaatttttcttaaatagtgtaacttttgcttaattctttttgtagcttgatttgcagcatgttgagtggtgaaatagatgccttgctgattgcagtaaatagttgccactcaattttatgttgctatgcgaactacagtttgttcccctttctacctgtctctcccgtaagtttactcattcaactagtgtttggtatcattctgtttcatgtgatttagtttggtcaagttgcttgaggaagttgtaattgcacaaactgtcttattccttattcattcaaatatcaagaaaaattaaatggatacttctaggtttcgtcaaggtatccatccactgtgcttggtaatatatattattattagtaccactaggggaaacac

SEQ ID NO: 3390 - DNA, 2521 bp, Phaseolus vulgaris
ctaatctccattttcatctgctgcgttgtactgaacattgagatctgtatcgccaaaatccatgatttcgatttgaatgcatcgtctgagttaggttaatttttggacatttggtggataatggaggtatcaaccaggagaaaaccggtgatctactgtgtttgccttttcttcattgtcaatttttttcttcaaattagcgatgcattttatcttccgggaagctacatgcacacttactcaaatggagatcagatatatgctaaggttaattcattgacctctattgagactgagcttccctacagctactacagtctcccttactgcaagccgcttggtggcataaagaaaagtgctgagaatcttggagagctcctcaggggagatcagatcgataactctgcctaccttttccgcatgaatgttaatcattcaatctacctctgcactacacccccattgactgaggttgaggtgaacctactgaaacaaaggactcgtgatctgtatcaagtaaatatgatccttgacaatttgcctgttatgaggtttgccaatcaaaatgggatgaaaatccagtggacggggttccctgttgggtacaccccaccggatggtactgcagattacatcatcaatcatctcaaattcaaagtattggttcatgaatatgaagggaatggtgttgaaatcattgggactggggaggaaggtatgggtgttatttctgaagctgacaagaagaaggtatctggatatgaaattgttggcttccaggttatcccttgtagtgttaagagggatcctgaagtcatgacgaaactccacatgtatgacagtatcgcttcgtcaaactgcccatctgagctagacaagtaccaaccaattaaagagcaagagaggatatcatttacatacgaagttgaatttgtgaaaagtgatataagatggccatcgcgttgggatgcttatttaaagatggagggttccagggtgcattggttctctatcctaaattcactcatggtgatttttttcctagcaggtattgtctttgtcatttttttgagaactgtgagaagggacttgacacggtatgaggaattggacaaagaggcacaagcacagatgaatgaagagctctctggatggaagcttgttgtgggtgatgtttttagagaaccggagtgttcaaaacttctatgtgtgatggttggggatggggttcagattctcggaatggctgctgtgacaattgtttttgcagccctgggtttcatgtcaccagcttccaggggaatgctgctgacagggatgataattttatatcttttcttgggaattgctgctggatatgtcagtgtacgtctgtggaggaccattaagggaacttcagaagggtggagatcaatttcctggttatctgcatgctttttccccgggattgcttttattattctcacgggactgaattttcttctgtggggcagcaaaagtactggtgctattcccatttctctgtattttgagttgctcttcctctggttctgcatttcagtgccacttactctcattggaggattcatgggcacaaaagctcagcaaattgattatcctgtgcgaactaaccagataccaagggagattcctgcacgtaaatatccatcatggcttcttgttcttggtgcaggaactcttccatttggaacccttttcattgagcttttctttatcctttccagtatctggcttgggaggttctattatgtatttggtttcctgttggttgttcttctactgcttgttattgtttgtgctgaagtgtcagtggtcctcacatatatgcatctctgtgtggaagattggcggtggtggtggaagtcgttcttcgcttcaggctctgttgctctttatgtcttcttgtactccattaactacttggtttttgacttgcagagtttgagtggacctgtctcggctatactttatcttggctattcattgctcatggcaattgcaatcatgttgtcaactggaaccattggcttccttatgtcattttactttgtccactacttgttctcatcagtaaagatagattgaagtttgctttgctatctctcaccaaccaagcaaaaggcatgctggaagagggatttctcttaattggtataacttttgcgtaattctttttgtagtttcatttctttgcagcatattgagtggggaaacggatgtcttgctgattgcagtaaatagttatcactcgatcttatgttgctatgcgaactactgtttcttcccctttcttcctgtgtcacccgtaagtggtttactcattcaactagtgtttggtatcattttatttcatgtgatttagtttggtaaagttgcttgaggaagttgtaattgcacggacggtctcattccttattcattcaaacgaatactgattaagaaaaatcaaatgggttcttctaggtttcttcaagatttctaccacttttggtagttcgaa

SEQ ID NO: 3391 - DNA, 2163 bp, Lotus japonicus
atccctttgatctgctgggtttgcatttccctcattgtctttgttcaatttagcaatgctttttatcttcctggaagttacatgcacacttactcaaatggagatcccatatatgccaaggttaattccttgacttccattgaaactgagcttcccttcagctactacagcctcccttattgccaaccccttggcgggattaagaaaagtgctgagaatctcggcgaactccttatgggtgaccagattgataactccccttaccttttccacatgaatgtcaatcagtctgtctacctctgcactacaccccccttgaacgagaacgaggtcaagctactcaaacagcgaactcacgatctctatcaagtaaatatgatccttgacaatctgcctgtcatgagatttgccactcaaaatggggttaaaatccagtggaccggcttccccgtcgggtacaccccacctgatggcagtgcggattacatcatcaaccacctcaagtttacagtcttggttcatgagtatgaaggaagtggtgttgaaatcatcgggaccggcgaggagggtatgggtgtgatttctgaagctgacaagaataaggcatctggatatgaaattgttggctttcatgttgtcccttgtagtgttaaacgcgatcccgaagccatgacaaagctccacacgtatgatgaaatgtctagaacaagctgcccagctgagcttgacaagtaccaagcggttagggaacaagagaggatatcatttacatatgaagttgaatttgttagaagtgatataagatggccgtcgcgttgggatgcttatttaaagatggagggtgcacgagtacattggttctcaatcctgaattcacttatggtgatctttttcctagctggtattgtttttgtcattttcttaagaactgtgagaagggacttgacaaggtatgaggaaatggacaaagagacacaggctcagatgaatgaggagctttctggatggaagcttgttgtgggtgatgtatttagggagcctgattgctcaaagcttctctgtgtgatggttggggatggagttcagattcttggaatggcagctgttactattgttttcgccgcccttggtttcatgtcacctgcttcacggggaatgctactaacggggatgataattttatatcttttcctcggaagtgctgcaggatatgtcagtgtacgtctctggagcaccattaagggaacttcagaagggtggaggtcaatttcctggtttgccgcatgcttttttcctggaattgcgtttgttattctaacaggactgaattttattctctggagcagcaaaagtactggtgctattcctatttccttgtattttgagttgatcttcctgtggttctgcatttcagtgccacttaccctcattggaggatttatggggacaaaagctccacaaattgaatttcctgtgcgaactaatcagattccaagggaaattccaacacgtaaatacccatcatggcttcttgttcttggtgctggaactcttccgtttggaacccttttcattgagcttttctttatcctttccagtatctggcttgggaggttctattatgtctttggcttcttgtcgattgttcttctattgctgattattgtttgtgctgaagtgtcagtggtcctcacatatatgcatctttgtgtggaagattggcggtggtggtggaaggcattctttgcatcaggctccgttgctctttatgtcttcttatactccattaactacttggttttcgacctgcagagtttgagtggacctatctctgctatactttatcttggctattcgctgctcatggcaattgcaatcatgttgtcaaccgggaccattggcttccttatgtcattctactttgtgcattatttgttctcatcagtgaagatagattgaggctctctttgctatctatcaacaaagcaaaaggcactctggaagaggattttttctcaattggtataacttaattctttttgtagcttgatttctttatagcatattaagtggataaacagatactgatctgcagtttgttccccttctatctgtattctgtaagtggtttaaaatttaaacatttaactagtgtttgatatc

SEQ ID NO: 3392 - DNA, 3210 bp, Cicer arietinum
gcccaattgaagtaaatgtccaatgccatttgttgaatgctcatactaccaacgcatttctgattctcgatctctctctctctatctgcttcctcccacccaaaaactacattcatctttggcgttgcgttcagttgagttgggatcgatctatctctttctcccttctcttccttccaattcttcaccaaaatcccatgatttaaaatcacagtcggaatttgcttagattcacagaaaactttccagcattttctgttgtcttgcgttaaaagaaatggaattaacaactgtgagaaaatccttcacctactgggtgttcctttctgtcattgtctttgctcaagttagcaatggtttttatcttccgggaagctatatgcatacctactccaatggagaattcataaatgccaaagtcaattcgttgacttctattgaaaccgagcttcccttcagttactacagcctcccttactgccagccgcctggtgggataaagaaaagtgctgagaatcttggagaacttcttatgggagatcagattgataactcaccctaccgatttcgaatgaatgtaaatgagactgtctacctctgtacaacatcaccattgaatgagcacgaggtaaagctactcaaacaacgaactcgtgatctgtatcaagtgaatatgatccttgacaacttgccagttatgagatatactagccaaaatggggttaaaatccagtggacagggttccctgttgggtacactccacctgatggcagtgcagattacatcattaaccacctgaagttcactgtattggttcatgaatacgaagggagaggggttgaaattattgggactggggaggaaggtttgggcattattactgaagctgacaagaagaaggcatctgggtatgaaatagttggttttcatgttgtcccttgtagtattaaatatgaccctgaagtaatggcaaagcacaaaatgtttgatagtatctctactgtaagctgcccaaacgagcttgacaagtatcaggtaataaaagagcgagaaagaatatcattcacatatgaagttgaatttgtgaaaagtgatataagatggccatcgcgttgggatgcttatttgaagatggagggttcccgagttcattggttctcgatcctaaattcactgatggttatttttttcctagctggtattgtttttgtcattttcttaagaactgtaagaagggatttgacaaggtatgaggaattggacaaagaggcacaagctcagatgaacgaggagctttctgggtggaaacttgttgtgggtgatgtatttagggagcctgattgctcaaagcttctttgtgtaatggttggagatggggttcagattcttggaatggctgctgttactattgtctttgcagcacttggtttcatgtctccagcatcccgaggaatgctgctaacaggaatgatcattttatatcttatcctgggaattgctgctggctatgtcagcgtacgtctttggaggaccatgaagggaacaacagaagggtggagatcaatatcttggtccgctgcatgtttttttcctggaattgctttcattatccttacagtactcaattttattctatggaacagcaacagtactggcgccatacccatttccttgtattttgagctgttcttcctctggttctgtatttcagtacctctgaccctcattggaggatttatgggaacaaaagcagagccaattgaatatcctgtacggaccaatcagattccaagggaaattcctgcacggaaatatccatcgtggcttcttgttcttggtgctggaacccttccatttggaaccctcttcattgagcttttctttatcctttccagtatctggcttgggaggttctattacgtgtttggtttcctgttggttgttcttctattgctgattgttgtttgtgctgaggtgtcggtggtcctcacatacatgcatctgtgtgtggaagattggcggtggtggtggaaggcattctatgcttcaggttctgttgctctttatgtcttcttgtactccattaactatttggttttcgacctgcagagtttgagcggacctgtctcagctaccctttaccttggctattcattaatcatggcaattgcaatcatgttgtcgaccggtaccattggctttcttatgtccttctactttgtccattacttgttctcatcagtgaagatcgattgagattctcactcttatctctcattacccaagtaaaagatcaatcaatataacttctgctgagttatttttgtagcttgattacatcgcagaatatagtggggcaactgatgctagtaatcgattgattttatactgctatgtgatctgcagtctgttcctcatctacctgtttaagctcattatgtttcaagtactctagtttaactaagtttcttaggaaattgtaattgctcggtctgtcttaaatctcgtttcaatatatagaaaaatgttagatgggtactttcagatttcattgtgatgttcattatgtttgtgggtgttcaatttttatatcttctatgcgttcaaggatagggaagaagactagtattacactttctatgaggattttatttatacctattgtccacaagccacaattttggctttgtaatgtactgtttatttttatattattttatagctggatgcttgtagattttagttaataatattattctagatatggaaaatattgaaaaaggggagcctttgcacaatagatggatgcttgctgctatgtaaggtcacgggttaatgtaaggctacctactaatagattcaaatttccctatatcctattcctactatggtggaatctctaaggtacagggttggaaaatataattagctgtcctattaacggtgagggattcctcaagcaattcagtaaatatttgtcaaaattgagttttagtattattattgaaaagattccattggatgctttaaatagcctccccttcctcagtacatttcattgaaataagattttataatgctgatgtattattccctctaaaggaaagaagaagaaaaacaaatgaatttgttttgaaagcatccctcctcgaacagatatcccttttacttttagtacacttaaaaaagatgaagacaatgaatttggc

SEQ ID NO: 3393 - DNA, 2510 bp, Lupinus angustifolius
aacccatcttaaccttgtatgcatcatttttcttaattttgtttttgttcagatctctttttccccaatactcaatttctcattccactctctaaacacattttatactttcgttactgttcaaacgacgccgtacccagatctcacgatttgaaattgattgcgtcattgttggaactagcttagatttccagacaagttttggacaatctgctgttgtcttgcattcgaggaaatggagttggtgagaaaaccctcgatctgctgggttttcgtttttgttgttatatttgctcatgtaagcaatggtttttatctgcccggaagctacatgcatacttattccaatggagatcccatatttgctaaagttaattcattgacctctattgaaacggagcttccttttagctactatagcctcccgtactgcaagccccttggtggcataaagaaaagtgccgagaatcttggggagctcctcatgggagatcaaatcgataactcgccctaccgtttcagaatgaatgttaatgagtcaatctacctatgtacaacaaccccgttgaatgagcatgaggtaaagctactcaaacaaagaacacatgatctgtatcaagtaaatatgatccttgacaacttgccggttatgaggtatgctactcaaaatggtgttaaaattcagtggactgggttccctgttgggtacactccacctgacggtagtgcagattacatcattaatcacctcaaattcagagtctttattcatgaatacgaaggaagcggtattgagatcattggaaccggggaggaaggtttgggtgtgatttctgaagcagacaagaagaaggcatctggatatgaaatagttggttttcaggttgtcccctgtagtattaagtatgatcctgaggccatgacaaagctccacacgtatgataatgtgtcttctataaactgcccaaatgagcttgacaagtatcaacaaataagagagcaagagaggatatcatttacatatgaggttgaatttgtgaaaagtgacgtaagatggccctcacgttgggatgcctatttgaagatggagggttcccgagtccattggttctcaatcctaaattcactcatggttatccttttcctagctggtattgtttttgtcatctttttaaggaccgtgagaagggacttgacaaggtatgaggaattggacaaagaggcacaggctcagatgaacgaggagctttctggatggaaacttgttgtgggtgatgtatttagggagcctgaatgctcgaagcttctctgtgttatggttggagatggtgttcagattcttggaatggctggtgttactattgttttcgcagcactcggtttcatgtcaccagcttcacggggaatgctactaacagggatgatcattttatatcttatccagggaatcgttgctgggtatgtcagtgtacgtctctggaggactattaagggaacttcagaagggtggagatcaatttcctggttggctgcatgctttttccctggaattgccttcgttattctcacagtactgaattttattctatggggcagccacagtactggtgctattcccatttccttgtattttgagcttttcttcctctggttctgtatttcagtaccacttaccctcattggaggatttctggggacaaaagctcagccaattgaatatcctgtgcgcactaatcagatccccagggaaattccctcacgaaaatatccatcatggcttcttgttcttggtgcaggaacacttccatttggaaccctcttcattgagcttttcttcatcctttccagtatctggcttgggaggttctattacgtgtttggtttcctgttggttgttctactattgctggttattgtttgcgccgaagtgtcagtggtcctcacctacatgcatctttgtgtggaagattggcggtggtggtggaaggcattctttgcttcgggttctgttgctctttatgtcttcttgtactccattaactacttggtttttgacctccagagtttgagtggaccggtctcagccaccctttacctcggctattcactactcatggcagttgcaatcatgttgtccaccggcaccatcggcttcctcatgtcattctactttgtgcattacttgttctcatcagtaaagatagattgaggttcttgctgatatctctcatcagtgaagatcaattcatataaacatctgcgaagttctgcttcattgcattgcattaaatagttgtcattagattttgtattgcaatgtgatctgcaatttgttattgtttttacccttcacaaatggtttactcgttcaagtattcaactagtgttcaatctcattttgtttcaagtactttagttttaattaaatagttgtaattgctcagtctctctcacaatgttagtggatactttcagatttctttatcattttcactgtgcatttgggtgtt

SEQ ID NO: 3394 - DNA, 2642 bp, Lupinus angustifolius
gagtcataaatcaaacccaatcgaagctgcatcatttctctctcgtttttggtcccttcctatgaactggaacacgatcttgtgccttgaatcgagtttagatctctatccccaataatccccatattgggtttctccttccactctctaacttcacatttttcaaacctctgttagcgttgaaacgacgccgtcgcaatatctcatgatttgaaatttaatgcatcattgatggaactagcttagattcgggacatagcattcaaggaaatggaattggtacgaaaaccctcaatctttcgggtttttggttgtgtcattgtctttgctcaagtaagcagtggtttttatctgccgggaagctacatgcacacttattccaatgaagatcctatatatgctaaagttaattcgttgacctctattgaaaccgagcttccttttagctactatagcctcccttactgcaagccccttggtggcataaagaaaagtgctgagaatcttggagaactccttatgggagatcaaatcgataactcgccctaccgtttcaggatgaatgttaacgagacaatttacctctgtacaacaaccccattgaatgagcatgaggtaaagctactcaaacaaagaactcgtgatctgtatcaagtaaatatgatccttgacaacttgccggttatgaggtatgctaatcaaaatggagttaaaattcagtggactgggttcccgattgggtacactccacccgatggtagtgcagactacatcattaaccatctcaaattcacagtcttggttcatgaatacaaaggaagcagtgttgaaattatcggaactggggaggaaggtttgggtgtcatttctgaagctgacaagaaggcatctggatatgaaatagttggttttcaggttgccccttgtagtattaaatatgattctgaagtcatgacaaagctccacatgtatgataatatgtcttctataaattgcccaagtgagcttcacaagtatcaagtaataagagagcaagagaggatatctttcacatatgaggttgaatttgtgaaaagtgatataagatggccatcacgttgggatgcttatttgaagatggagggttcccgagtccattggttctcgatcctaaattccctcatggttgtctttttcctagctggtattgtttttgtcatctttttaagaaccgtgagaagggacttgacaaggtatgaggaattggacaaagagacacaagctcaaatgaatgaggagctttctggatggaaacttgttgtgggtgatgtatttagggagcctgaatgttcgaagcttctttgtgttatggttggagatggggttcagattcttggaatggctggtgttactattgtttttgcagcacttggtttcatgtcgcctgcttcccgaggaatgctactaacagggatgataattttatatcttatccagggaattgttgccgggtatgtcagtgtacgtctctggaggactattaagggaacttcagaagagtggagatcaatttcctggttggcggcatgttttttccctggaattgccttcattattctcacagtactgaattttattctatggggcagccatagtactggtgctattcctatttccttgtactttgagttgttcttcctctggttctgcatttcagtaccccttacgcttatcggaggatttttggggacaaaggctcagacaattgaatatcctgttcgcactaatcagatcccaagggaaattcccgcacgcaaatatccgtcatggcttcttgttcttggcgcaggaatacttcctttcggaaccctcttcattgagcttttcttcatcctttccagtatctggcttggaaggttctattatgtgtttggtttcctgttggttgttcttctattactggttattgtttgcgccgaagtgtcagtagtactcacctacatgcatctctgcatcgaagattggcgttggtggtggaaggcattcttcgcttcgggttctgttgctctttatgtcttcttgtactccattaactacttggtttttgacctgcagagtttgcgtggacccgtctcggctaccctttaccttggctattcactactcatggcagttgcaatcatgttgtccactggcaccgttggcttccttatgtcattctactttgtgcattatttgttctcgtccgtaaagatagattgaggttcttgctgctatctctcattcactaagcaaaagatcatttcatataaactcgtgctgcgttctgctcgattgcattagaccggggcaataaatgctttgctggttgcattaaatagttgccattagattttgtattgcaatgtgatctgtaatttgttcttgcttttacccaagtgttcaagtattcaactactgttgaagctcattttcttttacctattttagttttagttaagttgctttaggaagttgtaattgcacagtcagtctgtatttatctattatgagatcaaaaaagagttcagctgatgtttatcctatttggagaacttgtataaagacatatgttgtgcaacaaaatccaatgcaaaacttcttggaggattgcttgctactta

SEQ ID NO: 3395 - DNA, 2881 bp, Trigonella foenum-graecum
gaccaacgcatttcagattctcgatctttctcctcttcttgcttgctacaaatcatcttttgctttgcgttgagttcagttcagtttcgatcgatctatctatctcttcctttcaattcatcgctaaaacccaacgatttgatatcactgttggaattagctttgatacacagaaaacttcccagcatctgcagttgtcttgcgttcaaggaaatggagttaccgactcttagaaagcctttcatctgctgggttttccttctttcattttctttgctcaagttagcaatggtttttatcttccaggaagctacatgcacacttattccaatggagaatttattaatgccaaagtcaattcgttgacttctattgaaaccgagcttcccttcagttactacagcctcccttactgccagccccctggtgggataaagaaaagtgctgagaatcttggagaacttcttatgggagatcagatcgataattcaccctaccgatttcgaatgaatgtaaatgagactctctacctctgtacaacagcaccattaaatgagcacgaggttaagctactcaaacaaagaactcgtgatctgtatcaagtgaatatgatcctcgacaacttgccggttatgaggtatactaaccaaaatggggttaaaatccagtggacaggataccctgttgggtacactccaactgatggcagtgcagattacatcattaaccacctgaaatttactgtattggttcatgaatatgaagggagaggggttgaaattattgggactggggaggaaggtttgggcattatttctgaagctgacaagaagaaggcatctgggtatgaaatagtggttttcatgttgtcccctgtagtattaaatatgacacggaagccatgacaaagcacaaaatgtatgatagtatctcttctgtaagctgcccaaatgagcttgacaaatatcaggtaataaaagagcaagaaaggatatcattcacatatgatgttgaatttgtgaaaagtgatataagatggccatcacgttgggatgcttatttgaagatggagggttctcgagttcattggttctcaatcctaaattcattgatggttattgttttcctagctggcattgttttgtcatttcttaagaactgtaagaagggattgacaaggtatgaggaattggacaaagaggcacaagctcagatgaacgaggagctttctgggtggaaacttgttgtaggtgatgtatttagggaacccgaatgctcaaagcttctctgtgtaatggttggagatggggttcagattcttggaatggcagctgttaccattgtttttgcagcacttggtttcatgtctccagcatctcgaggaatgctactaacagggatgatcattttatatcttatcctgggaattgcagctggctatgtcagcgtacgtctatggaggatcattaagggaacatcagaagggtggagatcaatttcttggtctgctgcatgtttttttcctggcattgctttcattatccttacagtactcaatttcattctatggaacagcaacagtactggtgctatacccatttccttgtattttgagctgttcttcctctggttctgtatttcagtacctctgaccctcattggaggatttatggggacaaaaggagagccaatcgaatatcctgtacggaccaatcagattccaagggaaattcctgcaaggaaatatccatcatggcttcttgttcttggtgctggaactctcccatttggaaccctcttcattgagctattctttatcctttccagtatctggcttgggaggttctattacgtgtttggtttcctgttggttgttcttctattgctggttgttgtttgtgctgaggtgtcggtggtcctcacatatatgcatctgtgtgtggaagattggcggtggtggtggaaggcattctatgcttcaggttctgttgctctctatgtcttcttgtactccattaactacttggttttcgacctgcagagtttgagtggacctgtgtctgctaccctttaccttggctattcactactcatggcaattgcaatcatgttgtcgaccggcaccattggcttccttatgtcattctactttgttcactacttgttctcatcagtgaagatagattgaggttcttgctgttatctcattacccatgtaaaagatcaatcaattgatataacttctactgagttctctttgtagcttgattgcattgcagaatagagtgggagcaactgatgctttagtgattgccttaaacaatcatcaatcgattttacgctgcaatgctgtctgcagtttgttcctcttctatctgtctccgaacgtagtcattcaaggactagtgtttgagctcattatctttcaagtactctagtttaaactaagtttctttaggaagttgtaattgctcagtttgtcttacattacatttggtttcaatatatagaaaaatgttagatggatattcagatttcattgtgatgttcttatgtttgtggttgtttaatttttgtcttccatgcgttcaaggatagggaagaagaccaagttttatacttatgaggatttattttatctatacttattgtgcacaagccacaattttggctttgcattgtactaatgttttattttatagtattattttataacttgatgcttgtagttttagtttgataatattcttctagatatagagaatattgaatggaggagccttagcacaatagttgtatgcctctgtgtgaagtcacgggaatgtaaggctacctgctacaataatatattcaatttaccctttggttctactatggtgga

SEQ ID NO: 3396 - DNA, 2915 bp, Medicago truncatula
cactttcttccttcttgttctatctcacccaaagctacaaaatcatcattcgctttgcgttgagttcaatttcgatcgatctatctatctctctgctccttctatccatttctattcattgccaaaaccctacgatttgatatcactgttggaattagctttgattcacggaaaacttctcagcatctgcagttgtcttgcgttcaaggaaatggagttaccaactctgagaaaacctttcatctactgggttttcttttctttcactgtgtttgctcaagttagcaatgggttttatcttccgggaagctacatgcacacttattccaatggagaatatattaatgccaaagtcaattcgttgacatctattgaaaccgagcttcccttcagttactacagcctcccttactgccaaccccctggtggaataaagaaaagtgctgagaatcttggagaacttcttatgggtgatcagattgataattcaccctaccgatttcgaatgaataaaaatgagactctctacctctgtacaacagcaccattaaatgagcacgaggtaaagctactcaaacaaagaactcgtgatctgtatcaagtgaatatgatccttgacaacttgccagttatgaggtatactagccaaaatggggttaaaatccagtggacggggtaccctgttgggtacactccatctgatggcggtgcagattacatcattaaccacctgaaattcactgtattggttcatgaatatgaaggtagaggggtcgaaattattgggactggggaggaaggtttgggcattatttctgaagctgacaagaagaaggcatctgggtatgaaatagttggttttcatgttgtcccatgtagtattaaatatgaccccgaagccatggcaaagcacaaaatgtatgatagtatctcttctgtaagctgcccaaatgagctcgacaaataccaggtaataaaagagcaagagaggatatcattcacatatgatgttgaatttgtgaaaagtgatataagatggccatcacgttgggatgcttatttgaagatggagggttctcgagttcattggttctcaatcctaaattcactgatggttattattttccttgctggcattgtttttgtcattttcttaagaactgtaagaagggatttgacaaggtatgaggaattggacaaagaggcacaagctcagatgaacgaggagctttctgggtggaaacttgttgtaggtgatgtatttagggagcctgaatgctcaaagcttctgtgtgtaatggttggagatggggttcaaattcttggaatggcaggtgttactattgtttttgcagcacttggtttcatgtctccagcatcccgagggatgctactaactgggatgatcattttatatcttatccttggaattgccgctggctatgtcagcgtacgtctatggaggatcattaagggaacatcagaagggtggagatcagtttcttggtctgctgcatgtttttttcctggcattgcttttgttatccttacagtactcaattttattctatggaacagcaacagtactggtgctatacctatttccttgtattttgagctgttcttcctctggttctgtatttcagtacctctgaccctcattggcggatttatggggacaaaaggagagccaatcgaatatcctgtaaggaccaatcagattccaagggaaattcctgcaaggaaatatccatcttggcttcttgttcttggtgctggaactcttccatttggaaccctcttcattgagcttttctttatcctctctagcatctggctcgggaggttctattacgtgtttggtttcctgttggttgttcttctattgctgattgttgtttgtgccgaggtgtcggtggtgcttacatatatgcatctgtgtgtggaagattggcggtggtggtggaaggcattctatgcttccggttctgttgctctttatgtattcttgtactccattaactacttggttttcgacctgcagagtttgagtggacctgtgtcagctaccctttaccttggctattcactactcatggcaattgcaatcatgttgtcaactggcaccattggcttccttatgtcattctactttgtgcactacttgttctcatcagtgaagatagactgaggttctggctgtatctcttattacccatgtaaaagatcaatcaattgatataacttctaccgagttctttttgtagcttgattgcattgcagaatagggtggaggctgatgctttagtgattgccttaaacaatcatcaatcaattttataatgcaatgcggtctgcagttcgtctctgaacatagtcattcaaggactagtgtttgagctcatcatgtttcaagtactctagtttatctaagtttctttaggaagttgtaatttagtctgtgttacatttcgtttcaatatatagaaaattgttagatggataatcagctttcaatgtgatgttcattatgtttgtgggtgtttttatatcttctattcgttcaaggatagggaggaagaccaagtattatacttatgatgatttattcttattttatctatacctattgtccacaagccacaattttggcttgtattgtacttataatattattttttttgcgaaattattttataacttgatgcttgtattttttagttgataatgctctggatatggaaaaatgaaaatattgaataggggagccttggcacaatatttggatgcctctgaggtcacactcacgggttaatgtaagggtacctactacaatagattcacatttcccttgatgcctactatggtggaagctttgtatgttgcactttatatgggaaaatattaaattctag

SEQ ID NO: 3397 - DNA, 2708 bp, Cajanus cajan
ataacgtaacagacgagaataggatgcccaacccaatgctacatttctgattctctctctctctttcacactcacaacttcgacttcaacaacacaacaagaaccatatgttgcatcgcgatctctctttagcttcatatatcgccaatatttcatgatttggtattgacttcagcggtgttggtgttggtgttggagctagcttattagaagattcacagaaagggttttcagcatctgttgttgttgtattgtattgtattgagggaaatggagttgcgaaaacccttcatctgccactgggttttccttttcgtcatcatctttgctcagtttgtcaatggtttttatctccccggaagctatatgcacacttactcgaatagggatttcatatatgccaaagttaattcattgacttcgattgaaaccgagcttcccttcggatattacagcctcccttactgccagccggatgggggcgtaaagaaaagtgctgagaatcttggagagcttctgatgggagatcagattgataactcgccataccggttccagatgaatgtaaatgagacggtctacctctgcaccacatccctgttgaatgagcacgaggtgaagctactcaaacaaaggacgagggatctgtatcaagtgaatatgatccttgacaacttgcctgttatgaggtttaccaaccaaaatggggttaaaatccagtggacagggttccctgttgggtacactcctcctgatggcagtgcagattacatcattaaccatcttaagttcacggtcttggttcatgaatatgaaggaagcggcgttgaaattgtggggacaggggaggaaggtttgggggttatttctgaatctgataagaaaaaggcatccgggtatgaaatagtcggttttcaggtggtaccttgtagtattaaatatgatcctgaagtcatgttgaagcacaagaggtatgatactctttctcccattagctgcccagctgagcttgacaagtatcaagtgataagagagcaggaaaggatatcgttcacatacgaggttgaatttgtgaaaagcgatataagatggccatcacgttgggatgcttatttgaagatggagggttcccgagttcattggttctcgatcttaaattcacttatggttatctttttccttgccggtattgtttttgtcattttcctaagaaccgtgaggagggacttgactaggtatgaggaactggacaaagagacccaagctcagatgaacgaggagctctcgggatggaaacttgttgttggtgatgtgtttagggagcctgattgctcaaagcttctctgtgtgatggttggagatggggttcaaattcttggaatggccggtgttactattgtttttgcagcatttggcttcatgtcaccagcatcccgaggaatgctactaacagggatgatcattttatatcttatcctgggaattgctgcaggctacgtcagcgtgcgcttatggaggaccattaagggaacaacggaagggtggagatcaatctcctggtcagctgcatgtttttatcctggaattgcttttgtcattcttacagtgctgaattttattctctggagcagcaacagtaccggtgccatacccatttccttgtattttgagttgttcttcctttggttctgcatttcagtaccccttaccctcattggaggatttatggggacgaaagctcagccaattgagtatcctgtgcggactaaccagattccaagggaaatccctgcccgcaaatacccatcatggcttcttgttcttggtgctggaactcttccatttggaaccctcttcattgagcttttcttcatcctgtccagtatttggcttgggaggttctattatgtgtttggtttcctgttggttgttcttctattgctagttattgtttgtgctgaagtgtctgtggtcctcacttacatgcatctctgcgtggaagattggcggtggtggtggaaggcattctttgcgtcaggttctgtcgctctttatgtcttcctgtactccattaactacttggtgttcgatctgcagagtctgagtggacctgtctcagctaccctttaccttggctattctctactcatggccattgcaatcatgttgtcaaccggcaccatcggcttccttatgtcattctactttgtgcactacttgttctcatcagtgaagatagattgaggttcttgctgtcattgcctattaactatgcaaatggttaattgatataacttgtgctgagtcctttttgtagcttgatcgcattgcagaatattgagtagggcaacggatgtttcattcattgtctaaaattgttgccaaacgattttatattctgatggggatcacagtttgttctccttctgcctgtagcgtacttattcaagtattcaattagtgttttgtgtttcaagtattttagtttaagtttcattagaaggttgtaattcaaactgtctcatctcatttcaatactgtagaaaaataatgttagatagatatgtgtctcagaactagttgtgatgttttctgtgcttttggctttttctttttgttttttttttacttttgtaacctttttggattcaagaatgggaaggagacttggtattatagtaaagggagttatttaagcttaatttttc

SEQ ID NO: 3398 - DNA, 2457 bp, Trifolium pratense
tgcgatttgtgtgaataatttcattcagaccaaacgcattgcatattctcgatcttcttctctttgtccctttctttcttccacccaaaaattacaaaattcatcttttgcattcacttcactttcgatcgatctatccaattcattcatcgccaaaacccttcatttgatatcactgttggagttagcttagattgacaggatacttttcagcatctcctcctgtcgtctcacgctcaaggaaatgggattaccaactatgagaaaacccttcatctgctgggttttcctttcgttcgttgtatttgctcaagttagcaatggtttttatttgccgggaacctacatgcatacttattccaatggagaatttataaatgccaaagtcaattcgttgacttctattgagaccgagcttcccttctcttactacagcctcccttactgccagccccctggtgggataaagaaaagtgctgagaatcttggagaactacttatgggagatcagattgataactcagcctaccgatttcgaatgaatgtaaatgaaactctatacctctgtacaacatcaccattgaatgagcacgaggtaaagctactcaaacaacgaactcgtgatctgtatcaagtgaatatgatcctcgacaacttgccagttatgaggtatactagccaaaatggggttaaaatccagtggacagggttccctgttgggtacactccatctgatggtggtgcagattacatcattaaccacctaaaattcactgtatttgttcatgaatatgaagggagaggggttgaaattattggaactggggaagaaggtatgggcattatttctgaagctgacaagaagaaggcatcagggtatgaaatagttggttttcatgttgttccttgtagtattaaatatgaccctgaagccatgaaaaagcacaaaatgtatgatggtatctcttctgtgagctgcccaaatgagcttgacaagtatcagataataaaagagcaagaaaggatatcattcacatatgatgttgaatttgttaaaagtgatataagatggccatcacgttgggatgcttatttgaagatggagggttcccgagttcattggttctcgatcctaaactcactgatggttattgttttcctagctggtattgtttttgtcattttcttaagaactgtaagaagggatttgacaaggtatgaggaattggacaaagaggcacaagctcagatgaacgaggagctttctgggtggaaacttgttgttggtgatgtatttagggagcctgattgctctacacttctctgtgtaatggttggagacggggttcagattcttggaatggcaggtgttactattgtttttgcagcacttggtttcatgtctccagcatcccgaggaatgctactaacaggaatgatcattttataccttatccttggaattgctgctggctatgtaagcgtacgtctttggaggatcattaagggaacatcagaagggtggagatcaatttcttggtctgctgcatgttttttcctggcattgctttcattatcctcacagtactcaatttcattctatggaacagcaacagtaccggtgctatacccatttccttgtattttgagctgttcttcctctggttctgtatttcagtacctctgaccctcattggaggatttatgggtacaaaaggagagtcaattgaatatcctgttaggaccaatcagattccaagggaaattcctgcacgaaaatatccatcatggctacttgttcttggtgctggaactcttccatttggaaccctcttcattgagcttttctttatcctttccagtatctggcttgggaggttctattacgtgtttggtttcctgttggttgttcttctgttgctgattgttgtttgtgctgaggtgtcggtggtcctcacatatatgcatctgtgtgtggaagattggcgatggtggtggaaggcattctatgcttcaggttctgttgctctttatgtcttcttgtactcaattaactacttggttttcgacctgcagagtttgagcggacctgtgtcagctaccctatacctcggctattcactactcatggcaattgcaatcatgttgtcaactggcaccattggcttcctaatgtcattctactttgtgcactacttgttctcatcagtgaagattgattgaggttttcagctgttatgtctcagtacctgtgtaaaagatcaattgatatatcttctattgagttctttttgtagcttgattgcatcgtagaatatagcgacgcaacggatgcttcattgttcctcttctacatgccttcgaaagtagtcattcaagtactcgactagtgtttgaactcattatatttcaagtattctagtttaaactaaatttctttaggaagttgtaattgct

SEQ ID NO: 3399 - DNA, 2831 bp, Trifolium pratense
gcattcacttcactttcgatcgatctatctctctctgttccttccaattcattcatcgccaaaaccccttcatttgatatcactgttggaattggcttagattcacaggaaacttttcagcacctcctcttgtcgtctcgcgttcaaggacatggagttaccaactatgagaaaacccttcatctgctgggttttcctttctgtcgttgtctttgctcaagttagcaatggtttttatttgccgggaagctacatgcatacttattccaatggagaatttataaatgctaaagtcaattcgttgacttctattgagactgagcttcccttctcttactatagcctcccttactgccagccccctggtgggataaagaaaagtgccgagaatcttggagaactacttatgggagatcagattgataactcaccctaccgatttcgaatgaatgtaaatgaaactctatacctctgtacaacatcgccattgaatgagcatgaggtaaagctactcaaacagcgaactcgtgatctgtatcaagtgaatatgatcctcgacaacttgccagttatgaggtatactagccaaaatggggttaaaatccagtggacagggttccctgttggatacactccatctgatggcggtgaagattacatcattaaccacctaaaattcactgtatttgttcatgaatatgaagggagaggagttgaaattattggaaccggtgaggaaggtataggcattatttctgaagctgacaagaagaaggcatcagggtatgaaatagttggttttcatgttgttccttgtagtattaaatatgaccctgaagccatgaaaaagcacaaaatgtacgatggtatctcttctgtaagttgcccaaatgagcttgacaagtatcaggtaataaaagagcaagaaaggatatcattcacatatgaggttgaatttgtgaaaagtgatataagatggccatcacgttgggatgcttatttgaagatggagggttcccgagttcattggttctcgatcctaaactcactgatggttattgttttcctagctggtattgtgtttgtcattttcttaagaactgtaagaagggatttgacaaggtatgaggaattggacaaagaggcacaagctcagatgaacgaggagctttctgggtggaaacttgttgtcggtgatgtatttagggagcctgattactccacacttctctgtgtaatggttggagatggggttcagattcttggaatggcagctgttactattgtttttgcagcacttggtttcatgtctccagcatcccgaggaatgctactaacaggaatgatcattttataccttatccttggaattgctgctggctatgtaagcgtacgtctttggaggatcattaagggaacatcagaagggtggagatcaatttcttggtctgctgcatgttttttcctggcattgctttcgctatcctcacagtactcaatttcattctatggaacagcaacagtaccggtgctatacccatttccttgtattttgagctgttcttcctctggttctgtatttcagtacctctggccctcattggaggatttatgggtacaaaaggagagtcaatcgaatatcctgtaaggaccaatcagattccaagggaaattcctgcacgaaaatatccatcatggctacttgttcttggtgctggaactcttccatttggaaccctcttcattgagcttttctttatcctttccagtatctggcttgggaggttctattacgtgtttggtttcctgttggttgttcttctgttgctgattgttgtttgtgctgaggtgtcggtggtcctcacatatatgcatctgtgtgtggaagattggcgatggtggtggaaggcattctatgcttcaggttctgttgctctttatgtcttcttgtactcaattaactacttggttttcgacctgcagagtttgagcggacctgtgtcagctaccctatacctcggctattcactactcatggcaattgcaatcatgttgtcgactggcaccattggcttccttatgtcattctactttgtgcactacttgttctcatcagtgaagatcgattaaggttctcagctgttatctctcagtacccatgtaaaagatcaattgatatatcttctattgagttctttttgtagcttgattgcatcgtagaatatagcgaggcaactgatgcttcattgatttccttaaattgtcatcaatggattttatactgctatgtgtctgcagtttgttcgttcctcttctacctgcctccgaaagtagtcattcaagtactcgactagtgtttgagctcattatatttcaagtactctagtttaaattaaatttctttaggaagttgtaattgcttggtctgtcttacgtcttgtttcaatataatagaaaaatgttagatggatactcaaatttcgttgtgatgttcatcatgtttgtgggtgtttaatcgatcttctgtgctttcaagaatagggaagaaaactttgtgttatgtatctattatctacaagccacaattttggcttggtattgtactaatgcttattttatagccagatgcttgtattttttagttaatgatattcatttagatatgcaaattttttgaaaagtttcatggcacaatagttggatgcttgctgctgtgtgagatcacaggctaatgtaaaatagattcaaatttccttagatcctactatggtggaacatggaatctctatagggttgaacttaatatgaaaaaattactgaatatataaatc

SEQ ID NO: 3400 - DNA, 2667 bp, Glycine max
tgggctagtccataccataacatgggaatataatgcccaacccaatgctattattgttgacgctacatttctgattctttcttgctcacacttgcgataccgacttcaacacaagaacaagaaccatctgttactttgcgttgcgatatctctctttttctctctttctgaaactcaatttatcaccaaaattctagggaaatggagttgcgaaaatccttcatctgccactgggttttcctttttgtcatcgtctttgttcaagtagtcaatggtttttatctccccggaagctatatgcacacttactcaaataaagatctcatatacgctaaagttaattcgctgacttcgattgaaaccgagcttccctacagctactatgacctcccttactgccagccggatggcggcataaagaaaagtgctgagaatcttggagagcttctgatgggagatcagatcgataactcgccataccgattccggatgaatgttaatgagacactttacctctgcactacgtccccgttgaatgagcacgaggtgaagctactcaaacaaaggacacgggatctgtatcaagtgaatatgatccttgacaacttgcctgttatgaggtttaccaaccaaaatggggttaaaatccagtggacagggttccctgttgggtacactccagctgatggcggtgaagattacatcattaaccaccttaagttcacggtcttggttcatgaatatgaaggaagtggggttgaaattgtggggactggagaggaaggtttgggtgttatttctgaatctgacaacaaaaaggcatcaggttatgaaatagttggttttcaggttgtaccttgtagtattaaatatgatcccgaagtcatgacaaagcacaacaggtatgatactctttctcctataagctgcccggctgagcttgacaagtatcaagtgataaaagagcgggaaaggatatcgttcacatatgaggttgaatttgtgaaaagtgatataagatggccatcacgttgggatgcttatttgaagatggagggttcccgagttcattggttctcaatcttaaattcacttatggttatttctttcctggctggtattgtttttgttattttcctaagaactgtgagaagggacttgacgaggtatgaggaactggacaaagagactcaagatcagatgaacgaggagctctctggatggaaacttgttgtgggtgatgtgtttagggagcctgattgctcgaagcttctctgtgtgatggttggagatggggttcaaattcttggaatggctggtgttactattgtttttgcagcacttggattcatgtcacctgcatcccgaggaatgctactaacagggatgatcattttatatcttatcctgggaattgctgcaggctatgtcagcgttcgtgtttggaggaccattaagggaacaacagaagggtggagatcaatttcctggttagccgcatgtttttatcctggaattgctttcattattcttacagtgctgaattttattctatggagcagtaacagtactggcgccataccgatttccttgtattttgagctgttctttctctggttttgcatttctgtacctcttaccctcattggaggatttatggggacaaaagctcagcctattgaatatcctgtgcgcactaaccagattccaagggaaattcctgcacgtaaatacccatcgtggcttcttgttcttggtgctggaactcttccatttggaaccctcttcattgagcttttcttcatcctttccagtatttggcttgggaggttctattatgtgtttggtttcctgttggttgttcttctattgctaattattgtttgtgctgaagtgtctgtggtcctcacttatatgcatctctgtgtggaagactggcggtggtggtggaaggcattctttgcatcaggttctgtggctctttacgtcttcttgtactccattaattacttggtgttcgacctgcagagtttgagtggacctgtctcagctaccctttaccttggttattcactactcatggccattgcaatcatgttgtcaaccggcaccattggcttccttatgtcattctactttgtgcactacttgttctcatcagtaaagatagattgaggttcttgttgtcattgcatattaactatgaaaaaggttgattgatataacttgatcacattgcatagtagggcaacggatgtttaattcattgtctgattttatattgcgatgggatctgcagtttgttctccttctgcctgtttcccaaagtagtgtactcattcaagtattcaactagtgtttgagatcatgtttcaagtattttgttcaagtttctttagaaggttgtaattcaaactctcatctcatttcaatactttagaaaaatgatgttagatagatacatgctttcagaactcgttgtgatattcactgtgcttctgggtatttaatatttttagcttcttttgggttcaaggatgggaaagtgacttagtataggatagggaaagtgacttggtattgtactattaaaatattttattcaaacataattaattgtctgcaatttttgcttttgtaatattattgttttattttattttatag

SEQ ID NO: 3401 - DNA, 2787 bp, Phaseolus vulgaris
agcatgcccaacccaacgctctttttgattactcctttctgttttgtcgctcacacttgcgactacgactccaacgcaagaatcatctgtcgttccgatctctctcttcctctctcaaatttcacgatttggtattgacagcacccgttgcctgcgttggtgttagcttattggaagattcaccgaaaagtttctctacatctgctgttgttgtattgcgtttaaattttggaggaaatggagttgcgaaaacccttcatctgctcctgtgttttcctttctgtcatggtctttgctcaagttgccaatgggttttatcttcctggaagctatatgatcacttactcaaataaaagtccgatatttgccaaagttaattcgttgacttcgattgaaactgagcttcccttcagctactacagcctcccttactgcccaccggtgggcggtataaagaaaagtgctgagaatcttggagaacttctgatgggagatcagatcgataactcgccataccgattccagatgaatgttaacgagactgtttacctctgtaccacgtctccgttgaatgagcacgaggtgaagctacttaaacaaaggactagggatctgtatcaagtgaatatgatccttgacaacttgcctgttatgaggtttaccacccaaaatggggttaaaatccagtggacagggttccctgttgggtacactccacctgatggtggtgcagattacatcattaaccaccttaagttcacggttttggttcatgaatatgaaggaagtggggttgaaattgtgggaaccggagaggaaagtttgggtgttttttctgagtctgacaagaaaaaggcatccgggtatgaaatagttggatttcaggttgtcccctgtagtattaaatatgatcctgaggtcatggtcaagcacaaaatgtatgatactctttctcctataggctgcccggctgagcttgacaagtatcaagtgataagagagcaggaaagaatatcgttcacatacgaggttgaatttgtgaaaagtgatataaagagtggccattacggcgggatgcttatttgaagatggagggttcccgagtacattggttctcaatcttaaattcacttatggttatttctttccttgctggtattgtttttgtcattttcctgagaactgtgagaagggacttgactaggtacgaggaactggacaaagagactcaagctcagatgaacgaggagctctctggatggaaacttgttgtgggtgatgtgtttagggagccttgttgctcaaagcttctctgtgtgatggttggagatggggttcaaattcttggaatggctggtgttactattgtttttgcagcacttggcttcatgtcaccagcatcccgaggaatgttactaactggaatgatccttttgtatcttatcctaggcattgctgcaggctatgccagtgtacgtttatggaagacaattaaaggaactgcggaagggtggagatcagtttcctggtcggctgcatgtttttttcctggaattgctttcgttattcttacagtactaaatttcattctatggagcagtaacagtactggtgccatacccatttccttgtattttaagctgttcttcctctggttctgcatttcagtacctcttaccctcattggaggatttatagggacaaaagctcagccaattgaatttcctgttcgcactaaccagatcccaagggaaattcctgcacgtaaatacccatcgtggcttcttgttcttggtgctggaactcttccatttggaactctcttcattgagcttttcttcatcctttccagtatttggcttgggaggttctattatgtgtttggtttcctgttggttgttcttctattgctaattattgtttgtgctgaagtgtctgttgtcctcacttatatgcatctctgtgtggaagattggcaatggtggtggaaggcattctttgcttcaggttctgtggctctttatgtcttcctatactccatcaactacttggtcttcgacctgcagagtttgagtggaccagtctcagctaccctttaccttggctattcattactcatggccattgcaatcatgttttcaaccggcaccatcggcttccttatgtcattctactttgtgcactacttgttctcatcagtaaagatagattgaggttcttgctgtcattgcacattaacgatgcaaaaattgatataacttctaccgagtcctttttgtatcttgatcacatcgcagagtagggcaacagatggtgcttcattctttgtccaaaactgttattaaacggttctatgttgatggaatctgcagtttgttctccttctgcctgtttcccaaagtcgtgtactcattcaagtattcaactggtgttttagatcattatgtgttaagcattttagtttgagtttctttagaaggttgtaattcaaactgtctcgtctcatttcaatacagtagaaaaattatgttagataactctttgtgattactccgtgcttctgggtttttaattttctagcttctttgtggattgaaggatggaatgtgacctagtataggatagggaaagtgacttatatattttattaaaaggattttatttaaacttaattgtctgcatttttgccttcagaatattattgtatcaattttatttcagatggttcagcttgtacatgagttaatttctggatatggaaaatattggataaacgtactattgcaa

SEQ ID NO: 3402 - DNA, 2532 bp, Arachis hypogaea
cctatcccctgtgtgccttgcctatcccctgttgcgtgtctcagaagcaagtggtatcaacgcagagtggccattacggccggggactgttcttttgtggtgaggactgaggacgatccaatccgcggatccaacataacccaaatatcgaataatttgcttctgcttcattcctaccgccggaaaccatctggtgcgttgagttcagatctctctccctctttccattaccaaattccaggataagaatctggatgcattattgttcgagttagcgtagactcataaaaaaagtgaagggaatggagttggtaacaaagccattgatgtactgggtttttatttccatcattgtctttgctgctcaactttgcaatggtttctatctgcctggaagttacatgcatacgtatgtaaatggagataatatatatgccaaggtgaattcattgacctctattgaaaccgagcttccattcagctattacagccttccatactgcaagccgcttggtggcataaaaaagagtgcggagaatctcggagagctccttatgggggatcagattgataactcaccctatcggttccagatgaatgttaatgagtcaatctatctctgtacaacaaccccgctgaatgagcatgaggtgaagctgctcaaacaaagaacgcgggatctgtaccaagtgaatatgatccttgataacctcccagttatgcgatttgctgttcaaaatggggttaaaatccagtggacagggttccccgttgggtatacaccccctggtagcaatgatgactacatcatcaaccacctgaagtttacaattttggttcatgaatatgaaggaagcaatgctgagattatagggactggggaggaaggtttgggtgttatttctgaatccgacaagagtaaagcatctggatatcaaatagttggctttcaggtttccccttgcagtgttaaatatgatcctgaagtcatgacgtcgctccacatgtatgataatatcacttctataagctgcccaagtgaacttgacaagtatcaagtaataaaagagcaagaaaggatatcattcacatatgaggttgaatttgtgaaaagtgatataaaatggccatcgcgttgggatgcttatttgaagatggaaggttccaaagttcattggttctcaatcatgaactcacttatggtcatctttttccttgctggtattgtctttgttattttcttgaggactgtgcgaagagacctgacaaggtatgaggaactggataaagaggcacaagctcaaatgaatgaggagctctcaggatggaaacttgttgtgggagatgttttcagggagcctaattgctcaaagcttctgtgtgtgatggttggagatggagttcaaattcttgggatgggtggcgttaccattgtttttgcagcccttggttttatgtcaccagcctcccgtggtatgttactaacaggaatgatactcttatttcttatccttgggattgctgccggttatgttagcgtacgactctggagcaccattaagggaaccacggaaggttggagatcaatttcctggtccgcagcttgtttctttcctggaatcgctttcattattcttacagtactgaattttattctgtggggcagcagcagtactggtgcgattcccatttccttgtattttgagctcttcttcctttggttctgtatttcggtaccacttaccatgattggaggatttatggggacaagagcagaggcaattgaatatcctgtgcggactaatcaaattcctagggaaattcctgcccgtaaatatccatcttggcttcttgttctcggtgccggaactcttccatttggaaccctctttattgagcttttcttcatcctttccagtatttggcttgggaggttctattatgtatttggtttcctgctcgttgttcttctgctgctgattattgtttgtgcggaagtatctgttgtcctcacctatatgcacctttgtgtggaagattggcagtggtggtggaaggcattctttgcttcaggttctgtttcgctgtatgtcttcttgtattcaattaactatttggtttttgaccttcagagtttgagcgggccagtctcagctacactttaccttggctattcgctactcatggcagtggcaatcatgttggccactgggacagttggcttccttacatcattctacttcgtgcattacttgttctcatccgtaaagatagattgaggttcctgctgctctctttcattgactcagcgaaaagatcagttgatctatactctgttgagttcattttgtagctttgcttgaattgcagaacagtgagtaggcaactgatggtaattgatcgcaataggcaattgtgaattgttatattacatattgcaatatctgcagtttgttccccttctccctgtctcccaaagtgatttgctcgttctagtattcaactagtgttctagctcattttgttttaagt

SEQ ID NO: 3403 - DNA, 2640 bp, Trifolium pratense
tgcgatttgtgtgaataatttcattcagaccaaacgcattgcatattctcgatcttcttctctttgtccctttctttcttccacccaaaaattacaaaattcatcttttgcattcacttcactttcgatcgatctatccaattcattcatcgccaaaacccttcatttgatatcactgttggagttagcttagattcacaggaaacttttcagcacctcctactgtcgtttcgtgttcaaggacatggagttaccaactatgagaaaacccttcatctgctgggttttcctttctgtcgttgtctttgctcaagttagcaatggtttttatttgccgggaagctacatgcatacttattccaatggagaatttataaatgctaaagtcaattcgttgacttctattgagactgagcttcccttctcttactatagcctcccttactgccagccccctggtgggataaagaaaagtgccgagaatcttggagaactacttatgggagatcagattgataactcaccctaccgatttcgaatgaatgtaaatgaaactctatacctctgtacaacatcgccattgaatgagcatgaggtaaagctactcaaacagcgaactcgtgatctgtatcaagtgaatatgatcctcgacaacttgccagttatgaggtatactagccaaaatggggttaaaatccagtggacagggttccctgttgggtacactccatctgatggtggtgcagattacatcattaaccacctaaaattcactgtatttgttcatgaatatgaagggagaggggttgaaattattggaactggggaagaaggtatgggcattatttctgaagctgacaagaagaaggcatcagggtatgaaatagttggttttcatgttattccttgtagtattaaatatgaccctgaagccatgaaaaagcacaaaatgtatgatggtatctcttctgtgagctgcccaaatgagcttgacaagtatcagataataaaagagcaagaaaggatatcattcacatatgatgttgaatttgttaaaagtgatataagatggccatcacgttgggatgcttatttgaagatggagggttcccgagttcattggttctcgatcctaaactcactgatggttattgttttcctagctggtattgtttttgtcattttcttaagaactgtaagaagggatttgacaaggtatgaggaattggacaaagaggcacaagctcagatgaacgaggagctttctgggtggaaacttgttgtcggtgatgtatttagggagcctgattactccacacttctctgtgtaatggttggagatggggttcagattcttggaatggcagctgttactattgtttttgcagcacttggtttcatgtctccagcatcccgaggaatgctactaacaggaatgatcattttataccttatccttggaattgctgctggctatgtaagcgtacgtctttggaggatcattaagggaacatcaggggggggttttttcctggcattgctttcgttatcctcacagtactcaatttcattctatggaacagcaacagtaccggtgctatacccatttccttgtattttgagctgttcttcctctggttctgtatttcagtacctctgaccctcattggaggatttatgggtacaaaaggagagtcaatcgaatatcctgtaaggaccaatcagattccaagggaaattcctgcacgaaaatatccatcatggctacttgttcttggtgctggaactcttccatttggaaccctcttcattgagcttttctttatcctttccagtatctggcttgggaggttctattacgtgtttggtttcctgttggttgttcttctgttgctgattgttgtttgtgccgaggtatcggtggtcctcacatacatgcatctgtgtgtggaagattggcgatggtggtggaaggcattctatgcttcaggttctgttgctctttatgtcttcttgtactcaattaactacttggttttcgacctgcagagtttgagcggacctgtgtcagctaccctataccttggctactcactactcatggcaattgcaatcatgttgtcgactggcaccattggcttccttatgtcattctactttgtgcactacttgttctcatcagtgaagattgattgagattctcagctgttatctctcagtacccgtgtaaaagatcaattgatatatcttctatgagttctttttgtagcttgattgcatcgtagaatatagcgaggcaacggatgcttcattgatttctttaaattgtcatcaatggatttgatactgctatgtgtctgcagtttgttcgttcctcttctatctttctctgaaagtagtcattcaagtaccagactagtgtttgagctcattatatttcaagtactctagtttaaactaaatttctttaggaagttgtaattgcccagtttgtcttgcatcttttcaacatatagaaaaatgttagatggatactcagatttcgttgtgatgttcattatgtttgtttaattgttatatcttctgtactttcaaggatagggaagaaaacttggtgttatgctacttcttatgaggatt

SEQ ID NO: 3404 - DNA, 2405 bp, Trifolium pratense
gccaaaacccttcatttgatatcactgttggagttagcttagattcacaggaaacttttcagcacctcctactgtcgtttcgtgttcaaggacatggagttaccaactatgagaaaacccttcatctgctgggttttcctttctgtcgttgtctttgctcaagttagcaatggtttttatttgccgggaagctacatgcatacttattccaatggagaatttataaatgctaaagtcaattcgttgacttctattgagactgagcttcccttctcttactatagcctcccttactgccagccccctggtgggataaagaaaagtgccgagaatcttggagaactacttatgggagatcagattgataactcaccctaccgatttcgaatgaatgtaaatgaaactctatacctctgtacaacatcgccattgaatgagcatgaggtaaagctactcaaacagcgaactcgtgatctgtatcaagtgaatatgatcctcgacaacttgccagttatgaggtatactagccaaaatggggttaaaatccagtggacagggttccctgttgggtacactccatctgatggtggtgcagattacatcattaaccacctaaaattcactgtatttgttcatgaatatgaaggcagaggggttgaaattattggaaccggggaggaaggtatgggcattatttctgaagctgacaagaagaaggcatcagggtatgaaatagttggttttcatgttattccttgtagtattaaatatgaccctgaagccatgaaaaagcacaaaatgtatgatggtatctcttctgtgagctgcccaaatgagcttgacaagtatcagataataaaagagcaagaaaggatatcattcacatatgatgttgaatttgttaaaagtgatataagatggccatcacgttgggatgcttatttgaagatggagggttcccgagttcattggttctcgatcctaaactcactgatggttattgttttcctagctggtattgtttttgtcattttcttaagaactgtaagaagggatttgacaaggtatgaggaattggacaaagaggcacaagctcagatgaacgaggagctttctgggtggaaacttgttgtcggtgatgtatttagggagcctgattactccacacttctctgtgtaatggttggagatggggttcagattcttggaatggcagctgttactattgtttttgcagcacttggtttcatgtctccagcatcccgaggaatgctactaacaggaatgatcattttataccttatccttggaattgctgctggctatgtaagcgtacgtctttggaggatcattaagggaacggggggggttttttcctggcattgctttcgttatcctcacagtactcaatttcattctatggaacagcaacagtaccggtgctatacccatttccttgtattttgagctgttcttcctctggttctgtatttcagtacctctgaccctcattggaggatttatgggtacaaaaggagagtcaatcgaatatcctgtaaggaccaatcagattccaagggaaattcctgcacgaaaatatccatcatggctacttgttcttggtgctggaactcttccatttggaaccctcttcattgagcttttctttatcctttccagtatctggcttgggaggttctattacgtgtttggtttcctgttggttgttcttctgttgctgattgttgtttgtgccgaggtatcggtggtcctcacatacatgcatctgtgtgtggaagattggcgatggtggtggaaggcattctatgcttcaggttctgttgctctttatgtcttcttgtactcaattaactacttggttttcgacctgcagagtttgagcggacctgtgtcagctaccctataccttggctactcactactcatggcaattgcaatcatgttgtcgactggcaccattggcttccttatgtcattctactttgtgcactacttgttctcatcagtgaagattgattgagattctcagctgttatctctcagtacccgtgtaaaagatcaattgatatatcttctattctgttctttttgtagcttgattgcatcgtagaatatagtgaggcaacagatgcttcattgttcctcttctacctgtctctgaaagtagtcattcaagtactcgactagtgtttgagctcattatatttcaagtactctagtttaaactaaatttctttaggaagttgtaattgctcagtttgtgttacatcttttcaacatatagaaaaatgttagatggatacccagatttcgatgtgatgttcattatgtttgtgggcgtttaattgttatatcttctgtattttcaaggatagggaagaaaa

SEQ ID NO: 3405 - DNA, 2898 bp, Glycine max
catattaataaataaggtcagatgcacataattatttgggaggcgtaggtgggctatccatacaaacatgggaatatcatgcccaacccgatgccattattgttcgctacatttctgattctttctcgctcacacttgcgacaccttcaacacaagaacaataatcatctgtggcgttgcgatatctctccctttcccaaactcaatatatcgccaaaattcctggatttggtattgactgcaccggtgttggtgttggtggttgggagttagcttattagaagaagattcacagagaagtttttctgcatctgctgttgttgtattgcattgaaggaaatggagttgcgaatacccttcatctgccgctgtgttttcctttttgtcgtcgtctttgctcaagtagtcaatgctttttatctccccggaagctatatgcacacttactcaaataaagatctcatatatgctaaagttaattcgttgacttcgattgaaactgagcttccctacaactactacagcctcccttactgccagccggatggcggcataaagaaaagtgctgagaatcttggagaacttctgatgggagatcagatcgataactcaccgtaccgattccagatgaatgttaatgagacgctttacctctgcactacgcccctgttgaatgagcacgaggtgaagttactcaaacaaagggcacgggatctgtatcaagtgaatatgatccttgacaacttgcctgttatgaggtttaccaaccaaaatggggttacaatccagtggacagggttccctgttggatacactccatctgatggcagtgaagattacatcattaaccaccttaagttcacagtcttggttcatgaatatgaaggaagtggggttgaaattgtggggactggcgaggaaggtttgggtgttatttcagaatctgacaataaaaaggcatcaggttatgaaatagttggttttcaggttgtaccttgtagtattaaatatgatctggaagtcatgacaaagcacaagaggtatgatactctttctcctataagttgcccggctgagcttgacgagtatcaagtgataagagagaaggaaaggatatcattcacatatgaggttgaatttgtgaaaagtgatataagatggccatcacgttgggatgcttatttgaagatggagggttcccgagttcattggttctcaatcttaaattcacttatggttatttctttcctggccggtattgtttttgtcattttcctaagaactgtgagaagggacttaacgaggtatgaggaactggacaaagagactcaagctcagatgaacgaggagctctctggatggaaacttgttgtgggtgatgtgtttagggagcctgattgctcgaagcttctctgcgtgatggttggagatgggattcaaattcttggaatggctggtgttactattgtttttgcagcacttggcttcatgtcacccgcgtcccgaggaatgctactaacagggatgatcgtcttatatcttatcctgggaattgctgcaggctatgtcagcgttcgtgtatggaggaccattaagggaacaacagaagggtggagatcaatttcctggttggctgcttgtttttatcctggaattgctttcattattcttacagtactgaattttattctatggagcagtaacagtactggtgccataccgatttccttgtattttgagctgttcttcctctggttctgcatttctgtacctcttaccctcattggaggatttatggggacaaaagctcagccaattgaatatcctgtacgcactaaccagattccaagggaaattcctgcacgtaaatacccatcgtggcttcttgttcttggtgctggaactcttccatttggaaccctcttcattgagcttttcttcatcctttccagtatttggcttgggaggttctattatgtgtttggtttcctgttggtagttcttctattgctaattgttgtttgtgctgaagtgtctgtggtcctcacttatatgcatctctgtgtggaagactggcggtggtggtggaaggcattcttcgcatcaggttctgtggctctttacgtcttcttatactccattaactacttggtgttcgacctgcggagtttgagtggacctgtctcagctaccctttaccttggttattcactactcatggccattgcaatcatgttgtctaccggcaccatcggcttccttatgtcattctactttgtgcattacttgttctcatcagtaaagatagattgaggttcttgctgtcattgcatattaactatgcaaaagattaattgatataacttccgctgagtccttgtagcttgatcacattgcggagtagggcaacggatgtttcattcattgtctgattttatattgcgatgggatctgcagtttgttctccttcttcttgtttcccaaagtagtgtactcattcaagtattctgctagtgtttgagatcattatgtttcaagtgttttagttaagagtttctttagaaggtttgtaattcaaaactgtcttatctcatttcaatactgtagaaaaatgatgttagatagatatatgctttcagaactcgttctgatgttcattgtgcttctgggtatttaatatttttagcttctttgggttaaaggatgggaaaatgacttagtataggttagggaaagtgacttagtattttatttaaactaactgtccgctcaattttggcttttataatattattgtttcattttttattttattttatagccggtgctgcacatgtacatttgagttgataattttgtgtatggaaaatattggatatacgtagtattggtattgca

SEQ ID NO: 3406 - DNA, 2402 bp, Arachis hypogaea
atcgaatactttctacaccagaacgatctggtgcgttgagttcagatcgcttcatcgtcagattcgaagattggaatttggacacatcagtgttcgagttagcatagattcacggaaaaagggttgaaggaaatggggtttgtaagaaagccgttgatctgctgggttttcgtttccatggttgtctttgctgctcagcttagcaattgtttctatctgcctggaagttacatgcacacatatgtaaatggagataaaatatacgccaaagtgaattcgctgacctcgattgaaactgagcttccattcagctattacagccttccatactgcaagccgcttggtggcataaagaagagtgctgagaatctcggagagctccttatgggggatcagattgataactcgccctaccggttccaaatgaatgttaacgagacaatctacctctgtacaacaacccctctgaacgagcatgaggttaagctacttaaacagagaactcgggatctgtaccaagtgaatatgatccttgataacctcccggttatgcggtttgctgttcaaaatggggttaagatccagtggacagggttccccgttgggtatacaccccctggtagcaatgatgactacatcatcaaccacctgaagtttacaattttggttcatgaatatgaaggaagcaatgctgagattatagggaccggagaggaaggattgggggttatttctgaatccgagaagaagaaagcatctggatatgaaatagttggctttcaggtttccccttgcagtattaagtatgatcctgatgtcatgacaaaactccacatgtatgataataccaatcctataacctgcccaagtgagcttgaaaagtatcaagtaataagagagcaagaaaggatatcattcacatatgaggttgaattcgtgaaaagtgatataagatggccgtcccgttgggatgcttacttgaagatggaaggttccagagttcattggttttcaatcatgaattcgcttatggttatctttttccttgctggtattgtctttgttattttcttgaggactgtgcgaagggacttgacaaggtatgaggaacttgataaagaggcacaagctcagatgaatgaggagctctcgggatggaaacttgttgtgggagatgttttcagggagcctaattgctcaaagcttctgtgtgtcatggttggagatggagttcaaattcttgggatgggtggtgttaccattgtttttgcagcccttggttttatgtcaccagcctcccgtggtatgttactaacaggaatgattcttttatttcttatccttgggattgctgccggttatgttagcgtacgactctggagcaccatcaagggaaccacggaaggttggagatcaatttcctggtccgcagcttgtttctttcctggaatcgctttcattattcttacagtactgaattttattctgtggggcagcagcagtactggtgcgattcccatttccttgtattttgagctcttcttcctttggttctgtatttcggtaccacttaccatgattggaggatttatggggacaagagcagaggcaattgaatatcctgtgcggactaatcaaattcctagggaaattcctgcccgtaaatatccatcttggcttcttgttctcggtgccggaactcttccatttggaaccctctttattgagcttttcttcatcctttccagtatttggcttgggaggttctattatgtatttggtttcctgctcgttgttctactgctgctgattattgtttgtgcggaagtatctgttgtcctcacctatatgcacctttgtgtggaagattggcagtggtggtggaaggcattctttgcctcaggttctgtttcgctgtatgtcttcttgtattcaattaactatttggtttttgaccttcagagtttgagcgggccagtctcagctacactttaccttggctattcgctactcatggcagtggcaatcatgttggccactgggacagttggcttccttacatcattctacttcgtgcattacttgttctcatccgtaaagatagattgaggttcctgctgctatctctcattgactcagcgaaaagatcagttgatcgatactctgctgagttcattttgtagctttgcttgaattgcagaacagtgagtaggcaactgatggtaattgatcgcaataggcaattgtgaattgttatattacatattgcaatatctgcaatttgttccccttctccgtctcccaaagtgatttgctcgttctagtattcaactagtgttgtagctcattttgttttaagtactttagtttcatttgattaggaacttgtaacttttcagact

SEQ ID NO: 3407 - DNA, 2331 bp, Manihot esculenta
cattgattcaaagatctgcgtaatttagtagctttcacattgatgtcgaaaatgaggatgcccaccgtttattgggcttcccttttggtgttcatctttgtgcatgcttgcaatgccttttatctgcctggcagctatatgcacacctattcaaccggtgaacctatatttgccaaagttaattccttaacttctattgaaactgagcttcccttcagttactatagcctaccttactgcaagccagctggtggaataaaaaaaagtgctgagaatcttggggagctccttatgggagatcagattgataactcaccttaccagtttagaatgaatgttaatgagtctgttttcctttgtactactcctccattgagtgagcatgaggtaaagcttttgaagcagagaacccgtgatctgtatcaagtgaatatgattttagataatttgcctgccatgaggtatgcaaagcaaaatggagttaacattcagtggactgggtttccagttgggtatgcaccacagaatagtaatgatgattacattatcaatcaccttaagttcacagttttggttcatgagtatgaagggagtggtgtggagataattggtactggggaagaaggtatgggtgtcatttctgaagctgataagaagaaagcatctggttatgagatagttggttttgaggttgtcccatgcagtgttaaatatgatcctgaaacaatgtctaagcttcatatgtatgataatatctcatctgccaactgccccttggaacttgacaagtctcaggtaataagggagcaagagagagtttctttcacttatgaggtttcatttgtgaaaagtgatactagatggccatctcgttgggatgcttatttgaagatggaaggtgctcgtgtccactggttctctattcttaattctcttatggtgatctttttcctagctggcattgtttttgtcattttcttgaggactgtgagaagggatttgacaagatatgaggaattggacaaagaagctcaagcacagatgaatgaggagctttcaggttggaagcttgttgttggtgatgtgtttagggaaccagattgctccaagcttctttgcgtcatggttggagatggagttcagattacggggatggcagtggtcacaattgtttttgcagcccttggtttcatgtcaccagcttcacgaggaatgctgctgacaggaatgataattctttatcttttcttgggcattgctgcaggctatgtttcagtacgtttgtggagaaccgtgaagggaacatcagaaggatggaggtgtgtttcctgggcatctgcatgcttcttccctggaattgcctttgtcatcctcacagtgttgaatttcattctatggggaagcaagagtactggtgctattcccatttccttgtattttgtacttctggccctgtggttctgtatttcagtgccactcaccctcctgggaggattctttgggacacgagctgaggcaattcagtatccagtccgaaccaaccagatcccaagggaaattcctgcacgcaaatacccatcatggcttcttgttcttggtgctggaacacttccatttggtacccttttcatcgagttgttcttcatcctttccagcatctggcttggaaggttttattatgtctttggtttcttgctcattgttcttctgctattggtaattgtttgtgctgaagtgtcagtggttctaacttacatgcatctgtgcgtggaggactggcgatggtggtggaaggcattctttgcatccggttcagttgctctctatgtgttcttatactccatcaattatttggtttttgacctgcagagtttgagtggacctgtgtcagctatactgtatcttgggtactcactgctcatggcaatagcaatcatgttgtctactggcacaatcggcttccttatgtccttctactttgtccattaccttttctcgtcggtaaagattgactagaagcgtttaacgtcttaacaatcagttgagaaggaaactgcttgcacaaagaggaagctgtcccctattcacaatttctctctctctctctctctctctctctctctctctctcttatgggatttgctaaaatttcttaagatagctgatattgttgtgctgtattaaagactcagatgatatggctaaaaatgatcaaggcctgttatattttttttctgcttttgagtttaggacatgatagtagttttgagcttcattcgaaattgtagaaactggtgatggtcttgctgttatgtactatttctttttctc

SEQ ID NO: 3408 - DNA, 2242 bp, Manihot esculenta
cttgtaggttaacttagattcgagtactgattcaaagacctacttaatttagtggctttctcgttgatgttgaaaatgaggatgcccgcaatttaccgggctttcattttggtggttctctttgcacatgcttgcaatgcattttacctgcctggtagctatatgcacacctattcaaatggtgaaccgatatttgccaaagttaattccttaacttctatagaaaccgagcttccctttagttattatagtctaccttattgcaagcctgctggtggaattaaaaaaagtgctgagaatctcggggagctccttatgggagatcagattgataactctccttaccggtttagaatgaatgtcaatgagtctgttttcctttgcactacgcctccactaagtgaacatgaggtaaagcttttgaagcagagaacacgcgatctgtatcaagtgaatatgattttagataatctgcctgccatgaggtatgctaagcaaaatggagttaacattcagtggactgggttcccagttgggtatgcaccacagaatagcaatgatgattacatcatcaatcaccttaaattcacagttttggttcatgagtatgagggtagtgctgtggagataattggtactggagaagaaggtatgggtgtgatttctgaagctgataaggagaaggcatctggttatgagatagttggttttgaggttgtcccatgcagtgttaagtatgatcctgaagtgatggctaagcttcatatgtatgacaatatctcatcagtcaattgtcccttggaccttgacaagtctcagatcatacgggagcaagagagagtttctttcacatatgaggttgaatttgtgaaaagtgatactagatggccatctcgttgggatgcttatttgaagatggaaggtgctcgtgtccactggttctctattctaaattctcttatggttatctttttcctagctggcattgtttttgtcatattcttaaggaccgtgagaagggatttgacgaaatatgaggaattggacaaagaagctcaggcacagatgaatgaggagctttcggggtggaagcttgttgtgggtgacgtgttcagggaacctgattgctcaaagcttctctgcgtcatggttggagatggagttcagattacagggatggcagtggtcacaattgtttttgcagccattggtttcatgtcaccagcttcacgaggaatgctgctgacaggaatgataattctctatcttttcttgggcattgctgcaggttatgtttcagtacgattgtggagaaccataaaggggacctcagaaggatggaggtcagtttcctggtcagctgcgtgcttctttcctggaattgcctttgttatccttacagcgctgaatttcattctatggggaagcaagagtactggtgctattcccatttccatgtattttgtacttctgtccctgtggttctgtatttcagtgccactcactcttttgggaggattctttgggacacgagctgaggcgattcagtatccagtccgaaccaatcagatcccaagggaaattcctgctcgcaaatacccatcatggctgcttgttcttggtgctggaactcttccatttggaacccttttcattgagctgttcttcatcctttctagcatctggcttggacggttttattatgtctttggtttcttgctcatagttctgctgctgttggttattgtttgtgctgaagtgtcggtggttctaacctacatgcatctctgtgtggaggattggcagtggtggtggaaggcgttctttgcttctggttcagttgcactctacgtgtttttatactccatcaattatttggtttttgacctgcagagtttgagtggacctgtatcagctgtactctatctcggctactcattgctcatggcaattgcaatcatgttgtctactggcacagttggcttctttatgtctttctactttgtgcattaccttttctcatcagtaaagattgattagaagcctttgatgcctttaacaatcccttgagaaggaagactgcttgcacaaaaaggaagctgccccttgtttccaatttttttttttttctggctaaattccatatgatagctgatcttgtcgtgctgtattaaagactcggatcatatgcttaaaattcagcgaggcctgttatatttttcaatactttcgagtttagagc

SEQ ID NO: 3409 - DNA, 2288 bp, Euphorbia peplus
tccgagatccgatctgcgtttttgttcagatctggttaacttagatccagcactgattcaaagatcttgtgaactcccgtccggggctttcgaaaatgaggatgcccaaaatttactgggcttccattttggtgcttctctttgtgaattcttgcaatgcgttttatctgcctggtagctatatgcacacgtattcaaccggcgaacctattatagccaaagttaactctttaacttctatagaaaccgagcttccttatggctactacagtctcccttattgcaagccacctggtggtgtcaagaatagtgcggagaatctcggggagctcctcatgggagatcagattgataactctccttatcgatttaaaatgaataccaacgagtctcttttcttatgtactactccaccgttgagtgaacatgaggtcaagcttttgaagcagaggactcgtgatctgtatcaagtgaatatgattctggataatttgcctgccatgaggtatgcaaagcaaaatggaatcaacattcagtggactggtttcccggttgggtatacaccacagagcagtaatgatgactacatcattaaccatctaaagttcacggtcttggttcatgagtatgaaggcactggtgtgcagataattggcactggggaagaaggtatgggtgtgatttcggaagctgataagcagaaagcatctggatttgagattgttggtttcgaggttgttccatgcagtgttaaatatgatcctgaagcgatgtcaaaacttcatatatatgatcctattgcaaaagtcaactgccccatggaccttgacaagtctcaaatcataagagaacaagagagggtttctttcacttatgaggttgagtttgtgaaaagtgatattagatggccatctcgttgggatgcttatttgaaaatggaaggtgctcgtgtgcattggttctcaatcctaaattcccttatggtgatctttttccttgctggtattgtttttgtcatatttttaaggactgtgagaagagatctgacaagatacgaggaattggacaaagaagctcaggcacagatgaatgaggagctttcaggatggaagcttgttgtaggcgatgtgttcagagagcctgaatgctcaaagcttctctgtgttatggttggggatggagttcagattacagggatgggagttgttactattgtttttgcagcccttggtttcatgtcaccagcttcacgaggaatgcttctcacaggaatgataatcctgtatcttttcttaggtgctgctgcaggatatgtagctgttcgtttgtggagaacaatgaaggggacttctgaagggtggaggtcagtttcctggtcagctgcatgtttcttccccggaatcgcctttgtgatactcacagttctcaactttattctgtggggaagcaagagtaccggtgctattccaatttccttgtattttgtactgctggctctctggttctgcatatccgttccgctaaccctcttgggaggtttctttggaactcgtgctgaggaaattaccttccctgtccgaaccaaccagatccctagggaaattcctgcacgaaaatatccatcatggcttcttgttcttggtgctggaactcttccatttggaacccttttcattgagctgttcttcatcctttcaagcatctggctaggacggttctactatgtctttggtttcttgcttatagtgcttctcctcttggtggttgtttgtgccgaagtctcagttgtccttacctacatgcacctctgtgtggaggactggcggtggtggtggaaggctttcttcgcctctggttcagttgctctctacgttttcttatattccatcaattatttggtttttgatctgcagagtttgagtggacccgtgtcagctgtactctatcttggctactccctgctgatggcaatagcaatcatgctgtcaactggcacaattgggttccttgtgtctttctactttgtgcattaccttttctcatcagtaaaaattgattagaagacaatgcttcactacaaacggatggagaaaactgcacacgaaagagtaaggaagccctcttggttccacaattcacattttttttggcatttgctaaagttcttataagctgattttgttatgctgtattaaagacttctagattatatgctaaatgcatcacagcctgttatatttttctatgcatttgatttaagcttaggaaacaagatatttgtagttttc

SEQ ID NO: 3410 - DNA, 2844 bp, Ricinus communis
aagagccaggcttagtattccacacatacatatatcgcgaatctctgcatcttctttcactactcttcggttcaactgcacattaataataagaaaccgtttgtttcttctgcttttctgcttcctcttcacgctactcgacccgctcttctcggaatccggatccgctccgtttctacccgaactatacttcgcttctccagatctactttagcttaagttagatcgagcaactgattccaaggatttggtttaaatttggtgcctttctccttgatggtgaaaatgaggatgcccacagttcactgggcttcccttttggtggtgctttttgcacacacttgcagtgcattttatttgcctggtagctatatgcacacatattcaactggtgaaaagatcgttgccaaagtcaattcattaacttctatagaaactgagcttccatttagctactacagtctcccttattgcaagccgcccggtagaattagaaaaagtgctgaaaatcttggggaacttcttatgggagatcagattgataattctccataccagtttagaatgaatatcaacgagtctgtttttctttgcactacacctccattgagtgaacatgaggtaaagcttttgaagcagagaactcgtgatttgtatcaagtgaatatgattttagataatttgcctgctatgaggtatgccaagcaaaatggagttaatattcagtggactgggttcccagttgggtatacaccgcagaatagtaatgatgattatatcatcaatcatttaaagtttactgtcttggttcatgagtatgaagggagtggggtggagataattggtactggggaagaaggtatgggtgtgatttctgaagctgataagaagaaggcttctggttttgagattgttggttttgaggttgtaccatgcagtgttaagtacgacccagaagtgatgtcaaagcatcatatgtatgacagtatctcatctgttaactgccccatggaccttgacaagtctcagatcataagggagcaagagagagtttctttcacatacgaggttgaatttgtgaaaagtgatactagatggccttctcgttgggatgcttatttgaagatggaaggtgctcgagtccactggttctctattctaaattctcttatggtgatatttttcctagctggaattgtttttgtcatcttcttgaggactgtgagaagggatttaacaagatacgaggaactagacaaagaagctcaagcacagatgaatgaggagctttcaggctggaagcttgttgtgggtgatgtgttcagagaaccagagtgctcaaagcttctctgcgtcatggtcggagatggagttcaaattacagggatggcagttgtcactattgtttttgcagcccttggttttatgtctccagcatcacgaggaatgttactgaccggaatgataattctttaccttttcttgggtattgctgcaggctatgtttcagtacgtttgtggagaaccatgaagggatcttctgaagggtggaggtcaatttcatggtcagctgcatgcttcttccctggaattgcctttgttatcctcacggtgctgaatttcattctgtggggaagcaagagtaccggtgctattcccatttccttgtattttgtacttctggccctctggttctgcatctcagttcctctcaccctcttgggaggattctttgggacacgagctgaggaaattcagtatccagttagaaccaaccagattccaagagaaattcctgctcgcaaatatccatcatggcttcttgttcttggtgctggaactcttccatttggaacccttttcatcgagctgttcttcatcctttctagcatctggcttggacggttttattatgtctttggtttcttgcttatagttttattgctattggtagttgtttgtgctgaagtgtcagtggtactaacttacatgcatctctgcgttgaggactggcggtggtggtggaaggctttctttgcctctggttcagttgccctctacgtgtttctatactccatcaattatttggtttttgacctacagagtttgagtggacctgtatcagctatactctatcttggctactcactgcttatggcaattgcaatcatgttgtctactggcactattggcttcctcatgtccttctactttgtgcattaccttttctcatcagtaaagattgactagaagcagttggtatgttttaaccagtcggagaaaactgcaaatgcaaccgcaactgcaagtgcattagcttcttgccataattcacatttttttcttgcttttttacttaattgttaaatttcatatgatagctgatcttgttgtgccctactgaagactccagattatattatgctaaatgcatcaaggcctgtcatgtcagtttttctatgcttctgagtttaggacattatagtagtcctgagcttcattcacattacgggttctggtcattccatcttttactctagatgctgtaattggtgacctttctgttctgtactatttttttttttttttacttctattttatcattaaaaaggagaagtcaatggcatatttactttaggtgagcctttcttaaattctcccccttgagtagcagatcattttggtccaaggccgaatggtaataatgtgaacagtgaataccctagtaagttttttgtccttgtacagggatggcagcccagtgaggctttatttttaaattttgttttattttatagtattcaggaggaaaaactgttcattaattggggaatgaaagactg

SEQ ID NO: 3411 - DNA, 3942 bp, Ricinus communis
caggcttagtattccacacatacatatatcgcgaatctctgcatcttctttcactgctcttcggttcaactgcacattaataataagaaaccgtttgtttcttctgcttttctgcttcctcttcacgctactcgacccgctcttctcggaatccggatccgctccgtttctacccgaactatacttcgcttctccagatctactttagcttaagttagatcgagcaactgattccaaggatttggtttaaatttggtgcctttctccttgatggtgaaaatgaggatgcccacagttcactgggcttcccttttggtggtgctttttgcacacacttgcagtgcattttatttgcctggtagctatatgcacacatattcaactggtgaaaagatcgttgccaaagtcaattcattaacttctatagaaactgagcttccatttagctactacagtctcccttattgcaagccgcccggtagaattagaaaaagtgctgaaaatcttggggaacttcttatgggagatcagattgataattctccataccagtttagaatgaatatcaacgagtctgtttttctttgcactacacctccattgagtgaacatgaggtaaagcttttgaagcagagaactcgtgatttgtatcaagtgaatatgattttagataatttgcctgctatgaggtatgccaagcaaaatggagttaatattcagtggactgggttcccagttgggtatacaccgcagaatagtaatgatgattatatcatcaatcatttaaagtttactgtcttggttcatgagtatgaagggagtggggtggagataattggtactggggaagaaggtatgggtgtgatttctgaagctgataagaagaaggcttctggttttgagattgttggttttgaggttgtaccatgcagtgttaagtacgacccagaagtgatgtcaaagcatcatatgtatgacagtatctcatctgttaactgccccatggaccttgacaagtctcagatcataagggagcaagagagagtttctttcacatacgaggttgaatttgtgaaaagtgatactagatggccttctcgttgggatgcttatttgaagatggaaggtgctcgagtccactggttctctattctaaattctcttatggtgatatttttcctagctggaattgtttttgtcatcttcttgaggactgtgagaagggatttaacaagatatgaggaactagacaaagaagctcaagcacagatgaatgaggagctttcaggctggaagcttgttgtgggtgatgtgttcagagaaccagagtgctcaaagcttctctgcgtcatggtcggagatggagttcaaattacagggatggcagttgtcactattgtttttgcagcccttggttttatgtctccagcatcacgaggaatgttactgaccggaatgataattctttaccttttcttgggtattgctgcaggctatgtttcagtacgtttgtggagaaccatgaagggatcttctgaagggtggaggtcaatttcatggtcagctgcatgcttcttccctggaattgcctttgttatcctcacggtgctgaatttcattctgtggggaagcaagagtaccggtgctattcccatttccttgtattttgtacttctggccctctggttctgcatctcagttcctctcaccctcttgggaggattctttgggacacgagctgaggaaattcagtatccagttagaaccaaccagattccaagagaaattcctgctcgcaaatatccatcatggcttcttgttcttggtgctggaactcttccatttggaacccttttcatcgagctgttcttcatcctttctagcatctggcttggacggttttattatgtctttggtttcttgcttatagttttattgctattggtagttgtttgtgctgaagtgtcagtggtactaacttacatgcatctctgcgttgaggactggcggtggtggtggaaggctttctttgcctctggttcagttgccctctatgtgtttctatactccatcaattatttggtttttgacctacagagtttgagtggacctgtatcagctatactctatcttggctactcactgcttatggcaattgcaatcatgttgtctactggcactattggcttcctcatgtccttctactttgtgcattaccttttctcatcagtaaagattgactagaagcagttggtatgttttaaccagtcggagaaaactgcaaatgcaactgcaagtgcattagcttcttgccataattcacatttttttcttgcttttttacttaattgttaaatttcatatgatagctgatcttgttgtgccctattgaagactccagattatattatgctaaatgcatcaaggcctgtcatgtcagtttttctatgcttctgagtttaggacattatagtagtcctgagcttcattcacattacgggttctggtcattccatcttttactctagatgctgtaattggtgacctttctgttctgtactatttttttttttttttacttctattttatcattaaaaaggagaagtcaatggcatatttactttaggtgagcctttcttaaattctcccccttgagtagcagatcattttggtccaaggccgaatggtaataatgtgaacagtgaataccctagtaagttttttgtccttgtacagggatggcagcccagtgaggctttatttttaaattttgttttattttatagtattcaggaggaaaaactgttcattaattggggaatgaaagactgagtcgcatgaacaattttcttcaatttatgaggccataactcatgaaattagctaataattggtctttgactgaagtacactagcttttttcttcggcctatatatatatatactgaacagtacacaacacattcaatagctctgttgtggtaattgatcatccaagtcagtggttgtgtatctgtcccataataccgattagttagtcttccaatcagtcttttttcctcaaactaaaatagatagcctcacgtgtttatcacaatttcttcggctatatcttttggcaaatgcataatagaaaactgctgaaagccctacttaagcatgaaaagcatccacatgaaacagaggtaggagaaaacatagaaagctcactgctgaaagttttacacgaggggtgggggtcaaagtttagacgctttattttatatttacagacaacaccaaaggttagcctctctaaaccaacctgcacccgtcgatcttgttgcgatatttaggagtcccagcaccacaatcattgtggttgaaggaacaatagttgttatcctggatagctggaatgctgtaatcatgattcagagaggcattcacaggggcattatccaggatgctttgacatcacatccgcacccttctacttgcttgtccaggatttgcattgaaacgttgccgagatgaacttgctgaattcatgggtgaacggaactggccttgaggaccggcagcaaatggagcttgagagctccgacttcgctgttgagctgaagtttgtgccctgccagcctccattgaattatattcattatgtatatttagctgatttcgggagaaagttggcctcggtgctataattccaacagtaggggggtaacttccactgcctatagttgcattgattccatcacctgagaggtagcttccactggctatacttgcatttgttccacaattagaggggttgtgacggaagtagcttccactggctatacttgcatttgttccaacattagaggggttgtgagggaagtagcttccactggctacagttgcattagttcctccactagtggagttctgctcgtagtagcttccactggctatag

SEQ ID NO: 3412 - DNA, 2778 bp, Theobroma cacao
taaccggagtgatggtggtagtggtggtattataatgagccgacagctctgttactctagcccaattcatttcataaaatttccatgatcttccatttctcaccctatatattaaggacccaatctacgctttactctcttgtaaatattctcaaaattcctcctagcttaaaccgtaaaagagagagagagagagggagagagaagcaaaagccagggggctctacttcgttctcacgcgactttgggggcgtcgcaggatccaggatccaggatccgatcagtttcaattcgaccccaacttcaaatcccgtagatctgtctcagaatattttatattgaatgcttcagtttagagtagcttagattcgagccgtatattgcaagatctgctgttatcatgacagtctcggagagcaagatgcccggaatctgctcgttttttgtgttagtgattctgtttgtccattcttgtcatgggttttacctacctgggagttacatgcacacgtattcaacctcagatactatagttgccaaagttaattccttgacttccattgaaactgagcttccttttagttactacagtctcccttactgcaaacctctcggtggaataaagaaaagtgctgagaatcttggggaacttctcatgggagatcagattgataacaccccttatcggtttcgaatgaatgtgaacgagtctctctacctttgcactaccaacgccttgaatgagcatgaggttaagcttttaaaacaaaggactcgtgatttgtatcaagtgaatatgattctagacaatttgccggtgatgaggattgcaaaacaaaatgggattaacattcagtggactggattcccggttgggtatactccaccaaatagtaatgatgattacattatcaatcacctcaagttcaaggtcttggttcatgagtatgaggggagtggagtggagataattggaactggggaagaagggatgggtgtgatttctgaagctgataagaagaaggcctctggtttcgagattgttggttttgaggtggttccatgcagtgttaaatatgatcctgaagttatgaccaaacttcacatgtatgacaatatctcctctgtcaactgccccttggagctagaaaaatcacagataataagggaacacgagaggatttcttttacttatgaggttgaatttgtgaaaagtgatattagatggccgtctcggtgggatgcttatttgaagatggaaggtgcacgtgtgcactggttctcaattctaaattcactgatggtgatcacttttctagctggtattgtgtttgtcattttcttgaggactgtaaggagggatttgacaagatatgaggaactggacaaagaagctcaagcacaaatgaatgaggagctttctggatggaagcttgtggtaggtgatgtttttagagaaccagattgtccaaagcttctctgtgtgatgattggagatggggttcagattaccggaatggcagctgtcactatagtttttgctgcccttggttttatgtcaccagcttcacgaggaatgctcctgacagggatgattattctttatcttttcttgggtattgctgctgggtatgtcgctgtacgtctctggagaactctcaagggaacttcagaaggatggaggtctgtttcctggtcggttgcatgcttctttcctggaattgtctttgttatccttacagtattgaattttattctgtggggaagcaaaagcactggtgcaattcccatttccctgtattttatactcttgtctctctggttctgcatttctgtgcctctcactctcgtgggaggattcttagggacaagagctgaagctattcaatatcctgtgcgaaccaaccagattcctagggagatacctgcacgcaaatatccatcatggcttcttgttcttggtgctgggacccttccatttggaacccttttcattgaactcttcttcatcctttctagcatctggcttggcaggttttattatgtgtttggcttcttgcttatagttcttctactactgatcattgtttgtgctgaagtgtccgtggtccttacctacatgcatctctgtgttgaggactggcgatggtggtggaaggctttctgtgcttcgggttcagttgcactctatgtgttcctgtactccatcaattacttggtctttgacctacagagtttgagtggtcctgtttcagctattctttatcttggctactctatgatcatggcaattgcaatcatgttgtctacaggcaccatcggtttcatcacttctttctattttgtccattatctgttctcatctgttaagattgattaaaagtttcatttggtgatcttcatcaacagctggaaagactttggcatggaagaggatgatatcctgattcatcattttggtttagctaaagttgcctttggtaactaatcattttacactgtatcaaagaggctctcaaaattactcaaaaattatctgttattttggtggttgttgaggttaggactttgatagattgaagagcttgtgatttgcagtcacatccttccaccctgcccccaatatcttttttcttttttattttgtcccagttacctagttatgagtttttgttggattattgtcatctcaatgattttgatgttctagaaagttgtaatcctgtattttctctcatattttaatcaaatagaaaggtttattttctttgattactg

SEQ ID NO: 3413 - DNA, 2647 bp, Gossypium raimondii
atgttggtagatttgtgactcatattttattataattttataaattacccattctcctccgttttgctctcttcaatatattcgcttcattcctactagctttaaagttaaaccactgaaacaaagtggaaaaaaaaaatatcaaagagaagcagaagcttcgttcttacgcgttttctgttcccaaagagccgaatcactttcaactggaaccctagacctgtctcagatttttcctccttatactgaatgctcagtctatagtagcttagattcgaaccgtatattgcaagatctgctattatcatggctttctcggaaaggaagatgcccggaatctgctcggtttttctgttagtggttctatttgcccattcttgtcatgggttttatctgcctggaagttacatgcacacgtattcaacttcggatacgatagttgccaaagttaattcattgacttccattgaaaccgagcttccctttagttattacagtctcccttattgcgaacctctcggtggaataaagaaaagtgccgagaatctaggtgagcttctcatgggagatcagattgataactccccttatcggtttaaaatgaatgtgaacgagtccctctatgtttgtactaccagccccttgaatgagcatgaagttaagcttttgaaacagaggactcgtgatttatatcaagtgaatatgattctagacaatttgccggttatgaggattgcaaaacaaaatggggttagtattcagtggactggattcccagttgggtttactccaccaaatagtaatgatgattacattatcaatcatctcaagttcaaggtcttggttcatgagtatgagggaagtggtgtgcagataattggaactggggaagaagggatgggtgtcatctccgaagctgataagaagaaggcatctggttatgagattgttggttttgaagtgactccatgcagtgttaagtacgatccagaagtcatgactaagcttcacatgtatgatagtatctctcctgtgaactgccccttggagctagacaagtcacagataataagggaacgagagaggatctcttttacttatgaggttgaatttgttaaaagtgatattagatggccatctcggtgggatgcttacttgaagatggaaggagcacgtgtgcactggttttcaattctaaattcattgatggtgatcactttcttagctggtattgtgtttgtcatattcttaaggactgtgaggagggatttgacaaggtatgaggaattggacaaagaagctcaagcacaaatgaatgaggagctttctggatggaagcttgttgttggtgatgtttttagggaaccagattgtgcgaagcttctctgtgtgatgattggagatggagttcagattacaggaatggcagcagtcactatagtttttgctgcttttggtttcatgtcacctgcctcacgaggaatgctactgacagggatgattattctttatcttttcttgggtattgctgctgggtatgctgctgtacgactctggagaactctcaagggaacttcggaaggatggaggtccatttcctggtcggttgcatgcttctttcctggaattgtgtttgttatcctcacagtattgaattttattctgtggggcagcaaaagcactggtgcaattcccatttctctgtattttgtactcttgtctctctggttctgcatttctgtgcctctcactctcgtgggaggattcttagggaccagagctgaagctatacaatatcctgtacgaaccaaccagattccaagggagattcctgctcgcaaatatccatcttggcttcttgttcttggtgcagggacccttccatttggaaccctgttcattgaactcttcttcatcctttctagcatctggcttggcaggttctattatgtatttggcttcttgcttatagttcttctactgcttatcattgtttgtgctgaagtttcggtggtccttacctacatgcatctctgcgttgaggactggcgatggtggtggaaggctttctttgcttcgggttcagttgcactctatgtgttcctatactccatcaattacttggtgtttgacctacagagtttgagtggtcctgtgtcagctattctttatcttggctactcaatgatcatggcaattgcaatcatgttgtctacaggcaccattggcttcatcacatcattctattttgtccattatcttttctcatctgttaagatcgattaaaaaggttccattgcgatcttcagctaccatcctgaagaagactttggcctgtaagaggatgatttctctcaagttgcctttggtagccgatcatgtatcactgtatcagtatatcaaacaggccctcaatggtcattcgaaaatatctgttatattggtgaaaggaactgatagtcgcatacttccgtcctgctctgccattttcattttcctttactgcagttacctagttattggtttttgttggattgcgcacggctcaattattttgatgttctagaaagttgtaattttgttggattgtaaaaacctttaatctttgatctttctcatatttttaatcaaatagaagggtttatta

SEQ ID NO: 3414 - DNA, 2672 bp, Gossypium hirsutum
gcttcgagcggccgcccgggcaggtacgcggggatgttggtagatttgcgacccatattttattataattttataaattacccatgctcctccgttttgctctcttcaatatattcgcttcattcctactagctttaaagttaaatcactgaaacaaggtggaaaaaaaatatatcaaagagaagcagaagcttcgttcttacgcgttttctgttcccaagagccgaatcactttcaactggaaccctagacctgtctcagatttatcttccttatactgaatgctcagtctatagtagcttagattcgaaccgtatattacaagatctgctattatcatggctttctcggaaaggaagatgcccggaatctgctcggtttttctgttagtggttctatttgcccattcttgtcatgggttttatctgcctggaagttacatgcacacatattcgacttcggataccatagttgccaaagttaattcattgacttccattgaaaccgagcttccctttagttattacagtctcccttattgcaaacctctcggtggaataaagaaaagtgccgagaatctaggtgagcttctcatgggagatcagattgataactccccgtatcggtttaaaatgaatgtgaacgagtccctctatgtttgtactaccagccccttgaatgagcatgaagttaagcttttgaaacagaggactcgtgatttatatcaagtgaatatgattctagacaatttgccggttatgaggattgcaaaacaaaatggggttagtattcagtggactggattcccagttgggtttactccaccaaatagtaatgatgattacattatcaatcatctcaagttcaaggtcttggttcatgagtatgagggaagtggtgtgcagataattggaactggggaagaagggatgggtgtcatctccgaagctgataagaagaaggcatctggttatgagattgttggttttgaagtgactccatgcagtgttaagtacgatccagaagtcatgactaagcttcacatgtatgatagtatctctcctgtgaactgccccttggagctagacaagtcacagataataagggaacgagaaaggatctcttttacttatgaggttgaatttgttaaaagtgatattagatggccgtctcggtgggatacttacttgaagatggaaggagcacgtgtgcactggttttcaattctaaattcattgatggtgatcactttcttagctggtattgtgtttgtcatattcttaaggactgtgaggagggatttgacaaggtatgaggaattggacaaagaagctcaagcacaaatgaatgaggagctttctggatggaagcttgttgttggtgatgtttttagggaaccagattgtgcgaagcttctctgtgtgatgattggagatggagttcagattacaggaatggcagcagtcactatagtttttgctgcttttggtttcatgtcacctgcctcacgaggaatgctactgacagggatgattattctttatcttttcttgggtattgctgctgggtatgctgctgtacgactctggagaactctcaagggaacttcggaaggatggaggtccatttcctggtcggttgcatgcttctttcctggaattgtgtttgttatcctcacagtattgaattttattctgtggggcagcaaaagcactggtgcaattcccatttctctgtattttgtactcttgtctctctggttctgcatttctgtgcctctcactctcgtgggaggattcttagggaccagagctgaagctatacaatatcctgtacgaaccaaccagattccaagggagattcctgcacgcaaatatccatcttggcttcttgttcttggtgctgggacccttccatttggaaccctgttcattgaactcttcttcatcctttctagcatctggcttggcaggttctattatgtatttggcttcttgcttatagttcttctactgcttatcattgtttgtgctgaagtttcggtggtccttacctacatgcatctctgcgttgaggactggcgatggtggtggaaggctttctttgcttcgggttcagttgcactctatgtgttcctatactccatcaattacttggtgtttgacctacagagtttgagtggtcctgtgtcagctattctttatcttggctactcaatgatcatggcaattgcaatcatgttgtctacaggcaccattggcttcatcacatcattctattttgtccattatcttttctcatctgttaagatcgattaaaaaggttccattgcgatcttcagctaccatcctgaagaagactttggcctgtaagaggatgatttctctcaagttgcctttggtagccgatcatgtatcactgtatcagtatatcaaacaggccctcaatggtcattcgaaaatatctgttatattggtggctgttgagaataggaaaaatttgtgatgtgtagtcgcatacttccgtcctgctctgccattttcattttcctttactgcagttacctagttattggtttttgttggattgcgcacggctcaattattttgatgttctagaaagttgtaattttgttggattgtaaaaacctttaatctttgatctttctcatt

SEQ ID NO: 3415 - DNA, 2519 bp, Gossypium raimondii
ccggaacagacatctctgtcactgtgactctagctcaaatttccatttctttttattcggtttgttcatatatgttcttacattcctcacctacattatatatatataaccccaatctctctgttcaatgatcttcagattatttgcaaaattcctaatagcttaaactattaagaagcaaaaaggcaaggagactctgatctgctagatctttctcagattccattttcatattgaatgcttcaatttagggtatagctctgtaatttttcaagatctgcagctatcaatgggaaacatgcctggaatctgttggggttttcaattattgattctatttgttcatcattgttatggattttacttgcccgggagttacatgcatacttattcgactaaagatgctatatatgctaaagttaattccttgacttcaatcgaaaccgagcttccgtttagttattacagtcttccttactgtaaaccgatgggtgggattaagaaaagtgccgagaatctcggtgagcttctaatgggagatcagatcgataactcaccttatcggtttcgaatgaatgtgaatgagtctctttacctatgcactaccagtcctttgaacgagcgcgaggttaagcttttgaaacaaaggactcgagatttgtatcaagtgaatatgattctcgataatttgcctgttatgaggattacgaaacaaaatggggttaacattcaatggacgggattcccgattgggtatactccgccgaatagtaatgatgattacattatcaatcaccttaagtttaaagttttggttcatgagtatgaagggagtggtgtgcagataatcgggaccggggaagaagggatgggtgtgatttccgaagctgataagacgaaagcttcgggttttgagattgttggtttcgaggttattccgtgtagtgttaaatatgatccagaagtcatgactaaacttcacatgtatgacaatatctcctctgtgaactgcccattggagctagacaaatcgcagataatacgggaacaagagaggatctcttttacttatgaggttgaattcgtgaaaagtgatatcagatggccgtctcgttgggatgcttatttgaagatggaaggttcacgcgtccactggttctcgattctaaattctctaatggtgatcactttcttagccggtattgtgtttgttattttattgagaaccgtaaggagggatttgacaaggtacgaggaacttgacaaagaagctcaagcacaaatgaatgaggagctttccggatggaagcttgtcgtgggtgatgttttcagagaacctaatcactcgaagcttctctgcgtgatgattggtgatggagttcagattatgggaatggctttagtcactatagtttttgcagctttgggtttcatgtcaccggcttcacgaggaatgctactcaccgggatgatcattctctatcttttcttaggtatagctgccggatatgtcgctgtttgtctttggagaactctcaaaggaactgcagaaggatggaggtctctttcctggtcagttgcatgcttcttcccaggaatcgtctttgttatccttacagcattgaatttcattctatggggcagcaaaagtaccggtgcaatcccgatttctctctacttcatactcttatctctctggttctgcatttcggttccgctcactctcttaggaggatacttcggtacccgagctgaacctatccaataccctgtacgaaccaaccaaatcccacgagaaatccctgcacgcaaatatccatcatggctacttgttctcggtgctggtacccttccatttggaaccctcttcatcgaactcttcttcatcctttcaagcatttggcttggcaggttttactatgtcttcggtttcttgcttatcgtccttctactcctcatcatcgtttgtgctgaagtatctgttgtcctcacttacatgcatctttgtgtcgaggattggcgatggtggtggaacgcattcttcgcatccggttccgtctcgctctatgtcttcctctactccatcaactaccttgtcttcgacttacagagcttgagtggcccggtttcagctgttctttacctcggttactcaatgatcatggcggttgcgatcatgttggctactggtaccattggtttcatcacatcattctattttgttcattatcttttctcgtccgttaagattgattaattgatttaaaaaatttccctttgtttgatctttttcaaagacttttggcaatgtatgggaggatgatatcttgattcattgttttgattttttgttgaagttttaacttcgttatttttctctctttttcttatatcagatagacaaggttattttctttaataaccctttgatattttttatttttctcaattcactactctttaattatggttcaaattttaaatttgtctctaaataattgaatccttaatgttgagta

SEQ ID NO: 3416 - DNA, 2613 bp, Populus trichocarpa
acacccttcgttaagtaaccctgtaactctctccatacctcacacgcacccgattcgtgctttcccttttcatttcagtgatttctcttccctttctccatcttcagttcacccacgcacaaaacaagacaaaaaaaaacccacagaagaatcttccacttcgcgagagaaagagcgagcgctctgcgtaacgccctgggcatctccgaatccggatccgatctctctccacacgaaccgtttacgacttttctagatctgattgagtggctttttttttgctggtattgaaaatgaggacgcccatgatctgttgggctttccttcttctggttttgtttggcaaagcatgcaatgggttttatttgcctggtagctatatgcacacgtattcaaccggggatgaaatcgttgccaaagttaactccttaacttctattgaaaccgagcttccttttagctactacagtctcccttattgccaaccccatggtggaataaaaaaaagtgctgagaatcttggggagcttcttatgggagatcagatcgataactctccttacaggtttagaatgaatgtgaatgagtctgtttacctttgcactaccaagcctttgagtgagcatgaggttaagcttctgaagcagagaacacgtgatctatatcaagtgaacatgattttggataatttgcctgtgatgaggtatgccaagcaaaatggaattgacattcagtggaccggtttccctgttgggtatacaccacaaaatagtaatgatgattatataatcaatcacctcaagttcactgtgttggttcatgagtatgaagggagtggtgttgaggttattggtactggggaagaaggcatgggtatgatttctgaatctgataagaagaaggcatctggtttcgagattgttggttttgtggttgtgccttgcagtgttaagtatgatcctgaagtgatgacgaagcaccatatctatgacaacatctcacttgtggaatgccccttggatctcgacaagtctcagatcataagggagcaagagaggatatccttcacctacgtggttgaatttgtgaaaagtgacattagatggccatctcgttgggatgcgtacttgaagatggaaggtgctcgcgttcactggttctcaatcctgaactcactcatggtgatctttttcctggctggtattgttttcgtcatcttcttaaggactgtgagaagggatttgactaggtacgaggaactagacaaagaagctcaagcacagatgaatgaggagctttctggatggaagcttgttgtcggtgatgtgttcagagaaccagattgcccaaagcttctctgtgtgatggttggagatggtgttcaaattacagggatggcagtagttactattgtttttgcagcctttggtttcatgtcgccagcttcacgaggaatgctgctgacagggatgattcttctgtatcttttcctaggtattgctgcaggctatgctgcagtacgcatgtggagaaccatcaaaggaacttcagaaggatggaggtccatctcttggtcagttgcgtccttcttccctgggattgtctttgttatcctaacaattttgaatttcattctctggggaagccatagtactggtgctattcctatttccttgtattttgtccttttgtccctctggttctgcatttcagtgccactcactctcttgggaggattcatggggacacgagctgaggcaattcaatacccagtgagaacaaaccagataccaagagaaattcctgcacgtaaattgccatcatgggtgcttgtcctgggtgccggaacccttccctttgggacccttttcattgaactgttttttattctctcaagcatctggcttggacggttttattatgtattcggtttcttgctgatagttctgctgctcctggttgttgtctgcgctgaagtgtctgtggttcttacctacatgcatctttgtgtggaggattggcggtggtggtggaaggctttctttgcttctggttcagtttctatctttgtctttctgtactccatcaattacctggtctttgacctacagagtttgagtggacccgtgtcagccatactctatctgggctattcactgatcatggcaattgcaatcatgttgtctactggcaccattggtctccttacatcgttctactttgtgcattaccttttctcatctgtaaagatagactaaaacgttgccattggtgtctgctccatggtatgaggaaattctcttggttcacatctttcgcacgtgctaaattctagctgatcaacttgtgctgtattaaagactcggatgatatcctgaatccatcaaggcctgttatattacatacgttttttccaggttagaagacatgatagtagtttgcagcttcatttggggcgcgtaaaatgttatgatcatttccgttgctctagaaatgttgtagtgttgatttactttgttgtatccttttctttttgataaaagaagtgcatatggcaggcaatgcaattccttaaaatctccaaacaatttgaatgcatcttccttagtttca

SEQ ID NO: 3417 - DNA, 2908 bp, Chelidonium majus
aattctctgttctttcttctttcgcgcgtgcccttcacctcatcagatcttggattgattcaattggagaaacgaatcgggatcgaacaattacttgtctttggatctgtagatctgtactaaaagcagtggccaaacggccttcctggatcagttcaggatttccggttcgattacacagtaacctaagccgattactctgaagtcttcaacagattcagtgaatttttaagcatctctacttgaattttgtcgtaaaattaactagaggtggaagttttattggcatagttaggtaattcgggtttgtagtgatccagatctggcattggctatgcagttgaatatcttatagattagggcaacaacagaggaaacttctgatttccttctacaatgatggcgtcttcgtcacttcaattttcttcaatccatttgtattgtctctatgtcgttctctttgcgtgcgtgtgcaatgggttttatctgcctggaagttacatgcacacctattcagaaggagataaaatattcgcaaaagttaattccttgacttcaatagaaacagagcttccttttagctattacagtcttccttactgcaaacccgagggaggtattaagaagagtgcagagaacttgggtgaactccttatgggagatcagattgataactccccgtaccgttttcaaatgaatgtcaatgagtcagtttacctctgcacaacaaccccactaaatgagaatgaggtaaagctcttgaaacagagaacccgtgatctatatcaggtaaacatgatactggataatttgcccgcaatgaggttcgccaagcaaaacggaattaacattcagtggacagggtatcctgttggttatgccccacctcagagcaatgaagattacatcatcaaccatctgaaatttaaggttttgattcatgagtatgaaggaggtgtggggataattggtactggagaggaaggttcggttgcatatacagaagctgaaaagaagaaggcatcgggatatgagatagtcgggtttgaggttgtaccttgcagtattaaacgtgatactgaggcaatgttaaagctccatatgtacgatgcaatcgacccagtgaactgccctgttgatctcgacaagtctcagataatcagggagcaagagcgagtctcatttacttatgaggttgaatttgtgaaaagtgatattagatggccttctagatgggatgcttacttgaagatggaaggtgcacgtgtgcactggttttcaatcctgaactcactgatggtgatcttcttcttagccggcattgtgtttgttatattcttaaggacagttcggagggatttaacaaggtatgaggaactggacaaagaagctcaagcacagatgaacgaggagctttcagggtggaagcttgttgtgggggatgtgtttagagaaccaaattgctcaaagctactctgtgtgatggttggtgacgggacccagattttagggatggctgttgttaccattctatttgcagctctaggtttcatgtcgccagcctcccgtggaatgctcttgacaggaatgataattctgtatcttttccttggtattgtagcaggttatgttggtgttcgtttatggaggaccattaagggaacgtcagaagggtggaggtcaatttcctggtcagtttcttgtttcttcccaggaatagtcttcataattctaactgccttgaactttgtactttggggcagcaagagtactggtgctatccccctctctttgtattttatactcttctccctttggttctgtatttcggttcctctaacccttgtgggaggcttccttgggacacgcgcagaggccattcagttccctgttcgaaccaatcagatccctagagaaatccctgcacgaaaatacccatcgtggcttcttgttcttggtgctgggactctcccctttggaacccttttcattgagctctttttcatcctttctagcatctggcttgggaggttctattacgtattcggcttcttgcttgtcgtctttgtcttgcttgttgtcgtttgtgccgaagtctctgttgtccttacctacatgcatctctgtgttgaggattggcagtggtggtggaaagctttctatgcctctggttcggtagcactttacgtgttcctgtactccatcaattatctggtattcgacctacggagtttgagtgggcctgtgtcagctattctctaccttggttattcgttgatcatggccattgctatcatgttgtctactggcaccatcgggttccttgtgtccttttatttcgtccattaccttttctcatctgtcaaaattgactaagaaatacttaaaacgtcaaatatgttgggacatgatagtcccttcttaatatcttccctttcatctctaaccatcacacattccatttggtttagacttgtagcaaagatttgtgtttttgaagctgattgattctggtgaactggaaactgttaatggtaaagtacctaaggatcgctggcgtcaaggttattccatcatctttcatgcttcatgaggttggaggtatcgagtttatctgtagctttatagttagtttgtgatttggctctatctggagctcttttaaactacatttggatcacatggtagagtggtttaagcagtttattcacattgttccttggatacatgtaaccactttcccctttcttttttgtttcttctgattaaattttgtaatgaaatcatcttcatctttcttagtttcttgtcagattttcataacctacagtactatgctatgagtttacttttgaggctcagtatcatcaatgtatcagttactaactactaagaaatgcttaaggcg

SEQ ID NO: 3418 - DNA, 2462 bp, Panax ginseng
gctttgattttgaatacactggcgagtgtagtttagagtgccgaagttttgagaatctggtcttgtttttccttttcttaagaccaatggcactgtcattgatctcgaaaaggacataccgggatgctttcatctatgttattttgatttcacatgtttgtaacgggttttaccttcctggaagctacatgcacacatattcgaccggtgatgaaatagttgccaaagtcaattcattgacatctattgaaacggagctccccttcagttactacagtctaccatactgcaagcctcaaggagggataaagaaaagcgctgagaatctcggagagttactgatgggagaccagattgacaactctccctaccgtttccgtatgaatgtcaatgaatctgtttatctctgcacgacaagtccattgagtgagaatgaggtaaagcttttgaaacagagaactcgcgatctgtatcaagtaaatatgattctcgataatttacctgccatgaggtttgccacccaaaatgggataaaaattcagtggactggctttccagttggatacacaccacccaatactaatgatgattacatcattaaccaccttaagttcaaagttttggttcatgagtatgaagggactggcgtagagataatagggacaggggaagaaggtatgggcattatatcagaaactgataaaaagaaagcttctgggtatgagattgttggttttgaggtcttaccttgcagtgttaaatatgatcctgagaagatggctaaacttcatagatatgacaatgttacgtccttaatctgtccacttgagctcgacaagtctcaaataataagagagcaagagagagtatcatttacttatgaggttgaatttgtgaagagtgatattagatggccatctcggtgggatgcttatctgaagatggaaggtgcccgtgtccactggttttctatcctcaactcacttatggttatattattcttagctggtattgtttttgttattttcttaagaacagtaaggagggatctgacacggtatgatgaattggacaaagaagcacaggcacagatgaacgaggaactctcaggatggaagcttgttgtaggtgatgtattcagagagccaaaattttcaaagctactatgtgtgatgattggagatggggttcagattacagggatggctgttgtgactattgtatttgctgcctttggtttcatgtcaccagcttcacgaggtatgttgttgacaggaatgataattctttatcttttcctgggaactggagccggttatgctggtgttcgtttgtggtgcactatcaagggcacttcagaggggtggaggtcagtttcatggtcggtcgcttgcttcttccctggcattgtctttgttattctcactgcattgaacttcattctttggggcagcaagagtactggcgctattcccatatccttgtattttataatcttgtcactgtggttctgcatttcagtgcctctcaccctattgggaggatacttagggacacgagctgagtctatccagtaccctgtgagaacgaaccaaattcctagggagatccctgctcgcaagtatccatcatggcttcttgttcttggtgctggaacccttccatttgggaccctctttattgagcttttcttcatcctttctagcatatggcttggaaggttttattatgtcttcgggtttttgcttgttgttcttctgttgttggttactgtttgtgccgaagtttccctggtcctcacttacatgcatctatgcgttgaggattggcagtggtggtggaaagcattttatgcctcaggttcggtagctttgtatgtattcctttactctatcaactacttggtttttgaccttcaaagtttgagcggacctgtgtctgcgatactttatcttggctactcactgatcatggcaattgcaatcatgttatctactggcaccattggattcctttcatccttttacttcgttcattatcttttctcatcggtgaagattgattgagaagttccttttttagtgctcagtggtcggcttgaaaattaagtctcctggtgaatagataaatgagtgctgacagtcctacaatatccttttgctaaattttgttacaagatcatgttgcaccatgtcaagaggcacccatgtgatctgaagttgtgctaaaggatggttatattttacttgtcgtttgagattagagatttcaatagtattcaattgtgatttagactcgtcgggaaaaaaaatgacttggtgatcctcactgttgtgttctgcattgctattttcatttcttttcccctttttactgtcctacccgtacatccaatggaaactaattgaatgggaccaaagttactgtccttttactatttcaatcataacattgataaaaat

SEQ ID NO: 3419 - DNA, 2591 bp, Citrus clementina
accatgcatttctcattttcttttcctttcttaattactactcaaatcaattcatattcagataatatataaaatcccggtccatgttcttgttcgctctcggaagaatcacaccaaaagattaaacaagaacgtaaagttctgcttccttttcacgcgctcggatcctcccagatctatccccgacccaaattcatttcttcagatctgcttcagatttggtgttgaattcgtatgatattaaggtagattagaagacagcgaggcagtgtttggatatttgaagatgagagaaaaaatatccatgattctttgggcttttttgtttgcggttctgtttgggcaagtttgcaatgggttttatttgcctggaagttacatgcacacgtattcgaatggggaacctatagataccaaagttaattcgttaacgtctattgagaccgaacttccatttagctactatagcttgccttattgtaaaccacttcgtggggtcaagaaaagcgcagagaatcttggggaattgcttatgggagatcagattgataactctccgtataggtttcggataaataagaacgaaactttatttctttgcataacgaccccattgagtgagaatgaagttaagcttttgaaacaaaggactcgtgatttgtatcaagtgaatatgattttggataacttgcctgtgatgaggtatgcaaagcaaaatggggttagcattcagtggacgggtttccccgttgggtacactccgggtaatagtaatgatgattacattatcaatcatctaaagttcactgttttggttcacgagtataaagggagtggcgttgagattattggtactggggaagaaggtatgggtgtgatttctgaagctgatgataagaaagcatctggatatgagattgtcggttttgaggttgttccatgcagtgttaagtatgatccggaagtcatgacaaaactccacatgtatgacaatattacatctgtgaagtgcccctcggagcttgacaagtctcaaattataagggagcaagagaggatttccttcacttatgaggttgaattcgtgaagagcaatataagatggccttctcgatgggatgcttatttgaagatggaaggtgctcgtgtacactggttctcaatcctcaattctctgatggtgatatttttccttgccggtatagtttttgtcattttcttgaggactgtgaggagggatttgacaaggtatgaggagttggacaaagaagctcaagcacagatgaatgaggagctttctgggtggaagcttgttgtgggtgatgtgtttagagaaccagatcatccaaagcttctttgtgtgatggttggagatggtgttcagattacagggatggcaattgtcactatcatatttgcagccttgggtttcatgtcacctgcttcacgtggaatgttactgacaggaatgatatttctttttcttttcttgggtattgctgctggttatgttgctgtacgaatgtggagaacaatcaagggaacttctgaagggtggagatcagttgcctggtctgctgcatgcttcttccctggaattgtctttgttatcctaacagtattaaatttcgttctttggggcagtaagagtaccagtgctcttcccatttccttatattttgtgctcttgtccctctggttctgcatttctgtgccacttactctcttgggtggattctttgggacacgagctgaggaaataacatatcctgtgcgaaccaaccagattcccagggaaattcctgctcgcaaatatccatcatggcttcttgtgcttggtgcaggaacccttccgtttggaaccctctttatagaacttttcttcattctttctagcatttggctgggaaggttctattatgtctttggttttctgctgatagttcttttgttgctggttgttgtttgcgctgaagtgtctgtggtcctaacatacatgcatctttgtgtggaggattggcgttggtggtggaaggctttctttgcttcaggatcagttgcactgtatgtgttcctgtactctatcaactatttggtatttgacctgcagagtttgagtggacccgtctctgctctactatatcttggttattcattaatcatggcagtcgcaatcatgttggcaaccggcaccattggcttccttacgtctttttacttcgtccattaccttttctcgtctgtaaagattgactgaaaaattgtgtttgtgaatcaatcttcatcgaccaggtagagaagactccagtacgtaggaagagggagttttcttggttcagccttccttttgatagatttagagattatgatatgctgtctcattcccctatattgttgttcttgtttttcctattttactagttttgagcatcattttggattacctctctcagtttacattgactgttctacaaaattgtaatttgttggttttgctctccttgtactttcgttagctttatcattgaagagaatttaaatagtctttttctttatatctttatatgtttggacatcgattcagctttata

SEQ ID NO: 3420 - DNA, 2591 bp, Citrus sinensis
accatgcatttctcattttcttttcctttcttaattactactcaaatcaattcatattcagataatatataaaatcccggtccatgttcttgttcgctctcggaagaatcacaccaaaagattaaacaagaacgtaaagttctgcttccttttcacgcgctcggatcctcccagatctatccccgacccaaattcatttcttcagatctgcttcagatttggtgttgaattcgtatgatattaaggtagattagaagacagcgaggcagtgtttggatatttgaagatgagagaaaaaatatccatgattctttgggcttttttgtttgcggttctgtttgggcaagtttgcaatgggttttatttgcctggaagttacatgcacacctactcgaatggggaagctatatataccaaagttaattcgttaacgtctattgagaccgagcttccatttagctactatagcttgccttattgtaaaccacttcgtggggtcaagaaaagcgcagagaatcttggggaattgcttatgggagatcagattgataactctccgtataggtttcggataaataagaatgaaactttatttctttgcataacgaccccattgagtgagaatgaagttaagcttttgaaacaaaggactcgtgatttgtatcaagtgaatatgattttggataacttgcctgtgatgaggtatgcaaagcaaaatggggttagcattcagtggacgggtttccccgttgggtacactccgggtaatagtaatgatgattacattatcaatcatctaaagttcactgttttggttcacgagtataaagggagtggcgttgagattattggtactggggaagaaggtatgggtgtgatttctgaagctgatgataagaaagcatctggatatgagattgtcggttttgaggttgttccatgcagtgttaagtatgatccggaagtcatgacaaaactccacatgtatgacaatattacatctgtgaagtgcccctcggagcttgacaagtctcaaattataagggagcgagagaggatttccttcacttatgaggttgaattcgtgaagagcaatataagatggccttctcgatgggatgcttatttgaagatggaaggtgctcgtgtacactggttctcaatcctcaattctctgatggtgatatttttccttgccggtatagtttttgtcattttcttgaggactgtgaggagggatttgacaaggtatgaggagttggacaaagaagctcaagcacagatgaatgaggagctttctgggtggaagcttgttgtgggtgatgtgtttagagaaccagatcatccaaagcttctttgtgtgatggttggagatggtgttcagattacagggatggcaattgtcactatcatatttgcagccttgggtttcatgtcacctgcttcacgtggaatgttactgacaggaatgatatttctttttcttttcttgggtattgctgctggttatgttgctgtacgaatgtggagaacaatcaagggaacttctgaagggtggagatcagttgcctggtctgctgcatgcttcttccctggaattgtctttgttatcctaacagtattaaatttcgttctttggggcagtaagagtaccggtgctcttcccatttccttatattttgtgctcttgtccctctggttctgcatttctgtgccacttactctcttgggtggattctttgggacacgagctgaggaaataacatatcctgtgcgaaccaaccagattcccagggaaattcctgctcgcaaatatccatcatggcttcttgtgcttggtgcaggaacccttccgtttggaaccctctttatagaacttttcttcattctttctagcatttggctaggaaggttctattatgtctttggttttctgctgatagttcttttgttgctggttgttgtttgcgctgaagtgtctgtggtcctaacatacatgcatctttgtgtggaggattggcgttggtggtggaaggctttctttgcttcaggatcagttgcactgtatgtgttcctgtactctatcaactatttggtatttgacctgcagagtttgagtggacccgtctctgctctactatatcttggttattcattaatcatggcagtcgcaatcatgttggcaaccggcaccattggcttccttacgtctttttacttcgtccattaccttttctcgtctgtaaagattgactgaaaaattgtgtttgtgaatcaatcttcatcgaccaggtagagaagactccagtacgtaggaagagggagttttcttggttcagccttccttttgatagatttagagattatgatatgctgtctcattcccctatattgttgttcttgtttttcctattttactacttttgagcatcattttggattacctctctcagtttacattgactgttctacaaaattgtaatttgttggttttgctctccttgtactttcgttagctttatcattgaagagaatttaaatagtctttttctttatatctttatatgtttggacatcgattcagctttata

SEQ ID NO: 3421 - DNA, 2626 bp, Amsonia hubrichtii
atagaatatagaggacctaaaactaactgaaggaataccagaaaaccagtgctctttctctcgccctattcattcgtcgattacattagctacattctgctctcgctgtccacaggccaaaccctaaccagctcgcgattctacttccttggagcttgttttccattccagatccacctccggtgtttatgcttgaaactctataaacggtggcttagattcagtgactttgaagggatctgcttcctcttccttttattggacaatggcattgccatcgatctgtaaaaggaaatatttggctgctttcatttacttagttttggcatctcatgtctgtcatgggttttatctcccggggacctacatgcatacgtacacccctggagaggaaataactgtcaaagtgaattcattgacttcaattgaaactgaacttccgttcagctactatagtcttccttattgccagcctcaaggggaaataaagaaaagtgctgagaatcttggagaactgcttatgggggaccaaattgataactccccttaccgtttcaagatgaatgtcaatcagtctctttatctctgcaccactcacccgctgagcgagcaagaggtaaagctcttgaaacagagaactcatgatctgtatcaagttaacatgattttagataatttgcctgctatgagatatgccacccaaaatgggaatagagtccagtggactgggtttcctgttggctacacaccaccgggtggtactgatgattatataatcaatcacctccagtttagggtcttgattcacgaatatgaaggggctggagtggagataattggaactggggaagaaggtatgggtgtcatttcagaggctgataagaaaaaggcttctgggtatgagattgttggttttgaggttgtaccctgcagtgttaaatatgaccctgaaaagatgacaaaacttcacatgtatgacactgttcaatcagtgaactgtcctatggagctcgataagtctcaagtaataaggaagcaagagcgggtatcatttacatatgaggttgaatttgtgaaaagcaacattagatggccatctcgatgggatgcttatctcaagatggaaggttcccgtgttcattggttctcaatcctcaactcactgatggttatcttcttcttggctggtattgtctttgtgatctttttgaggactgtgagaagggatttgacaaggtatgaggaattagacaaagaagctcaggcccagatgaatgaggagctatcggggtggaagctcgtggttggtgatgtatttagagaaccaaatcactcaaagctacttgctgtgatggtaggagatggtattcagattttgggcatggcggttgtaagtattgtctttgcagcccttggtttcatgtcaccagcttcacgaggtatgctgcttacagggatgatacttctttatcttttcctgggaattgcagctggatatgttggtgtccgtatgtggacaaccattaagggaacctcagaagggtggagatctgtttcttgggcaattgcatgtttctttcctggaatcgtttttgttattcttactgtgctgaatttcatcctctggggaagtaagagtactggtgctattcccatttccttgtattttgttcttttgtcactctggttctgcatttcagttcccctcaccctgttgggaggcttcctaggaaaaagagctgagcctattcaatacccagtacgaactaaccagattccaagggagatccctgctcgcaagtacccatcatggcttcttgttcttggtgctggaactcttccattcggaacacttttcattgaacttttctttattctatctagcatctggcttggacggttctattatgtatttggttttctcttgattgtcctcctcctgttggttattgtttgtgctgaagtttctgtcgttctcacttacatgcacctgtgtgttgaggattggatgtggtggtggaaagcattctatgcctctggttctgttgccctctatgtgttcttgtactccatcaattacttggtttttgaccttcagagtttaagtggaccagtatcggctattctttatattggttactcgctaatcatggcagtcgcaatcatgctggccaccggtgccattggtttcctcacatcattctactttgtccattaccttttctcctcagtgaagattgattgaagggtgatgttgttttgaagttaattcttggctagctggagaagagaatagatggaggaagtttaactattctgctttgtatctttgtgttctacacaatcttgttccatcataccattttactcaacagactctcaggttgtcactaagtgcctcggcctactgttactttagtttgtttattttgggtgaggctagaattttggaagtattaaagctgtgatttagctgtttcattcccagtcagctgttttcttgtctcccccttagaagcttccttctgtgtttttacatcttgcccttttctttttttgtcatactttcataaccttctttcaaagtaattgtagtttgatggaacttttcctgatattttgaaga

SEQ ID NO: 3422 - DNA, 2644 bp, Catharanthus roseus
cttaccaaaataacttctgttctgcttctctttctctcccttcattccgccattacattggccattttttgctctctccgccctcagtccaaatcctaaccagcttgcccttctactcgattggagctcgttttccgttccagatccacctccgctacccactgatatgagtgtttattcttgacaatctatcaactgtggcttaggtcgagtgactttgaagtgttctacgtctattccttttattgaaaaatggcgatgccatcgatctgtaaaaggaaatattgggctgcttttattttcttggttttggtatctcaaatctgtcatggattttatctccccggtacctacatgcatacatacactacaggagaggaaataactgtcaaagtgaattcattgacttcaattgaaactgaacttcccttcagctactacagtcttccttactgtgagcctctagggggcataaagaaaagtgctgagaatcttggagaactgcttatgggagaccagattgataactccccttaccgtttcaagatgaatgttaatcagtctctgtatctttgcaccacttatccccttagtgagaatgaggtaaagctcttgaaacagagaactcatgatttgtatcaagtgaacatgattttagataatttgcctgctatgagatatgccacccaaaatggcattaaagtccagtggactggatatccagttggctacacaccaccaggtggtactgaagattatataatcaatcaccttcagtttaaggttttgattcacgaatatgaaggggctggagtggagataattggaactggggaagaaggtatgggtgtcatctcagaggctgacaagaaaaaggcttctggttatgagattgttggttttgaggttactccttgcagtgtaaagtacgaccctgagaagatgacaaaacttcacatgtatgacgctgttccatcagtgagttgtcctttggagcttgagaagtctcaagtaattaggcagcaggagagggtatcatttacatatgaagttgagttcgtgaaaagcaacattagatggccatctcggtgggatgcttatctcaagatggaaggatcccgtgtccattggttctcaatcctcaactcattgatggttatcttcttcttggcgggtattgtttttgtgatctttttgaggactgtaagaagggatttgacaaggtatgaggaattagacaaagaagctcaggcccagatgaatgaggagctttcagggtggaaactcgtggttggtgatgtctttagagagccaaatcactcaaagctacttgctgtgatggtagggaatggggttcagatcttaggcatggctgctgtaagtattgtctttgcagcacttggtttcatgtcgccagcttcacgaggtatgctgcttacagggatgatacttgtttatcttttcctgggaattgcagctggatatgctggtgtgcgcttgtggagaactattaagggcacctcagagggatggaggtccatttcttggtcaatttcatgcttcttccccggaattgtttttgtcatacttactgtgctgaatttcatcctctggggaagtaagagtactggtgcccttcccatatccttgtattttattcttttgtcactctggttctgcatttcggttccccttacccttttgggaggcttcctaggaaccaaagctgagcctattcaatacccagtacgaactaatcagattccaagggagatccctgctcgcaagtatccatcatggcttcttgttcttggtgctggaactcttccgttcggaacacttttcattgaactcttcttcattctctctagtatctggcttggaaggttttattacgtatttggtttcctccttattgtcctcttgctgttggtcattgtttgtgctgaggtttctgtggttctcacttacatgcacctgtgtgtggaggattggatgtggtggtggaaagcatactatgcctctggttctgttgccctttatgtgttcttgtactccatcaactacttggttttcgacctgcaaagtttgagtggaccagtgtcggctattctgtacattggttactcgctgatcatggcaattgcaatcatgctgggcacaggtgccatcggtttcctcacatcattctactttgtccattaccttttctcctcagtgaagattgattgaagggtggtgatgttgattgaagatgattctcgtctaatagctggagaagtcaataggtggaggaagttaaagtgatcggcttactgttgcttttttttttctttatttttgttgaggctagaattttggaattattattaaagatgtgatttagctgtttcattctcagtctgatctgttttcttgtctctccctaaagaactttcttctgcgatttgggatcttgtcctttgattttccagacatattttcatgacctgctatcaatgtaattttagtagatggaacttttttcttgatgtattttcaaggaagaggggataaagatgatcataatgacggtctttggtcttccttgctattaccattaggtaaatactatgagcatatatagatactgagcacgtagttc

SEQ ID NO: 3423 - DNA, 1982 bp, Nicotiana benthamiana
aatggcttccctgttgatttcaatgaggagatattgggctgttttcctatatgtcattcttgtttctcatgcctgtaatgggttttatcttcctggaagctacatgcatacatattcaacaggtgaagaaatcattgtcaaagtgaattccttgacttcgattgaaactgaacttccattcagctactatagtcttccttactgcaagcccccaggtggagtcaagaaaagtgctgagaatctgggagagttgctcatgggagatcagattgacaactctccctatagatttaagatgaatgtcaatgaatctatttacctgtgtactacgccacccttaaatgagcatgaggtaaagctgttgaagcagaggacccgtgatctataccaggttaacatgattctggataatttgcctgctttgagatatgccaaccaaaatgggctcaaaattcagtggacagggtttccagtaggttcctcaccacaaaacagtaacgaagattacataattaaccaccttaagttcagggttttgattcacgagtatgagggtgctggaattcagataattggtactggtgaagaaggtatgggtgtcatttcagagactgacaagagtaaagcatctggttttgagattgttgggtttgaggttgttccatgcagtgtcaagtatgagccagaaaagatgacaaaactccatatgtacgacaactcttcatccattagttgtccacttgagcttgagaagtctcaaataataagagagcaagaaagagtgtctttcacgtatcaggttgaatttgtgaaaagtgatattagatggccatctcgatgggatgcttatctgaagatggaaggtgctcgggtccattggttctctattctcaactcgttgatggtaatttttttcttggctggtattgtttttgttatcttcttgagaacagttagaagggatttgaccaagtatgaggaattggataaagaggctcaggcacagatgaatgaggagctttctggttggaagcttgtggttggtgatgtttttagagagccaaatcactcaacgttactgtgtgttatgattggagatggggttcagattactggaatggcagttgtcactattgtttttgctgcatttggtttcatgtcaccagcttcacgaggaatgctgctaacaggtatgatattgctttatctcttcctgggaattgctgctggttacgttagtgtgcgtgcttggagaacaataaagggcacttctgaaggttggagatcggtttcttggtcaactgcgtgcttttttcctgggattgtcttcgtcatcctcactgtgctgaattttattctttggggaagcagaagtactggggcactccccatctccctatttttcactctcttagcactctggttctgtatttcagtgcctctcaccctcttgggaggataccttggaacacgagccgagcctatttcatatcctgtgcggactaaccagattcctagggagatccctgcacgcaagtatccctcttggcttcttgttcttggtgctggaactctgccatttggaaccctctttattgaactcttcttcatcctctctagtatttggcttggacggttctactatgttttcggctttctacttattgtcctcctcctgttagttactgtttgtgctgaagtttcagttgttctcacttatatgcatctttgtgtggaggattggatgtggtggtggaaagcattctatgcatcaggctctgttgctctctatgtgttcctgtactccatcaattacttggtttttgacctccagagcttgagtggcccagtatcagctatactttaccttggctactctttgataatggctgttgcgatcatgctgtcaactgccactattggcttcctcacatcattttacttcgtgcattatcttttctcatcagtgaagatcgactaaa

SEQ ID NO: 3424 - DNA, 2693 bp, Gossypium hirsutum
agattccattttcatattgaatgcttcaatttagggtatagctctgtaatttttcaagatctgcagctatcaatgggaaacatgcctggaatctgttggggttttcaattattgattctatttgttcatcattgttatggattttacttgcctgggagttacatgcatacgtattcgactaaagatgctatatatgctaaaattaattccttgacttcaatcgaaaccgagcttccgtttagttattacagtcttccttactgtaaaccgatgggtgggattaagaaaagtgccgagaatctcggtgagcttctaatgggagatcagatcgataactcaccttatcggtttcgaatgaatgtgaatgagtctctttacctatgcactaccagtcctttgaacgagcgcgaggttaagcttttgaaacaaaggactcgagatttgtatcaagtgaatatgattctcgataatttgcctgttatgaggattacgaaacaaaatggggttaacattcaatggacgggattcccgattgggtatactccgccgaatagtaatgatgattacattatcaatcaccttaagtttaaaattttggttcatgagtatgaagggagtggtgtgcagataatcgggaccggggaagaagggatgggtgtgatttccgaagctgataagacaaaagcttcgggttttgagattgttggtttcgaggttattccgtgtagtgttaaatatgatccagaagtcatgactaaacttcacatgtatgacaatatctcctctgtgaactgcccattggagctagacaaatcgcagataatacgggaacaagagaggatctcttttacttatgaggttgaattcgtgaaaagtgatatcagatggccgtctcgttgggatgcttatttgaagatggaaggttcacgcgtccactggttctcgattctaaattctctaatggtgatcactttcttagccggtattgtgtttgttattttattgagaaccgtaaggagggatttgacaaggtatgaggaacttgacaaagaagctcaagcacaaatgaatgaggagctttccggatggaagcctgtcgtgggtgatgttttcagagaacctaatcactcgaagcttctctgcatcatgattggtgatggagttcagattatgggaatggctttagtcactatagtttttgcagctttgggtttcatgtcaccggcttcgcgaggaatgctactcaccgggatgatcattctctatcttttcttaggtatagctgccggatacgtcgctgtttgtctttggagaactctcaaaggaactgcagaaggatggaggtctctttcctggtcagttgcatgcttcttcccaggaatcgtctttgttatccttacagcattgaatttcattctatggggcagcaaaagtaccggtgcaatcccgatttctctctacttcatactcttatctctctggttctgcatttcggttccgctcactctcttaggaggatacttcggtacccgagctgaacctatccaataccctgtacgaaccaaccaaatcccacgagaaatccctgcacgcaaatatccatcatggctacttgttctcggtgctggtacccttccatttggaaccctcttcatcgaactcttcttcatcctttcaagcatttggctcggcaggttttactatgtcttcggtttcttgcttatcgtccttctactcctcatcatcgtttgtgctgaagtatctgttgtcctcacttacatgcatctttgtgtcgaggattggcgatggtggtggaacgcattcttcgcatccagttccgtctcgctctatgtcttcctctactccatcaactaccttgtcttcgacttacagagcttgagtggcccggtttcagctgttctttacctcggttactcaatgatcatggcggttgcgatcatgttggctactggtaccattggtttcatcacatcattctattttgttcattatcttttctcgtccgttaagattgattaattgatttaaaaattttccctttgtttgatctttttcaaagacttttggcaatgtatgggaggatgatacattgattcattgttttgattttttgttgaagttttaacttcgttatttttctctctttttcttatatcagatagacaaggttattttctttaataaccctttggtatttttatctttctcaattcactactctttaattatggttcaaattttaaattggtctctaaataattgaatccttaatgttgagtatattttaaaacacattaatccttttataaacaggtgtacctatgggcattttagatcttgcatgtaaaaagattgaaaatttgtcaagttccacaattagtgtggaccagaaaaagcatggattaagttgaaaaaaatttgccaagttcagggactaaatgactaaatattaagttattggcccgaatgaatgtggctactaccggctaggcttggttaaagccgaatccaccaaatcccaatgcccgatttacccgtaggcctacacaggctttcatcttcctcctcaaaacacgaaccaccgtgaggattgcaaatcaatagccaagccccgttaccaaaatgcttcctacagcagcgattcctccgataacgacttaaaacatcgggag

SEQ ID NO: 3425 - DNA, 2407 bp, Triphysaria pusilla
ttagaagggcaatattgctgcaaccatacagcacaatttcttatttctcacgcgaatttcactcgcactctctttatcttcttcacttcacatgagaaaaactccatttcactgctgcttttagatcctgatatcgctcgatccgaattcagatccaccgtcggactgatttatatgcgtcactaagatctgcgaagctggtttgaggacatttcattgctgtccttctattgaacaatgacgctgcctttgagttcaagaaagaagttatgcacagctttcacatacttggctctcatattccaagcctgtaatggtttttatctacctggaagctatatgcatacatattcaacaggagatgagatttacgccaaggtgaattctttaacctccattgagactgagcttcccttcagctattatagccttccctattgcaagcctattgggggcatcaagaaaagtgctgaaaatcttggagaactgttaatgggagatcaaattgacaattctccatatcgtttccggatgaatgtcaacgagtctgtatatatctgcaccactcctccactgaatgataatgatgtgaagcttttaaaacagagaactcgggatctgtatcaagtgaacatgattctcgacaatttacctgctatgagatttaccaaccaaaatggagtcaagattcagtggactggatacccggttggatatacccctcccggcagcaatgatgattacattatcaaccatcttaagtttagagtattgattcatgagtatgaaggagctggtgtggagataattggtactggtgaagaaggtatgggtgtgatttcagaagctgacaaaacgaaggctgcgggttatgagattgttggtttcgaggttgtcccttgtagcgtaaaatacgactccgacaagatgacgaaactccacatttacgataatgtcacatccgtcaactgtccgctggagcttgacaagtcccagatcataagggagaaagaaagagtgtcgttcacgtacgaggtcgagtttgtgaagagcaacgtgaggtggccatctcgttgggacgcatatctaaagatggaaggggcccgtgtgcactggttctcgattctcaactcgttgatggtgattttcttcttggctggcattgtttttgtcattttcttgagaacggtgagacgggacctgacaaggtacgaggagttggacaaagaggctcaggcacagatgaacgaagagctttcgggatggaagctcgtcgttggtgatgtctttcgcgagccgtcccattcaacacttctctgtgtgatggtcggagacggagttcagattactgggatggctgtagtgactatcgttttcgcagcttttggttttatgtcgccggcttcacgaggtatgctgttgacgggtatgatattgctttatctcttccttggaattgcttccgggtacgtcagcgtgcgtatgtggacaactattaaaggctcatccgagggatggagatcgatttcttggaagacagcctgctttttcccgggaatcattttcgttattttgacattcttgaatttcatcctttggggaagtaacagtaccggtgctattcctatttccttatatttcatactgttttctctctggttttgtatttcggtcccactcactttattaggtggacattttgggacgcgagccgagcctataacatacccggttcggactaatcagatccccagagagatacctgcccgcaaatacccatcgtggcttctcgttcttggtgctgggacacttcccttcgggactctctttatcgagcttttcttcatactctcgagtatctggctcggaagattctattacgtttttggtttcttgcttattgttcttacgttgttggtggttgtttgtgctgaggtctctgttgttctgacatacatgcatctctgtgtcgaggactggatgtggtggtggaaagcattttatgcctcaggttcggttgcgctgtatgttttcttatactccatcaattatctggtatttgatctgcagagcttgagtggccccgtttcggcaacgctttatctcggctattcgctgataatggcagtggcgatcatgctttcgactggaactattgggtttcttacttcgttttactttgtccattatcttttttcgtcggtcaagattgattaaagaatgttatcggctttagtagtttggagggatagaaagtgtttgaggcagtgttaccaagagcatcttagcttcttttacattgcagtgctgttttaaacttttatgtatctttgatacctgagataaattataaactaaaatttgttatttgaagctgtttcacttgaattgttattttaagttgttt

SEQ ID NO: 3426 - DNA, 2539 bp, Gossypium hirsutum
ttttctctacacatgaccctaatctccgatttaatctcttgaaaatactcgcaagaatcccggtagcttaaaccgttaccaaggaaaaggaaaagttaaatccatagggctctgcttcgttcccacgcgttttccgtggtgtccaaggatccaatattcatcagtttcagttcctatcgaacttcaaccaccctagatctgtctcagacttatttgtatcttgggtgcctcgggttactgtagcttaggttcgagcgtatactgcaagatttgctattacgatggttttcccagaaagaaagatgcctggagtttgctgggtttttctgttactgcttctgtttgctcatatttgtgatgggttttaccttccgggaagttacatgcacacgtattcgactaaggatactatatttgccaaagttaattccttgacttccattgaaaccgagctcccttttagttattacagtctcccttactgcaagcctcttggtggagtaaagaaaagtgccgagaatcttggtgaacttctcatgggagatcagattgataactccccttataggtttcgaatgaatgtgaatgagtctctctatctttgcaccaccagccccttgaatgagcacgaggttaagcttttgaaacagaggactcgtgatttgtatcaagtgaatatgattctagacaatttgccagtgatgaggattgcaaaacagaacggggttaacattcagtggactggattcccggttggttattctccaccaaacagtaatgatgattacataatcaatcatctcaagttcaaggttttggttcacgagtatgagggaagtggtgtggagataattggaactggggaagatgggatggctgtgtttcccaaagctgataagaagaaagcttctggttttgagattgttggtttcgaggtggttccgtgcagtattaaatatgatccagaagccatgactaaacttcacatgtatgacaaagtttcctctgtgaactgccccttggggctcggcaagtcgcagataataagggaacgagaaaggatctcttttacttacgaggttgaattcgttaaaagtgatattagatggccatctcggtgggatgcttatttgaagatggaaggtgcacgcgtgcactggttctcaattctaaattctctaatggtgatcactttccttgctggtattgtgtttgtcatcttcttgaggactgtgaggagggatttgacaaggtatgaggaactggacaaagaagctcaagcacaaatgaatgaggagctttctgggtggaagcttgttgtaggagatgtcttcagagaaccagattgtccaaagcttctctgcgtgatgattggagatggagttcagattatgggaatggcagctgtcactatagtttttgctgccttcggtttcatgtcaccagcttcacgaggaatgctactgacagggatgattattctttatcttttcctgggtattgtggctgggtatgttgctgtacgtctctggagaactctgaagggaacttcagaaggatggaggtctgtttcgtggtccgttgcgtgcttctttcctggaattgtctttgttatccttacggtattgaattttatactgtggggcagtaaaagtactggtgcaatccccatttccctgtattttgtacttttatctctctggttctgcatttctgtgcctctgactctcattggaggattcatagggaccagagctgaagctattcagtatcctgtaagaactaaccagattcctcgggagattcctgcacgcaaatatccatcatggcttcttgttcttggtgctgggacccttccatttggaacccttttcattgaactcttcttcatcctatctagcatctggcttggcaggttttattacgtgtttggtttcttgcttatagttcttctactactgatcatcgtttgtgccgaagtgtcagtggtccttacctacatgcatctttgtgtcgaggactggcgatggtggtggaaggctttctttgcttcgggttcagtatcactctatgtgttcctctactccattaattacttggtctttgacctacaaagtttgagtggtcctgtgtcagctattctttatctcgggtactcaatgatcatggcgattgcgataatgctgtcaacgggcaccattggcttcatcacatcattctattttgtccattatctcttctcctccgtcaagatcgactaaaagtttcatttggtgatcttcatcaactggtggaaaagacataggcttgtaagagtatgatatatcggtgaagttgccattggtagctaatcatgttacactcatcaaagagacactcaaaatcattcaaaattatatgttaattttggtggtggttgagtgtaggacctgatagatttaaaagtctgattactagttacgagtttttgtttggattacatgtaggaagttgtagtttgttggacgttaaatcttgtattttatctcatatttttaat

SEQ ID NO: 3427 - DNA, 2409 bp, Tabernaemontana elegans
ctccgttggctacgttctgctctcgttgttctcaggccaaaccctaaccagttcgtgattctactcgctcggagttcgttttccatcccagatccaccttcggtgtttatgcttgaaaatctattaattgtggcttagattgagtgactttgaagggatctgcttcctgttccttttattgaacaatggcattgccatcgatctgtaaaaggaaattttgggctgctttcatttacttggttttggtatctcatgtctgtcatgggttttatcttccgggaacctacatgcatacgtacgcccctgcagaggaaataactgttaaagtgaattcattgacttcaattgaaactgaacttcccttcagctactatagtcttccctattgcaagcctcaagggggcataaagaaaagtgctgagaatcttggagaactgcttatgggggaccaaattgataactccccttatcgtttcaaaatgaatgtcaatcagtctgtttatctttgcaccactcccccactgagtgagcatgaggtgaagctcttgaaacagagaacacatgatctgtatcaagtgaacatgattttagataatttgcctgctatgagatacgccatccaaaatggaattaaagtccagtggaccggttttccagttggctacacaccaccaggtggtactgatgattatataatcaatcacctccagtttagggttttgattcacgaatatgaaggcgctggaatggagataattggaacgggggaagaaggtatgggtgtcatctcggaggctgataagaaaaagacctctggatatgagattgttggttttgaggttgttccttgcagtgttaaatatgaccctgagaagatggaaaaacttcacatgtatgacaccgttccatcagtaagctgtcctatggagcttgataagtctcaagtaattaggcagcaagagcgagtatcatttacatatgaagttgaattcgtgaaaagcaacattagatggccatctcgctgggatgcttatctcaagatggaaggttcccgtgttcattggttctcaatccttaactctctgatggttatcttcttcttggctggtattgtttttgtcatctttttgaggactgtgagaagagatttgacaagatatgaggaattagacaaagaagctcaggcccagatgaatgaggagctttcagggtggaaacttgtagttggtgatgtgtttagagaaccaaatcattcaaagctgctctctgtgatggtagcagatgggattcagattttaggcatggcggttgtaagtattgtctttgctgcctttggcttcatgtcaccagcttcacgaggcatgctgcttacggggatgatacttctttatcttttcctgggaattgcagctggatattctggtgtgcgtgtgtggagaaccattaagggcacctcagaaggttggaggtctgtttcttggtcaattgcatgcttcttccccggaattgtttttgttattcttactgtgctgaatttcatcctctggggaagtaagagtactggagctattcccatttccttgtattttgttcttttgtcactctggttctgcatttcggttcccctcacccttttgggaggcttcctaggaacaaaagctgagcctattcaattcccagtaagaactaaccaaattccaagggagatccctgctcgcaaatacccatcttggcttcttgttcttggtgctggaactcttccatttggaacacttttcattgaacttttcttcattctctccagcatctggcttggacgattctattatgtatttggttttctcctcattgtcctcctgctgttggttgtcgtttgtgctgaagtttcagttgttctcacttacatgcacctgtgtgttgaggattggatgtggtggtggaaagcattttactcctctggttctgttgccctctatgtgttcttgtactccatcaactacttggtttttgaccttcagagtttgagtggaccagtgtcggctattctttacattggttactcgctgatcatggcaatcgcaatcatgctggccaccggtgccatcggattcctcacgtcgttctactttgtccattaccttttctcctcggtgaagattgattgaagggcgggcaatgttgagtgaaagataattcttggctagctggaaaagagaataggcgaagaaagtttaacttcctttgtatttttctgttctacacaatcttgtcccatcttaccgacagggtctcaggttcactaagtgcctgactgcctacttcactatttttatttttattttttaggctagaattttggaagtattaaagctgtgatttagttatttcattctcagtctgatctgtttt

SEQ ID NO: 3428 - DNA, 2466 bp, Nicotiana benthamiana
gcagagttcctggagtaatctacagagatcttgtattttttgtggtagatcaaactacttttcaggtggttggtgtttttgttgagcaatggcttccccgttgatttcaacgaggagatattgggctgttttcctttatgtcattcttgtttctcatgcctgtaatgggttttatcttcctggaagctacatgcatacatattcaacaggtgaagaaatcattgtcaaagtgaattccttgacttcgattgaaactgaacttccattcagctactatagtcttccttactgcaagcccccaggtggagtcaagaaaagtgccgagaatctgggagagttgctcatgggagatcagattgacaactctccctatagatttaagatgaatgtcaatgaatctatatacctgtgtactaccccacccttaaatgagcatgaggtaaagctgttgaagcagaggacccgtgatctgtaccaggttaacatgattctggataatttgcctgctttgagatatgccaaccaaaatgggctcaaaattcagtggacagggtttccagtaggttcctcaccacaaaacagtaacgaagattacataatcaaccaccttaagttcagggttttgattcacgagtacgagggtgctggaattcagataattggtactggtgaagaaggtatgggtgtcatctcagagactgacaagagtaaagcatctggttttgagattgttgggtttgaggttgttccatgcagtgtcaagtctgagccagaaaagatgacaaaactccatatgtacgacaattcttcatccataagttgtccacttgaacttgagaagtctcaaataataagagagcaagaaagagtgtctttcacgtatgaggttgaatttgtgaaaagtgatattagatggccatctcgatgggatgcttatctgaagatggaaggtgcccgggtccattggttctcaattctcaactcgttgatggtaatatttttcctggctggtattgtttttgttatcttcttgagaacagttagaagggatttgaccaagtatgaggaattggataaagaggctcaggcacagatgaacgaggagctttctggttggaagcttgtggttggtgatgtttttagagagccaaatcactcaacgttactgtgtgttatgattggagatggggttcagattactggaatggcagttgtcactattgtttttgctgcatttggtttcatgtcaccagcttcacgaggaatgctgctaacaggtatgatattgctttatctcttcctgggaattgctgctggttacgttagtgtgcgtgcttggagaacaataaagggcacttccgaaggttggagatcggtttcctggtcaactgcgtgcttctttcctgggattgtcttcgtcatcctcactgtgctgaatttcattctttggggaagcagaagtactggagcactccccatctcattatttttcactctcttagcactctggttctgtatttcagtgcctctcaccctcttgggaggataccttggaacacgagctgagcctatttcatatcctgtgcggactaaccagattcctagggagatccctgcacgcaagtatccgtcttggcttcttgttcttggtgctggaactctgccatttggaaccctctttattgaactcttcttcatcctctctagtatttggcttggacggttctactatgttttcggttttctgcttattgtcctcctcctgttggttactgtttgtgctgaagtttcagtcgtgctcacttatatgcatctttgtgtggaggactggatgtggtggtggaaagcattctatgcatcaggctctgttgctctctatgtgttcctgtactccatcaattacttggtttttgacctccagagcttgagtggcccagtatcagctatactttaccttggctactctttgataatggctgttgcgatcatgctgtcaactgccactattggcttcctcacatcattttacttcgtgcattatcttttctcatcagtgaagatcgactaaatggttctgcagggtgattactgttgttggatggctagtcctgccagaaagagtatctgaactgcagccaagcccctttgtacttcctattttactgtcatattctgaggctagatattttgttagttcaaagttgtgatttagttttttcatccttcattgtgttttaatcacattttcccatatttcttgtatcttgatgaccgctactttcaatggagaaattaccagtaactgatcttagctgattatcttactttgtaattgaaacggaggataggtttaaggtggttttgttccatatcactttttgaacgaatactctggttatgtttgggttcatattaaagtcccatgcatagatttggttgttgctatattgtatcatgtgttggtta

SEQ ID NO: 3429 - DNA, 1981 bp, Nicotiana benthamiana
aatggcttccccgttgatttcaacgaggagatattgggctgttttcctttatgtcattcttgtttctcatgcctgtaatgggttttatcttcctggaagctacatgcatacatattcaacaggtgaagaaatcattgtcaaagtgaattccttgacttcgattgaaactgaacttccattcagctactatagtcttccttactgcaagcccccaggtggagtcaagaaaagtgccgagaatctgggagagttgctcatgggagatcagattgacaactctccctatagatttaagatgaatgtcaatgaatctatatacctgtgtactaccccacccttaaatgagcatgaggtaaagctgttgaagcagaggacccgtgatctgtaccaggttaacatgattctggataatttgcctgctttgagatatgccaaccaaaatgggctcaaaattcagtggacagggtttccagtaggttcctcaccacaaaacagtaacgaagattacataatcaaccaccttaagttcagggttttgattcacgagtacgagggtgctggaattcagataattggtactggtgaagaaggtatgggtgtcatctcagagactgacaagagtaaagcatctggttttgagattgttgggtttgaggttgttccatgcagtgtcaagtctgagccagaaaagatgacaaaactccatatgtacgacaattcttcatccataagttgtccacttgaacttgagaagtctcaaataataagagagcaagaaagagtgtctttcacgtatgaggttgaatttgtgaaaagtgatattagatggccatctcgatgggatgcttatctgaagatggaaggtgcccgggtccattggttctcaattctcaactcgttgatggtaatatttttcctggctggtattgtttttgttatcttcttgagaacagttagaagggatttgaccaagtatgaggaattggataaagaggctcaggcacagatgaacgaggagctttctggttggaagcttgtggttggtgatgtttttagagagccaaatcactcaacgttactgtgtgttatgattggagatggggttcagattactggaatggcagttgtcactattgtttttgctgcatttggtttcatgtcaccagcttcacgaggaatgctgctaacaggtatgatattgctttatctcttcctgggaattgctgctggttacgttagtgtgcgtgcttggagaacaataaagggcacttccgaaggttggagatcggtttcctggtcaactgcgtgcttctttcctgggattgtcttcgtcatcctcactgtgctgaatttcattctttggggaagcagaagtactggagcactccccatctcattatttttcactctcttagcactctggttctgtatttcagtgcctctcaccctcttgggaggataccttggaacacgagctgagcctatttcatatcctgtgcggactaaccagattcctagggagatccctgcacgcaagtatccgtcttggcttcttgttcttggtgctggaactctgccatttggaaccctctttattgaactcttcttcatcctctctagtatttggcttggacggttctactatgttttcggttttctgcttattgtcctcctcctgttggttactgtttgtgctgaagtttcagtcgtgctcacttatatgcatctttgtgtggaggactggatgtggtggtggaaagcattctatgcatcaggctctgttgctctctatgtgttcctgtactccatcaattacttggtttttgacctccagagcttgagtggcccagtatcagctatactttaccttggctactctttgataatggctgttgcgatcatgctgtcaactgccactattggcttcctcacatcattttacttcgtgcattatcttttctcatcagtgaagatcgactaa

SEQ ID NO: 3430 - DNA, 2653 bp, Panax ginseng
gattttttagataatatttcagcttttgtttctttttttctcttcggtagtccagtttcaaactagtataaaagtaagattggttttataaactctggtggaggaagggattaaattggggagaaagatatctgtacaaggactaacagttaaatgtttgtatttgtacgctttgattttgaatacactagcgagtgtagcttagagtggcgaagttttgagaatctggtctatttttccttttcttaagaccaatggcactgtcattgatctcgaaaaggacataccgggatgctttcatctatgttattttgatttcgcatgtttgtaacgggttttaccttcctggaagctacatgcacacatattcgacaggtgatgaaatagttgccaaagtcaattcattgacatctattgaaacggagcttcccttcagttactacagtctaccatactgcaagcctcaaggagggataaagaaaagcgctgagaatcttggagagttactgatgggagaccagattgacaactctccctaccgtttccgtatgaatgtcaatgaatctgtttatctctgcacaacaagtccattgagtgagaatgaggtaaagcttttgaaacagagaactcgcgatctgtatcaagtaaatatgattctcgataatttacctgccatgaggtttaccacccaaaatgggataaaaattcagtggactgggtttccagttggatacacaccacccaatactaatgatgattacatcattaaccaccttaagttcaaagttttggttcatgagtatgaagggactggcgtagagataatagggacaggggaagaaggtatgggcattatatcagaagctgataaaaagaaagcttctgggtatgagattgttggttttgaggtcttaccttgcagtgttaaatatgatcttgagaagatggctaaacttcatagatatgacaatgttacgtccttaatctgtccacttgagctcgacaagtctcaaataataagagagcaagagagagtatcatttacttatgaggttgaatttgtgaagagtgatattagatggccatctcggtgggatgcttatctgaagatggaaggtgcccgtgtccactggttttctatcctcaactcacttatggttatcttattcttagctggtattgtttttgttattttcttaagaacagtaaggagggatctgacacggtatgatgaattggacaaagaagcgcaggcacaaatgaacgaggaactctcagggtggaagcttgttgtaggtgatgtattcagagagccaaaattttcaaagctactatgtgtgatgattggagatggggttcagattacagggatggctgttgtgactattgtatttgctgcctttggtttcatgtcaccagcttcacgaggtatgttgttgacaggaatgataattctttatcttttcctgggaaccggagccggttatgctggtgttcgtttgtggtgcactatcaagggtacttcagaggggtggaggtcagtttcatggttggtcgcttgcttcttccctggcattgtctttgttattctcactgcattgaacttcattctttggggcagcaagagtactggcgctattcccatatccttgtattttataatcttgtcactgtggttctgcatttcagtgcctctcacactattgggaggatacttagggacacgagctgagtctatccagtaccctgtgagaacgaaccaaattcctagggagatccctgcccgcaagtatccatcatggcttcttgttcttggtgctggaacccttccatttgggaccctctttattgagcttttcttcatcctttctagcatatggcttggaaggttttattatgtcttcgggtttttgcttcttgttcttctgttgttggttactgtttgtgccgaagtttccctggtcctcacttacatgcatctatgcgttgaggattggcagtggtggtggaaagcattttatgcctcaggttcggtagctttgtatgtattcctttactctatcaactacttggtttttgaccttcaaagtttttagcggacctgtgtctgcgatactttatcttggctactcactgatcatggcaattgcaatcatgttatctactggcaccattggatttctttcatccttttacttcgttcattatcttttctcatcggtgaagattgattgagaagtccttttttagtgctcagtggtcggcttgaaaattaagtctcctggtgaatagataaatgagtgctgacagtcctacaatatccttttgctaaattttgttacaagatcatgttgcaccatgtcaagaggcacccatgtgatctgaagttgtgctaaaggatggttatattttccttgtcgtttgagattagattagagatttcaatagtattcaattgtgatttagactcgtcgggaaaaaaatgacttggtgatccttccttactgttgtgttctgcattgctattttcatttcttttcccctttttattgtcctacccgtacatccaatggaaactaattgaatgggaccaaagttactgtccttgtactatttcaatcataacattgataaaaatgtttaaattgccact

SEQ ID NO: 3431 - DNA, 2680 bp, Gossypium raimondii
actggagttacggtagtagcggtgaaaattaaagagtcgagtccacggctctgttactcttatcacaactttcattggccaaaattttcttttctgtctacacatgaccctaatctccgatttaatctcttgaaaatactcgcaagaatcccggtagcttaaaccattaccaaggaaaaggaaaagttaaatccataggcctctgcttcgttcccacgcgttttccgtggtgtccaaggatccaatatttcatcagtttcagttcctatcgaacttcaaccaccctagatctgtctcagacttatttgtatcttgggtgcctcgggttactgtagcttaggttcgagccgtatactgcaatatctgctattacgatggttttcccagaaagcaagatgcctggagtttgctgggtttttctgttactgcttctgtttgctcatatttgtgatgggttttaccttccgggaagttacatgcacacgtattcgactaaggatactatatttgccaaagttaattccttgacttccattgaaaccgagctcccttttagttattacagtctcccttactgcaagcctcttggtggagtaaagaaaagtgccgagaatcttggtgaacttctcatgggagatcagattgataactccccttataggtttcgaatgaatgtgaatgagtctctctacctttgcaccaccagccccttgaatgagcacgaggttaagcttttgaaacagaggactcgtggtttgtatcaagtgaatatgattctagacaatttgccagtgatgaggattgcaaaacagaacggggttaacattcagtggactggattcccggttggttattctccaccaaacagtaatgatgattacataatcaatcatctcaagttcaaggttttggttcacgagtatgagggaagtggtgtggagataattggaactggggaagatgggatggctgtgtttcccaaagctgataagaagaaagcttctggttttgagattgttggtttcgaggtggttccgtgcagtgttaaatatgatccaaaagccatgactaaacttcacatgtatgacaaagtctcctctgtgaactgccccttggggctcggcaagtcgcagataataagggaacgagaaaggatctcttttacttacgaggttgaattcgttaaaagtgatattagatggccatctcggtgggatgcttatttgaagatggaaggggcacgcgtgcactggttctcaattctaaattctctaatggtgatcactttccttgctggtattgtgtttgtcatcttcttgaggactgtgaggagggatttgacaaggtacgaggaactggacaaagaagctcaagcacaaatgaatgaggagctttctgggtggaagcttgttgtaggagatgtcttcagagaaccagattgtccaaagcttctctgcgtgatgattggagatggagttcagattatgggaatggcagctgtcactatagtttttgctgccttcggtttcatgtcaccagcttcacgaggaatgctactgacagggatgattattctttatcttttcctgggtattgtggctgggtatgttgctgtacgtctctggagaactctgaagggaacttcagaaggatggaggtctgtttcgtggtccgttgcgtgcttctttcctggaattgtctttgttatccttacggtattgaattttattctgtggggcagtaaaagtactggtgcaatccccatttccctgtattttgtacttttatctctctggttctgcatttctgtgcctctgactctcattggaggattcatagggaccagagctgaagctattcagtatcctgtaagaactaaccagattcctcgggagattcctgcacgcaaatatccatcatggcttcttgttcttggtgctgggacccttccatttggaacccttttcattgaactcttcttcatcctatctagcatctggcttggcaggttttattacgtgtttggtttcttgcttatagttcttctactactgatcatcgtttgtgccgaagtgtcagtggtccttacctacatgcatctttgtgtcgaggactggcgatggtggtggaaggctttctttgcttcgggttcagtatcactctatgtgttcctctactccattaattacttggtctttgacctacaaagtttgagtggtcctgtgtcagctattctttatctcgggtactcaatgatcatggcgattgcgataatgctgtcaacgggcaccattggcttcatcacatcattctattttgtccattatctcttctcctccgtcaagatcgactaaaagtttcatttggtgatcttcatcaactggtggaaaagacataggcttgtaagagtatgatatatcggtgaagttgccattggtagctaatcatgttacacttatcaaagagacactcaaaatcattcaaaattatatgttaattttggtggtggttgagtgtaggacctgatagatttaaaagtctgattactagttacgagtttttgtttggattacatgtaggaagttgtagtttgttggacgtgaaatcttgtattttctctcatatttttaatcaaatagaaacatttactttctaagatcacagccatggaccatgggcc

SEQ ID NO: 3432 - DNA, 3402 bp, Panax ginseng
gctctgcctatactcggaccagatctagaaatagtgaaacccccaacccatttgttttaacactttacattatcatcctcatcagccataacaatttcagtacaaagctcgaatcactcaattcgggagatctatttgtggttatgtcttcaatctctctatttccattaatgcttagtatctatagatctgtagagcaccgactaatttacacaatctacaatcttagtatctgtttaaatattttattttgttttcagttgatgaatgttcaaaaattgtatgttttctgtaattgctgttctatgatcccctgtaccgtagatttgaagttttggtgatcgagggttttgtttatgtagcttattgttttttcttagttaaaataggagattgttagttgataattcattcaaatagattctctccttttctttttgctactttgaagttggaaaaggtgtcagaaaagaaagaatttggaaaagaaaatggagaaacaattaaaacttaaaaagactcaaaacacttggctttaaaagggacttgatttttcgttaaggtggatatatgtctgttaagttgattctatgttattcagttttcagttttttagataatatttcctgctgtttccttttctattattgagttccaaaaatagtgtgaatgactcctaaaagaaagtaagattttttttttaactcctgtacaagttgggagaaagggattaatgagggagcaagagatcaatacgaggcactgacagtttaaatattgtacttgtagcttttattgataatacgctggcaagtttggcttagagtttgtgaagttttggggatctggtctgtgtttccttttcttaagaccaatggcattgtcatttgtctcgaaaaggacatactgggctgctttcacctatgtcttttgatctcgcatgtttgtaatgggttttacctgccgggaagctacatgcacacatactcgacgggtgacgaaatacttgccaaagtcaattcattgacatctattgaaactgagcttcccttcagctactacagtctaccatactgcaagcctcaaggggggataaagaaaagtgctgagaatcttggagagctactcatgggagaccagattgataactccccctatcgtttccgtatgaatgtcaacgagtctgtttatctctgcacaacaaaacccttaagtgagaatgaggtaaagctcctgaaacagagaactcgtgatctatatcaagtaaatatgattctggataatttacctgccatgaggtttgccactcaaaacggtgtcagaattcagtggactgggtttccagttggatacacaccacccaacactaatgatgattacatcattaatcatcttaaattcaaggttttggttcacgagtatgagggtactggtgtacagataattgggacaggggaagaaggtatgggtgtaatttcagaagctgataagaagaaaacgtctgggtatgagattgttggttttgaggttttcccttgcagtgtcaaatatgatcctgagaagatggctaaacttcatagatatgacaacgttacatccttaatctgtccgcttgagcttgacaagtctcaaataataagagagcaagagagagtctcatttacttatgaggtcgaatttgtgaagagcgatattaaatggccatcacggtgggatgcttatctgaagatggaaggtgcccgtgtccactggttttctatcctcaactcactggtggtgatctttttcctagctggtattgttttgttatttcttaagaacggtaaggagggatctgacgaggtatgaggaattggacaaagaagctcaggcacagatgaatgaggagctatcaggatggaagcttgttgtaggtgatgtgttcagagaaccaaatttttcgaagctactttgtgtaatgattggtgatggggttcagattacagggatggctgttgtgactattgtatttgctgcgtttggtttcatgtcaccagcttcacgaggtatgttgttgacaggaatgattattctttatcttttccttggaactggagctggttatgctggtgtacgtttgtggtgcactattaaggggacttcagaagggtggaggtcagtttcttggtcggtcgcatgcttcttccctggcattgttttcatcattcttactgcattgaacttcattctctggggcagcaagagtactggtgctattcccatatccttgtattttatactcttgtctttgtggttctgcatatcagtgcctctcaccctactgggaggatacttggggacacgagctgagcctatcaaataccctgtgagaacgaaccaaattcctagggagatccctgctcgcaagtatccatcatggcttcttgttcttggtgccgggaccctcccatttgggaccctctttattgaacttttcttcattctttctagcatatggcttggaaggttttattatgttttcgggttccttcttattgttcttctgttgttggttaccgtgtgcgccgaagtttccgtggtcctcacttacatgcatctttgcattgaggattggcaatggtggtggaaagctttttatgcctcaggttctgttgctctgtatgtgttcctgtactctatcaattacttggtttttgaccttcaaagtttgagtggaccagtttcagcgatgctttatattggctactcactgatcatggcaattgcaatcatgttatctaccggcaccattggcttccttacatccttcttctttgttcattacctcttctcatctgtgaagattgattgaaagttccttctgtaatgctcgttggctggtttgagaatgaagactcctgttgcatagataaatgaagttattacagaccctacattatccttttgctcaattttgtttgcaacaagatcatgttccaccatgtcaagagggagccagatgatctgcagttgtgctaaaaggatcacactatattttccttttcttttgagattagacattaaatttgtgatttaggcttgttccaaaaagaaaaaaaaattggacttggaaatcctcattgttgtgttcgtattgctatttttttattctttctcccgttttactgtccttcctgtgcatccattggaaaccaactgtatgggattgaaattactatccttgtactttgttcaattctaacattgaaagaaaggtaccttaaattgaaactaaaaaaaaaaaaaaacaaaaaaaaaaacaaaaaaaaaaacaaaaaaaaaacaaaaaaaaacaaaaaaacaaaacaagaagagacaagagaacacagagagaccccccccccccccccccccccccccccc

SEQ ID NO: 3433 - DNA, 2273 bp, Solanum phureja
atattgggctcttttcgtctatgttgttctggtttctcatgccagtaatggtttttatcttcctggaagctacatgcatacatattcaccaaatgaagaaatcgtagtcaaagtgaattcattgacttcgattgaaactgaacttccattcagctactatagtcttccttactgcaagcctccaggcggagtcaagaaaagtgctgagaatctaggagagttgctcatgggagatcagattgacaactccccctacaaatttaggatgaatgtcaatgagtctatttacctgtgtactactcctcccctaaatgagcatgaggtaaagctgttgaagcagaggacccgtgatctatatcaggttaacatgattttggataatttacctgctttgagatatgccaaccaaaatgggctcaaaattcagtggactgggtttccagttggctactcaccacaaaacagtaacgatgattacataatcaaccaccttaaattcagggttttaattcatgagtacgagggtgctggagttcagataattggtaccggtgaagaaggtatgggtgtcatttcagaaactgataagagtaaaacatctggttttgagattgttggttttgaggtggttccatgcagtgtcaagtatgagccagaaaagatgacacaacttcatatgtatgacaacacttcgtcaataagttgtccactggagcttgacaggtctcaaataatacgagagcaagaaagggtgtctttcacttatgaggttgaatttgttaaaagtgatactagatggccatctcgatgggatgcttatctgaagatggatggtgcccgagtccattggttctcaattctcaactctttgatggtaatatttttcttggctggtattgtttttgttatctttttgagaacagttagaagggatttgaccaagtacgaggaactggataaagaggctcaggcacagatgaatgaggagctttctggttggaagcttgtggtgggtgatgttttcagagagccaaatcactcgaagttactgtgtgtgatgattggagatggggttcaaattactggaatggcagttgtcactattgtttttgctgcatttggtttcatgtcaccagcttcacgaggcatgctgctaacaggcatgatattgctttatctttttctgggaattgctgctggttacgttagtgtgcgtgcttggagaacaataaagggtacttcggaaggttggagatcggttgcatggtcaactgcatgcttctttcctgggattgtctttgtcatcctcactgtgctgaatttcatcctttggggaagcaagagcactggcgcactccccatctcattatatttcattctcatatcgctttggttctgtatttcagtgcctctcaccctcttgggaggacaccttggcactcgagctgagcctattcaatatccagtgcggactaaccagattcctagggagatccctgcacgcaagtatccctcttggcttcttgttcttggtgctggaactctgccatttggaaccctctttattgaactcttcttcatcctctctagtatttggcttggacgattctactatgttttcggttttctgcttatagtcctcctcctgttggttactgtttgtgctgaagtttcagttgtgctcacttatatgcacctttgtgtggaggattggatgtggtggtggaaagcattctatgcatcaggttctgtttctctatatgtgttcctgtactccatcaactacttggtttttgaccttcagagcttgagtggcccagtatcagctatactttaccttggctactctttgataatggcagtagcaatcatgctttcaactggcactattggcttcctcacatcattttactttgtgcattatctttttgcatcagtgaagattgactgaacaggtgtgcagagccgcgattattattgtttagatggctaaagaaagacctgttgtgcattgtggaactttacatagtcctgccagaaagagtatctaaaattgcagtgagggacttatctattttactgtaatgttctgaggctagatattttgttagtccaaaagctattgtttagtattttcatctttcattgtgttttaattacatttcccccacatttcttgtatctttacaacctctactttcaatgggaaaattatgagaaaactcattgtagctttgaaattgaaaaggaagataggtttaaggtggttttgt

SEQ ID NO: 3434 - DNA, 2626 bp, Triphysaria pusilla
accaaatgaaaaagaaggtgagatccaaatctggaacactccatatcctggatagaaggggttgctgcaacccaaattctcacacatcgcacgctaatttcacccccactatctttctcactcttctccacttgcacaggagaaaaactctgtatcattgcatgttatagaccttcatttcgcccgatccgaattcagatccaccgtcggactgattcatatgcaccattaattttgctctgcgaagctggtttgaggacatttaactgctttccttctattgtacaatggcgcctttgatttcaaggaaattatgcacaactttcacatacctggttctcataatccaagcctgtaatggtttttatctacctggaagctatatgcatacatattcaacaggagatgagatttacgccaaggtgaattctctaacttccatagagaccgagcttcccttcagctattatagtcttccctattgtaagcctcctgggggcataaaaaaaagtgccgaaaatcttggagaacttttaatgggagatcaaattgacaattctccatatcgtttccggatgaatgttaacgagtctgtatatatctgcaccactcctccactgagtgataatgatgtgaagctcttaaaacagagaactcgggatttgtatcaagtgaacatgattctagacaatttacctgctatgaggtttaccaaccaaaatggagtcaaaattcagtggactggatacccggtgggatatacccctcccggaaacaacaacgattacattatcaaccatcttaagtttagagttctgattcatgagtatgaaggagctggtgtggagataattggtactggtgaagaaggtatgggtgtgatttccgaagctgacacaaagaaggctgcggggtatgagatcgtcggttttgaggttgtcccttgtagcgtaaaatacgactctgataaaatgacgaaactccacatttacgataatgtcacatccgtcaactgtccgctggagctcgacaagtcgcagatcataagggagaaagagagagtgtcattcacgtacgaggtcgagtttgtgaagagcaatgtgaggtggccatctcgttgggacgcttatctgaggatgaaggggcccgtgtgcactggttctcgattctcaactctttgatggtgattttcttcttggccggcattgtttttgtcattttcttgagaacagtgagacgggacttgacaaggtacgaggagttggacaaagaggctcaggcgcagatgaacgaggaactttcgggatggaagctagtcgttggtgatgtctttcgcgagccgtctcattcgaagttactctgtgtgatggttggggacggagttcagattactggaatggctgttgtgactatcgttttcgcagcttttggttttatgtcgccagcttcacggggtatgctattgacggggatgatattgctttatcttttcctcggaattgcttccggttacgtcagtgtgcgcatgtggacaactattaaaggctcgtccgagggatggagatcgatttcttggacgacggcatggttttttccaggaattgtttttgttattttgacattcttgaatttcatcctttggggaagtaacagtaccggtgctattcctatttccttatatttcattttgtttacgctctggttttgtatttcggtaccactcactttattaggtggacatcttgggacacgggctgagcctattaagtacccggttcggactaatcagatccctagagagatacccgctcggaaatacccttcgtggcttcttgttcttggtgctgggacacttccctttgggactctctttatcgagcttttcttcatactctcgagtatctggctcgggagattctattacgtcttcggcttcttgcttattgttttcacgttgttggtggttgtttgtgctgaggtctctgttgttctgacgtacatgcatctctgtgtcgaggactggatgtggtggtggaaagctttttatgcctcgggttcagtatctctgtatgttttcttgtactcaatcaattatctggtatttgatctgcagagcttgagtgggcccgtgtcggcgacgctgtatctcgggtattcgctgataatggctgtggcgattatgctttcgactggcaccattgggtttcttacttcattctactttgtccattatctgttttcgtcggtgaagattgattgaagaatgttatgggctttagttagaggcgagtttgcagggatggtaagtgttttgaggcagtgcgttatcgagagcagcttttacattgcaggtccgttttaaaaatttatataatcttgatattgttgttataaacgaaaattgttaccttgagctgtttcagtttcttcgtgttgatgttgtagtcatatacatatagcccgatttggttccagtataatgctaataattacgtggcatgaagaaaacaataattgcttaattttcctgctgtaactgtaccccatatgctggtttgttaccagcgtgttgtatgggtttttttcttcagaatttgtataaagatgaggcaaaaaaaaaaaaaaa

SEQ ID NO: 3435 - DNA, 2533 bp, Plantago ovata
gccattgaatagattttcactctctctcacttcacattcccattgataagccagatcaaatcctcgaacaagtgtagcagattgaatcacactactttgatctccattaagctgaattcactctcgtctgagtttcgaccggattaatcgttttcagcggaaggcatctcgcctgatccgagcagatccatctcgggttgattgtatgtcatcatcgtagctatattcaattggtttaaggatggcgttgtccttgatattaagaaggaaagtgtgcaccactttcatatgcttagttttcttgctgcatgcatgtaatgggttctatctgcctgggagctatatgcatacatattcaaccggagaagacatttatgctaaagtgaactcattgacctccattgaaactgagcttcccttcagctattacagtctaccctattgcaaacctagagggggaatcaagaaaagtgctgaaaatcttggagaactcctaatgggagatcaaattgacaattccccataccgcttccgtatgaatgtgaatgagacggtgtacctctgcaccactgccccgttaagtgagaatgaggtcaagcttttgaaacaaagaactcgggatctgtatcaggtgaatatgattctcgacaatttgcctgccatgaggtataccaccaatcaacagggggttaaaatccaatggaccgggtatccaattggatatacaccggaaaacagtaaggaggattacataattaatcatctaaagtttagggtattgattcatgagtatgaaggagctggtgtggagataattgggactggagaggaaggtatgggtatcgttactgaagctgataaaacaaaggcttcaggatatgagattgttggttttgaggttatcccatgtagtgttaaatacgaccctgaacaaatggccaaacttcacaactacgataatatcacatctgtgagttgtccacaagaacttgataaatctcaggttatcaaggagcaagaaagagtctcatttacatatgatgttgagtttatcaaaagcgacatcaggtggccatctcgttgggatgcttatctgaagatggaaggtgatcgtgttcactggttttcaattctcaattcattgatggtgattttcttcctggcaggcattgtttttgtcatatttttgagaacagtcagaagggatctgacaaggtacgaagaattggataaggaagctcaagcacaaatgaatgaggaactctctggatggaagctcgtggttggtgatgtcttcagagagccatttcactcaaaattactctgcgtaatggttggtgatggagttcagattcttggaatggcagttgtcactattctttttgcagctcttggtttcatgtcaccagcttcacgtggtatgcttctaacaggcatgatactgctttatcttttccttggaattgctgctggttatgtcggtgtacgtatgtggagcactgttaaaggttcacccgaagaatggcgatcagtttcttggtcaatagcatgcttcttcccgggaatcgtttttcttatactaactgtgttgaatttcatcctttgggcaaacaagagtacgggagcaatccctatttccttatatttcaccgtcttgtctctctggttctgtatttctgttccactcactctcttgggaggtttcctaggcacacgggcagaacctattcaattccctgtccgtactaaccagatcccacgagaaatcccagcccgtaagtatccttcatggcttctcgttctaggtgctggaactcttccatttggaaccctgttcatcgagcttttcttcattctctccagcatctggcttggacgtttctattacgtttttggctttttgctaattgttttccttctactaatcgtcgtctgtgctgaagtttcggttgtgttgacttacatgcatctctgtgtggaggactggatgtggtggtggaaagcattttacgcctcaggttcagttgccctatacgtgttcctgtactccatcaattatctcgtatttgatcttcagagtttgagtggtcctgtgtctgctatactttatcttggctactccctgataatggcaatcgcgatcatgctttctaccggcaccattggattccttacatcgttctactttgttcattaccttttctcatcagtgaagattgactgaagaacgtgtacccataatgattctgataccatttttgtgggcatagagacttggcagcaatacatttaagggcatctgggctatccattcggccatagaacatgctgttacaattttcctgcatacatgtattcttttatagtgctttgatgattctttactgatccaaattgtagttgacggtttctatttcatcttcctgtgtaccttggcattcgcaatgtagttcactggacatgttgagaataaagggcaagtggttaccccattagtccattattatcataaaatgattagctaatccttatg

SEQ ID NO: 3436 - DNA, 2768 bp, Petroselinum crispum
aaaaatggaaatttgagatctgaaaaatccgttgttacttttcttgtaatttcatcaagcaaaagtctattatctggagagcggtagcagcaggagtagtattatatcacaaaagtctcttgttgcctgctcttacaattacaatttacaactcaactcactcactccgttcctacatcctctctctccgttttttcttaaaagaagcttgcattggctttaaggggtcaagtatagaggatctcagaaccaaagacaatgtctttgagctcgggaaggacatgctgggctgcattcatctattttcttctggtttcacgtttttgtaatgggttttacctgccgggaagctatatgcacacatattcaaccggtcaggaaatatttgctaaagtcaattcactcacatctatagaaactgagcttcccttcagctactatagtctaccatactgcaagcctcatggcggggtaaagaaaagtgcagagaatcttggagagttacttatgggcgaccagatcgacaactctccttatcgtttccgtatgaatgtcaacgagtcagtttatctttgcacgacaaagccattaagcgagaatgaggtgaagctcctaaagcagagaacacgtgatctctatcaagtaaatatgattctggacaatttacctgccatgaggtttgccactcaaaatggagtcaaaattcagtggactggttttccagttggatatacaccaccgagctcagaagatgattacatcatcaaccaccttaagttcaaagtttttgttcatgagtatgaagggactggtgtagagataatcgggacaggggaggaaggtatgggtgtaatatcagaagctgatacgaagaaagcatctggatatgagatagttggttttgaggttttgccttgcagtgtgaagtatgatcctgaaacgatggccaagcttcatatatatgacaacgttacatctctaaactgcccacttgacttagacaagtctcaaattataagtgagcaagaaagagtatcatttacatatgaggttgaatttgtgaagagcgatattaaatggccatcccggtgggatgcttatctcaaaatggaaggtgctcgtgtccactggttttccatcctcaactcgctgatggtaatattctttttagctggtatagtttttgttatatttttaagaacagtcaggagagatctgacaaaatatgaggaattggacaaagaagctcaggcacaaatgaatgaagagctctcagggtggaagcttgttgtaggtgatgtattcagagagccaaatttttcaaagctactatgcgtgatgattggagatggagttcagattacaggaatggctattgtgactattgtatttgctgcatttggtttcatgtcaccagcttcaagaggtatgctgttgaccggaatgattatcctttacctcttcctgggaacaggggctggttatgcaggtgtacggttgtggtgtattatcaagggaacgtcagaagggtggaggtccgtctcttggtcagttgcatgtttcttcccaggcattgcttttgtgatccttactgcattgaacttcattttatggggcagcaagagtactggtgccattcctatatacttgtattttatactattgtctctgtggttctgcatttcagttcctctcaccctattgggtggatacttagggacacgagctgagcctatcaagtaccctgtgagaacaaaccagattccaagggagattccggctagcaagtatccatcatggcttcttgttcttggtgccggaaccctcccatttggaaccctctttatagagcttttcttcattctttctagcatatggcttggaaggttttattatgtcttcggattccttcttgttgttctcttgctgttggttactgtgtgtgctgaagtgtcagtggtcctcacatacatgcatctctgtattgaggactggcaatggtggtggaaatcattttatgcatcaggttctgttgccctgtatgtattcctgtactctattaattacttggtctttgaccttcaaagtttgagtggaccagtgtcagcaattctttatcttggctactcactgctcattgcaattgcgattatgttatctaccggcaccatcggcttccttacatctttctactttgtccattaccttttctcatcagtgaaaattgactgagaagttccttcagcagtgctcaacgattattggataatgaaacttcttggtgccaagataagataagagaatctcctcctgactatagtttttctaaagatgtcctcaacaagatgtcctcacggcaaaatacttcttcattttcttgcctctaaagaatattacattacgatagtgttaatcatgtgatttagacttgttcagacaactgtaatctagctatcattgtttgtttctgaaatgcatttacaaatattttacccttctcactgttttgcctatatattcagtatattgtaatctaacatgacatatgaattatatttatttactgttcctcaaatatgttcaagtaaacgctgttgaaaagccttcaccaactatattccattagtaacttctggttcagattacatcaattcagaaagttgagcataccagctgtttcttttttctctttgtagctgttgcatatatataaatgaaaattttcttttcgataaaaatcatgtttctgtgtttaactgtaattgtgc

SEQ ID NO: 3437 - DNA, 2674 bp, Aquilegia formosa
ctctctctctctctctctgtcttctagatccagatcgaaggttgagaagtcagatatctcgtatttcgaggcagatttggggtaaggttttgctcaccatcatcatcttcttgttcttcttcatttatatgattagatctgaatgaagttgaaatcattgaatcagatctgaatgaatttataaaacattcgatatgataaaaatgtttaattggtatagttttacagcaattttgattcttgtttgtatgaatgtcgtatgcaatggattttatttacctggaagttatatgcatacatattcaagtggtgaagcaataatagtaaaagtgaattcattaacttcaatagaaactgaacttccatttggttattatacactaccttattgtaaaccaaaagatggaattaagaaaagtgctgagaatttaggtgaattattaatgggtgatcaaattgataattcaccttatcgatttcgtatgaatgttagtgaatcagtttatttatgtacaacaactcctttgaatgaacatgatgttaaactttttaaacaaaggacacgagatttgtatcaagttaatatgattcttgataatttacctgcgatgagatttgcaaaacaaaatgggattaatattcaatggactggatttcctgttggttataatccaccacaaactgatgatgattatgttattaatcatcttaagtttaaggttttggttcatgagtatgaaggtagtggtgttgagataattggtactggggaagaaggtttgggtgttattacagaaactgataaagggaagaaatctggttttgagattgttggttttgaagttgtaccttgcagtgtcaaacgtgatcctgaggttatgttgaaaatgaatatgtatgataaaatagatccagttaattgtccacttgagcttgataaatcacagttgattagagaacaagagaggatttcatttacatatgaagtggagtttgtgaaaagtgatatcaggtggccatctcgttgggatgcttatttgaaaatggaaggggctcgcgttcattggttttcaatcctaaactcgctcatggtcatcttctttttagctggtattgtgtttgttatattcttgaggacagtcaggagggatctaacaaagtatgaggaactggacaaagaagctcaagcacagatgaatgaagagttatctggttggaagcttgtagtgggtgatgtgtttagagagccaaattgtgcaaggctgttgtgcgtgatggttggtgatggtacacaaattactggaatggctgttgttacgattgtgtttgcagctcttggtttcatgtcaccagcttcacgaggaatgctcttaactggaatgatagttctgtatcttttccttggtattgtggctggttatgtaggcgttcgtttatggagaacaatgaagggaacttctgaaggatggaggtcaatttcatggtcagttgcgtgtttcttctctggaatagtctttgccattcttacagtattgaatttcttattatggggcagcaagagcactggtgctataccgatctccacctatttcatactcttgtttctttggttctgtgtgtcagtccccctcacccttttgggaggcttcttaggaacaagagcagaggctatttcgtatcctgtccgaactaaccaaattcctagggagatccctgcacgaaaatacccatcatggcttctcgttcttggtgctggaacacttccttttggaactctattcattgaactcttcttcatcctatccagcatctggctggggaggttttactatgtgtttgggtttttgcttgttgttcttctgttgcttgtcgttgtctgtgcagaagtttccgttgtcctcacctacatgcatctgtgtgtcgaagattggcagtggtggtggaaagctttctttgcctctggttcggtttctgtttatgtgtttctgtactccattaattacctcatattcgacttacagagtttaagtggaccagtgtcggctacactttatcttggttactcactgatcatggcatttgcaatcatgctgtctactggaaccattggcttcctcatatccttctattttgttcattatcttttctcatctgtcaagattgactagtcacttatactgaagcagcgaaagtccatttacttgtttaatacctttggtagcttccttcggtatacaccaagagaaaaggacctattatggaagaagaagatgtccaaagtgttgagctttcttcatacacgtacaactcagtaaaagttactctctttctgttaagctgcctgctagtcatggattttcaagtttgagaagttttggtgccattagtaagtcgtcatgctgcattacgttcaaattgcaggttaatggtgattgcactgactcacaaaatttcagatcttgtccttgcttgtggaaggtctttataccttttgtagtcgtgagttgtgccatctgtttcatcatgtttcgcagaatttaagatttacttcaatcagatctcattcttagtagttcggattttgttaatggaattattcaattgtcatattttgttcttttattttcatggttgttgaacttggggattcaaacttcctacttgtctatttgca

SEQ ID NO: 3438 - DNA, 2309 bp, Arabidopsis lyrata
ttatcagcgtgaccttcttcttcaccaagagagcgatttcgaaacacaaagtccctctcctacctcttctagatctgactccgtcgtagatctccatacctggatctgtctcaggaagggacaatgtttggtgtgtaccgagttttcgtgttgctggtgtttgttagtcagctttgcaatgggttttacttaccagggagttatatgcacacatattcagatggagactctatctttgctaaagtcaattccttgacgtctattgaaactgagcttcctttcagttactatagtcttccttactgtaaaccgcttgagggtatcaagaaaagtgctgagaatcttggggagcttctcatgggggatcagattgataactctgcttataggtttcggatgagaacgaacgagtcactctacttatgcaccaccagtcctctcaatgagcatgaggtcaagctcttgaaacagagaacccgtgagttgtatcaagtgaatatgattcttgataacttgcctgctttgagattcgctaagcaaaatggggttactatccagtggactggatatcctgttgggtattcgccaccaaacagcaatgatgattacatcattaatcacctcaagtttaaggtcttggttcatgaatatgaaggcaatgtcatggaggtgattggtaccggtgaagaaggtatgggtgtgatctctgaagctgataaaaagaaggcactgggctatgagattgttggatttgaggttgttccctgcagtgttaagtatgatcctgcaaaaatgacgaaacttcacatgtatgaccctgttccttcagttaactgtccgttggagcttgacaaagctcagatcattaaagaacatgaaaggataaccttcacttatgaagttgaatttgttaagagtgagacaagatggccatccagatgggatgcctatttgaaaatggaaggtgctcgtgttcattggttctctattctgaactctcttatggtgatcttctttctcgccggtatagtttttgtcatattcctaaggacagtgagaagggatttgacaaagtatgaggaactggacaaggaagcacaggcacagatgaatgaagagctttctggatggaaacttgttgtcggagatgtgttcagagaaccagaaatgtcaaagcttctatgcattatggtgggagacggggttcggattacaggaatggctgttgtcacgattgtttttgcagcacttggattcatgtcgcctgcttcaagaggaatgctactaaccgggatgattattctctatcttttcttgggtattgctgctgggtacgctggtgttcggctctggagaaccgtcaagggaacttcagaaggatggagatcgctttcctggtccatagcatgcttcttcccgggtattgcttttgttatactaacagtgttgaacttccttctctggagcagcaacagtactggagccatcccaatctcattgtactttgagctcctggctctctggttctgcatctcggttcctctcaccctgtttggaggattcctaggcacacgagcagaagcaatccagtttccagtgagaaccaaccagattccaagggaaataccagaacggaaatacccgtcatggcttctagtccttggagcaggaacccttccttttggaacgctgttcatagaactgttcttcatcttctccagcatatggttagggagattctactacgtatttgggttcttactcatagttctgcttcttttggtagtcgtgtgtgcagaagtatcagtggtcttgacctatatgcatctctgcgttgaagattggaggtggtggtggaaagccttctatgcatctggttcagtcgcattgtacgttttcgcttactccatcaactacttggtctttgatctacaaagtctgagtggacccgtctcagctatgctttacattggctactctctgcttatggcaattgctatcatgctcgccactggaaccattggcttcctcacctccttttacttcgtccactatctcttttcctctgtcaaaatcgattgataccttgacgacaaaatctcaaccgttgatctctgcttttcaaaagcaatttcaggggttgttatttttttgtcagtactagacttgtagagtctcactatattttacatgtttttattttttctcggacctatattctccttatatgtttttttcttacatctccgccttctatgtttttgttttgaacttttgagtagaaaataaacaaatttgcctttcagctt

SEQ ID NO: 3439 - DNA, 2509 bp, Arabidopsis thaliana
cgcaccgacatattgtataagcgcgtcacagagaataactacccaacacacccacgattttcttgattttcgttattcgctctctttgcgaacgcattaagcaaccaaagcaaagcagtgagagagattatcagcgtgaccttcgaaacaacccaaagtccctcgaccacctcttctagatctgactccctcgtagatctccatacctggatctctctctctcaggaagggacaatgtttggtgtgtatcgagtattcgtgttactggtgtttgttagtcagctttgcaatgggttttacttaccagggagttatatgcacacatattcagatggagactctatcttcgccaaagtcaattccttgacttctattgaaactgagcttcctttcagttactatagtcttccttactgccaaccacttgaaggtatcaagaaaagtgctgagaatcttggtgagcttctcatgggtgatcagattgataactctgcttataggtttcggatgagaaccaatgagtctctttacttatgcactacgagtcctttgaatgagcatgaggtcaagctcttgaaacagagaactcgtgagttgtatcaagtgaatatgattcttgataacttgcctgctttgagattcgctaagcagaatggggttactatccagtggactggatatcctgttgggtattcgccacctaacagtaatgatgattacatcattaatcacctcaagtttaaggttttggttcatgagtatgaaggcaatgtcatggaggtgattggtactggtgaagaaggtatgggtgtgatctctgaagctgataagaagaaggcattggggtatgagattgttggatttgaggttgttccctgcagtgttaagtatgatgctgaaaaaatgacgaagcttcacatgtatgaccctgttccttcagttaactgtccattggagcttgacaaagctcagatcattaaagaacatgaaagaataaccttcacttatgaagtggaatttgttaagagtgagacaagatggccatccagatgggatgcctatttgaaaatggaaggtgctcgtgttcattggttctctattttgaactcgcttatggtgatcttctttctggccggtatagttttcgtcatattcctgaggacagtgagaagggatttgacaaagtatgaggaactggacaaggaagcacaggcacagatgaatgaggagctctctggatggaaacttgttgtcggagatgtgttcagagaaccagaaatgtcaaagcttctatgcattatggtgggagatggggttcgaattacaggaatggctgttgtcactattgttttcgctgcacttggattcatgtcgcctgcctcaagaggaatgctactaaccgggatgattattctctatcttttcttgggtattgttgctgggtacgctggtgttcggctctggagaactgtcaaggggacttcagaaggatggagatcactttcctggtccattgcatgcttcttcccgggtattgcttttgttatactcacagtgttgaacttccttctctggagcagcaacagcactggagccatcccaatctctttgtattttgagctcttggctctctggttctgcatctcggttcctctcaccctatttggaggattcctaggaacacgagcagaagcaatccagttcccagtgagaaccaaccagattccaagggaaatcccagaacggaaatacccgtcatggcttctagtccttggagcaggaacccttccttttggaacgctcttcatagaactgttcttcatcttctccagcatatggttagggagattctactatgtatttgggttcttactcatagttctgcttcttttggtagtcgtgtgtgcagaagtatcagtggtcttgacctacatgcacctctgcgttgaagactggaggtggtggtggaaagccttctatgcatctggttcagtcgcattgtacgttttcgcttactccatcaactatttggtctttgatctacaaagtctgagcggacccgtctcagctatgctttacattggctactctctgcttatggcaattgcaatcatgctcgccactggaaccattggcttcctcacctccttttacttcgtccactatctcttttcctctgtcaaaatcgattgataccttgacgacaaaatctcagccgttgatctctgctttctctaaagcaatttcaggtgttgttatttttttgtcagtactagacttgtagagtccactatattttacatgtttttattttttcctggacctatattctccttatatgttttttttcttacatctccgcctcattatgtttttgttttgaacttttgagtagaaaataaacaaatttgcctttctgctttaggtttcttttggattgtgttttcttgcttctctttgtttccactgatgagtacaaatctgttctcaagtggcagaattgagttgt

SEQ ID NO: 3440 - DNA, 2421 bp, Mimulus guttatus
ccacgcgctaacccatcagcgccaattcaggcattcacacacgaattttcacaagcaaaataaaaaaagaaacaagaaaaaatcaatttcacactcattttcactaaaccctagccttaccgaatccgaattctgatcgaccgcagacttcattgttttttcaaatgccatcagtttgtagggttcagcacgtttgacggcaatttctctccgttcctttttttaacaaatggcgttgcctctgatgtcgaaaaggaaattacatgctgctcttatattattggtccaaatattgcaagtctgtaatggcttttatctgcctggaagctatatgcacacatactcaactggagacgaaatatacgccaaagtcaactctttaacctccatcgaaaccgagcttccattcagctattacagccttccttattgccagcctatgggtggcataaaaaaaagcgccgaaaatctcggtgagctacttatgggagaccaaatcgacaactctccataccgtttccgaatgaatgtgaacgagactgtattcctatgcacaactcccccactgaacgaggagcaggtcaaactcttaaaacagagaacacgtgacatgtaccaagtcaacatggttcttgataatttgcctgctatgaggtttacaaaccaaaacggggttaaaatacagtggaccggttacccaattggatacaatcccgaaaacagcaacgatgattactttatcaatcatctcaggtttagggttttgatccacgagtacgaaggagttggtgtggagataatcggaaccggagaagaaggcatgggcgtaatttccgaagccgagaataaaaagggattagggtacgagattgtcggattcgaggtagtaccttgtagcgtaaaatacgatccagacaagatggcaaaaatccacatgtacgacaacataacatcggtgagctgtccgcacgagctcgacaagtcccaggttataaaggagcaggagagagtgtcgttcacttacgaggtcgaattcgtaaaatccgacatacggtggccctctcggtgggacgcttatctcaagatggaaggcgaccgagtccactggttctcgattctcaattctttaatggtgattttctttttggcgggaatcgttttcgtcatattcttacgaacggtgagaagggatctcacgaggtacgaggagttggataaagaagctcaagcccagatgaacgaagaactttccggatggaagcttgtggttggagatgtctttagagaaccttctaactcgaaattactttgtgtgatggttggagatggggttcaaattaccggaatggcggttgtcactattgttttcgccgccctcggttttatgtcgcccgcttctcgaggcatgttgctgactgggatgatattgttgtatctattcctcggaatcgccgctggttatataggtgtaagaatgtggaggactattaaaggctcgtccgagggttggagatcggtttcttggtctattgcgtgtttttttccagggattgttttcgttatcctaactttcttgaatttcattctatggggaagtaagagtaccggagcgattccgatttcgttgtatttcatacttctgtctctctggttctgtatttcggtaccactcaccctcttgggggggcatttagggacaagagccgagcctattcaattccctgtaagaacgaatcagatccctcgagaaatcccttcccgaaaatacccctcgtggcttcttgttcttggtgcggggactcttccattcgggaccctttttatcgagctcttcttcatcttatcgagcatttggctcggaagattctattacgtgtttggttttcttctcattgtccttacgttgttggtggttgtctgtgctgaggtttcggttgtcctgacttacatgcatctgtgtgtggaggattggatgtggtggtggaaggcgttttttgcatcgggttcggtttctctttacgtgttcttgtattcgatcaattatttggtctttgatctgcagagtttgagcggccctatttctgctacgctttacatcgggtattctttgataatggcgattgctatcatgctttctactggcacgattggattgcttacgtcgttctactttgttcactaccttttctcgtcggtgaaaattgattgaagtggcgtagcgtaatctcgattttttcggagcttttttttttctttctaagcacatttatttatttattcatagggatgtttttaccaatgtttcttgatactagatacttctctagtaacttctgtttcaatataattgtgtcctgaaaggttcttccttttatttatgtccttatggttaattttctaataatatttactagttcatgc

SEQ ID NO: 3441 - DNA, 2445 bp, Triphysaria pusilla
aacgtgagcctgcgtgagatctgaatctgaaacttcatatactagtagaaggattgctgcaacatacagcacaatttctcatttctcacacatcgcacgcgaatttcacgcgcactctctttctcttcttcacttcacatgagaaaaattccttttcactgcagcttttagatcctaatatcgctcgatccgagttcagatccaccgtcggactggtttatatgcgtcactaagatctgcgaacctggtttgaggacatttcattgctgtccttcttttgaacaatgacgctgccttcgagttcaagaaggaagttatgcacagctttcacatacttggctctcatattccaagcctgtaatggtttttatctacctggaagcttattattgtctattacatattcaacaggagatgagatttacgccaaggtgaattctttaacctccattgagactgagcttcccttcagctattatagccttccctattgcaagcctattgggggcatcaagaaaagtgctgaaaatcttggagaactgttaatgggagatcaaattgacaattctccatatcgtttccggatgaatgtcaacgagtctgtatatatctgcaccactcctccactgagtgataatgatgtgaagcttttaaaacagagaactcgggatctgtatcaagtgaacatgattctcgacaatttgcctgctatgagatttaccaaccaaaatggagtcaagattcagtggactggatacccggtgggatatacccctcccggcagcaatgatgattacattatcaaccatcttaagtttagagtattgattcacgagtatgaaggagctggtgtggagataattggtactggcgaagaaggtatgggtgtgatttcagaagctgacaaaaccaaggctgcgggttatgagattgttggtttcgaggttgtcccttgtagcgtaaaatacgactccgataagatgacgaaactccacatttacgataatgtcacatccgttaactgtccgctggagctcgacaagtcccagatcataagggagaaagaaagagtgtcgttcacatacgaggtcgagtttgtgaagagcgacgtgaggtggccgtctcgttgggacgcatacctgaagatggaaggggcccgtgtgcactggttctcgattctcaactcgttgatggtgattttcttcttggctggcattgttttcgtcattttcttgagaacagtgagacgggacctgacaaggtacgaggagttggacaaagaggctcaggcgcagatgaacgaagagctttcgggatggaagctcgttgttggtgatgtctttcgtgagccgtcccattcaacgcttctctgtgtgatggtcggagatggagttcagattactgggatggctgttgtgactatagttttcgcagcttttggtttcatgtcgccggcttcacgaggtatgctgttgacggggatgatattactctacctctttcttggaattgcttccgggtacgtcagtgtacgtatgtggacgactattaaaggctcatccgaaggatggagatcgatttcttggaagacagcgtgctttttcccgggaatcattttcgttattctgacattcttgaatttcatcctttggggaagtaacagtaccggtgctattcctatttccttatatttcatactgttttctctctggttttgtatttcggtaccactcactttattaggtggacattttgggacgcgagccgagcctataacatacccggttcggactaatcagatccctagagagatacctgcccgcaaatacccgtcatggcttctcgttcttggtgctgggacactccccttcgggactctctttatcgagcttttcttcatactctcgagtatctggctcggaagattctattatgttttcggtttcttgcttattgttcttacattgttggtggttgtttgtgctgaggtctctgttgttctgacatacatgcatctctgtgtcgaggactggatgtggtggtggaaagcattttatgcctcaggttcggttgcgctgtatgttttcttatactcaatcaattatctggtatttgatctgcagagcttaagtgggcccgtttcggcaacgctttatctcgggtattcgctgataatggcagtggcgatcatgctttcgactggaactattgggtttcttacttcgttttactttgtccattatcttttttcgtcggtcaagattgattaaagaatgttatcggctttagtttggagggatagaaagtgtttgaggcagtgttaccaagagcatcttagcttgttttacattgcagtgctgttttaaacttttatgtatctttgatacctgagatatattataaactaaaatttgttatttgaagctgtttcacttgaattgttat

SEQ ID NO: 3442 - DNA, 2608 bp, Solanum lycopersicum
gattgcaactcacgcgatagtagggccacacatataacacgcgcaaacggtttttattggcaaagtccctcagtgccctctggatttcacttcacgattctcatgcttttccccttttcttccaaatctccgtcgattccaccgtcatttctcacttttccgatcactcgtccactcgccgagttcctggaataatctacagagatcttgcattttttggttagatcaaactagtattcaggtgaccggtatttttgttgagcaatggcttccccattgatctcaacaaggagatattgggctgttttcatctatgttgttctggtttctcatgccagtaatggtttttatcttcctggaagctacatgcatacatattcaccaaatgaagaaatcttagtcaaagtgaattcattgacttcgattgaaactgaacttccattcagctactatagtcttccttactgcaagcctccaggcggagtcaagaatagtgctgagaatctaggagagttgctcatgggagatcagattgacaactccccctacagatttaggatgaacgtcaatgagtctatttacctgtgtactactccgcccctaaatgagcatgaggtaaagctgttgaagcagaggacccgtgatctgtatcaggttaacatgattttggataatttacctgctttgagatatgccaaccaaaatgggctcaaaattcagtggactgggtttccagttggctactcaccacaaaatagtaacgatgattacataatcaaccaccttaaattcagggttttaattcatgagtatgagggtgctggaattcagataattggtaccggtgaagaaggcatgggtgtcatttcagagactgataagagtaaaacatctggttttgagatcgttggttttgaggtggttccatgcagtgtcaagtatgagccagaaaagatgacaaaactccatatgtatgacaacacttcgtcaataagttgtccactggagcttgacaggtctcaaataataagagagcaagaaagagtgtctttcacttatgaggttgaattcgttaaaagtgacactagatggccatctcgatgggatgcttatctgaaaatggatggtgcccgagtccattggttttcgattctcaactctttgatggtaatatttttcttggctggtattgtttttgttatctttttgagaacagttagaagggatttgaccaagtatgaggaactggataaagaggctcaggcacagatgaatgaggagctttctggttggaagcttgtggtgggagatgttttcagagagccaaatcactcgaagttactgtgtgtgatgattggagatggggttcaaattactggaatggcagttgtcactattgtttttgcagcatttggtttcatgtcaccagcttcacgaggcatgctgctaacaggcatgatattgctttatctttttctgggaattgctgctggttacgttagtgtgcgtgcttggagaacaataaagggtacttcggaaagttggagatctgttgcatggtcaactgcatgcttctttcctgggattgtctttgtcatcctcactgtgctgaatttcatcctttggggaagcaagagcactggcgcactccccatctcattatatttcattctcatatcactttggttctgtatttcagtgcctctcaccctcgtgggaggatatttgggcactcgagctgagcctattcaatatccagtgaggactaaccagattcctagggagatccctgcacgcaagtatccctcttggcttcttgttcttggtgctggaactctgccatttggaaccctctttattgaactcttcttcatcctctctagtatttggcttggacgattctactatgttttcggttttctgcttatagtcctcctcctgttggttactgtttgtgctgaagtttcagttgtgctcacttatatgcacctttgtgtggaggattggatgtggtggtggaaagcattctatgcatcaggttctgtttctctatatgtgttcctctactccatcaactacttggtttttgaccttcagagcttaagtggcccagtatcagctatactttaccttggctactctttgataatggcagtagcgatcatgctttcaactggcacgattggcttcctcacatcattttactttgtgcattatctttttgcatcagtgaagattgactgaacaggtgtgcagagccgcaattattattgtttagatggctaaagaaagacctgttgtgcattgtggaactttacatagtcctgccagaaagagtatctaaaattgcagatgagggacttttgtacttttctattttactgtaatgttctgaggctagatattttgttagtccaaaagctattgtttagtattttcatctttcattgtgttttaattacattttccccatatttcttgtatctttacaacctctactttcaatgggaaaattaccagaaaactcattgtagctttgaaattgaaaagaaagataggtttaaggtggttttgttatgctggaatttggttctttcagcctcacacc

SEQ ID NO: 3443 - DNA, 2717 bp, Petroselinum crispum
ttccttatatatgatgtgtagtgatttctaattattatgagacaattcattgaaatttcatcactgaatacggtcagtttttgaagctgagtatctgttttttgcttcagtgtcattgcatttcagatttacttcaatcatcatatttgttatatcattcctgcatttatttccttatgaagttcaatacattgagaaaatactctttagcaaaaagcaagatcaacatatgtaatcatagttatagaccttggtgagagaaaaaattgagtggtgaagagctagatatcagtataagcactaatatgtaagcacgctatttgcagcattttcttataagaagctggctaatttcttgaagagggttaagtgttgaggattttaggaccaggaacaatgcctttgatcttggaaaagacatgctgggctgcatttatctatgtccttctaatctcccattcttgtaatgggttttacctgccgggaagctacatgcacacatattcaacagggcaggaaatattcgccaaagtcaattcactgacatctattgagaccgagcttccattcagttactacagtctaccatactgcaagcctcaaggcggggtaaagaaaagtgcagagaatcttggagagttactaatgggagatcagatcgacaactcaccttatcattttcgtatgaatatcaatgagtcagtttatctctgcacgacaagtccattaagcgagaatgaggtgaagctcctaaaacagagaacacgtgatctctatcaagtgaatatgattctggacaatttacctgccatgaggtttgccactcaaaatggagtcaaaattcagtggactggttttccagttggatatacaccaccaagctcagaagatgattacatcatcaaccaccttaagttcaaagtttttgttcatgagtatgaagggactggtgtagagataatcgggacaggggaggaaggtatgggtgtaatatcagaagctgatacgaagaaagcatctggatatgagatagttggttttgaggttttgccttgcagtgtgaagtatgatcctgaaacgatggccaagcttcatatatatgacaacgttacatctctaaactgcccacttgacttagacaagtctcaaattataagtgagcaagaaagagtatcatttacatatgaggttgaatttgtgaagagcgatattaaatggccatcccggtgggatgcttatctcaaaatggaaggtgctcgtgtccactggttttccatcctcaactcgctgatggtaatattctttttagctggtatagtttttgttatatttttaagaacagtcaggagagatctgacaaaatatgaggaattggacaaagaagctcaggcacaaatgaatgaagagctctcagggtggaagcttgttgtaggtgatgtattcagagagccaaatttttcaaagctactatgcgtgatgattggagatggagttcagattacaggaatggctattgtgactattgtatttgctgcatttggtttcatgtcaccagcttcaagaggtatgctgttgaccggaatgattatcctttacctcttcctgggaacaggggctggttatgcaggtgtacggttgtggtgtattatcaagggaacgtcagaagggtggaggtccgtctcttggtcagttgcatgtttcttcccaggcattgcttttgtgatccttactgcattgaacttcattttatggggcagcaagagtactggtgccattcctatatacttgtattttatactattgtctctgtggttctgcatttcagttcctctcaccctattgggtggatacttagggacacgagctgagcctatcaagtaccctgtgagaacaaaccagattccaagggagattccggctagcaagtatccatcatggcttcttgttcttggtgccggaaccctcccatttggaaccctctttatagagcttttcttcattctttctagcatatggcttggaaggttttattatgtcttcggattccttcttgttgttctcttgctgttggttactgtgtgtgctgaagtgtcagtggtcctcacatacatgcatctctgtattgaggactggcaatggtggtggaaatcattttatgcatcaggttctgttgccctgtatgtattcctgtactctattaattacttggtctttgaccttcaaagtttgagtggaccagtgtcagcaattctttatcttggctactcactgctcattgcaattgcgattatgttatctaccggcaccatcggcttccttacatctttctactttgtccattaccttttctcatcagtgaaaattgactgagaagttccttcagcagtgctcaacgattattggataatgaaacttcttggtgcacagataagagaatctcctcctgactatagtttttctaaaaatgtcctcaaggcaaaatacttcttcattttcttgcctctaaagaatattacattacgatagtgttaatcatgtgatttagacttgttcagacaactgtaatctagctatcattgtttgtttctgaaatgcatttacaaatattttacccttctcactgttttgcctatatattcagtatattgtaatctaacatatgaattatatttatttactgttcctcaaatatgttcaagtaaacgctgttgaaaagc

SEQ ID NO: 3444 - DNA, 2263 bp, Brassica napus
aaagcaaagcaaggctaggtagaagagatagagagagaagaagtccctccctctctcgcccctggatctgacttcgttgaagatctcggaacctcgatctgcctcaggaaggaaaatgtaccgggttatcgttttgctagtgtttgttgcgcagctttgcaatgggttctacttgccagggagttatatgcacacatattcaaacggagactcaatcttcgccaaagtcaattccttgacgtctatagaaaccgagcttcctttcagtttctatagccttccttactgcaaaccactcgagggcatcaagaaaagtgctgagaatcttggggagcttctcatgggggatcagattgataactctgcctataggttccggatgaacaccaacgagtctctctatctctgcaccaccagtcctctgaacgagcatgaggtcaagctcctgaaacagagaacgcgcgagttgtaccaagtcaatatgattctcgataacttgcctgctttgagattcgccaagcaaaatggggttaccatccagtggactggataccctgttggatattcaccacccaacagcaatgatgattacatcatcaatcacctcaagtttaaggtattggtccatcagtacgaaggcaatgtcatggaggtcattggcacgggtgaagaaggtatgggtgttatctccgaagctgataaaaagaaggccctgggttatgagatagttggatttgaggttgttccatgcagtgtcaagtacgatcctgagaaaatgaccaaacttcacatgtatgaccctgctccttcagttaactgtccgttggagcttgacaaagcccagatcataaaagaacatgaaaggataaccttcacttatgaagtcgaatttgttagaagcgagacaagatggccatcaagatgggatgcctatttgaaaatggaaggtgctcgtgtccattggttctctatactgaactcccttatggtgatcgtcttcctcgccggtatagtctttgtcatattcctgaggacggttagaagggatctgacaaagtacgaggagctggacaaggaagcgcaggcacagatgaacgaagagctctctggatggaaacttgttgtcggagatgtgttcagagaaccagaactttcaaagcttctatgcattatggtgggagacggtgttcagattacaggaatggctgttgtcactattgttttcgcagcactaggattcatgtcgcctgcatcaagaggaatgttactaaccgggatgattattctctatcttttcttgggtattgctgctgggtacgctggtgtccggctctggagaaccgtcaaaggaacttcagaaggatggagatcactatcctggtccatcgcatgcttcttcccgggtatagcttttgttatactaacagtgttgaacttccttctctggagcagcaacagcactggcgccatcccaatatcactctactttgagctcttggctctctggttctgcatctcggttcccctcaccttgtttggaggattcttaggcacgcgagcagaagcaattcagtttccagtgagaaccaaccagattccaagggagatcccagaacgtaaatacccgtcatggcttctagtccttggagcaggaacacttcctttcggaactctgttcatagaactcttcttcatattctccagcatatggttaggcagattctactacgtattcgggttcttactcatagtgctgcttcttttagtagttgtgtgtgcagaggtatcagtggtgttgacctacatgcacctctgcgtggaagattggagatggtggtggaaagctttcttcgcatctggttcagtcgccttgtatgtctttgcttactccatcaactatttggtgttcgatctccaaagtctgagtggaccggtctcggctatgctttacattggctactctctgcttatggccattgcaataatgctctcaacgggaaccattggcttccttacttccttttacttcgtccactatctgttttcctctgtcaaaatcgattgaaacttgacgagaaaatctcagccgttgaatttttgctttttctgaagcaaattttcaggtgttgttatttttttttgtcagtaatagacttgtagagtccagtgttttttcctctttgaattttcagacttatattaccgttatatgttatttgtttttttctgaactttgagtagaaataaatggtgtcgtatttct

SEQ ID NO: 3445 - DNA, 2383 bp, Euonymus alatus
ggccgaggggaatagctgttgcgttgtttctttgaaaatccggaacaaattcttagtaggagctgtctgggcttcgtttttacgcattctagcagtgtaggatccggctcgagacgatctgtgtcgccaaccattgatattgcatgaattttatagatctgacgaagatttgatggttgatgcgtccattataggagtgtagactgagcattatttcagagatctgctttataagatggctttcttgatgacatcgaaaggtaggatgcccaatatcttccaggctctcctgtttttggttttctttgcccatgcctgctttgggttttatctgccaggaagctacatgcacacgtatgcacctcgtcaacacatatttgccaaagttaactcattgacttctattgaaactgagctcccatttagctactacagtctgccttactgcgaaccccaaggtggaatcaagaagagtgccgagaatcttggagaactccttatgggagatcagattgataactcgccataccggtttcggatgaatgtcaatgagactgtgtatctctgcactacaaatccgttgagtgaacatgaggttaagcttttgaagcagagagcccgtgatctgtatcaagtgaatatgattttagataatcttcctgtgatgaggtatgcaacagagaatggggttaaaattcagtggacaggattcccaattggatatacacctagcaacagtaatgaggattacattatcaaccacctcaagtttacagtctttgtccacgagtacgaaggaagtggcgtggagattattggtactggggaagaaggtatgggtgtgatttctgaagctgataagaataaggcttctgggttcgagattgtcggttttgaggtacaaccttgtagtatcaagtatgatcctgtagtgatgacaaaactccacatgtatgacaacatttcagccgtgagttgcccatctgagattggcaagtctcaaataataagggaccaagagagagtttccttcacttatgaggttgaatttgtaaaaagtgatattagatggccatctcgatgggatgcttatttgaaaatggaaggtgctcgtgttcactggttttcaatccttaattcactcatggttatctttttcctggctggaattgtgttcgtcatatttttaaggactgtgcgaagggatttgactagatatgaggaattggacaaggaagctcaagcacagatgaatgaggagctgtctgggtggaagcttgttgtgggtgatgtattcagagaaccagagtattccaaacttctttgcgtgatggttgcagatggggtacagattatgggtatggcagttgtcactattgtttttgcagcccttggtttcatgtcaccggcatctcgaggaatgctgctgacagggatgataattctttaccttttcttgggcattattgctgggtatgttggtgtgcggatgtggagaaccatcaagggaacttcggaggggtggaaggcagtttcatggtcagttgcatgcttctttcctggaatcgtctttattatccttacagcattaaacttccttctttggggtagtaatagcactggtgctatcccaatttccacgtattttatactgctggctctctggttctgcatatcagtgcctctcaccctcttgggaggagtttttggcacacgagctgaggccatccagtatcctgtgcgaaccaaccagattcctcgggaaattccagtccgcaaatacccatcatggcttttggttcttggtgctggaacccttccttttggaactctcttcattgagcttttcttcatcctttctagcatctggcttgggaggttctattatgtctttgggttcctgctgatagttctttccctgctggttgttgtttgtgctgaagtatcggtggtcttaacatatatgcatctctgtgtggaggactggcggtggtggtggaagtctttcttcgcctcaggttctgtatcactatacgtctttctgtactctatcaattacttggttttcgacctacagagtttgagcggtcctgtgtcagccatgctctatctcgggtattcattgctcatggcagtcgcgatcatgttatctactggagccattggtttcctcatgtccttctacttcgtgcattacctcttctcatccgtaaagattgattagcacaattgccgtttgcgatcttcctcgaccaattatgagttgttttgccatcggggaaaacaaagttctcttgcttcattttttttggttttttacgtatttcactacagtagttaaccatgttgcagtgtattgaggatgctttcaaaatatgttacc

SEQ ID NO: 3446 - DNA, 2450 bp, Orobanche aegyptiaca
ctctcgctctcctctacttcacatgagaaatctcaattcgctgtagcttttagaccctaatttcgcccgatccgagctcagatccatcgtcggactatctatacatgccatcaacttagctttgtgtagctggtttgaagacggttctctgctttccttctattgaacaatggctgtgcctttgatgtcgagaaggaaattttccactgctttcacatacttgcttttcatactccaagcatgtagtggtttttatctacctggaagctacatgcatacatattcaacaggggatgaaatttacgccaaggtgaattctttaacctctatcgagaccgagcttcccttcagctattacagtcttccttattgcaagcctcgtgggggtatcaagaaaagtgctgaaaatctcggagagctgttaatgggagatcaaatcgacaattctccatatcgtttccggatgaatgtcaatgagtctatatatatatgtacgacacctccactgcgtgagaatgaggtgaagcttttaaaacagagaactcgggatctgtatcaagtgaacatgattcttgacaatttgcctgctatgagatttaccaaccaaaatgggattaaaattcagtggactggatacccagtgggatatactcctccagggagcaatgatgattacattattaaccatcttaagtttagggtattgattcacgagtatgaaggagctggtgtggagataattggcactggagaagaaggtatgggtgtcatttcagaagctgacaaaaagaaggctgcagggtatgagattgttggtttcgaggttgtcccttgtagcgtaaaatatgaccctgagaagatgacaaaactccacatctatgatagtgtcacgtctgtcaactgtccattggagctcgacaaatcccaaatcataagggagcaagagagagtttcattcacatacgaagttgagtttgtaaaaagcgacatcaggtggccatctaggtgggatgcttatctgaaaatggaaggtgcccgtgtacactggttttcaattctcaactcgttgatggtgattttcttcctagcaggcattgtttttgtcatatttttaagaacagtgagaagggatttgactaggtatgaagaattagacaaagaggctcaggcgcagatgaatgaagagctttcaggatggaagcttgtggttggtgatgttttcagggaaccttcccatacaaaattgctctgtgtaatggttggtgatggaattcagattactgggatggcagttgttactattgttttcgcagcttttggctttatgtcaccagcttcacgaggtatgctgttgacggggatgatattgctttatcttttcctaggaattgctgctggctataccagtgttcgcatgtggacgactattaaaggttcatctgaaggatggaaatcggtttcttggtcaacatcgtgcttttttcctggaatcgtttttgttatcttgacttttcttaatttcatcctttggggaaataacagtaccggtgctattcctatttccttatatttcatactcttttcactctggttttgtatttctgtgccactgactctcttgggcggacactttggtacacgtgccgagcttattaaataccctgtccgtactaatcaaatccccagagaaataccttcacgcaaatatccctcgtggcttcttgttcttggtgctggggttcttcctttcggaactctctttatcgaactctttttcatactctccagtatctggctcgggagattttattatgtgtttgggttcttgcttattgttcttttgttgttagtggtcgtctgtgctgaggtttctgtcgttctgacctatatgcatctatgtgttgaggattggatgtggtggtggaaagcattttatgcttctggttcagttgctctgtatgttttcctgtattcgattaattatctggtgtttgatctacagagcttgagtgggcctgtttcagcaacggtttatcttgggtactcgctgataatggcggtcgcgattatgctttctactggtactattgggtttcttacttccttctactttgttcattatcttttttcgtcggtcaagattgattgaagaatgtaatgggtttttagttagagattggtttgtgggcacggaaaagaacttgtcagcttttcgtctgactaaattgcggggccagtttaaaaatcttctgtttcttgatacttgaattactatagactaaattgttattttggttgtttcagtttgtgtttctggcatttttgtattcaactgtcttgtcgtgttgtagtcttacacaaagcccggtttggttccgtccgagtataaatgatgattctatggagtgaagaaaaccaacaatgtttgatattcataatgtgactgtcga

SEQ ID NO: 3447 - DNA, 2526 bp, Populus trichocarpa
gttttacttgtacgtttcctagctgttcctccctctcgtttgagcacaacacacatacgattcgtgctctacttttccttcttcttcatttaccccacgcgaacaaaatcacggaagaatcttccacttctgttatatcagtgagaaagagatagctgtgcgtaacacttttggatcgaaggaggcatctccggatccggatccgatcttccttcacccggactgtttgtcagttttctagattgattggagtggctttttaccttactggtaatcaaaatgagggcgcccatgatctgctgggctttccttctgctggctctgtttgggaacgcatgtaatggcttttatttgcctggtagctatatgcacacgtattcacctggggatgccatctttgccaaagttaactccttaacttctatcgaaactgagcttccctttagttactacagtctcccttactgccaacccaaggaaggagtcaaaaaaagtgcggagaatcttggggagcttcttatgggagatcagatcgataactctccttacaggtttagaatgaacgtgaatgagtctgtttacctttgtaccaccaagcctttgagcgagcatgaggttaagcttctgaagcagagaacacacgatctatatcaagtgaacatgattttggacaacttgcctgtgatgaggtatgccaagcaaaatgaaattgacattcagtggacggggttccctgttgggtatacgccacagaatagtaatgatgattatataatcaatcacctcaagttcactgtcttggttcatgaatatgaagggagtggtgttgagataattggtactggggaagaaggtctgggtgtgatctctgaagctgatgagaagaaggcatctggtttcgagattgttggttttgtggttgttccttgcagcgttaagtatgatcctgatgcgatgataaagcaccagatttatgacaatgtctcatctgtgagctgccccttggaccttgacaagtctcagatcataagggaacaagagaggatttccttcacctacgaggttgaatttgtgaagagtgaaattagatggccatcacgatgggatgcttacttgaagatggaaggtgcccgtgttcactggttctcaatcttgaactcactcatggtgattttctttctggctggtattgttttcatcatcttcttaaggactgtgagaagggatttgacaaggtatgaggaattggacaaagaagctcaagcacagatgaatgaggagctttctgggtggaagcttgttgtcggtgatgtgttcagagaaccagattgctcaaagcttctctgtattatggttggagatggtgttcaaattacagggatggcggtagttactattatttttgcagcctttggtttcatgtcaccagcttcacgagggatgctgctgacagggatgattctgctgtatcttttcctaggtattgtggcgggctatgttgcagtacgtttgtggagaaccatcaaaggaacttcagaaggatggaggtctgtttcttggtcggttgcgtgcttcttccctggaattgtctttgttatcctcacaatactgaacttcattctctggggaagccaaagcactggtgcaattccaatctccttatattttgtccttttggccctctggttttgcatttcagtgccactcactcttttgggagggttcatggggacacgagccgaggcaattcaatacccggtgagaacaaaccagataccaagagaaattcctgcacggaaattgccatcatgggtgcttgtccttggtgctggaacccttccctttgggaccctcttcattgaactgttcttcattctctctagcatctggcttggacggttttattatgtctttggtttcttgctgatagttctgctgctactagttattgtctgtgctgaagtatctgtggttcttacctacatgcatctttgcgtggaggattggcggtggtggtggaaggctttctttgcttccggttcagtatcaatctttgtctttctctattccatcaattacttggtttttgacctacagagtttgagtggacctgtgtcagccatactctatctgggctattcactgatcatagcagttgcaatcatgttatctactggcaccattggtttccttacgtcattctactttgtgcattaccttttctcatccgtaaagatagactaaaaagttgctattggtgtctgctccttgtgaagaggaaattttcttggttcacattttttgcatttgctaaatttgtgctgtattaaagactcaaatgatatcctgaattcatcaaggcctgttatattccgagattagaagacatgatagttgtttaatgttttggttgttgcagttgctctataacgtcgttgtattatttttatttttttacttagttgtaatgctctcgtttgataaaataaaagtgcaaatggcatcatgcaatgcaattccttaaaa

SEQ ID NO: 3448 - DNA, 2275 bp, Brassica oleracea
acacaaagcaaagcaaagcaaggctaggtagaagagatagaaagagaagaagtccctccctctctcgcccctggatctgacttcgttgaagatctcggaacctcgatctgcctcaggaaggaaaatgtaccgggttatcgttttgctagtgtttgttgcgcagctttgcaatgggttctacttgccagggagttatatgcacacatattcaaacggagactcaatcttcgccaaagtcaattccttgacgtctatagaaaccgagcttcctttcagtttctatagccttccttactgcaaaccactcgagggcatcaagaaaagtgctgagaatcttggggagcttctcatgggggatcagattgataactctgcctataggttccggatgaacaccaacgagtctctctatctctgcaccaccagtcctctgaacgagcatgaggtcaagctcctgaaacagagaacgcgcgagttgtaccaagtcaatatgattctcgataacttgcctgctttgagattcgccaagcaaaatggggttaccatccagtggactgggtaccctgttggatattcaccacccaacagcaatgatgattacatcatcaatcacctcaagtttaaggtcttggtccatcagtacgaaggcaatgtcatggaggtcattggcacgggtgaagaaggtatgggtgtcatctccgaagctgataaaaagaaggccctgggttatgagatagttggatttgaggttgttccatgcagtgtgaagtacgatcctgagaaaatgaccaaacttcacatgtatgaccctgctccttcagttaactgtccgttggagcttgacaaagcccagatcataaaagaacatgaaaggataaccttcacttatgaagtcgaatttgttagaagcgagacaagatggccatcaagatgggatgcctatttgaaaatggaaggtgctcgtgtccattggttctctatactgaactcgcttatggtgatcgtctttctcgccggtatagtctttgtcatattcctgaggacggttagaagggatctgaccaagtacgaggagctggacaaggaagcgcaggcacagatgaacgaagagctctcaggatggaaacttgttgtcggagatgtgttcagagaaccacaactttcaaagcttctatgcattatggtgggagacggtgttcggattacaggaatggctgttgtcactattgttttcgcagcactaggattcatgtcgcctgcatcaagaggaatgttactaaccgggatgattattctctatcttttcttgggtattgctgctggttacgctggtgtccggctctggagaaccgtcaaaggaacttcagaaggatggagatcactatcctggtccatcgcatgcttcttcccgggtattgcttttgttatactaacagtcttgaacttccttctctggagtagcaacagcactggcgccatcccaatatcactctactttgagctcttggctctctggttctgcatctcggttcccctcaccttgtttggaggattcttaggcacgcgagcagaagcaattcagtttccagtgagaaccaaccagattccaagggagatcccagaacgtaaatacccgtcatggcttctagtccttggagcaggaacacttcctttcggaactctgttcatagaactcttcttcatattctccagcatatggttaggcagattctactacgtattcgggttcttactcatagtgctgcttcttttagtagttgtgtgtgcagaggtatcagtggtgttgacctacatgcacctctgcgtggaagattggagatggtggtggaaagctttcttcgcatctggttcagtcgccttgtatgtctttgcttactccatcaactatttggtgttcgatctccaaagtctgagtggaccggtctcggctatgctttacattggctactctctgcttatggccattgcaataatgctctcaacgggaaccattggcttccttacttccttttacttcgtccactatctgttttcctctgtcaaaatcgattgaaacttgacgagaaaatctcagccgttgaatttttgctttttctgaagcaaattttcaggtgttgttattttttttttgtcagtaatagacttgtagagtccagtgttttttcctctttgaattttcagacttatattaccgttatatgttatttgtttttttctgaactttgagtagaaataaatgatgtcgtatttctgc

SEQ ID NO: 3449 - DNA, 2602 bp, Cocos nucifera
gctttacctaactccatggtggtccctcgaccccgatcgagaaggcccccggatagacggtcgagatggcgctaaacgttaaccaaatcgaaatcgctacgataataagagatgcggtattccgacgccattctgccgaccttctgcttctcttctctttcttcgtcccatccccctctcaaaacccagagaggtcccttatcttctcttcctccgttccgctcgtttgctcgccgaatccgagggcgcccagctcaaatcgcacgaaaaaggttattggaataagtttaaggcctgtggtcaccatggcaccgttgatgatctcaaaaaggcacttttctttacttcctttattttttcttctgattacatgtccttccaatggcttctatctccccgggagttatatgcacacctactctcaacgtgaacccatctcggtcaaagtaaattcgctcacgtcgatcgagacggagctgccatttagctactatagtcttccttattgccaacctaagggtgggatcaagaagagcgcagagaatctgggagagctgctcatgggggatcagatcgacaactctccgtacacattccatatgaatgtcaatgaatcgctttatctttgcacaacgaagccattaaatgagcatgaggtgaagctcctgaagcaaagaactcgagatctctatcaggtgaacatgattctcgacaaccttcccgtaatgaggttcactcaacagaatgatgtcaccatccagtggactggttttccggttggatacacccccactggaagcaatgatgactatatcatcaatcacctcaagtttaaggtcttggtccatgagtatgaagggagtggtgtagaaatcattggcacaggggaagaggggatggggatgccctcagagaccgataagaagaagatgtctgggtacgagatagttgggtttgaagtaatcccgtgcagtgttaagcgtgatgcagaaaggatgtcgaagcataacatgtatgaccaaatcgagcccgtgaattgccccttggagctcgacaagtgtcaggtgatcaaggagcaggagaggatcacattcacctatgacgtagagtttgtgaagagcgacattagatggccctcgcggtgggatgcctatttgaagatggatggtgccaaggtccactggttctctatcatgaactcccttatggtcatcttctttttggctggaatagtgtttgttattttcttgagaaccgtccgaagggacttgacaaggtatgaggagttggataaagaggcccaggctcagatgaatgaggagctctcaggctggaaacttgttgtgggcgatgtgtttagagagccgacatgctctaaactgctttgtgtcatggttggagatggtgttcagattacatgtatggcagttgtgacgattgtgtttgccgcccttgggttcatgtcccctgcatcacggggtatgctcttgactgggatgatcctcctttatctcttccttggtatttttgctgggtataccggagtccggttatggagtaccatcaaaggcgggtcggaagggtggaggtcagttgcttggtcgattgcctgcttcttccctgggatggtgtttgtaattctcaccttcttaaacttattgctttggtggaacaatagcacaggggctctcccaatctcattgtacttcactcttctgtctctgtggttttgcatctcggtgcccctcatccttttgggtggtttcttgggtacccgggctgagcccattcagttcccagttaggaccaaccaaattccgagggaaattccggcaaggaagtacccttcgtggttacttgtccttggtgctggaacccttccttttgggaccctcttcattgagttattctttatcctctccagcatctggcttgggaggttctattatgtgttcggatttctactcatcgtcctcctattgcttgttattgtctgtgctgaagtgtctgtggttctgacttacatgcatctctgtgtggaagattggaggtggtggtggaaagcattctttgcttctggttcggtcgctctttatgtgctcctatactccatcaactacttggtgtttgatcttaagagcttaagtgggcctgtgtcagctatgctttacctggggtattcgcttatcatggctgttgctatcatgctatctactggcaccatcggcttcctgatgtcgttctactttgttcactacctcttctcatctgtgaagattgactagaggattgcttctttaaggtgcaatagtctcttgcattcgtttgagatgtttcttgatggattttggatctatatcactcaggattccatatatgtttaagatttttatactgatgaccaggtgcaatgaaggctattctattgagtggaatctcaatgacctacagtatttagatgatcaactgtttttccttaaatttttaacatgatgtcctccgagactttcttttcaatgcttttaagcttcatggtaacttttcctctctgttatttcaattcttcactcatgttattgagactattaatgaggatcacctg

SEQ ID NO: 3450 - DNA, 2441 bp, Cyclamen graecum
acgactctgattgatataaaacaagcatactttaataatttggacggaggattgcgttagtgatctttctctagataatcaagctaatggctggttcaatggcctcgaagagaacatactgggtgacttttatctttgtgtttctggtttcacggatttgcaatgcattttatctaccaggaagctacatgcatacatattcaaacggagaagaaatagtagccaaagttaactccttgacctcaattgagacggagcttcctttcagctactatagtctcccttactgcaaacccctcaagggaataaagaaaagtgctgagaatctcggggagctgcttatgggggatcagattgacaactcgccctaccgttttcgtatgaacgtgaatgaatctgtattcctttgcacgactagtccattaagtgaaaacgaggtaaagctcttgaaacaaagaactcgtgatttgtaccaggttaacatgattttggataacttgccagctatgaggtatgctcaacagaatggtgttaaaattcagtggaccggctttcctgtagggtatactcctcaaaatagtaatgaggattacataatcaaccacctcaaattcagagttttggttcatgagtacgaggggactggtgttgagataatcggtactggggaagagggtatgggtatcatctcagaagccgataagaaaaaggcttctgggtatgagattgttggtttcgaggttgtgccttgcagtgtcaaatatgagcctgctgtgatggagaaacttcatatgtatgacagtatcaccccagtgaattgtccattggaacttgagaagtctcagataataaaagagcaagagagggtttctttcacttacgaggttgaatttgttaagagtgatattaggtggccatctagatgggatgcttacctaaagatggaaggtgctcgtgtccactggttctccattctaaactcgctgatggtcatcttcttcttagctggtatagtatttgtcatatttttgcgtactgtgagaagggatttgacaaggtacgaggaactagacaaggaagctcaagcccaaatgaacgaggagctctctgggtggaaacttgttgtaggtgatgtgtttagagaaccaaatcactcgaagttattgtgcgttatgatcggtgatggggtccagatcacaggaatggctgtagttactattgtctttgccgctctcggttttatgtcaccagcctctcgaggaatgttactgaccggtatgataattctctatcttttcctcggcattggtgctggttatgctggtgtacgtctttggactacaattaagggaaatccagatgggtggagatccgtttcgtgggcgattgcctgttttttccctggaattgtgtttgtcatccttactggactaaatttccttctttggggcagccaaagcaccggagcaattcccatttccttatatttcattttattagctctttggttttgcatttcggtcccactcacccttttgggaggatactttggcactagggcagagcctatttcttttcctgtacgaactaatcagattcctagagaaataccagctcgaaaatacccatcatggcttctcgttctcggggctggaaccctcccgtttggtaccctcttcatcgagctctttttcattctctctagtatctggctcgggagattctactacgtgttcgggttcctatttgtggtcttattgttgcttgtggtcgtgtgtgctgaggtgtctctggtgcttacatatatgcatctatgtgtggaggactggcagtggtggtggaaagcattctatgcatcaggctctgtcgctctttacgttttcctttactcgatcaattatctagttttcgacctccagagtttgagtggaccagtttcggctatgctttatctcgggtactctcttatcatggcagttgctatcatgttggcaactggtactatcgggttcataacctccttctactttgtccattaccttttctcatccgtgaagatcgactgaagaaaaaaggaaaacagtagttccatactctaaaatttaaatttctagttgagactcatttgcgcgtatccaagcccagactttcgttgattttgctttgctgcataatcgtatggcactgaaatgagaacttgttacatgttacctgcttctaaaggttacagattttagtattgttgtagttgtctttttgccatctttgttcaaatttttactgttgaagcgtcgaaaacctgtagttgtgtaacttttcccctagttcttaaaatcatcgagtttaggcataacctcgacggttctttgaacctttcgaactgcagctaattgatgtgatctgtgaaagagagatgggattgttatgaagtttgttccggt

SEQ ID NO: 3451 - DNA, 2600 bp, Mimulus guttatus
gtattatagcattgagtgagatctaaatctaaaccttcacactcacgcgatagagcatttgctgcaaccatacagcacagtttttttcacactctcacatccgaaattcacacacacacacacacacacgcactctcgacttcgcaagtaaaactccatttctctgcgcgaaagccctaaactcggccgatccgagtccagatccattgtcgaactgatctgaatatgccatcggcatcaatttaactttgattcagctggtttgaggacatttgatcagctttccttcgacagaacaatggctttgcctttgatttcgggaaggaatttatgcatttctttcagttacttggttctcattttccaagcttgtaatggtttttatctacctggaagctatatgcacacatattcaacaggggatgaaatatacgcgaaagtgaattctttgacctccattgagactgagcttcccttcagctattacagtcttccttattgccagcctccagggggcattaagaaaagtgctgaaaatcttggagaactgataatgggagatcaaattgacaattctccatatcgcttccgcatgaatgtcaacgagtctgtgtacatctgcaccagtcctccattgagtgagcatgatgttaaacttctaaaacagagaactcgggatctgtatcaggttaacatgattcttgataatttgcctgctatgaggtacacaaaccaaaacggggttaaaatccagtggaccggatacccagtgggatacagtcctctgaacagtaatgatgattactttatcaaccatctcaagttcagggtattaattcacgagtacgaaggagctggtgtggagataattggtactggagaagaaggtatgggtgttatttcagaagctgacaaaaagaaggcatcagggtacgagattgttggttttgaggttgtcccgtgcagtgtaaaatacgaccccgataagatggaaaaactccacatttacgacaatgtcacatcagtaaattgtcctctagacgctgagaggtctcagattataagggataaagaaagagtgtcattcacatacgaggtcgagtttgtgaaaagcaacataaggtggccgtctcggtgggatgcctatctgaaaatggaaggcgcacgtgtgcactggttctcgattctcaactccttgatggtgatcttattcttggcaggcattgtctttgtcatattcttgagaaccgtgagaagggatctgacgaggtacgaggaactggacaaagaagctcaagcccagatgaatgaggagctttcgggatggaagctagtggtgggtgatgtattcagagaaccctcacactcgaaattactctgtgttatggttggagatggagttcaaattaccggaatggcagttgtcactatcgtttttgcagctctaggtttcatgtcaccagcctcacgaggcatgcttttaacagggatgattctgctttatctcttccttggaattgccgctggatatgtcggtgctcgaatgtggacgaccattaaaggctcgcccgaaggatggagatcggttgcttggtcaaccgcgtgcttcttcccaggaattgttttcgttattctgacgatcttgaacttcatcctttggggaagtaacagtaccggagctattcctatttctttatatttcatactcttgtcgctctggttctgtatttcggtgccactaactctcgtcggtgggcatttaggcacaaaggccgagcctattcaattccctgttcgaactaatcaaatccccagagagatccctgcacgcaaatacccctcatggctgcttgtacttggtgctggaactcttccgtttggaactctctttatcgaacttttcttcatcctgtccagtatttggctcggaaggttctattacgtattcggtttcttgcttattgtactgtccttactggtcgttgtttgtgcggaagtttctgtcgtgctcacttacatgcatctctgtgtcgaggattggatgtggtggtggaaggcattctacgcctctggttcggttgcactgtacgttttcttatactcgatcaattatctggtttttgacctacagagtttgagcggtccagtttccgctacactttaccttggctattcgttgataatggcggtcgcaatcatgctttctaccggcactattggcttcctcacttcgttctactttgttcattaccttttctcgtcggtgaagatcgattaaaaacaaaaatctttcagctttacatcaagcatattttaggggtccttaaacttttgctgtatcttgatattactatagaacttcattgtgtttttcttttttagctggcttccatttctatgttctgttattttttatattttttttctttttcattttccaatatttcatattgtagtgtcttgtatacattatgccaattgtgtgcttgattcttgctatactgtaattttatgttggagagctgaggtagacttgagttggtaattgtatagatagaaaattacaaccacctccatgaagtaaagtctaattacaaaaa

SEQ ID NO: 3452 - DNA, 2541 bp, Tropaeolum majus
aaaaaaaaaattccacttcttctatacgcgtatataggaatcatctgcggatccgatctgacacattacgttcattgcaaaatctgcatcggagactctagatctgtttcagattttatgttgatagcttctgttatggtagcctagatcgagatctgctgtagaagattggttactcgttgatatcaaagatgaaaatgggtcctatcttcaggagtttcctctttgtagttttctttgctcatgttagcaatggattttatttgcctgggagctatatgcacacttattcaccgagtgaagagatatacgccaaagttaattctttgacatctattgaaactgagcttcctttcagctactacagtcttccttactgcaaacccagtggtggaataaagaaaagtgctgagaatctaggggagctccttatgggagatcaaatcgataactctccttataggtttaggatgaatgtcaatgagtctatctacctctgcacaacggatccattgaccgagaatgaagttaagcttttaaaacaaaggacccgtgatttgtatcaggtgaatatgattctggacaacttgcctgctatgagatatgcaaaacaaaacgggatgaacattcagtggactgggtaccctgttgggtatacacctcccggcagcaaagatgactacattattaatcatctcaagttcaaggtcttggtccatgaatatgaaggaagtggtgtggagatcattggtaccggggaagaaggtatgggtgtaatttctgaagctgataagaagaaggcctccgggttcgaaatagttggttttgaagttattccctgcagtgttaagtatgatgcaggaaagatgaaaaaactcaacatgtatgacactgttacccctgtcaattgccctttggagcttgaaaagtctcaaataataaaggaaaaggagagagtgtccttcacttatgaggttgaattcgctaaaagtgacaccagatggccatctcgatgggatgcttatttaaagatggaaggtgcacgtgttcattggttctctatcttgaactccctcatggtgatctttttcctagctgggattgtttttgtcatattcctgaggactgtcagaagggatttgacaaggtatgaggaattggacaaagaagctcaagcacagatgaacgaggaactttcaggttggaaacttgtagtaggtgacatcttccgagaaccagattttccgaagcttctttgtgtaatggtgggagatggggttcagattacagggatggctgttgtcaccatagtctttgcagcacttggtttcatgtccccagcttcaagaggaatgctcttaaccgggatgattattctttaccttttcctgggtattatttccggctatgttggtgtgcggatgtggagaaccattaagggaacgacagaagggtggagatcactttcctggtccgttgcatgcttctttcctggaattgtttttgttatcctcacggcactgaattttcttctctgggccaacaagagtactggcgcaattccaatttcattgtatttcatactcctgtccctttggttctgcatttccgtgcccctaaccctctttggaggattcttagggacacgagctgaggaaattacgtttccggtaagaaccaaccagatccctagggaaattcctgcacgcaaatatccatcatggcttcttgttcttggggcagggacactgccattcgggacactattcattgaacttttcttcatcctttcaagcatctggctcggaaggttctattacgtgttcgggttcttattgatagttcttatactgctggttattgtctgcgctgaagtctcagtcgtcctcacctacatgcacctttgcgtggaggattggcgttggtggtggaaggcctttttcgcttcgggttcagttgcactctacgtgttcctctactcgatcaattacttggtcttcgacctacagagtttgagtggacccgtctcagctatggtttaccttgggtactcactcatcatggcgattgcgataatgctgtctaccggcaccattggcttccttatgtccttctacttcgtacattatcttttctcgtctgtgaagattgattaaaaagctttcttctgttgtctttttacaagccaggaactggagaagtatttcataataggcgaagggacgtttttcgaggcctacacattttggctacaaagttcattcggtatgtaatcatgttgcgatgtactaatttgtgtctcttcgaatattttgttgattccgtcaagacttttatatttttctatgtttttttttgtcttcataagattagagtacttgttataggagtttgaattttaccatcttatccccacatctccaatcttttacaagatgcatgtgtttctttttgtgggcattaacgagttatgaacttcatttcagtgtttagatatattttgtttgttctaaaaaagttgtaataaattcggtcaagact

SEQ ID NO: 3453 - DNA, 2508 bp, Prunus persica
gatttattgttgaatgcatctgtaagactagcgtagatctactgcttactccaacctctggtgagtgctatttttctcgatttcgatggcgatatcgaatccgagagtgacctatatcaaatggactatgcttgttttggctctatttgcgcacagctgtaatgggttttatctgccgggaagctacatgcatacatattccaaagcgcaagaaatcgttaccaaagttaactccttaacttctatagagactgagctgcccttcagctactacagtctcccttattgcaaaccccctgaaggtatcaagaaaagcgctgagaatctcggggaactcctcatgggagatgagatcgagaactccgcttaccgatttaaaatgaatgtcaataaaactctttacctatgtaccacacaccctttgactgagcacgacgtaaagctgctgaaacaaagaacccgtgatctgtatcaggtcaacatgatccttgataatttgccggcgatgagatatgcttaccaaaatggggttaagattcagtggactgggtttcctgttgggtacactccacccaacagtaaagatgattacataatcaatcacctgaagttcagggttttgattcacgagtatgaagggagtggtgtgcagataattgggactggggaagaaggtccgggtgtcatttccgaagctgataagaaaaaggcatctgggtttgagattgttggctttgaggtttacccgtgtagcattaaatacgaccctgacaccatgaagaaaaaatccatgtaccaaagtatcccagatgtaaattgcccctcagagcttgaaaagtctcaaataataagggagcaagagagagtatcattcacttatcaggttgagtttgtgaaaagtgatataagatggccatcaaggtgggatgcttatctgaagatggagggggctcgtgtgcactggttctctatcttgaattcattaatggtgatctttttcctcgctggtattgtctttgtcatattcctaaggactgtgaggagggatttaacaagatatgaagaactggacaaagaatctcaagctcagatgaatgaggagctctctgggtggaagcttgttgtgggagatgtgttcagagaaccagattcttcaaagcttctttgtgttatggttggagatggggttcagattacagggatggcagttgtcactatcatttttgcagcatttggtttcatgtcgccagcttcacgaggaatgctattgacaggaatgatcattctatatcttttccttgggattattgccggttatgttgctgtccgtatgtggagaaccataaagggaacttccgaagggtggagatcagtttcctggtttgtggcatgcttctttcctggaatcgtctttcttatccttacggtactgaacttcattctatggggcagcaatagtactggtgctcttcccatttccttgttttttgtactcttgtccctctggttctgcatttcagtgcctctcactcttctcggaggtttcttaggcacacgagctgaggcaattcaatatcctgtgagaaccaaccagattccaagggaaattcctgcgcgcaaatatccatcatggcttcttgttcttggctctgggacacttccatttggaaccctcttcatcgaacttttcttcatcctttctagcatctggcttgggaggttctattatgtctttggtttcctgcttatagtgcttctgttgttggttattgtttgtgctgaagtttcagtggttctcacctacatgcatctttgtgtggaggattggaggtggtggtggaaggctttctttgcttcaggttctgtttccctttatgtgttcctgtactccatcaattacttggtatttgacctgcagagtttgagtgggcctgtgtcggctatcctttaccttggttattcattgatcatggcaactgcaatcatgttgtcaactggcacaattggctttctcatgtctttctactttgttcattacctcttctcatccgtaaagatcgattaaaagtgttggctggaattcttcatcaaacagttgggaaatgagtctgctatgtaggaagaagtatttttggttattcattatagtctttacttggttgcattgaaagctgattgtattgcagcatctcaagaggctctctgattatatgggaagaagacctatttctgtttgctgccttgcttgtgatatgatcagcggcagattctcctttcacccccacacatatccgatttggtttcttactgcttcactagtgttgcgctttactttagtttaatcacattctactagaaagttgtaattcgtggaccttcagtccttgtattgtcttttatttcgtatctgaatagaaaggtgaattggataattctttcgaatcccaacaaccggttgattttgtgctggtaaaattttaaatttgatacacctctttaatgtttcct

SEQ ID NO: 3454 - DNA, 2227 bp, Valeriana officinalis
atgtcgagttaagctcacgccatccccgctccaatctcgatcgacagacaaaaccataacatcatttctctgatcgacaaaaccataacattatttcacttccatgtccatcatcaaaccctaaaatctctcctagatccaacacaaccctactcaactcccagatctacatcagaatccgtgttgcgtccatgagcaaggcaaacttaaattgatcaaagtcttgaagatctgatccgtgcttttgttcttaagatcaatggcactgtctatgatcttgagagctttaattctctatttctgtatttctcaaacttgtaatggattctatctacctggaagctacatgcacacatactcagagggtgaagaaatatttgcaaaagtcaactcattgacttcaatcgaaactgagcttcctttcggctactacactctcccatactgtaaacccataggaggaataaaaaaaagtgccgaaaatcttggtgaacttctaatgggagatcaaattgacaattctccttatcgttttcgcatgaacaagaacgaatctatctatctgtgtactacaagtcctttaaatgagcacgaagtcaaacttctgaaacagagaactcgcgatttgtatcaagttaatatgattcttgataatttacccgccatgagattcgcaaaccaaaatggaatcaagattcagtggacaggttttccagttggatatactcctccaaatagtaatgatgattacattatcaatcatcttaaattcaaggttcttgttcatgagtacgaagggacgggtgttgaaataataggaaccggcgaagagggtatgggcataatttcacaatcagataaaaaggcttctggttatgaaatcgtggggtttgaagtttatccgtgcagtgttaagtacgaccctgtgaaaatggagaagctccatatttacgataacgccactagtgtaaattgccctcttgatcttgaaaaatcacagataattagagagcaagagagaatatcctttacgtacgaagttgaatttgtgaagagtgatactcgatggccatctcgttgggatgcttatctgaaaatggaaggtgctagggttcactggttttcaatcttgaactcattaatggtgatcttctttctagctggaattgttttcgtaattttcttgagaacagttagaagagatttaactaggtacgaggaattagataaagaatcacaagcacaaatgaatgaagaactttcaggttggaaactcgtagttggtgacgttttcagagaaccaaattgcgcaaaacttctctgcgtcatggttggtgacggtgtccaaatcacaggcatgacagctgtcacgattgtgtttgccgcattcgggtttatgtcaccggcatcaagaggaatgttgttaacaggtatgattattctatatctatttttgggaacatttgccggttattcgtcagttcgattatggcaaaccttgaagggtggaaattcggacgaatggcgatcggtatcttggctgacagcctgtttttttcctggaatcgtattcgtcatactaactttcttgaattttattctgtggggtagtaaaagcactggtgccatcccaatttcgctttattttattctattatccctctggttctgcatttcggttccactgaccctattaggaggttacatggggaaacgtgccgaaatcataacttttccagtaagaacaaaccaaatcccaagagaaattccggcgagaaaatacccttcttggattctggttcttggagcaggaactttaccgtttggaaccctattcatcgaacttttcttcatactttccagcatttggctcggaagattctactatgtttttgggttcttacttgtcgttcttcttttgcttgtcactgtttgtgctgaagtctctgtggttctcacgtacatgcatttgtgtgtggaggattggaggtggtggtggaaggcattttatgcgtcgggttcagtgtcactgtatgttttcttatattctataaattacttggtttttgatcttcaaagtcttagtgggcctgtgtcggcgattctctatcttggatattcgctgattattgctgttgctattatgctgtctaccggtactattggctttctcacttctttctattttgttcattatctattttcgtcggtgaagatagactaggcg

SEQ ID NO: 3455 - DNA, 3137 bp, Cocos nucifera
ctaaatttattttagttgacgtagatctactcaaccccaaccttctcctttgattaaggttcaccctaagtcaaccctcgaattcaatccaaaggagaaaccgcaccagatagacggtcgagatagcgccaaacttaaaccacatcaaaatgttttatggggagaagtgatgcgttaattccacgctataccgacgacattcttccctcttctgcatcccatctcctccgagagatcccatcccttctcttcctctactttgcaccttttcttcgcgaatcggaggagatcaagatccagtcctgcgaaataggtaactatgacctagtttgcttggtggatttagatctaagtccttgaatttttctgtttcaaaagaagatatagaagatagctttaaggcctggtctctatggcgccgatattgatctcgaagaggcccttttctttgatctttccccttttttgcttctgattacatgcccttccaatgggttctatctccccgggagttatatgcacacctactctgaaggtgaacctatctcagtcaaagtgaattcactcacctctatcgagacggagctgccatttagctactatggtcttccctattgccaaccaaaggatggaatcaagaagagtgcagagaatctgggagagcttctcatgggggatcagatcgacaattctccgtacaggttccgtgtgaatgtcaatgaatcactttatctttgcacgacaaagccattaactgagcttgaggtgaagctgttgaagcaaagatctcgcgatctctatcaagtgaacatgattcttgacaatctgcctgtaatgaggtacactcagcaaaatggtgtcaccattcagtggactggttttccggttggatacacccccattggaagcaatgatgactatataatcaatcacctcaagtttaaggtcttggtccatgagtacgaagggagtggtgtagaaatcattggcacaggggaagaggggatgggggtgatctcagagactgataagaagaagatgtctggttatgagatagttgggttcgaagtaactccttgcagcgctaagcgtgacccagaaagcatgttgaagcataacatgtatgacacaattgaacctgtgaattgccccctggagcttgacaagtgtcagatgatcaaggagcaggagaggatcacattcacctatgaagtagagtttgtgaagagcgacattagatggccctcacggtgggatgcctatttgaagatggatggtgccaaggtccattggttctcaatcatgaattcccttatggtaatcttctttttggctggaatagtgtttgttattttcttgagaacggttcgaagggacttgacgaggtatgaggaattggataaagaggcccaggctcagatgaatgaggagctctcaggctggaaacttgttgtgggtgatgtgtttagggagccaacctgctctaaactgctttgtgtcatggttggagatggtgttcagattacatgtatggcagtcgtgacaattgtttttgctgcgctggggttcatgtctcccgcatcacggggcatgctcttgacagggatgatactcctttatctcttccttggtatttttgctgggtatgttggtgtccggctatggagtaccatcaaaggtgggtctgaaggatggagatcggttgcttggttgattgcctgcttctttcctgggatcgtgtttatggttctcaccttcttaaacttcttgctctggtggaacaagagcacaggagctcttccaatctcattgtacttcactcttctatctctgtggttttgcatctcagtgccactcactcttttagggggtttctttggtacccgggctgaacctatacaattcccagtcaggaccaaccaaattccaagggaaattccagcaaggaaatacccttcatggttgcttgtccttggtgctggaacccttccttttgggaccctcttcattgagttattctttatcctctccagcatctggcttgggaggttctattatgtgttcggatttctactcatcgtcctcctattgcttgttattgtctgtgctgaagtgtctgtggttctgacttacatgcatctctgtgtggaagattggaggtggtggtggaaagcattctttgcttctggttcggttgctctttatgtgttcctatactccatcaactacttggtgtttgatcttaagagcttaagtgggcctgtgtcagctatgctttacctggggtattcgcttatcatggctgttgctatcatgctatctactggcaccatcggcttcctgatgtcgttctactttgttcactacctcttctcatctgtgaagattgactagaggattgcttctttaaggtgcaatagtctcttgcattcgtttgagatgtttcttgatggattttggatctatatcactcaggattccatatatgtttaagatttttatactgatgaccaggtgcaatgaaggctattctattgagtggaatctcaatgacctacagtatttagatgatcaactgtttttccttaaatttttaacatgatgtcctccgagactttcttttcaatgcttttaagcttcatggtaacttttcctctctgttatttcaattcttcactcatgttattgagactattaatgaggatcacctgttcttgcaaatattagcagttttcttctatgatgtcaattaattctggaaaagagttctttgtgcttcttataggattttagggccgccggagtggcatctggaaccctttcgattggattttcattgtgtatttattttatcatattatttaatacctcatcatggtatttaattcattgacgagtgtagaagaaaataaggatatttaattcaatgatgggtgtagaagaaaagagaaggcattttatggttgccacctatgtgatactataaatattatttaatatctcatctttggtatttagtttaaaagggagggttttgttcttgaaacgagggtccatcaattaattatgggatacacggggccatttagatgtggtccaacgttccgtttgtaagaggcgtatgggattctatcacc

SEQ ID NO: 3456 - DNA, 2308 bp, Brassica rapa
aggaggaaaatgtacggggttttcgttttgctagtgtttgttgcacaggtttgcgatgggttctacttgccagggagttatatgcacacatattcaaacggagactcaatcttggcgaaagtcaattccttgacgtctatagaaactgagcttcctttcagtttctatagccttccgtactgcaaaccactcgagggcatcaagaaaagtgctgagaatcttggggagcttctcatgggggatcagattgataactctgcctacaggttccggatgaacacgaacgagtctctctatctctgcaccaccagtcctctgaacgagcatgaggtcaagctcctgaagcagagaacacgcgagttgtaccaagtgaatatgattctcgataacttgcctgctttgagattcgccaagcaaaatggggttaccatccagtggactgggtaccctgttggatattcaccacccaacagcaatgatgattacatcatcaatcacctcaagtttaaggtcttggtacatcagtacgaagggaatgtcatggaggtcattggcacgggtgaagaaggtatgggtgtcatctctgaagctgataaaaagaaggccctgggctatgagatagttggatttgaggttgttccatgcagtgtgaagtacgatcctgagaaaatgaccaaacttcacatgtatgaccccgttccttcagttaactgtccgttggagcttgacaaagcccagatcataaaagaacatgaaaggataaccttcacttatgaagtcgaatttgttagaagcgagacaagatggccctcgagatgggatgcctatttgaaaatggaaggtgctcgtgtccattggttctctatactgaactcgcttatggtgatcgtctttctcgccggtatagtctttgtcatattcctgaggacggttagaagggatctgaccaagtacgaggagctggacaaggaagcgcaggcacagatgaacgaagagctctcaggatggaaacttgttgtcggagatgtgttcagagaaccacaactttcaaagcttctatgcattatggtgggagacggtgttcggattacaggaatggctgttgtcactattgttttcgcagcactaggattcatgtcgcctgcatcaagaggaatgttactaaccgggatgattattctctatcttttcttgggtattgctgctggttacgctggtgtccggctctggagaaccgtcaaaggaacttcagaaggatggagatcactatcctggtccatcgcatgcttcttcccgggtattgcttttgttatactaacagtcttgaacttccttctctggagtagcaacagcactggcgccatcccaatatcactctactttgagctcttggctctctggttctgcatctcggttcccctcaccttgtttggaggattcttaggcacgcgagcagaagcaattcagtttccagtgagaaccaaccagattccaagggagatcccagaacgtaaatacccgtcatggcttctcgtccttggagcaggaacacttcctttcggaactctattcatagaactcttcttcatcttctctagcatatggttaggcagattctactacgtattcgggttcttactcatagtgctgcttcttttagtagttgtgtgtgcagaggtatcagtggtgttgacctatatgcacctctgcgtggaagattggagatggtggtggaaagccttcttcgcatctggttcagtcgccttgtatgtctttgcttactccatcaactatttggtgttcgatctccaaagtctgagcggaccggtctcggctatgctttacatcggctactctctgcttatggccattgcaataatgctctcgacgggaaccattggcttccttacttccttttacttcgtccactatctgttttcctctgtcaaaatcgattgaaacttgacgagaaaatctcacccgttgaatttttgcttttgctgaagcaatttttcaggtgttgttattttttctgtcagtaatagacttgtagagtccagtgtttttcaggtgttgttatttttttcctttctgaattttcggacttatattaccgttatatgttattttcgttttttctgaacttttgagtagaaataaatgatgtcgtatttctgcatttttgctcttatattttttaatctcacttgttttcaatttcaacttttgtgtgtttttttttatttaccttgtaattcagtgatttgtcgagcttctgggaatgagttggacaatcaatgtgtggctt

SEQ ID NO: 3457 - DNA, 2496 bp, Brassica rapa
atggtagcaccgacacatgtgtatgcgctgcagaggataagtacccacgcagacacacacgattttcttgatctttgttactcgccctttgcgaacatacaaagcaaggctaggtagagatagagagagagagagaagtccctctcttgcccctggatctgacttcgtcgaagatctcgatctgcctcaggaggaaaatgtacggggttttcgttttgctagtgtttgttgcacaggtttgcgatgggttctacttgccagggagttatatgcacacatattcaaacggagactcaatcttggcgaaagtcaattccttgacgtctatagaaactgagcttcctttcagtttctatagccttccgtactgcaaaccactcgagggcatcaagaaaagtgctgagaatcttggggagcttctcatgggggatcagattgataactctgcctacaggttccggatgaacacgaacgagtctctctatctctgcaccaccagtcctctgaacgagcatgaggtcaagctcctgaagcagagaacacgcgagttgtaccaagtgaatatgattctcgataacttgcctgctttgagattcgccaagcaaaatggggttaccatccagtggactgggtaccctgttggatattcaccacccaacagcaatgatgattacatcatcaatcacctcaagtttaaggtcttggtacatcagtacgaagggaatgtcatggaggtcattggcacgggtgaagaaggtatgggtgtcatctctgaagctgataaaaagaaggccctgggctatgagatagttggatttgaggttgttccatgcagtgtgaagtacgatcctgagaaaatgaccaaacttcacatgtatgaccccgttccttcagttaactgtccgttggagcttgacaaagcccagatcataaaagaacatgaaaggataaccttcacttatgaagtcgaatttgttagaagcgagacaagatggccctcgagatgggatgcctatttgaaaatggaaggtgctcgtgtccattggttctctatactgaactcgcttatggtgatcgtctttctcgccggtatagtctttgtcatattcctgaggacggttagaagggatctgaccaagtacgaggagctggacaaggaagcgcaggcacagatgaacgaagagctctcaggatggaaacttgttgtcggagatgtgttcagagaaccacaactttcaaagcttctatgcattatggtgggagacggtgttcggattacaggaatggctgttgtcactattgttttcgcagcactaggattcatgtcgcctgcatcaagaggaatgttactaaccgggatgattattctctatcttttcttgggtattgctgctggttacgctggtgtccggctctggagaaccgtcaaaggaacttcagaaggatggagatcactatcctggtccatcgcatgcttcttcccgggtattgcttttgttatactaacagtcttgaacttccttctctggagtagcaacagcactggcgccatcccaatatcactctactttgagctcttggctctctggttctgcatctcggttcccctcaccttgtttggaggattcttaggcacgcgagcagaagcaattcagtttccagtgagaaccaaccagattccaagggagatcccagaacgtaaatacccgtcatggcttctcgtccttggagcaggaacacttcctttcggaactctattcatagaactcttcttcatcttctctagcatatggttaggcagattctactacgtattcgggttcttactcatagtgctgcttcttttagtagttgtgtgtgcagaggtatcagtggtgttgacctatatgcacctctgcgtggaagattggagatggtggtggaaagccttcttcgcatctggttcagtcgccttgtatgtctttgcttactccatcaactatttggtgttcgatctccaaagtctgagcggaccggtctcggctatgctttacatcggctactctctgcttatggccattgcaataatgctctcgacgggaaccattggcttccttacttccttttacttcgtccactatctgttttcctctgtcaaaatcgattgaaacttgacgagaaaatctcacccgttgaatttttgcttttgctgaagcaatttttcaggtgttgttattttttctgtcagtaatagacttgtagagtccagtgtttttcaggtgttgttatttttttcctttctgaattttcggacttatattaccgttatatgttattttcgttttttctgaacttttgagtagaaataaatgatgtcgtatttctgcatttttgctcttatattttttaatctcacttgttttcaatttcaacttttgtgtgtttttttttatttaccttgtaattcagtgatttgtcgagcttctgggaatgagttggacaatcaatgtgtggctt

SEQ ID NO: 3458 - DNA, 2465 bp, Brassica napus
ccgttacgggtttaaggtcgcggccacgtttggggtccgaccgtaaaccccgggaccgttcccggtttccgtatcccgtccactccggccaacggtttcttggcgtttaccctaaaaaaactaaggcccgacccttggtaggacgtctcgattccgtcgggagtggcgtcaacaaagacagcaccccgtcctacctctttaaagtttagtagaataggtagagatagagagagagagagaagtccctctcttgcccctggatctgacttcgtcgaagatctcgatctgcctcaggaggaaaatgtacggggttttcgttttgctagtgtttgttgcacaggtttgcgatgggttctacttgccagggagttatatgcacacatattcaaacggagactcaatcttggcgaaagtcaattccttgacgtctatagaaactgagcttcctttcagtttctatagccttccgtactgcaaaccactcgagggcatcaagaaaagtgctgagaatcttggggagcttctcatgggggatcagattgataactctgcctacaggttccggatgaacacgaacgagtctctctatctctgcaccaccagtcctctgaacgagcatgaggtcaagctcctgaagcagagaacacgcgagttgtaccaagtgaatatgattctcgataacttgcctgctttgagattcgccaagcaaaatggggttaccatccagtggactgggtaccctgttggatattcaccacccaacagcaatgatgattacatcatcaatcacctcaagtttaaggtcttggtacatcagtacgaagggaatgtcatggaggtcattggcacgggtgaagaaggtatgggtgtcatctctgaagctgataaaaagaaggccctgggctatgagatagttggatttgaggttgttccatgcagtgtgaagtacgatcctgagaaaatgaccaaacttcacatgtatgaccccgttccttcagttaactgtccgttggagcttgacaaagcccagatcataaaagaacatgaaaggataaccttcacttatgaagtcgaatttgttagaagcgagacaagatggccctcgagatgggatgcctatttgaaaatggaaggtgctcgtgtccattggttctctatactgaactcgcttatggtgatcgtctttctcgccggtatagtctttgtcatattcctgaggacggttagaagggatctgaccaagtacgaggagctggacaaggaagcgcaggcacagatgaacgaagagctctcaggatggaaacttgttgtcggagatgtgttcagagaaccacaactttcaaagcttctatgcattatggtgggagacggtgttcggattacaggaatggctgttgtcactattgttttcgcagcactaggattcatgtcgcctgcatcaagaggaatgttactaaccgggatgattattctctatcttttcttgggtattgctgctggttacgctggtgtccggctctggagaaccgtcaaaggaacttcagaaggatggagatcactatcctggtccatcgcatgcttcttcccgggtattgcttttgttatactaacagtcttgaacttccttctctggagtagcaacagcactggcgccatcccaatatcactctactttgagctcttggctctctggttctgcatctcggttcccctcaccttgtttggaggattcttaggcacgcgagcagaagcaattcagtttccagtgagaaccaaccagattccaagggagatcccagaacgtaaatacccgtcatggcttctcgtccttggagcaggaacacttcctttcggaactctattcatagaactcttcttcatcttctctagcatatggttaggcagattctactacgtattcgggttcttactcatagtgctgcttcttttagtagttgtgtgtgcagaggtatcagtggtgttgacctatatgcacctctgcgtggaagattggagatggtggtggaaagccttcttcgcatctggttcagtcgccttgtatgtctttgcttactccatcaactatttggtgttcgatctccaaagtctgagcggaccggtctcggctatgctttacatcggctactctctgcttatggccattgcaataatgctctcgacgggaaccattggcttccttacttccttttacttcgtccactatctgttttcctctgtcaaaatcgattgaaacttgacgagaaaatctcacccgttgaatttttgcttttgctgaagcaatttttcaggtgttgttattttttctgtcagtaatagacttgtagagtccagtgtttttcaggtgttgttatttttttcctttctgaattttcggacttatattaccgttatatgttattttcgttttttctgaacttttgagtagaaataaatgatgtcgtatt

SEQ ID NO: 3459 - DNA, 2884 bp, Prunus mume
aaaaaaatccaatgtaactttagtgggctggggcccaacctacttcacaataccaatatgagcgcgtagagaataagttattctcatctcctttcgcaccatttttccgaagcaaagttggttccttcatgccttctataacccctttgctctaatgggagcagcataaaattttaaaagaaggggacgccgagattttgagcttcgctctcacgcacacagccttcagcatcccttcaaagttttgctccagatctattacgatttattgttgaatgcatttgtaagactagcgtagatccactgcttactccaacctctggtgagtgctatttttctcgatttcgatggcgatatcgaatccgagagtgacctatatcaaatggactttgcttgttttggctctatttgcgcacacctgtaatgggttttatctcccgggaagctacatgcatacatattccaaagcgcaagaaatcattaccaaagttaactccttaacttctatagagactgagctgcccttcagctactacagtctcccttattgcaaaccccctaaaggtatcaagaaaagcgctgagaatctcggggaactcctcatgggagatgagatcgagaactccgcttaccgatttaaaatgaatgtcaatgaaactgtttacctatgtaccacacacccattgactgagcacgacgtaaagctgctgaaacaaagaacccgtgatctgtatcaggtcaacatgatccttgataatttgccggcgatgagatatgcttaccaaaatggggttaagattcagtggactgggtttcctgttgggtacactccacccaacagtaaagatgattacataatcaatcacctgaagttcagggttttgattcacgagtatgaagggagtggtgtgcagataattgggactggggaagaaggtccgggtgtcatttccgaagctgaaaagaaaaaggcatctgggtttgagattgttggctttgaggtttacccttgtagcattaaatacgaccctgacaccatgaagaaaaaatccatctaccaaagtatcccagctgtaaattgcccctcagagcttgaaaagtatcaaataataagggagcaagagagagtatcattcacttatgaggttgagtttgtgaaaagtgatataagatggccatcaaggtgggatgcttatctgaagatggagggggctcgtgtgcactggttctctatcttgaattcattaatggtgatctttttccttgctggtattgtctttgtcatattcctaaggactgtgaggagggatttaacaagatatgaagaactggacaaagaatctcaagctcagatgaatgaggagctctctgggtggaagcttgttgtgggagatgtgttcagagaaccagattcttcaaagcttctttgtgttatggttggagacggggttcagattacagggatggcagttgtcactatcatttttgcagcatttggtttcatgtcgccagcttcacgaggaatgctattgacaggaatgatcattctatatcttttccttgggattattgccggttatgttgctgtccgtatgtggagaaccataaagggaacttccgaagggtggagatcagtttcctggtttgtggcatgcttctttcctggaatcgtctttcttattcttacggtactgaacttcattctatggggcagcaatagtactggtgctcttcccatttccttgttttttgtactcttgtccctctggttctgcatttcagtgcctctcactcttctcggaggtttcttaggtacacgagctgaggcaattcaatatcctgtgagaaccaaccagattccaagggaaattcctgcgcgcaaatatccatcatggcttcttgttcttggcgctgggacacttccatttggaaccctcttcattgaacttttcttcatcctttctagcatctggcttgggaggttctattatgtctttggtttcctgcttatagtgcttctgttgttggttattgtttgtgctgaagtttcagtggttctcacctacatgcatctttgtgtggaggattggaggtggtggtggaaggctttctttgcttcaggttctgtttccctttatgtgttcctgtactccatcaattacttggtatttgacctgcagagtttgagtgggcctgtgtcggctatcctttaccttggttattcattgatcatggcaactgcaatcatgttgtcaactggcacaattggctttctcatgtctttctactttgttcattacctcttctcatccgtaaagatcgattaagagtgttggctggaattcttcatcaaacagttgggaaatgagtctgctatgtaggaagaagtatttttggttattcattttagtctttacttggttgcattgaaagctgattgtattgcagcatctcaagaggctttctgattatatggcaagaagacctatttctgtttgctgcctcgcttgtgaaatgatcagcggtagattctcctttcaccccacacatatccgatttggtttcttactgctcactagtgttgcgctttactttagtttaatcacattctactagaaagttgtaattcgtggaccttcagtccttgtattatcttttatttcatatctgaatagaaaggtgaattggataattctttcgaatcccaacaaccggttgattttgtgctggtaaatttttaaatttgatacacctctttaatgtttccttatgggatttaattcagttgaactgttgttttgttttagtcggaggctgaattacaggctcctacagtcccactgttcgttggttagtgaagcttgccaacttcaggggagatttt

SEQ ID NO: 3460 - DNA, 2438 bp, Eutrema halophilum
aagcaaggcagggagagagattaagctgcgtgacctacaccgagagcgagagagagagaaagagagagattgagagaagaagaactccctctcgtgcccctggatctgactccgttgaagaactcggaatctggatctgcttcaggaagaaaaatgtttgctttgtaccgagttttcgtcttgctggtttttgtttgtcagctgtgcaatgggttctacttgccagggagttatatgcacacatattcaaacggagactcaatcttagccaaagtcaattcattgacatctatcgaaactgagcttcctttcagtttctatagtcttccttactgcaaaccgcttgagggcattaagaaaagtgctgagaatcttggggagcttctcatgggggatcagattgataactctgcttataggtttcggatgaacacgaacgagtctctctatctctgtaccacgagtcctctgaatgagcatgaggtcaagctcttaaaacagagaacgcgcgagttgtaccaagtgaatatgattctagataacttgccagcattgagatttgccaaacaaaatggggttaccatccagtggactggataccctgttggatattcaccacccaacagcaatgatgattacatcattaatcatctgaagtttaaggtgttggtccatgaatacgaaggcaatgtcatggaggtaattggtacgggtgaagaaggtatgggtgtgatctctgaagctgataaaaagaaggccctgggctacgaggtagttggatttgaggttgttccctgtagtgtgaagtatgatcctgcaaaaatgacgaagcttcacatgtatgaccctgttacttctgttaactgtccgctggagcttgaaaaagctcagatcataaaagaacatgaaagaataaccttcacgtatgaagtcgaatttgttaggagtgagacaagatggccatcgagatgggatgcctatttgaaaatggaaggtgctcgcgtccattggttctctattctgaactcgcttatggtaatcttcttcctcgccggtatagtctttgttatattcctgaggacagtgagaagggatttgacaaagtacgaagaactagacaaggaagcgcaggcacagatgaatgaggaactctctggatggaaacttgttgtcggagatgtgttccgagaaccagagctatccaagctactatgtattatggtgggagacggtgttaggattacaggaatggctgttgtcacaattgtttttgcagcacttggtttcatgtcacctgcttctagaggaatgttactaaccggcatgataattctctatcttttcttgggtatagctgctgggtacgctggtattcggctctggagaaccgtcaaaggaacttcagaaggatggagatcactttcttggtctatcgcatgcttcttccctggtattgcttttgttatactaacagtgttgaatttccttctctggagcagcaacagcaccggtgccatcccaatatcactgtactttgagctcttggctctctggttctgcatctcggttccactcaccttgttcggaggattcttaggcacacgagcagaaacaatccagtttccagtgagaaccaaccagattccaagggaaatcccagaacggaaatacccgtcatggcttctcgtccttggagcaggaacacttcctttcgggaccctattcatagaactcttcttcatcttctccagcatatggttaggtagattctactacgtgttcgggttcttgctcatcgttctacttcttttagtagtcgtgtgtgcagaagtatcagtggtcttgacctatatgcacctctgcgtcgaagattggagatggtggtggaaggcgttctacgcgtctggttcagttgctttgtacgtttttgcgtactctatcaactatttggtctttgatctgcaaagtctgagcggaccggtctctgctatgctttacattggttactctctgcttatggcaattgcaatcatgctcgctactggaaccattggctttctcacttcgttttacttcgtccattatctcttttcctctgtcaaaatcgattgatacttgacgagaaaaatctcacccgttgatgtttgctttttttctaaagcaattttctggtgttgttttttttgtcagtactagacttgtagagtccaccactattttacatgtttttgttttcttttaatattcggacctatattacccttatatgtttgtttttttttccttacaattccacctcttgtgtttttcgggactattgagtagaaagaaaataaacctttttttcttgcttctccgttggttcggtttaaatttctgtttttggtttatacacacaattctatgatggcctggcttaagaaaatgcattcgacgat

SEQ ID NO: 3461 - DNA, 2262 bp, Vinca minor
accactgctctctctctcgtttcgatccatttcgtcggctacactcttccctcgctgccttgctcgaaattcttccattcccgattcacctccggtgtttatgcttgagaatctattgactgtggatttggttgagtgcctttgaaggggtctatctacttacttttccttttattgaaaaatggcattatcatcgatctgtaaaaggaaatattgggctgctctcatttacttgtctttggcatctcatctttgtcatggattttatcttcccgggacctacatgcacacgtacacccctgcagaggaaataactgtcaaagtgaattcattgacttcaattgaaactgaacttcccttcagctactatagccttccttattgtcagcctcaagggggcataaagaaaagtgctgagaatcttggagaactgcttatgggagaccaaattgataactccccttaccgtttcaagatgaatgtgaatcaatctctttatctctgcaccactccccctctgagcgagaatgaggtaaagctcttgaaacagagaactcatgatatgtatcaagtgaacttgatcttagataatttacctgctatgagatatgccaaccaaaatggggttaaagtccagtggactggatttccagttggctacaggccaccgggtggtactgaagactatattatcaatcaccttcagtttaaggttttgattcatgaatatgaaggggctggagtggagataattgggactggggaagaaggtatgggtgtcatctcagaagctgataagaagaaggcttctgggtatgagattgttggttttgaggttattccttgcagtgttaaatatgaccctgagaaaatgacaaaacttcacatgtacgacaccgttccatcagtgagctgtcctttggagcttagtcagtctcaggtaataaggcagcaagaacgagtgtcatttacgtatgaagttgagtttgtgaagagcaacattagatggccatctcggtgggatgcttatctcaagatggaaggatcacgtgttcattggttctcaatccttaactcactgatggttatcttcttcttggctggtattgtttttgtgatctttttgaggactgtgagaagggatttgacaaggtacgaggaattagacaaagaagcgcaggctcagatgaatgaggagctttcggggtggaaacttgtggttggtgatgtgtttagagaaccgaatcactcaaagctactctctgtgatggtaggaaatggggttcagatattaggcatggcagctgtaagtattgtctttgccgcacttggctttatgtcgccagcttcccgaggtatgctgcttacgggaatgatacttgtttatctttttctgggaatttctgctggatatgctggtgtccgcatgtggagaaccattaagggcacctcagaagggtggaggtctgtttcttggtcaatttcatgtttcttccctggaattgtttttgttattcttactgtattgaatttcatcctctggggaagtaagagtactggggctattcccatttccttgtactttattcttttgtcactctggttttgcatttcggttccccttacccttttgggaggcttcctaggaacaaaagctgagcctattcaatacccagtacgaactaaccaaattccaagggagatccctgctcgcaagtatccgtcatggcttcttgttcttggtgctggaactcttccatttggaacacttttcattgaacttttcttcattctatctagcatctggcttggacggttctattacgtatttggttttctcttgattgtcctcctgctgttggttattgtttgtgctgaggtttctcttgttctcacttacatgcacctctgtgtcgaggattggatgtggtggtggaaagcatactatgcctctggttctgttgccctctacgtgttcttatactccatcaactacttggttttcgacctccagagtttaagtggaccagtgtcggctgctttatatattggttactcactgatcatggcaatcgcaatcatgctggcaacaggtgccattggtttcctcacatcattctactttgtgcattaccttttctcctcagtgaagattgattaagggtagtgttgagtgaagataattcttggctagccggagaagaaaataggtgaaggaagtttaactgatctgctctgtatttctctgttctacataatctt

SEQ ID NO: 3462 - DNA, 2220 bp, Eutrema parvulum
gattttttgtttcatacaggaaggaaaatgtttgctttgtaccgagttttcgtcttgctggtttttgtttgtcagctgtgcaatgggttctacttgccagggagttatatgcacacatattcaaacggagactcaatcttagccaaagtcaattcattgacatctatcgaaactgagcttcctttcagtttctatagccttccttactgcaaaccgcttgagggcataaagaaaagtgctgagaatcttggggagcttctcatgggggatcagattgataactccgcttataggttccggatgaacacgaacgagtctctctatctctgtaccacgagtcctctgaatgagcatgaggtcaagctcttaaaacagagaacacgcgagttgtaccaagtgaatatgattctagataacttgccagcattgagatttgcaaaacaaaatggggttaccatccagtggactggataccctgttggatattcaccacccaacagcaatgatgattacatcatcaatcacctgaagtttaaggtcttggtccatcaatacgaaggcaatgtcatggaggtaattggcacaggtgaagaaggtatgggtgtgatctctgaagctgataaaaagaaggccttgggctatgagatagttggatttgaggttgttccatgcagtgtgaagtatgatcccaagaaaatgatgaaacttcacatgtatgaccctgttacttcagtgaactgtccgttggagcttgacaaagctcagattataaaagaacatgaaaggattaccttcacttatgaagtcgaatttgttaggagtgagacaagatggccatcaagatgggatgcctatttgaaaatggaaggtgctcgtgtccattggttctctattctgaactcgcttatggtgatcttctttctcgccggtatagtctttgtcattttcctgaggacagtgagaagggatctgacaaagtacgaggaactagacaaggaagcgcaggcacagatgaatgaagaactctctggatggaaacttgttgtcggagatgtgttccgagaaccagagctatccaagctactatgtattatggtgggagacggtgttaggattacaggaatggctgttgtcacaattgtttttgcagcacttggtttcatgtcacctgcttctagaggaatgttactaaccggcatgataattctctatcttttcttgggtattgctgctgggtacgctggtgtcaggctctggagaaccgtcaaaggaacttcagaaggatggagatcactctcctggtccatcgcatgcttcttcccgggtattgcttttgttatactaacagtgttgaacttccttctctggagcagcaacagcactggcgcaatccctatatcgctgtactttgagctcttggctctctggttctgcatctcggttccgctcaccttgttcggaggattcttaggtacacgagcagaagcaattcagtttccagtgagaactaaccagattccaagagaaatcccagaacggaagtacccgtcatggcttctcgtcctcggtgcaggaacacttcctttcggaacactattcatagaactcttcttcatcttctccagcatatggttaggtagattctactacgtgttcgggttcttgctcatcgttctacttcttttagtagtcgtgtgtgcagaggtatcagtggtcttgacctatatgcatctctgcgtcgaagattggagatggtggtggaaatcgttcttcgcatctggttcagtggccttgtatgtctttgcttactccatcaactatttggtctttgatctgcaaagcctgagtggaccggtctcggctatgctttacattggctactctctgcttatggcgattgcaatcatgctcgctactggaaccattggcttcctcacttccttttacttcgtccattatctgttttcctctgtcaaaatcgattgaaacttgacgagaaaatctcaaccgttgaatgtttgctttctctaaagcaatttttcaggtgttgtttttttttgtcagtaatagacttgtagagtcaactattttacatgtttttttttcttctaatattcggacctatattacccttatatgttggttttttcttacaattccacctcttatgtttttcggaactatgagtagaaataaaagatactgtatttctgctttttg

SEQ ID NO: 3463 - DNA, 1891 bp, Tripterygium wilfordii
gctacatgcacacatatgcacctggtcaacccatacttgccaaagttaactcattgacttctattgaaactgagcttccatttagctactacagtctgccttactgcaaaccccctggtggaatcaagaagagtgccgagaatcttggagaactccttatgggagatcagatagataattcgccgtaccgatttcggatgaatatcaatgagactgtgtatctctgcactacaaatccattgagtgaacatgaggttaagcttttgaagcaaagaacccgtgatctgtatcaagtgaatatgattttagataatcttcctgtgatgaggtatgcaacagagaatggaattaaaattcagtggacaggattcccagttgggtatacacctggcaacagtaatgatgattacattatcaaccacctcaagttcacagtcttggtccacgagtacgaaggaagtggtgtggagattattggtactggagaagaaggtatgggtgtgatttctgaagctgataagaagaaggcttccggttttgagattgtcggttttgaggtacaaccttgtagtatcaagtatgatcctgaagtgatgacaaaacaccacacctatgacaacatttcctctgtgagttgcccctctgagcttgacaagtctcaaataataagggaccaagagagagtgtccttcacatatgaggttgagtttgtgaaaagtgatattagatggccatctcgatgggatgcttatttgaaaatggaaggtgctcgtgttcactggttttcaatccttaattcactcatggtgatctttttcctggctggaattgtgttcgtcatattcttaaggactgtgagaagggatttgactaggtatgaggaattggacaaagaatctcaagcacagatgaatgaggagctttctgggtggaagcttgttgtgggtgatgtattcagagaaccagagtgttccaaacttctttgtgtgatggttgctgatggggtacagattatgggtatggcagttgtcactattgtttttgcagcccttggtttcatgtcaccagcatctcgagggatgctgctgacggggatgataattctttaccttttcttgggcattattgctgggtatgttggtgtgaggatgtggagaaccatcaagggaacttcagaggggtggaagtcagtttcatggtcagttgcatgcttctttcctggaatcgtctttattatccttacagcattaaacttccttctttggggcagtaatagtactggtgctatcccaatttccatgtattttgtactgctggctctctggttctgcatatcggtgccactcaccctattgggaggactttttggcacacgagctgaggccatccagtatcctgtgcgaaccaaccagattcctcgggaaattccagcccgcaaatatccatcatggctattggttcttggtgctggaacccttccttttggaactctcttcattgagcttttcttcatcctttctagcatctggcttgggagattctattatgtctttgggttcctgctgatagttctttccctgctggttgttgtttgtgctgaagtatcggtggtcttaacctatatgcatctctgtgtggaggactggcggtggtggtggaaatctttcttcgcctcaggttcggtatcactatacgtcttcctatactctatcaattacttggtttttgacctacagagtttgagcggtcctgtgtcagccatgctctatctagggtattcattgctcatggcagtcgcgatcatgttgtctactggagccattggcttcctcatgtccttctactttgtgcattacctcttctcatccgtaaagattgattagcacaattg

SEQ ID NO: 3464 - DNA, 2617 bp, Musa acuminata
cggtttgggtcaactcggttccgcttcttccttccaccgctcgcatcccccttctctcgaacaccgaggagatccatcgatcgcgccgcgccccctcttcacccccccggctccccagatcgactctttcttctgacgcgactctgtcggtttccgcaaaaaagtttgggatttggggggatccgatggctccattttccatctctttgaggtcttcttgcttcatcctcgtcgctttgttgattttggggccgagctatgccttttacctgcccgggagttatatgcatacgtattctcaaggtgaaaccataacggtgaaagtgaattcgctcacttcgttcgagaccgagctcccttttagctactacagcctgccctactgccaaccgcaggacgggatcaagaagagtgcggagaatttgggcgagcttctcatgggtgaccagatcgacaactccccttaccagttccatgtcaatgtcaatgaatccttttacctctgcaccacgaacccgttgaacgagcgcgaggtgaagctgcttaagcagcggactcgcgatctgtatcaggtgaacatgattcttgacaaccttcccgttaggagatttaccgaacagaacggtgccacctttcaatggacagggtttcctgttggttacaccccgtcgggaagttccgaagactacatcattaatcacttgaagtttaaggtcctagtccatgagtacgagggaagccgtgtggagataattggcacaggggaagaagggatgggagtgatttcagagactgaaaaacagaagatgtctgggtatgagattgtcgggtttgaagttgttccatgcagcgtgaagcgcgatccggaagcaatgtcgaagctgaacatctacagtaaagttggtcccgtggactgcccattggagcttgagaaatcccaagcaattcgggaacaggagaagatctctttcacttatgaagttgtatttgtgaaaagcgatgtcagatggccctcgaggtgggatgcgtatctcaagatggagggtgccagggttcactggttctcgatcatgaactctttgatggttatattctttttggctggaatagtctttgtaatatttttgaggactgtaaggagggaccttactagatacgaggaactggataaagagtctcaagcgcagatgaacgaggagctatccggctggaaacttgtcgtgggagatgttttcagagagccaacgaactcaaagctgctctgtgtaatggttggtgatggagtgcagattaccggtatggctgttgtgaccattgtgtttgctgctcttggcttcatgtctcctgcctcacgaggcatgctcttgacggggatgatcattctctatctcttccttgggattgctgctggatacgttggtgttaggctatggaggaccattaaaggtggctcagaaggatggaggccggtttcatggtcgattgcttgtttcttccccgggatcgcatttgttattctctgcattctgaacttcatgctgtggggaagcagcagtacaggagctctcccaatctcattattctttgttctgttatccttgtggttctgcatctcggtgccacttacccttttgggtggattcttgggcactcgggctgagcacattcagttccctgtgcgaacaaatcagattccaagagaaatccctgcgaggaagtatccctcatggctgcttgtccttggtgctggaactctacccttcgggaccctttttatcgagttattcttcattctatctagcatatggcttgggaggttctattacgtgttcgggttcctgctcatagttcttctcttgctggtcaccgtctgtgctgaggtttctgttatcctaacatacatgcatctctgcgtggaggattggcagtggtggtggaaagccttctttgcatctggctcagttgccatttatgtgtttttgtactccatcaactacttggtgtttcagctgaggagcctgagcgggcctgtgtcagcaatgctctacctaggctattcgttgatcatggctgttgctatcatgttatccactggcaccattggtttcttgacgtcattttactttgttcactatctcttctcatcagtcaagattgattagaggttcgctccctcgagattcagcagttcctcacttcaatttacaatcttggcatagccttaggattaatagatttgattaacttgccttgaagttaagactacttgtactcaaggtcagctgcttcaaagtatttttctaggatgagatctatggaactgcagcttgtcattttcttttctttcatttcactatgttacctccgagacttgcttacgactgttaagctttatttggatgtcaaggtcacagagttactttttcttttcaccttattttctgtttcttgttcgacatttactgaaccttgacagtaggatgtcagtttggcaactattttcttatctattgctccagttatcaatgtttgctgagattattgtggcagttatcttaattacatgataaatttcatgtgttccatattagttggaggttttatttaagctgtgctt

SEQ ID NO: 3465 - DNA, 2695 bp, Petroselinum crispum
aaaaatggaaatttgagatctgaaaaatccgttgttacttttcttgtaatttcatcaagcaaaagtctattatctggagagcggtagcagcaggagtagtattatatcacaaaagtctcttgttgcctgctcttacaattacaatttacaactcaactcactcactccgttcctacatcctctctctccgttttttcttaaaagaagcttgcattggctttaaggggtcaagtatagaggatctcagaaccaaagacaatgtctttgagctcgggaaggacatgctgggctgcattcatctattttcttctggtttcacgtttttgtaatgggttttacctgccgggaagctatatgcacacatattcaaccggtcaggaaatatttgctaaagtcaattcactcacatctatagaaactgagcttcccttcagctactatagtctaccatactgcaagcctcatggcggggtaaagaaaagtgcagagaatcttggagagttacttatgggcgaccagatcgacaactctccttatcgtttccgtatgaatgtcaacgagtcagtttatctttgcacgacaaagccattaagcgagaatgaggtgaagctcctaaagcagagaacacgtgatctctatcaagtaaatatgattctggacaatttacctgccatgaggtttgccactcaaaatggagtcaaaattcagtggactggttttccagttggatacacaccaccaaactcaaaagatgattacatcattaatcaccttaagtttaaagttttggttcatgagtatgaaggaactggcgtagagatcatcgggacaggtgaagagggtatggctgtaatttcagaagctgaaaagaagaaagcttctggatttgaaattgttggttttgaggtcttcccttgcagtgtgaagtatgatcctgaaaagatggctaaacttcatctctatgacaatgttacatctgtactctgccctctggatttagagaattctcaaattattagagagcaagaaagagtatcatttagctatgaggttgaatttgtgaagagtgatattagatggccatcacggtgggatgcttatcttaagatggaaggtgcccgtgtccactggttttccatccttaattcgcttatggtgatagtcttcttggctggtattgtttttgttattttcttaagaacggtcaggagagatctgacaaggtatgaggatttggacaaagaatctcaggcacaaattaatgaagagctctcagggtggaagcttgttgtaggtgatgtgttcagagagccaaatttttcaaagctactatgcgtgatgattggagatggggttcagattacagggatggctgttgtgactattgtatttgctgcatttggtttcatgtcaccagcttcacgaggtatgttgttgacgggaatgattattctttaccttttcctgggaaccggggctggttatgctggtgtacgtttgtggtgtactgtcaaggggacttcagaaggatggaggtctgtatcttggtcagtcgcatgcttcttcccaggcattgtctttgtcatccttacctttttaaacttcgttctatggggcagcaagagtactggtgcaattcccctatacttgtattttatacttttgtcgctttggttctgcatttctgttcctctaaccctattgggtggatacttggggacacgagctgagcctatcaagtaccctgtaagaacgaaccagattccaagggaaattcctgctcgcaaataccctacgtggcttcttgttcttggtgctggtaccctcccatttggtaccctctttattgagcttttcttcatcctttctagcatatggcttggaaggttttattatgtatttggattccttcttgttgttcttttgctgttggttactgtgtgcgctgaagtttcagtggtcctcacttacatgcatctctgtatcgaagattggcagtggtggtggaaagcgttttatgcatcaggttccgtctccctatatgtattcctgtactccatcaattacttgatttttgaccttcaaagcttgagtggacctgtatcagcgattctttatcttggctactcattgatcatggcaattgcaattatgttgtctaccggcaccatcggcttcctcacttccttctactttgttcattaccttttctcatcagtgaaaattgactgaagaagtccttcagcaatgcacaatgattatgaggattatgaaaactcttggttcacagataatagattctccaaatgcccttacaatacaattttggcaaagattttgttgcaccgtgtcaaaatggattggtggatgagctgttggcgccaaatgatcttcgtgtttctcggattagatattgccgtagtgttaattttgtgatttatagttgtccgaacacaacagaactgtaatctagctatcctctttgtttgtttctgattcatttacaagtcattcgcttttacaccgttatgcttatactttcattatatttgacagatggattatacatactattgctggagtttgatcaactaaatttgtgaattatgtttctggttagtagacttttaaagttttccaataccatgtatgattagatgcaagcgggttaaaaatatttaatttggttttctgc

SEQ ID NO: 3466 - DNA, 2928 bp, Ananas comosus
cccaactccctctcctcactcaatcactcatcttctccctcgaacgctgagacggatccggagagggtgcttctcgaatctcgaatctcgtcctctttattaactcctcctcctctccccatttctccttgtttcgcttctagatccctcctcgttctcctcccgatctggcttctccttgccctagtcctgcgaatcaggattcgcagtagatgacgttaatttgtagaataaattagggtctgagcaaacagatctggcagtgtaaattttgctatagctgaagtcaatatggcgagatctcggatctcagatggatcttactctctgatcctctctgctttgttgtatctgctcttaatcgtctctcctggcaatgccttctatctccctggtagttatatgcacacatacgcacaaggcgaaaccatttgggtcaaagtcaactcccttacttccatcgagaccgagctccctttcagttactacagcctcccctactgccggccgcagggcgggatcaagaagagtgctgagaatttaggggagcttctcatgggcgatcagattgataactcgccgtatagatttcgtgttaatgttagtgagtccctctacctctgcaccacaaacccattaaatgagaatgaagtgaagcttttgaagcagaggacccgtgatctttatcaggtcaacatgattctcgacaaccttcctgtactgcggttcgctgagcagaatgggcttacagttcagtggactgggttccctgttgggtacactccagttggtagttcagaagattatattatcaaccacttgaagtttaaggtcttggttcatgagtatgaaggaagtaacgtggagattattagcacgggggaagagggctttggagtgatctcagataccgataagaagaagatgtcggggtatgagattgtagggtttgaagttgtcccgtgcagtgtgaagcgggacccagaatccatgttgaagaaaaacatgtatgataaaattgattctgtgaactgcccgctggagattgagaaatctcagatgattcgcgagcgagaaaggatctcatttacttatgaagtcgagtttgtgaaaagcgatatcagatggccctcacggtgggatgcttatttaaaaatggagggctcaaaggtccattggttctcgataatgaattctttgatggttatcctcttcttggcggggattgtatttgttatattcctaaggactgttaggagagatctaactaaatatgaggagctggataaagaagcccaagctcagatgaatgaggagctttcagggtggaaactcgttgtgggcgatgtattcagagagcctgcttgctcaaagctactatgcgtcatggttggggatggagttcagattttgggaatgggcatagtcgcaatcatctttgctgctctaggattcatgtctcctgcctcgagaggaatgctgttgacaggcatgatcattctctatctcttccttggtattgcagctggatatgttggtgttcgcctctacaggactataaagggtagctctgaaggatggaggtcgctttcttggtcaattgcctgctttttccctggaataatattcgtaattctcaccacactaaattttatactgtggaagaacaagagtactggggctttacccatctcactctttttcactcttctggccctttggttctgcatctcggtgccgcttaccctttttggtgggtttctgggcacaagggctgaacatatagaattcccagttcgtactaatcagatcccaagagaaattcctgaagggaaatacccatcttggcttcttgttcttggtgctggaacacttccctttggcaccctcttcattgagctcttcttcattctctctagtatatggcttgggaggttctattatgtgtttggattcctacttatcgttttcctattgcttgtgattgtctgtgccgaagtgtcggtcgttttgacttacatgcatctctgcgtggaggactggaaatggtggtggaaagctttctttgcttctggctcggttgccctttatgtgctcctatactcgatcaactacctggtgtttgaccttagaagcttaagtgggcctgtttctgctatactctaccttggttattcactgatcatggcttttgctatcatgctatcgaccggcacaatcggctttttgatgtcattttcttttgtttactatcttttctcatccgtaaagattgattgaaggtactcttctccatctcttgatgccataagtttagtaaattaatctactccagggtctacctattattacagctgaaatttaccattaatcaacctgtaccttttcatactctgtattcttttgttgcatttctctcagattcatgcataaacttttgtaattcaggcttgctgcttatgtgcttttagcaatatttaatgtagcttccaagttctatcaatattctggatttatggtggaggttgtttcttttcctagaaaagagcaatattttgaagttctctttactccatgatggtggtgattgcgttctgcagtttatgcagctaatgcatttggaattggcattttgcgcaacaaagaacaacatagatatttatcaggtatgattgcctgcttgtgttatatatttttcaccgtgcatggcatcagtagcttagctcctaacggatggctcacctgagcacagcatagtgatctccaaaaacttgtgaggctagccaaggttgtttggaacatttcttgttaaccagttgaaattgggtcagcaatagtcttcttatgagttcaggtaattaaatctccttctccattactggtatcttcttaaaaattaagttattaaatcttctctaacactggtct

SEQ ID NO: 3467 - DNA, 2934 bp, Ananas comosus
ctcgggatctcgacggttctcgatccaatctcagcgaacgggtaactctccgaaccctagatcggtttcatttggtctctgttttcgattgtaggtctttctttttcccgatcgtaattgaaggaatctagggctcgtttgctgattcaaaggtttgtttggcttggatctattttgttgcttcaattagggttcccgaaggttttcttttattgttttgatatgtttcagtgtcatttctcgatttgaggcgtgcgagaactcataactgaatccaaataactagggttttctatcgcgtatggtagatctggagtaatcttatcctttactgtatcgaaattgtgatcttctatcgcatcctccagatctggagtaaacttaccatgaggatctgattgctgcttgcttattcactttgtatagattcttaaatgtgtagatctgcttttgtgttattacagtatgttaccggagatctgattttatgttgttgttgtttttctcgtcacctcttgctttgtttttcccacaggttttaattgaaatcaactagatctggatgaacctagggtttaagaagacagatctgagaccgtaagttgagataccgaagtatttatctgcataaatgctgagcgatcgattcccaaagatgtcttcctcttggattatacctgttttcgtctctctgcttctttttgcatctccgaccaatgccttctaccttcctggtagctatatgcacacctacgtgccaggtgaagaaatttgggtgaaagtgaattccctcacctcgatcgaaaccgagctcccctttagctactacagcctgccttactgccgcccgcaaggtgggatcaagaaaagcgccgagaatttgggcgagcttctcatgggcgatcagatcgataactctccttatcgttttcgcattaatacgaacgagtccctctacctctgcactacaactcctctaaatgagcatgaggttaaactcttgaagcagaggagccaagacctctatcaggtgaatatgatcctcgacaaccttcctgttctgaggttcaccgaacagaacggcatgaccattcagtggactgggtttcctgttgggtactcccctagtggaggttctgaagtttatatcatcaatcacttgaagtttaaggtcttggtccatgagtatgaggggagtaaagtgcagattattggcactggcgaagagggcttgggtgtgattactgagaatgataaaacgaagatgtctgggtatgagattgtgggttttgaagttgttccgtgcagtgtgaagcgggatcctgatgccatgtcgaagcttaacatttatgataaaattgagcctgtaaactgcccactggagcttgagaagtctcagatgattcgtgaaaaagagagaatatcctttacttatgaagtcgagtttgtgaagagcgacattagatggccttcacggtgggatgcgtacttgaaaatggaaggtgctaaagtccactggttctcaatcatgaactccttaatggtcatcttctttttggctggtatagtgtttgtcatattcttgaggaccgttcggagggatctgactagatatgaagagctggataaggaagcccaagctcagatgaatgaggaactatctggctggaaacttgtagtgggtgatgtcttcagagaaccaacatgcccaaaattgctttgtgtaatgattggtgacggaattcagattttgggtatggcggttgtgacaatcgtctttgctgcgctgggtttcatgtctcctgcctcgagagggatgctcttgactggaatgattattctatatctcttccttgggattgctgccggatatgttggtgttaggctctggagaactatcaaaggtacttctgaagggtggcggtcagtttcctggtcgattgcttgtttcttccctggtattgtattcgtcattctcaccatacttaacttcatactgtggggaaacaacagtaccggagctctacctatctcattgttcttcactcttctctccttgtggttctgcatctcggtgcctcttacccttttgggtggtttcttaggaactagggctgagcctatagaattccctgttcggaccaaccaaatcccaagagaaatcccagcgcgaaaatacccatcgtggcttcttgtactgggagctggaacactaccctttggcaccctattcatcgagctcttcttcatcctctctagcatttggctcgggaggttctactatgtgttcgggttcttactcatcgtcctccttttgcttgttgttgtgtgcgctgaagtgtcggtggtcctgacctacatgcatctatgtgtcgaggactggaggtggtggtggaaggcattctttgcttctggctcggtcgctctttatgtgttcctttactccatgaactacctggtgtttgaccttagaagcttgagtgggcctgtttctgctgtagtctaccttggctattcgctgatcatgtgtcttgcgatcatgttatctactgggaccattggcttcctgacctcactctcttttgttcactatctgttctcttcagtcaagatagattaaaaggtcagtctcttcaattaaacttcaaattaatctatcaatacacatagggatcgaccaactacattgaactgttcaaggtgaagcttacactgacgtcatcttctttgctgaatttcaccatgtgtttggcagacgtgtctttatggtttttgttttattattttatctttagatatgaagctaaacttttgtaagttgggcttggctggttttatagatgtcgaagtatgtaatttttatttgatttaactttatcaatctagtaaagaattcatattatgctgtttccaattgccagttggttagcatcc

SEQ ID NO: 3468 - DNA, 2635 bp, Musa acuminata
cacggtttgggtcaactcggttccgcttcttccttccaccgctcgcagcccccttctctcgaacaccgaggagatccatcgatcgcgccgcgccccctcttcgcccccccccgcctccccagatcgactctttcttctgacgcgactctgtcggtttccgcaaaaaagattgggatttggggagatccgatggctccattttccatctctttgaggtcttcttgcttcgtcctcgtcgctttgttgattttggggccgagctatgccttttacctgcccgggagttatatgcatacgtattctcaaggtgaaaccataacggtgaaagtgaattcgctcacttcgttcgagaccgagctcccttttagctactacagcctgccctactgccaaccgcaggacgggatcaagaagagtgcggagaatttgggcgagcttctcatgggtgaccagatcgacaactccccttaccagttccatgtcaatgtcaatgaatccttttacctctgcaccacgaacccgttgaacgagcgcgaggtgaagctgcttaagcagcggactcgcgatctgtatcaggtgaacatgattcttgacaaccttcccgttaggagatttaccgaacagaacggtgccacctttcaatggacagggtttcctgttggttacaccccgtcgggaagttccgaagactacatcattaatcacttgaagtttaaggtcctagtccatgagtacgagggaagccgtgtggagataattggcacaggggaagaagggatgggagtgatttcagagactgaaaaacagaagatgtctgggtatgagattgtcgggtttgaagttgttccatgcagcgtgaagcgcgatccagaagcaatgtcaaagctgaacgtctacagtaaagttggtcccgtggactgcccattggagcttgagaaatcccaagcgattcgggaacaggagaagatctctttcacttatgaagttgtatttgtgaaaagcgatgtcagatggccctcgaggtgggatgcgtatctcaagatggagggtgccagggttcactggttctcgatcatgaactctttgatggttatattctttttggctggaatagtctttgtaatatttttgaggactgtaaggagggaccttactagatacgaggaactggataaagagtctcaagcgcagatgaacgaggagctgtccggctggaaacttgtcgtgggagatgttttcagagagccaacgaactcaaagctgctctgtgtaatggttggtgatggagtgcagattaccggtatggctgttgtgaccattgtgtttgctgctcttggcttcatgtctcctgcctcacgaggcatgctcttgacggggatgatcattctctatctcttccttgggattgctgctggatacgttggtgttaggctatggaggacaattaaaggtggctcagaaggatggaggccggtttcgtggtcgattgcttgtttcttccccgggatcgcgtttgttattctctgcattctgaacttcatgctgtggggaagcagcagtacaggagctctcccaatctcattattctttgttctgttatccttgtggttctgcatctcggtgccacttacccttttgggtggattcttgggcactcgggctgagcacattcagttccctgtgcgaacaaatcagattccaagagaaatccctgcgaggaagtatccctcatggctgcttgtccttggtgctggaactctacccttcgggaccctttttatcgagttattcttcattctatctagcatatggcttgggaggttctattacgtgttcgggttcctgctcatagttcttctcttgctggtcaccgtctgtgctgaggtttctgttatcctaacatacatgcatctctgcgtggaggattggcagtggtggtggaaagccttctttgcatctggctcagttgccatttatgtgtttttgtactccatcaactacttggtgtttcagctgaggagcttgagcgggcctgtgtcagcaatgctctacctaggctattcgttgatcatggctgtcgctatcatgttatccactggcaccattggtttcttgacgtcattttactttgttcactatctcttctcatcagtcaagattgattagaggttcgctccctcgagattcagcagttcctcacttcaatttacaatcttggcatagccttaggattaatagatttgattaacttgccttgaagttgagactacttgtactcaaggtcagctgcttcaaagtatttttctaggatgagatctatggaactgcagcttgtcattttcttttctttcatttcactatgttacctccgagacttgcttacgactgttaagctttatttggatgtcaaggtcacagagttactttttcttttcaccttattttctgtttcttgttcgacatttactgaaccttgacagtaggatgtcagtttggcaactattttcttatctattgctccagttatcaatgtttgctgagattattgtggcagttatcttaattacatgataaatttcatgtgttccatattagttggaggttttatttaagctgtgcttataatcacttcttg

SEQ ID NO: 3469 - DNA, 2318 bp, Raphanus sativus
gggttactcgccctttgcgaacgctctaagcaaggctagggatagatagatatagagagagagagcgagagagagatagagaagaaatccgtctcttgcccctagatctgacttcgttgaagatctcagaacctggatctgcgtcaggaaggaaaatgtaccgggttttggttttgctggtgtttgttggtcagctttgcaatgggttctacttgccagggagttatatgcacacatattcaaacggagactcaatcttggccaaagccaattccttgacgtctatagaaaccgagctacctttcagtttctatagccttccttactgcaaaccactcgagggcatcaagaaaagtgctgagaatcttggggagcttctcatgggggatcagattgataactctgcctataggttccggatgaacaccaacgagtctctctatctctgcaccaccagtcctctgaacgagcatgaggtcaagctcctgaaacagagaacccgcgagttgtaccaagtgaatatgattctcgataacttgcctgctttgagattcgccaagcaaaatggggttaccatccagtggactggataccctgttggatattcgccacccaacagcaatgatgattacatcatcaatcacctcaagtttaaggtcttggtccatcagtacgaaggcaatgtcatggaggtcattggcaccggtgaagaaggtatgggtgtcatctctgaagctgataaaaagaagcccctgggctatgagatagttggatttgaggttgttccatgcagtgtcaagtatgatgccgaaaaaatgaccaaactccacatgtatgaccctgttccatcagttaactgtcccttggagcttgacaaagcccagatcataaaagaacttgaaaggataaccttcacttatgaagtcgaatttgttagaagcgagacaagatggccatcaagatgggatgcctatttaaaaatggaaggtgctcgtgtccattggttctctatactgaactcgcttatggtgatcgtctttctcgccggtatagtctttgtcatattcctgaggacagtgagaagcgatctgacaaagtacgaggaactggacaaggaagcgcacgcacagatgaacgacgagctctctggatggaaacttgttgtcggagatgtgttcagagaaccagaactttcaaagcttctatgcattatggtgggagacggtgttcggattacaggaatggctgttgtcactattgttttcgcagcactaggattcatgtcgcctgcatcgcgcggaatgttactaaccgggatgattattctctatcttttcttgggtattgctgctgggtacgctggtgtccggctctggagaaccgtcaaaggaacttcagaaggatggagatcactatcctggtccatcgcatgcttcttcccgggtattgcttttgttatactaacagtgttgaacttccttctctggagcagcaacagcactggcgccatcccaatatcactctactttgagctcttggctctatggttctgcatctcggttcctctcaccttgtttggaggattcttaggcacgcgagcagaagcaattcaatttccagtgagaaccaaccagattcctagggagatcccagaacgtaaatacccgtcatggcttctcgtccttggagcaggaacacttcctttcggaactctattcattgaactcttcttcatattctccagcatatggttaggcagattctactacgtatttgggttcttactcatagtactgcttcttttagtagttgtgtgtgcagaggtatcagtggtgttgacctatatgcacctctgcgtggaagattggagatggtggtggaaagccttcttcgcatctggttcagtcgccttgtatgtctttgcttactccatcaactatttggtgttcgatctccaaagtctgagcggaccggtctcggctatgctttacattggctactctctgcttatggccattgcaataatgctctctacaggaaccattggcttccttacttccttttacttcgtccactatctgttttcctctgtcaaaatcgattgaaatttgacgagaaaatctcagccgttgaatgtttgctttttctgaagcaattttttcaggtgttgttattttcttttgtcagtaatagacttgttagagtcctgtgttttttctctctctgaattttcggacttatattaccgttatatgttattttcgttttttttttctgaactttgggtagaaataaatgattccgtttttctgcaaata

SEQ ID NO: 3470 - DNA, 2471 bp, Chelidonium majus
gaattcctgtgagctattatccgatcggactataactgcatttgatctgatctgaaggtatttcagttgcaaacaaactgctatttgaagagtgaattaatatttggatccgtacttgtattgcattagaattcacctgaagttggaagttcaattattatttgtctggcatttttgtcatctggagatctagatctgacattggatatgtctttgagtatctcttagatccaaggaaatactggggaaatcgatatcagtttctcttccaatggccatcttagagaaactttcttcaatccattcgtgttgtctctttgttgttttattggcttgtgtgtgcaatgggttttatttgcctggaagttatatgcacacatacaaaaatggagaagtcatatttgcgaaagttaattccttgacgtccattgaaacagagcttccttttagttattacagtcttccttactgcaaacctcaggaaggtgttaagaagagtgcagagaatttgggagaactccttatgggagatcaaattgataactccccataccgttttaaaatgaatgtaagcgagtcgctttatctctgcacaacgagcccactaaacgagaatgaggtcaagctcttgaaacagagaacccgtgatctatatcaggtgaatatgatccttgataatttacctgcaatgaggtatgccaagcaaaagtgggattaacattcagtggacagggtatcctgttggttatgccccacctcaaagtaatgatgattacgttataaatcatctgaaatttaagattttgattcacgagtatgaaggaactggggtggagttactcggtactggggatgagaccatggctgtagttacagaacctgacaagaaaaaaggatctgagatagttgggtttgaggttgtcccctgcagtgtgaaacgtgatcctgaggcgatgttaaagctcaagatgtatgatccaattgatccagtgaactgtcctgttgatctcgacaagtcacagataatcagggagcaagagcggatcacatttacttatgaggttgaatttgagagaagtgatattagatggccttctcgatgggatgcttacttgaagatggaaggtgcgcgtgtgcattggttctcaatcctgaactcgctcatggtgatcttctttttagctggcattgtctttgttatattcttaaggacagtgagaagagatttaacaaggtacgaggaactggacaaagaagctcaagcacagatgaacgaggagctttcagggtggaagcttgttgtcggtgatgtctttagagagccaaattgcccaaaactattgtgcgtgatggttggagatgggacccagattttagggatgtctgttgttaccattgtttttgccgctcttggtttcatgtcaccagcttctcgaggaatgctcctgactggtatgattattctgtatcttttccttggcattatagcgggttatgttggtgttcggctatggataactatcaagggaacttcagaagggtggaggtcaatttcctggtccgtttcgtgtttctttcccggaatagtattcgtaattctcactgccttgaacttcatactttggggcagcaagagcactggtgctatccctatctcactgtattttatactcttgtccctttggttctgcatttctgttcctctaaccctcttcggaggctattttgggacaaaggcagagcccattcaattccctgtgcgaaccaaccagatccctagagaaattcctgcacgaaaatacccatcatggcttcttgtactcggtgctgggactctcccctttggaaccctcttcattgaactctttttcatcctttctagtatctggcttgggagattctattacgtatttggcttcttgcttgttgtcttcgtcttgctggttatcgtatgtgctgaagtctctgttgtccttacctacatgcatctctgtgtggaggattggcagtggtggtggaaagctttctttgcctctggttcagtcgcactctatgtgttcctgtactccatcaattacctgatattcgatctgaggagtttgagtgggcccgtctcagctatgctctatctcggttattcattgatcatggcaattgctgtcatgttgtctaccggcacaattggtttccttgtttccttgtatttcgttcactaccttttctcatctgtcaaaatcgactagaagtattggaaactccaaaaatacatttgaaaagatgaaaatccgccatcccctccaaatttttcgctcatttctaacagtcatgcctttcgttctgtttatcgttacagcaaagattttgggttttgcaaaacctatagctgattgatcctggtaaactgctggtatgggtaaaagtaatcaagatcatcatggctttcagatgattcccaccatctttcatgcttc

SEQ ID NO: 3471 - DNA, 2358 bp, Phalaenopsis aphrodite
atcgtcgatctcaaagagggagtcgcctgcttctcgccgctcttcttcgagcgatttttcttcggattgaagcaaatttggttagaataaggattagttggagatggaacaatgcttttgaatctctagagattgggattttggtgttcagatctgagatctgcaacaaggaggaggtttctgattattggaaatagttgtgttctatgtcattggttactgtattgacgagcatgaaatccttttcatttgttttcttctttcttccacttatctgtcattgcaatggattctatcttccgggaagctacatgcgcacctattctgaaggtgaaaccatatgggtgaaagtgaattccctcacctcaattgagaccgagcttcctttcaactactactctcttccctactgtaaaccccaggatgggatcaagaaaagtgctgaaaatttaggagagctcttgatgggtgatcaaattgacaactctccttacaaattcaacgttaatgtcaacgaatctatttacctctgcaccaccaaatctttgagcgagcatgaggtgaagctcctgaaacagagaacccgtgatctgtaccaggtgaatatgattcttgataatcttcctgtcatgagattaactcaacagaatggcatcacaatccagtggactggattccctgttggctactcaccaactggtaccaatgatgattacattattaatcacctgaaatttaaagtcatggttcatgaatatgaaggtaaacgtgtggagattattggcaccggggaagaagggatgggagttatctcagaaacggataagaacaaaatgtctggttatgaaatcgtaggatttgaggttatcccttgcagtgttaaaagagatcctcaaagcatgtcaaagcttaatatgtatgataagattgatccaataatctgtcctttagagctcgataagtctcaggttattcgcgagcaagaacgaataactttcacctacgaagtcgaatttgtgaaaagcaatataaggtggccttcccgatgggacgcgtatttgaagatggacggtgctagggttcactggttctcaatcatgaactctgtcatggtcatcttcttcctagccggcatagtctttgttatattcttgaggacagttcgaagagatttgaccagatacgaagaactggataaggaatcccaggctcagatgaacgaggaactttctggctggaagctcgtcgtcggcgatgtcttccgtgagccaaactgctcgaagcttctctgtataatggtcggagatggtattcagatcaccgggatggccgttgtaaccatagttttcgccgctctcgggttcatgtcgcccgcctcaagaggaatgctcttaaccggaatgatccttctctatctcttcctcggcattgctgccggctacgttggcgtacggctatggagaaccatcaaaggcgggtcggaaggatggcggccgttagcctggctcattgcctgcttcttccccggcatcgtattcgtcatcttaacaatcttaaatttcattctttggggcagcaacagcaccggagcgatccccatttcattgttcttcactctcttagcattgtggttctgtatttcggtgcctctcactctcctcggaggattcctaggcaccagagcggagcatatacagtacccagttcgaacgaaccagattccgagagaaatcccagctcggaaatacccgtcgtggcttctcatcctcggggccggaacccttcccttcggcactttattcattgaactcttcttcatcctctctagcatctggctcgggaggttctattatgtctttgggtttctgctcgttgtctttattctgctcgtcgtcgtctgtgctgaggtttctgtagtgctgacgtatatgcacctctgtgttgaggattggaggtggtggtggaaggctttctatgcttctggttctgtggcattatatgtcttcctttactccattaattacttgatatttgacttgaggagcttgagtggacctgtatcagccattctgtaccttggatattctcttataatggcttttgcagtaatgctggtaacaggtactattggttttctcacatccttatattttgttcactatctcttctcttcagtgaagattgattagaaaagattatgcgttggactgaagaaggtgggtctctgccaaatttaacttcagatttagagagaaatgttagttgatgaggtaaggattaagtaacatcagatgttcaagccatattgtttttttttaatattgctttgatatgcatgagattattataggttttctt

SEQ ID NO: 3472 - DNA, 2573 bp, Citrullus lanatus
ggaatattaattccagtgcaacgaaatatcaagaacccccaacaaaatactcactctgtatcgtccgttgcgcttcgtgagtatctcttaccgcgtcggtgtttccaatggcctcctccagttcgaggaagccctcaatctgtcgggttttccttgtgtttgtggttcttgcctatcgttgtgatgccttctatcttcccggaagctacatgaatgtttactcctctgaggatcctatatttgctaaggttaattccttgacttccattgaaaccgaacttcccttcaactattatagtctcccctactgcaaacctccgggtggtgtcaagaaaagtgcagagaatcttggggagctgcttatgggtgatcagattgacaactctccttatcgttttcgtatgaatgtaaatgaaacagtctacctctgtactaccgagcctttgagtgaggttcaagtgaagcttttgaaacagaggacccgtgatctctatcaggtaaacatgatactggataatttacctgccatgagatttacggaacaaaatggggttaaaatccagtggactgggtttccggttgggtatacaccatcaaacagtgaggatgattatattattaatcatcttaagttcacagtcttggttcatgagtacgaagggagtggtgtggaaataattggcactggggaagaaggtatgggtgtgatttcgcaaactgaacagaagaagtcttctgggtttgagattgttggatttcaggttgcaccttgtagtattaaacacgatcctgaagtgatgaaaaagtataagatgcttgagaatatcacacatgtagattgtccgaaagaacttgagaagtcccagatcatcagggagaaagagcaagtgtcattctcttatgaggtgcagtttgttaaaagtgatatacggtggccatcaaggtgggatgcatatttgagaatggagggttccaaagtacactggttctctattttaaattctctaatggttatcttcttcttagcgggtatagtttttgtcatattcttaaggaccgtgagaagagatttgacaaggtatgaggagttggacaaagaatctcaagcacagatgaacgaggagctctcaggatggaaacttgtggttggagatgtgttcagggaacctgattgttcgaagctcctctgtgtgatggttggtgatggggttcaaattttggggatggcagttgttactgttgtttgtacagcatttggcttcatgtcgccagcctcaagaggcatgctactgacagggatgattattctttatcttttcctcgggattattgcaggttatgttggtgtacgtgcatggagaaccattaaaggaacgtcagaagggtggaggtcggtttcctggtcagttgcttgcttctttcccgggattgtcttcgtcattcttacaatactgaacttcatactttggagtagcaagagtactggtgccattcccatctcactatattttgaactcttggctctctggttttgcatatctgtgccactcaccctgctaggaggattcttcggcacacgagcagaggaaattcagtttcccgtgagaaccaaccagattccgagggaaattcctgctcgaaaatacccatcttggcttctcattcttggagctgggacccttccctttggaacccttttcatcgaactcttctttatcctttctagcatctggcttggaaggttctattatgttttcggtttcctactgatagttttgtctttgctggttattgtgtgtgctgaagtatcagtcgtccttacctacatgcatctctgtgtggaagattggcggtggtggtggaaggctttctttgcttctggttccgttgctctttacgtcttcctttattccatccactacttggtctttgagctgcagagtttgagcggaccggtctcggctattctttatctcggttattcattgatcatggcaacggcaattatgttatcaactggcaccatcggcttcctaacgtctttctactttgttcactacctattttcatcagtgaagatagattagaaatagtaacgacgcggatgatttcggtaacattttggctcttggtgaattgtctgatactttctttttttcttttcagcttagcaagtttcttaggcaattggtctttggagctgttacattatatatggagtgaagtgagatgatgggatggttggttatttctagttatatgaatcccaacctatgtttagaatgcaaatatctactgcctccctcccaccaagaccaaatccccaaaagaaaggaaaaaaaaaaaaaaaaaaaaaaaaaaaaaaaaaaaaaaaaaaaaaggagattgtcttggtttcttaatgccattgatctagttttgattgagcgcttccattcttgtataccatttcattgtatttctttaaaagaaagactgattgagctttctctattcatattttccacgttgattccttttccacattttgttattgcttttcctgccacatcattaatatatacttaagacaa

SEQ ID NO: 3473 - DNA, 2277 bp, Allium cepa
aaaccctcgagaagttcaaataaggttaccgaagttatttccagatcgataaagttacagtcttatgctgccattttaaatctcatgagttcgattgatgcctgaagtctcctgcgatctgctcaattattttgattcataaaaggatataaccacaaggttgacatatccattatggggagagcaatatctttaatatcatcagcttacttcctcctcctcctcctatttacattgccaagcaatgcattttacctacctggaagttatatgcatacatattccaaagatgataaaatatcagctaaagtaaactctctcacctcaattgaaacggaacttccttttgactactacagccttccatactgccaaccccaaggtggagtcaagaaaagcgctgaaaacttgggagaacttttaatgggagatcaaatcgataattctccatacaggttccgtatgaatgtcaatgaatcagtttacctctgcactacacaccctttaaacgagaacgaagtgaagcttctgaaacaaagaacccgtgatctttaccaggtaaatttgattctagacaacctacctgccatgagattcaccacccaaaatggagttactattcaatggactggattccctgtagggtataccccaaacaccgaaagcaatgatgattacatcatcaatcacttgaaattcaaggtccttatccacgaatatgaaggaagcggcatgcaaattcttggcaccggggaagaaggtttggctgttgtttcagaagtcgataaaactaaaaagtctggttacgagatagtaggattcgaagttgtgccttgtagtgttaaaagagaccctgaagctatgtcaaaacttaacatgtacgacaacatcgaccctatcaactgccctttagagctcgacaagtgtcagttgatccgtgaacatgcgagggtaacgttcacgtatgaagttgagtttgtgaagagcgatataaaatggccttccagatgggatgcttacttgaaaatggagggtgcaagagtgcattggttttcaatcatgaactctctaatggtcatcttcttcctagctggaatagtgtttgttatctttttaaggacagtgcgtagggatttgactagatatgaggagttggacaaagaagcgcaagcacagatgaatgaagaactctcaggatggaagcttgttgtaggagatgtgttccgtgaacctgagcactcgaagttgctatgtgttatgataggcgatggagttcaaattttagggatggcactagtgaccatagtgtttgctgccctagggtttatgtcacctgcatctagaggcatgttactgactggcatgataattttgtaccttttccttggtatctttgctggttattttggggtcagggcatggataaccataaagcaaagctcggaaggatggagaggggtagcatggtcaactgcatgtttcttccccgggatagtatttgttatcttgacaatactgaacttcatcctatggggaagcaaaagcaccggggctatccctatctcactttacttcatactaatctctctctggttttgcatatcggtgcccttaaccttgctaggggggttcataggaacacaagcggagcccataaaattcccagtccgtaccaatcaaatccctagagaaatccctgcccgaaagtacccttcatggcttctagtcctagggtcaggtaccctgccttttgggacgctgttcattgaactgtttttcatactatcgagcatttggctgggaagattctactatgttttcgggtttctattcgtggttttgatgctgcttataacggtgtgtgctgaagtgtcggtggtgctgacatacatgcacttgtgcgtggaggattggaggtggtggtggaaggctttctttgcttctggctctgttgctttgtatgtctttctgtactccatcaactacttggtttttgaccttaggagcttgagtggccctgtctctgctatactgtatatcgggtattcgctcattatgtctttggctgttatgctgagcacgggaactgttgggtttcttgtctctttctacttcgtgcactatcttttctcttccgtgaagatcgattaggatgatctttctcccctcttttttgttggttttacactattatgttatgcggttaaagatgtaatttgaaatttgttgcaagaaactttgctggattttattttctattaactatattttgttgct

SEQ ID NO: 3474 - DNA, 2730 bp, Petroselinum crispum
tgagagaaaaaattgagtggtgaagagctagatatcagtataagcactaatatgtaagcacgctatttgcagcattttcttataagaagctggctaatttcttgaagagggttaagtgttgaggattttaggaccaggaacaatgcctttgatcttggaaaagacatgctgggctgcatttatctatgtccttctaatctcccattcttgtaatgggttttacctgccgggaagctacatgcacacatattcaacagggcaggaaatattcgccaaagtcaattcactgacatctattgagaccgagcttccattcagttactacagtctaccatactgcaagcctcaaggcggggtaaagaaaagtgcagagaatcttggagagttactaatgggagatcagatcgacaactcaccttatcattttcgtatgaatatcaatgagtcagtttatctctgcacgacaagtccattaagcgagaatgaggtgaagctcctaaaacagagaacacgtgatctctatcaagtgaatatgattctggacaatttacctgccatgaggtttgccactcaaaatggggtcagaattcagtggactggttttccagttggatacacaccaccaaactcaaaagatgattacatcattaatcaccttaagtttaaagttttggttcatgagtatgaaggaactggcgtagagatcatcgggacaggtgaagagggtatggctgtaatttcagaagctgaaaagaagaaagcttctggatttgaaattgttggttttgaggtcttcccttgcagtgtgaagtatgatcctgaaaagatggctaaacttcatctctatgacaatgttacatctgtactctgccctctggatttagagaattctcaaattattagagagcaagaaagagtatcatttagctatgaggttgaatttgtgaagagtgatattagatggccatcacggtgggatgcttatcttaagatggaaggtgcccgtgtccactggttttccatccttaattcgcttatggtgatagtcttcttggctggtattgtttttgttattttcttaagaacggtcaggagagatctgacaaggtatgaggatttggacaaagaatctcaggcacaaattaatgaagagctctcagggtggaagcttgttgtaggtgatgtgttcagagagccaaatttttcgaagcttctatgcgtgatgattggagatggggttcagattacagggatggctgttgtgactattgtatttgctgcatttggtttcatgtcaccagcttcacgaggtatgttgttgacgggaatgattattctttaccttttcctgggaaccggggctggttatgctggtgtacgtttgtggtgtactgtcaaggggacttcagaaggatggaggtctgtatcttggtcagtcgcatgcttcttcccaggcattgtctttgtcatccttacctttttaaacttcgttctatggggcagcaagagtactggtgcaattcccctatacttgtattttatacttttgtcgctttggttctgcatttctgttcctctaaccctattgggtggatacttggggacacgagctgagcctatcaagtaccctgtaagaacgaaccagattccaagggaaattcctgctcgcaaataccctacgtggcttcttgttcttggtgctggtaccctcccatttggtaccctctttattgagcttttcttcatcctttctagcatatggcttggaaggttttattatgtatttggattccttcttgttgttcttttgctgttggttactgtgtgcgctgaagtttcagtggtcctcacttacatgcatctctgtatcgaagattggcagtggtggtggaaagcgttttatgcatcaggttccgtctccctatatgtattcctgtactccatcaattacttgatttttgaccttcaaagcttgagtggacctgtatcagcgattctttatcttggctactcattgatcatggcaattgcaattatgttgtctaccggcaccatcggcttcctcacttccttctactttgttcattaccttttctcatcagtgaaaattgactgaagaagtccttcagcaatgcacaatgattatgaggattatgaaaactcttggttcacagataatagattctccaaatgcccttacaatacaattttggcaaagattttgttgcaccgtgtcaaaatggattggtggatgagctgttggcgccaaatgatcttcgtgtttctcggattagatattgccgtagtgttaattttgtgatttatagttgtccgaacacaacagaactgtaatctagctatcctctttgtttgtttctgattcatttacaagtcattcgcttttacaccgttatgcttatactttcattatatttgacagatggattatacatactattgctggagtttgatcaactaaatttgtgaattatgtttctggttagtagacttttaaagttttccaataccatgtatgattagatgcaagcgggttaaaaatatttaatttggttttctgctctgttaacccgcctctagccaaaaattttgtcacttaacaatctaatttgttcaccaatgttttagcactaaactactccagcttagcacagcagtgcaacatgttaaacactgtgatttcagtggctgatcatgttattcttgtcggtc

SEQ ID NO: 3475 - DNA, 2715 bp, Eschscholzia californica
gagggagagagagagagaatactagacaaagctaatatccgaaacctacgaatttgggttactctttcacggattcatcctcacctgatcttctacaccttcttcttgttggttgcgtgtgattctagtgtgatttcttcgttgaggttgttttcagtagctaacctgtaaatccagtaaaccaaagcgagaacgtgagcacctattagagctactacaatgagaggaacattttccatacgcaaagagaatttctagagagagaaagaggagtttgtatggttattttctcttctctccaccagtcttcacgctctttctccggacatcagaaaaccctaactccgttttgagcatcagatctgcggtttatatcagtttgaacagatttggtggtgaattgattatcttgatcgagtagatctatactttgaaagcatcaaactttggaagtttttatctttctttagatctgatattggaatatgcatttttgcatttcctagattcgaagcgatacaaggggaaactgttctttgattcacttccaatggcttcttcaatctatttgtcttgtctccttgttcttctttttggttgtgtgtgcaatgggttttatctgcctgggagttacatgcatacgtatacaccgggggagcaaatatttgcaaaagttaattccttgacttccattgaaactgaacttcctttcagttattatagtcttccttactgcaaacccccaggagggattaaaaagagtgcagagaatttaggggagcttcttatgggagatcagattgacaactccccatatcgtttccgcatgaatgttaatgaatctatttatctctgcacaaccagcccgttaaatgagaacgaggtaaaactattgaaacaaagaacccgcgatctgtaccaggtgaatatgattttggataatttacctgctctgaggtatgctgaccaaaatgggattaacatccaatggacagggtatcccgttggttacgctccagctctaagtaaagatgattacatcatcaatcatctgaaattcaaggttttggttcacgagtacgaaggaactggtttggaggtgattggtactggagatgagtccatggctgtagttgcagaacctagtgaaaagaagaatgggtatgagatagttggatttgaggttgtcccttgtagtatcaagcgtgacacagaggaaatgttaaagctccatatgtatgatacaatcgatccaattaactgccctgttgatcttgacaagtctcagataatcaaggagctagagcgagtcacatttacttacgaggttgaatttgtgaaaagtgatattagatggccttctcgttgggacgcttatttaaagatggaaggtgcacgtgttcactggttctcaatcttgaactcgctaatggttatctttttcttagctggtattgtgtttgttatattcttgaggaccgtgaggagggatttgacaaggtacgaggaactggacaaagaagctcaagcacagatgaatgaagagctttcagggtggaagcttgttgtgggtgatgtatttagagaacctaattgcccaaagctactttgtgtgatggttggtgatgggacccaaattctggggatggctgttgttaccatcgtattcgctgctcttggtttcatgtcaccagcttctcgaggaatgctactgacaggcatgataattctgtatctcttcctcggaattatagctggttatgttggtgttagagtatgggtaaccatcaagggaacttcagaaggatggagatccattgcttggtccgtttcctgtttcttcccaggaatagtatttgtaatccttactgccttgaacttcatcctttggggcagcaagagtactggtgctatccctatctccttatatttcatactcttgtccctctggttctgcatttctgttcctctaaccctattgggtggtctatttgggactagggccgaacccatcaaatatccagtccgaactaaccagatcccaagagaaatccctgcaagaaaatacccatcatggctccttgtccttggtgctggaactctcccatttggaacccttttcattgaactctttttcatcctttctagcatctggctcggtagattctactacgtgtttggattcttgctcgttgtctttgtgttgctagttattgtttgtgccgaagtctctgttgtccttacttacatgcatctctgtgtggaagattggcagtggtggtggaagtcattcttcgcatctggttctgttgctctttacgtgttcatgtactccattaattacctgatatttgatctcaggagtttgagtggacctgtttctgctatgctctaccttgggtattctttgatcatggcaatcgctatcatgttgtcaactggcaccatcggtttccttgtctccttctatttcgttcactaccttttctcatctgtcaaaattgattagaattggtaaatcctcactcctctctctctctctctttctaactttcatgattttggttatgtttagacttgcagaaaaagatcagtgtttgttgatcgatctttgtggacggtaactgaactatctttcatgcttcataaggttggaggtttctttagtttctttgtagcttcacagtttgctgttattcggctcgtctctttcaa

SEQ ID NO: 3476 - DNA, 2505 bp, Musa acuminata
cccggctttatttatggccaaccccttctgcttcgattcgaccccctttgcgctccacgatctcagcggcgagagagaggcatcgaagaggctctccttccttcgcaagtcgtgccgcttccctaagcttccatgatgaggtttcttgaatgatattgtgaattccgaaggtggttggggttgagaccttagatctgatacgccgtaaggataaagaggaggggagggtgaccacagcgcgatggggccaacttcgaacccagaaaggtcttcctctttgtgtttcttgactttctcgatcgtgcttttgttgtgtggttcggggaatgcgttttatctccctggtagctatatgcacacctactcggaaggcgagaacatatgggtcaaagtaaattcgctcacctcaatcgagaccgagctcccgtttggctactacaccctgccctattgccagccacagagtgggatcaagaagagcgcagagaatctgggggagcttctcatgggcgaccagatcgataactctccttatcgcttccgtgtcaatgtgaacgagtccctctacctgtgcaccacaaaaccgttgaacgagcatgaggttaagctcttgaagcagaggacccatgatctctatcaggtgaacatgattctggacaatcttcctgtgaggagattcaccgagccgaatggagtcgtcattcagtggactgggtttccagttggctatatcccagctggaagctctgaagcatacatcatcaatcacttgaagtttaaggtgttggttcacgaatatgaaggccgtggcatgcaaatcatgactacaggggaagaagggatgggaatgatcgcggagacagatgctaagaactccggatatgagattgttgggtttgaagtgattccctgcagtgtgaagcgtgatccagaggcgatgctgaaacttaacatttatgataaagttgattctgtgaactgcccattggagctcgagaagtcccaaacgattcgggagcaagagaagatctcttttacctatgaggttgtctttgttaaaagtgacattagatggccgtcccggtgggatgcctatctgacaatggggggtgcaagagttcattggttctcgatcatgaactcattgatggttatcttctttttggctggaattgtctttgttattttcttgagaacagttcggagggacttaacgagatacgaagagctggacaaggaatcacaagcccagatgaatgaagagctatctggctggaaacttgtcgtgggtgatgtgttcagagagccaacctgctcaaagctgctttgcgtcatggttggagatggcatacagattacgggcatggcagttgtgacaattgtctttgctgctcttggattcatgtctcctgcttcccgaggcatgctattgacagggatgataattctctatcttttccttggaatcgtggctggatatgttggtgttattttatggaggaccataaaaggggggtctgatggctggaggtcagtctgctggtcgactgcttgtttcttcccggggattgtctttatcgttctcacaatattaaacttcatactatggggaagcaagagcaccggagctatccctatctcgctcttcttcactctgctttccttgtggttctgcatctcagtgccgctgactctgataggcggattcataggcacccgagcagaggaaatacggtttcccgtcaggaccaaccaaatcccaagagaaattcctgctcggaaatatccgtcatggtttcttgtccttggcgcagggaccctaccctttgggaccctcttcatcgaactcttcttcatcctttctagcatttggcttgggaggttctactatgtgtttggattccttctcgtcgtcttcctgctgctggtgatcgtctgtgctgaagtatctgtcgtcctgacttatatgcacctctgcgtggaggactggaggtggtggtggaaggctttcttcgcctctggttctgttgcgctctatgtgttcctctactccatcaactacttggtgtttgacctaaggagcttgagtgggccggtgtcagccatcctttacctgggttattcactgatcatggctactgcaatcatgttatccaccggcaccatcggctttctgatgtcattctattttgtccactatcttttctcctccgtcaagatcgattaagactctgcttctttgggctgccaggaccagctactcctttgaagaccgtcttcaaaactgttgtgtgaacatgaaagggccttcatgttctttgcgcgcactcatgttgagttgcttttgagggggggaatgttattgtagtcgcctatcttacaatgatacatcctaaggaaccgaacattttaaatgcttctgtttcaatagtttcttttatcgtttatgccccatgactcaactctgttagtgtaatttctctatggttgctataattttttagt

SEQ ID NO: 3477 - DNA, 2550 bp, Musa acuminata
gtctcatcccggctttatttatggccaaccccttctgcttcgattcgaccccctttgcgctccacgatctcagcggcgagagagaggcatcgaagaggctctccttccttcgcaagtcgtgccgcttccctaagcttccatgatgaggtttcttgaatgatattgtgaattccgaaggtggttgggattgagaccttagatctgatacgccgtaaggataaagaggaggggagggtgaccacagcgcgatggggccaacttcgaacccagaaaggtcttcctctttgtgtttcttgactttctcgatcgtgcttttgttgtgtggctcggggaatgcgttttatctccctggtagctatatgcacacctactcggaaggcgagaacatatgggtcaaagtaaattcgctcacctcaatcgagaccgagctcccgtttggctactacaccctgccctattgccagccacagagtgggatcaagaagagcgcggagaatctgggggagcttctcatgggcgaccagatcgataactctccttatcgcttccgtgtcaatgtgaacgagtccctctacctgtgcaccacaaaaccgttgaacgagcatgaggttaagctcttgaagcagaggacccatgatctctatcaggtgaacatgattctggacaatcttcctgtgaggagattcaccgagccgaatggagtcgtcattcagtggactgggtttccagttggctatatcccagctggaagctctgaagcatacatcatcaatcacttgaagtttaaggtgttggttcacgaatatgaaggccgtggcatgcaaatcatgactacaggggaagaagggatgggaatgatcgcggagacagatgctaagaactccggatatgagattgttgggtttgaagtgattccctgcagtgtgaagcgtgatccagaggcgatgctgaaacttaacatttatgataaagttgattctgtgaactgcccgttggagctcgagaagtcccaaacgattcgggagcaagagaagatctcttttacctatgaggttgtctttgttaaaagtgacattagatggccgtcccggtgggatgcctatctgacaatggggggtgcaagagttcattggttctcgatcatgaactcattgatggttatcttctttttggctggaattgtctttgttattttcttgagaacagttcggagggacttaacgagatacgaagagctggacaaggaatcacaagcccagatgaatgaagagctatctggctggaaacttgtcgtgggtgatgtgttcagagagccaacctgctcaaagctgctttgcgtcatggttggagatggcatacagattacgggcatggcagttgtgacaattgtctttgctgctcttggattcatgtctcctgcttcccggggcatgctattgacggggatgataattctctatcttttccttggaatcgtggctggatatgttggtgttattttatggaggaccataaaaggggggtctgatggctggaggtcagtctgctggtcgactgcttgtttcttcccggggattgtctttatcgttctcacaatattaaacttcatactatggggaagcaagagcaccggagctatccctatctcgctcttcttcactctgctttccttgtggttctgcatctcagtgccgctgactctgataggcggattcataggcacccgagcagaggaaatacggtttcccgtcaggaccaaccaaatcccaagagaaattcctgctcggaaatatccgtcatggtttcttgtccttggcgcagggaccctaccctttgggaccctcttcatcgaactcttcttcatcctttctagcatttggcttgggaggttctactatgtgtttggattccttctcgtcgtcttcctgctgctggtgatcgtctgtgctgaagtatctgtcgtcctgacttatatgcacctctgcgtggaggactggaggtggtggtggaaggctttcttcgcctctggttctgttgcgctctatgtgttcctctactccatcaactacttggtgtttgacctaaggagcttgagtgggccggtgtcagccatcctttacctgggttattcactgatcatggctactgcaatcatgttatccaccggcaccatcggctttctgatgtcattctattttgtccactatcttttctcctccgtcaagatcgattaagactctgcttctttggcctgccaggacctgctactctttgaagaccgtcttcaacactgttgtgtgaacatgaaagggccttcatgttctttgcacgcactcttgttgagttgcttttgagggggggaatgttattgtagtcgcctatcttacaatgatacatcctaaggaaccgaacattttaaatgcttctatttcaatagtttcttttattgtttatgccccatgactcaactctgttagtgtaatttctttatggttgctataattttttagtgtgtttagttggtttatgtcgagataatccagcatatta

SEQ ID NO: 3478 - DNA, 2628 bp, Castanea mollissima
gttccagttatctcattctcatagcacatggcatagggttccccttccaactcttgcctttctgttatccctcacccctgatttctctccgctcagagagagagacagagacaaagaaagatcctcagatcaacaacaaaaccagatctgtgctttgatccgatctcgctccacagccttgtagctgtaactcacacacagatccaccatcactgtttctaagatctgggtcttttcagtttcgcaatggctttatcaaagccattcttgaaatgggttttcgtgtgtttggttattctctttgcacatactacttgcaatgcgttttaccttcctgggagctatatgcacacttattcacctcgggaacccatatttgccaaagtcaattccttgacttccattgaaaccgagcttcctttcagctactatagtctcccttactgcgaaccccaagagggtgtcaagaaaagtgctgagaatctcggcgagcttctcatgggagatcagatcgataactccccgtaccgtttccgaatgaatgttaatgaaacagtttacttgtgtactacccccccgttgaaggagaatgaggttaagctcttgaaacagagaacccgtgatttgtatcaagtgaatatgattcttgataacttgcctgccatgaggtactctaggcaaaatgatgtgagcattcagtggactgggtatcctgtcgggttcactcaaaataataatgacgattacatcattaatcatctcaagttcaaggttttggttcacgagtatgaagggagtggtgtggagatcattgggactggggaagaaggcatgggggtgatttcgactgatgccgataagaaaaaggcgtccgggtttgaaattgttggttttgaggttgtcccttgcagtgttaagcatgatcccgaagccctgtcgaaacgtaaaatgtatgacaatattggccctgtgacctgcccttctgagcttgacaagtctcagataatacgggagcaagagaaggtgtcattcacctatgacgttgaatttgtgaaaagcgatataagatggccatcgagatgggatgcttatttgaagatggagggtgcccgagtccactggttctctatcttgaattcagtaatggttatctttttcctggctggtatagtttttgttatattcttgaggacagtgagaagggatctaacaaggtatgaggaattggacaaagaatctcaagctcagatgaatgaggagctttctgggtggaagcttgttgtgggtgatgtcttcagagaaccaaattgccccaagctactttgcgtgatggtcggtgatggggttcagattttagggatggcaattgtcactattgtttttgcagcttttggtttcttgtcaccagcttcgcggggaatgttacttactggaatgattgttctgtatcttttccttggaattgctgctggttatgttggtgtacgcctctggagaaccttgaagggaacttcagaaggttggaagtctgtttcctggtcggtggcatgcttcttttctggaattgtctttgctatcctcacagcattgaatttcattctttggggcagcaagagtactggtgccattcccatttccttgtactttttgctgctgttcctctggttctgcgtttcagtgccacttaccctcctgggaggattgcttgggacacgagctgaggcaattcagtaccctgtgcgaaccaaccagatccctagggaaattcctgcacgcaaatatccatcatggcttcttgttcttggtgccgggaccctgccatttggaaccctctttatcgagctattctttattcttactagcatctggcttggcaggttttattatgtctttgggttcctgctgattgttcttctattgctagttattgtttgtgctgaagtgtcagtggtcctcacttacatgcatctatgtgtggaggattggcagtggtggtggaaagctttctttgcttcaggttcagttgccctttacgtgttcctgtactccatcaattacttggtttttgacctgaaaagtttgagtgggcctgtgtcagccattctatatctcggctattcactgatcatggcatttgcaatcatgttggcaactggcaccattggcttccttatgtctttctactttgttcattacctattctcatccgtaaagattgattaaaaagtgatagctggtattcttcatcaaccagttggagaaggctctggtatgtaggaagaggaaagtaattttctcggataatctttttggtgtttacttgtctgaggctgactgttcacagctcatattaagaggctctcagatggtttgatgatgctatcaaagcctgttatattttctatgcatcttgagtttagagaacagcaaagttgtaatccccccttttctctctttgttgtcctttttttctgcttttccacaattactaatattgaggttcatttgcactatctgtttcagtttaatcaaattgttctaggaagttgtaattgtttgaacttctatccttaatctctttcattttataattgaatagaaaggttgattggtcatttgattttactc

SEQ ID NO: 3479 - DNA, 2600 bp, Quercus alba
atagcatagcatagcatagcatatagcatagggttccccttccaactcttgcctttcttttatcgctcacccctgatttctctccactcagagagacagagacaaagaaagatcctcagatcaacaacaaaatcagatctgtgctttgatccgatctcgctccacagcccttgtagctgtaactcacacacacagatccaccatcactgtttctaagatctgggtcttttcagtttcgcaatggctttatcaaagccattcttgaaatgggttttcctgttcttggttattctctctgcacatactacttgcaatgcattttaccttcctggaagctatatgcacacatattcgcctcgggattccatatttgccaaagtcaattccttgacttccatcgaaaccgagcttcctttcagctactatagtctcccttactgccaatcccctgagggtatcaagaaaagtgctgagaatctcggcgagctgctcatgggagatcagatcgataactccccataccgtttccgaatgaatgttaatgaaacagtttacttgtgtactacccacccgttgaaggagaacgaggttaagctcttgaaacagagaacccgtgatttgtatcaagtgaatatgattcttgataacttgcctgccatgaggtactctaggcaaaatgatgtgagcattcagtggactgggtatcctgtcgggttcactcaaaataataaggaagattacatcattaatcatctcaagttcaaggttttggttcacgagtacgaagggagtggtgtggagatcattgggactggggaagaaggtatgggggtgatttcgactgatgcggataagagaaaggcgtccgggtttgaaattgttggttttgaggttgtcccttgcagtgtgaagcatgatcccgaagccatgctgaaacataaaatgtatgacaatgttaatcctgtgacctgcccttctgagcttgacaggtctcagataatacgggagcaagagagggtgtcattcacctatgacgttgaatttgtgaaaagtgatataagatggccatcgagatgggatgcttatttgaagatggagggtgcccgagtccactggttctctatcttgaattcagtaatggttatctttttcctggctggtatagtttttgttatattcttgaggacagtgagaagggatctaacaaggtatgaggaattggacaaagaatctcaagctcagatgaatgaggagctttctgggtggaagcttgttgtgggtgatgtcttcagagaaccaaattgccccaagctactttgcgtgatggtcggtgatggggttcagattttagggatggcaattgtcactattgtttttgcagcttttggtttcttgtcaccagcttcacggggaatgttacttactggaatgattgttctgtatcttttccttggaattgctgctggttatgttggtgtacgcctctggagaaccttaaagggaacttcagaaggttggaagtctgtttcctggtcggtggcatgcttcttttctggaattgtctttgctatcctcacggcattgaatttcattctgtggggcagcaagagtactggtgccattcccatttccttgtactttttactgctgttcctctggttctgcgtttcagtgccacttaccctcctgggaggattattggggacacgagctgaggcaattcagtaccctgtgcgaaccaaccagatccctagggaaattcctgcacgcaaatatccatcatggcttcttgttcttggtgctgggaccctgccatttggaaccctctttattgagctattctttattcttactagcatctggcttggcaggttttattatgtctttgggttcctgctgattgttcttttattgctagttattgtttgtgctgaagtgtcagtggtcctcacctacatgcatctatgtgtggaggattggcagtggtggtggaaagctttctttgcttcaggttcagttgccctttacgtgttcctgtactcaatcaattacttggtttttgacctgaaaagtttgagtgggcctgtgtcagccattctatatctcggctattcactgatcatggcatttgcgatcatgttggcaactggcaccattggcttccttatgtctttctactttgttcattacctattctcgtccgtaaagattgattaaaaagtgatcgctggtattcttcatcaaccagttgcagaaagctctggaatgtaggaagaggaaaataattttctcggataatctttttggcgtttacttgtctgaggctgactgtttacagctcatattaagaggctctcagatggtttgatgatgctatcaaagcctgttatattttctatgcatcttgagtttagagaacagcaaagttgtaatccccccttttctctctttgttgtactttttttatgcttttccacaattactaatattgaggttcatttgcactatctgtttcagtttaatcaaattgttctaggaagttgtaattgtttgaactttctatccttattctctttcattttataattgaatagaaaggt

SEQ ID NO: 3480 - DNA, 2326 bp, Cucumis melo
gaaaaatcaagaacccccaacaaaatactcactctgtatcgtccgttgcgcttcctgagtatctcgcaccgcgtcggtgtttccaatggcctcctccagttcgaggaagccctcaatctgtcgggttttccttgtatttcttgttcttgcctatcattgcgatgccttctatcttcccggaagctacatgaatgtttactcctctgaggatcctatatttgcaaaggtcaattccttaacttccattgaaaccgagcttcccttcaactattacagtctcccctactgcaaaccacggggtggtgtcaagaaaagtgcagagaatcttggggagctgcttatgggtgatcagattgacaactctccttatcgtttccgtatgaatgtaaatgaaacagtctacctctgtactaccgagcctttgagtaaggatcaagtgaagcttttgaaacacagaacccgtgatctctatcaggttaacatgatactggataatttacctgccatgagatttactgaacaaaatggagttaaaatccagtggactgggtttccggttgggtatacaccatcaaatagtgaggatgattacattatcaatcatctgaagttcacagtattggttcatgagtatgaagggagtggcgtggaaataattggcactggggaagaaggtatgggtgtgattacgcaaaccgaacggaagaagtcttctggattgagattgttggatttcaggtgcaaccttgtagtattaaacatgatcctgaagtgatgacaaagtatgaaatgcttgaaaatatcacaggggtagactgtccgaaagaacttgataagtcccagatcatcagggagaaagagcgagtgtcattcacttatgaggtgcagtttgtcaagagtgatatacggtggccatcaagatgggatgcatatttgagaatggagggttccaaagtacactggttctccattttgaattctctaatggtaatcttcttcttagcaggtatagtttttgtcatattcttaaggactgtgagaagagatttgacaaggtatgaggagttggacaaagaatctcaagcgcagatgaacgaggagctctcaggatggaaactagtggttggagatgtgttcagggaacctgattgttcgaagctgctctgtgtgatggttggtgatggggttcaaattttggggatggcagttgttactgttgtttgtacagcatttggcttcatgtcaccagcttcaagaggaatgctactgacagggatgattattctttatctgttccttgggattattgcaggttatgttggtgtacgagcatggagaaccattaaaggaacgtcagaagggtggaggtcggtttcctggtcggttgcttgcttctttcctgggattgtcttcgtcattcttaccatactgaactttatactttggagtagcaaaagtactggtgccattcccatctcactatattttgaactcttggctctctggttttgcatatctgtgccactcaccctgcttggaggattctttggcacacgagcagaggaaattcagtttcccgttagaactaaccagattcctagggaaattcctgctcgaaagtatccatcttggcttctcattcttggagctgggacccttccctttggaacccttttcatcgaactcttctttatcctttctagcatctggcttggaagattttattatgttttcggtttcctactgatagttttgtctttgttggttattgtgtgtgctgaagtatcagtcgtccttacctacatgcatctctgtgtggaagattggcgatggtggtggaaggctttctttgcttctggctccgttgctctttatgtcttcctttattccatccactacttggtctttgagctgcagagtttgagcggtccggtctcagctattctttatctcggttattcattgatcatggcaacggctattatgttatcaacaggcaccatcggcttcttaatgtctttctactttgttcactacctattttcatcggttaagatagattagaaacagccaaacaacacaccaccagtgcgctcggggagcggatgattttcggtaacattttggttgttggtgaaatgtctgatacttcttttctttcttttgagcttagcaagtttcttaggcaaatagtctttggagctgttacattatatatggagtgaagtgaaagatgatgggatagttatttctagttacatgaatcccaacctatctttagaatgcaaatatctactacctctctcccaccaatatcaaatcccat

SEQ ID NO: 3481 - DNA, 2276 bp, Elaeis guineensis
gatcccatatcctctcttccgctcgtttgttcgccaaatccgaggggacccaggtcaaatcgcacgaaaaaggttattggaataggtttaagacctgtggtctccatggcaccgttgatgatctcaaaaaggtgcttttctttacttcctttatttttcttctgattacatgtccttccaatggcttctatctccccgggagttatatgcacacctactctcaagatgaacccatctcagtcaaagtaaattcactcacgtctatcgagacggagctgccatttagctactatagtcttccttattgccaacccaagggtgggatcaagaagagcgcagagaatctgggagagctgctcatgggggatcagatcgacaactctccatacacattccatatgaacgtcaatgaatcgctttatctttgcacaacgaagccgttaaatgagcacgaggtgaagctcctgaagcaaagaactcgagatctctatcaggtgaacatgattcttgacaacctgcctgtaatgaggttcactcaacaaaatggtgtcaccatccagtggactggttttccagttggatacacacccattgcaagcaatgatgactatatcatcaatcacctcaagtttaaggtcttggtccataagtatgaagggagtggtgtcgaaatcattggcacaggggaagaggcgatggggatgccctcagagactgataagaagaagatgtctgggtatgagatagttggatttgaagtaatcccgtgcagtgtcaagcacgacgcagaaaccatgtcaaagcataacatatatgaccgcatcgagcctgtgaattgccccttggagcttgacaagtgtcagatgatcaaggagcaggagaggatcacattcacctatgatgtagagtttgtgaagagcgacattagatggccctcgcggtgggatgcctatttgaagatggatggtgccaaggtccactggttctcgatcatgaactcccttatggtcatcttctttttggctggaatagtgtttgttattttcttaagaactgttcgaagggacttgacaaggtatgaggagttggataaagaggcccaggctcagatgaatgaggagctctcaggctggaaacttgttgtgggcgatgtgtttagagagccaacatgctctaaactgctttgtgtcatggttggagatggtgttcagattacatgtatggcagttgtgacaattgtgtttgctgccctcgggttcatgtctcctgcgtcacggggtatgctcttgactgggatggtcctcctttatctcttccttggtatttttgctgggtatactggcgtccggttatggagtaccatcaaaggcgggtctgaagggtggaggtcggtagcttggtctattgcttgcttcttccctggcgtggtgtttgtaattctcaccttcttaaacttcttgctttggtggaacaatagcacaggggctctcccaatctcattgtacttcactcttctgtctctgtggttttgcatctcggtgcccctcattcttttgggtggtttcttaggtacccgggctgaccccattcagttcccagttaggaccaaccaaattccaagggaaattccagcgaggaagtacccttcatggttacttgtccttggtgctgggacccttccttttgggaccctcttcattgagttattctttatcctctccagtatctggcttggaaggttctattatgtgtttggatttctactcatcgttcttctcttgcttgtcattgtctgcgccgaagtgtctgtggttctgacttacatgcatctgtgtgtggaagactggaggtggtggtggaaagcattttttgcttctggttcggtctctctttatgttctcctatactccatcaactacttggtgtttgatcttaagagcttgagtggggccgtgtcagctatgctctacatgggttattcgcttatcatggctcttgcaatcatgctatccaccggcacaattggcttcctgatgtcgttctacttcgttcactacctcttctcatcggtgaagattgactgaggattgcttcaagctgcaatggtttcttgcattgaattgcgatgcttcttgatgaatttttgatctatatcatgctcagaattccatatatgtttgaggtgcgtatagtgatgaccgggtgcggtgaatgcttatttcattgaggatcttaatgacccacagcatttatatgttccctgttcttttctattt

SEQ ID NO: 3482 - DNA, 2328 bp, Allium cepa
aataaggttaccgaagttatttccagatcgataaagttacagtcttatgctgccattttaaatctcatgagttcgattgatgcctgaagtctcctgcgatctgctcaattattttgattcataaaaggatataaccacaaggttgacatatccattatggggagagcaatatctttaatatcatcagcttacttcctcctcctcctcctatttacattgccaagcaatgcattttacctacctggaagttatatgcatacatattccaaagatgataaaatatcagctaaagtaaactctctcacctcaattgaaacggaacttccttttgactactacagccttccatactgccaaccccaaggtggagtcaagaaaagcgctgaaaacttgggagaacttttaatgggagatcaaatcgataattctccatacaggttccgtatgaatgtcaatgaatcagtttacctctgcactacacaccctttaaacgagaacgaagtgaagcttctgaaacaaagaacccgtgatctttaccaggtaaatttgattctagacaacctacctgccatgagattcaccacccaaaatggagttactattcaatggactggattccctgtagggtataccccaaacaccgaaagcaatgatgattacatcatcaatcacttgaaattcaggtccttatccacgaatacgaaggaagcggcatgcaaattcttggcaccggggaagaaggtttggctgttgtttcagaagtcgataaaactaaaaagtctggttacgagatagtaggattcgaagttgtgccttgtagtgttaaaagagaccctgaagctatgtcaaaacttaacatgtacgacaacatcgaccctatcaactgccctttagagctcgacaagtgtcagttgatccgtgaacatgcgagggtaacgttcacgtatgaagttgagtttgtgaagagcgatataaaatggccttccagatgggatgcttacttgaaaatggagggtgcaagagtgcattggttttcaatcatgaactctctaatggtcatcttcttcctagctggaatagtgtttgttatctttttaaggacagtgcgtagggatttgactagatatgaggagttggacaaagaagcgcaagcacagatgaatgaagaactctcaggatggaagcttgttgtaggagatgtgttccgtgaacctgagcactcgaagttactttgtgttatgataggcgatggaattcaaattttggggatggcactagtgaccatagtgtttgctgccctagggtttatgtcacctgcatctagaggcatgttactgactggcatgataattttgtaccttttccttggtatctttgctggttattttggggtcagggcatggataaccataaagcaaagctcggaaggatggagaggggtagcatggtcaactgcatgtttcttccccgggatagtatttgttatcttgacaatactgaacttcatcctatggggaagcaaaagcaccggggctatccctatctcactttacttcatactaatctctctctggttttgcatatcggtgcccttaaccttgctaggggggttcataggaacacaagcggagcccataaaattcccagtccgtaccaatcaaatccctagagaaatccctgcccgaaagtacccttcatggcttctagtcctagggtcaggtaccctgccttttgggacgctgttcattgaactgtttttcatactatcgagcatttggctgggaagattctactatgttttcgggtttctattcgtggttttgatgctgcttataacggtgtgtgctgaagtgtcggtggtgctgacatacatgcacttgtgcgtggaggattggaggtggtggtggaaggctttctttgcttctggctctgttgctttgtatgtctttctgtactccatcaactacttggtttttgaccttaggagcttgagtggccctgtctctgctatactgtatatcgggtattcgctcattatgtctttggctgttatgctgagcacgggaactgttgggtttcttgtctctttctacttcgtgcactatcttttctcttccgtgaagatcgattaggatgatctttctcccctcttttttgttggttttacactattatgttatgcggttaaagatgtaatttgaaatttgttgcaagaaactttgctggattttattttctattaactatattttgttgctgagacttcagtattctcctgctaagttttgttagcttgtttggttgtgtcttgcttttgttagccactat

SEQ ID NO: 3483 - DNA, 2057 bp, Cocos nucifera
tttttgcttctgattacatgcccttccaatgggttctatctccccgggagttatatgcacacctactctgaaggtgaacctatctcagtcaaagtgaattcactcacctctatcgagacggagctgccatttagctactatggtcttccctattgccaaccaaaggatggaatcaagaagagtgcagagaatctgggagagcttctcatgggggatcagatcgacaattctccgtacaggttccgtgtgaatgtcaatgaatcactttatctttgcacgacaaagccattaactgagcttgaggtgaagctgttgaagcaaagatctcgcgatctctatcaagtgaacatgattcttgacaatctgcctgtaatgaggtacactcagcaaaatggtgtcaccattcagtggactggttttccggttggatacacccccattggaagcaatgatgactatataatcaatcacctcaagtttaaggtcttggtccatgagtacgaagggagtggtgtagaaatcattggcacaggggaagaggggatggggatgccctcagagaccgataagaagaagatgtctgggtacgagatagttgggtttgaagtaatcccgtgcagtgttaagcgtgatgcagaaaggatgtcgaagcataacatgtatgaccaaatcgagcccgtgaattgccccttggagctcgacaagtgtcaggtgatcaaggagcaggagaggatcacattcacctatgaagtagagtttgtgaagagcgacattagatggccctcacggtgggatgcctatttgaagatggatggtgccaaggtccattggttctcaatcatgaattcccttatggtaatcttctttttggctggaatagtgtttgttattttcttgagaacggttcgaagggacttgacgagggatgaggaattggataaagaggcccaggctcagatgaatgaggagctctcaggctggaaacttgttgtgggggatgtgtttagggagccaacctgctctgaactgctttgtgtcatggttggagatggtgttcagattacatgtatggcagtcgtgacaattgtttttgctgcgctggggttcatgtctcccgcatcacggggcatgctcttgacagggatgatactcctttatctcttccttggtatttttgctgggtatgttggtgtccggctatggagtaccatcaaaggtgggtctgaaggatggagatcggttgcttggttgattgcctgcttctttcctgggatcgtgtttatggttctcaccttcttaaacttcttgctctggtggaacaagagcacaggagctcttccaatctcattgtacttcactcttctatctctgtggttttgcatctcagtgccactcactcttttagggggtttctttggtacccgggctgaacctatacaattcccagtcaggaccaaccaaattccaagggaaattccagcaaggaaatacccttcatggttgcttgtccttggtgctggaacccttccttttgggaccctcttcattgagttattctttatcctctccagcatctggcttgggaggttctattatgtgttcggatttctactcatcgtcctcctattgcttgttattgtctgtgctgaagtgtctgtggttctgacttacatgcatctctgtgtggaagattggaggtggtggtggaaagcattctttgcttctggttcggttgctctttatgtgttcctatactccatcaactacttggtgtttgatcttaagagcttaagtgggcctgtgtcagctatgctttacctggggtattcgcttatcatggctgttgctatcatgctatctactggcaccatcggcttcctgatgtcgttctactttgttcactacctcttctcatctgtgaagattgactagaggattgcttctttaaggtgcaatagtctcttgcattcgtttgagatgtttcttgatggattttggatctatatcactcaggattccatatatgtttaagatttttatactgatgaccaggtgca

SEQ ID NO: 3484 - DNA, 2252 bp, Allium cepa
ggttaccgaagttatttccagatcgataaagttacagtcttatgctgccattttaaatctcatgagttcgattgatgcctgaagtctcctgcgatctgctcaattattttgattcataaaaggatataaccacaaggttgacatatccattatggggagagcaatatctttaatatcatcagcttacttcctcctcctcctcctatttacattgccaagcaatgcattttacctacctggaagttatatgcatacatattccaaagatgataaaatatcagctaaagtaaactctctcacctcaattgaaacggaacttccttttgactactacagccttccatactgccaaccccaaggtggagtcaagaaaagcgctgaaaacttgggagaacttttaatgggagatcaaatcgataattctccatacaggttccgtatgaatgtcaatgaatcagtttacctctgcactacacaccctttaaacgagaacgaagtgaagcttctgaaacaaagaacccgtgatctttaccaggtaaatttgattctagacaacctacctgccatgagattcaccacccaaaatggagttactattcaatggactggattccctgtagggtataccccaaacaccgaaagcaatgatgattacatcatcaatcacttgaaattcaaggtccttatccacgaatacgaaggaagcggcatgcaaattcttggcaccggggaagaaggtttggctgttgtttcagaagtcgataaaactaaaaagtctggttacgagatagtaggattcgaagttgtgccttgtagtgttaaaagagaccctgaagctatgtcaaaacttaacatgtacgacaacatcgaccctatcaactgccctttagagctcgacaagtgtcagttgatccgtgaacatgcgagggtaacgttcacgtatgaagttgagtttgtgaagagcgatataaaatggccttccagatgggatgcttacttgaaaatggagggtgcaagagtgcattggttttcaatcatgaactctctaatggtcatcttcttcctagctggaatagtgtttgttatctttttaaggacagtgcgtagggatttgactagatatgaggagttggacaaagaagcgcaagcacagatgaatgaagaactctcaggatggaagcttgttgtaggagatgtgttccgtgaacctgagcactcgaagttactttgtgttatgataggcgatggaattcaaattttggggatggcactagtgaccatagtgtttgctgccctagggtttatgtcacctgcatctagaggcatgttactgactggcatgataattttgtaccttttccttggtatctttgctggttattttggggtcagggcatggataaccataaagcaaagctcggaaggatggagaggggtagcatggtcaactgcatgtttcttccccgggatagtatttgttatcttgacaatactgaacttcatcctatggggaagcaaaagcaccggggctatccctatctcactttacttcatactaatctctctctggttttgcatatcggtgcccttaaccttgctaggggggttcataggaacacaagcggagcccataaaattcccagtccgtaccaatcaaatccctagagaaatccctgcccgaaagtacccttcatggcttctagtcctagggtcaggtaccctgccttttgggacgctgttcattgaactgtttttcatactatcgagcatttggctgggaagattctactatgttttcgggtttctattcgtggttttgatgctgcttataacggtgtgtgctgaagtgtcggtggtgctgacatacatgcacttgtgcgtggaggattggaggtggtggtggaaggctttctttgcttctggctctgttgctttgtatgtctttctgtactccatcaactacttggtttttgaccttaggagcttgagtggccctgtctctgctatactgtatatcgggtattcgctcattatgtctttggctgttatgctgagcacgggaactgttgggtttcttgtctctttctacttcgtgcactatcttttctcttccgtgaagatcgattaggatgatctttctcccctcttttttgttggttttacactattatgttatgcggttaaagatgtaatttgaaatttgttgcaagaaactttgctggattttattttctattaactatattttgttg

SEQ ID NO: 3485 - DNA, 2483 bp, Malus domestica
gattaatcggtgaatgcatctgtaagacttagcttagatccactgctcactccaacttgtggtgagtgttgtgtttttttgggttctgatggcgatattgaatccgggaatgctctcaatcaaatgggctctgctcgttttggttgtttttgtgcacacctgtaatgggttttatctccccggaagctacatgcatacatatgcgaaggggcaagaaatcactacaaaagttaactccttgacttctatagagactgagctgcccttcagctactacagtctcccttattgcaaaccccctgaaggcatcaagaaaagtgctgagaatctcggggaacttcttatgggagatgagatcgagaactctgcataccgctttaacatgaacgtgaatgagactcgttacctgtgtaccacagatcctttgaccgagcacgacgtaaagctgctgaaacagagaacccgtgatctgtatcaggtaaatatgatccttgataatttgcccgcaatgagatatgcttatcaaaatggggttaagattcagtggactgggtttcctgttgggtacacatcacctaacagtaaagaagattacatcatcaatcacctcaagttcagggttatgattcacgagtatgaagggagtggtgtgcagataattgggactggggaagaaggcatgggtgtcatttcggaagctgataagaagaaggcatctgggtttgagattgttggctttgaggtttacccttgtagcattaaatacgacccagaggccatgaagaaaaaagctatgtatgaaaatatcaaacctgtaagttgccccgcagagctcgaaaaggctcaaataataaggcagcaagagaaagtatcatttacttatgaggttgagtttgtgaaaagtgatacaagatggccatcaaggtgggatgcttatctgaagatggagggtgctcgtgtgcactggttctctattctgaattcattaatggtgatctttttcctagctggtatagtttttgtcatattcctaaggacggtgaggagggatttaacaagatacgaagaactcgacaaagaatctcaagctcagatgaatgaggagctctctgggtggaagcttgttgtgggagatgtgttcagagaaccagattctccaaagcttctttgcgtgatggttggggatggagttcagattactgggatggcagttgtcacaatcatctttgcagcatttggtttcatgtcaccagcttcacgaggaatgctactgacaggaatgatcattctatatctcttccttgggattattgctggttatgttgctgtccgtatgtggagaaccataaagggaacttctgaagggtggagatcggtttcctggtttgtggcatgtttctttcctggaatcgtctttgtgattcttacaatactgaatttcattctatggggcagcaagagtactggtgctcttcccatttctttgtattttatactcatctccctctggttctgcatttccgttcctctcacccttctcggaggattcttaggcgcacgagctgagccaatttcatatcccgtgagaaccaaccagattccaagggagattcctgcgcgcaaatatccatcatggcttcttgttcttggtgctgggacacttccgtttggaacccttttcattgaactcttcttcatcctttctagcatctggcttggaaggttttattatgtcttcggtttcctttttatagtgcttacgttgttggttatcgtttgtgctgaagtttcagtagttctcacatacatgcatctttgtgtggaggattggaggtggtggtggaaggctttctttgcctcaggttcagtttccttttacgtgttcctgtactccatcaattacctggtatttgacctgcagagtttgagtgggcctgtgtcggctatcctttacctcggttattcattgatcatggcaactgcaatcatgttgtcaactggcaccattggctttctcatgtctttctactttgttcattacctcttctcatccgtaaagatcgactagaaaagtgttggctggcattgtattcaaacagttgggaaatgtgaggctgctatatgtaggaggaagaagtgcttttgttaaatcattttagcctttacacttggttgcatccgaaagctgatggtgttgcggtatctcttgcggctctccgatgatagtgcatgaagacctttgttttctgcgtgctgtcctcgtttgcgacgtcaccagcggcagttctccgtttacccctcatccccattttgctttactgcttcactagtgttgcgcttttactttatatcatattgtttgtgttagaaattgtaattcgtggaccttcaatccttgtattctcttctatttcgtatttgaaaggaaaggtaaattggataattcttttaattctcaacagcttgattttttttgctggtaa

SEQ ID NO: 3486 - DNA, 2580 bp, Chelidonium majus
aaaaaacgttggagtttttcacaccctttacattatattttcagtttttagagagagagagagagtttgattcttccgtttgatcttcaccgaagaattcctgtgagctattatccgatcggattataactgcatttgatctgaattcacctgaaattggaagttgaattatcattatctggcagttttgtcatctgacattggatatgtctttgagtatctcttagatccaaggaaataccggggaaatcgatatctgttcctcttccaatggccttgttagagaaactttcttcaatccattcgtgttgtctcgttgttgttttattggcttgtgtatgcaatgggttttatttgcctggaagttacatgcacacatacaaaaatggagaaaacatatttgcgaaagttaattccttgacgtccattgaaacagagcttccttttagttattacagtcttccttactgcaaacctaaggaaggtgttaagaagagtgcagagaatttgggagaactccttatgggagatcagattgataactccccgtaccgttttagaatgaatgttaacgagtcgctttatctctgcacaacgagcccactaaacgagaatgaggtaaagctcttgaaacagagaacccgtgatctatatcaggtgaatatgatccttgataatttacctgcaataaggtatgccgagcaaaatgggattaacattcagtggacagggtatcctgttggttacgccccactcaaagtaatgatgattacattataaatcatctgaaatttaagattttgattcacgagtatgaaggaactgggggtggagttactcggtactggggatgagaacatggctgtagttacagaacctgacaagaaaaaaggaatttgagatagttgggtttgaggttgtcccctgcagtgtgaaacgtgatcctgaggcgatgttaaagctcaagatgtatgatccaattgatccagtgaactgccctgttgatctcgacaagtcacagataatcagggagcaagtacggatcacatttacttatgaggttgaatttgagagaagtgatatcagatggccttctcgatgggatgcttacttgaggatggagggtgcacgtgtgcattggttctcaatcctgaactcgctcatggtgatcttctttttagctggcattgtctttgttatattcttaaggacagtgagaagagatttaacaaggtacgaggagctggacaaagaagctcaagcacaaatgaacgaggagctttcagggtggaagcttgtcgtcggtgatgtctttagagagccaaattgcccaaaactgttgtgcgtgatggttggagatgggacccagattttagggatggccgttgttaccattgtttttgccgctcttggtttcatgtcaccagcttctcgaggaatgctcctgactggtatgattattctgtatcttttccttggcattatagcgggttatgttggtgttcggctatggataactatcaagggaacttcggaaggtggaggtcaattcctggtccgtttcgtgtttctttcccggaatagtattcgtaattctcactgccttgaacttcatactttggggcagcaagagcactggtgctatccctatctcactgtattttatactcttgtccctttggttctgcatttctgttcctctaaccctcttcggaggctattttgggacaaaggcagagcccattaaattccctgtgcgaaccaaccagatccctagagaaattcctgctcgaaaatacccatcatggcttcttgtacttggtgctgggactctccccttcggaaccctcttcattgaactctttttcatcctttctagtatctggcttgggagattctattacgtatttggcttcttgctcgttgtcttcgtcttgctggttgtcgtatgtgctgaagtctctgttgtccttacctacatgcatctctgtgtggaggattggcagtggtggtggaaagctttctttgcctctggttcagttgcactctacgtgttcctgtactccatcaattacctgatattcgatctcaggagtttgagtgggcccgtctcagctatgctctacctcggttattcattgatcatggcaattgctgtcatgttgtctacaggcacaattggtttccttgtttccttctatttcgttcactaccttttctcatctgtcaaaattgactagaagatattggaaactctaaaaatattggaaactctaaaaatacatttgaagatgaaaatccgccatcccctccaattttttcgctcatttctaacaatcgtgccttttcgttctgtttagtgttgcagcaaagattttgagttttcaaaacctatagctgattatcctggtaaactgctagtattggaaaattaaatcaagatcatcatggctttcagatgattccaccatctttcatgcttcatggggttggaggtccctagtttctctgtagctctacaattagtttttatttggctcatctatctcatttgattctgcaaagccttttttgaactac

SEQ ID NO: 3487 - DNA, 2469 bp, Amaranthus tuberculatus
tgtttcacctcatcgagatctactcagattagatcggggtaaacaatattcaagatcaagttgtttcactggttttgcattgcaatggctttttctatgaaaaggacgttgcaaatcgatcgggttttcgtgtgcctcttcctcttctcttatgtttgtaatgggttttatttgcctgggacttatatgcactcctactctgttcaagatgaaatatatgcgaaagttaattcgctaacctccatcgagaccgagcttccctttagctattacagtcttccttattgtaagccacatgacggtgtcaagaaaagtgctgaaaatcttggggagcttctcatgggagatcagattgataactctccctaccgttttcgaatgaatgttaacgagtctattttcttgtgtataactagtcctcttagtgagcaggaggtgaaacttttgaaacagagaactagagatttgtatcaggttaacatgatgttggataatctccctgcaatgagatatgcaacccaaaatggtgttaagattcaatggaccgggtttccaattggttactctccacctaatagtaatgatgattacattattaatcatctcaagtttagggttttgattcatgagtatgaagggaacactgtggagatcattggtacaggggaggaaggtatgggagtgatctctgaagctgacaagaagaaaacttctggttatgagattgttggttttgaggtgattccctgcagtgttaagcgtgaccctgatgaaatgtcaaaacttcacatgtatgataatataaatttaattaactgcccgatggagctggacaagtcacaaatcataagagagcgagagagagttgcgtttacttacgaggttgagtttgtcaagagtaataccagatggccatctagatgggatgcatacctgaaaatggaaggtgcacgagtgcattggttttctatattgaattcgcttatggtgatctttttcttggctggtattgtgtttgttatatttttgaggaccgtaagaagagatttgaccaggtatgaggaattggacaaagaagctcaagcacagatgaatgaggagctgtcaggatggaagcttgttgtgggtgatgtctttagagaacccgaacactctaagctattatgtgtgatggtcggagatggtgtccagattacaggaatggccgtcgtgactattgtttttgcagctcttggtttcatgtcaccagcatctaggggaatgctattgacagggatggttattatctatcttttgctggggactgttgctggctatgctggtgtatatttatggaagactatcaagggaacaccagacggttggaggtcagttgcctggtggaatgcatgctttttccctggtattgtctttgtgatcctcacattcctgaatttccttttatggggaagcaagagtacaggcgctataccaatctctttgtattttatccttctctctctctggttttgcatttctgtgccgctcactctcttcggaggctttcttgcaacacgagctgagcctattcagtatccagtccgaaccaatcagatccccagagaaattcctgcacgaaaatacccttcatggttgctcgttttgggagccggtacccttccgtttggcactctgtttattgaactgttcttcattttgtccagcatatggctggggaggttctactatgtctttggcttcttatttgtggtattggtattacttgtgatcgtttgcgctgaggtctctgttgtcctgacttacatgcatctttgcgttgaagattggcgatggtggtggaaagcattttttgcttccggttctgttgctgtctacgtcttcctttactccattaactacttagtttttgacctccagagtctcagtggacctgtttcagccattctctatctgggctattccttgataatggcagtcgcgattatgttatcaactggcaccattggtttccttatgtccttttacttcgtccattatctgttctcatcagtaaagattgattaaatacacgcatgatggttgctacgctcatggcattgtctgcaagacccaagagaagattgtattggttagtattcttaaattcatcaaatactcgttattggacctgtcgccctagttggaggatgataatattttgcagcgtctggagacctgatcaagcttggtatcatgctcttagttttgtaatcttgtcctccttttccttttctttttcccctttgaattcttatgatgcactggatatctttttaaaaacaattagtattggcttgcattctctttagatgtcgtttatatggcagtttccatagacagagttgtaatccatcggacatgtttttcattcattaaatgtcaaaccaaatgtatggtttcattcacatgcagtcttatctttttcaagtt

SEQ ID NO: 3488 - DNA, 2394 bp, Cucumis sativus
attgccgcatttctttcagtttccaatggcctcctccagttcgaggaagccctcaatctgtcgggttttacttgtatttcttgttcttgcctatcattgcgatgccttctatcttcccggaagctacatgaatgtttactcctctgaggatcctatatttgcaaaggttaattccttaacttccattgaaaccgagcttcccttcaactattacagtctcccctattgcaaaccaccgggtggtgtcaagaaaagtgcagagaatctaggggagttgcttatgggtgatcagatcgacaactctccttatcgttttcgtatgaatgtaaatgaaacagtctacctctgtactaccgagcctttgaatgaggatcaagtgaaacttttgaaacacagaacccgtgatctctatcaggtaaacatgatacttgataatttacctgccatgagatttactgaacaaaatggagttaaaatccagtggactgggtttccggttgggtatacaccatcaaatagtgaggatgattatattatcaatcatctaaagttcacagtcttggttcatgagtatgaagggagtggcgtggaaataattggcactggggaagaaggtatgggtgtgattacgcaaactgaacggaagaagtcttctggttttgagattgttggatttcaggtgcaaccttgtagtattaaacatgatcctgaagtgatgaaaaagtatcagatgcttgaaaatatcacaggtgtagactgtccgaaagaacttgataagtcccagatcatcagggagaaagagcaagtgtcattcacttatgaagtgcagtttatcaaaagtgatatacggtggccatcaagatgggatgcatatttgagaatggagggttccaaagtacactggttctccattttgaattctctaatggtaatcttcttcctagcaggcatagtttttgtcatattcttaaggactgtgagaagagatttgacaaggtatgaggagttggacaaagaatctcaagcgcagatgaacgaggagctctcaggatggaaacttgtggttggggatgtgttcagggaacccgattgttcgaagctgctctgtgtgatggttggtgatggggttcaaattttggggatggcagttgttactgttgtttgtacagcatttggcttcatgtcaccagcttcaagaggaatgctattgacagggatgattattctttatcttttccttgggattattgcaggttatgttggtgtacgagcatggagaaccattaaaggaacgtcagaagggtggaggtcggtttcctggtcggttgcttgcttctttcctgggattgtctttgtcattcttaccatactgaacttcatactttggagtagcaagagtactggtgccattcccatctcactatattttgaactcttggctctctggttttgcatatctgtgccactcaccctgcttggaggattctttggcacacgagcagaggaaattcagtttccagttagaactaaccagattcctagggaaatccctgctcgaaagtatccatcttggcttctcattcttggagctgggacccttccctttggaacccttttcatcgaactcttctttatcctttctagcatctggcttggaagattttattatgtttttggtttcctactgatagttctgtctttattggttattgtgtgtgctgaagtatcagtcgtccttacctacatgcatctctgtgtggaagattggcgatggtggtggaaggctttctttgcttctggttccgttgctctttatgtcttcctttattccatccactacttggtctttgagctgcagagtttgagcggcccgatctcagctattctttatctcggttattcattgatcatggcaacggctattatgttatcaacaggcaccatcggcttcttaatgtctttctactttgttcactacctattttcatcagtaaagatagattagaaacagccaaggagcggatgattttcggtaacattttggttgttagtgaattgtctgatacttcttttctttcttttgagcttagcaagtttcttaggcaaatagtctttggagctgttacattatatatggagtgaagtgagagatgatgggatagttattgctagttacatgaatccccaacctatgtttagaatgcaaatctccaccacctccgtcccaccaatacaaaatcccatgaaaaaaagaaaaagaaagatttgtcttggtttcttaatgtcattgatcaagttttgattcagcgcttccatttttgtataccatttcattgtatttctttaaaagaaagaccaattgtgctttctctattgatattttccatgttattc

SEQ ID NO: 3489 - DNA, 2447 bp, Centaurea maculosa
acacattataaaaaaagtagatcggatctaaacactccaaatcccttcttctctctgtttataatttcatcaatcctcttcttcttcttcattaaaccctaaccacctcatccaccgccattgttttccactccactttccagatctacatatggttttgtaataagattgactgcttcgatcagtggctaacaggttgagtgactcttcagagaatctgtttggtgttccttaagaccaatggctttgtcattgatctcaagaggaacttgctggcttcttttcgtttatgcgatttttgtctcgcatccttgcaatgggttctatttgcctggaagctacatgcatacgtattcaacacgcgatgaaatatacgccaaagttaattctctgacatcaattgagacggaacttccctttagttattacagtctaccatactgcaaaccttctgggggaataaagaaaagtgcagagaatcttggagaattacttatgggagaccaaatcgataattccccctatcgtttccggatgaatgtcaatgaatccgccttcctatgcacaacgcatccgttaaacgagcatgaggttaagcttttaaagcaaagaactcgtgatttgtatcaagttaatatgattttggataacttgcctgcaatgaggtttgccaaccagaatggacttaaagttcagtggaccgggttccctgttggatacacccctcccaacagcgatgatgattacatcatcaatcacctaaagttcaaggtctttgtgcacgagtacgaaggcacaggggtgcagatatttggcacgggagaagaaggtatgggtgtgatatcggcagccgaagatgagaagaaagcttccgggtatgagattgttgggtttgaggtttcccatgcagtgttaagtacgaacctgaaaagatggctaaactccatcaatacgatgaagtgccatccgtgaactgcccgctggacttggacaaatctcaaattataagggaacaagagagaatctcttttacctatgaggttgaattcgtgaagagtgatatcaaatggccatctcgttgggacgcttatctcaagatggaaggtgctcgtgtccactggttctccattctcaattcgttgatggtgatcttctttttggctggtattgtttttgttatcttcttaagaacggttagaagggatctcacccgttatgaggaacttgacaaagaatctcaagcacaaatgaacgaagaactgtcaggatggaaacttgttgtcggtgatgtgtttcgtgaaccaagtcactccaaacttctatgtgtcatgataggagatggggttcagatcacaggaatggctgtggtcacgatcgtattcgctgccttaggttttatgtcacccgcttcacgaggtatgcttttaaccggaatgatcatactttatctgttcttaggaaccggagctggttatgctggtgtatttctatggcgtatcatcaagggtacatctgaaggatggagatctgtttcttggtccatcgcttgcttcttccctgggatcgttttcatcattctgaccgtcttaaatttcattctttggggaagtaaaagcaccggtgccattcccatttctttgtacttcataattttatcactctggttttgcatctcggtcccactcaccctcttgggaggatacttaggtactcgatccgagccatggcagtatccggttcgaaccaaccagatcgctagggaaatccctgcaagaaaatatccttcgtggctgctagttctcggtgccggaacccttcctttcggaaccctctttatcgagctctttttcatcctttctagcatctggctcggaagattctattacgtatttgggtttttgcttgtcgttcttctgttgttggtcgttgtttgtgcggaagtttccgtagttctgacctacatgcatctttgtgtcgaagactggcagtggtggtggaaagcgttttatgcttcaggctcggtttcgctctatgtgtttctgtattctataaactatttggtgtttgaactgcagagtttaagcggtccagtgtcggctgtactctatcttggttactcgttgatcatagcggttgcgatcatgctggctaccggcaccattggcttgatcacatccttctgttttgttcactatcttttttcatcggtcaagatcgattagaacgagtccttaattcaggtttcttatcgaccgttcgaagagacagaattcgtcatttctttacggacacatagttgatcacttgttaaattttagagatttcagcagcattatatcatctatcttgtttgttatgtgccttcttattacaattacaatctgtatgtttcacattgaggagaaatgcagtttcaatggctgctatatatggtattgttccagttt

SEQ ID NO: 3490 - DNA, 3029 bp, Papaver somniferum
tagaaaggggctacaaaaacgtagagcttttccattccttttcagttccttcagaattcagtttccaagttatattagattttcacattgtgctctcctcttcaaaattcagttcataagaagattttgtggaatcacctggaaacgggatatcatcatttgtcaacctatcggatctgaagatcttggactatttagtggagaagcttattttgtttcgcggatctgtactggaaagcatatctggaacaattcgataggtgatttgattactgtgaagtctgttttcaagagattagtaaattctaagcaacttatatttttttgttaggagtttactcaagttggatattgaagcagctaacatggtctggcttttgatttcatttctattagtgatccagatctggcattttttatgataatgcacttgaatctctgttagacctaggaactctttttatcttcttacaatggctgttcaaaggaaatttcttcaacccatttctgtgcactcattattattctgttggcgagtgtgtgcaatgggttttatctgcctggcagttatatgcacacatacacaccaggagaatcgatatttggaaaagtgaattctttgacttcaatagaaacagagcttcctttcagctattacagtcttccttactgcaagcctgagggagggattaagaagagtgcagaaaatttgggggaactccttatgggagatcaaattgataactccccttatcggttcaatatgaataggaatgagtcgctttacctatgcacaaccaacccgttaaatgagaacgaggtaaagctcctaaaacagcgaactcgtgatctgtaccaggtgaatatgatcctcgacaatttgcctgcaatgaggtatgccaagcaaaatgggatcaacattcaatggacagggtaccctgttggttatgctccacctcaaagtagtgaagactatattgtaaatcatttgaaatttaaggttttggttcatgagtacgaaggaacaggtgtgcaggtacttggtactggagatgaaaccatggctgtggttcaagaatctgaaaagaagttaaatgggtatgagatagttgggttcgaagttgttccttgcagtgtgaaacgtgaccctgaggcgatgtcaaagctgaagatgtacgacactgttgaccctgtcaactgccctgttgatcttgaaaaatctcagattatcagggaacaagagcgagtttcatttacttatgaagttgaatttgtgaaaagtgatattagatggccttcacgatgggatgcttacttgaagatggagggtgcacgggtgcactggttctcaatcatgaactcgttgatggtaatcttctttttggctgggatcgtctttgttatttttctaaggacagtgaggagggatttgacgaggtacgaggaattggacaaagaagcgcaagcccagatgaatgaggagctttctgggtggaagcttgtcgtgggtgatgtttttagagagccaaattgctcaaagctactctgcgtgatggttggagatggtacccagattttggggatggcagttgttactattgtgtttgcagctcttggattcatgtcaccagcatctcgaggaatgctcttgactggaatgataattctgtatcttttccttggtctagttgcgggttatgttggtgttagactatggataactatcaagggaactacagaagggtggagatcagtttcctggtcggtttcgtgcttcttccctggaattgttttcataattcttactgccttgaacttcatactttggggcagcaagagcactggtgctattcccatttccttgtattttattctcatttctctttggttctgtatttctgttcctctaacccttttaggaggctactttgggacaaaggcggagcccatccagtaccctgtgagaaccaaccagatccctagagaaatccctgtgcgaaaatacccatcatggcttctcgtacttggtgctggcaccctccccttcggaaccctcttcatcgaactgtttttcattctttctagcatctggcttgggaggttctactatgtatttgggttcttgctagttgtcttcgtcctgcttgtcgttgtttgtgccgaagtttctgttgtccttacctacatgcacctctgtgtggaggattggcagtggtggtggaaagctttctatgcctctggttcagtctcactctacgtgttcatgtactccatcaattaccttatatttgaccttaggagtttgagcgggcctgtgtcagctatgctttacctaggttattcattgatcatggcaatcgcaatcatgttgtctactggcacaataggtttccttatttccttctacttcgttcattacctattctcatctgtcaaaattgactagggagatactgaaaacatcaaataccaataaagagataatcaccacttctcatatttttttaccctcatctctgtattagttgtgcatctctttctttctatctggtgcagcaaaggtttataggattccaaaagcctgtagcttttcggtcatggtgaattgagaactggtgttcatggtaaggtatgtcaaggttgcagcttgattttaccatcttctttcatgcttgctgaggttggagatctttagttactctgtagcgtttttctctttctccccttagttggttaagttttggttcttctgggccatccttcagaccatagatatatataaccttgttgtttaagcagattcttacaaacattgttatttggaaaatttgtcactctagctttctgttgtctgtttactgatttgtcagattgaattttgtaatgagattttgagttccaggtctttcttagtcacatttgattaaaaacagcaaataaagttgtaccttcttatttagtgtaattgtcagtaccttctagggctgcacaactgtcggttcggtttttagcaaaaccaattactgaaa

SEQ ID NO: 3491 - DNA, 2696 bp, Eucalyptus grandis
gggatgcttcatgtgcagtcaacatctcacagctttttccggtataaagtaggagacgattcggccattcggggggggagggatcgagtgcgttggcgtcgctgccgaggttccagaggagaagaagaggaggcttcgggtttccttttccgcgattcgcatgcgctttcgggggagcgctgaggagcggatctgatcggcctgaattggatccagatctgaggaaagatgtccagatccgggatgcactcgatatgcaaatggcgtctgcctttgctgttggctctgttggcccacgtttgtagtgggttctatcttccaggaagctacatgcacacgtactccactcatgataagatattcgccaaagtcaattctttgacatctatcgagaccgaacttccctttagctactacagtctcccttactgccaaccaccagaaggcgttaagaagagtgcggagaatcttggtgagctgctcatgggggatcaaatcgataactccccctatcgcttccaaatgaatatcaacgagacggtgtacctctgcactacggtggcactgaaggatcatcaagtgaagcttcttaagcagaggactcgggatttgtatcaagtcaacatgatccttgacaatttgccggcgttgaggtatgccaagcagaacaatgtcaacattcagtggactggttttccagttgggtacacgccacagggcagcaatgaggattacattattaatcacctcaaatttagggtcttggttcatgagtacgaaggtagtggagtggagatcataggaactggtgaagagggtcttggtgtaatctctgaagctgatgataagaagaaggcttcgggttttgagatagttaagtttgaggtcattccttgcagtgttaaatttgaccccgacaagatgtcaaagcacaaaatgtatgaccgaatcgatccagttacctgcccggcggagtatgacaagtcacaaataattagggagcaagagcgagtgtcattcacctatgaagttgaatttgtgaagagcgacattagatggccatcacgatgggatgcttatttacaaatggaaggtgcaaaagtacactggttttccatcctcaactcattgatggtgatctttttcttagctggtattgtctttgtgatattcttgcggacagtgagaagggatctcacaaggtatgaggaattggacaaagaagctcaagcacagatgaatgaggaactttctggctggaagcttgtcgtgggcgatgtcttcagagaaccagagtgtgcaaagcttctttgtgtgatgattggagatggggttcaaattactggaatggcagttgtcaccattgtctttgctgcttttggctttatgtcgcctgcttcacgaggaatgctcttgactgggatgataatcctctatctattccttggaatttttgctggatatgttggtgtccgcttgtggagaactctcaagggaacttcagaaggatggaggtctgtctcctggtcagttgcttgttttttccctgggattgtcttcataattcttacggtactcaatttcttactttggggaagcaacagtaccagcgctattcccatatccttgtacttcatcctgttcgccctttggttttgcatctccgtgccactcaccctattgggaggatttctaggtacacgtgctgaggcaattcaatatcctgttcgtaccaaccagatccccagagaaattcctgcacgcagatatccctcgtggcttcttgttctgggcgcagggacacttccatttggaaccctcttcatcgaactgttctttatcctctctagcatctggcttgggaggttttattacgtctttggcttcctgctaatcgtgctcttattgctgatcgttgtctgtgctgaagtctctgtggtccttacctacatgcatctttgtgtagaggactggcgatggtggtggaaagctttctatgcttctggcacggtcgccctttatgtgttcctatattccatcaactacttgatttttgaccttcagagtttgagtggacctgtgtcagccatgctttaccttggttattctctgataatggcaactgcaatcatgttgtccactggcaccattggcttcctcacgtctttctattttgttcattaccttttctcatcggtgaagattgattagagattttcacctttcctgtcgtcccaaaagaaagaaaacggaaaccacttttcatgaagtctacgagctagctggaatctctgcctctggtttgtagaatgttttcttggtccttgcttttggctttctccgagtatcattttgtggccaaccatgctgcactggatagagaggcgcatgctattgctgatattatccacgccttaaataatatctgagctccgtgaggttagaggttttgatgtcgttatagtttctcaaaattgttataggctgttggatcattctaaactttttgttcatgggttttagttcatgtcagcgaatattattatagtcaatggacagtttatttcatattatggatgtttgatgttgtcttggcaagcatgtcagattcgatatctactcaattcaataaggcagtaatcgattcacattgttgttcatatgtctaataaatcatctgatggtttgcccactca

SEQ ID NO: 3492 - DNA, 2295 bp, Castanea mollissima
agccttgtagctgtaactcacacacagatccaccatcactgtttctaagatctgggtcttttcagtttcgcaatggctttatcaaagccattcttgaaatgggttttcgtgtgtttggttattctctttgcacatactacttgcaatgcgttttaccttcctgggagctatatgcacacttattcacctcgggaacccatatttgccaaagtcaattccttgacttccattgaaaccgagcttcctttcagctactatagtctcccttactgcgaaccccaagagggtgtcaagaaaagtgctgagaatctcggcgagcttctcatgggagatcagatcgataactccccgtaccgtttccgaatgaatgttaatgaaacagtttacttgtgtactaccgaccgttgaaggagaatgaggttaagctcttgaaacagagaacccgtgatttgtatcaagtgaatatgattcttgataacttgcctgccatgaggtactctaggcaaaatgatgtgagcattcagtggactgggtatcctgtcgggttcactcaaaataataatgacgattacatcattaatcatctcaagttcaaggttttggttcacgagtatgaagggagtggtgtggagatcattgggactggggaagaaggtatgggggtgatttcgactgatgccgataagaaaaaggcgtccgggtttgaaattgttggttttgaggttgtcccttgcagtgttaagcatgatcccgaagccctgtcgaaacgtaaaatgtatgacaatattggcgctgtgacctgcccttctgagcttgacaagtctcagataatacgggagcaagagaaggtgtcattcacctatgacgttgaatttgtgaaaagcgatataagatggccatcgagatgggatgcttatttgaagatggagggtgcccgagtccactggttctctatcttgaattcagtaatggttatctttttcctggctggtatagtttttgttatattcttgaggacagtgagaagggatctaacaaggtatgaggaattggacaaagaatctcaagctcagatgaatgaggagctctctgggtggaagcttgttgtgggtgacgtcttcagagaaccaaattgccccaagctactttgcgtgatggtcggtgatggggttcagattttagggatggcaattgtcactattgtttttgcagcttttggtttcttgtcaccagcttcgcggggaatgttacttactggaatgattgttctgtatcttttccttggaattgctgctggttatgttggtgtacgcctctggagaaccttgaagggaacttcagaaggttggaagtctgtttcctggtcggtggcatgcttcttttctggaattgtctttgccatcctcacagcattgaatttcattctgtggggcagcaagagtactggtgccattcccatttccttgtactttttgctgctgttcctctggttctgcgtttcagtgccacttaccctcctgggaggattgcttgggacacgagctgaggcaattcagtaccctgtgcgaaccaaccagatccctagggaaattcctgcacgcaaatatccatcatggcttcttgttcttggtgccgggaccctgccatttggaaccctctttatcgagctattctttattcttactagcatctggcttggcaggttttattatgtctttgggttcctgctgattgttcttctattgctagttattgtttgtgctgaagtgtcagtggtcctcacttacatgcatctatgtgtggaggattggcagtggtggtggaaagctttctttgcttcaggttcagttgccctttacgtgttcctgtactccatcaattacttggtttttgacctgaaaagtttgagtgggcctgtgtcagccattctatatctcggctattcactgatcatggcatttgcaatcatgttggcaactggcaccattggcttccttatgtctttctactttgttcattacttattctcatccgtaaagattgattaaaaagtgatagctggtattcttcatcaaccagttggagaaggctctggtatgtaggaagaggaaagtaattttctcggataatctttttggtgtttacttgtctgaggctgactgttcacagctcatattaagaggctctcagatggtttgatgatgctatcaaagcctgttatattttctatgcatcttgagtttagagaacagcaaagttgtaatccccccttttctctctttgttgtcctttttt

SEQ ID NO: 3493 - DNA, 2465 bp, Avena sativa
tcacacatgttctaggccgattggtgagaatttgtgcttcagatggctggggcgttgcatagctctcgtggtctggccctgttattgttggttgggctgttgctgactgctccaggcaatgcattctacttgcctggcagctacatgcacacatattcccaaggtgaggatatatgggcaaaggtcaattcactcacgtccattgagaccgagatgccgttcagctactacagtctaccatattgccgtccccctggtggcatcaaaaagagtgccgagaacctgggtgagcttctcatgggtgaccagatcgacaactcgccctaccggttcagtgtgaatgttaacgagtccctcttcctctgcaccacgaaagggcttaatgagaatgatgcaaagcttctcaagcagcgggcccgtgatctttatcaggttaacatgatgctggacaatctgccggtcatgcgttttgctgagcagaatggtgtcacagtacagtggactggctttcctgttggttacactcctgctggtagttctgatgattatatcatcaaccacttaaagtttaaggtcttggtccatgagtacgaaggttcaaatgtggaaatcatcggtactggagaagaaggatcttctgtcatcccagagacggacaagaaggggatgtatgggtatcagatagttggttttgaggttgttccttgcagtgtgaagcatgatgccgaggctttctctaagctaaacatgcatgacaagattgacccggtgagctgcccaatggagcttcggaagtctcaagtgatcaggcaacaagagaggattacatttacatacgatgttgagtttgtgaagagtgacatcaggtggccatctaggtgggatgcttatctgaagatggaggctggcgccaatgtccactggttctctataatgaactccctcatggtcatcttgttcttggcaggaattgtctttattatattcctgagaactgtcaggagggatctcaccaggtatgaagagctcgacaaggaagctcaagcgcagatgaatgaggagctatctgggtggaagcttgttgttggagatgtattcagagagccaacttgccccaagctgttatgcatcatgattggcgatggggttcaaatcctgggcatggcaatcgtaacgatagttttttcaacacttgggttcatgtctccagcttcgagaggaatgcttcttaccgggatgattattctctatcttttcctcggtattgcagctgggtatgtcagtgttcggctatggaggactattaagggaacgtctgaaggatggagatcattgtcctggctgactgcctgctttttccctggtattatgttcattgtccttactatcttgaacttcatcttgtggggaagcaacagcactggagctttacctatttcgttattcttcacccttctggctctgtggttctgtatctctgtgccgttaacgctcgccggtggcttccttggtacgagagcggagcaaatcgaattccctgttcgcaccaaccagattcccagagagatccctgctcggaaatatccctcatggcttctggtccttggagcaggcacgctaccatttggaacactgtttattgagctcttcttcattctctcgagcatctggcttggaaggttctactatgtgtttggcttcttgctgattgtcctgctgatgctggtcgtcgttgcgccgaggtatctgttgtccttacatacatgaacctctgtgtcgaggactggcggtggtggtggaaggctttctttgcatcgggctctgtcgctctctacgtgttcctctactccatcaactacctggtctttgatctccgaagcctgagtggacctgtgtctgcaatgctttacatcggctactcgttcctcatggcattcgcaatcatgcttgccaccggaaccattggcttcttgacgtcaatctccttcgtgcattatctcttcgcgtccgtaaagattgactgatggatacttggtatatcgaaacggccttttgtatttgtattgctagttgtgtgcgcgatgttcacctgagaacacactatttactgaagtgattttgatgtactgcagatgtttttgagtagatgtgttgtgatcttctcaagtaaaatgtagtttcgctttatcctttccaatccttgtgagctttgtaactggtacaattactttagactagatactgcaaccagatctacaggtattaaggagcaatgactcggtctgtttttcctgtgctcattggatgaaattcaaatctctgattgggaaggcgttgctgctagcctccattttggcaaaaaatgtagtatgtgtgaagtagacatagtagctacatgttcagatgttcttgcctaatttttttcttccgaaatgagagcttcctattgcttttatataataaaa

SEQ ID NO: 3494 - DNA, 2665 bp, Amorphophallus konjac
ctacccccgcgcgcgcttctgagggcgggctctccggcgtctccgccatctctggaatccgattcttcgacccagctatgcactgaatggcgggtcggcaaaattagatttttgaacccgtagacactcgggatcttagatttcgaagtctcttcaagcaaagtctagatcagagccagggagaagcagagggagtaacagtaatcccatggcgaccccttcaatcccaaaaccctgttctttgatccgttcagcacttttgatctgtgtgctgttgtgttctctttgcaacgccttctaccttcctggaagctacatgcacacgtattcccagggcgaagagataaatgtgaaggtgaattctctcacttcgatcgagaccgagctcccattcagctactatagccttccttattgcaaaccccccgatgggatcaagaagagtgcggagaatctgggtgagctcctcatgggagaccagatcgacaattccccatacagattccacgtcaatgtgaacgagtccatctacctctgcaccacaaacccgttgaatgatcaggaggtgaagctactgaagcagaggacccgcgacctctaccaggtcaatatgatccttgacaacttgcctgcaatgagggttacacagcagaatgggatcactattcagtggacgggattccccgttgggtacacattaggtgctaccaacgatgactacatcatcaaccatctgaaatttaaggtgttggtgcacgagtacgaggcaaggggtgttgagatcatcactaccggtgaagagggaccaggggtagtcgcaaccactgatgacaagaagttgtctggatatcagatagttggctttgtggttgttccttgcagtattaagcgtgatcccgatgccttttcaaagcacaacatgtttgataagattgagcccggggtctgtccgtcggagcccgagaagtctcagattattcgtgagcaggagaggatctcatttacctatgatgtggagtttgtgaagagtgacaccagatggccctcgcgatgggacgcatacttaaagatggaaggagcacgtgtacactggttctcaatcatgaactctctgatggtgatcttcttccttgctggaattgtctttgttatattcttgaggacagtgaggagggacttgactaggtacgaggagttggataaggaagcccaagcacagatgaatgaggagctctccgggtggaaacttgttgtgggtgatgtgttcagagagccaactaacccgaagctactctgtgtcatgattggagatggtgttcagattgcgggcatggctgttgtgacaattgtgtttgctgcttttggtttcatgtccccagcttcacgcggcatgcttttgacggggatgattgttctctatctatttcttggtattgtggctggatatgccagtgttaggctctggaggaccatcaaaggcacgtctgaaggctggaggtctgtctcctggtccgtggcctgtttcttccctgggatagcttttgttgttctgactgtgttgaacttcctactgtggagcagtaagagcaccggggctattcctatctctctttactttgtcctgctgtccctgtggttctgcatctcagttccactcactctcttggggggattctttggtactagggcagagcctatagggtatccagtgcggactaaccagatcccaagagaaatacctgcacggaagtacccctcgtggctccttgtccttggtgcagggacccttcctttcggaacccttttcatcgagctctttttcatcctctccagcatctggcttggaaggttctactatgtgtttggtttcttgcttgttgtcctcctgttgctggttattgtctgtgctgaagtgtccgttgtgctcacctacatgcacctgtgtgtggaagactggaggtggtggtggaaagcattctttgcctccggttcagttgctctctatgtcttcctgtactccatcaactacttggtgtttgacctcaggagcctgagcgggcctgtgtcagctatgctctacctagggtattcgttcctcatggcttttgccatcatgctgtctactggcaccatcggcttcctcacatccttctattttgtccattaccttttctcctctgtcaagattgactagatcatcctgattccgtcgagctgctttcatcatacacctcttcatagtttcacattcttacaaacgtagtgtcttggagctttttggatggtgtgatcacacggtcgtaggaagtcgtcctcctgggagcagaactgcccattcttcacctgaggataaagttggaatcttagataggggaatggtgaatggttcttcttatcatatactttaaacaggttacaacagtttgttatgggaagcatatagaagcttcggtctatcaaaagttggaagaccactttgtttcttagtgtgacaatgagataattatttgtgtcgaatgttttttgttgttttgggttcattttggcattctcttggcatttgtcacttcacgtctaggtgcttatgctcattgttcctcgaatttccacgctagattctctgtcattgttttaattgttattggcgtcgttttgcaacttgtaa

SEQ ID NO: 3495 - DNA, 2671 bp, Aristolochia fimbriata
ccaaactactgttagtggtgttggaggctgaaatcaactgcctatatttgtgaaatatcgccattcatatattcagcttttatcatctccaagatcaagttaatgaacgaaggaatttctgaaatggctgtttggaagtcctcaaagttttattttatattgttcctcgtggttcttttttctaatatttgtcgcggtttctatcttcctgggagttatatgcacacatattcagaaggtgaagagatttcagttaaagtgaattccttgacttcaattgaaaccgaacttccgttcagttattacagtctaccgtactgcccacctcctggtggagttaaaaaaagtgcagagaacttgggggaacttcttatgggtgatcagattgataactctccttaccgttttcgcatgttaaaaaatgaatcagtttatctctgcactacaaaacctttaactgaacttgaggtcaagcttttgaagcagagaactcgtgatctctatcaggtaaacatgattctggacaatctaccggccatgcggtatgccaagcaaaaagggattaatatacagtggactgggttccctgttggttataccccctcgtcccaaagtaatgatgattatattatcaatcatttgaagtttaaggttcttgtgcatgagtatgaagggagcggtgtgcagattattggcactggtgaagagggcatgggagtaataaccgaggaatccgataagaaaaaggcaaatggctatgagatagttgggtttgaagttgtcccatgtagtatcaaatggaacccaaatgagatggcaaaacacaaaatgtatgataaccttgacaaagtaaactgtccatcagaacttgaaaagtctcagatcatccgcgagcaagaaaaagtctcatttacttatgaagtggagtttgagaagagtgatactcgttggccttctcgttgggatgcttatttgaagatggaaggtgctcgagttcattggttctcaatcctgaactccttgatggttatcttcttcttagctggtattgtatttgtcatatttttgaggacagtgagaagggacttgaccaggtacgaagaattggacaaagaagctcaagctcagatgaatgaggaactttctggatggaagcttgtggtaggtgatgtatttagggagcctgaatgctcaaagctcctctgtgtgatggttggagatggtgtacagattgctgggatggcagttgtaacaattgtttttgcagctcttggattcatgtctcctgcttcccgtggaatgcttttgactggaatgatagtgctatacctatttcttgggatgccggctggatacgtggcagttcgtctttggtcaacaattaaaggtactacagaagggtggaggtcactgtcttggtcagttgcttgcttcttctctgggatcgtttttaccgttctaactattttgaacttcatgctttggtcaagcaaaagtactggtgccatcccaatttctttgttctttctgcttcttttcctttggttctgcatcttggtgccacttactctctttggggggtttatgggaacacgtgctgaacccattcaatatccagttaggaccaatcagattcccagagaaattccttctagaaaatacccctcatggcttcttgttcttggtgctggcactctcccgtttggaactctctttattgaacttttctttattttgtcaagcatatggcttggaaggttctactatgtcttcgggttcttgcttgtggtcctgctcctgcttgttattgtttgtgctgaagtttctgttgtccttacctacatgcatctgtgtgtagaggactggagatggtggtggaaggcattctttgcctctggctccgtcgcactgtatgtgtttctgtactcgatcaattatttgatatttgacctgaggagtcttagtggtcctgtttcagctatgctctaccttggttactctttagtcatggcactcgctatcatgttagctactggcaccattgggttcatcatgtccttctattttgtccactacctcttctcgtcagtcaaaattgattaaaaattaggggacgatgtagcaaggacaataattgccctctttcagacctgagaaatactttataccttagtggcagagcggatcttttccatcttttacggttcgtcttactcttactcaaattcatcatcttctagcaatttcacaggttttggagttctttttatccagtgttgcgaacagttcattggaggttttcttatatatcctttggcatatttcatgggttaactgatgttggctcagtttgttggaatcgatggaccagtacatactttgctgaaaacccggccaattcaaggtgggaagaatgtgtaagactccgagtttgtttggtttagttactaagtttttcacctagttaagtttctgcaacacttaaatttgtacccttgatgagattcatttagctctgatgctagcctcttagcagttgtattaccctgtaatccgaagcttaaagttgtgcttttgttaatggccacgtcttcatcttttctgtttcatttactactgagctacaagttgagtttaacggaggttttccttctatcaaatgagcctacgc

SEQ ID NO: 3496 - DNA, 2543 bp, Avena sativa
tcgcccattttttccgtccgcttgccttcccaagtcccgtctttcccctgtgctccgatctatccatccccgttcgccagctccgacctcgctttctccccgtgcgccaccgccgcggcagggtagctcacacatgttctaggcgattggtgagaatttgtgcttcagatggctggggcgttgcatagttctcgtggtctggctctgttattgttggttgtgctgttgctgattgctccaggcaatgcattctacttgcctggcagctacatgcacacatattcccaaggtgaggatatatgggcaaaggtcaattcactcacgtccattgagaccgagatgccgttcagctactacagtctaccatattgccgcccccctggcggcatcaaaaagagcgccgagaacctgggtgagcttctcatgggtgaccagatcgacaactcgccctaccggttcagtgtgaatgttaacgagtccctcttcctctgcaccacgaaagggcttaatgagaatgatgcaaagcttctcaagcagcgggcccgtgatctttatcaggttaacatgatgctggacaatctgccggtcatgcgtttcgctgagcagaatggtgtcacagtacagtggactggctttcctgttggttacactcctgctggtagttctgatgattatatcatcaaccatttaaagtttaaggtcttggtccatgagtacgaaggtgcaagtgcggaaatcatcggtactggagaagaaggatctgctgtcgtctcagagacggacaagaaggggatgtctgggtatcagatagttggttttgaggttgttccttgcagtgtgaagcatgatgccgaggctttctctaagctaaacatgcatgacaagattgacccggtgagctgcccaatggagcttcggaagtctcaagcgatcaggcaacaagagaggattacatttacatacgatgttgagtttgtgaagagtgacatcaggtggccatctaggtgggatgcttatctgaagatggaggctggcgccaatgtccactggttctctataatgaactccctcatggtcattttgttcttggcaggaattgtctttattatattcctgagaactgtcaggagggatctcaccaggtatgaagagctcgacaaggaagctcaagcgcagatgaatgaggagctatctgggtggaagcttgttgttggagatgtattcagagagccaacttgccccaagctgttatgcatcatgattggcgatggggttcaaatcctgggcatggcaattgtaacgatagttttttcaacacttgggttcatgtctccagcttcgagaggaatgcttcttaccgggatgattattctctatcttttcctcggtattgcagctgggtatgtcagtgttcggctatggaggactattaagggaacgtctgaaggatggagatcattgtcctggctgactgcctgctttttccctggtattatgttcattgtccttactatcttgaacttcatcttgtggggaagcaacagcactggagctttacctatttcgttattcttcacccttctggctctgtggttctgtatctctgtgccgttaacgctcgccggtggcttccttggtacaagagcggtgcaaatcgaattccctgttcgcaccaaccagattcccagagagatccctgcacggaaatatccatcatggcttctggtccttggagcaggcacgctaccatttggaacactgtttattgagctgttcttcattctctcgagcatctggcttggaaggttctactatgtgtttggcttcttgctgattgtcctgctgatgctggttgtcgtttgcgccgaggtatctgttgtccttacatacatgaatctctgtgtcgaggactggcggtggtggtggaaggctttctttgcatcgggctctgtcgctctctacgtgttcctctactccatcaactacttggtctttgatctccgaagcctgagtggacctgtgtctgcaatgctttacatcggctactcattcctcatggcattcgcaatcatgcttgccactggaaccattggcttcttgacgtcaatctccttcgtgcattatctcttcgcgtccgtaaagattgactgatggatacttggtatatcgaaacggccttttgtatttgtattgctagttgtgtgcgcgaggttcacctgagaacacactatttactgaagtgattttgatgtactgcagatgtttttgagtagatgtgttgcgatcttctcaagtaaaatgtagtttcgctttttcctttccaatccttgtgagctttgtaactgctacaattactttagactagatactgcaaccagatctacaggtattaaggagcaatgactcggtctgttttcctgtgctcattggatgaaattcaaatctctgattgggaaggcgttgctgctagcctccattttggcaaaaaatgtagtatgtgtgaagtagacatagtagctacatgttcagatgttcttgcctaa

SEQ ID NO: 3497 - DNA, 2403 bp, Ambrosia trifida
aaataaaaataatatttaaaaaaccagataaaagtgtgtgaaattagtaacgcaaatatagagatccgatccctgaaatattactgtattattaatccaaccaattctggtagtagtccatcatcagtcttgttcgtggaaaccctaacgacctcatacatatggtttggtgataaacattgcagcattagtggtttcggttgattgaagtttgggagccgtaactgttaggtagttagttatacattcgtaaaaggttagacaatggctttgtctttcgaccgtaaaaggacatgtttggtcctttttacatatgtggttttccttgggcatctctgcaatggtttctatttgcctggaagctatatgcatacatactcaaatggtgagaagatatttgccaaagtcaattcattaacatctatcgaaacagagcttccctttagttattacagtttaccgtactgcaaaccttctggtggagtgaagaaaagtgctgaaaatttaggagaattgcttatgggagaccaaattgacaactcaccctatcgtttccaaatgaacgtcaacgagtctgttttcctttgcactacacatccattgagtgagcatgaagtaaagcttttaaaacaaagaacacatgatttgtatcaagttaatatgatacttgataacctgcctgcaatgaggtttgctaaccagaatggtgttaaaatccaatggacggggtttccagttggatttacacctcccggcagtaaggatgattacattattaatcatgttaagttcagggtgtttgtacacgagtatgaaggtacgggtgtgcagataattggtacgggtgaagaaggaatgggtgtgatatcaacttctgatgataaaaagaaggctgctggatatgagattgttggttttgaggtttttccgtgcagtgttaagtacgaccctgagaaaatggcgaagctccatcaatatgatcaagtggattctgtaaactgtccgttagagctggaaaaatctcaaataataagagaacaagaaagagtatcattcacttacgaagttgagtttgtgaaaagtaatgtaagatggccgtcccgttgggatgcttatctgaaaatggaaggtgctcgtgtgcattggttctcaattcttaactcactaatggtgatcttctttttagctggtattgtttttgttatatttttaagaaccgtgagacgtgatcttacacggtatgaagagttagacaaagaatctcaagcacaaatgaacgaagagctatcgggatggaaacttgttgttggtgatgtgtttcgcgagccaaatcactccaaacttctatgcgtgatgataggagatggagtacaaatcacaggaatgaccgttgtcacaatcttattcgctgcatttgggttcatgtcacccgcttcacgaggtatgcttttaaccggaatgataattctttatcttttcttggggactggagcagggtatgctggagtttatctgtggagaacagttaaaggtacttcagaaggatggcgatccgtttcttggtcaattgcgtttttcttcccgggtatcgttttcgtgattttaactgtattaaacttcattctctggggcagtaacagtactggtgcaattcccatttcattatacttcatacttttatcacttttattttgcatctcggtcccactcactctgttaggagggtacttagggactcgggccgacccaattcagttccctgttcggaccaatcaaattgctagagaaatcccggcacaaaaatacccttcgtggctactagtaatcggtgctggaacccttccgttcgggacccttttcatcgagctctttttcattctttctagcatctggctcggaagattctactatgtgttcgggttcttgcttgtggttcttatgttgttggttgtcgtgtgtgctgaggtgtcggttgttctgacctacatgcatctatgtgttgaggactggcagtggtggtggaaagcattttatgcttcgggctctgtctctctttacgtgttcttgtattccatgaagtatttggtttttgaccttcagagtttaagcgggcctgtgtcggctatactctatcttgggtactcgctgattgtcgcgattgcaatcatgttgtctactggcaccattgggttcattacgtcgttctactttgttcactatttgttctcctcagtgaagatcgattagagggtgcgttgtgcaaattcttataggcaggcagaggcaggcaggcttccatttcaaatctgacatgttcattttagaaggcctggaaattttccggcttatcgaaggttagacgagtatattgtcttatgtttttgttttctatgacttgttata

SEQ ID NO: 3498 - DNA, 2746 bp, Papaver somniferum
tcgtttttgtgttggccttttatagttcaatagtgtcacacacgcaaacaccacctcttatatcacgttcgactcccgaaccctattcatccgaatttacagttgcagaagaagctctcagggcttgctagttctcctcttggcgccatacgattgtttctgggattcatccagaaacggtgtcgaatcatctgctagatctggagatctcagctatttggtggaatattttagttgaaatagataaatgtgtgcaaattcatcttgaagtgattcagatctgaaatttggatatataacagagatcgagggatttgttttcatattgttgttctgacgatggagaaaacttcgctggctggtttctgttgtctctttgttattctgtttgctaccgtttgtgatggattttatctgcctggaacttacatgcacacttactcaaatggtgaatcaatacttgcgaaagttaattccttgacttctatcgaaacagagcttccttttagttattacagtcttccttactgcaaacctccaggagggattaagaagagtgcagaaaatttgggggaacttcttatgggtgatcagattgataactctccttacagatttaaaatgaatcagaatgaatcactttatctgtgtacaacgagtccgttgaacgagaatgaggtgaagcttttgaagcaaagaacccgtgatctgtatcaggtgaatatgatcctggataatttaccagctatgaggtatgctacacaaaatgggatcaagatccagtggacagggtacccagtcgggtatgcacctcctcaaagtaacgaagattacatcataaatcatttgaaatttaaggtattggttcatgagtatgaaggaagtggtgtggtgttacttggtactggagatgaaactatggctgtggttcaagagcctgaaaagaagttaaatggttatgaaattgttgggtttgaggtcattccttgcagtatcaaacgtgatcctgaggcaatgaaaaagctcaagatgtatgatagtgtcgatccagtaaactgtcctgtcgatcttgagaagtctcaaataatcagggagcaagagcaagtctcatttacttatgaggttgaattcgtgaaaagtgatattagatggccttcgagatgggacgcttacttgaagatggaaggagcgcgtgtacactggttctcaatcatgaattcgctgatggttatattctttttagctggtattgtctttgttatattcttaaggacagtgagaagggatttgacaaggtacgaggaactggacaaagaagctcaagcacagatgaacgaggagctttctgggtggaaacttgtagtgtcagatgtctttagagaaccgacctgctcaaagctactctgtgtgatggtgggagatggaacccagattttggggatggctgttgtaaccattatatttgcagctcttggtttcatgtccccagcttctcgaggaatgctcttgactggaatgataattctgtatcttttccttggtattgttgcgggttatgttggtgttcgactatggataactgtaaagggaactacagaaggatggagatcagtttcctggtcttgttcggttttcttcccaggaatagtgttcgtaattcttactgcattgaacttcgtactctggggcagcaagagcactggtgccatcccaatctccttatattttatactattgtctctttggttctgcatttctgttcctttaacccttttgggaggttaccttgggacaaaagcagaacccattacttaccctgtgcgaactaaccagatcccaagagaaatccctgcgcgaaaatatccatcttggcttcttgtacttggtgctggtacccttccctttggaactctcttcatcgaactctttttcattctttcaagcatctggcttggtaggttctactatgtctttgggtttttgctcgtggtcttcatcttgcttgtcgttgtttgtgccgaagtgtctgttgtccttacatacatgcacctatgtgtggaggactggcagtggtggtggaaagcgttctttgcctctggttcagtctcactgtacgtgttcatgtactctatcaactacctgatatttgatctaaggagtttgagtggacctgtctcagctatgctctaccttggttattcattgatcatggcaatcgcaatcatgttgtctactggcaccattggtttcctggtttccttctatttcgttcattaccttttctcatctgtcaaaattgactagaagatactcaaaagcaaataggcatgaagagataagtcagcctttctcatttttccctcctcatctctacattagtcatgcttttctttctattttagcctttgcagcaaaagattttagattttgaaagcctgtagcttattgttcttggtgaaacaatactaaaggtaaggtatgtgaaggtcgcagctttaggttaatttcatcaccttttccgtgctccgtgatgttgaaggtctctgatatctttgtagctcttctctctattatacatacatagtggttgagatttggttcttgtttggccttcatttggatcatatatatatatatccttgttttttttttaagcagcttatcatcaacattgttatttggaaacttcttggctttcatttttgtttaattattcttgtcagtctttctgtgtttgatttggaaa

SEQ ID NO: 3499 - DNA, 2366 bp, Papaver somniferum
aaattcatcttgaagtgattcagatctgaaatatataacagagatcgagggatttgttttcatattgttgttctgacaatggagaaaacttcgctggctggtttctgttgtctctttgttattctgtttgctaccgtttgtgatggattttatctgcctggaacttacatgcacacttactcaaatggtgaatcaatacttgcgaaagttaattccttgacttctatcgaaacagagcttccttttagttattacagtcttccttactgcaaacctccaggagggattaagaagagtgcagaaaatttgggggaacttcttatgggtgatcagattgataactctccttacagatttaaaatgaatcagaatgaatcactttatctgtgtacaacgagtccgttgaacgagaatgaggtgaagcttttgaagcaaagaacccgtgatctgtatcaggtgaatatgatcctggataatttaccagcaatgaggtatgctacacaaaatgggatcaagatccagtggacagggtacccagtcgggtatgcacctcctcaaagtaacgaagattacatcataaatcatttgaaatttaaggtattggttcatgagtatgaaggaagtggtgtggtgttacttggtactggagatgaaactatggctgtggttcaagagcctgaaaagaagttaaatggttatgaaatagttgggtttgaggtcattccttgcagtatcaaacgtgatcccgaggcaatgaaaaagctcaagatgtatgacagtgtcgatccagtaaactgtcctgtcgatcttgagaagtctcaaataatcagggagcaagagcaagtctcatttacttatgaggttgaattcgtgaaaagtgatattagatggccttcgagatgggacgcttacttgaagatggaaggagcgcgtgtacactggttctcaatcatgaattcgctgatggttatattctttttagctggtatcgtctttgttatattcttaaggacagtgagaagggatttgacaaggtacgaggaactggacaaagaagctcaagcacagatgaacgaggagctttctgggtggaaacttgtagtgtcagatgtctttagagaaccgacctgctcaaagctactctgtgtgatggtgggagatggaacccagattttggggatggctgttgtaaccattatatttgcagctcttggtttcatgtccccagcttctcgaggaatgctcttgactggaatgataattctgtatcttttccttggtattgttgcgggttatgttggtgttcgactatggataactgtaaagggaactacagaaggatggagatcagtttcctggtcttgttcggttttcttcccaggaatagtgttcgtaattcttaccgcattgaacttcgtactctggggcagcaagagcactggtgccatcccaatctccttatattttatactattgtctctttggttctgcatttctgttcctttaacccttttgggaggttaccttgggacaaaagcagaacccattacttaccctgtgcgaactaaccagatcccaagagaaatccctgcacgaaaatatccatcttggcttcttgtacttggtgctggtacccttccctttggaactctcttcatcgaactctttttcattctttcaagcatctggcttggtaggttctactatgtctttgggtttttgctcgtggtcttcatcttgcttgttgttgtttgtgccgaagtgtctgttgtccttacatacatgcacctatgtgtggaggactggcagtggtggtggaaagcgttctttgcctctggttcagtctcactgtacgtgttcatgtactctatcaactacctgatatttgatctaaggagtttgagtggacctgtctcagctatgctctaccttggttattcgttgatcatggcaatcgcaatcatgttgtctactggcaccattggtttcctggtttccttctatttcgttcattaccttttctcatctgtcaaaattgactagaagatactcaaaagcaaataggcatgaagagataagccggcatttctcatttttccctcctcatctctacattagtcatgtttttctttctattttagcctttgcggcaaaagattttagattttgaaagcctgtagcttattgttcatggtgaaacaatactaaaggtatggtatgtgaaggtcgcggctttaggttaatttcatcaccttttccatgctccgtgacgtcgaaggtctctgatatctttgtagctcttctctctattatacatacatagtggttgagatttggttctcgtttggccttcatttggatcatat

SEQ ID NO: 3500 - DNA, 2555 bp, Fragaria vesca
tttcactttctttccaaagaaagcaacaagagtcggttccttcatctctgctaagccaaaaccagaaggcttcgtttccaagccaaccctccacctccgcttcaccttctccgatctactccgatatattgttggatgcgtcttttttaagagagtagcttagataccacttggtgggggtgttctttttcgtttcgattcagatggctgtgtcgaaatcaagaacgctgcccgagtttctatgggcattgctggttttggttatgttcgcgcatgtctgcaacgggttctatctccctgggagctacatgcatacgtattcgaaagggcaagagatatttaccaaggttaattccttgacttctattgagactgagcttccgttcagttactacagtctgccgtactgcaaaccccaaggaggtatcaagaagatggcggagaatctcggggagcttctgatgggagatgagatcgagagctctccttaccgcttcaggatgaatatgaacgagactgtttacttgtgtactacaaaccctttgaaggagcatgaggtgaagctgttgaagcagaggaccagggatatgtatcaggtcaatatgatccttgataatttgcccgccatgagatatgcttatcaaaatcgggcgacgatccagtggactgggtatcctgttgggttcacaccagatggaagtaaagatgattacatcatcaaccacctcaagttcagggttttgattcatgagtatgaagggagtggtgtgcagataattggtactggggaagaaggcatgggtgtcatttcagaagcagataagaagaaagcatctggctatgagattgttggctttgaggtttacccttgtagcgttaaatacgacgctgataccatgagtaaaaatgagatgtataagtctatcgcaccggtgaattgtcccaaagatgcgtccgagtctcaaatcataagggaacaagagagagtgtcattcacttatgaggttgaatttgtgaaaagtgatataagatggccatcaagatgggatgcttatttgaagatggagggtgcccgtgtgcactggttctctatcctcaattcattgatggtgatattcttccttgccggtatcgtttttgtcatattcctaaggactgtgaggagggatttaacaagatatgaagaactggacaaagaagcgcaagctcagatgaatgaggagctttctgggtggaagcttgttgtgggagatgtgttcagagagccagatcactcaaagcttctttgtgtgatggtcggtgacggggttcagattacagggatgtcagttgtcactatcatctttgcagcatttggctttatgtcacctgcttcacgaggaatgttactgacaggcatgatcattctatatcttttccttggtattattgctggttatgttgctgtccgaatgtggagaaccataaagggaacttcagaagggtggagatccgtttcctggtttgttgcatgcttctttcctggaatcgtatttgttattcttacaattctgaatttcatcctatgggggagcaatagtactggcgctattcctatttccttgtattttgtactcttttccctctggttctgcatttcagtgccactcactcttcttggaggattcttagggacacgatctgaggctattcaatatcctgtgagaaccaaccagattcctagagaaattcctgcacgcaaatatccatcatggcttcttgttctaggtgccgggacacttccctttggaaccctgttcattgaacttttcttcatcctttccagcatctggctaggaaggttctattacgtctttggtttcctgcttatagttcttctattgctggtggttgtttgtgctgaagtttcagtggttctcacatacatgcatctctgtgtggaggattggcggtggtggtggaaggctttctttgcttcagggtcagttgccctttatgtgttcctgtactccatcaactacttggtatttgatctgcagagtttgagtggccctgtgtcggctaccctttacctcggttactcgttaatcatggcaactgcaataatgttgtcaactggcaccatcggctttctcatgtctttctactttgttcattacctatttgcatctgtcaagattgattagaagtgtttgctggtatttttgttaatcatacagttggaaatgagtctgctatgtcggaaggagtatttttggttaaggtgattgtattgcggcatatcaagagtctctctgatggtgctgcatgaagactatattttctgtatactgcctcatctgtaacaagcccagcagcagcttctccttttacctcatacatcccattttatttcttactacaatcagtgttgtgcttcaattcggattacgaactttagttattcacattgtgctagaaagttgtaatgtcatggaccgtcaatccctgtattctctccaatttcatatctgaaatgaaagtaaaaacttgataatcaaaattgtgctcattac

SEQ ID NO: 3501 - DNA, 2528 bp, Trifolium pratense
ataaaccctaatctggacgaaattgaaatggcggtggcagaggaaaccggcggaggaactactatcattgatgaaacttacgaattctctgcgccgcgattctttgatttcatgaaaggggaatcggatgatgaaatccgtagggctgagctctggtttcacaccgctctctcttatgctccttctccattcatgcctaaaatcaaggctggtagatccattaccgtggataccttatgtgattttagtgaagctgataatcatatgccaaagatgtcagcaaatgttgaagataatgtttcgaaatcaaatacacaatcagagagcatgactagcaagataaaggaacatgatgaagcaaaggaggaaaagcttacaacggtttctcaagtgatttcaactaataagaaagatgatgcaccatcctgcgaggccaaagaagaaaataattcaacttcccttgaggatattgttggtaaggaaatgagtgatcataaaggagggcagtgcttaaaagtagttgcatctacagaagcatctgttgaagtagcaaaagatgtttgcacaccaaatccggcgttgcggaaaaatgtcaataccacttccactaattccaagaagcaacagaactctaagaaggtatctacgaataccaaaactcggttacaatcagcagccacaaagagcactctagggacgccacacttcgcccaagagaatcaagctattaagaggcaaaaattggaaggaggaaaaactagacagattctgaatccgaaacctcaaactttgcctcatgataagtcaaaattgggttattgttcaagtactagcaaaattcacaaagaggacagaaaggtttatgttcgtgaaacaccaaaaacacccgcatctgcaccatttgtatcaatggcagaaatgatgaagagattccagtctagtacgagagacctgccattgcctaatactctatcccatacaaaaccaaaactcacattgaccaggccaaaggaacctgaatttgagacaaatcagcgggttcgcccagctagagtgaagagtgctgctgagcttgaggaagaaatgatggctaagatgccaaaattcaaggcacggccattgaataagaagattctgcaaacttcaactttgcctcccatgccaagaagtacaccccaaccaccagagtttaaggaatttcatctagaaacactggctagggctcatcaaaatacagattcagcttcaaaagcctcatcagaggtgtctcataaggagaattcatcaaaacctcatcttactgaacctaaacctccacttctccaaacatcgctacgggcccgcccaccaacagtgaaaagctctttagaaatagagcaagaggaacttgagaagattcctaaattcaaggcaagacctctaaataagaagatcttcgaaagtaaaggggatattggaatattctgccatatgaagaagcatgttactgaacctcaagaatttcattttgcaacaaatgagaggtttccaccaccacctacttccgtggctgatttatttgacaagctttctttgaagtctgaacctgcttgtaaccgcaacacaattccaaaagtcactactccaaatccattccatcttcacactgaggaaagaggagctgagaaagagaagaaattgatcatggaacttttccagaaagaactggaagaggaagcaacaagggttccgaaggctaacccatacccctataccactgactatcccgtgatcccaccaaagccagaacccaagcaatgcacaaaaccagagccatttcaattggagagcctagtgagacatgaggaagaaatacaaaaggaacaagaagaaagacttaggatgcaaagagaggaaagaaagatgagaaaatttaaggcacagccaatattaaaagaggacccaatcccagttccagagaaggtccgcaaaccccttacagaagttaaagagtttgatttacatttgaatcatcgggctgtggatagagcacaatttgacgagaggattaaggagaaagaagtgatgtacaaacgatacagagaggagagtgaagcagcaagaatgatggaggaagagaaggcactgaaacagatgagaaagacaatggttcctcatgctagaccagttccaaattttgataatccattttgtccccaaaagacttctaaaacaacaaaacccaagtcaccaaatttgcgtgttctccaaagaagacggaagatattcaatggttccgcagtctcgagtcctgctaacatcagatgactggagttatacatatgtgatcgaagtttggtgttcaagtactcttgaatccttgacaccttccttaggtgtctatgtaatagtgtaatagtttgttaaaatctgtattctttgatgtaaattttttctaaactgcaactaaacaatttgtgataacttagcattttaaccttaattgctaaattaagattaagaattctctgaggatatctctagagaag

SEQ ID NO: 3502 - DNA, 2315 bp, Trifolium pratense
tattttaatcttcccaattttcacataataataaaccctaatctggacgaaattgaaatggcggtggcagaggaaaccggcggaggaactactatcattgatgaaacttacgaattctctgcgccgagattcttcgatttcatgaaaggggaatcggatgatgaaatccgtagggctgagctttggtttcacaccgctctctcttatgctccttctccattcatgcctaaaatcaaggctggtagatccattaccgtggataccttatgtgattttagtgaagctgataatcatatgccaaagatgtcagcaaatgttgaagataatgtttcgaaatcaaatacacaatcagagagcatgactagcaagataaaggaacatgatgaagccaaggaggaaaagcttacaacggtttctcaagtgatttcaactaataagaaagatgatgcaccatcctgcgaggccaaagaagaaaataattcaacttcccttgaggatattgttggtaaggaaatgagtgatcataaaggagggcagtgcttaaaagtagttgcatctacagaagcatctgttgaagtagcaaaagatgtttgcacaccaaatccggcattgcggaaaaatgtcaataccacttccactaattccaagaagcaacagaactctaagaaggtatctacgaataccaaaactcggttacaatcagcagccacaaagagcactctagggactccccacttcgcccaagagaatcaagctattaagaggcaaaaattggaaggaggaaaaactagacagattctgaatccgaaacctcaaactttgcctcatgataagtcaaaattgggttattgttcaagtactagcaaaattcacaaagaggacagaaaggtttatgttcgtgaaacaccaaaaacacccgcatctgcaccatttgtatcaatggcagaaatgatgaagagattccaatctagtacgagagacctgccactgcctaatactctttcccatacaaaaccaaaactcacattgaccaggccaaaggaacctgaatttgagacaaatcagcgggttcgccctgctagagtgaagagtgctgctgagcttgaggaagaaatgatggctaagatgccaaaattcaaggcacggccattgaataagaagattctgcaaacttcaactttgcctcccatgccaagaagtacaccccaaccaccagagtttaaggaatttcatctagaaacgctggctagggctcatcaaaatacagattcagcttcaaaagcctcattggaggtgtctcataaggagacttcatggaaacctcatcttactgaacctaaacatccactactccaaacatcgctaagggcccgcccaccaacagtgaaaagctctttagaaatagagcaagaggaacttgagaagattcctaaattcaaggcaagacctctaaataagaagatctttgaaagtaaaggggatattggaatattctgccatatgaagaagcatgttactgaacctcaagaatttcattttgcaacaaatgagaggtttccaccaccacctacttccgtggctgatttatttgacaagctttctttgaagtctgaacctgcttgtaaccgcaacacaattccaaaagtcactactccaaatccattccatcttcacactgaggaaagaggagctgagaaagagaagaaattgatcatggaacttttccagaaagaactggaagaggaagcaacaagggttccgaaggctaacccatacccctataccactgactatcctgtgatcccaccaaagccagaacccaagcaatgcacaaaaccagagccatttcaattggagagcctagtgagacatgaggaagaaatgcaaaaggaacaagaagaaagacttagaatggaaagagagcaaagaaagatgagaaaatttaaggcacagccagtattaaaagaggacccaatcccagttccagagaaggtccgcaaaccccttacagaagttaaagagtttgatttacatatgaatcatcgggccgtggatagagcacaatttgacgagaggattaaggagaaagaaatgatgtacaaacgatacagagaggagagtgaagcagcaagaatgatggaggaagagaaggcactgaaacagatgagaaagacaatggttcctcatgctagaccagttccaaattttgataatccattttgtccccaaaagacttctaaaacaacaaaacccaagtcaccaaatttgcgtgttctccaaagaagacggaagatattcaatggttccgcagtctc

SEQ ID NO: 3503 - DNA, 2663 bp, Trifolium pratense
cgttattagcaactagcaatcgttagttactaactagtaagtagtatgatagtagtccaaacatattattagtgtaaatatatatgcttagttcccaaaacatcgacttttattttgttttaatcatcccaattttcacacaaaccctaatcggaacgaactcgaaatggcggtggcatcagaggcaaccggtggagcaactactatcattgatgaaacttacgaattctctgcaccaagattcttcgatttcatgaaaggggaatcagatgaggaaatccgtagggccgagctctggtttcacaccgctctctcatacgctccttctccattcatgcctaaaatcaaggctggtagatccattactataggtaccttgtgtgattttagtgaagctgacaatgtgccaaagatgtcagcaaatgttgaagatagtgttttggaatcaaatcaacaaccacaaagcatgactagcaaaataaaggaagagggtgtagccaaggaagaaaaccttacaaatgtttctcgtgtgatttctaccaataaggaagatgatgtaccatgctgcaaggccaaagacgaaaataattcaacttatctcgaggatgttgttggtaaggaagtgagtgatcataaaggggagagcttaaaagtacaaacatccacagatgcatctgttgaagtaggaaaagatgtttgcacaccaaatccagcattgaggaaaaatgtcaataccacttccactaattccaagaagcaacagaactctaaaacggtatccacaaatgccaaaactcggttacaatcagcagccaagaagagcacttcagggaccccccacttagcccaagagaatcaagctattaagaggcaaaaattggaaggaggaaaaactagacagattctgaatccgaaacctcaaactctgcctcatgataagtcaaaattgggttattgttcaagtactactagcaaaattcacaaagaggacagaaaggtttatgttcgtgaaacaccaaaaacacccgcgtctgcgccatttgtatcaatggcagaaatgatgaagagattccagactagtgcgagagacctgccactgcataacactgtttcccatacaaaaccaaaactcacactgaccaggcctaaggaacctgaatttgagacaaatcaacgggttcgccctgctagagtgaagagtgctgctgagcttgaggaagaaatgatggctaagatgccaaaattcaaggcacggccattgaataagaagattctgcaaacttcaactttgcctcccatgccaagaagtacaccccaaccaccagagtttaaggaatttcatctagaaacgctggctagggctcatcaaaatacagattcagcttcaaaagcctcattggaggtgtctcataaggagacttcatggaaacctcatcttactgaacctaaacatccactactccaaacatcgctaagggcccgcccaccaacagtgaaaagctctttagaaatagagcaagaggaacttgagaagattcctaaattcaaggcaagacctctaaataagaagatctttgaaagtaaaggggatattggaatattctgccatatgaagaaacatgttaccgaacctcaagaattccactttgcaacaaatgagaggtttccaccacctactgccgtggctgatttatttgacaagctttctttgaagtctgaacctgcttgtaaccgcaacacaattccaaaagtcactactccaaatccattccatcttcacactgaggaaagaggagccaagaaagagaagaaattgatcatggaactttttcagaaagagttggaagaggaagcaacaagggttccgaaggcaaacccatacccctataccactgactatcccgtgatcccaccaaagccagaacccaaaaaatgcacaaaaccagagccatttcaattggagagcctagtgagacatgaggaagaaatgcaaaaggaacaagaagaaagacttagaatggaaagagagcaaagaaagatgagaaaatttaaggcacagccagtattaaaagaggacccaatcccagttccagagaaggtccgcaaaccccttacagaagttaaagagtttgatttacatttgaatcatcgggtcgtggagagagcacaatttgatgagaggattaaggagaaagaaatgatgtacaaacgatacagagaggagagtgaagcagcaagaatgatggaggaagagaaggcactgaaacagatgagaaagacaatggttcctcatgctagaccagttccaaattttgataatccattttgtccccaaaagatttctaaaacaacaaaacccaagtccccaaacttgcgtgttctccaaagaagacggaagatattcaatggctccacagtctcatcaagtcctactactaacatgagatgactggagcatccagtttgtgatcaaagtttgagttcaagaactcttgaatccttgacacttccccccaaggtgtctctttgtaatagtgtaataatagttaaaatctattctttgatgtaaagtttttctaaaactgcagctcgatgtaaaaacaatttgtgataccaaatcaacatttcaaataatattgctaaattaagattatgagttaaaa

SEQ ID NO: 3504 - DNA, 2343 bp, Trifolium pratense
tccttctccattcatgcctaaaatcaaggctggtagatccattactataggtaccttgtgtgattttagtgaagctgacaatgtgccaaagatgtcagcaaatgttgaagatagtgttttggaatcaaatcaacaaccacaaagcatgactagcaaaataaaggaagagggtgtagccaaggaagaaaaccttacaaatgtttctcgtgtgatttctaccaataaggaagatgatgtaccatgctgcaaggccaaagacgaaaataattcaacttatctcgaggatgttgttggtaaggaagtgagtgatcataaaggggagagcttaaaagtacaaacatccacagatgcatctgttgaagtaggaaaagatgtttgcacaccaaatccagcattgaggaaaaatgtcaataccacttccactaattccaagaagcaacagaactctaagaaggtatctacgaataccaaaactcggttacaatcagcagccacaaagagcactctagggacgccacacttcgcccaagagaatcaagctattaagaggcaaaaattggaaggaggaaaaactagacagattctgaatccgaaacctcaaactttgcctcatgataagtcaaaattgggttattgttcaagtactagcaaaattcacaaagaggacagaaaggtttatgttcgtgaaacaccaaaaacacccgcatctgcaccatttgtatcaatggcagaaatgatgaagagattccagtctagtacgagagacctgccattgcctaatactctatcccatacaaaaccaaaactcacattgaccaggcctaaggaacctgaatttgagacaaatcagcgggttcgcccagctagagtgaagagtgctgctgagcttgaggaagaaatgatggctaagatgccaaaattcaaggcacggccattgaataagaagattctgcaaacttcaactttgcctcccatgccaagaagtacaccccaaccaccagagtttaaggaatttcatctagaaacactggctagggctcatcaaaatacagattcagcttcaaaagcctcatcagaggtgtctcataaggagaattcatcaaaacctcatcttactgaacctaaacctccacttctccaaacatcgctacgggcccgcccaccaacagtgaaaagctctttagaaatagagcaagaggaacttgagaagattcctaaattcaaggcaagacctctaaataagaagatcttcgaaagtaaaggggatattggaatattctgccatatgaagaagcatgttactgaacctcaagaatttcattttgcaacaaatgagaggtttccaccaccacctacttccgtggctgatttatttgacaagctttctttgaagtctgaacctgcttgtaaccgcaacacaattccaaaagtcactactccaaatccattccatcttcacactgaggaaagaggagctgagaaagaaaagaaattgatcatggaacttttccagaaagaattggaagaggaagcaacaagggttccgaaggctaacccatacccctataccactgactatcctgtgatcccaccaaagccagaacccaagcaatgcacaaaaccagagccatttcaattggagagcctagtgagacatgaagaagaaatccaaaaggaacaagaagaaagacttaggatgcaaagagaggaaagaaagatgagaaaatttaaggcacagccaatattaaaagaggacccaatcccagttccagagaaggtccgcaaaccccttacagaagttaaagagtttgatttacatttgaatcatcgggctgtggatagagcacaatttgacgagaggattaaggagaaagaagtgatgtacaaacgatacagagaggagagtgaagcagcaagaatgatggaggaagagaaggcactgaaacagatgagaaagacaatggttcctcatgctagaccagttccaaattttgataatccattttgtccccaaaagacttctaaaacaacaaaacccaagtcaccaaatttgcgtgttctccaaagaagacggaagatattcaatggttccgcagtctcgagtcctgctaacatcagatgactggagttatacatatgtggtcaaagtttggtgttcaagtactcttgaatccttgacaccttccttaggtgtctatgtaatagtgtaatagtttgttaaaatctgtattctttgatgtaaattttttctaaactgcaactaaacaatttgtgataactcagtattttaaccttaattgctaaattaagattaagaattctctgaggatatctctagagaag

SEQ ID NO: 3505 - DNA, 1692 bp, Glycine max
ctggtgccctccagaaaagaaggagccaaggtcccttccctataaccgcgtctttccacaactgtaatcgcgttagaaagtagattaattgctaacacacacccacggcacgttactactataaattccccttcccatccctttatttttcccccacaacacatcgttttttcagcatatgtctcaaaggcccacggttcctcactcctcttccatagcctgcggccttcactctcatctcctggtctccagtgagatgaaccctagctccaattggtccctttaatcaattacctcttaattagtaattacttaatctcaattagcctttcactctcccacacaacaacatcatgggcgtcaaaggttttgtcgaaggaggcatcgcttccatcattgcaggatgttccacacacccacttgatctcatcaaggtccgcatgcagcttcagggcgaaaacaatttgcccaaaccggttcaaaatctccgacccgcactcgccttccaaaccggttcgaccgtccacgtggcagcggctattccgcagacccgcgtgggtcccatcgcggttggggttcgcctcgtccagcaagaaggccttgcggccttgttctccggcgtctccgccactgtcctccgccagacgctctactccaccacccgtatgggcctctacgacgtcctcaagaccaagtggaccgactccgtcaccggcaccatgccgctcagccgcaagatcgaggccggtctcatcgccggtggcatcggcgccgccgtggggaaccccgccgacgtggccatggtccgaatgcaggcagacgggcgcctccctccggcacagcggcgcaactacaagtccgtcgtggacgccatcacgcgaatggcgaagcaagaaggcgtcactagcctttggagaggctcatcgcttacggtgaaccgcgccatgctcgtgacggcgtcgcagctcgcgtcgtacgaccagttcaaagaaacgatcttggagaacggcatgatgcgcgacgggctcgggacccatgtcacggcgagcttcgcggcggggttcgtggcggcggtggcgtcgaaccccgtcgacgtgatcaagacgagggtgatgaacatgagggtggagcccggggcgacgccgccctacgccggcgcgttagattgtgctctgaagactgtgcgcgcggagggtcccatggcgctttataaggggtttattcctacgatctcgaggcagggaccgttcactgtggtgctgttcgtgacactggaacaggttcgcaagttgcttaaggatttctgatgaggatgatgacgagaagatgtatgctactttccttttcaataagatgctttttctgtttgtgttatgttttaatagtactagtgatgtagttctaggatggcaattttgttattctattaatcaatgagaagtgctgtttattttccgaattagactgtggcacggcaaattgtttttaaaaaataaaaataaaagcaggttatcgatatttttcaatccactggattaatccgctagctcctagagatatgtgactgtcatagatctaatcaaattttacacagtgcgttattagtcaattttaagaattctgtatttgatttgaaaggtgaaaatgttgcgagagcgtgtaacagtatataggctgcgatggagagaaaag

SEQ ID NO: 3506 - DNA, 1581 bp, Phaseolus vulgaris
tttcccacaccaaaaccaagacaaaacgtcccagcatatgtctcagaggcccacggttccacactcttcttccatagcctgtggcctccattcccatctcctggtctccagtgagatgaaccctaattccaattggtcccaatagcttcaaatttctctactttcccatctcattctttttacaaaaccactaactctacttataacccttattcattcccattctcattttccgacacaacaaaaacatcatgggtgtcaaaggtttcgtagagggaggcatcgcttccatcatcgccggctgttcaacgcacccacttgatttaatcaaggtccgcatgcagctccagggcgaatccaacgctcccaaaccggttcacaatctccgacccgcactcgccttccaaaccggttcaaacctccacgtgtcagccattccgcaggcccgcgtgggccccatcgcggttggcgtccgcctcgttcagcaagaaggccttgccgccctcttctccggcgtctctgccaccgtcctccgccagacactctactccaccacccgcatgggtctctacgacatcctcaagaccaagtggaccgaccccgccgccggcaccatgcctctcggccgcaagatcgaggccggcctcatcgccggcggcatcggagccgccgtcggaaacccggccgacgtcgcgatggttcgaatgcaggccgacgggcgccttccgctggcggagcggcgcaattacaagtccgtcgtggacgccatcttgcgaatggcgcggcaagagggcgttactagcctctggagaggttcatcgcttacggtgaaccgcgccatgctagtgaccgcgtcgcagctcgcgtcgtacgaccagttcaaagagacgattctcgagaagggcttgatgcgcgatgggctcgggacccacgtcacggcgagcttcgcggcgggattcgtggcggctgtggcgtcgaaccccgtggacgtgatcaagacgagggtgatgaacatgaaggtggagcccggggcggcgccaccgtacgccggcgcgttggattgtgctctgaagacggtgcgagcggaggggcccatggccctctacaagggtttcattcctacgatctcgaggcagggacccttcaccgttgtgctgttcgtgacgctggaacaggttcgcaagctgcttaaggatttttgagtggtagatcgacgaagatgacgacgaaaatgcttctttccttttcaaataagatctgttatgtttggcgttgtgttgggatagtgatgttgtagctctagaatggtaattttgtttcttatcttgcctatttatcaatgagaagtacctttcagttttctaattgggtttttgacaccataaattatagcttatggaaattgtgatcttgttttttctttcttgcaatcaaccttaagaattttgtttaggtaatttgattcctctggattagattatgagttagaatttgtgtttgtgagtgttcttactttcccacaacccaacgcaacacgggtctgggaccatgagacgcgtaaagtcccttgctctttgtata

SEQ ID NO: 3507 - DNA, 1784 bp, Lupinus angustifolius
cccacaccaaataactcttcctcattcattgctttcggctactagcctatgtctcagagggctactgttccccactcttcttccatagcttgtggccttcattcccatctcctggtctcaagtgaaatgacctctaattccaactggtcctcttctatcttttttcattaacctacattaactaaccctttcttctctaacaaaccaaaatttctattaccttcaattctattcattctttcaaagtttataactttattacaagatctattatgggtctcaaaggttttgctgaaggaggcatcgcttccatcattgctggatgttccactcaccctcttgacctcattaaggttcgtatgcagctacagggtgaacccagcccgaacccggttcataatctccgaccggcacttgcatttcagaacggttcttcgatccacgtgtcacctgctccgcaaacaccacagatcaaacctcgtatgggtcccattgctgtgggtgttcgcctagttcaacaggaaggtgtcgctgctctattttccggcgtctccgccaccgtactccgtcagacgctctactccaccacccgcatgggtctatatgatgttctcaagcagaagtggtccaccggtgggaacatgccgctgtcgcgtaagattgaggcgggtctgatagcgggtggtatcggcgccgccgtgggaaacccggctgatgtggctatggttaggatgcaggcggatgggcgtctcccgccggctcagcgtcggaactataagtccgtcgtggatgccttatcaactatggtgaagcgtgaaggtgtcaccagcttgtggcgcggttcatcgcttacggtgaaccgtgcaatgctggtgacggcgtcacagttggcgtcttacgaccagtttaaggagatgatattggaaaaggggttgatgcgtgatgggcttgggacccatgttacagcgagttttgcggccggattcgtagcggcagtggcgacgaatccggtggatgtgatcaagactagggttatgaacatgagggtggagccgggggcggaggcaccgtattctggtgctgtggattgtgctttgaagactgtgcgtgctgaaggtcctatggccctttacaagggatttattcctacgatttcgaggcagggacccttcactgttgtgctgtttgtgactctggaacaggttcgcaagttgttcaaggatttctaagatgatgacgaagatctttcattttccataaagaagatttcttgctttcgtatttttccttatatttatcgttatgaatgagaagcaaccttgtgttttgttatccattatctacttgaataagagaagttcattccatttccgaaattattttgtccagatttttaatttaaaataagcagtaataagcttcttgtttaattttgagaaccatgttttttaatcatccaaataatagagtaagtgataaataacccttgtagctgaaattgtgcaagtgttaggtgatggtgttttgcccacacaactcgttatgaagaatcagtgaactttttaggggaatggtttgttctattcagtgatctctcatgatattcgggtaaagtatcttatttatatatgtgacgtataaggtatgactaaagtagttagcataaagaattattctttacttaataaaatccatgatccgatgccttcccttctccgattcaattgttccaccaaaccaaagcttccttgtccttccatcttatgattctctatgattggtac

SEQ ID NO: 3508 - DNA, 1375 bp, Lupinus angustifolius
tcacaacaacaaaaaaccattctctcttcttgtttaccccaatagcatatgtctcagagggttactgttccccactcatctgccatagattgtggccttcattcccatctcatggtctctagtgagatgagctctaattccaactcgtcttcctctcattaacccctattactcctcttcctttaaaccctcaccattttttgatcttctccgtttttatctcaattcaattaattcttttaaagctataaacttttttgcataatcaatcatgggtatcaaaggttttgttgaaggaggcattgcttccatcattgctggatgttccacccaccctcttgacctcatcaaggttcgtatgcagctccagggagaatccaacccagcccctgttcgtaacattcgatcggaacttgcatttcataatggttcttccatccacgtggcacaagctccgcagatcaaaccccgtgtgggtcccatttctgttggcattcgcttagtccagcaagaaggtgtcgccgcgctattttccggcatatccgccaccgtcctccgccagacgctctactccaccacacgtatgggtctgtacgatatcctcaagcagaagtggtccatcggtgggaacatgccgctatcacgcaagattgaggctggtctgattgccggcgctgtcggtgccgccgttggaaacccggctgatgttgccatggtccggatgcaggccgatggccgcctcccgccagctcagcgtcgaaactataagtctgtggtggatgcaatatccaccatggtgaagcaagagggagtcaccagcctatggcgcggttcgtcgcttaccgtgaaccgcgcaatgctggtgactgcctcgcaattggcatcttatgaccagtttaaggagatgatattggagaagggagtgatgcgtgatgggctaggtactcacgtgactgcgagcttcgcggcagggttcgtggcgtctgtggcgtcgaacccggtggatgtgatcaagactagggttatgaacatgagagttgagcctggggcagagcctccttattctggtgctttggactgtgctttgaagacagtgcgagctgaaggtcctatggccctttacaagggctttattcctacgatttcgaggcagggaccctttactgttgtgttgtttgtgacgttggaacaggttcgcaagttgttcaaggattactaagatggatgatgacgaagatctttgattttttcaattaaaattcctagctttcatattttttatttatttaatttctgagctctggtttatggattgatggctctctcgtcaacggtgtatcaattttatacatcctatatatatagtttatattta

SEQ ID NO: 3509 - DNA, 2134 bp, Glycine max
aaaagaaggaggcaaggtcccttccctataaccgcgtgaattaataagccaacgtgacctttccattccacaagttggtgcggcccgtaatcgcgtttttcactagtataaattccccttctcatttcccagaccataaccaaaacacatcgtttattcagcatatgtctcaaaggcccacgattcctcactcttcttccatagcctgcggccttcactctcatctcctggtctccagtgagatgaaccctagctccaattggtcccattagttacctctttcctgcatctcatatatcccattctttctcattcacacagcatcatgggcgtcaaaggttttgttgaaggaggcatcgcttccatcatcgcaggatgttccacacacccacttgatctcatcaaggtccgcatgcagctccagggtgaaaacaatttgcccaaaccggttcaaaatctccgacccgcactcgccttccaaaccggttcgaccctacacgtggcagctgcagttccgccgccccgcgtgggccccatctcggttggggttcgcctcgtccagcaagagggcctcgccgccttgttctccggcgtctccgccaccgtcctccgccagacgctctactccaccacccgcatgggcctctacgacgtgctcaagaccaagtggaccgactccgtcaccggcaccatgccactcggaaaaaagatcgaggccgggctcatcgccggcggcatcggcgccgccgtgggaaaccccgccgacgtggcgatggtccgaatgcaggccgacggccgcctccctccggcgcagcggcgcaactacaagtccgttgtggacgccatcacgcgaatggcgaagcaagagggcgtcactagcctgtggagaggctcatcgcttacggtgaaccgcgccatgctcgtgacggcgtcgcagctggcttcctacgaccagttcaaagaaatgattctcgagaacggcgtgatgcgcgacggcctcgggacccacgtcacggcgagcttcgcggcggggttcgtggcggcggtggcgtccaaccccatcgacgtgatcaagaccagggtgatgaacatgagggtggagcccggggaggcgccgccgtacgccggcgcgttggattgtgctctgaagacggtgcgcgcggagggtcccatggcgctttataagggttttattcctacgatctcaaggcagggaccgttcactgttgtgctgttcgtgactctggaacaggttcgcaagttgcttaaggatttctgatgatgacgaagatgtatgctactttcattttcaataagatgcgttttgtgtttgtcttgtgctctaatactagtgatgtagttctggaatggtaattttgttattctattaatcaatgagaagcacacattattctccgaattaaacttagataatcttattttttcatttgatcaaaaggctaattttatttatcatatatgactctcattagtctaataaatttttttaagcacaataaaaattaaatataaatttttttattaaataaatcgtgttcatttatgaaaatgtattagagtctttactgcaccaaatttttatactacacggcaaattgtttattctcacgtaattatagattctgagaatctttttagttttattttaagaattctgtatttgatttgaaaggtgaaaatgttgcaagagtatggtattcatgaagttttctgagatctagaaataggtggcgatattagtgacgattgtgtctttctcacgcagaacttacattagtcattagacccgacacagcacaattgtttgcggagtaattggtgttctaaaatctaaagtaaatatcccacttggatattttgggggttgggtcatgagacgcgtaaagtatctcactccttctctatgtatatcatacgcgtgaccaaagtgctaaaaaaagtgccaaggattatcctttccttcttttaaatatgcttgttttattgtctttccttcttttttaacccatgcttgtttgttgtaatgccttctcttctttttaatctgtggtcttccaactttattctctacgatcggttggtacttaatgctagaagcctagaaggtagaagc

SEQ ID NO: 3510 - DNA, 2238 bp, Cicer arietinum
ctaaattttatattaatattttgtacataaataaataaattctgattggaggcttccaaagaaagagggtatttttacaagcgcgttaattaactattacaagaatttggactaaagtttctttttttccaccaatttgtgcatcctgtaatcgcgttgaagcagtaacctagatacttccaaagaacaaaccaactataaaacccccctcaacctttcttcttttctccacacaaaaactacagcatatgtctcaaaggccttccgttcctcactcttcttctatagcttgtggtctccattctcatctcctggtctccagtgagatgaactctaactccaattggtcctattctaattgccactagttattattagatctacaattatttcattctttttctcctaaatttttttctattctttcaaacctttttctcaaaaaaaccaaagcatcatgggtgtcaaaggttttgttgaaggaggcattgcttccattatcgcaggttgttccacccacccacttgatttaatcaaggttcgtatgcagctccaaggcgaaaacgctcccaaaccgaacccggttcataacctccgaccggcacttgctttccaaaccggaacaacttccatccacgtggggcctactccgctcccacaacctcgtgtgggtcccatctcagttggtgtacgtctcgtccaacaagaaggcgtccgagctctcttctccggcgtctccgccaccgtgctccggcagactctctactccaccaccaggatgggcctttacgacatccttaagactaaatggtcagatcaagctagcggtaacatgccgctggctcgcaaaatcgaggccggactcattgccggcggagtcggagccgcgattggaaaccctgccgatgtagccatggttcgaatgcaagccgatggaagacttccatcggctcagcgtcggaactacaaatctgtcgtggacgccattacaagaatggcgaaacaggagggcgtgacaagtctctggcgcggttcatctttaacagtgaaccgcgctatgttagtcacggcctcccaattagcctcctacgatcaattcaaggagatgattctcgagaagggagtgatgcgtgatggacttgggacccacgtgacagcgagttttgcggcgggatttgtggcggcggtggcaagtaacccagtggatgttattaaaacgagggtgatgaatatgaaggtggaggcaggtaaggaagcaccttatgctggtgctttggattgtgctttgaaaacggttcgtgctgaaggtcctatggctctttacaaagggtttatacctacaatttcgaggcagggtcctttcactgttgttctttttgttactcttgagcaggttcgcaagttgttcaaagatttctgagtaagtagatcgatgatgatgacgaagatttttagtttaagtttcgattccaataaactctgtttgaaattattttcctagtgttctgttgttatgaaatggtaattttgttataatgttatttgattaatgaaagtggcattcaacaaacaatttaaggaatatttttaaattgagaatttgacagtttgaccacagcaaatcactaattttttatttttttaaagttttgaatatgagaaaggaattgcgtgcacgtaaataataaaataggtggaacttattagcttgttattttggtttcaattttgaaaggaaagtgcgagcagtttggtaacgatatcttttttatggtaacaattgtgtgagattgaggatgaaaggaaagtttagtatattggtaaaggtgcatgtggtggtgctgaatgtttcttcctcagacaatgtaagttgtttgtcacgattcagtgcacttattagctagcggaataattcatgatcccaaaaatctctaatgcacataatttaggggattggggcccaaatgaggtgttaaattatctcctttatatatctgtgtgttacaaatctcttgagtgcgtgttcctgtcgcaatactattattatcagaaattaggacaacattgttttcaatttttatctatatttatgtttgatacgtgtcaatgttttaagatggatgtttatctccaattaattgtgcccgtggaaatggtggtggtgggattttcatgtcatagtttttttaataatcatctttaggggaaacggagttaataatttagtcctaataattt

SEQ ID NO: 3511 - DNA, 1959 bp, Cajanus cajan
acaccaaaaccaaaacctatcgtttcagcatatgtctcaaaggcccacggttccacactcttcttccatagcctgcggcctccactcccatctcctggtctccagtgagatgaaccctaattccaattggtctcattagttcaaccttttctcattctttcaaaccaacacaactaaccctagttaactcctcactcctcactcctcactccattccaaacaaaaacatcatgggcgtcaaaggtttcgctgagggagggatcgcttccatcatcgcaggatgttccacacacccactcgacctcatcaaggtccgcatgcagctccagggcgaaactaatgtccctaaaccgcttcacaacctccggcccgcactcgcgttccaaaccggttcgactgtccacgtggcggccttaccccagccccgcgtcggccccatcgcggtcggcgtccgcctcgtccagcaggagggcgtcgccgcactcttctccggcgtctccgccaccgtcctccgccagatgctctactccaccacccgcatgggcctctacgacgtcctcaagaccaagtggaccgaccccgccgccggcaccatgccgctcacccgcaagatcgaggccggtctcatcgccggcggcgtaggcgccgccgtcgggaaccccgccgacgtggccatggtccgaatgcaggccgacgggaggctcccggcggcggagcggcgcaactacaagtccgtggtggacgccatcacgcggatggcgcggagcgagggcgtggctagcctgtggcgaggctcatcgcttacggtgaaccgcgcgatgctcgtgaccgcatcgcagctcgcgtcgtacgatcagttcaaggagatgattctggagaagggtctgatgcgcgacgggctcgggactcacgtcacggcgagcttcgcggcggggttcgtggccgcggtggcgtccaaccccgtggacgttattaaaacgagggtgatgaacatgaaggtggagcccggggcggcgccgccgtacgccggcgcgttggactgtgctctgaagacggtgcgcgcggaggggcccatggccctttacaaggggtttgtgcctacgatctcgaggcagggaccgttcaccgtcgtgctgttcgtgacgctggaacaggttcgcaagctgcttaaggatttctgattatgataatgatgatgacgaagattacgctttccttttcaataatatgcggtttgattttgtgttatgaattatgatgtagttctggaatggtaattttgttactttattcatcaatgagagcaagttgttcacgtttaagagaattcttcaatatttttctagtgtgattttgagggtaaaattgttttttcaagtatcgaaagaaattataatctcgcacatgatcttcgggggttgggactttgggcccacgagacgcgtaaagtgttttcctcttctcgaaaaatagtatatgtatattcgcatgtgatcaaagtaccatggaaagaaaacaacagggattattcttttcttccttgtaacccttgtttgtttgatctaatgtctttccttctttttgatccgtctccttccaactttattctctacgatcagttggtacccaatgccagaaggaacttatggattaaatagttatttaaataaaaattaaaattttaacgatgattaatttcattatatctcttgattagttgataaaattgaaaacgggttgagctgttttttaactatattttattgtatgcttttaaagaaatttgtgttctattgggcaattttccaaggttcaaaatagggaaatcgatttaatattatttcttcctattgaaaagacatatacttttgcaagaaaaatgggagatacttctctgttgtgaggttttgtttttagtcttgttgtagtttgttttttgaacttaggagttaggtctct

SEQ ID NO: 3512 - DNA, 1587 bp, Cajanus cajan
caaaacctatcgtttcagcatatgtctcaaaggcccacggttccacactcttcttccatagcctgcggcctccactcccatctcctggtctccagtgagatgaaccctaattccaattggtctcattagttcaacctttttcctcactcctcactcctcactccattccaaacaaaaacatcatgggcgtcaaaggtttcgctgagggagggatcgcttccatcatcgcaggatgttccacacacccactcgacctcatcaaggtccgcatgcagctccagggcgaaactaatgtccctaaaccgcttcacaacctccggcccgcactcgcgttccaaaccggttcgactgtccacgtggcggccttaccccagccccgcgtcggccccatcgcggtcggcgtccgcctcgtccagcaggagggcgtcgccgcactcttctccggcgtctccgccaccgtcctccgccagatgctctactccaccacccgcatgggcctctacgacgtcctcaagaccaagtggaccgaccccgccgccggcaccatgccgctcacccgcaagatcgaggccggtctcatcgccggcggcgtaggcgccgccgtcgggaaccccgccgacgtggccatggtccgaatgcaggccgacgggaggctcccggcggcggagcggcgcaactacaagtccgtggtggacgccatcacgcggatggcgcggagcgagggcgtggctagcctgtggcgaggctcatcgcttacggtgaaccgcgcgatgctcgtgaccgcatcgcagctcgcgtcgtacgatcagttcaaggagatgattctggagaagggtctgatgcgcgacgggctcgggactcacgtcacggcgagcttcgcggcggggttcgtggccgcggtggcgtccaaccccgtggacgttattaaaacgagggtgatgaacatgaaggtggagcccggggcggcgccgccgtacgccggcgcgttggactgtgctctgaagacggtgcgcgcggaggggcccatggccctttacaaggggtttgtgcctacgatctcgaggcagggaccgttcaccgtcgtgctgttcgtgacgctggaacaggttcgcaagctgcttaaggatttctgattatgataatgatgatgacgaagattacgctttccttttcaataatatgcggtttgattttgtgttatgaattatgatgtagttctggaatggtaattttgttactttattcatcaatgagagcaagttgttcacgtttaagagaattcttcaatatttttctagtgtgattttgagggtaaaattgttttttcaagtatcgaaagaaattataatctcgcacatgatcttcgggggttgggactttgggcccacgagacgcgtaaagtgttttcctcttctcgaaaaatagtatatgtatattcgcatgtgatcaaagtaccatggaaagaaaacaacagggattattcttttcttccttgtaacccttgtttgtttgatctaatgtctttccttctttttgatccgtctccttccaactttattctctacgatcagttggtacccaatgcca

SEQ ID NO: 3513 - DNA, 1609 bp, Lotus japonicus
acaccaaaaccaaacacaccatagcatatgtctcaaaggcccaacgttccacactcttcctccatagcctgtggcctccattcccatctcctggtttccagtgagatgtcctctaactccaactggtcctatacaatcatcccccattaatttcagtcctttttcttttcattctttcaaaaaacacccctaattagctaccaatttcttcaactctcttttactctttcctcattctctaagaaaaaaaccaccacaatgggccttaaaggtttcgcagaaggaggcatcgcttccatcatcgccggttgctccacccaccctctagatctcatcaaggtccgcatgcagctccagggtgaagccaacgctgcccctaaaccggttcaacaactccgacccgctctcgccttccaaaacggttcaaccatccacgtggcggcgcatccacattctcctccgccgccgccgatgccacaaccccgcgtgggccccatttctgttggcgtccgtcttgttcaacaagaaggcctccgcgcactcttctccggcgtctccgccaccgtcctccgtcagatgctgtactccaccacccgcatgggcctctacgacatcctcaagcagaagtggtccaacggcggaaacatgccgctctcacgcaagatcgaggccggactcatcgccggtggaatcggcgccgctgttggcaaccccgccgacgtcgccatggtgcgaatgcaggccgacgggaggctcccggcggcgcagcgccggaactactcatctgtagtcgacgccatcaccaggatggcgaagcaggagggagtcaccagcctctggcgcggttcatcgctgactgtgaaccgcgcgatgctggtgacggcgtcgcagctggcgtcgtacgaccagttcaaggagatgattctggagaagggtttgatgcgtgacgggcttgggacccacgtgacggcgagtttcgcggcggggtttgtggcggcggttgcgtcgaacccggttgatgtgattaagacgagggtgatgaacatgaaggtggagcctggggcggagccgccgtacgccggcgcgttggactgtgccttgaagactgtgcgtgctgagggacccatggctctctataagggattcatacctacaatttctaggcagggacccttcaccgtggtgctgttcgtgacattggaacaggtccgcaagatgttcaaggattactagattgatgatgatgacgaagaattgaatgaatgtttactatgtttacttttcaataagctctgcattttgttttagaaaaatattagtacttatattattaatcaaattaaggttgttgttcttattttttgtttctaatccaggattatttttcatacattatccctaaatcaactagcacggttgaatgaatttggatccttgaattgttgtcacgttaaagttttttgttcatttatttatttctttgtacttgaaaagtatacacaatttaaagacatcaccatcatactgatgtatcagtataaagggtaaattccgattcaatgtattgaatttgaatggaagaaattatatacgtttacgttaccttgta

SEQ ID NO: 3514 - DNA, 1584 bp, Medicago truncatula
gatgcttccaaaaaataccccaactataaatactctctcatatctcttcttttctccacaccaaaacaacattcatagtttcttagcatatgtctcagagacctaacgttcctcactcttcttccatagcctgtggccttcattcccatctcctggtttccagtgagatgagctctaactctaattggtctttttccaattcccagtagaactagtttctctactactatcaattaaattcattattacacccccaatattcatttttattctttgaaacttattgaaaccctttttctatactaactcagaaacaacaacaaaaaaacaccatgggtgtcaaaggttttgttgaaggtggtattgcttcaatcatagcaggatgttccacacatccactagatcttattaaggttcgcatgcaacttcaaggtgaaaacgcgcctaagccgaacccagttcagatccttcgaccggctcttgctttcggtcaaaccggaacaactacgatccatgttgggtctactccggttcctcagcctcgtgtgggccttgtctcagtcggagtccgtcttgttcaacaagaaggtgtaacagctttgttctctggcatctccgccaccgtgctcaggcagacactgtactccaccaccaggatgggactttacgaggttttgaaaaacaagtggacagatcgtgaagctggtggcactatgccgctggttcgcaagatcgaggctggacttattgctggtggggttggtgctgctatcggtaaccccgccgatgttgccatggttcgaatgcaagccgatgggagactcccaccggctcagcagagaaactacaaatctgttgttgacgccattaccagaatggcgaagcaggaaggtgtgactagtctctggcgcgggtcatcattgactgtgaaccgcgccatgctggtcacagcttcacagctggcttcatatgatcaattcaaggagatgattcttgagaagggtgttatgcgtgatggccttgggacccatgtgacagctagttttgcagcgggatttgtggcggcggttgcgtcgaatccagtggatgttattaagacaagggtgatgaacatgaaggtggaggctggaaaggaaccaccctatgctggtgctttggattgtgctttgaagacagttcgtgctgagggtcctatggctctttacaagggatttattcctacaatttcaaggcagggacctttcactgttgttctgtttgttactttggagcaagttcgcaagttgttgaaggatttctgagttgctagattgatgatggcgaagatttttagtttttaagttgattccaataaactctgttttaatttttgtcttctaatgtggttgttctagatggtaattttgattaatgaaaaccatgattttaaattgatgtgcagatcttatatcggaatgacaaaacaccagaaaatgtggtttatgctacttatgatattcatattgaatattaatcacctataaaatatgattaattgtaaatgcttagattgtacgtgattaaaattgtggttaattcaattac

SEQ ID NO: 3515 - DNA, 1522 bp, Trifolium pratense
aaaacaacaaacgttatttcctttagcatatgtctcaaaggccttctgttcctcactcttcttccatagcctgtggccttcattcccatctcctggtttccagtgagatgtcctctaactccaattggtccttttccaattaattcattcttttttttattcattattaattcttttttattcttcttacaattttaaacccttttaccaaaaacaaaacatcatgggtgttaaaggttttgttgaaggtggtattgcttcgattatcgcaggatgttctacacatcctttggatcttattaaggttcggatgcaacttcaaggagaaaacgctcctaaaccgaacccggttcaggttcttagaccagcacttgcttttggccaaaccggatcagcaacctcgatccacgtggcaggccaaactgcggtaccacaagcgcgtgtgggtttggtttcggttggagttcgtcttgttcaacaagagggtgttaaggctttgttctccggtgtttctgctaccgtgctccggcagacgctgtattctactaccaggatgggtttgtatgatattctgaagaataaatggacggatcgtgaagctggcgggactatgccgctggctcgtaagattgaggctggacttattgctggaggagttggagctgcgattggaaatccggctgatgttgctatggttagaatgcaagccgacgggagactcccggcggctcagaggagaaactataaatctgttgttgatgccattactagaatggctaagcaggaaggcgtgaccagtctatggcgcgggtcatcacttactgttaaccgcgccatgctggtcacggcttcccagttggcatcttatgatcagtttaaggagatgattttagagaaaggtgtgatgaaagatggacttgggactcatgtgacagcgagttttgcggctgggtttgtggcagctgttgcatcgaatccggtggatgttattaaaactagggttatgaatatgaaggtggaggctggtaaggaaccaccttatgctggtgcattggattgtgctatgaaaacgattcgtgctgagggtcctatggctctttacaaaggatttattcctacaatttcaaggcagggacctttcactgttgttctgtttgttaccctggagcaggttcgcaaggtgttgaaggatttctgagttataggatcgatgatcgatgatgatggcgaagaagtttagcttttaatttgattccaataaactgttctaatgtgatgttcattttgatgatgttattgattaatgaaaaccatggattttaaattgctatgcaaatcttgttctaagatgattattttgatgatgttattggttaatcaaaaaccatgatttttaattgctatataaaacttgatatcagtgacaaaataggagaaattgtccgtcttatttcaaccgtctgattaaaattgcgcaagacaaaagatcgaataagattagaccgtccatattgtcttgact

SEQ ID NO: 3516 - DNA, 1327 bp, Trifolium pratense
cgttatttcctttagcatatgtctcaaaggccttctgttcctcactcttcttctatagcctgtggccttcattcccatctcctggtttccagtgagatgtcctctaactccaattggtccttttccaattaattcattcttttttattcattattaattcttttttattcttcttacaattttaaacccttttaccaaaaacaaaacatcatgggtgttaaaggttttgttgaaggtggtattgcttcgattatcgctggatgttctacacatcctttggatcttattaaggttcggatgcaacttcagggagaaaacgctcctaaaccgaacccggttcaggttcttagaccagcacttgcttttggccaaaccggatcagcaacctcgatccacgtggcagggcaaactgcggttccacaagcgcgtgtgggtttggtttcggttggagttcgtcttgttcaacaagagggtgttaaggctttgttctccggtgtttctgctaccgtgctccggcagacgctgtattctactaccaggatgggtttgtatgatattctgaagaataaatggacggatcgtgaagctggcgggactatgccgctggctcgtaagattgaggctggacttattgctggaggagttggagctgcgattggaaatccggctgatgttgctatggttagaatgcaagccgacgggagactcccggcgcctcagaggagaaactataaatctgttgttgatgccattactagaatggctaagcaggaaggcgtgaccagtctatggcgcgggtcatcacttactgttaaccgcgccatgctggtcacggcttcccagttggcatcttatgatcagtttaaggagatgattttagagaaaggtgtgatgaaagatggacttgggactcatgttacagctagttttgcggctgggtttgtggcggctgttgcatcgaatccggtggatgttattaaaactagggttatgaatatgaaggtggaggctggtaaggaaccaccttatgctggtgcattggattgtgctatgaaaacgattcgtgctgagggtcctatggctctttacaaaggatttattcctacaatttcgaggcagggacctttcactgttgttctgtttgttaccctggagcaggttcgcaaggtgttgaaggatttctgagttataggatcgatgatcggtgatgatggcgaagaagtttagcttttaatttgattccaataaactgttctaatgtgatgttcattttgatgatgttattgattaatgaaaaccatggattttaaattgctatgcaaaaaaa

SEQ ID NO: 3517 - DNA, 1420 bp, Trigonella foenum-graecum
gccacaccaaaacaacacattgttgcttagcatatgtctcaaagacctaacgttcctcactcttcttccatagcctgtggccttcattcccatctcctggtctccagtgagatgagctctaactccaattggtctttttccaattcccagtagttctttttctacaatctattcaattcattcttacacctcccaaaattattttctatcttttcaaaaccttttttctctatactaactcagaaatccaaaatcatgggtgtcaaaggttttgttgaaggtggtatcgcttcaatcatcgctggatgttccacacatccactagatctaatcaaagttcgcatgcaactccaaggagaaaacgctcctaaaccgaacccggttcagatcctccgaccggcacttgctttcggtcaaaccggaacaaccacgatgcatgtggggcctactccggttcctcagcctcgtgtggggctcatctcagtcggagtccgcctcgttcaacaagaaggtgtaacagccttgttctccggcatctccgccaccgtcctccggcagactctgtactccaccaccaggatgggactctatgaggtcctgaaaaacaagtggacagatcgtgaagccggtggcactatgccgctggctcgtaagattgaggctggacttattgccggcggggttggtgctgcgattggtaaccccgccgatgttgccatggtccgaatgcaagccgatgggagactcccaccggctcagcggagaaactacaaatctgtagttgatgccattactagaatggcaaagcaggaaggtgtgaccagtctctggtgcgggtcaacattgaccgtgaaccgcgccatgctggtcacagcttcacagctggcatcatatgatcagtttaaggagatgattttggaaaagggagtcatgagtgatggacttggaactcatgtgacagcaagttttgcggcgggatttgtggcgtcggttgcgtcgaatccggtggatgttattaagactagggtgatgaacatgaaggtggaggttgggaaggaaccaccttatgctggtgctttggattgtgctttgaaaacagttcgtgctgagggtcctatggctctttacaagggatttattcctacaatttcaaggcagggacctttcactgttgttctgtttgttactctggagcaggttcgcaagttgttgaaggatttctgagttagtagattgatgatggcgaagatgttttgtttttaatttgattcaaataaactctgttttaatttttgtgttctattgttccaaatggtaattttgacaatgttattgattaatggaaaccatggttttaaatttctatgcaaatcttaatatcagtaacaaaaaaatagtggttaatgtcggtaatgatgtt

SEQ ID NO: 3518 - DNA, 1378 bp, Vigna unguiculata
gacaaaacgtcccagcatatgtctcagaggcccacggttccacactcttcttccatagcctgtggcctccattctcatctcctggtatccagtgagatgaaccctaattccaattggtctcaatagcttcaaatttctctactttttcatctcattctttcaaaaatcaaaccaattcattaccactaactctagttaacccttattcatccccattctcattttccgacacaacaaaaacatcatcatcatcatgggtgtcaaaggtttcgtcgagggaggcatcgcttccatcatcgccggatgttccacacatccacttgatttgatcaaggtccgcatgcagctccagggagaaaacaacgctcccaaaccggttcacaatctccgacccgcactcgcctttcaatccggttcaaacgtccacgtggcgaccattccgcaggctcgtgtgggccccataggggtcggcgtccgcctcgttcagcaagaaggccttgcggccctcttctccggcgtctccgccaccgtcctccgccagacgctctactccaccacccgcatggggctctacgacatcctcaagaccaagtggaccgaccccgcctccggcaccatgcatctcggccgcaagatcgaggccggcctcatcgccggcgccatcggagccgccgtcggaaacccggcggacgttgccatggttcgaatgcaggccgacgggcgcctcccgccggcagagcggcgcaactacaagtccgtcgtggacgccatcctgcgtatggcgaggcaagagggcgttactagcctgtggagaggttcatcgcttactgtgaaccgcgccatgctcgtgactgcgtcgcagctcgcgtcttacgaccagttcaaagagatgattctccagaggggcgtgatgcgcgatgggcttgggacccatgtcacggcgagtttcgcggcagggttcgtggcggcggtggcgtcaaaccccgtggacgtgatcaagacgagggtgatgaacatgaaggtggagcctgggtctccgccaccttacgccggcgcgttggattgtgctctgaagacggtgcgtgcggaggggcccatggccctctacaagggtttcgtgcctacgatctcgaggcagggacccttcaccgttgtgctgttcgtgacactggaacaggttcgcaagttgcttaaggatttttgaacggtagatcgacgaagaagacgatgacgaaaatgcttctttccttttcaataagatctgttttgttttggtgttgtgttgtattgtgataccgatattgtagtactagaatggtaattttgtttattttatctgtgaatcaatgagaagtttaagttttccgattgggttttg

SEQ ID NO: 3519 - DNA, 1412 bp, Cucumis melo
aatcaaaccattatttgtttgcgtaatacagagtcctctgttagcatatgtctcatagacccatcgttcctcattattcctccattgccttccatcttcattcccatctcttggtttctagtgagatgaactctaattccaactggtctttttaatccctattttctctgtcttttccgtttccccatatcagatctctccatatttctctctctttccgattctcttctttctttcccgagaaaatctccactcctcaacaatgggtgtcaagggatttgtcgaaggtggaattgcttccatcgttgccggttgttccacccacccgcttgatctaatcaaggtccgaatgcaacttcagggtgagacccctgctcccaccgctgcggttaataacctccgccctgctctcgcttttcaaaccacctctgtaactgctccgaggtctattaatattcctcccccgccgcctccgacggcgcgtgttggtccaatcgctgttggagttcgtattgtgcagcaggaaggagtcgccgctcttttctctggcgtttccgccaccgttctacgacagactctgtactccactacccgtatggggctttacgatattctaaaacaaaaatggaccgatcaggataccggaaaaatgccgctcattcggaagatatcggccggtttgatcgccggtgcggtaggtgctgcagttggcaacccggctgatgtagcgatggtccgaatgcaagccgacggacggctaccattggcgcagcgtcggaattacaaaagcgtggtcgacgccataacccagatggcacgtggggaaggcgtgacgagtctgtggcgtggttcctcgttgacggtgaaccgtgcgatgctcgtaacggcttcgcagctcgcatcgtacgatcagatcaaggagacgattctgcagaagggattgatgaaggacggactggggacacacgtgacggcgagtttcgccgctggattcgtggcggcggttgcgtcaaatccagtggatgtgatcaaaaccagggtgatgaacatgaaggtagaggcaggggcggcgccaccgtactccggcgcgttggattgcgcgttgaagacggtacgggcggagggcccaatggcactttacaaaggattcattccgacgatttcacgtcagggaccattcacggtggtgctgtttgtgacgctggaacaagtccggaaggtgtttaaagatttctaattaaagaatgatgatgacgaaaattgtaacatttttaaggatatattccaccataaatcgatgtgtttaagttcgaggttattttaattttatgggactattataattcacttttttccaacttcgttgtttgttcgtttcttcacgtagtgtgtctcccacaatcccttataac

SEQ ID NO: 3520 - DNA, 1374 bp, Trifolium pratense
cctttagcatatgtctcaaaggccttctgttcctcactcttcttccatagcctgtggccttcattcccatctcctggtttccagtgagatgagctctaactccaattggtccttttccaattccctctagaaattaatacaattaccaaattcttttttattcattattattgattaataataatcctccaaaattattttttattcttatacacaatttcaaacactttactcttttttttaacctaaaaaaacatcatgggtgttaaaggttttgttgaaggtggtattgcttcgattatcgcaggatgttctacacatccattggatcttattaaggttcggatgcaacttcaaggcgaaaacgccgctcctaaacccaacccggttcaggttcttagaccggcacttgcttttggtcaaaccggaacagcaacctcgatccacgtggctgcgcaaactgccgttccacaggctcgtgtgggtcttgtttcagtcggagtccgtctggttcaacaagagggtgttaaagctttgttctccggcgtttccgccaccatgctccggcagacactttattctactaccaggatgggtctatatgatatcttgaagaacaagtggacagatagtgaagccggcgggactatgccgctggctcgtaagatcgaggctggacttattgctggaggagttggagctgcaatcggaaacccggctgatgttgctatggttagaatgcaagccgacgggagactcccggctgctcagagaagaaactataaatctgttgttgatgccattactagaatggctaagcaggaaggcgtgaccagtctatggcgcgggtcatcacttactgttaaccgcgccatgctggtcacggcttcccagttggcatcttatgatcagtttaaggagatgattttagagaaaggtgtgatgaaagatggacttgggactcatgttacagctagttttgcggctgggtttgtggcggctgttgcatcgaatccggtggatgttattaaaactagggttatgaatatgaaggtggaggctggtaaggaaccaccttatgctggtgcattggattgtgctatgaaaacgattcgtgctgagggtcctatggctctttacaaaggatttattcctacaatttcgaggcagggacctttcactgttgttctgtttgttaccctggagcaggttcgcaaggtgttgaaggatttctgagttataggatcgatgatcggtgatgatggcgaagaagtttagcttttaatttgattccaataaactgttctaatgtgatgttcattttgatgatgttattgattaatgaaaaccatggattttaaattgctatgcaaa

SEQ ID NO: 3521 - DNA, 1602 bp, Eucalyptus grandis
cacctgaaccaatctctccaccgacaccgccggcagcaaaccgtcctctttcctttcttccccttttcgcatcgatcgtccgccggcatatgtctcagagacccgccgtccctcactcctcctccgtcgccttcggcctccactcccatctcctcgtctccagcgacatgaaccccaactccaactggtaaaggaacaggaggcggcgagagaggagaagaagatattcttccgatcccggcattgattccggcgaggggatagagcttgagatcaggccgtgttgatcgtctgttccggccgagttcggagatgggtgtcaagggattcgtggaaggaggcatagcctcgatcgtggccggctgctcgacccacccgctcgaccttctcaaggtccgcatgcagcttcagggcgaggggcacgcgcctcccaacccctccgtccagaacctgcgccccgccctcgctttccaatcgccggcggcggcggcggctcccttgccgcggcccctgcctccgccgcgagtcggcctggtcacggtgggcgtgcggctcgtccggcaggaaggcgtggccgcgctgtactccggcgtgtcggccaccgtcctccgccagaccctctactccaccacccggatgggcctctacgacgtgctgaagcagaagtggaccgacccggccaccgggaacatgccgctgacccggaagatcgtggccgggctcatcgccggcggcatcggcgcggccgtcgggaacccggcggacgtggccatggtgcggatgcaggcggacgggcggctcccgccggagcagcgccggaactaccggagcgtggtggacgccatccagcggatggcgcggcaggagggggtggcgagcctgtggcgggggtcgtcgctgacggtgaacagggcgatgctggtgacggcgtcgcagctggcgtcctacgaccagatcaaggagaccatcctggccaaggggctgatgaaggacgggctggggacgcacgtcacggcgagcttcgcggccgggttcgtggcggcggtggcgtcgaacccggtggacgtgatcaagacgagggtgatgaacatgaaggtggaggaggggcgggagccgccgtaccggggggccgtcgactgcgcgctgaagacggtgagggcggaagggccgatggcgctgtacaaggggttcatcccgacgatatcgcggcaggggccgttcacggtggtgctcttcgtcacgctcgagcaggtccggaagctgctcaaggatttctagctgcgtcgacggcggcggcggcgacgggatgatgatgatgatggcgataattctaggatttctctaattagggaattacataaaattaaaatagaaaccatataatatgtggtggattctataaataaaaaatttatgatttagattacgtgccttgcatctagggtttcctgtgtgctgtaatgtatgatgaatccgtgtggctcccggaatacgggaaggaagatgccgcaatcaaagcgcccccttgcacccgcttttggttcttgttcctccgttgtataatttccaggtactatttaaaaaaaaaaaaattactttccc

SEQ ID NO: 3522 - DNA, 1372 bp, Citrus clementina
acttctcctagtcttgccaaatcagcctctctctctctctctctaaaaaaagaaaagaaagaaaaggctccttcttcttctttcttattatcacattgtagccggcatatgtctcatagacccatcgtccctcattcttcctccatagcttttggccttcattctcatctcctggtctccagtgagatgagctccaataccaactggtaacaacaacgcaacttacaattttcactgacccacaaattaattcgatctaacattatttttcattaaattgatcatttcttcttgattcgttttctgaaaacaaaaaaagaattaaaatgggtgtgaaaggctttgttgaaggcggcattgcttctattgttgctggatgttcaacgcatccccttgacctaatcaaggtccgcatgcaactccagggcgaaaaccaggttccgtctatgcgtcccgctctcgctttccatgccaactcctccgccgtccacgtgtctgcgccaccccgcctgggtcccgtcggcgtcggcgtccgtattattcaacaagaaggagtttcggctctcttttccggggtctccgccacggtgctccgccagaccttgtactccaccacgcggatgggtctctacgacgttctcaagcaaaagtggactgacccggaaacccggaacatgccgctcgtgcgtaagatagccgccgggttaattgctggtggaataggagccgccgtcggcaaccccgctgacgtggcaatggtccgcatgcaggctgacggaaggctccctcccgcgcagcgtcgcaactacaagagcgtcgtcgacgctataaccagcatggccaaacaagaaggcgtgaccagcctgtggcgaggatcgtcccttactgtgaaccgggccatgctggtcaccgcgtcgcagctggcgtcctacgatcagatcaaagaaaatatactgtcaaaagggtggatgcgcgacggcctcgggacccacgtgacggcgagtttttctgcggggtttgtggcggcggtggcgtcgaatcctgtggacgtgataaagactagggttatgaacatgaaggtcgaggccgggaaagagccgccgtacaaaggggcgctggattgtgccctgaagacggttcggagcgaggggccgatggctctgtataagggttttatccctacgatttccagacaagggccgtttacagttgtcctgtttgttacgcttgaacaggtcaggaagttgatgaaggatttctgaggatgatgacgacaacgacgatcaaaattagatatgttttgatgtggatttattattaattattcgcagtttaattcacaaggaagaaaataaacatgtgattcaattca

SEQ ID NO: 3523 - DNA, 1371 bp, Citrus sinensis
acttctcctagtcttgccaagtcatcctctctctctctctaaaaaaagaaaagaaagaaaaggccccttcttcttctttcttattatcacattgtacccggcgtatgtctcatagacccatcgtccctcattcttcctccatagcttttggccttcattctcatctcctggtctccagtgagatgagctccaattccaactggtaacaacaacgcaacttacaattttcactgacccacaaattaattcgatctaaaattctttttcattaaattgatcatttcttcttgattcgttttctgaaaacaaaaaaaaaagagttaaaatgggtgtgaaaggctttgttgaaggcggcattgcttctattgttgctggatgttcaacgcatccccttgacctaatcaaggtccgcatgcaactccagggcgaaaaccaggttccgtctatgcgtcccgctctcgctttccatgccaactcctccgccgtccacgtgtctgcgccaccccgcctgggtcccgtcggcgtcggcgtccgtattattcaacaagaaggagtttcggctctcttttccggggtctccgcaacggtgctccgccagaccttgtactccaccacacggatgggtctctacgacgttctcaagcaaaagtggactgacccggaaacccggaacatgccgctcgtgcgtaagatagccgccgggttaattgctggtggaataggagccgccgtcggcaatcccgctgacgtggcaatggtccgcatgcaggctgacggaaggctccctcccgcgcagcgtcgcaactacaagagcgtcgtcgacgctataaccagcatggccaaacaagaaggcgtgaccagcctgtggcgaggatcgtcccttactgtgaaccgggccatgctggtcaccgcgtcgcagctggcgtcctacgatcagatcaaagaaaatatactgtcaaaagggtggatgcgcgacggcctcgggacccacgtgacggcgagtttttctgcggggtttgtggcggcggtggcgtcgaatcctgtggacgtgataaagactagggttatgaacatgaaggtcgaggccgggaaagagccgccgtacaaaggggcgctggattgtgccctgaagacggttcggagcgaggggccgatggctctgtataagggttttatccctacgatttccagacaagggccgtttactgttgtcctgtttgttacgcttgaacaggtcaggaagttgatgaaggatttctgaggatgatgacgacaacgacgatcaaaattagatatgttttgatgtggatttattattaattattcgcagtttaattcacaaggaagaaaataaacatgtgattcaattca

SEQ ID NO: 3524 - DNA, 1542 bp, Trifolium pratense
tttccctttagcatatgtctcaaaggccttctgttcctcactcttcttccatagcctgtggccttcattcccatctcctggtttccagtgagatgagctctaactccaattggtccttttccatttcccactagaaccaaattcttttttattcattattattgattaattaatcctcattcttatacacaatttcaaacactttactcttttttaacctaaataaacatcatgggtgttaaaggttttgttgaaggtggtattgcttcgattatcgcaggatgttctacacatccattggatcttattaaggttcggatgcagcttcagggcgaaaacgctgctcctaaaccgaacccggttcaggttcttagaccggcacttgcttttggtcaaaccggaacagcaacctcgatccacgtggctgctgcgcaaactgctgttccacaggctcgtgtgggtttggtttcagtcggagtccgtcttgttcaacaagagggcgttaaggctttgttttccggcgtctctgctaccatgctccggcagacactgtattctactaccaggatgggtctatatgatatcttgaagaacaagtggacagatagtgaagccggcgggacgatgccgctgattcgtaagatcgaggctggacttattgctggaggagttggtgctgcgatcggaaacccggctgatgttgctatggtcagaatgcaagctgacgggagactcccggcggctcagagaagaaactacaaatctgttgttgatgccattacaagaatggctaagcaggaaggcgtgaccagtctctggcgcgggtcttcacttactgttaaccgcgccatgctggtcacggcttcccagcttgcatcttatgatcagtttaaggagatgattttagagaaaggtgtgatgaaagatggacttgggactcatgtgacagcgagttttgcggctggatttgtggctgcagttgcatcgaatccggtggatgttattaaaactagagttatgaacatgaaagtggaggctggtaaggaaccaccttatgctggtgcattggattgtgctatgaaaacagttcgtgctgagggtcctctggctctttacaaaggatttattcctacaatttcgaggcagggtcctttcactgttgttctgtttgttactctggagcaggttcggaaggtgatgaaggatttctaagttagaagatcgttgatgatggcgaagaagtttagtttttaattcgattccaataaactgttttaatatttttactagtgttgttcaccaatggttctatgttactgattaatgaaaaccatggattttaaattgctatgcaaatcttgttctaagatgattattttgatgatgttattgattaatcaaaaaccatgttttttaattgttatgcaaagcttgatatcagtgacaaaataggagaaattgtccgtcttatttcaaccgtctgattaaaattgcgcaagacaaaagatcgaataagattagaccgtccatattgtcttgact

SEQ ID NO: 3525 - DNA, 1427 bp, Trifolium pratense
cgttatttccctttagcatatgtctcaaaggccttctgttcctcactcttcttccatagcctgtggccttcattcccatctcctggtttccagtgagatgagctctaactccaattggtccttttccaattccctctagaaattaatacaattaccaaattcttttttattcattattattgattaataataatcctccaaaattattttttattcttatacacaatttcaaacactttactctttttttaacctaaaaaaacatcatgggtgttaaaggttttgttgaaggtggtattgcttcgattatcgcaggatgttctacacatccattggatcttattaaggttcggatgcaacttcaaggcgaaaacgccgctcctaaacccaacccggttcaggttcttagaccggcacttgcttttggtcaaaccggaacagcaacctcgatccacgtggctgctgcgcaaactgctgttccacaggctcgtgtgggtttggtttcagtcggagtccgccttgttcaacaagagggtgttaaagctttgttctccggcgtttccgccaccatgctccggcagacactttattctactaccaggatgggtctatatgatatcttgaagaacaagtggacagatcgtgaagctggcggaactatgccgctgattcgtaagatcgaggctggactaattgctggaggagttggtgctgcgatcggaaacccggctgatgttgctatggttagaatgcaagccgacgggagactcccggcggctcagaggagaaactacaaatctgttgttgatgccattacaagaatggctaagcaggaaggcgtgaccagtctatggcgcgggtcttcacttactgttaaccgcgccatgctggtcacggcttcccagctggcatcttatgatcagtttaaggagatgattttagagaaaggtgtgatgaaagatggacttgggactcatgtgacagcgagttttgcggctggatttgtggctgcagttgcgtcgaatccggtggatgttattaaaactagagttatgaacatgaaagtggaggctggtaaggaaccaccttatgctggtgcattggattgtgctatgaaaacggttcgtgctgagggtcctctggctctttacaaaggatttattcctacaatttcaaggcagggacctttcactgttgttctgtttgttactctggagcaggttcgcaaggtgatgaaggatttctaagttagaagatcgatgatgatggcgaagaagtttagtttttaattcgattccaataaactgttttaatatttttactagtgttgttcaccaatgttctatgttactgattaatgaaaaccatggattttaaattgctatgcaaatcttgttctaagatgattattttgatgatgttattga

SEQ ID NO: 3526 - DNA, 1155 bp, Vicia sativa
ttttttctctctactaactcaaaaacctaaaacaacaacatcatgggagttaaaggttttgttgaaggtggcgttgcttccatcatagcaggatgttccacccacccgcttgacctaatcaaggttcgcatgcaactccagggcgaaaacgctcccaaaccgaacccggttcagaatctccgacccgctcttgctttcggtccaaccggaacaacttccatcaatgttgcccataccccggttgctccagctattcagcctcgtgtgggtccgatctccgttggagtccgtctcgttcaacaagaaggtgtcagagccttattctccggcgtctccgccactgttctccggcagacactctactccaccaccaggatgggtctctacgacatcctgaaaaacaaatggtcagatcgtgaagccggaaccatgccgcttctccgcaagatcgaagctggactcatcgccggtggagtcggagccgcaatcggaaatccggccgatgtcgccatggtccgaatgcaagccgatggtcgactcccagtatcccagcgtcgaaactacaaatcagtcatcgacgccattaccagaatggcgaaacaagaaggtgtaacgagtctctggcgcggttcatctttaaccgtgaaccgtgccatgctggttacagcttcccagctggcgtcatacgaccagttcaaggaaattatcctcgagaaaggattaatgaaagacgggcttgggacccacgtgacagcgagttttgcggcggggtttgtggctgcggttgtgactaatccagttgatgttattaaaactagagtcatgaacatgagggtggagcctgggaaggaaccaccttatgctggtgctttggattgtgcggtgaaaacggttcgtgctgagggtcctatggctctttacaaagggtttatacctaccatttcgagacagggtcctttcacggttgttttgtttgttactctggagcaggttcgcaagttgttgaaggatttctgagttagtagaagatgatgacgaagatacttatctactccatattttgattgattcctaataattgtgttttaatttcttgtcttttgatggttattttgtttacgttattgatgaatgaaaactatggttttaaatgat

SEQ ID NO: 3527 - DNA, 1577 bp, Ricinus communis
cccatcattcattcttttttctttctcacccctccaattaagaaaaagaaaaaacacaaatctatctgttataatagcatatgtctcagaggccaaacgtccctcactcttcttctgtagcctttggtctccattcccatctcttggtttccagtgagatgaacccaaattccaactggtgtttcttcttctagttcccggaatttatatatttcttatataaatcgttctaatttcttggagaaagagagaaaccagaacccagagaaagataatcttttatttacttatataccaaaaatgggagtgaaaggttttgttgaaggagggatagcttcaatcattgctgggtgctccacgcatcctcttgaccttattaaggtccgaatgcaactccaaggcgaaactcacgctccgactgctgtccaaacgctccgtcctgctcttgctttccaccctcctggcaccactacccccgcatcggccatacacgtccatcctcctcgcgtgggccccatttctgtcggtgtccgtatcgtccagcaagagggtgttgccgctcttttctcaggtgtctccgccacggttctccgtcagactctctactccaccacccgtatgggtctgtacgacatcttgaaacagaagtggacagatccgaacacaaaaaccatgcctttatcaagcaagattgtcgcaggattaattgccggtggtatcggagctgccgtcggaaaccctgctgacgtggcgatggtacgtatgcaagctgacggacgtctcccacctgctcaacgccgtaattataagagcgttgtggatgcgatcacccgcatgacaaaacaggaaggcattactagtctctggcgcggctcatctttaacagtgaaccgtgccatgttagtaacagcatcacagctagcatcatacgatcaattcaaggaaatgattctcgaaaaagggtggatgcgtgatgggcttgggacccatgtcacggcgagttttgcggcggggtttgtggcggctgttgcgtcgaatcccgtggatgtgattaagacgagggtgatgaatatgaaggtggaaccaggaaaggcgccgccgtattctggagcgttggattgcgcgttgaagactgtaaaagctgaagggccgatggcgttgtataaagggtttataccaacgatttcaagacaagggcctttcactattgtgttgtttgtgaccttggaacaggtcaggaaattgctcaaggatttctgaggatctattcatgatgatgatgatgaaaattagcttcttttttttttttaaaaaaaaaaaattctttggatttggatcggtggttatgaatattagtttttcataatcaagcttttcttttcatttttttttccaaaatttgtatttctatttctatgtgtaatggtcattctcttatagtctaaataaattaataattagttattgaaaaaataataattaaatcatcgagtatctaatatgtgatcataacagagaaaatcggatttaacttctaagtcattttattttgtactaaatttgaccacagagtaatg

SEQ ID NO: 3528 - DNA, 2063 bp, Ricinus communis
tcaaaattcaggagcttatttgtattttggcataaaaagaaaacaagaagaataatttgtggagattttggcatgtgcaagacacagcagagacttgagaaaagtctgaacaaagtggccgcataaccgcgtaaaacaaaaggaaacggctacaaattttccatatcttcacaatgtttcgcgtaagaacctaatttccattaccttttcccttccaccacagccattagtcactataaatacctacaccaccttcgtccctcaaaacccatcattcattcttttttctttctcacccctccaattaagaaaaagaaaaaacacaaatctatctgttataatagcatatgtctcagaggccaaacgtccctcactcttcttctgtagcctttggtctccattcccatctcttggtttccagtgagatgaacccaaattccaactggtgtttcttcttctagttcccggaatttatatatttcttatataaatcgttctaatttcttggagaaagagagaaaccagaacccagagaaagataatcttttatttacttatataccaaaaatgggagtgaaaggttttgttgaaggagggatagcttcaatcattgctgggtgctccacgcatcctcttgaccttattaaggtccgaatgcaactccaaggcgaaactcacgctccgactgctgtccaaacgctccgtcctgctcttgctttccaccctcctggcaccactacccccgcatcggccatacacgtccatcctcctcgcgtgggccccatttctgtcggtgtccgtatcgtccagcaagagggtgttgccgctcttttctcaggtgtctccgccacggttctccgtcagactctctactccaccacccgtatgggtctgtacgacatcttgaaacagaagtggacagatccgaacacaaaaaccatgcctttatcaagcaagattgtcgcaggattaattgccggtggtatcggagctgccgtcggaaaccctgctgacgtggcgatggtacgtatgcaagctgacggacgtctcccacctgctcaacgccgtaattataagagcgttgtggatgcgatcacccgcatgacaaaacaggaaggcattactagtctctggcgcggctcatctttaacagtgaaccgtgccatgttagtaacagcatcacagctagcatcatacgatcaattcaaggaaatgattctcgaaaaagggtggatgcgtgatgggcttgggacccatgtcacggcgagttttgcggcggggtttgtggcggctgttgcgtcgaatcccgtggatgtgattaagacgagggtgatgaatatgaaggtggaaccaggaaaggcgccgccgtattctggagcgttggattgcgcgttgaagactgtaaaagctgaagggccgatggcgttgtataaagggtttataccaacgatttcaagacaagggcctttcactattgtgttgtttgtgaccttggaacaggtcaggaaattgctcaaggatttctgaggatctattcatgatgatgatgatgaaaattagcttcttttttttttttaaaaaaaaaaaattctttggatttggatcggtggttatgaatattagtttttcataatcaagcttttcttttcatttttttttccaaaatttgtatttctatttctatgtgtaatggtcattttcttatagtctaaataaattaataattagttattgaaaaaataataattaaatcatcgagtatctaatatgtgatcataacagagaaaatcggatttaacttctaagtcattttattttgtactaaatttgaccacagagtaatgctattaatatgagaacaaatcaaaaaagaaaaaggggttcatttcattattttaatatatactaaattcttgcctcttacttgttggttaacacttgaaattgagcttcataagctaaattgtatgtatgtggcttctggtttgaggtctgaaacccagaattgccaaatggggaagataggacagacaaataacagtaggtttgcgattttggccgaa

SEQ ID NO: 3529 - DNA, 1252 bp, Cucumis sativus
aattaaaccattgtttgcttgcgtaatacaagagtcctgtgttagcatatgtctcacagacccatcgttcctcattattcctccattgccttcggtcttcattcccatcttttggtttccagtgagatgaactctaattccaactggtctttttaatccctattttcgccggcttttccgcttcccatatcatatctctccatatattcctctctttccaattctctttcctctcttctttctttcccgagaaaattcccatgggtgtcaagggatttgtcgaaggtggaattgcttccattgttgccggttgttccacccacccgcttgatctgatcaaggtccgaatgcaacttcagggtgagacccctgctcccaccgctgcggttcataacctccgccctgctctcgcttttcaaaccacctctgtaactgctccgaagtctataaatattcctcccccgccgcctccgccggcgcgtgttggaccaatcgctgttggggttcgtatcgtgcagcaggaaggagtcgccgctcttttctctggcgtttccgccaccgttctacgacagactctgtactcgactactcgtatggggctttacgatattctaaaacagaaatggaccgatcaggataccgggaaaatgcccctcattcggaagatatcggccggtttgatcgccggtgcggtaggtgctgcagttggcaacccggctgatgtagcgatggtccgaatgcaagccgacgggcggctaccattggcgcagcgtcggaattacaaaagcgtggtcgacgccataacccagatggcacgtggggaaggcgtgacgagtctgtggcgtggttcgtcgttgacggtgaaccgtgcgatgctcgtaacggcttcgcagctcgcatcgtacgatcagatcaaggagacgattttgcagaagggattgatgaaggacggactggggacacacgtgacggcgagtttcgccgctggattcgtggcctcagttgcgtcaaatccagtggatgtgatcaaaaccagggtgatgaacatgaaagtggaggcaggggctgcgccaccgtactccggcgcgttggattgcgcgttgaagacggtacgggcggaggggccaatggcactttacaaaggattcattccgacgatttcacggcagggaccattcacggtggtgctgtttgtgacgctggaacaagttcggaaggtgttgaaagatttctaattaaacaacgatgatga

SEQ ID NO: 3530 - DNA, 1260 bp, Euphorbia esula
aaatattttttcctcttatgtctcagaggtcgaacgttcctcattcttcctccattgccttcgctctccattcccatctcctggtctccagtgagatgaaccctaactccctctggtaacactattctaatctaatctaatcttccccaaaagaaaaaaaaattaaattccaattctacccccccaaaagatgggattcaaaggttttctcgaaggcggcatagcttcaattatcgccggttgctccacgcatcctcttgatctcctcaaggtccgcatgcaactccagggggaatctcacgcgccgcctgttcagacgctccgccctgctctcgctttccaccgtggggggaccaccaccattcacgtgcctcaacaaccccctctgcctccacctcctcgtgtcggccttgtcactctcggtgttaaacttgtccagaaagagggccccgccgctcttttctccggtgtttccgccaccgtcctccggcagactctgtattccacaacacgtatgggactctacgatatattgaaacagaaatggacggatccgaaaactaaaaccatgcctctagcaagcaagataggcgccggacttatcgccggtgggatcggagctgccgtcgggaatccggccgatgtggcaatggtacggatgcaggcggacggacgtcttcctcccggtgagcggcggaattacaaaagcgtagtggatgcgattactcgtatgtcgaagcaagaaggaattgctagcctgtggcgcggctcatcgcttacggtgaaccgcgctatgctggtgacggcgtcgcaattagcatcgtatgatcagtttaaggaaatgatcctggagaaggggttgatgaaggacgggcttgggacgcatgtgacggcgagtttcgcggcggggtttgtggcggcggttgtgtcgaatccggtggatgtgattaagacgagagtgatgaatatgaaggtggaagccggtggagttccgccgtatgcaggggcgttagattgcgctttgaaaacggtgaaagcggaagggccgttagcgctttataagggatttataccgacgatttcacggcaaggtccgtttacggttgttctgtttgttactcttgaacaggtcagaaaattgttcaacgatttctgatctgtgaattgacggcgacggcgacggcgaaagtcgtcttaatgcgcgcgtttaatttgtgaagctgcgaattaattaattccgcaatagtaattcaaatgtaa

SEQ ID NO: 3531 - DNA, 1224 bp, Euphorbia peplus
gccttcgctctccattcccacttcctcgtctccagtgacatgaaccctaattccctttcctaactaaatcaacttcccattccaattctaccccccaaaaccaaatatgggtttcaaaggtttcgtcgaaggcggcatagcttccattatcgcaggttgttccacgcaccctctcgatctcctcaaggtccgcatgcaactccagggtgaatctcaatctcacgcgcctctccgccctgctctcgctttccagcgtggtggtcccaccaccactatccacgtgcctccacctcctcgtgtcggccttgtcacactcggcgttaaacttgtccagaaagaaggtcccgccgctcttttctccggcgtctccgccaccgtcctccgccaaactctatactcaacaacacgcatgggactctacgatatcttcaaacagaaatggacagatcccaacactaaaacaatgcctctatctagcaagattgccgccggactcatcgccggaggtatcggagctgccgtcgggaatcctgccgacgtggcaatggtacggatgcaagcagacggacgtcttcctccaggtgagcgacggaattacaaaagcgtggtggatgcgattacacgtatgtcgaaacaagaaggcgttgctagcctgtggcgcggctcatcgcttacggtgaaccgcgctatgcttgtaacggcgtcgcaattatcgtcgtatgatcagtttaaggaaatgattttggagaagaagttgatgaaggacgggcttgggacgcatgtgatggcgagttttgcggcggggtttgtggcggcggttgtgtcgaatccggtggatgtgattaagacgagagtgatgaatatgaaggtggaagccggtggagctccgccgtacgccggcgcgttagattgtgctttgaaaacggtcaaagcggaggggccgttagctctttataagggttttataccgacgatttcacggcagggtccgtttaccgttgttctgtttgtcactcttgaacaggtcaggaaagtgttcaaggattggtgatctgttaattcacggtgacggtggaaagttgtcttaatgcgcgtttaatttgtgatactgttttttgcactcgttttaattaattgttgttactgttacttaattatttgattaattaaagggtcgttctagtgggattgtttaggcagtgtttagtttggccgggatgaaaa

SEQ ID NO: 3532 - DNA, 2430 bp, Vitis vinifera
cattgcagcgttctctcttggatacgcaaccagcatatgtctcagagacccaacgtcccacattcctcttccattgcatttggcctccattcccatctccttgtttccagtgatatgaaccccaactccaactggtcctcttagattttcttcttctttttcttaaaagccctggacaaagggatttaagcaaaaagaacccatcttttcgttttttcacttgctgggtccagtttgattgtgtgtttggtttctgagaaaacttagagatgggtctcaagggctttgttgaagggggtattgcttcgatcatcgctgggtgttccacccacccgctcgacctcatcaaggtccggatgcagctccagggtgagacgcaggttcccaatcccgccgttcaaactctccgtccagcgctcgctttccagacaggcgccgctcccacggctgtccacgtgactcggcccccgcgcgtgggtccgatcaccgtcggagtccggatcgtgcaacaggaaggggtggtcgctctcttctccggcgtctctgccaccgtccttcgccaaacgctgtactccactactcgcatgggtctctacgacattcttaagaagaaatggactgacccagctaccggcaacatgccgctcgtaagcaagataggagctggactgatcgccggcgggatcggggccgtcgtcggaaaccctgccgacgtggccatggtccgaatgcaagccgacggccgcctccctctggcccagcgccgcaactacaaaagcgttctggacgccataaccagaatgtccaaacaggagggagtcactagtctgtggcgcggctcctcccttacggtgaatcgcgccatgctcgtcacagcctcgcaactcgcctcctacgatcagatcaaggagacaatcctacaaaagggtctgatgaaggacggcctcggaacgcacgtgacggcgagcttcgccgccggatttgtagcggcagtggcctcaaaccctgtggacgtaatcaaaaccagggtgatgaacatgaaggtggagccgggggcggcgccgccgtacaccggagctttggactgcgccctgaaaacagtacgcgcagagggaccgatggccctctacaaggggttcatccctacaatctcaaggcagggacctttcactattgtgctcttcgtcacactggaacaggtccgcaagctgctcaaagatttctgatgatgacgatcaagaatattaggaattttaatttcgtgttttattttaaattataagaagaaaacaaaaacagtatcattcgatgctttggtttatggaaatgtggagggctgatgattttattgaataaattggaatttgagtaggggcccagccgcccagggagcgtggagggcacaggaaaatgcccattaaccctttacgcgtagagtccacagatgcccattgttgcttgcttaggaatttggaattatgaatgggtcgtcaacattacgatatttctttatgcagaattaatccctttcttgtaaatgcgccacacaaccaaattgtaaatgccccatacaaccgaacacgaggtggatgatgaatttggagggtgggatgcattcacaagaaccacgatccaatagcatgggcttgcttgccttgcttgccgacacttggaaggggctgtttatctgtttttttggccttatacgataattaggtgatggagttggatgagttatgaagagataattgaaggaacggatttggagttttggagatggaaagagggaggaaggtgattaatggtgatggtttctggttaggtgcatctggggccgtgtcatttagtgatttgatgttgataccttatacgcattggggtgactttttttaaatgtcgccgtcatggccacgttagaatcagtctgacatgttaagcaataggcctagtcatggggtcatcgattgagtggctggctataattgtcaaattgccttcgtcactttcatgttgggcacatcacaatttgaacatttccaccatgcagattgctacaatctgaacgaatttttccgcactgcagatgaccatctgcctaacgttttgctgcatatagacccagaaccatatgccacgttgactgcatattgtgacccagaagctaagaccacgcaaagtcgatggccccgttcaagtcctcctaacaagtgattcctctgggatggatttggacgtcagttttacttgtgaaatcatcatttgtgatggatatctgaccgacaactacaactacgacttgtaaaattattcaatcataacgtatctaaaatgctcgagttcttgtggcaacaaaaaggaatatgtttgcatttcctgtacaaactgcatctttaatctaactacatgatatcagtgcatctccatgctaaa

SEQ ID NO: 3533 - DNA, 1150 bp, Vitis vinifera
ttgctgggtccagtttgattgtgtgtttggtttctgagaaaacttagagatgggtctcaagggctttgttgaagggggtattgcttcgatcatcgctgggtgttccacccacccgctcgacctcatcaaggtccggatgcagctccagggtgagacgcaggttcccaatcccgccgttcaaactctccgtccagcgctcgctttccagacaggcgccgctcccacggctgtccacgtgactcggcccccgcgcgtgggtccgatcaccgtcggagtccggatcgtgcaacaggaaggggtggtcgctctcttctccggcgtctctgccaccgtccttcgccaaacgctgtactccactactcgcatgggtctctacgacattcttaagaagaaatggactgacccagctaccggcaacatgccgctcgtaagcaagataggagctggactgatcgccggcgggatcggggccgtcgtcggaaaccctgccgacgtggccatggtccgaatgcaagccgacggccgcctccctctggcccagcgccgcaactacaaaagcgttctggacgccataaccagaatgtccaaacaggagggagtcactagtctgtggcgcggctcctcccttacggtgaatcgcgccatgctcgtcacagcctcgcaactcgcctcctacgatcagatcaaggagacaatcctacaaaagggtctgatgaaggacggcctcggaacgcacgtgacggcgagcttcgccgccggatttgtagcggcagtggcctcaaaccctgtggacgtaatcaaaaccagggtgatgaacatgaaggtggagccgggggcggcgccgccgtacaccggagctttggactgcgccctgaaaacagtacgcgcagagggaccgatggccctctacaaggggttcatccctacaatctcaaggcagggacctttcactattgtgctcttcgtcacactggaacaggtccgcaagctgctcaaagatttctgatgatgacgatcaagaatattaggaattttaatttcgtgttttattttaaattataagaagaaaacaaaaacagtatcattcgatgctttggtttatggaaatgtggagggctgatgattttattgaataaattggaatttgagt

SEQ ID NO: 3534 - DNA, 1543 bp, Nicotiana benthamiana
cgcgtatggtttccccaaaaccctatttccacttgatttcctttcttttcctctttccctataaattcctttcttctacctctttcttaactcaccaattcattctttactgcttatgtctcagagacctagcgttccacacttcgcatctttagcttttggtcttcattcccatctcctggtttccagtgagatgtgctctaattccaattggtcttaaattgatccattttaatatcaatttttttgttctagtgttcaatttcttaattcttttttagctctcttatttcattcaattgaaataccaaaattttcgatttcgattattgaaagatgggtgttaaaggatttgttgaaggaggtattgcttctattattgctgggtgtagtactcacccacttgatttaattaaggtacgaatgcaacttcagggtgaaaccccagctccggcggcggcggttcagaatctccgtccggcacttgcttttcatagtggtactcacgctacgactcatattcatgttccggcgccgccacctccgcctcgtgtagggcctgttgctgtgggtgtaaagatcatacagcaagaaggtgttgctgctctgttctccggtgtttcggctactgttctccggcagacgctttattctactacacggatgggtttgtacgatatgttgaagcagaaatggaccgatccggatactaacaacatgcctttgtcgaggaagatcgttgccggacttatcgccggaggtatcggagccgccgtcggaaacccggcggacgttgctatggttcgcatgcaagctgacggccggctcccgttagctcagcggcgcaactacaaaagcgttgttgatgctataacgcaaatgagcaagagcgagggaattactagcctgtggcgcggctcatctcttacggtgaaccgcgctatgctcgttacagcatcacagctggcatcgtacgatcagttcaaagagacgatcttagagaaggggctaatgaaggacgggcttgggacccacgtgacggcgagcttcgccgccgggttcgtggcggcagtggcgtcgaatccggtagacgtgattaagacacgtgtcatgaacatgagggtggagcccggtatgaccccaccttatagtggggcccttgactgtgctatgaaaactatcaaagctgagggacccatggcactttacaagggtttcatccctacaatatcaaggcaaggaccattcactattgtgctctttgtcacactggaacaggtccggaaattactcaaggattactgatgatgacgaagaaaagtatttaaaatgtttttatttaattaatgttctaaatttaaaattagctccttaagtttaggagagaagtaatactaagtctatggtcagatgttgtgttcttacttatattgcttatatataaaaaattaatttctcgtttggtggaattattcttgatttagcaactgttgattgaaggcaagtattgtagtttctaattttctgatgttttttgcttgaa

SEQ ID NO: 3535 - DNA, 1368 bp, Nicotiana tabacum
ccaattcattctttactgcttatgtctcagagacccaacgttccacacttcgcatctttagcttttggtcttcattcccatctcctggtctccagtgagatgagctctaattccaattggtcttgaattgatccatttttttttgttctagtgttcaatttcttaattcttttctagctctcttatttcattcaattgaaataccaaaattttcgatttcgattattgaaagatgggtgttaaaggatttgttgaaggaggtattgcttctattattgctgggtgtagtactcacccacttgatttaattaaggtacggatgcaacttcagggtgaaacccctgctccggcggcggctgttcagaatctccggcctgcacttgcttttcatagtggtacccacgctacgactcatattcatgttccggcgccgccacctcctccccgtgtgggtcctgttgctgtgggtgtaaagatcatacagcaagaaggtgttgctgctttgttctccggcgtgtcggcgactgttctccgtcagacgctttattctactacccggatgggtttgtacgatatgttgaagcagaaatggaccgatccggatactaacaacatgcctttgtcgaggaagatcgtcgccggactaatcgccggaggtatcggagccgctgtcggaaacccggccgacgttgctatggtccgcatgcaagctgacggccggctcccgttagctcagcggcgcaactacaaaagcgttgttgatgctataacgcaaatgagcaagagcgaagggattactagcctgtggcgcggctcgtctcttacggtgaaccgcgctatgctcgttacagcatcacagctggcatcgtacgatcagtttaaagagacgatcttagagaaggggctgatgaaggacgggcttgggacccacgtgacggcaagcttcgccgccgggttcgtggcggcagtggcatcgaatccggtagacgtgattaagacacgtgtcatgaacatgagggtggagcccggtatggccccaccttatagtggggccctagattgtgctatgaaaactatcaaagctgagggacccatggcactttacaagggtttcatccctacaatctcaaggcaaggaccattcactattgtgctctttgtcacactggaacaggtccggaaattactcaaggattactgatgatgacgaagaaaaatatttaaaatgtttttatttaattaatgttctaaatttaaaattagctccttaagtttaggagagaactaatactaagtctatggtcagatgttgtgttcttactattatattacttatatatatatataaaatctcgtttggtggaatta

SEQ ID NO: 3536 - DNA, 1354 bp, Citrullus lanatus
caattcaccattcattcttttgcgtattacatagtcctctgttagcatatgtctcacagacccatcgttcctcattattcctccatagccttcggccttcattcccatctcttggtttccagtgagatgaactccaattccaactggtctttttaattcccctttccccgtcttttccgtttcccagatcagatctccatatttctctctgtttcgaattccattttctctcttgtttgtttcccgagaaaatttcgattcctggaaaatgggtttcaagggattcctcgaaggtggaattgcttccattgttgccggctgttccacccacccgcttgatctcatcaaggtccgaatgcaacttcagggtgagactcctgctcccacggccgcggttcataacctccgccctgctctcgcttttcaaaccacctctgtaactgctccgaggtctttgaatattcctccgccgcctccggcggcgcgtgttggtccaatcgctgtcggggttcgtattgtgcagcaggaaggagttgctgctctcttctctggcgtttccgccaccgtcctccgacagactctgtactcgactacccgtatggggctttacgatattctcaaacagaagtggaccgatcaggatacagggaaaatgccgctcattcggaagatatcggccggtttgattgccggtgcggtcggtgctgcagtcggcaacccggctgatgtagcgatggtccgaatgcaagccgacgggcggctaccactagcgcagcggcggaactacaaaagcgtggtcgacgccataacccagatggcacgtggcgaaggcgtgacgagtctgtggcgtggttcgtcgttgacggtgaaccgtgcgatgctcgtaacggcttcgcagctcgcatcgtacgatcagatcaaggagacgattctgcaaaagggattgatgaaagacggactggggacacatgtgacggcgagtttcgccgccggatttgtggcggcggtggcgtcgaatccggtggacgtgatcaaaaccagagtgatgaacatgaaggtggaggcgggggcagcgccgccgtactccggcgcgttggattgcgcgttgaagacggtgcgggcggaggggccgatggcactgtacaaaggattcattccgacaatttcacgacaggggccgttcacggtggtgctgtttgtgacgctggaacaagttcgaaaggtgtttaaagatttctaattaaagaatgatgatgacgaaaattgtaacattttaaagaatatattgcataaatcaaggtgattgagtttggagttattttaattttatgggaatattaattgtaagggcttt

SEQ ID NO: 3537 - DNA, 1622 bp, Fragaria vesca
ctctcctcttatttcttgtcctataaatattctcttctattgccttccttgttcaaacccaattcggttttaattcccttttctgtgattctcatagcatatgtctcagaggcccagcgttccccactcttcttccatcgccttcggcctccattctcatctcctggtctccagtgagatgacccccagctccaactggtcttgaatatcattgtccaaaccattactgatcaatattactcggttttatttctctcttttttttgaaagaaaagaatcgaaacatgggtgtgaaaggcttcgttgagggaggcatagcttccatcgtcgccgggtgttcgactcaccccatggacctgatcaaggtccgaatgcagctccagggtgagacccaggtccccaaacctgaccaagctcttcgaccagcgatggcctctgccgctaggggagccgcttcctctatccatgtccctgtccccccaaccccgcctccgcgcgtgggtctggtcaccgtgggagtcaagctcattcaacaagagggtgttgcggctttgttctccggcgtatcagccaccatgctccggcagtgcctgtattccactacccggatggggctgtacgacattctcaagaagaaatggactgacccggaaaccgggaacatgcccctgcagcgcaagatcggcgccggactcatcgccggagctatcggcgccacggtggggaacccggcagacgtggccatggtgcggatgcaggccgacgggcggctcccggcggctgagcgccggaactacaagagcgtggtggacgctataacccgcatggcgaagcaagaaggcgtcacgagcctgtggcgcggttcgtctatgacggtgaaccgcgccatgctcgtgacggcttcgcagctggcgtcgtacgaccagttcaaggagacgattctcgagaaagagctgatgcgagacgggctcggtacccacatcactgcgagtttcgcggcggggttcgtggcggcggtggcgtcgaacccggtggacgtgatcaagacaagggtgatgaacatgaaggtggagccgggggcggcgccgccgtacaagggggcgttggactgcgcggtccagacggtgcgttcggaagggccgatggcgctttacaaagggtttatacccacgatttctaggcaggggcctttcacggtcgtgctgtttgtgacattggagcaggtaaggaagttgctcaaagatttctgaagaaattaagatcatgatggagctaattgatgtcgacgaaacatggagtaatttttagaatatttacaataaaagttttcgatttaattcctttgtcatatgtcccctatagattgcggggaaggactcgtttagttaattatgaagcaaaattctcttacaataattgttcttaatcttttagggatacaaatttatttataatttggttggaaacattctttcccaaaatatatatattcgttactagaagatgatcgaatttgctactataatattatggtaacgtgaaaaatgttgatcacgtagcattgcctctacgactcttcactcgatattgatcgtcgtctggatcagcatcactgtcaaact

SEQ ID NO: 3538 - DNA, 1408 bp, Nicotiana tabacum
ggcgcgggggatcaccaattcattctttactgcttatgtctcagagacccaacgttccacacttcgcatctttagcttttggtcttcattcccatctcctggtttccagtgagatgagctctaattccaactggtcctcttgatttgatccattctaatttcagttttttttagagttcaaacaaattcttaaattctttttagttcttatatttcattcaattgaaatactaaaattttcgatctcggtttgatttctgaaatatgggtgttaaaggatttgttgaaggaggcattgcttctattattgctgggtgtagtactcacccacttgatttaattaaagtccgaatgcaacttcagggtgaaaccccagctccggcgccggctgttcaaaatctccggcctgcacttgcctttcacagtggtacccacgctacgactcatattcatgttccggcgccgccacctccgccgcgcgtggggcctgttgctgtgggtgtaaagatcatacagcaagaaggcgttgctgctctgttctccggcgtgtcggcgactgttctccggcagacactttattctacgacccggatggggttgtacgatatgttgaagcagaaatggaccgatccggatactaacaacatgcctttgtcgaggaagatcgtcgccggacttatcgccggaggtattggagccgccgtcggaaacccggccgacgttgccatggtccgcatgcaagctgacggccggctcccgttagctcagcggcgcaactacaaaagcgtcgttgatgctataacgcaaatgagcaagagcgagggtattactagcctgtggcgcggctcatctcttacggtgaaccgcgctatgctcgttacagcatcacagctggcatcgtacgatcagtttaaagagacgatcttagagaaggggctgatgaatgacgggcttgggacccacgtgacggcgagcttcgccgccgggttcgtggcggcggtagcgtcgaatccggtcgacgtgattaaaacacgtgtcatgaatatgaaggtggagcccggtacggtcccaccttatagtggggcccttgattgtgctatgaaaactatcaaagctgagggacccatggctctttacaagggtttcatccctacaatctcaaggcaaggaccattcactattgtgctctttgttacactggaacaggtccggaaattactcaaggattactgatgatgacgaagaaaaatattattactaaaatgtttcatttaattaatgttctaaattttaaattagctccttaagtttaggagagaagtaatactaagtctatggtcagatgttgtgttcttactattatattacttatatatataaaataaaaaaatctcgtttgattgaatta

SEQ ID NO: 3539 - DNA, 1450 bp, Manihot esculenta
aacaatcattcatttctctttcttgtttcctatagcatatgtctcagagacctaacattcctcacttctcctctgtagccttcggtctccattcccatctcctggtttccagtgagatgaaccccaactccaactggtcctccttttctctttaaacaatcccatctttctttctctcatcttttcttttctttcttcctttcttttcccggaaaagataacaaaagccctgatttttgccaattctttagtttattaaccaactgagattgttgttttgattcttgttaagcttttgaaaaatgggtttgaaaggttttgttgaaggaggcatagcttcaattattgctgggtgctccacccaccctctggaccttattaaggtgcgtatgcaactccaaggggaaacacacgcaccaaatcctgccgccgcacagagtctccggccggctcttgccttccacaccaccactcctggaaccacccttcatgtgcctcaacaaccattccccactccagtacctcgtgttggtcccatcactgtaggtgtccgtatcgtccagcaagaaggtgtggctgcgcttttttcaggtgtttccgccaccgtcctccggcagaccctctactccactacccggatggggctctacgatatcttgaaacagaaatggactgatcctaacaccaaaaccatgcctttaaccagcaagattgttgccgggcttatagcaggtggtatcggtgcagccgttggaaatccagcagatgtagcgatggtccgcatgcaggcggacgggcgtcttccaccagctcagcgccggaactacaagagcgttgtcgatgcaatcacgcgcatggcaaagcaagaaggcattacaagcctttggcgtgggtcatcgctgacggtgaaccgggccatgctggtgacagcatcgcagctagcatcatacgatcaattcaaggaaacaatcctggaaaaaagattgatgagcgatgggcttggaacccacgtgacagcgagtttcgctgctgggtttgtggcagcggtagcatcgaacccagtggacgtgataaagacaagggtgatgaacatgaaggtggaagcaggggaagcgccaccgtatgcaggggcgttggattgcgcgataaagacggtgaaggcggaggggccgatggcgctttacaagggatttataccaacgatttcaagacaaggccctttcacgatcgtgctgtttgtgacattggagcaggtcaggaagctgctcaaagatttctgatgtcgacgaaaattgaactttttatatcggatcgagttttttgaaggttgggttttggaaattctcaaattgggttttttttttaaaaaaaaataatttgttattttcagccaaaaaaataaattatagagaaggaattaagatacccaactgaattatcatgtagtatt

SEQ ID NO: 3540 - DNA, 1480 bp, Panax ginseng
gtgcgacagcacgtgcattaaaacctaattttccaccttctttcctctctcaacaatccatcccccctatatattctttctcatctcccatccttccctcaattcatctccctcacactcacttgtactactgctagcatatgtctcagagacctaacgtaccacactcttcttccatcgcctttagcctccattctcatctcctggtttccagtgagatgaactctacctctaattggtcttaatttcgaatcctttataccaagcacccattaaatttcacttcttaattagatctgagaattttctaacaaaattcaaaattcaaacatgggtgttaaaggtttcgttgaaggaggcatagcttcgataattgcagggtgttcaacccacccacttgacctcatcaaggtccgaatgcaactccaaggtgaatccgccgcccctgcacctgccgttcagacgctccgacccgctttggccttccaaacaggctcaacggctcgcatccacgtacccacaccgccacctccgccgcgtgttggcccaatcgccgtgggagttcggatcgtgcagcaagacggcgccagggcgcttttctccggcgtgtcggccaccgtcctccggcaaacgctttactccacgacccggatggggctgtatgatatactgaagcagaaatggactgacccgaatactggtaacatgcctttagcgagaaaaataggcgccggactgatcgccggcggaatcggagccgccgtcgggaacccagctgacgtggccatggtccgcatgcaagccgatggtcggcttcccttcgctcagcggcgcaactataaaagcgtggtcgacgcaatttcacaaatgactaaaaacgagggaattactagcctgtggcgcggatcatctcttacggtgaaccgcgctatgcttgtcactgcttctcagctggcatcatatgatcagatcaaggaaacaatactagacaacggtctgatgaaagatgggcttgggacccacgtgacggcgagctttgccgccgggtttgttgcgtccgtggttaccaatccggtggatgtgatcaagaccagggtgatgaacatgaaggtggagccgggaaaggccccaccgtatgctggagcccttgattgtgcacttaagaccgttcgatctgaagggccgatggcactgtacaagggctttatccctacgatctcaaggcagggaccatttacggtggtgctgtttgttacactggaacaggtccggaagctgcttaaggatttttaatttgattacagatgatgacgatgaaaaattataaaatttattgatatctaatagagtgattgatcctctctccagttacttaggaattaggataagtcaaatgtttttctctcttaatatattggtttgataattttaaataagtgtaattgcttaatttttaatattatcttaaatattaatataa

SEQ ID NO: 3541 - DNA, 1542 bp, Vaccinium corymbosum
ttccttcctctctcagaatatcttcgcacaatatatgtctcagaggccaacagttcctcattcttcctcaatcgccttctccctccattcccatctcctggtttccagtgagatgaaccccaactcctattggtcccatttcttctgaaaaaaaattccccttattaaaaacccatttcaatttctctcggaaaatctattgtaaggtgtattgaaattgaattaatctattgtttttggtaagatcggacggagaatcgaaatgggtctgaaaggatttgttgaaggaggaatcgcatcgatcgtagcgggcgtttcgacccacccgcttgacctgttaaaggtccggatgcagttgcagggcgaggcccaggctacgcactcgctccgacccgcacttgccttccaaactggctcacacggagcgttccacgcgccaccgcatcctcacgcgccgccgcgggtgggtctggtgtcggtcgggatgcggatcgtgcagcaagagggcgtcgccgccctgttctctggcgtctctgccaccgtcctccggcagacgctgtactccaccacccgaatggggctttacgatatgttgaagaaaaaatggagcgatccgactacaggtaacatgcctctagtgcagaagatagcggctggtcttatagccggtggaatcggagccgccgtgggaaacccggccgacgtagcgatggtacggatgcaggcggacggccggctcccgttggctcagcgccgcaactacaaaaagcgtaattgacgccatatcacaaatggccaaaaacgaggggggttactagcctgtggcgcggttcatcgctaacggtgaaccgcgcaatgttggtcacggcatcacaacttgcatcgtacgatcagatcaaggagaccatactggaaaagggcttgatgaaagacgggctcgggacccacgtgacggcgagcttcgcggcggggttcgtggctgcggtggtgtcgaatccggtggatgtgatcaaaactagggtgatgaacatgaaggtggagcccgggatggcccctccttactcgggggccgttgattgcgtcgtgaagacggttcgatcggagggaccgatggctctctacaaggggttcatccctacgatatcgaggcagggaccattcactgttgtgctctttgtcacactggaacaggtccgcaagctgctcaaagatttctaactcccgtgatgatgacgaagaatttcaaaaagtgatgatttaatattagagaattatatatatgtcttagtgttttttattggtggagcagtagaattattccccttattgtggaatgaagggagaatgtgtctcaagatatatttattaaataacggagtaccatgtggtattgttatgtgatactctccataaataaaagatcgtcatcacactcgctgcgccaatcgggggtgggtgttgtgcgatgagtgctatgcaccgtattgtgagtcaaaactacgtcgttttgcttgattttttggcacacatttgaagttttac

SEQ ID NO: 3542 - DNA, 1220 bp, Vinca minor
ttaatagcatatgtctcagagacctaacgtcccccacttcgcttctgttgcttttggccttcattctcatctcctggtttccagtgagatgacctctaattccaactggtctttataaatttaatttcatctcacaaagagccaaatttcaagaaaattattcaattttctcgatccaatttccaaaaaatccctgtcttttgattattttccactagatttgaaatgggttttaagggatttgtcgaaggaggcatagcttccattgttgcgggttgcagtactcacccaatggatcttattaaggtccgaatgcaacttcaaggtgagggtccgggtccgactcctgctgttcaaaccctccgacccgctttagcttttcatactactgtgggccattcttctcgtattcatgttccttctcctcctcctccgccgctgccccgtgtaggacccattgctgtgggtgttaagattgtccagcaagaaggaatggcggcgcttttctccggcgtctccgccaccgtactccggcagacactttactccaccaccagaatggggctttacgatgtgctgaaacagaaatggacagatccacacactaataacatgccgttgacgaggaaaatagctgccggactcgtcgccggagctattggcgccgccgtcgggaacccagctgacgtggcgatggtacgcatgcaagccgacggtcgtctcccggttgctcagcggcggaactacaagagcgtggtggacgcaattacgcaaatgtccaagaacgagggcgttactagcctgtggcgcggctcatctcttacggtgaaccgcgctatgttggttacggcatcacagctggcatcgtacgatcagttcaaggagacgatattggagaagggtttgatgaaggatggacttgggacccacgtcacggccagcttcgcggccggattcgtggcgtcggtggcttcaaatccggtggatgttattaagactcgggtcatgaacatgaaagtggagccgggtatggatgctccatacagtggggcccttgattgtgcaatgaagactattaaggctgaggggcccatggcactgtacaaggggtttattcctacaatctcaaggcagggtccatttactatcgtgctctttgttacactggaacaggtccggaaattattcaaggaattttaaatagtgatgatgacgaagaa

SEQ ID NO: 3543 - DNA, 1436 bp, Catharanthus roseus
tgcacttcgcctccgttgcctttggccttcattctcatctcctggtctccagtgagatgaactccaactccaactggtctttttcttctcaataactttttttttcatcatctcactattcaattcgattcattcctttaaagaaaaagggaagaatcaaaatcaaattccaatccctgccttttgattgcttattttttacgttataaagaaaacaagaaattatgggtttgaaaggatttgccgaaggaggaatagcttccattgttgcaggatgcagcactcatccattggatctaattaaggtccgaatgcaactccaaggcgaggctcctgccccgacccgatctgttcaagcacttcgacccgctttagccttccacacaaccgtaggtcatgcctctcatattcacgttccttcccctcctctgccaccgccgcctcctcgcgtcggactaattggtgttggggttaaaattgtccaacaagaaggcatggcagctctcttttccggcgtatccgccaccgtcctccgccagactctttattccacaaccagaatggggatctacgatatattgaaacaaaaatggacagatccacacacaaaaaacatgccattaaccaggaaaatagctgccggactcgtcgccggcgccatcggcgccgcagttggaaaccccgccgatgtcgcaatggtacgaatgcaagccgacggtcgactccctgtggctcagcggcggaactataaaagcgtggtggatgcaatcacgcagatgtccaagaacgagggaattactagcctgtggcgcggctcatctcttacggtgaaccgcgctatgctggtgacggcatcacagctcgcgtcatacgatcagttcaaggagatgatattggagaagggattgatgaaggacggacttgggacacacgtggtggccagcttctccgccgggtttgtggcggcggtggcttcaaatccggtggatgtgattaaaactagggttatgaacatgaaggtggaggccggggcggctccaccttacagtggggcccttgattgtgcgatgaagacgatcaaggctgagggacccatggcactctataaggggttcattcctacaatctcaaggcagggaccatttacaattgtgctctttgtcacactggaacaggtccggaaaatattcaaggatttttaaatagtgatgatgacgaagaaaatatagcgtaaaataaacaaaaattaattgtttaagtattttatattttggagttcctaaattcttgggaggattttgactatatgtcctcagttctttaattaaatgtcatattagtttatttaatataatttttctattaaatgttgtacacttgaaagggaattttcattgcaaaaagttccatactagaggcgtggtcggcgtctctca

SEQ ID NO: 3544 - DNA, 1966 bp, Cicer arietinum
ccatccccttactacaagcaactccccaacacaaacctctgtgtgtgtttctcattttcgtatctgaacaccgttgcttctttctgtcacatgtctcataagcccaactttactcaatcttgtttcatagcattttgtcctcattcccaaccaaaactccaattagtcatttcctatcatctcccaataatttgattccgttcattccgttacattcccctcagggctcaatcacaatcacaaacacaaaataaataaataaaaaccttattatttactttcgaaatatccccgatatagtctgttgacaaaatcaacccaaccaatctctttaatttcctttgattttttcaaagttacaaactttttcacaaaaaagagtaatgggtgtcaagggtttcgttgaaggaggcatagcttccatcattgcagggtgttcaacacaccctcttgatctcatcaaggttcgaatgcagcttcaaggagaaattcaaacacccaatatccgacccgcaatggcaatccaaccgggttccgttcactcgttgccgccgccgccacgtgttggtccaatttccgttggtgttaaattagtccaacaagaaggtgtagccgctcttttctccggcgtctccgccaccgtcctccggcaggttctctactccacaacccgtatgggactctacgacatgctcaagaaaaaatggaccgatccaaacgccggcggtaccatgccgttaacaagcaaaatcgcagcagggctgatcgccggtgggatcggggcagcggtcgggaatccagccgacgtggcgatggtcaggatgcaggccgacggaagacttccgccaactcaaagacgaaattataaatccgtcgtcgatgccatcacgagaatggcaaaagatgagggagttactagtctatggcgcggttcatcgcttactgtgaaccgcgccatgttagttacggcgtcgcagctggcatcctacgacgagtttaaggaaacaattttggaaaaaggttggatgcgggatgggcttgggactcacgtgacagcgagttttgcagcgggttttgtggcagcagttgtgacgaatccggtggatgtgattaaaacgagggtgatgaatatgaaggtggaggttggatcgccgccgccgtactccggtgctgttgattgtgttttgaagactgttcgtggtgagggtcctatggctctttataagggttttattcctacgattacgagacagggaccttttacggttgttctgtttgttacgttggaacaggttcgtaagttgcttaaggatttctaagttcgatgatgaacaacgttaataatgttctttagacggattttatttttattaatttttttagttttagttttatttaaattaagattttggtatgtgttgctcagatcagctattccaattaaattggcaatagattgttatcgactgaattaggaactagttatggtgcttggaatttggagtatgaaattaatattattttttcattttaattttgagtttatcaagttggagaatgttattattatcacgagcttcataatttgtttctgtatcttgaaaaatgttgtccattttttccccctaacattgcaaatggagatatacaatatacaaatagatgaggatgattaagtgtgactgtgacagtttagatacaaataatttcgaggaaaagtgaagaaataaaagaatgtgattctgctttaggagttattttatggtggtgggttctgatgcatggtatggtatctgtttaagttccaatttaattcaagaaaagggaagtacaatggtatgttttggtcccctagttagctgaaaaaggtttttgaaagtagaacagtgtgattttaggtttggaaattcgtcgacctcaaaaatttagttttcatcttatttggacttttcacactagatttgcg

SEQ ID NO: 3545 - DNA, 1288 bp, Panax ginseng
ctggtttccagtgacatgaactctacctctaattggtcttaattttgaatcctttataccaaacacccataatatttcacttcttaattagatctgagaattttctaataaaattcaaaattcaaacatgggtgttaaaggtttcgttgaaggaggcatagcttcgataattgcagggtgttcaacccacccacttgacctcatcaaggtccgaatgcaactccaaggtgaatccgccgcccctgcacctgccattcagacgctccgacccgctttggccttccaaacaggctcaacggctcgcatccacgttcccacaccgccacctccaccgcgtgttggcccaatcgccgtgggagtaaggatcgtgcagcaagacggcgtcagggcgcttttctccggcgtgtcggccaccgtcctccggcaaacgctttactccacgacccggatggggctgtatgatattctgaagcagaaatggactgacccgaatactggtaacatgcctttagtgagaaaaataggcgccggactgatcgccggcggaatcggagccgccgtagggaacccagccgacgtggccatggtccgcatgcaagccgatggtcggcttcccttcgctcagcggcgcaactataaaagcgtggtcgacgcaatttcacaaatgactaaaaacgagggaattactagcctgtggcgcggatcatctcttacggtgaaccgcgctatgcttgtcactgcttcgcagctggcatcatatgatcagatcaaggaaacaatactagacaacggtctgatgaaagatgggcttgggacccacgtgacggctagctttgccgccgggtttgttgcggccgtggttaccaatccggtggatgtgatcaagaccagggtgatgaacatgaaggtggagccgggaaaggccccaccgtatgctggagcccttaattgtgcacttaaaactgttcgatctgaagggccgatggcactgtacaagggctttatccctacgatctcaaggcagggaccatttacggtggtgctgtttgttacactggaacaggtccggaagctgcttaaggatttttaatttgattacagatgatgacgatgaaaaattaggaaaataaaatttattgatatctaatttattgtctcaaatattatattggtttgataattttaaataagtttaattttgcttaatttttaatattatctcaaatattaatgtaactttagttcatttattattttttgtttaatataaataatatattttttaata

SEQ ID NO: 3546 - DNA, 1317 bp, Panax ginseng
cagagacctaacgtaccacactcttcttccatcgcctttagcctccattctcatctcctggtttccagtgagatgaactctacctctaattggtcttaatttcgaatcctttataccaagcacccattaaatttcacttcttaattagatctgagaattttctaacaaaattcaaaattcaaacatgggtgttaaaggtttcgttgaaggaggcatagcttcgataattgcagggtgttcaacccacccacttgacctcatcaaggtccgaatgcaactccaaggtgaatccgccgcccctgcacctgccattcagacgctccgacccgctttggccttccaaacaggctcaacggctcgcatccacgttcccacaccgccacctccaccgcgtgttggcccaatcgccgtgggagtaaggatcgtgcagcaagacggcgtcagggcgcttttctccggcgtgtcggccaccgtcctccggcaaacgctttactccacgacccggatggggctgtatgatattctgaagcagaaatggactgacccgaatactggtaacatgcctttagtgagaaaaataggcgccggactgatcgccggcggaatcggagccgccgtagggaacccagccgacgtggccatggtccgcatgcaagccgatggtcggcttcccttcgctcagcggcgcaactataaaagcgtggtcgacgcaatttcacaaatgactaaaaacgagggaattactagcctgtggcgcggatcatctcttacggtgaaccgcgctatgcttgtcactgcttctcagctggcatcatatgatcagatcaaggaaacaatactagacaacggtctgatgaaagatgggcttgggacccacgtgacggcgagctttgccgccgggtttgttgcgtccgtggttaccaatccggtggatgtgatcaagaccagggtgatgaacatgaaggtggagccgggaaaggccccaccgtatgctggagcccttgattgtgcacttaagaccgttcgatctgaagggccgatggcactgtacaagggctttatccctacgatctcaaggcagggaccatttacggtggtgctgtttgttacactggaacaggtccggaagctgcttaaggatttttaatttgattacagatgatgacgatgaaaaattaggaaaataaaatttattgatatctaatagagtgattgatcctctctccagttacttaggaattaggataagtcaaatgtttttctctcttaatatattggtttgataattttaaataagtgtaattgcttaatttttaa

SEQ ID NO: 3547 - DNA, 1282 bp, Lotus japonicus
acttttcctcaaatctcaaaatgggtatcaagggtttcgtcgaaggaggcatagcatccatgattgcagggtgttccacacaccctcttgatctcatcaaggtccgaatgcagctccaaggagaggcccaatcccaaaacctccgaccctctctcgctttcaacccaacctctacccacccaccaccaccggcggcggccaggccgggtcccatcgccgtcggcgttaagctagtccaacaggaaggcttcgccgcactattctccggcgtctccgccaccgttctccgccagctcctgtactccagcactcgcatggggctctacgacatgatgaagaagaaatggtccaatcccaacggcaccatgccactcacgaacaagatcgcggcggggctgatagctggcggaattggcgctgccgtcgggaaccccgccgacgtggcaatggtccgaatgcaggccgacgggaggctcccaccggcgcagcggcggaactacaagtccgtggtcgacgcgatcacgaggatggtgaaggacgagggcgtcaccagcctgtggcgcggctcatcgctcacggtgaaccgcgccatgctggtgacggcgtcgcagcttgcttcgtacgaccagtttaaagaaatgatcttggagatgggcttgatgggtgacgggctcgggactcacgtgaccgcgagcttctcagcaggttttgtggcggcagttgcgtcgaaccccgtggacgtgatcaagacgagggtgatgaacatgaaggtggagccaggggcggcgccaccgtactccggtgctattgattgcgccttgaagacggtgcgcgcggaaggtcccatggctctttacaagggttttattcccacgatctcgaggcagggacccttcacggttgtgcttttcgtgacgttggaacaggttcgtaagttgcttaaggatttctagagtttctgaggcgtatgcaggttcaaagtgctgatatactaaggaggcaaagttgtttgttttttagggcattcttggaaattagaatgacaaatagacttgcatattttgatttctctagtgggtgccatggtggcaatgtttcaaaggcttcttaggaaatgttatattttttttccttcactaagtttttatcttaggtttttctggtgattgaattgtttcctctatttaatgaaagaattgttctcatgtagtttttctcatgcaataaaatcttttgttgtcaaaaacatatcattcttttagatagtttgatgtgtgatatt

SEQ ID NO: 3548 - DNA, 1428 bp, Solanum tuberosum
cccgggacaatttatatgtctcacagactcaacgttccacacttcgcatctatagctttcggtctccattcccatctcctggtttccagtgagatgaactctaattccaattgggcttaaacctttgattcattctattttttttttcaattttttccattacctaattcatattcattctttttttaaaaaaagctttcgtctcgattcatttggtataatgggtgttaagggatttgttgaaggaggtattgcttcgattattgctggttgtagtactcacccacttgatttaatcaaagtccgtatgcagcttcagggagaaaccccaatttcagctccggcgactgttcacaatctccgtccagcacttgcttttcacactggtgctgctaatcatactatttccattccggcgccgtcggtggttgctccaccgcgtgtaggaccggtttctgtaggtgttaagattattcaacaagaaggagttgctgctttgttctccggtgtatcagctactgttctccggcagacactttactctacaaccagaatgggtttatacgatatgctgaagcaaaaatggaccgatccagatactaacatcatgcctttgtcgaagaagatcgttgccggattaatcgccggcgggatcggagctgccgtcggtaatcccgccgatgtagcgatggtccgcatgcaagccgacggccggcttccgatctctcaacgccgcaactacaaaagcgtgatcgatgcaattactcagatgagtaaaagcgaaggggtaactagcctgtggcgcggttcatctcttactgtgaaccgcgccatgctagttaccgcatcgcagctagcatcgtacgatcagttcaaagagactatcctcgagaaggggttaatgaaggatgggcttgggacacatgtgacttcgagctttgctgctgggtttgtggcggcggtggcgtcgaatccagtggatgtgattaagacacgtgttatgaacatgaaggtcgagccgggaatggccccaccgtataatggggccattgattgtgcaatgaaaactatcaaagctgaggggccaatggcattgtataagggatttattcctacaatctcaaggcaaggtccatttactgtggtgctctttgtcacactggaacaagtcaggaaaatgcttaaggatttttaatgatgatgacgaagaaaaaaaaaattaagggattttagtattaagaattttaaaaaaagtttagtttaatttatgttttttaagttttaagtttgggaaaggtgatactatgttgtgttctaatattattattattgttacttctatatgaaaaatgagttcttgtttggtggaaattaatgattcttgattaagcaaatgtttaatttttgtgtaaaaaaaaaaaaaaaaaa

SEQ ID NO: 3549 - DNA, 1395 bp, Vinca minor
aatagcatatgtctcaaagacctaacgtcccacacttttcttccgttgcctttggccttcattcccatctcctggtttccagtgagatgacctctaattccaaccggtctttgtaattgttatttcatctcacaaagagttgtcccaatttcaacaagaaaattattcaattttctcagtatttctgccttttgattgcttttttttaattaaagtttacgagatttgaaatgggttttaaaggatttgctgaaggaggcatagcttccattgttgcgggttgcagtactcacccgttggatctaattaaggtccgaatgcaactccagggtgaggcaccctctgttcgggttcaaaccctacgacccgctttagcctttcatacaactgtgggccatgcttctcatattcatgtcccatctcctccgccgcgtgtgggacccgttgctgtgggtgttaagattgttcaacaagaaggaatggcggcactcttctccggcgtctccgccaccgtcctccgccagactctttactccaccaccagaatggggctttacgatgtattgaaacaaaaatggacggatccacacagtaagaacatgcctttaacgaggaaaatagccgctggactcgtcgctggagctgtcggcgccgccgttggaaacccagctgatgtggcgatggtccgcatgcaagccgacggtcggcttccggcggcacaacggcggaactataagagcgtggttgacgcaattaccaaaagcgagggcattactagcctgtggcgcggctcatctcttacggtgaaccgcgctatgcttgtgaccgcgtcacagctggcatcgtacgatcagtttaaggaaacgattttggagaaggggttgatgaaggatggacttgggacccacgtcacggccagtttcgccgccgggtttgtagcggcagtggcttcaaatccggtggatgttattaagactcgggtcatgaatatgaaagtggagccgggtatggatgctccatatagtggggcccttgattgtgcgatgaagactattaaggctgagggtcccatggcactgtataagggttttattcctacaatctcaaggcagggaccatttactattgtactctttgttacactggaacaggtccgaaaaatattcaaggaatattagatagtgatgatgacgaagaaagtagaacaaaatgaaactgaattatttattattttattttatgttttaagttccctgagaatttgggagtatttgactgtgtcctctatattgtaatggaattttgtctatttttttttaatattttttcctcttgaaactgtctaaaactttttattttaatcgacgaaagtaattagtgaattaataaaagtaa

SEQ ID NO: 3550 - DNA, 1431 bp, Trifolium pratense
cacaaacaaaccttttgtgtttctcgttttcgttccaacaacgtttcttccttctgtcacatgtctcatacccctaacgttactcaatcttgtttcatagtacccttcgatcttcattcacaacctaaactccaatatatcctttcttaccatctccctataatttgattccgtatatttcgttacattacatattcccttaaatcacaaaaacaaaacaaatcgcacgttttatattcccgataaattctcttgacaaaatcaatcccaacccatctctttaattcctttgattcattcaaagtttctgactttttcacaaaaactgtaatgggtgtcaagggtttcgtcgaaggaggcattgcttctgtcattgcaggatgttccacacaccctcttgatctcatcaaggttcgaatgcagcttcaaggtgaaaatagtcaaaaacccaatatccgaccggcacttgctttccaacacggttatgttcgttcgtcgcagttatctgctgcgacggcgacgccccgtgttggtccgatcgcagttggtgttaagttggttcaacaagaaggtgtaactgctcttttctccggcgtttccgccaccgtcctccgccaggttctctattcgaccacccgtatgggactatatgacatgctcaagaaaaaatggtcggatcccaattccggcggtactttgccgttgacgagaaaaattgcagcggggctgctcgccggtgggattggcgcgatggtcggtaatccagctgatgtgtcaatggttaggatgcaggccgatggaagacttccgttggcccagagaagaaactataagtccgttgtcgacgccatcacaaggatggtgaaagacgagggagttactagtttatggcgcggttcatctctaactgtgaaccgcgcaatgttagttacggcgtcacagttggcgtcgtacgatgaattcaaggaaatgatattggaaaagggatggatgaaggatgggctagggacccacgtgacagcgagttttgccgcgggttttgtggcagcagttgcgtcgaatccggtagatgtgattaagacaagggtgatgaatatgaaggtagaggccggatcgccgccaccgtactccggtgccattgattgtgctttgaagacggttcgtgccgagggtcctatggctctttataagggctttattcctacaattacaaggcagggaccttttacggttgtgctgtttgttacgttggaacaggttcgtaagttgcttaaggatttctaagttccatgatgatgatgaagaagaacattaataatgttctttaagacagattttatttttagatttaattaagattattatgatatgttgttgtttagttcagagatattccaatttaattagctatgattgttaccaattttgatt

SEQ ID NO: 3551 - DNA, 1930 bp, Medicago truncatula
aagatttgacaaagatatttttctatttttcttctaatttgttacctcatgacagtgccagcttccacaatcattcttttcccttccaaacacacttgctataaattcctctatttcccaatataacttcacaacacaaacctcgttttcgttttcacacatggtttcttcttttgtcacatgtctcaaaccttttacgttcctcaatcttgtttcatagtaacttttgatattcattcccaacctaaacttcaattagtcctctcttaccaccttcccataatttgagatccgtttatttcgttacataaacaaatctcatagaaaatatttcccaaaaattctattgacaaaatcaacacaacccttttctttcttattcgttgtcgcaaactttttgtgccaattaatcgcaatgggtgtgaaaggtttcgtcgaaggaggcatagcttccatcattgcagggtgttcaacacaccctcttgatctcatcaaggttcgaatgcagcttcaaggagagaatgctcctacaaccaatatccgaccagcattagctttccaacccggttcggttcatcggtcaccagcggtgacggcccaaccgccccgtgttgggccgatcgccgttggtgttaagctagtccaacaagaaggtgtagcagcacttttctccggtgtctctgccaccgttctccggcagtgtctctattccaccactcgtatgggactctatgatatgatgaagaaaaaatggtctgatcctatctccggtactttgccgttgacaagcaagattggagcggggctgctagccggtgggattggcgcggctgtcgggaatccggctgatgtggcaatggttaggatgcaggccgatggaagacttccatcggcccaaagaagaaactataaatctgtcgtcgacgccatctccaggatggcgaaagacgagggagttactagcctatggcgcggttcatctctgacagtgaaccgcgccatgttggttaccgcatcacagctggcatcctatgatgagtttaaggaaaagattttgaaaaatggttggatgaaggatgggcttgggacccatgtggtagcgagtttttcggcaggttttgtggccgcggttgcatcgaatccagtggatgtgattaagactagggtgatgaatatgaaggtggaggctggatcgcctccaccttactccggtgccattgattgtgctttgaagactattcgtgctgagggtcctatggctctttataagggttttattcctacaattacaaggcagggaccgtttaccgttgtgttgtttgttacattggaacaggttcgtaagttgcttaaggatttctaaggtagatgcatgatgatgaagaattatgtttcgaacaaccttaataatgctctttttagtcagatttttatttttagatttaattatggttataatataatgttatttagtttagtgattccaatagtgtgttaccgattgtgattgaattctgtaccaagaattggtgcttagaatttggattatgagaaattattactatagtttttaatttttaatcttgagattctaaagttctttacgtttacgtgggagaatattatcactagcttcttaattaattaattttttacaaaatgttatcctttttcgatttaagtgtgacagtttagatgcagataaattcaagaaaaagtgaagaaagaaaagaatgtgattctgcttaggagttaagttccaatttcattcaagaaaggaagcacaattgtaaattttggtccccttcattgaaaatgcctttttaaaagttgatggtatgatacgtttggaaatttgtccaatggatcgatctcaacaattttcatgtttaagctcatgattcatgtttctcatatcagctgaattttt

SEQ ID NO: 3552 - DNA, 1779 bp, Mimulus guttatus
aaaacctagtttccttccttcccctttccaccttcctcttttccacacacatacacacacaaaagcaagcactataaataaaatccctccgccaccatctccgccaccaccaccagttccgccacccatcagaaattttcttacagcatatgtctcaaaggccaaacattccccacttctcctccatagctttcggcctccattcccatctcctggtttccagtgagatgaactcagtttccaattggtcttcttcttcttccttttaattttcgattttttatttttttaattaacagcatccggaattttcggatctcgatttttgtttgttcatttttttcgatcggagaaaaaaaatatgggggtgaagggatttgttgaaggaggtattgcttcaattgtcgccggttgcagcacccaccccctcgatttgattaaggtcaggatgcagctccagggggaggcggcggcggcggcgccgccgccggccctccgccctgctctcgccttccaaacaccctcctcctccgtcgctcaaaacgtccgcctcactccacctccaccccgggtggggcctgttgccgtcggactccggatcgtgcagcaggacggtttcgccggcctcttctccggcgtctccgccaccgtcctccgccagacgctgtactccaccacgaggatgggcctgtacgacatcctgaagacgaagtggtccgatccgaacacgaacaacatgccgctgacgaggaagatcgtcgccggactcatcgccggcggcatcggcgccgccgtgggtaaccccgccgacgtggcgatggtccggatgcaggcggacgggcgcctcccggcggcgcagaggcgcaactacaagagcgtggtggatgccatctcccagatgagcaagggagagggcgtcgccagcctgtggcgcggctcatcccttacggtgaaccgcgccatggtggtaaccgcctcccagctggcgtcgtacgaccagatcaaggagacgatactcgacaaggggctgatgaaggacgggctcgggacgcacgtgacggccagcttcgcggccgggttcgttgcgtcggtggcgtcgaacccggtcgacgtgatcaagacgcgggtgatgaacatgaaggtggagcccggggtggcgccgccgtacgccggcgcaatcgactgcgcgatgaagacgatcagggcggaggggccgatggcgctgtacaaggggttcattccgaccatctctaggcaaggacctttcaccgtcgtgctgtttgtcacacttgaacaggtccgaaaattgctcaaggatttttgaatggtgatgatgatgacgatcaagatattttcaataataaattattattattattattattattattaattataaaattataaaatcgcttttggactttatttttatttattatatattaaatattaaatattaattagatgattattgatgtataacaatcttaattaattggtatgagtgtcaaaaaatataattgtaagattgaaaatgaagcaattcttgcgaataaaaatgttattcgttgcttttttgctgtgcaaagtagatgctaaacttgcttaagaaccttgttttaacttttaatacaacatgaatattagatttgagaacataattatcagtgatatatgtagtggattgtagtaagattttaactctcaacaagagagattaggaaaatttattgttttgcaattttgttaagcttattttaaacattgttacggttgata

SEQ ID NO: 3553 - DNA, 1496 bp, Cajanus cajan
accaaacatagcgctttttcttagcatatgtctcaatggtccaacgttcctcactcttgttccatagccttcggcctccattcccatcttcttgtctccagtgaaatgaacccaaactccaattggtcctcttgaacccaaaccaaaccctttaattacattccattcttttctctcatcaaaatttctccccggaaaattctgacaaaatcaaccacaccccacctcttcaatttcattgattctttcaaaataacaaactttttggcttgaatcgaaatgggtgtcaaaggtttcgtcgaaggaggcattgcttccgtgatcgcagggtgctccacccaccctcttgatctaatcaaggtccgaatgcagctccaaggagagacccaacactcaaatctccgacccgcactcgctttccacccaacttccgtccacgcgccgccgcatcgtccggcaaaagcaggtcccatcgccgtcggcgtcaaattagtccaacaagaaggcgtcgccgcgcttttctccggcgtctccgccaccatcctccgccagcttctctactccaccacccgcatggggctctacgaagtgctcaaggagaaatggtccgaacccaattccgccggcggcaccaccatgcccctcacccgcaagatcgcggcaggactcatggccggcggaattggcgccgccgtcggcaacccggccgacgtgtcaatggtccgcatgcaggccgatggaagactcccaccggcccaacgacggaattataaatccgtcgttgatgctatcaccagaatggtgaaagacgagggcgtgaccagtttatggcgcggttcatctctcacgataaaccgcgccatgctggtgacggcctcgcagctggcctcttatgaccagttcaaggagatgattttggaaaggggtgtaatgggtgacgggcttgggacccatgtgacggcaagtttcgcggcggggtttgtggcggcggtcacgtcgaaccccgtcgacgtgatcaagactagggtgatgaacatgaaggtggagcccggggcggcgccgccgtactccggtgcactcgattgcgccatgaagacggtgcgcgcggagggtcccatggctctttacaaaggctttgttcccacgatttcgagacagggacccttcacggttgtcctgttcgtcacgttggaacaggtgcgcaagttacttaaggatttttaagtgcgaagataatgacgaagaacaaaatatttcgaaaggtttcataagtaagagtttttgtttaggtgtcttttgtcccgtgagtgtttttgtttagttttaagataagggttatatcaataatataaaagatgggtgttactgttatttagttcaaaaattcaaatttaattggtattatgttaatccttagtctttattacctaggtagatcatttttccccttttagctaattcataaaattctttacgtttgggtaattccacacgcc

SEQ ID NO: 3554 - DNA, 1374 bp, Gossypium hirsutum
ttttcttggttggcatatgtctcaaaggcctaacgttccccactattcttcaatagcttttggtctccattctcatctcctggtttccagtgagatgaaccctaattccaactggtcttaatagtttcatctctttctttttcttctattgattttttgttttaattccttttattgcctttctgaaaaaaagtaattgccttgttgatttgcaagcaaattttggtaaagttcttaaatatttgagtttagatcttctttgagagtgccgctatgggagtgaagggttttgttgaaggaggcatagcctcaatcgtggccgggtgttcgacccacccgcttgatttgatcaaagtccgaatgcagctccagggtgaaagccatgttcccaatccggctgttcaagcactccgccctgctttagcctttcagacaaccactactaccacctcctctgctatccacatgcctcctccgccggcgcgtgttggacctgtggccaccgggatcaagatcttccggaccgaaggcgtcgctgctcttttttctggcgtctctgctaccgtcctccgccagaccctctattccaccacccgcatgggactctacgacatcctaaaacagaagtggactgataaagagaccaaaacaatgcctctctcgcggaaaatcaccgccgggctaatcgccggggggatcggcgctgccgttgggaacccagccgacgtggcgatggtgcgaatgcaagctgacggacgcctccccgtatctcaacgtcgtaactataccagcgttgtcgacgccatcactcgcatgaccaaacaagaaggcgtcacctccttgtggcgcggctcatcgctgacggtgaatcgtgcgatgttggtgacggcatcgcagcttgcctcctacgatcagatcaaagagatgattttggaaaacgggctgatgaaagatgggctggggacacacgtggcagcgagcttttcagccgggtttgttgcggcagtggcgtcgaatcccgttgatgtgataaaaacaagggtgatgaacatgaaggtggaggcagggcaaaagccgccgtacgccggcgctttggattgtgctatcaagacggtgaaggcggaagggccgatggctttgtataaagggtttatacccacaatctcgagacagggaccatttacggtggtgctgtttgtgacgctggaacaggtccggaagttgcttaaggacttttaaggcattgataacaaagacgatgacgaaaatgaatgtttaagttacttaattgttttccagttttatgttgttctacatgttaaacgcgatgtgtgattcttgttctaataatgatatcaatagatgagatatttg

SEQ ID NO: 3555 - DNA, 1412 bp, Gossypium raimondii
accccattcattagctgatttttcttggttagcatatgtctcaaaggcctaacgttccccactcttcttcaatagcttttggtctccattctcatctcctggtttccagtgagatgaaccctaattccaactggtcttaatagtttcatctctttctttttcttctattgattttttgttttaatttcttttattgcctttctgaaaaaaagtaattgccttgttgatttgcaagcaaattttggtaaagttcttaaatatttgagtttagatcttctttgagagtgccgctatgggagtgaagggttttgttgaaggaggcatagcctcaatcgtggccgggtgttcgacccacccgcttgatttgatcaaagtccgaatgcagctccagggtgaaagccatgttcccaatccggctgttcaaacactccgccctgctttagcctttcagacaaccactactaccacctcctctgctatccacatgcctcctccgccggcgcgtgttggacctgtggccaccgggatcaagatcttccggaccgaaggcgtcgctgctcttttttctggcgtctctgctaccgtcctccgccagaccctctattccaccacccgcatgggactctacgacatcctaaaacagaagtggactgataaagagaccaaaacaatgcctctctcgcggaaaatcaccgccgggctaatcgccggggggatcggcgctgccgttgggaacccagccgacgtggcgatggtgcgaatgcaagctgacggacgcctccccgtatctcaacgtcgtaactataccagcgttgtcgacgccatcactcgcatgaccaaacaagaaggcgtcacctccttgtggcgcggctcatcgctgacggtgaatcgtgcgatgttggtgacggcatcgcagcttgcctcctacgatcagatcaaagagatgattttggaaaacgggctgatgaaagatgggctggggacacacgtggcagcgagcttttcagccgggtttgttgcggcagtggcgtcgaatcccgttgatgtgataaaaacaagggtgatgaacatgaaggtggaggcagggcaaaagccgccgtacgccggcgctttggattgtgctatcaagacggtgaaggcggaagggccgatggctttgtataaagggtttatacccacaatctcgagacagggaccatttacggtggtgctgtttgtgacgctggaacaggtccggaagttgcttaaggacttttaaggcattgataacaaagacgatgacgaaaatgaatgtttaagttacttaattgttttccagttttatgttgttctacatgttaaacgcgatgtgtgattcttgttctaataatgatatcaatagatgagatatttgctctaaaattactgtaagt

SEQ ID NO: 3556 - DNA, 1312 bp, Platanus occidentalis
tactagaacccatttcgttcttcaatacccaatttggtttctattttctagaatcaaatcaactctttcaagtagaaaaaaaacgaatcgaaatgggtctgaaaggtttcattgaaggaggcatcgcctcgattattgcagggtgttcaacccacccactcgacctcatcaaggtccgcatgcagctccagggcgaatcccaggtcccaaatcctgccattcagactcttcgtccagctttggccttcaacaacacctccgccgccgctccgggcaccattcgcgctccaccacctccaccgccgcgtgtcggccctatcaccgtcggagtccggatcgtccagaccgaaggcgtggctgccctcttctccggcgtatccgccaccgtcctccgtcaaacactttattccaccacccgtatgggcctctacgacatcctcaaacagaaatggaccgaccccagatcgggcaacatgccgctggtgcgcaagataacggccggcctgatcgccggcggtatcggcgccgccgtcggcaatcccgcggacgtggccatggtacgcatgcaggccgacggccggctccctctggcccagcgccggaactacaaaagcgtggtcgacgcgatcacgcagatgtcgaaacaggaggggataaccagcctgtggcgcggatcttctctgacggtgaaccgtgcgatgatcgtgacggcatcgcagctggcgtcgtacgatcagatcaaggagtctatattggcgaaggggttgatgagggatggtcttgggacccacgtaacggcgagtttcgcggcggggttcgtggcgtcggtggcgtcgaatccggtggacgtgataaagaccagggtgatgaacatgaaggtggaggcaggggcggcgccgccttactccggagcgcttgactgcgccatgaagacggtgcgcgcggaggggccaatggccctgtacaagggattcatccctacgatcacgaggcagggacccttcactgtggtgctgttcgtgacccttgagcaggttcgcaagttactcaaggatttctgatggtgacgatgatgacgaaagaagtaattaatattaataatattattttattttattttatttcagtactttgggatttctgaagattggtaaaatggatgagacattattgttggttattttcttttttaatgttatgaattttgggtttttatttttggtgagccccactcgaagcgattcaagcccgtacagccgccggaggggcagaagcgctgacacggagacttgatctctagtctcctctatgg

SEQ ID NO: 3557 - DNA, 1171 bp, Amsonia hubrichtii
acgttaccggagaaaattaaaatgggtttcaaaggatttctcgaaggaggcatagcttccattgttgcaggttgcagcactcatcctttggatctcattaaggtccgcatgcaactccaaggggaggcagctgccccgaccccggctgttcaatcactccgccccgctttagcctttcacaccaccgttgccaatgcctctcatattcacgtcccgtctcctcctcttccgccaccgccgccgcgtgccggactcatttctgtgggtgttaaaattgtccgacaagaaggcatggcagcactcttttctggcgtctccgccaccgtcctccgacagactctttactccaccaccagaatggggctctacgatgtcttgaaacagaaatggacagacccccacactaagaacatgccattaacgagtaaaataactgccggactcattgccggcgctgttggagccgcagttggaaaccccgccgatgtggcaatggtacgaatgcaagccgatggtcggctcccggtggctcagcggcgcaactataagagcgtggttgacgcaattacgcaaatgtctaagaacgaaggcatcactagcctgtggcgcggttcatctcttaccgtgaaccgcgctatgctggtgacagcatcacaactggcatcatatgatcagatcaaggagacgatattagaaaagggtgtgatgaaggatgggcttggcacccatgtcacggccagctttgctgccgggtttgtggcagcggtggcctcaaatccggtggatgttatcaagactagggttatgaacatgaaggtagagccaggtatggccccaccatacaatggggccctcgactgtgcaatgaagactatcaaggcagaggggcccatggcactctacaaggggttcattcctacaatctcaagacagggaccatttactattgtgctctttgtcacactggaacaggtccggaaagtattcaaggaattttaaatagtgatgatgacgaagaaaataggagaaaataaaaatactatttatagtatttaatatttaagttatttggagagcatgtgttgggattccatatatgctcctagtatatttaatggaattatctaatattttatgtctttgatttattctttttgtttcacttgaaatt

SEQ ID NO: 3558 - DNA, 1159 bp, Panax ginseng
agagacctaacgtacacactcttcttcatcgcctttagcctccattctcatctcctggtttccagtgacatgaactctacctctaattggtcttaattttgaatcctttataccaaacacccataatatttcacttcttaattagatctgagaattttctaataaaattcaaaattcaaacatgggtgttaaaggtttcgttgaaggaggcatagcttcgataattgcagggtgttcaacccaccacttgacctcatcaaggtccgaatgcaactccaaggtgaatccgccgcccctgcacctgccattcagacgctccgacccgctttggccttccaaacaggctcaacggctcgcatccacgttcccacaccgccacctccaccgcgtgttggcccaatcgccgtgggagtaaggatcgtgcagcaagacggcgtcagggcgcttttctccggcgtgtcggccaccgtcctccggcaaacgctttactccacgacccggatggggctgtatgatattctgaagcagaaatggactgacccgaatactggtaacatgcctttagtgagaaaaataggcgccggactgatcgccggcggaatcggagccgccgtagggaacccagccgacgtggccatggtccgcatgcaagccgatggtcggcttcccttcgctcagcggcgcaactataaaagcgtggtcgacgcaatttcacaaatgactaaaaacgagggaattactagcctgtggcgcggatcatctcttacggtgaaccgcgctatgcttgtcactgcttcgcagctggcatcatatgatcagatcaaggaaacaatactagacaacggtctgatgaaagatgggcttgggacccacgtgacggctagctttgccgccgggtttgttgcggccgtggttaccaatccggtggatgtgatcaagaccagggtgatgaacatgaaggtggagccgggaaaggccccaccgtatgctggagcccttaattgtgcacttaaaactgttcgatctgaagggccgatggcactgtacaagggctttatccctacgatctcaaggcagggaccatttacggtggtgctgtttgttacactggaacaggtccggaagctgcttaaggatttttaatttgattacagatgat

SEQ ID NO: 3559 - DNA, 984 bp, Ricinus communis
cttacgtaccaaatcatgggtgcaaaaagttttgttgaaggtggtgtagcatcaatagtagctggttgctccactcaccctttagatctaataaaggtccgtatgcaactccaaggcgagaacttgccaaaatcgcaagtccacaacctccgtcctgcttttgctttcaactccacagcttccgctgccattcacgtcgcttctccaccgccacgcgtcggtcctgtctccgttggcatccgcattttccaaacagaaggtgtcgccgcattgttctccggcgtttctgccactgttctccgccaaacactttactccaccactcgtatggggctttacgatattctcaaacagaaatggactcgaccagataccggaaacatgccgcttgttagcaaaatcaccgccggtttaatcgccggaggaattggcgcagccgttggaaaccccgccgacgtagctatggtgagaatgcaagccgacggccgtctccctcctgctcaacgccgtaactataacggcgtccttgacgccattacacgaatgtcaaagcaagaaggaatcaccagcctgtggcgcgggtcttccttaacggtgaaccgtgcgatgatcgtgacggcgtcacaattggcatcgtacgatcagataaaagaggcgattctggagaagggtgtgatgagagacgggctagggacacacgtgacggcgagctttgccgcagggtttgtggcggctgtggcgtcaaatcctgtggatgtgataaaaactagggtcatgaatatgaatgtggaggcagggaaggctgccccttataatggagcaattgactgtgctttgaagacggtgagagctgaagggctaatggctctatataaagggtttatccctaccatttcaagacaggggccttttactgtagttctttttgtcacacttgagcaagttaggaaattgctcaaggatttttaatttacgatgatgatg

SEQ ID NO: 3560 - DNA, 1565 bp, Ricinus communis
gcttaatattcactagcacatgtctcaaaggcctactgttcctcactcttcttccattgctttttccctccactcccatcttctcgtctccagtgacttaacccctaactggctttaaaactctccaaaatcctccccaaacagagcaatttttgcttcctattcctgatatttcattcattctttttcaataacagcagcagcaattaaaaaaagggagtagttacttacgtaccaaatcatgggtgcaaaaagttttgttgaaggtggtgtagcatcaatagtagctggttgctccactcaccctttagatctaataaaggtccgtatgcaactccaaggcgagaacttgccaaaatcgcaagtccacaacctccgtcctgcttttgctttcaactccacagcttccgctgccattcacgtcgcttctccaccgccacgcgtcggtcctgtctccgttggcatccgcattttccaaacagaaggtgtcgccgcattgttctccggcgtttctgccactgttctccgccaaacactttactccaccactcgtatggggctttacgatattctcaaacagaaatggactcgaccagataccggaaacatgccgcttgttagcaaaatcaccgccggtttaatcgccggaggaattggcgcagccgttggaaaccccgccgacgtagctatggtgagaatgcaagccgacggccgtctccctcctgctcaacgccgtaactataacggcgtccttgacgccattacacgaatgtcaaagcaagaaggaatcaccagcctgtggcgcgggtcttccttaacggtgaaccgtgcgatgatcgtgacggcgtcacaattggcatcgtacgatcagataaaagaggcgattctggagaagggtgtgatgagagacgggctagggacacacgtgacggcgagctttgccgcagggtttgtggcggctgtggcgtcaaatcctgtggatgtgataaaaactagggtcatgaatatgaatgtggaggcagggaaggctgccccttataatggagcaattgactgtgctttgaagacggtgagagctgaagggctaatggctctatataaagggtttatccctaccatttcaagacaggggccttttactgtagttctttttgtcacacttgagcaagttaggaaattgctcaaggatttttaatttacgatgatgatgaaatttttttattatgattaagattttgagatgcaatacataaattgtttaaggtcttactatttcaatctgattttactgctcagagaaaaattacaagaacaaatttattaataaatattgcacaaatttggcaacccaactcatccaatcaacacgatgcgtggtacgactgagattgctatatcagaacctggagataataagtttaagattagtggaggcttgattccaggtcttatacacacaggccaagcaactccagttacatcaaatagaaagagatatattttgagttctaccgtacaaaatgtaacagtaccctagttggcttctaaaccagcacaagaatcag

SEQ ID NO: 3561 - DNA, 1439 bp, Actinidia deliciosa
ctctctctctaaattagctttgcacgatatatgtctcagaggcccaacgtcccacactcttcctccgtcgcgttcggcctccactctcatctcctggtctccagtgagatgaaccccagctccaactggtcctgaaaattcaaattctctctctcctcaccaattaatttcactttctcgttctcattttccgggaaaatacagaagtttccgagaaaatcgacatgggtgtgaaggggttcgtcgaaggaggcatcgcttcgatcgtcgcaggatgcgcgacccacccgcttgacctaatcaaggtccgaatgcaactacagggggagaaccacgcaccgaaccccgttcaaaccgtccgacccgctttggccttccagactacacaatcggggacgatccacgcgccgccgccgccgccgcgcgtggggccaatcgcggttgggatccggatcgtgcagcacgacggcgccgccgctctgttctccggtgtctccgccacagtcctccgccagaccctttactccaccacccgcatgggcctctacgacatcatgaagaagaaatggagcgatccgaacaccggcaacatgcccctcctgcgcaagataggcgctggcctcctcgccggaggcatcggcgccgccgtcggcaaccccgccgacgtcgccatggtccgaatgcaagccgacggccgcctccctccggcccagcgccgcaactacaagagcgtgatcgacgccatttcacaaatgtcaaaaagcgagggaattactagtctgtggcgcggatcatcgcttacggtgaaccgcgcgatgcttgtaacagcatcacagctcgcatcttatgatcagataaaagaaacaatattagagaagggtgtgatgaaggatgggctcgggacccacgtgacgtcgagcttcgccgccgggttcgtggctgcggtggcctcaaacccggttgacgtgatcaaaacgagagtgatgaacatgaaggtggaaccggggatggccccaccttacgccggagccattgattgtgcgatgaagaccgttcgatctgagggcccaatggcactgtacaagggcttcatccctacgatctcgaggcagggaccattcactgttgtgctctttgtgacgctggaacaggtccgcaagctgctcaaggatttctaaatcatgtgacgtgatgatgacgaagaattttaggaaatactataattatttattagtagtctttatcatttaatgtttgcttgtaatttttatttaaaaaaggggacattttagaaaactattctaggttcccctacgtgcgggaagagaactaagaagcaaggatgatgtaccagatcacagatgtttgtcattttaattttcttgtgctattttataaataaacaatttatgaaaatgttttctttaactttgaaaaaa

SEQ ID NO: 3562 - DNA, 1646 bp, Quercus alba
atttctctcccaaacctcaaaaaccaaaaaaagccattttcttatagcatatggctcaaaggcctagcgttcctcattattcttccatagccttgggcctccattctcatctcttggtttccagtgagatgaacccaaactctaactggtccttacattgaaaagcttaaaagaaaaaaactttcccttgaatattctaaatttagcccctaaaagctaaacccatataattccattctttctatttaacattcacaaagttcttgtttttgaacggtttaagctttttttttgctgattcaaaaaaatgggtctcaagggtttcgttgaaggaggcatagcttcaatcgtggcgggttgtgccactcacccacttgacctgatcaaggtccgaatgcagcttcaaggcgaaacccatgttccgaacccgaacctccaatctctccgcccagctctagctttccacacgacgtcgctttcggctcctgggtccatccacgtgcctcctccgccgctccccaccgtggcggcgaaggtgggtccgatcgccgtcggcgtgcgtatcgtccaacaagaaggcgtgtccgctttgttcacgggggtgtccgccacgatgctccggcagacactttattcgacgacccgaatgggactgtacgatattctgaaaaagaagtggtccgacccaaaatccgggaacataacgctgctgcaaaagatagcggctgggctcatagccggcgcggtcggcgccgccgtgggaaacccggctgacgtggcaatggtgcgcatgcaagccgatggtcggctcccccaagctcagcggcgcaactacaagagcgtactggacgccatttcgcgcatggcgagccaagaaggcgtgccgagcttgtggcgcggctcgggtctgactataaaccgagccatgttggtcacggcttcgcagctagcttcgtacgatcagatcaaggagatgatattggaaaagcgggtgatgagagacgggctcgggacccacgtgacggcgagcttcgcggcgggtttcgtggcggcggtggcgtcgaacccagtcgacgtgataaagacccgagtgatgaatatgaaggtggagccaggggctgagccaccttactccggtgctttggattgtgcgttgaaaactgtgcgagctgagggaccattagctctttacaaagggtttattcctacgatctcgaggcaaggacctttcactgtcgtcctgttcgtcacgctcgaacaggttcgtaagttgcttaaggatttctgatggagattcgatgatagttgatgatgacgaaaatgttactgattaattaataattaataaaagtttcgttttttatttaattgttgtgtttatttttcatttttttaatgagttattttatgtttgggttccttgagtttaggaggactagaagagggtagtcaaaacgaaaaacaaacgtgtgattggtgtgacaaatgttgtttaagtaaactcatcaacctcatgtcccatgatcgcaataaataatatcacgtgtatcatcagagttttactagtgttatcgctcaaactgctcaccaagggaaacaattcgagatctcctattatcaaaccaccccttacggtgatagttgtc

SEQ ID NO: 3563 - DNA, 1171 bp, Carica papaya
ggaaaaacccaacacaggaagataacttcgtatttctcttcttccttaatttggtttcttattgaaaccagaggagcttttttttctttgtttcttgaattgaagcataaccagattcagattatcagacatgggtgtcaaaggttttgttgaaggcggtatagcttccattgtagctggctgctcaactcatcctctggatctcatcaaggtccgcatgcaactccaaggcgagaaactcacggcttcaaacgccaacccagctcccactctgcgaccggctcttgcttttcactctgcgaatacaactgccactctgcttccccatgattcaatccgcgtatcgccgccgccgcaaccgccgcgagtgggtccaatctctgtaggcgtccgcatagtccaagctgaaggcgtcgccgctttgttctccggcgtctccgctactgtgctccggcagacgctctactccactacccgcatgggtctctatgacgtcctcaagcaaaagtggtccgacccggcatccggaaacatgcccctgacacgcaagatcgtcgccggcctagtcgctggaggaatcggggcggccgtcggaaaccccgctgacgtggctatggttaggatgcaagctgatggacggctcccaccggctcagcggcgcaactacagcggcgtggtcgacgcgatcacgcgcatgtcgaagcaggaaggggtcactagcctgtggcgcgggtcagcccttacggtaaaccgcgctatgatcgtaacggcgtcgcagctggcatcttatgatcagatcaaggaggcgattctggagaaaggaataatgaaggatgggctggggacccacgtgacagcgagcttcgcggcgggattcgtggctgcggtggcgtcgaatccggtggacgtgatcaagacacgcgtgatgaacatgaaggtggagccaggacaggccccaccttatagtggagccatagattgcgcgttgaagacagtgaaggctgagggacccatggctttgtacaaagggtttataccaacgatctccaggcaaggtcctttcactgttgtgttgttcgtgacacttgagcaggttaggaagttgctcaaggagttatgagaagatcttagggctgtgttacagaggaagaagaagatgatgacgataact

SEQ ID NO: 3564 - DNA, 1379 bp, Rosa hybrid cultivar
tattctctcccttaccttttcttgttcaaacccaactggttttaattccctcatccccctctgtgattcgcatagcatatgtctcagaggcccagcgttccccactcttcttccatcgccttcggcctccattctcatctcctggtctccagtgagatgaaccccaactccaactggtcttgaaaattattctcgaaccaaattctctgatcatttatctctcggttttgttactttttcgaaagaagagaatcagacatgggtgtgaaaggttttgttgaaggaggcatagcttccatcgttgccgggtgttcgactcaccccttggacctgatcaaggtccgaatgcagctccagggtgagactcaggtgccgaaacctgacccggccgcggctcaagctcttcgaccagcgatggctgcggccgctcggggaggctcttcctccattcatgtccctgtccctccggcgccggccccgcgcgtgggtccaattgccgtcggagtcagaatcattcagcaagagggtgttgctgccatgttctctggcgtatccgccaccatgctccgccagtgcttgtactccaccacccggatgggcttgtacgacattctcaagaagaaatggaccgacccggaatccggcaacatgccgctccagcgaaaaatcggtgccggactgatcgccggagccatcggtgcgtcggtcggaaatccggccgacgtggccatggtgcggatgcaggcagacggccgtctcccggccgcccagcgccgcaactacaaaagcgtggtggacgctataacctgtatggcgaaacaagaaggtgtcacgagcctgtggcgcggttcgtctctcaccgtgaaccgcgccatgctcgtgacagcttcacagctggcttcttacgaccagatcaaggaaacaattctcgataaagggctgatgcgagacgggctcgggacccacataaccgcgagcttcgcggcggggtttgtggcggcggtggcgtcgaacccggtggacgtgatcaagacccgggtgatgaacatgaaggtggagccaggggcggagccaccgtacaagggggcgctggactgcgcggtgaaaacggtgcgttcggaagggccgatggcgctttacaaagggtttatacctacgatttcgaggcaggggcctttcactgtcgtgctgtttgtgacattggagcaggtaaggaagttgctcaaagatttctgaagaagatgatgatgacgacgaattcagggagtaatatttaaaatattacaataagtggatcttttgatttaattgttttcatatgtccctagagattggggaggaatcatttagttaattatgaagcaatatcctccagcaat

SEQ ID NO: 3565 - DNA, 1570 bp, Fagus grandifolia
ttctctaacaaaatcccatagcatatgtctcaaaggcctagcgttcctcattattcttctatagccttgggcctccattcccatctcctggtctccagtgagatgaacccaaactcaaactggtcctataattttcattagaaaaaaacttttaaccttttgaatgttctaaaattagcctctaaaaacaaaacccatattcctttctttatattttatcaaagttttaatcttttcgtgattcaaaaaatagggtgtgaaaggtttcgttgaaggaggcatagcttcaattgttgcaggatgtatgactcaccctcttgacctaatcaaggtccgaatgcagctccaaggcgaaaccccatgccccgaaatccaaacccgggtactgtccaatctctccgccccgctctcgctttccaaacaacttcgctttcaggtcctggatcatccattcacgtgcctcccccaccgcgcgtgggtccaatcgctgtcggtgtacgtatcatccagttggaaggcgtgtcggctttgttctcgggcgtgtcggccacggttctgaggcagacactttactccacgacccgaatgggtttatacgatattctgaaacagaaatggtccgacccgaaatccgggaacatgccgttggttagaaagataggggcggggctcgtagctggcgccgtcggcgcggctgtgggaaaccctgccgacgtggcaatggtacgcatgcaagccgatggtcggcttcctgaatcacagcggcgcaattacaagagcgtggtggatgccatctcacgcatggcgcgccaagaagggattacgagcttgtggcgcggctcgtctttaactataaaccgagccatgctcgtcacggcttcacagctggcttcgtacgatcagatcaaggaaacgatacttgaaaagggagtgatgagagatggactcgggacacacgtgacggcgagtttcgcggcggggtttgtggcggcggttgcgtcgaatccggtggatgtgattaagactagggtgatgaatatgaaggttgagccaggggctgagccgccttatagtggggctttggattgcgctttgaaaacagtgcgagccgagggacctttggcgctttacaaagggttcgttcccacgatttcgaggcaaggacctttcactgtcgtgctgtttgtcacgttggagcaggttcgcaagttgcttaaggatttctgatgttgaattgaattgttcttcagcaaaaaaagaattgaattgttcttctattactctatgatgatgacgaaatatttggaatattaataaaagttcgcttagctaagttgcaaaacagtttgtagttctggattataagccaattatgcacgcgtgaattatgtccttataaaatgctacagtgtatagtcaaaccttgtccgtgaattatttagtttaaaaatctaatgagttaccacatcattaatttgtagtcttaattacaaactggtttgtagttaaattctatcgtttttcattttaatttgtgttgcttgagaatgggaggttaattaaaaaaaaa

SEQ ID NO: 3566 - DNA, 1350 bp, Solanum lycopersicum
aactcacaatttatatgtctcacagactcaacgttccacacttcgcatctatagctttcggtctccattctcatctactggtttccagtgagatgatctctaattccaattggatttaaaagatcttagtatttttttcccattacctaatacatatttaattttttgatttgattcattggtataatgggtgttaagggatttgttgagggaggtattgcttcgattattgctgggtgtagtactcacccacttgatttaatcaaagttcgtatgcagcttcaaggagaaaccccaatttcagctccggcgactgttcacaatctccgtccagcacttgcttttcatactgctaatcatacgattcatattccggcgccgtcggtggttgctcatgctccaccgcgtgtaggaccggttgctgttggtgttaagattattcaacaagaaggtgttgctgctttgttttccggtgtatcagcgactgttctccggcagacgctgtactctaccaccaggatgggtttatacgatatgctgaagcagaaatggaccgatccagatactaacatcatgcctttgtcgaagaagatcgttgccggattaatcgccggcgggatcggagctgccgttggtaatcccgccgacgtagcgatggttcgcatgcaggctgacggccggcttccgatctctcaacgccgcaactacaaaagcgtgatcgatgcaattactcagatgagtaaaagcgaaggggtaactagcctgtggcgcggttcatctcttaccgtgaaccgcgccatgctagttaccgcatcgcagctagcatcgtacgatcagttcaaagagactatcctcgagaaagggttaatgaaggacgggctcggaactcatgtggtttcgagctttgctgctgggtttgtggcagcgatagcgtctaatccagtggatgtgattaagacacgtgttatgaacatgaaagtcgagccgggaatggccccaccgtatagtggggccattgattgtgcaatgaaaactatcaaagctgaagggccaatggcattgtataagggatttattcctacaatctcaaggcaaggtccatttactgtggtgctctttgtcacactggaacaagtcaggaaaatgcttaaagatttttaatgatgatgacgaagaaaaaaaagttaattaaattagtattaaggatttaaaaaaaaaagtttagttgaatttatgttttttaagtttgggaaaagtgatactatgttgtgttctaatattattatttatggttacttctatatgaaaaaacgagttcttgtttggtggaaattaatgattcttgattaa

SEQ ID NO: 3567 - DNA, 5546 bp, Ricinus communis
accaaaaaacaaaaacagaagaaggaaagaaaaaaaaataataaaagaaagaagaaagaaagataaaggaactaagaatacgggtgacgtgtgcaagtgcccgcatgatagagagatgccccgctctctatggagaggaagttttttattttttttattttttttggctaccaaaatcatttctcattctgaatcaaacaaacccaaatgcttaagaaaaaatgaaaatcctcaatactctctcttctctctccctctcatccttcttcttagtcttcatttattttgtttgaattaaatctcttaattcgaacgaggtacattctccattattgtaacctgttaaagctctatgtatgtggatacgtctcgttttctatcggcattgtgtttggagatttttgagcctttaggttgatgtcattttgcggatcaagctatgactactaataagagcgttaacacagaattgtctcagggagatggtggcggcggcggcggcggtgctcctcgaccacctccttccggacctccgccaccaggacatcctgataatgctgcttctcgtgccgggaattcggtcttcaagagtggacctctttttatttcatccaaaggaattggttggacgtcatggaagaaacggtggtttattctaacacgaacctcactggttttctttagaagtgatccaagtgctgttcctcaaaaagggagtgaagtgaatttgactcttggtggtattgacctcaacaattcaggcagtgtggtagtgaagtcagacaaaaaactcttgactgttctctttcctgatggccgtgatgggcgagctttcacgcttaaggctgaaacgatggaagatttatatgattggaagactgcccttgagaatgctttggcacaagcaccaagtgctgcacttgtgatggggcaaaatggcatcttcaagaatgatccgactgattgtgttgagggttcatttgatcagtgcgtgttaccagtgaaggacaaggtgcctggtaaagcaatggtcattggcagaccagttttgcttgctttagaagatgttgatggaactccatcttttctagagaaggctcttaggtatatagaagagcatggagtcaaggtagaaggaatcttgcggcaagctgcagctgttgatgatgttgagcatcgaattcgagaatacgaacaagggagaacagagttctcggcaggggaagatgcacatgtgattgctgattgtgtcaagtattttctccgtgagttgccatcctctccagtccctgcatcttgctgcaaggcattactagaagcatttcgcaagtctattggcggaaaagatcataacaatcgagttaatgccatgcgagaagcaatattagaaacctttcctgagccaaatcgtcgcttattgcaaagaattctattgatgatgcaaaatgtggcttctcacaaagcagagaatcggatgagcacttcagctgttgctgcttgtatggcacccttacttcttcgtccccttctagctggtgattgtgaaattgaaaatgattttgatgtgggtggtgatggttccatgcaacttttgcaagcagctgctgcagctaatcatgcccaagccattgtcataactctattggaagagtatgataagatttttaatgaaggtgtcatgtcccctggactatactctgactcggaagaatgtgatagtgaggatgaggaggtaactgatgacgatgagtcttatgaagatgatgaacaggatgatgcatctcaagagactgatgcgtatactgacgatgatctcaatgatacatcaagcagaaatgagagtggtgactctggcgaagaagatctatccgacaataagggatgtgatgatcttagctctatttccaactcccctgaagtagataatggttccgaagctgcggagttgtcaaattcagttcaaacttcgttaccttcatatcgtgaagtagataggggtgagaatagcctgggtgaaagtaacaaaaatttgacaacactaaccgctgagtcggatgaattactaggagatctttccagcaaaactactttggagaataagcaaactggcgatccatctgtatgcattaaaagatcttcaagcatgtccaatggacgtgcacctgatattaattttccaagttcttgtgggcgtacttctgggaggaagaacctttctatggaatcccttgattaccattttgatgatgaaattgaaatccaaaagctggaggcgactaaaattgatctgcaacacagaatttccctttctgatagttcactgtatttttccatgcaggttaaaggtaatgcagttctgcaagccaacttagaacagcgaaagaaggccctgaacgagcgccgcctagccctcgagcaagatgtggcgagactacaagaagagctacaaaaggaaagagacaagaggatggttctggaagcaggacttaacaattctcaagctaaccaatctgttccagttatcattgatgaaaagataaaggaagatctagaggaaataagtcaagcagaggcagatgtcaacaatttgaagcaaaaggttgataatctcagtatgcagcttaatcagcagcgtgatcaaaattatggttccccacacgattcaaacaatcaaggaaggtgtttgattgcaggaaagataaagagagagatactgaagccagtgctggttcatatcttggaaaatctgcaaataaggcaagtcttgccattggtaattaactctgataatgtgcaccggaataacatggggattttaaaatgccaggataatttaatagatgaatcaactattttaccaaacaagactcagcaggcagatgcatcacggagcagcaactccaggtcttcatccaattccaagaagactagctacaggagtgagggaacaaattccactacgtctgctctgacaaagttgacaacccggctcaatttcctgaaggagcggcgaagccagcttaccagtgaaatcctggataaaggccgaggttcaagtcaggctacagctactaataaagttcgtcaatcaccgcaaatcccagacaagagccaaggttcagaagttcattctgttccaaatccagataaagctagacgatcagagagctctcagtcagtccctaacccagacaaagggttagggatagaaggccaatcacataaaaattctgaaaaatctagaaaatcggacagtcaccaagatggaggaaaatctctggaaagtcaaaatgcagataaaggaaaatttgacggtagtgctgacaaaggtaaaggatcaggaggccaacctaagggagctcaaagaaccaactccagatgattgatgttagatgattgatcgttttaagcacatggtggcattgttattgtcctccctgaagcaatttttgtgaggttgattcgttttgcctggtaaagcacttgatacctgcgtatactgaaagaagatgatcaaaatcctgacacctcctataagcccatgatgtacatacataccaagatgcttagttgagttgtataagctgatttgtctgtaagttagttgctgattcttgtgctggtttagaagccaactagggtactgttacattttgtacggtagaactcaaaatatatctctttctatttgatgtaactggagttgcttggcctgtgtgtataagacctggaatcaagcctccactaatcttaaacttattatctccaggttctgatatagcaatctcagtcgtaccacgcatcgtgttgattggatgagttgggttgccaaatttgtgcaatatttattaataaatttgttcttgtaatttttctctgagcagtaaaatcagattgaaatagtaagaccttaaacaatttatgtattgcatctcaaaatcttaatcataataaaaaaatttcatcatcatcgtaaattaaaaatccttgagcaatttcctaacttgctcaagtgtgacaaaaagaactacagtaaaaggcccctgtcttgaaatggtagggataaaccctttatatagagccattagcccttcagctctcaccgtcttcaaagcacagtcaattgctccattataaggggcagccttccctgcctccacattcatattcatgaccctagtttttatcacatccacaggatttgacgccacagccgccacaaaccctgcggcaaagctcgccgtcacgtgtgtccctagcccgtctctcatcacacccttctccagaatcgcctcttttatctgatcgtacgatgccaattgtgacgccgtcacgatcatcgcacggttcaccgttaaggaagacccgcgccacaggctggtgattccttcttgctttgacattcgtgtaatggcgtcaaggacgccgttatagttacggcgttgagcaggagggagacggccgtcggcttgcattctcaccatagctacgtcggcggggtttccaacggctgcgccaattcctccggcgattaaaccggcggtgattttgctaacaagcggcatgtttccggtatctggtcgagtccatttctgtttgagaatatcgtaaagccccatacgagtggtggagtaaagtgtttggcggagaacagtggcagaaacgccggagaacaatgcggcgacaccttctgtttggaaaatgcggatgccaacggagacaggaccgacgcgtggcggtggagaagcgacgtgaatggcagcggaagctgtggagttgaaagcaaaagcaggacggaggttgtggacttgcgattttggcaagttctcgccttggagttgcatacggacctttattagatctaaagggtgagtggagcaaccagctactattgatgctacaccaccttcaacaaaactttttgcacccatgatttggtacgtaagtaactactccctttttttaattgctgctgctgttattgaaaaagaatgaatgaaatatcaggaataggaagcaaaaattgctctgtttggggaggattttggagagttttaaagccagttaggggttaagtcactggagacgagaagatgggagtggagggaaaaagcaatggaagaagagtgaggaacagtaggcctttgagacatgtgctagtgaatattaagcaatgaattcaaagaatgagtttcttagaggggttcatggagaatatatatagtgtgggtggagaatgacggagagggaagggagtgtggcgatgaaggagaataggaagatacatcatacgtgtaaatgggaattcagacgcggttcttggggtccatgttttggtgctggatggatgccctaagacccgacccaatttttttccccttgtaaattaattatagttgttggcttcctctgtttgactttgacgctactttaggttgtttctctaatttattttcccaccttctgggagcagcagactgcaaaagatttgtgattataagtcttattgctgtttctttttcacaatcaagttaattgtctgctat

SEQ ID NO: 3568 - DNA, 1465 bp, Castanea mollissima
ctcccaacaacaaaaaaaagaaacaaagagccattttcttatagcatatgtctcaaaggcctagcgttcctcattattcttccatagccttgggcctccattctcatctcttggtttccagtgagatgaacccaaactctaactggtccttacattgaaaagcttaaaaataaaaataaagactttcccttgagcttgaatattctaaatttagcccctaaaagctaaaccccatataattctattctttccatttaacattcacaaagttcttgtttttgcacggtttaagctttttttgctgattcaaaaaaaatgggtctcaagggtttcgttgaaggaggcatagcttcaattgtggcaggctgtgccactcacccacttgacctcatcaaggtccgaatgcaacttcaaggcgaaacccatgttccgaacccgaacctccaatctctccgcccagctctagctttccacacgacgtcgctttcggctcctgggtccatccacatgcctccgccgctccccaccgcggcggcgaaggtgggtccaatcgccgtcggcgtgcgtatcgtccaacaagaaggcgtgtccgctttgttcacgggcgtgtccgccacgatcctccggcagacactctattcgacgacccgaatgggactgtacgatattctgaaaaagaagtggtccgacccaaagtccgggaacataacgctggtgcaaaaagatagcggctgggctcatcgccggcgccgtcggagccgccgtgggaaacccggctgacgtggcaatggtgcgcatgcaagccgacggtcggctcccccaagctcagcggcgcaactacaagagcgtagtggacgccatttcacgcatggcgagccaagaaggcgtgccgagcttgtggcgcggctcgggtctgactataaaccgagccatgctggtcacggcttcgcagctagcttcttacgatcagatcaaggagatgattctggaaaagggggtgatgagagacgggcttgggacccacgtgacggcgagcttcgcggcgggttttgtggcggcggtggcgtcgaacccggtcgacgtgataaagacccgagtgatgaacatgaaggtggagccagggactgagccaccttactccggtgctttggattgtgcgttgaaaactgtgcgagctgagggaccgttggctctttacaaagggtttgttcctacgatctcgaggcaaggacctttcactgtcgtcctgttcgtcacgctcgaacaggttcgcaagttgcttaaggatttctgatggagattccatgatagtcgatgatgacgaaaatgttactgattaatatattaaattaaagtttcgtttttatttaatgtcatgtgtttactttttcatttttttaatgatttattttatgtttgggttccttgtgttgggaggaggactagaacaggttagtcaaagact

SEQ ID NO: 3569 - DNA, 1091 bp, Castanea mollissima
gctgattccaaaaaatgggtctcaagggtttcgttgaaggaggcatagcttcaattgtggcaggctgtgccactcacccacttgacctcatcaaggtccgaatgcaacttcaaggcgaaacccatgttccgaacccgaacctccaatctctccgcccagctctagctttccacacgacgtcgctttcggctcctgggtccatccacatgcctccgccgctccccaccgcggcggcgaaggtgggtccaatcgccgtcggcgtgcgtatcgtccaacaagaaggcgtgtccgctttgttcacgggcgtgtccgccacgatcctccggcagacactctattcgacgacccgaatgggactgtacgatattctgaaaaagaagtggtccgacccaaagtccgggaacataacgctggtgcaaaagatagcggctgggctcatcgccggcgccgtcggagccgccgtgggaaacccggctgacgtggcaatggtgcgcatgcaagccgacggtcggctcccccaagctcagcggcgcaactacaagagcgtagtggacgccatttcacgcatggcgagccaagaaggcgtgccgagcttgtggcgcggctcgggtctgactataaaccgagccatgctggtcacggcttcgcagctagcttcttacgatcagatcaaggagatgatactggaaaagggggtgatgagagacgggcttgggacccacgtgacggcgagcttcgcggcggggtttgtggcggcggtggcgtcgaacccggtcgacgtgataaagacccgagtgatgaacatgaaggtggagccagggactgagccaccttactccggtgctttggattgtgcgttgaaaactgtgcgagctgagggaccgttggctctttacaaagggtttgttcctacgatctcgaggcaaggacctttcactgtcgtcctgttcgtcacgctcgaacaggttcgcaagttgcttaaggatttctgatggagattccatgatagtcgatgatgacgaaaatgttactgattaatatattaaattaaagtttcgttttatttaatgtcatgtgtttactttttcatt

SEQ ID NO: 3570 - DNA, 1511 bp, Gossypium hirsutum
cactgacccagaccccattcattagctgatttttcttggttagcatatgtctcaaaggcctaacgttccccactcttcttcaatagcttttggtctccattctcatctcctggtttccagtgagatgaaccctaattccaactggtcttaatagttccatctctttctttttcttctattgattttttgtttaaacttcttttattgcctttttgaaacaaagtaattgccttgttgatttgcaagcaaattttggtaaagttcttaagtatttgagtttagatcttctttgagagtgccgctatgggagtgaagagttttgttgaaggaggcatagcctcaatcgtggccgggtgttcgacccacccgcttgatttgatcaaagtccgaatgcagctccagggtgaaagccatgttcccaatccggctgttcaaacactccgccctgctttagcctttcagacaaccactactactacttcctctgctatccacatgcctcctccgccggcgcgtgttggacctgtggccaccgggatcaagatcttccggaccgaaggcgtcgctgctcttttttctggcgtctctgctaccgtcctccgccagaccctctattccaccacccgcatgggactctacgacatcctgaaacagaagtggactgataaagagaccaaaaccatgcctctctcgcggaaaatcaccgccgggctaatcgccggagggatcggcgctgccgttgggaacccagccgacgtggcgatggtgcgaatgcaagctgacggacgccttcccgtatctcaacgtcgtaactataccagcgttgtcgacgccatcacacgcatgaccaaacaagaaggcgtgacctccttgtggcgcggctcgtcgctgacggtgaatcgtgcgatgttggtgacggcatcgcagcttgcctcctacgatcagatcaaagagatgattttggaaaacgggctgatgaaagatgggctggggacacacgtggcagcgagcttttcagccgggtttgttgcggcagtggcgtccaatcctgttgatgtgataaaaacaagggtgatgaacatgaaggtggaggcagggcaaaagccgccttacgccggcgctttggattgtgctatcaagacggtgaagtcggaagggccgatggctttgtataaagggtttatacccacaatctcgagacagggaccatttacggtggtgctgtttgtgacactggaacaggtccggaagttgcttaaggacttttgaggcattgataacaaagacgatgacgaaaatgaatgtttaagttacttaattgttttccagttttatgttgttctacatgttaaacgcgatgtgcgattcttgttctaataatgatatcaatagatgagatatttgctcttaaaaaaaaaaacaaaaagaatctgaggacgaaacggtagttaagattctggagtggccaaccccaaaggtaaggtttctttatgaggttggggtttaacaaa

SEQ ID NO: 3571 - DNA, 1489 bp, Capsicum annuum
gtctcaaagacccaatactccacacttttcatctatagcttttggccttcattcccatctcctggtttccagtgagatgaactctaactccaattggtcttgaaaatatcaaattctttgtgatcctatttagtcggcggtgcagtaaagctcccgctattctaattaaccttcttttgtagcacactaacacaagctcttgctattcttgttagtattcttttgtagcacttttggatctttatattgttgtttttgtagagcttcctgaatatctcgagaatgggtgttaaaggatttgttgagggaggtattgcttcgattattgctgggtgtagtacacatcctctagatttgatcaaggttcgtatgcagttgcagggtgaaaccctaaacaaagctcctgctccgcacaccgttcataatctccgtccagcacttgccttccatggtggtggtggtgctgctgctagccatggtaatatccacgtctcggggccaatggtacgaccgacgagtgtgggaccagttgctgttggtgtgaaaattatacagcaggaaggagtggctgcacttttctccggtgtatcggcgactgttctccggcagacgctttattctacgacccgaatggggttgtacgatatgctgaagcagaaatggtctgatccgaataagagcaacatgcctctgtcgaggaagattatcgccggattagtggccggtgggatcggagctgcggttgggaaccctgctgacgtggcaatggtgcgaatgcaagccgacggccggctcccattggaccagagaaggaactacaaaagcgtagttgatgcaattactcagatgagtaaaagcgaaggcgttactagcctgtggcgcggttcatcacttaccgtgaaccgcgccatgctagtaactgcgtcgcagttggcatcgtatgatcagttcaaggaaatgatcttggaaaaagggctgatgaaagatggtctagggacccacgtgacggcgagctttgcagctggatttgtggctgcagtagcctcaaatccagtcgacgtgattaagacacgtgtcatgaacatgaaggtggagccgggaatggctccaccgtacagtggggcccttgattgcgctgtgaaaacgatcaaagccgagggccccatggcactttacaaggggttcattccaacaatctcaaggcaaggaccatttactattgtgctctttgttacattggaacaagtcaggaaaatgctcaaggatttttgatgatgatgacgaagacaaaaataattttagtattaagaatttaaaaaaatgtttagtttatttaatgttttaagtttttaatttgggggttaagtttgggagaagtaatactatgttattttcttgttttgttattgtcacttctatataaaaaaaataagttctcttttggtagatttaatgattctttattaagcaaatgttgattgaagcaaaa

SEQ ID NO: 3572 - DNA, 1194 bp, Tabernaemontana elegans
tgttcaattcaattcaattcaattccttcctagaaagggaagaaagaatcaaaatccctgccttttggttgtttttacgctacagaagaatatgggaatcaaaggatttgttgaaggaggcatagcttccattgttgcaggttgcagcactcaccctttggatctcatcaaggtccgcatgcaactccagggtgaggctcctgctccgaacccggctgttcagacgatgcgccccgctttggccttccacaccaccgttggccatgcctctcaggttcacgtcccttccccccctctgccaccaccgcctacgcgtgtcggacccatttccgtgggtgtgaagcttatccaacaggaaggcgtggcagctcttttctctggtgtctccgccactgtcctccgccagactctttactccaccaccagaatggggctctacgatgtcttgaagcaaaagtggacagacccccacaccaacaacatgccattaacgagtaagatagctgccgggctcatcgctggtgctgtcggagctgcagttggaaaccccgccgatgtcgcaatggtgcgcatgcaagccgatggtcggcttccggcggctcagcggcgcaactataagagcgtggtggacgcaattacccaaatgtccaagaatgaaggcattactagcctctggcgcggttcatctcttacggtgaatcgcgctatgctggtgacggcatcacaactggcatcatatgatcagatcaaggagatcatactacagaagggggtgatgaaggacgggctaggcacccacatcacggccagtttcgccgccgggtttgtggcggctgtggcctcaaatccggtggatgtaatcaaaactagggttatgaacatgaaggtggagcccggccaggccccaccttacaatggagctcttgattgtgcaatgaagactatcaacgctgaggggcccatggcactctacaaggggttcattcctacaatctcaaggcagggaccattcactattgtgctctttgtcacactggaacaggtccggaagatattcaaggacttttaattaaatagcgatgatgacgaataaaataaaaaaataaaaaatatatttttagtattttatatttaagttcctgacaatgtggaaagaatgtatgaggttgtcggtgttttaatggaatttgttta

SEQ ID NO: 3573 - DNA, 1493 bp, Orobanche aegyptiaca
cgactttcaattggttcctttttgacagcatatgtctcaaaggcctaacgtcccccacttttcctccattgctttcggcctccattcccctctcttggtttccagtgagatgcactctaattccaactggccttctctctagatcttcctgattattactttttactattattgatttttacatttattaacccaatccacattattcttttcttctcttaatcaatctcttcccctttctcttggatttgtacgcttctctctgcaaatcttttctttaattattattttggaaattaaaatcttttgagttgaattttttccaatcatgggtttgaagggatttgttgagggcggtattgcttccattattgctgggtgtagtacgcaccctctcgatttgattaaggtccgtatgcagcttcagggcgaggcatcgatgccggcggcgcaaaatctccggccggctctggccttccaccccgccaccaccgtccaccaccacataccgcctccccgagtggggcccatttcggttgggctccggatcattcaacaggacggcgccgccgccctattttccggcgtctccgccaccgtcctccgccagacgctatactccaccaccaggatgggcttgtacgacgttctgaagaagaaatggacggatccgaacaccaacaacatgccgctggcgaggaagatcgtcgccggactaatcgccggcggtatcggcgccgccgtcggaaacccggccgacgtggccatggtccgtatgcaagccgacggacgccttcccccagcgcagcggcgcaattataagagcgtggttgacgcgattacacagatgagcaggaacgagggcgtagttagcctgtggcgcggctcatcccttacggtgaaccgcgccatgctcgtcacggcctcgcaattggcgtcgtacgatcagttcaaggaaatgatacttgagaagggtctgatgaaggacgggctcgggacccacgtgacggccagcttcgccgccggattcgtggcggcggtggcgtcgaatcctgtggacgtgatcaaaacgcgcgtaatgaacatgaaggtggagccgggggttgcaccgccgtactccggcgccgttgactgcgcgatgaaaacgatcagggcggaggggccgatggccctttacaaggggtttataccgacgatctcgaggcaaggaccatttactgtggtgctctttgtcacactggaacaggtccggaaattactcaaggatttttgaaacttaattaattagcttgatgatgacgaagatgaagtgatgatgaaattgaggaaataaagtatgttctttttaattgtgatttgactaagcaagagtttttttcttttaattgtcccatatacaatttgaaaaattgggcatcggcacttctttttttacataattaagatatttgtcatactccctccgtcccgctggaagatttacatggaaccct

SEQ ID NO: 3574 - DNA, 2897 bp, Physcomitrella patens
tttggactcaccaccgccatcgctgtcctcgcactctcgatcctgttgctgctcacgcgcaagcttctcttgctcgctctctctctctctctctctcacacgcacatcgtgatgctctatgtgcatcgctcgccttctccttcctccatatctctagtgtaaagggtttcagtggagtttttacgctgccgaatcaaccccagcacggcgcgacttggttgcgcagtggacatgatgtcgcggaaccctaaccgggttgtgcagtggaggagcggagagggcgccatggatctgaaggcgcgcgttgctttgtcttcgtttatgtttatgctgttgctgttttcccccgcgcatgcgttttacttgcccgggacttatctgcatccgtatcacaaaggggacaagctggaggtgaaggttaactccatcacctccatcgagacggagcttccttactcgtactacagtctcccgttctgcagaccccccgagggtatccacaaagtggcggagaacatcggggagatgctgatgggtgaccagattgagaattcgccgtacaagtttcagatgaagatagaccagaacgatttgcttgcgtgtgtcgcgcctgccatgaccgagaacgatgtgaagcacatcactcagcgaattgatgatctgtacctggtgaacttgattctggataatttgcctgcgtcgcggctcatcaggcagaaggatccgagcaacccgttgcggttgacagggtcgccgattgggttcaagatcgaggccgactcacagcattacatttacaaccacttgattttcaaggttttggtgcacccttacgacaaggactctggctcaggggctgtgttaggtaccggggagggtttggacaccatgcccgtggcaacgacgcagaacctgacggggacttacatggtggtagggtttgaggtggttccttgcagtgttgtgcgcgattctaaggctgcgagtaagttgaactaccaggatgcccttcccccgtcagattgtgatcctaagaagccttaccagcccatcaaggtgggacaagagatcgtgtactcatacagcgtccagttcgaagatagttcaatccggtggccgagcaggtgggacgcgtacttgaagatggatggagcgcgcgtgcactggttctcgatattgaactctctgatggtgatctcgttccttgctggaatcgtgttcgtgattttcctgagaacggtccggagggacttgacgaagtacgaggagctggacaaggaagcgcaagtgcagatgaacgaggagctgtcgggatggaagctggtggtaggcgacgtgttccgtgcacccgagaaccctcagctgctttgcgtggtgattggggacggagtccagattctgggaatggcggtggttacgatcctgttcgcagcactgggatttatgtctcctgcgtcgcgaggaatgctgctgaccggaatggttatgttgtacctgttcttggggatcatcgctgggtacgtggcttcgcgaatgtggtacactctgaagggcttgaaagatggatggaggccgatagcgtggaagacggcatgcttcttccccgggatcgcattcacaatcatgacgagcttgaacttcctcttgtggtcacggggcagtacgggtgccattcctatctctctgtatttcacactgctgtttttgtggtttaccatttcggtgcctctgactttgctgggagggtatctgggcgtgaaagcggagccaatcacattccctgtccgaacgaaccagattccacgtgagattccaccacagcgttatccttcatggctgctggtgctaggcgcgggcacgctgccgtttgggacgctgttcatcgagctgttcttcatcatgtcaagcatctggctggggcgcgtgtattacgtgttcgggtttctgttcgtggtgttgatcctgctggtgatcgtgtgcgcggaagtgtcagtagttctaacctacatgcacttgtgcgttgaggaccatcggtggtggtggaagtctttcttcgcatctgggtcggtggcgctgtatgtgttcctgtattcaatcaattacctggtatttgacctgcacagcctggcggggccggcgtctgcgatgctgtacgtgggatactcgctgttaatggcaatcgcgattatgttcgcgacgggcacagtgggattcctgatgtcgttctacttcgtgcactacttgttctcgtcagtgaagatcgattaaaggatgtagaagtcttatgcaatcaaggctgtgattgtgttttgggagacgtggtaagcaaatgcagccttggggattgtctatatgccagacttgtgtaggatgtgggatcatgatgtagcttatgattagatttttgtttttattttggtggagttcatcttcatccccgagtaggattagataggacttcttatcggaagcagaacttgtaagaacaggccggaaagagtgggcgaacattgttctctggcatgttgtatgaagaggtcagcaaatggagttgatgataaaatgaaaaagagggcggtttatctatttcatgcacatgggctttttggttgagggttgttgcctgaaaaggtttgaagggtagttgttgtcaaatgtgttgacaagatattgagctagtgttgctagtgtttccatttgcagcagaagggttggttgtggccatttggacaagttgttgcttgcatctatggtctcgtctgctgcagtgaaactatatcttggatattacggtgaggatgtgttttttcaggacctcgaaggtggaggtcgtcatatgaaatcttgtttctttgtgaaagtttcagtctgtcattttctttcatgcactttattct

SEQ ID NO: 3575 - DNA, 2294 bp, Abies balsamea
attgttaggataggatagaatagggattagaacctgggacgctgcgatggagcgacagcagcagcgacaagaattgtctacagaggagatagggaagtacgcacacagcccagtgcacttggcggtggtggggcgggactatgtggcgcttcggcggatcctttcaacgctgccgcgattgcccaaggccggagaagtgactacggaggaggaatcggtagtggcagaggagcgggcggatattgtgtcgggttccatagatcggcgggacgtacccgggcgggaaacggcgctccatgtggccgtccggctcggggattgcaccgccgtggagatgctaatggccgccggggccgattggagtctccagaacgagcagggatggaacgccttgcaggaggcggtttgtgcgcgcgaggatgtcatcgcaatgatgataaccaggcattatcaacccctcgcctgggccaaatggtgccggcgcctcccccgcatcatagccactactgggagaatgagagatttctacatggaaatcactttccattttgagagctccgtgatccccttcataggacgcattgcgccgtccgatacttacaggatctggaagcgcggttcgagcctcagggcggacatgaccttggcagggtttgatgggtttcggatacagaggtccgatcagagcttcttgttcttgggcgagggcacggaggacccgaaattgcccgccggatctcttatcgtcttaactcataaggaaaaagaaatcaccaatgctctcgagggcgccgggactccgccatccgacgccgaggtcgcgcaagaggttgccctgatggcgcagacgaatttgtataggcctggcattgatgttaccgaggccgagctcgtgcctcatttgaattggaggcggcaggacaggactgaaatgatcggtccctggaaggccaagatctatgacatgctgcatgtgatgctcagtgttaagtcccggagggtccctggggcgatgactgatgaggagctctttgcagcagagaatggcaggtttgcggacgagccggggggttatgaggagattttgacaaaggaggagaaagaacagttggaccaagctctcagtatggagcattcggaggccactgaagacgaggcggcgacattctttggccctgtggatcaagatggatgtcatcagaatggccggttgttgtcttcggcagcggatcctgatgcctctgaggcctctgaatccaattctgataaagataggcgaagttggtttgggtggagcaagaagatgctaaaaactgatggactgaagcgaacagcactgaattcacatgtcagtaagcctgataaacagctagagaaatccctatccgattgcaatggcaatggcactttagtaatgaggaatcttcaaggatactgaagaaattcgccaagttagctccagagagcagtcatagatcagtcgatcagcagccatctgatttcaaaaggatgatgctatgggtagtagaaagggaaaagagaaagctagtaaaaacagtaataagaaagactcttttaaaaagaaaaggtccagtggaacaaatgacattaagcaagaaagcgaatacaagaaggggttgaggcctgtgctgtggcttacacctgattttcctctcaaaatagaagagtttcttcctttgcttgacattttagcaaacaaggtaaaagctgttcggaggttgagggagctgttgacaaccaagctgcctcctgggacttttcccgtcaaggtggctattccaattgtccccacaattagagttgtaatcacatttacaaaatttgaggagctgcaatctggtgaagagttctcaactcctctttcaagtccagctcattttcaggatgcaaaagggaaagagacagaggcctctaattcgtcagtttcatggatgtcttggatgagggggtctcatagtcatacatcaaatgaaccaacaagtttggaagatcatttgagagatgattcagatcctttttatataccgagtcactatacctgggttgacatgaatgagaagaagcgccgaatgaaagccagaaagatgaaaaacaagaaaggaaaagcacattcttcccggaatgcagatggttccagtgatatcgaggagtaaccattgtaagaattataaatttatagtcatagaggttgtcaaggctgagttgtccattatactgtatgtttttacctttatcaaatcatgtagttttttctgctaaatatcttctgaaat

SEQ ID NO: 3576 - DNA, 2528 bp, Cedrus atlantica
gcccagaggagatggggaagtacgcgcacagcccaagtagacaattagtagacggtaggtaggggaagggactaatagcggctcttcgacggatcctttcaacactgccgcgattgcccaaggctggagaagtgactacggaggaggaatcgatagtggcagagcagcgggcggacatcgtgtcgggttccatagatcggcgcgacgtgccggggcgggaaacggcgctccatgtggccgtccggcttggggattgcacagccgtggagatgctgatggccgcgggggccgattggagtctccagaacgagcagggatggaacgctttgcaggaggcggtgtgcgcgcgcgaagacgccatcgcaatgatgataaccaggtattatcaacccctcgcctgggccaaatggtgccggcgcctcccccgcatcatagccactactgggagaatgcgagatttctatatggaaatcactttccattttgagagctccgtgatccccttcatagggcggattgcgccgtccgatacttacaggatctggaagcgcggttccagcctcagggccgacatgaccctggcagggtttgacgggtttcggatacagaggtccgatcagagcttcttgttcttgggtgagggcacggaagacccgagattgcccgccggatctcttatcgtcttaactcacaaggaaaaagaatcaccaatgcgctcgagggcgccgggactccgccatccgatgccgaggtcgcgcaagaggttgctttgatggcgcagactaatttgtataggcctggcattgatgttacccaggccgagctcgtgcctcatttgaattggaggcggcaggacaggactgaaatggtcggtccctggaaggccaagatctatgacatgttgcatgtgatgctcagcgtcaagtcccggagggtccctggggcgatgactgatgaggagctgtttgcagcagagaatgacaggtttgtggacgagccggggagttatgaggagattttgacaaaggaggagaaagaacagttggaccatgccctcagtatggagaattcggaggccattgaagacgagggggcggcattctgtggccctgtggatcaggatggatgtcatcagaatggcggatcgtccgcttctgcaggggatcctgacgtccctgaggcctctgaggcctccgagcctaattatgataaagatagacgaggttggtttgggtggagcaagaagatgctaaaaactgatggactgaaacgaacagcactgaattcaccaatgagtaagcctgataaacagctagataaatccctacctgactgcaatggcaatggcactttagttaatgaggattcttcaaggatactgaagaagttctctaagttagctccagagagcagtcacagatcagtcgaccaacaactatctgatactccaaaggatgatgctgtgggtagtagaaagggaaaagagaaggctagtaaaagcagtaataagaaagattcaagtaaaagaaaaggttgagtggaacaaatgacactaagcaagaaagcgaatacaagaaggggttgaggcctgtgctgtggctcacccctgattttcctctcaaaatagaagagtttctgcctttgcttgacattttagcaagcaaggtaaaagctgttcggaggttgagggagctgttgacaaccaagttgcctcctgggacatttcctgtcaaggtggctattccaattgtccccacaataagggttgtaatcacatttacgaagttcgaggaactacaacctgtagaagagttctcaactcctctttcaagtccagctcattttcaggatgcaaaaggaaagagacagaggcttctaattcgtcggtttcatggatgtcttggatgagggggtctcatagtcgtacatcaagtgaaccaacaagtttggaagatcatttgagagatgatttagatcctttttacataccgagtaactatacctgggttgacatgaatgaaaagaagcgccgtatgaaagccagaaagacgaaaagcaagaaaggaaaagcacagtcttcccggaatgcagatgggtctctcagtgatcttgatgagtaaccattgtaagtttatagccatagaagttgttgaggctgagtttgctggaatggagcatttctcatctctagtgcatcgatccattatgattgtatgtttttacccttttcaaatcatgtagttttttctgctaaatatcttgtgaaatgggcaattgacaagttggtttgggataagcagatatttgcagagaatctgcacatttttctgtgttcaggttaacataaattcttgcgccttgttcctattgttgaggcatatgggataaataataaaaaagttgatgtaaagttagaaaaagttacgtgctatctacttgtatcgagggtgtcatgttcatgcatccatccttttatccagcttttgctgtccctttaacaggttatgttgtattcacatgaagtttcc

SEQ ID NO: 3577 - DNA, 2234 bp, Picea glauca
gatgctgatggccgccggggccggattggagcctccagaacgagcagggatggaacgccttgcaggaggcggtgtgcgcgcgcgaggacgctattgcaatgacgataaccaggtattatcagcccctcgcctgggccaaatggtgccggcgcgtcccccgcatcatagctactactgggaggatgagagatttctacatggaaatcactttccattttgagagctctgttatccccttcatagggcgcattgcgccgtccgatacttacaggatctggaagcgcggttcgaccctcagggctgacatgaccctggcagggtttgacgggtttcggatacagaggtccgatcagagcttcttgttcttgggcgagggcacggacgacccgagattgccctccggatctcttatcgtcttaactcataaggaaaaagaaatcagcaatgcgcttgagggcgccgggactccgccatccgatgccgaggtcgcgcaagaggttgccctgatggcgcaaacgaatttgtacaggcctggcatcgatgttacccaagcagagctcgtgcctcatttgaattggaggcggcaggacaggactgaaatggtcggtccctggaaggccaagatctatgacatgcagcatgtgatgctcagtgtcaagtcccggagggtccctggggcgatgactgacgaggaactctttgcagcagagaatgacaggtttgcggatgagccgggctgttatgaggagattttgacaaaggaggagaaagaacagttggaccaagctctcagtatggagaattcggaggccatcgaagacgagggggcggcattcttcggccctgtggatcaggatggatgccatcagaatggccggttgtcggcttcggcaggggatcctgatgcctctgagtcctccgaggcctctgaagccaattgtgataaagataataggcgaggttggtttgggtggagcaagaagatgctgaaaactgatggactcaagggaacgacatcgaattcacaaatcaataagcctgataaacagctagagaaatccccacctgaatgtaatggcaatggcactttagttaatgaggattcttcaaggatactgaagaagttctctaagttagctccagagagcagtcagaaatcagtcgaccaccaaccatctgattttcaaaaggatgatgctgtgggtagtagaaagggaaaagagaaggctagtaaaagcattaataagaaagattcaagtaaaaagaaaaggtccagtggaacaaatgacactaagcaagaaagcgaatacaagaaggggttgaggcctgttctttggctcacacctgattttcctctcaaaatagaagagtttctgcctttgcttgacattttagcaaataaggtaaaagctgtccggaggttgagggagctgttgacaaccaagctgcctcctgggacttttcctgtcaaggtagctattccacttgtccccacaataagggttgtaatcacatttacgaaatttgaggaactgcaacctgtagaagagttctcaactcctctttcaagtccagctcattttcaggatgcaaaagggaaagagacacaggtttctaattcgtcagtttcatggatgtcttggatgagggggtctcataatcgtacatcaagtgaaccaacaagtttggaagatcatttgagagatgatttagatcctttttacataccaagtaactatacctgggttgacatgaatgaaaagaagcgtcgaatgaaagccagaaagatgaaaaacaagaaaggaaaagcacattcttcccggagtggagatggttccttgactgatattgatgagtaatcattgtaagaattatagccaaagaagttgtctgaggttgctggaatggagcatttctcttctctagtgcattgatccattattattgtatgtttttaccattttcaaattatgtagttttttctgctaaatatcttgtgaaatgggcaattgataagttggtttgggataagaagatatttgcagagaatctgcacatttttctgtgttcaggttaacataaattcttgcgccatgttcctattgtcgaggcatatgggataaataataaaaaagttgatgtaaagttagaaaagttatgtgctatctacttgtatcaggggtgccatgttcatgcatccatccttttatctggctttttctgcacctttaaca

SEQ ID NO: 3578 - DNA, 708 bp, Nicotiana benthamiana
accacactcattttcccaaaagtcctacagacattcttttttgttgctcttctgagtttctcctcacgaaagaacttgatcttcttttccaaaaaacaagctagctaaaacttcctctagtaaaaaaatggccataagaaaatcatcaaacaagttgtcacaaactgcagtaatcaagcaaatcttgaaaaggtgttcaagtttgggaaaaaaacatggatatcaagatgaagaaggacttcctcttgacgtacccaaaggtcattttgttgtgtacgttggcgaaaatagaacaagatacattgttccaatttcaatattaactagacctgaattccagtacctcctacatcgcgctgaagaagaatttggctttgatcatgacatgggccttacaattccttgtgatgaacatgtttttgaatctctaacgtcaatgttaagataaaattaaagacagggaatcgagaagatcgaggaactagcagctaggatgttggaagggaaattttatacagaagttcaagaatctgttttactgcttctgtccttcatttttattttctacgtcacatttttttattttctacgtcacatttttttttttttgggacttttgggatcttgtttattgttaactaattaactggaaatccaatgttgaggatttctgtttgtaaatctcaaaagtttgtaattttcctcgca

SEQ ID NO: 3579 - DNA, 1225 bp, Populus trichocarpa
cataaacataaaccgcagagcaagaaacgaaaagaactcaaaacaacgtcgttcaagccaaaacaagtgacttgtcctctaagtcgaattatatttttcttcaaaaaccccgcagatctcacagagaagcaaagcaaaacccaagctaaaacaagagaaaactgaagcctagccatggctcgatacgatcgtgcaatcacagtattttctcctgatggccatttatttcaagtagaatatgctctcgaagctgtccgtaaaggaaacgctgccgttggtgtccgtggcactgatattgtcgttctcggtgttgaaaagaaatccaccgctaaacttcaagattctagatcagtgaagaagattgtatctttggacgatcatgtggcactagtatgtgctggattgaaggcagatgcccgtgtcttggttaacaaggcacggattgagtgccaaagctataggctaactgttgaggatcctgtaactgttgaatatataacgcgttatattgctggtttgcaacagaaatatacacagagtggtggtgtgaggccatttggtctttcgaccttgattgttggctttgacccacacttgggtgtccccgctctttatcaaactgatccttctggagctttttcagcatggaaagctaatgctaccgggagaaactcaaactcaatgcgggagtttttggagaaaaactataaggaaacttctgggcaaggaactgtgaagttagctatccgtgctttacttgaagttgttgagagtggggggaagaacatagaaattgctgtgatgacaaaagaccaggggctgcggcagcttgaagaagctgagattgatgcaattgttgctgagatcgaagcagagaaagcagcggctgaggctgcaaagaaagctccactgaaagattcctagacctgctgtagttctcatacatcaccttgtactgtccaagtgatttagtttcttcattgctatatcacattggcttgtttccttttgtcagacacctgatttcaagtctctgccagccttcattttgtgtttcttctcttatagcctctcatttgaaatggtcacaactgctttatgtttcctagcgatgttgaacgattcgattcatgctattttcaaagttctgcaaaaattggtacttgatatatcctcttacacttaaaaactaaaaattaaattttagcaattgggttctaaacaa

SEQ ID NO: 3580 - DNA, 889 bp, Euphorbia peplus
aaacctaagtgaaaatggcaaggtacgatcgagcaatcacagtgttctctccagatggacatttgttccaggtcgagtacgctctcgaagctgtccgcaaaggtaacgccgccgtcggtgttcgtggtactgatgtcgtcgttctcggcgtcgagaagaaatccaccgccaaacttcaagacgctagatcagtcaggaagattgtttctttggatgatcacgtagcactggtatgtgctggcttgaaagcagatgcacgtgttttggtcaacaaggctcgcattgagtgtcaaagccataagcttactgttgaggatcctgtaactgttgaatatattacccgttacattgctggcctacaacagaaatatactcaaagcggtggtgtgagaccatttggtctttctaccttgattgtaggttttgatcctcatactggcgttccatctctctatcaaactgatccatcaggagctttttcagcatggaaagctaatgctaccggtagaaactctaattccatgagggagtttttagaaaagaactttaaagatacctcaggccaagaaactgtcaagttagcaattcgggctttgcttgaggttgttgagagtgggggaaagaacatagaaattgctgtgatgacaaaagagcatggtctccggcaacttgaagaagcagaaatagatgctattgtagctgaaattgaagcggaaaaagcagcagcagaggctgcaaagaaggctcctccaaaagaaacataggttcactgtacttgtcaccatctatatacccaagtgattagtttcgtcgagaccagattactttgtggtgcttgacgctctcatctttgctgaagtcatcttgctttttatgtctattgtatttg

SEQ ID NO: 3581 - DNA, 808 bp, Manihot esculenta
gcttaaactgaaatggctcgatacgatcgcgcaattaccgtgttctcgccggatggacatttgtttcaagtagaatacgctctcgaagccgtccgcaagggaaacgctgccgtaggtgttcgcggcaccgatgtcgtcgttctcggtgttgagaagaaatctactgccaaacttcaagactctagaacggtgaggaaaattgtttctttggatgatcacgtagcactagtatgtgctgggttgaaagcagatgcacgtgttttggtcaatagggctcgcattgagtgtcaaagccataggcttactgttgaggatcctgtaactgttgaatatattactcggtacattgctggtctacaacagaagtatacacaaagtggtggggtgagaccatttggtctttcaaccttgattgttggttttgatccatatactggtgtcccatctctgtaccagacagatccatcgggagcattttcagcatggaaagccaatgctaccgggagaaattcaaattcaatgcgggagttcctagaaaagaattataaagaaacatctgggcaagaaaccgtgaaattagcaattcgtgctttgctggaagttgttgagagtggggggaagaacatagaaatagctgtgatgacaaaagagcatggccttcgacagcttgaagaagcagagattgatgcaattgttgctgagatagaagcagagaaagcagcagcagaggctgcaaagaaagctccatcaaaggaaacctagagctactgcagttctaatttatcatcttgtactgaatgattaattt

SEQ ID NO: 3582 - DNA, 972 bp, Ricinus communis
aaaataaaaaatagaaaaaaaggaaaagcaaagcaaacaaaaaccagatcacacagaactagaaaaaccctgcaattacataaagaaatccagacaagctaaaaatggctcgttatgatcgtgcaattactgtgttctctccagacggacatttgttccaagtggaatacgctcttgaagccgtccgtaaaggaaacgccgctgttggtgttcgcggcacggacgttgtcgttttaggcgttgaaaagaaatccaccgctaaacttcaagatgctagaacggtgaggaagattgtttctttggacaatcacgtagcactagtgtgtgctggattgaaagctgatgcacgtgtgttaatcaatagggctcgcgttgagtgtcaaagccataggcttactgttgaggatcctgtaactgttgaatatattacacgttacattgctggtctacaacagaagtatacacaaagtggtggagtgagaccatttggtctttcaactttaattgttggttttgatccctacactggtatcccatctctttatcagaccgatccatcaggggcattttcagcttggaaagctaatgctactgggagaaactcgaattctatgcgagagtttcttgagaagaactataaagaaacttctggacaagaaactgtgaagctagctattcgtgctttacttgaagttgttgagagtggggggaagaacatagaaatcgctgtaatgacaaaagaccatggcctgaggcagcttgaagaagcagagattgatgctattgttgcagagatagaagcagagaaagcagcggcagaggctgcaaagaaggctccaccaaaggaaatctagatatactgtagttctcatgtattatcttgtactgagtgactagtttattttgctgtctcatcagattgttatgtttacattaatttcttttcgaaaggaacatctttcaggatttcac

SEQ ID NO: 3583 - DNA, 1079 bp, Manihot esculenta
aagtcgagtagttccctttaatattttccagaatcgacagccaacaaagaccagatcggcagaaactctgagatagcctcaaactgacatggctcgttacgatcgtgcaattacggtattctctccggatggacatttgtttcaagtagagtacgctctcgaagccgtccgcaagggaaacgccgccgtaggtgttcgcggcactgacgtcgtcgttctcggtgtcgagaagaaatccaccgccaaacttcaagacgctagaacggtgaggaaaattgtttctttggatgatcacatagcactagtttgtgctgggttgaaggcagatgctcgtgttttggtcaacagggctcgcattgagtgtcaaagccataggcttactgttgaggatcctgtaactgtcgaatatataacacgctatattgcaggcttgcaacagaagtatacacaaagtggtggtgtgagaccatttggtctttcaaccttaattgttggttttgatccctatactggtgtcccatctctttatcaaacagatccatctggagcattttctgcctggaaagccaatgctactgggagaaactcaaattcaatgagggagttcctggaaaagaattataaggaaacttctgggcaagaaactgtaaagttagcaattcgtgcattgcttgaagttgttgagagtgggggtaagaatatagaaattgccgtgatgacaaaagagcacggtctgcgacagcttgaagaagcagaaattgatgcaattgttgctgaaattgaagcagagaaagccgcagcagaggctgcaaagaaggctcctccaaaggaaacctagatctacatgtactatagtttgcatttgttatcttgtactgggtgattagcttcttcactgctacatcaccattttatgtttaacattaatttcttggttaaagcaacagctctttttcagtactccatcccttttctgagtttctctcttttaattgctgttttggtttggcaattagtgggtttgtttatatattaaaatatgtcgaatgttgcctcatggaaatggttgcttaatttgg

SEQ ID NO: 3584 - DNA, 979 bp, Arnica chamissonis
tcaaagctaaaatttcgaatcgaaatacctaaatcttcactagaatctcaatatttaatggcgagatacgacagagctatcacggtgttctcgccggacggacacctgttccaagttgaatacgcattggaagccgtacgcaagggtaacgccgccgtcggtgttcgtggcacagacaccgtcgtccttggggtagagaagaagtctaccgttaaacttcaagactcgagatctgtaaggaaaattgtaagtctggatgatcacattgcattggcttgtgctggacttaaagctgatgcacgtgttcttattaacaaggcacgaattgagtgccagagccataggcttactgttgaggatccagtaactgtagagtatatcacgcgttacattgcaggtcttcaacagaaatacacacaaagtggtggtgtcaggccgtttgggctttcaaccctaatcgtaggatttgatccgtattctggtgttccagcattatatcagacagatccttcaggcaccttttctgcttggaaagctaatgctactggcaggaactccaattccatgagggagtttctggaaaagaattacaaagagacctctggtcaagaaactataaaactggccatccgcgctctgcttgaagttgttgagagtggagggaagaacatagaagttgctgtgatgacaaaggagggactgaggcaacttgaagaagctgaaattgacgcaattgttgcagagattgaagcagaaaaggcagctgccgaggctgcgaagaagggtcctgctgccaaggaaacataatgtgtcaaaaagcaagtcgttttctcacccggttttattcagtttgaactttgcttgttcgttaccaatcgtatggtagttttatggaaattgtctctcatttgaagatatttatgcttttgatcgaatccatcatcctttcattatgtgattcatgtttgataatgttttt

SEQ ID NO: 3585 - DNA, 1194 bp, Ricinus communis
atttacaacacacagacgacatcgtttaaacgataaatacctcggcatcaatcagtctttccactctccggtcgctaacttaacttgtcccctaagtcgaattctcctcttctaaaataaaaaatagaaaaaaaggaaaagcaaagcaaacaaaaaccagatcacacagaactagaaaaaccctgcaattacataaagaaatccagacaagctaaaaatggctcgttatgatcgtgcaattactgtgttctctccagacggacatttgttccaagtggaatacgctcttgaagccgtccgtaaaggaaacgccgctgttggtgttcgcggcacggacgttgtcgttttaggcgttgaaaagaaatccaccgctaaacttcaagatgctagaacggtgaggaagattgtttctttggacaatcacgtagcactagtgtgtgctggattgaaagctgatgcacgtgtgttaatcaatagggctcgcgttgagtgtcaaagccataggcttactgttgaggatcctgtaactgttgaatatattacacgttacattgctggtctacaacagaagtatacacaaagtggtggagtgagaccatttggtctttcaactttaattgttggttttgatccctacactggtatcccatctctttatcagaccgatccatcaggggcattttcagcttggaaagctaatgctactgggagaaactcgaattctatgcgagagtttcttgagaagaactataaagaaacttctggacaagaaactgtgaagctagctattcgtgctttacttgaagttgttgagagtggggggaagaacatagaaatcgctgtaatgacaaaagaccatggcctgcggcagcttgaagaatcagagattgatgctattgttgcagagatagaagcagagaaagcagcggcagaggctgcaaagaaggctccaccaaaggaaatctagatatactgtagttctcatgtattatcttgtactgagtgactagtttattttgctgtctcatcagattgttatgtttacattaatttcttttcgaaaggaacatctttcaggatttcacccatctttagtggtttctttctcatcttataatcacccttctgagtttgggtatgagctggatatgttggctgttgctctgtggagtggttgcttaatttataattgtt

SEQ ID NO: 3586 - DNA, 1125 bp, Platanus occidentalis
cctagaagagaaagggaagtgtggcggacttagaagaaactctgggggcagtagaaagtctctttaggtgccttgaaccccaagcagtcggcaagtctggctcaaaagttataatcgctgagcaaaaccaacctcttcccatctaagaaatcaaacagaagataaataatggctcgatacgatcgcgcgatcacagtattctctcccgatggtcatctgtttcaagttgaatacgcgctcgaggccgtgcggaagggcaacgcggccgtcggagttcgaggcaccgattgcatcgttctcggcgttgagaagaaatccaccgctaaacttcaagattcaagatcagttaggaagattgtaaatttggatgatcacattgcactggcctgtgctgggctaaaagcagatgctagggtcctgattaacagggcgcggattgaatgtcagagccacaggcttacagttgaggatcctgtaacagttgaatatatcacacgttacattgctggtcttcaacaaaagtatacacaaagtggtggtgtgagaccttttggtctttcaactctgattgtgggatttgatccatacactggtgttccatcactttatcagacagatccatcagggacattttcagcttggaaagctaatgcgactgggagaaactcaaattccatgcgagaatttttggagaagaattataaagaaacttctgggcaagagactgtcaagcttgcaattcgcgcattgcttgaagttgttgagagtgggggaaagaacatagagattgctgtgatgacaagagagcaagggttgcggcaacttgatgaagctgaaattgatgccattgttgctgagatagaagcagagaaagcagcagctgaggctgcaaaaaagggtcctccaaaagaaacctagtttctcccaagctttcatactaagattgcaatttcttgaagaattctgaattaatttactttcttgttttggatgtttttgctcctacttgactccagatttttttactttgcaagtaatggaattgctcttatttatctatcctctaattatcagttttttttttatagccgttcctaactaatgtaggaacccgcaactagaaac

SEQ ID NO: 3587 - DNA, 1058 bp, Musa acuminata
gcttccgtgagattataattatattactgggccgagagccctggtgccccttcttcttccccaagtaaaccctctctgtcttctgatccttttttctgctctttgttgtcgcaacaaagcacggtaccaaacagatggcccgctatgaccgcgcgatcaccgtcttctcccccgacggccacctcttccaggtggagtacgccctcgaggccgtccgcaagggcaacgctgccgtcggcgttcgcggcaccgacaccatcgtcctcggcgtcgagaagaagtccacccccaagctccaggactcccgatcggtgcgcaagatcgtgagcctggacacgcacatcgcgttggcgtgcgcgggcctcaaggccgacgcccgcgtcctcatcaaccgcgcccgcatcgagtgccagagccaccgccttaccgtggaggacccggtcacggtcgagtacatcacccgctacatcgccggcctgcagcagaagtacacccagagcggcggtgttcggcccttcggcctctccacgctcatcgtcggcttcgacccctacagcggcgtgcccgcgctctaccagaccgacccttcggggaccttctcagcctggaaggccaacgccaccgggaggaactccaactcgatgcgggagtttctggagaagaattacaaggagacttccgggcaggagacagtgaaattagccatcagagcactgcttgaagttgttgagagtggaggaaagaacatagaaattgctgtgatgaccaaggaacatggtcttcgtcaactcgaagaagctgagatcgatgctatcgtcgctgaaatagaggcagagaaagctgcagctgaggctgccaagaaggccccttctagagatacttaactttggaagtgcttaacttttccttttcaattaattgcttttcctattttccaaagactttcaaacttgtgggctttatgctgtatgttgccgatggaattctcctttcattttacatggaattctcttttgtttgttggttgaaattgttaatgtcatgatgtcagattttaa

SEQ ID NO: 3588 - DNA, 1119 bp, Musa acuminata
gttatatgctcgtttattgcttccgtgagattataattatattactgggccgagagccctggtgccccttcttcttccccaagtaaaccctctctgtcttctgatccttttttctgctctttgttgtcgcaacaaagcacggtaccaaacagatggcccgctatgaccgcgcgatcaccgtcttctcccccgatggccacctcttccaggtggagtacgccctcgaggccgtccgcaagggcaacgctgccgtcggcgttcgcggcaccgacaccatcgtcctcggcgtcgagaagaagtccacccccaagctccaggactcccgatcggtgcgcaagatcgtgagcctggacacgcacatcgcgttggcgtgcgcgggcctcaaggccgacgcccgcgtcctcatcaaccgcgcccgcatcgagtgccagagccaccgcctaaccgtggaggacccggtcacggtcgagtacatcacccgctacatcgccggcctgcagcagaagtacacccagagcggcggtgtccggcccttcggcctctccacgctcatcgtcggcttcgacccctatagcggtgtgcccgcgctctaccagaccgacccttcggggaccttctcagcctggaaggccaacgccaccgggaggaactccaactcgatgcgggagtttctggagaagaattacaaggagacttccgggcaggagacagtgaaattagccatcagagcactgcttgaagttgttgagagtggaggaaagaacatagaaattgctgtgatgaccaaggaacatggtcttcgtcaactcgaagaagctgagatcgatgctatcgttgctgaaatagaggcagagaaagctgcagctgaggctgccaagaaggccccttctagagatacttaactttggaagtgcttaacttttccttttcaattaattgcttttcctattttccaaagactttcaaacttgtgggctttatgctgtatgttaccgatggaattctcctttcattttacatggaattctcttttgtttgttggttgaaattgttaatgtcatgatgtcagattttaattatgttgatgttacctattttgctttattagtgttactggac

SEQ ID NO: 3589 - DNA, 1175 bp, Theobroma cacao
actcaaaaacagtgcgtcttactcttggaattcagatcgcaaagcaaaagcaaaggcagatccttcgacgcagtattttttccttttggtaagaaaagagaacaaacaagagagaagaaaaatagagaaacaaggtgtgattatatagaaaaagcgtagacaaaaatggcgagatatgatcgagcaattacagttttctcccccgacgggcatttattccaggtggagtacgctctcgaagccgtccgcaaaggtaacgccgccgtcggagttcgcggagccgacatcgtcgtcctcggcgtcgagaaaaagtccacggccaagctccaagactccagaactgttagaaagattgtgtctttggatgatcatattgctctggcttgcgcgggtttaaaagcagacgctcgcgtcttgattaatagggctcgaattgaatgtcagagtcataggctcacagttgaggatcctgtaactgtcgaatatataacacggtacattgctggtcttcaacagaaatatacgcaaagcggtggtgtgagaccctttggtctttctaccttgattgttggttttgatccgtacaccggtgttccttctctttaccagactgatccatcgggaacattttctgcttggaaggctaatgcaactgggagaaactctaactcaatgagggagtttctggagaaaaattataaggagacttctgggcaagaaacagtaaagttagccattcgtgctttgcttgaagttgttgagagtgggggaaagaacatagaagttgccatgatgacaaaagaacatggactgcggcaactagaagaagctgaaatcgatgccattgttgctgagatcgaagcagagaaagcagctgcagaggctgcaaagaaggccccacctaaagaaccctagttcaattagaatcctcataaatccttggccacgcctcagtttgaccttcataaggtctcccttgaaacgttattcagttatgtcgattggttggacatgttgaatgttgatacgtgcaaaaccttacatgtattttgagcatcatgcttttgctgatggtacttgattgtgtcacaaatagagtaatatccaactctttctacgtttccctttttcgttgcacccaagaaagacaaaatgacatttcttatcaattaaaa

SEQ ID NO: 3590 - DNA, 927 bp, Centaurea maculosa
aaaaacttcaaatccccttacgaaaccctaattatttctagaatctgatttgctatggcgagatacgatagagctataacggttttctcgccggacggccatcttttccaagttgaatacgccttggaagccgttcgcaagggtaacgccgccgtcggtgttcgtggcaccgataccatcgtcctcggcgtcgagaagaagtccaccgttaaacttcaagactcgagatcagttaggaaaattgtaagcctggatgatcacattgcattggcttgtgctgggctcaaagcagatgcccgtgttctcattaacaaggcacggattgagtgccagagccataggcttactgttgaggatccagtaactgtggagtatatcacacgttacattgcaggtcttcaacagaaatacacacaaagtggtggtgtcaggccatttgggctttcaactctaattgtaggatttgatccctacactggtgttccgtcattatatcagacagatccttcggggacattttctgcttggaaagctaatgccactggtaggaactccaattccatgagggaatttctggagaagaattacaaagagacctctggtcaagaaactataaagcttgccatccgtgccctacttgaggttgttgagagtggcgggaagaacatagaagttgccgtgatgacgaaggagggactccgacaacttgaggaagctgaaattgatgccattgttgcagaaatcgaagcagaaaaagcagctgccgaggctgcaaagaagggccctgctaaggaaacataacttggctcaccttgttttgttagaactcttcttcagtttgacctttccgttacatgtatgtctgttgaagtcttttggcatgttgattcaccactcgttaaggaattttgtttcgtttgacgttat

SEQ ID NO: 3591 - DNA, 982 bp, Centaurea maculosa
acgaaaccctaattattttcagaaatctgattagctatggcgagatacgacagagctataacggttttctcgccggacggccatcttttccaagttgaatacgccttggaagccgttcgcaagggtaacgccgccgtcggtgttcgtggcaccgataccatcgtcctcggtgtcgagaagaagtccaccgttaaacttcaagactctagatcagttaggaaaattgtaagcctggatgatcacattgcattggcttgtgctgggctcaaagcagatgcccgtgttctcattaacaaggcacggattgagtgccagagtcataggcttactgttgaggatccagtaactgtggagtatatcacacgttacattgcaggtcttcaacagaaatacacacaaagtggtggtgtcaggccatttgggctttcaactctcatcgtaggatttgatccctacactggtgttccgtcattatatcagacagacccttcagggacattttctgcttggaaagctaatgccactggtaggaactccaattccatgagggaatttctggagaagaattacaaagagacctctggtcaagaaactataaaacttgccatccgtgcactgcttgaggttgttgagagtggcgggaagaacatagaagttgctgtgatgacgaaggagggactccgacaacttgaggaagctgaaattgatgccattgttgcagaaatcgaagcagaaaaagcagctgccgaggctgcaaagaagggccctgctaaggaaacataacttggctcaccttgttttgttagaactcttcttcagtttgacctttccattacatgtacgtctgttgaagtcttttggcatgttcattcaccactcgttaaggaatttgtttcgtttgacgtataatttgattgaatgtatcacgcatctatattattccgtattagatgaaactttgtaactaaaaaaaaaaaaaaaa

SEQ ID NO: 3592 - DNA, 1111 bp, Chelidonium majus
aacggagcgaaaccctaagtaccgatcgatcacagttagaaaagaaacagaaatcaagaagaagaagggtaaaaatggccagatacgaccgtgctattacagtgttctcaccggatggtcatctgttccaagttgagtacgccctagaagctgtccggaagggtaatgccgccgtcggggtcagaggtacagacactatcgtccttggtgtcgagaagaagtccactgccaaacttcaagattctaggtcagttagaaagattgttaacctggataatcacattgcattggcctgtgctgggctaaaagcagatgcgcgtgttttgattaacaaggcaaggattgaatgtcaaagccataggctgacagtcgaggatccggtcactgtcgaatatatcacacgctacattgcgggccttcagcaaaagtatacacagagtggtggtgtgaggccatttggcctttctactttgattgtgggttttgacccatacactggtgttccatcactctatcagacagacccctcagggacgttttcagcttggaaggctaatgctacagggagaaactccaactctatgcgagagtttctggagaaaaactacaaagaaacttctggacaagaaactgtaaagctggctattcgtgcattgcttgaggttgttgagagtgggggaaagaacatagagatagcagttatgacgaaagaggggttgcgtcaacttgaagaaactgaaattgatgccatcgttgccgagatcgaagcagaaaaagcagcagcagaggcagccaaaaagggccctgctcccaaggaaacttaattctccccaagtaacttgtcagatctgcaaagaaaccctaggttaagagaaaatgaaacaagaaatcctagcatgagatttggtatggttcttttgaatatctgttgcatgtctccttgtcttttcagatatagtgtgcattgctatttgctaagcaatatttcgtggtttcagcgatacattttagacttgcaattagcttttttagctacattatcattcacttatgtagggaacatagttgctagaaatacttcattttccccttgctatataagttgttgttg

SEQ ID NO: 3593 - DNA, 1022 bp, Cirsium arvense
tctgcaattttttggtctcagatcaaacccctttcgaaatcccctttcgaaaccctaattattttcagaaatctgattagctatggcgagatacgacagagctataacggttttctcgccggacggccatcttttccaagttgaatacgccttggaagccgttcgcaagggtaacgccgccgtcggtgtccgtggcaccgataccatcgtcctcggcgtcgagaagaagtccaccgttaaacttcaagactctagatcagttaggaaaattgtaagcctggatgatcacatcgcattggcttgtgctgggctcaaagcagatgcccgtgttctcattaacaaggcacggattgagtgccagagccataggcttactgttgaggatccagtaactgtggagtatatcacacgttacattgcaggtcttcaacagaaatacacacaaagtggtggtgtcaggccatttgggctttcaactctcatcgtaggatttgatccctacactggtgttccgtcattatatcagacagacccttcagggacattttctgcttggaaagctaatgccactggtaggaactccaattccatgagggaatttctggagaagaattacaaagagacctctggtcaagaaactataaaacttgctatccgtgccctgcttgaggttgttgagagtggcgggaagaacatagaagttgctgtgatgacgaaggagggactccgacaacttgaggaagctgaaattgatgccattgttgcagaaatcgaagcagaaaaggcagctgccgaggctgcaaagaagggccctgctaaggaaacataacttggctcaccttgttttgttagaactcttcttcagtttgacctttccattacatgtatgtctgttgaagtcttttggcatgttcattcaccactcgttaaggaatttgtttcgtttgacgtataatttgattgaatgtatcacccatctatattattccgtattagatgaaactttgtcaaaaaagaaaaaa

SEQ ID NO: 3594 - DNA, 988 bp, Cirsium arvense
ctcccaaagtcgagagatcacttcgcatattaagagctctgcatttttggtctcagatcaaagctaaaagttcgaatctcagtacgaaaaacctaaattttctttaaaatctcataatctatggcgagatacgacagagctataacggttttctcgccggacggccatcttttccaagttgaatacgccttggaagccgtacgcaagggtaacgccgccgtcggtgttcgtgggaccgacaccatcgttctcggcgtggagaagaagtctaccgtcaaacttcaagactcgagatcagttagaaaaattgtaagtctggatgatcacattgcattggcttgtgctgggcttaaagcagatgcccgtgttcttattaacaaggcacgaattgagtgccagagccataggcttactgttgaggatccagtaactgtagagtatatcacacgttacatagcaggtctacaacagaaatacacacaaagtggtggtgtcaggccatttgggctttcaactctaattgtagggtttgatccctatactggtgttccatcattatatcagacagatccttcagggacattttctgcttggaaagccaatgccactggtaggaactccaattccatgagggaatttctggaaaagaattacaaagagacctctggtcaagaaactattaaacttgccatccgtgcccttcttgaggttgttgagagtggagggaagaacatagaagttgctgtgatgacaaaggagggactccgacaacttgaggaagccgaaatcgatgccattgttgcagagattgaagcagaaaaggctgctgccgaggctgcaaagaagggtcctgctaaggaaacataattgcgttcatctttgttctatttacaactcttcaatttgaccttttcgttacttgtatgtctattgaactcttttggcatgttcattctccagttataaggaatttgtttcatttgactta

SEQ ID NO: 3595 - DNA, 1021 bp, Zingiber officinale
gcacgcggtacgattctatcggcgatcgaattcaatggctcgctacgaccgtgccatcaccgtcttctcccccgacggccatctcttccaggtcgagtatgccctcgaggcggtccgcaagggaaacgccgctgtcggcgtccgtggcaccgacgccatcgtcctcggcgtcgagaagaaatcaacccccaagctccaggactcccgatcggtgcgtaagatcgtgagcctggacacgcacatcgcgctggcgtgcgcgggtctgaaagccgacgcccgcgtgctcatcaaccgcgcccgaatcgagtgtcagagccaccgactcacagtggaggatcccgtcacggtcgagtacatcacccgctacatcgccggcctgcagcagaagtacacccagagcggaggcgtgcgcccctttgggctttccgcactcatcgttggatttgatccggacactggcgtccctgccctgtaccagactgatccctcggggacattttctgcctggaaggccaacgccactgggagaaattccaattcgatgcgggagtttctggagaagaactacaaggagacctctgggcaagagactgtgaagctagccattagggcactgcttgaagttgttgagagtggaggaaagaacatcgagattgcagtgatgacaaaagaacagggtcttcgtcaacttgaagaagccgagattgatgctatcgtcgctgagattgaggctgagaaagcggcagcggaggctgcaaagaagcccccttctaaagatagccaagtctagtttacgccagcttctgctttagtcagttgcttctcttaatttaatacgttgacctgaaactgttaatttatgggctgctatgttctgcaggagctcattttgcttatctataattctaagtcaacctctaatcgcatgtccgtgggttgttagttacagagaattaaaagcagagttagtccacggtgttcttagttgaatcttctagtaaagtagtaacactcctcgtgc

SEQ ID NO: 3596 - DNA, 1082 bp, Vitis vinifera
tgttgcctacgtcttgacattgaaaaggaggaggagggaattgcagagattccagaaaaaatcgagtaaggaagaaagaaacaagaagctgaagaagaaagatggccagatacgatagggcgattacagtcttctcaccagatggtcatctctttcaggtcgagtacgctctcgaagccgtccgtaaaggcaacgccgccgtcggcgtccgcggcaccgacaccatcgttctcggcgtcgagaaaaagtccaccgccaaactccaagattccagaacagttaggaagattgttaacctggatgatcacattgcactggcctgtgctgggctcaaggcagatgctcgagtcctaattaacagagcacggattgaatgccaaagccacagacttactgttgaggaccctgtaactgttgagtatattacacgctatatcgcgggtcttcagcaaaagtacacacagagcggtggtgtgagaccatttggcctttcaactttgattgtgggctttgatccatacactggtgtgccatctctatatcagacggatccatcagggacattttctgcttggaaagctaatgcaactgggagaaactctaattcgatgagggagttcctggagaagaactataaagaaacttccgggcaagaaactgtgaagcttgcaattcgtgcattgcttgaagtggttgagagtggaggaaagaacatagaaattgctgtgatgacgagggagcatggtctgcggcaacttgatgaggctgaaattgatgccattgttgctgagattgaagcagagaaggctgctgccgaggctgcaaagaagggccctccaaaggatacatgagctttgcctttcccctctcttctccatttatgcttatcctaccttgcaacttccttaaaagagttaaaaacaaggtagaacttttcaaaatttaaaactatgtcctggattttggtgtgggcaagagcgactgtcattgtcagcattttcaatgctgttaagaagtattgcaaccatgaactttaaaattcaatttaacagcttctctccaaatgggttgtgaaactgatt

SEQ ID NO: 3597 - DNA, 1053 bp, Vitis vinifera
cagatcgcagagcaaaagcgaaggaaaggaagaagaagaggagcaaggagaaggaaaatggctcgatacgaccgtgcgatcaccgtgttttcaccggacggccacctattccaggtggagtacgccctggaagccgtccgtaagggcaacgccgccgttggcgtccgcggcaccgacaccatcgtcctcggggtcgaaaagaagtccaccgctaagctccaggactctcgaacggtccggaagattgttaacctggatgatcacattgcattggcctgtgctgggctaaaagcagatgcacgtgtgttgataaatagagcacgtattgaatgtcagagccataggcttacagtcgaggatcctgtcactgttgaatatattactcggtacattgctggtcttcagcagaagtacacccagagcggcggtgtaagaccatttggcctttcaactttgattattggctttgacccctacacaggtgttccatcactttatcagacagacccatcgggaacattttcagcatggaaagccaatgcaaccgggagaaactcaaattcaatgcgggagttcttggaaaaaaattataaagaaacttctggacaagaaactgtgaaattagcaattcgggctttgcttgaagttgttgagagtgggggaaaaaacatagagattgccgtgatgacgaaagagcatggattgcggcaacttgaagaagctgagattgatgccattgttgctgagatcgaagcagagaaagcagcagctgaggctgctaagaagggccctcccaaagaaacctagttcaggcatcaatcatactccaccatgctcttaccattgttgttcagacatcctcctacttcatcaagcagcatctgagtttagccagaaaacgtcttgtcccaatggtgattgatcatcccgggtatttctgaacattttggattgatattcgtacttggcactttgtatgctttatctattacgcatcaatgtatcacaaactgttggattgaatcgaaaattctcagcagagagccatcaaaa

SEQ ID NO: 3598 - DNA, 989 bp, Musa acuminata
taacctttttagtgtagaagagagaataaagccctttgcagtagcagcaacagagccggcatcgaaagcgcatccaatggcccgctacgaccgcgccatcaccgtcttctcccccgatggccacctcttccaggtcgagtacgccctcgaggccgtccgcaagggcaacgccgccgtcggcgtccgcggcaccgacacggtcgtcctcggcgtcgagaagaaatccacccccaagctccaagactcccgatcagtgcgcaagatcgtgagcctggacacgcacatcgcgctggcgtgcgcgggcctcaaggccgacgcccgcgtgcttatcaaccgcgcccgcatcgagtgccagagtcaccggctcaccgtcgaggaccccgtcacggtcgagtacatcacccgctacatcgccggcttgcagcagaagtacacccagagcggcggcgtccggcccttcggcctctccaccctcatcgttggcttcgatccctacaccggcgtcccagcgctctaccagaccgacccctcggggaccttctcggcctggaaggccaacgctactgggagaaactccaactccatgcgggagttcctggagaagaactacaaggagacctccgggcaggagacagtcaagctggccatcagaacgctgcttgaagttgttgagagcggtggaaagaacatagaaattgctgtattgaccaaagagcatggtcttcgtcaacttgatgaagctgaaattgatgcaattgttgctgagatagaggcagagaaagctgcagctgaggctgcaaagaaggccccttcaaaagatacctaaatttggatattctgatcagctccagtaacttttcctatttaaagttgtttttttaattctaagacttcttatttgtgggcattttggtttatgtgaactggtagaacttcattcatttttgaacaagttttccttctatccaaaactcactttttatctttta

SEQ ID NO: 3599 - DNA, 1170 bp, Aristolochia fimbriata
aattgttcttcagagtattttgtagtaataaattggtgccttgctccttaagcaccttttctatactttcttcttccctcgccattttcttctttcttcttggcgactccatcctttctgcgtctctgactacagaaaggcctcgacgagaagctgtaaccagttgcaggaaagtaggcaagccttagaaccctagcgtcaaccctgttgcgagttctatggctaggtacgatcgcgcgatcactgtcttttctccggacggtcatctctttcaggtcgagtacgcgctcgaggccgtccgcaagggaaatgcggccgttggggttagggggacggacaccatcgttttgggtgttgagaagaagtcaacagcgaagcttcaagactctagatctgtgagaaaaattgtgaatctagatgaccacattgcattggcatgcgcggggttgaaggcagatgctcgagttttgataaatagggctcgtattgaatgtcagagccacagacttactgtagaagaccctgtgactgttgaatacatcactcgttacattgctggccttcagcagaagtatacccagagtggtggtgtgagaccgtttggcctttccacattgattgtggggttcgacccatacacaggagttccttcactttatcagacagatccgtctggtacattttccgcctggaaagctaatgcaacgggtagaaactcaaattccatgagggaatttcttgagaaaaattacaaggaaacttccgggcaagaaactgtgaagctggctattcgtgctttgctcgaagttgttgagagtggtggaaagaacatcgagattgctgtcatgactaaagaacaggggcttcgtcaacttgatgaagccgagattgatgccattgttgctgagattgaagctgagaaggctgccgctgaagctgcaaagaaggctcctagagaaacatagaagccttatttagtttaatgtgtctcaaactttctgaaagatctgtcatctaggattagtacattcagttatgctatgactatttttgtgacagtttcatacttgtgtggctagaaagttggcccaacttacacactcaacatacatgcatttttaccagttacattttgaatgtcagacggttcttctttcaaaaaaaaaagaa

SEQ ID NO: 3600 - DNA, 1121 bp, Musa acuminata
aacctttttagtgtggaagagagaataaagccctttgcagtagcagcaacagagccggcatcgaaagcgcatccaatggcccgctacgaccgcgccatcaccgtcttctcccccgatggccacctcttccaggtcgagtacgccctcgaggccgtccgcaagggcaacgccgccgtcggcgtccgcggcaccgacacggtcgtcctcggcgtcgagaagaaatccacccccaagctccaagactcccgatcagtgcgcaagatcgtgagcctggacacgcacatcgcgctggcgtgcgcgggcctcaaggccgatgcccgcgtgcttatcaaccgcgcccgcatcgagtgccagagtcaccggctcaccgtcgaggaccccgtcacggtcgagtacatcacccgctacatcgccggcttgcagcagaagtacacccagagcggcggcgtccggcccttcggtctctccaccctcatcgttggcttcgatccctacaccggcgtcccagcgctctaccagaccgacccctcggggaccttctcggcctggaaggccaacgctactgggagaaactccaactccatgcgggagttcctggagaagaactacaaggagacctccgggcaggagacagtcaagctggccatcagaacgctgcttgaagttgttgagagcggtggaaagaacatagaaattgctgtattgaccaaagagcatggtcttcgtcaacttgatgaagctgaaattgatgcaattgttgctgagatagaggcagagaaagctgcagctgaggctgcaaagaaggccccttcaaaagatacctaaatttggatattctgatcagctccagtaacttttcttatttaaagttgtttttttaattctaagacttcttatttgtgggcattttggtttatgtgaaccagtagaacttcattcatttttgaacaagttttccttctatccaaaactcactttttatcttttactaatgcttcttttgtttttggtcaatattttagtgacgccgatgttgcatatttacttaattaatactgtggaaacaaaatcggcatgattttaaggtcatggtaatatgaaatggcaattgtgctgatggc

SEQ ID NO: 3601 - DNA, 942 bp, Vaccinium corymbosum
gcctcaccctcaaaatcagcccaacagacaaaccagcaaaatcagagcaacaaaagagtactccgtaaacatcaatggcgaggtacgacagagcgatcacggttttctcaccggacggccacctcttccaagtcgaatacgcccttgaagccgtccgtaagggcaacgccgccgtcggcgttcgtggcaccgacactgtcgtcctcggagtcgagaagaagtccaccgccaaactacaagattccagatctgttaggaagattgtaaacctggatgatcacattgcattggcttgtgcagggctcaaagctgatgctcgtgtccttataaacagggcacgcattgagtgtcaaagccacaagcttaccgttgaggatccagtaacagtcgagtatattacgcgttacattgctggtcttcaacagaagtatacacaaagtggtggtgtgagaccatttggtctttcaactttaattgtgggatttgatccctatactaatgtaccatcactctatcagactgatccatctggtacattttctgcgtggaaagctaacgcaactgggagaaactctaattcaatgcgagaatttttggagaaaaattataaagaaacttctggtcaagaaactgtgaagcttgctattcgtgcattgctcgaggttgttgagagtgggggaaagaacattgaagtcgctgtgatgacaaaggagggcctgcgtcaacttgatgaagctgaaattgatgccattgttgcagagatcgaagcagagaaagctgctgctgaggcggcaaagaagggccctcccagggacacttaagttatcttttccatttgctgatatggatttttagccagtcccgataattccatcgacttgtggacttaaaaattctgttacttcaaggttttattctggtgttatgtggattgaatgggat

SEQ ID NO: 3602 - DNA, 1598 bp, Cicer arietinum
acaattccagtaaaattggtaagtgtccatgaaagaaggccttatcggcccaacataattgagctgcttgttgcccaagcagcatcagtcaacaacaacagagttacttctctaccgaaaaaaagagaaagcttcatttcataggtttgtttgaatcggaaagtagaaaaagaagcacaacaaaaatatcaatatggcgaggtacgatagagctatcacagttttttctcccgatggtcatcttttccaagtcgagtacgccctcgaagccgttcgtaaaggtaacgctgccgttggtgtacgtggtaccgataatgtcgttctcggcgtcgagaagaaatccaccgccaaactccaggacactagatcagtaaggaagattgttaatctggatgatcacattgcccttgcttgtgctggactaaaagccgatgcccgtgtccttattaaccgggcacgagttgaatgtcaaagtcacaggcttactgttgaggatcctgtcactgtcgagtatataacccgttacattgcaggtcttcagcagaagtacacacaaagtggcggtgttcgaccctttggcctatcaaccttgattgttggatttgatccatacactgggtcaccatccctgtaccaaacagacccttctggtaccttttcagcttggaaagctaatgcaactggaagaaactcaaattcaatccgtgagtttctagagaaaaactttaaagaaacttctggtcaagaaactgtcaaattggcaatccgggcattgcttgaagttgttgagagtggaggcaagaacattgaagttgctgtgatgaccaaggagaatggtcttcgtcaattagaggaagctgaaattgatgccattgttgctgagattgaagcagagaaagcagctgctgaggctgcaaagaaagctcctcctaaggatacatgagtttatgtttcttttcttttgtattacacaagcatggttcttgttagatgttggctctacttattgaaagctaaaattgatgccataggatctgagattgaacaaagaaaagagctgccgaggctacacaggacattctgagacatgattttctgttatatttgtttagcttgtgaattgtctatgctgtgtgttggcctaactttaaaatgacttttttattgtgtttaggtcatttcatgtagtctttttcaatttaattgcatgtcattattagtcgagttgcaaatggagtctgaaaggtgcatccaaaatatattttgcatgcaattattagtccattgttacacgaggtaagcaataaaagtgtcatagtatatatgtcttgagaatagagctcataaaaatttatattgtgatttattatatttgaaaaaaaaaggcaaaattgttctcacgatcttttaaattattttattgtaacaaattagtttttatgtttttttttcctttcatgtaggtcctcctttaactttgacaccacattgacctttcgttgtgttctttaacaaatgcttgtggtaatgttgaatatggaagtgaagtcgaatgtggccgttggaattataatgttagattgtacagtagaagaaga

SEQ ID NO: 3603 - DNA, 1074 bp, Gossypium hirsutum
actcagtaatagcagaagcaaatcctaaggaatagaagaaaaatggcaagatacgacagagcgattaccgtgttctcgccggacggccatttattccaggtggaatacgccctcgaagccgttcgtaaaggtaacgccgccgttggcgtacgcggcaccgacatcgtcgttctaggcgtcgagaaaaaatccgccgccaaactccaggactcacgatcggttaagaagattgtgaatttggatgatcatattgcattggcatgtgctggactcaaagccgatgctcgtgtcctcatcaacagggctcggatcgaatgtcaaagccataggctgactgttgaagatccggttaccgtcgagtatattactcgttacattgcgggtcttcagcagaagtatactcaaagtggaggtgttagaccatttggtctctcaactctgatcgttggctttgatccatatagcggtgtaccggcactatatcaaactgatccatcagggacattttcagcttggaaagctaatgcaactgggagaaactcgaactcgatacgagagtttctagagaagaactataaggaaacttctgggcaagaaaccattaagcttgcaattcgtgcattgcttgaggttgttgagagtgggggaaagaacatcgaagttgctgtgatgacgaaggaacatggtcttcggcagcttgaagaagctgaaatcgatgccattgcagccgagatcgaggcagagaaggaagcagccgaggctgcaaagaaggcccctccaaaggaaaaatgatgaagcatcaactgtttaagctatcatttgtttctttcttttttcttttctggtctgactgcttaatttctgaaattgaagtttcatttgccattgttggcattttatttgctttttagttgtttcagtttaagcaggtatcaatcacattcagataatatgcaaatatgaatcttgcaaaaaggttttaaggttaaaaagaggaatttggcctcttttattatgatttaagtttcatgcatcatcattgatgaataataatatgatatatcatcattgaat

SEQ ID NO: 3604 - DNA, 1006 bp, Taraxacum officinale
cggcgggggatccccattattaagagctctgtagttttgctctcgtctcaaaactaaaagttcgaatccgaatacgaaaacctaaatccccgctagaatctgatcagttatggcgagatacgacagagctataacggtgttctcccccgacggtcacctcttccaagttgaatacgccctggaagccgtacgcaagggtaacgccgccgtcggtgttcgtggcacggacaccatcgtacttggcgtcgagaagaagtccaccgttaaacttcaagactcaagatcagttaggaaaattgtaaatttggatgaccacatagcactagcatgtgctggactaaaagcagatgcgcgtgttcttatcaacaaggcacgaatcgagtgccaaagccataggcttacagttgaagatccagtaactgtagagtacatcacacgttacattgcaggtcttcaacagaaatacacacaaagtggtggtgtaaggccatttggtctttcaactctaatagttggattcgatccctacactggcatcccagcattataccaaactgatccttccggaacattctccgcctggaaagctaatgccactggtagaaactccaattccatgagggagtttcttgaaaagaattacaaagagacatctggtcaagaaactatcaaacttgccatccgtgctttacttgaagttgttgaaagtggagggaagaatatagaagttgctgtgatgacaaaagaggggctcaggcaacttgaggaggcggaaatcgatgcaattgttgcggaaattgaagcggaaaaggcggcggctgaggcggcaaagaagggtcccgctaaggaaacatgaggatgagaagggcgtttatgtcttttcttacctggtttttattgttacaagtcttcagtttgaccttttggatacatgtatttgagactattggcatgtttattcaccaattgcttggtagttataaggaatctgttggatttgactttt

SEQ ID NO: 3605 - DNA, 1113 bp, Lactuca sativa
aaaagtttgggggtctatttgtttcttttctaaatgagttgccttgctcccaaagtcgagagatcccccattattaagagctctgtatttttggtcccggatcaaaactaaaagttcgaatccgagaacgaaaacctaaatctccggtagaatctgatcagctatggcgagatacgacagagctataacggtgttctcccccgatggtcacctcttccaagttgaatacgccctggaagccgtacgcaagggtaacgccgccgtcggtgttcgtggcactgacaccatcgtccttggcgtcgagaagaagtccaccgttaaacttcaagactcaagatcagttaggaaaattgtaagcttggatgatcacatagcattggcttgtgctggacttaaagcagatgcccgtgttcttatcaacagggcaagaatcgaatgccaaagccataggctaactgttgaagatccagtaactgttgaatatatcacacgttacattgcaggtcttcaacagaaatacacacaaagtggaggtgtgaggccatttgggctttcaactctaattgtgggatttgatccttatactggtgttccatctttatatcaaaccgatccttcaggaacattttctgcttggaaagctaatgccactggtagaaactccaattccatgagggaatttcttgaaaagaattacaaagaaacatctggtcaagaaactatcaaacttgccattcgtgctttgcttgaagttgttgaaagtggagggaagaatatagaagttgctgtgatgacaaaggaagggctgaggcaacttgaggaggctgaaattgatgccattgttgcagagattgaagcagaaaaggcagctgctgaggccgcaaagaagggtcctgctaaggaaacatgaggatgagaagggcatttatgtctttttctcacccggttttttattgttgttttcttatttgaccttttggatacatctgttttaagacttttggcatggtagttataaggaatttgttaaatttgacatttaagaagctttaatttgtggtttgattgaatgtcttatgagccatggttatctacttatctttcgtgatgcat

SEQ ID NO: 3606 - DNA, 1274 bp, Prunus mume
aagccaaataagcaagagcaaaaatcttatatgaccattttgcccatagtgcgaaaataaaattaacaagtgacttgttgcctaagttgagaattgcaaaatataatttgtcactgcaaagttgtaaaagcaaaaagacctgctctcacaaatactactagatcagaagaagcagaagagaaagaggaagaagacagtggaacgatggcgaggtacgacagagccataacggtgttttctccagatggtcatctctttcaagtcgaatacgcactcgaagctgtgcgcaagggtaacgccgccgtcggcgtacgtggcaccgacaccatcgttctcggcgtcgaaaagaagtccactgccaagctccaggactccagatcagtgaggaagatcgtgaacctggataatcacattgctctagcctgtgctgggctcaaagcagatgctcgtgttttgataaacaaggcgaggattgaatgtcaaagccacaggcttactgttgaggatccagtaacagttgagtatataacgcgttacattgctggtcttcagcaaaagtacacacaaagtggtggtgtgagaccatttggtctttcaactttgattgttggttttgatccatacacgggttcaccatcactataccagacagatccttctgggactttttcagcatggaaagctaatgcaactggaagaaactccaattcgataagggaatttctggagaagaacttcaaagaaacttctgggcaagaaaccataaagcttgcaatccgtgctttgcttgaggttgttgaaagtgggggaaaaaacatagaggtggctgtgatgactaaggatcatggtctgcggcaacttgaagaagctgaaattgatgctattgttgctgagatagaagcagagaaagccgctgctgaggcggcaaagaagggccctcctagggaaacatgatcttgtatcatcctattttcattttgcaagtttattttactagctctggttcatgtcctccaccttgctgttctttcggagttgtactttgcacttgctgtggcttaaactgatcactgtcatcagcatttagtatgctcatgagcttcaaaactgctagttattactgcttatattttcaaatggattgggatttgcttaattaagttttaattgagactgttagaatcattgtcttttaatttgtgatgattaattcggggattttatgaagattcaacaatctagtttattctaccatttgctacacccaacttaat

SEQ ID NO: 3607 - DNA, 1108 bp, Prunus persica
acttgttgcctaagttgagaattgcaaaatataatttgtcactgcaaagttgtaaaagcaaaaagacctgctcgcacaaatactactagatcagaagaatccgaagaggaaaaggaagaagacagtggaacgatggcgaggtacgacagagccataacggtgttttctcctgatggccatctcttccaagtcgaatacgcgctcgaagctgtgcgcaagggtaacgccgccgtcggcgtacgtggcaccgacaccatcgttctcggagtcgaaaagaagtccactgccaagctccaggactccagatcagtgaggaagatcgtgaacctggataatcacattgctctagcctgtgctgggctcaaagcagatgctcgtgttttgataaacaaggctaggattgaatgtcaaagccacaggcttactgttgaggatccagtaacagttgagtatataacgcgttacattgctggtcttcagcaaaagtacacacaaagtggtggtgtgagaccatttggtctttcaactttgattgttgggtttgatccatacacgggttcaccatcactataccagacagatccttctgggactttttcagcatggaaagctaatgcaactggaagaaactccaattcgataagggaatttctggagaagaacttcaaagaaacttctgggcaagaaaccataaagcttgcaatccgtgctttgcttgaggttgttgaaagtgggggaaaaaacatagaagtggctgtgatgactaaggatcatggtctgcggcaacttgaagaagctgaaattgatgctattgttgctgagatagaagcagagaaagcggctgctgaggcggcaaagaagggccctcctagggaaacatgatcttgtatcatcctattttcattttgcaagtttattttactagctctggttgatgtcctccgccttgctgttcttttggagttgtactttgcacttgctgtggcttaaactgatcactgtcatcagcacttagtattctcatgagcttcaaaactgctagttattactgctaatattttcaaatggattgggatttgcttaattaagttttaattgagactggtag

SEQ ID NO: 3608 - DNA, 1117 bp, Silene vulgaris
aataacttactttgatccaaacaagagagagaaaacctaaaaagcttaggaaaatctacaacaatggcgagatacgatagagctatcactgtcttctcacctgatggtcatctctttcaagtcgaatacgctcttgaagctgttcgtaaaggtaacgccgctgtcggcgttcgcggcactgatgtagttgttcttggtgttgagaagaaatctactgctaaacttcaggattctaggtcggttaaaaaaattgtaaaccttgacaaccatattgctttggcctgtgctgggctcaaagctgatgcccgtgtccttataaacaaggcacgtgttgaatgtcaaagccacaggcttaccttggaagatccagtgacggttgagtatattacccgttacattgctggccttcagcagaagtacacgcaaagtggtggtgttagaccatttggtctttcaactttgattgtcggctttgacccacacaccaaagtgccggctctataccaaacagatccatctggcaccttttcagcctggaaagccaatgcaacaggcagaaactctaattcaataagagaatttttggagaagaactacaaagaaactgaagggcaagaaactgtgaagctggcaattcgtgcattacttgaagtggtcgaaagcggaggaaagaacttggaagttgcagtgatgaccaaggaaggtttgcgtcagttggaggaggctgaaatcgatgccattgttgctgagattgaagcagagaaagcagcagctgaggcagctaagaaaggtcctgctagagattcataggcgcaccattttcttttcatggcttacttttggtgaacaagttacttcccttaccttgaggtttaatcctttgccggttcatgatgtttctttagcgctgggtttcagattattcataagccagactctggattttgtgtgcgctattagtagacaatttgaattatgccatagtactgtctatgtttcattatcggctgtagaattatctgtaattgcttggatatgaaaggatttcgtcatttgagttgagttctttggcatgaattttaaaggattctggtcctctgttctccagactgtttac

SEQ ID NO: 3609 - DNA, 1061 bp, Valeriana officinalis
ctcttcgagagctctataaacatcagcttctctgatactgattactctcacacagatcacgaatccgaaaccaatctcaacactcaatacagtttaatcggcgatggcgagatacgatagagcaattacagtcttctctcccgacggtcatctattccaagtcgagtacgcgcttgaagccgtcaggaagggtaacgccgccgtcggagtcagaggtaccgacaccgttgttctcggcgttgagaagaagtctactgttaaactacaggattccagatcagttagaaagattgtgaatctagacaaccacattgcactagcatgtgctgggctgaaagcagatgcacgtgtgcttataaacaaggcaagaatagaatgtcagagtcacagactaactgttgaggatcctgtaacggttgaatatatcacgcgttacatcgcaggtcttcagcaaaaatacacacaaagtggtggtgttaggccttttggactttcaaccctaattgtgggttttgacccatatactgatgttccatcactataccagactgatccttctggtaccttttctgcttggaaagccaatgctactgggagaaactccaattcgatgagggaattccttgaaaagaattacaaagaaacttctggtcaagaaaccatcaagctcgctatcagggctctactcgaagttgttgagagtgggggaaagaacatagaagtagcggtgatgacgaaagataaaggtttacgtcaacttgaagaggaagaaatcgacgccattgttgctgagattgaagctgagaaagctgctgctgaggctgcaaagaagggccctcaaagggattcataataacgtttgctcttttcgcgtaacaacttttatatggtactcttcactttctcgtctagactttgtttccatctactcatttgaatccttgtcagtttgatttttcgctaagttggattatgtttatgaaagtcgaggtttatttcttaagcatcacatggtgacttgagttcaatattatgttgttgtgttgcttaacccttttgtt

SEQ ID NO: 3610 - DNA, 1101 bp, Trifolium pratense
atggggacatcactctgcatagctttgtttgaatcagaatcagaaggtagaatagaaacaagatcaaaatggcgaggtacgatcgtgcaatcacagtcttctctcccgacggtcatctcttccaagtagaatacgctctcgaagctgttcgtaaaggtaacgccgccgtcggtgttcgcggtaccgataacgttgttctcggcgtcgaaaagaagtccactgcgaaactccaagactctagatcggtgaggaagattgttaatcttgacaatcacattgcccttgcctgtgctggattaaaagctgatgcacgagtccttataaaccgtgcccgggttgaatgccaaagccacaggctgacagtagaggatccctgcaccgttgagtatattactcgatatattgcaggtcttcagcagaagtatacacagagtggcggtgtccggccctttggcctttccaccttgatcgtcggctttgatccttacactggctcaccctctctctaccaaaccgacccttctggtacattctcagcatggaaagccaatgctaccggaagaaactctaattcaatccgtgagtttcttgaaaagaacttcaaagaaacatctgggcaagagactgttaaattggccattcgggctttgcttgaggttgttgaaagtggaggaaagaacattgaagttgcagtgatgaccaaggaggatggacttcgtcaattggaggaagctgaaattgacgctattgttgctgagatcgaagcagagaaagcagctgctgaggctgcaaagaaagctcctcctaaggatacatgattctagctttttttcgttttgtattatccaaagcataggtgttggctctacttattgtaatctataatttgccatcatatctgagattgaaacacaaaagagagctgctgatgctacacaagaactgctgtttttctatatttgtttagctcgtgaattgttgttcttgttgagtgttggactaacttaaaaatgacttatttttattgttttttgggctatgtcatgtagtctttctcagttcaattgcatgttagtatcattcaagtttgccattggagtt

SEQ ID NO: 3611 - DNA, 1085 bp, Trifolium pratense
agaatcagaaggtagaatagaaacaagatcaaaatggcgaggtacgatcgtgcaatcacagtcttctctcccgacggtcatctcttccaagtagaatacgctctcgaagctgttcgtaaaggtaacgccgccgtcggtgttcgtggtaccgataacgttgttctcggcgtcgaaaagaaatccaccgccaaacttcaagattctagatcagtgaggaagattgttaatcttgacaatcacattgctcttgcatgtgctggactaaaagctgatgcacgtgtccttataaaccgtgcccgagttgaatgtcaaagtcaccggcttactgttgaagatccttgtacagtggagtatattactcggtacattgcaggtcttcagcaaaaatacacacagagtggtggtgtgcgtccctttggcctttccactttgatagttggttttgatccttacaccgggtcaccgtcgctgtaccaaactgacccttctggtacattttctgcatggaaagccaatgctactggaagaaactcaaattcgatccgtgagtttcttgagaagaactttaaagaaacttctggccaagaaactgtcaaattggctatcagggcattgcttgaggttgttgagagtggaggaaagaacattgaagttgctgtgatgaccaaggaggatggactgcgtcaattggaggaagctgaaattgacgctattgttgctgagatcgaagcagagaaagcagctgctgaggctgcaaagaaagctcctcctaaggatacatgattctagatttttacgaagcatcattcttgttagttgttggctctacctattgtaatctataatttgccatcgtatctgagattgaaacacaaaagagagctgctgatgctacacaagagctgccgtttttctatatttgtttatcttgtgaattgttgttgttgggtgttggcctaacttaaaatgacttctttttattgtttttcttagttcaattgcctgttagtatcattcaagtttgccaatgccaatggagttcaattttaaaaatttggcatacctatgctttatgtttattgttg

SEQ ID NO: 3612 - DNA, 1146 bp, Vicia sativa
aagagaaagcttcttcatataggttttgttcaaatcggagaagtagaagaaagaagaatatcaaaatggcgagatacgacagagcgatcacagtcttctcccccgatggccatctcttccaagtcgagtacgctctcgaagccgttcgcaaaggtaacgccgccgtcggtgttcgcggtaccgataacgtcgttctcggcgtcgagaagaaatccaccgccaaactccaagactctagatcagtgaggaagattgttaatctggacgatcacattgcacttgcgtgcgctggactaaaagccgatgctcgtgttcttattaaccgggctcgagttgaatgtcagagtcacaggcttaccgttgaggatccttgcactgtggagtatataacccgtcacattgcaggtcttcagcagaagtacacacagagtggtggtgtgagaccctttggcctttcaaccttgattgttggctttgatccttacactggatcgccgtccctttaccaaacagacccttctggcacattttcagcttggaaagctaatgctactggaagaaactctaattcaatccgggagtttttggagaagaactttaaagaaacttctgggcaagaaactgtcaaattggctatccgggccttgcttgaagttgttgagagtggaggcaagaacattgaagttgctgtgatgaccaaggagcatggtctgcgtcaacttgaggaagctgaaattgacgccattgttgctgagattgaagcagagaaagctgctgctgaggccgccaagaaagctccccccaaggatacatgattttaggtttcttttgctttgtactaccaagcaccactctgataggtgttggctctacttattggaagctaaaattgatgccatcatatctgagattgaaacaaaaaaaaaaggcctacggaggctacacaagagatccttagacatgtttttcatttatatttgtttagatcgttaaatgtatttgctgggtgatggcctaacttaaaaatgatttcttttactgttttttttgggtcatgtcatggagttattttcaatttaatagcatgccattattattcgagtttgtaaatgttaatttttaaatatttcatgccaagactttatt

SEQ ID NO: 3613 - DNA, 1033 bp, Aquilegia formosa
tgcctagcttgtttcccaagcagctgcaatcgaagcctttttcttcttcttcttcgcaagagatcttgtttcattttaaatcaactgaagaaatcgaaaaaatcgaagaagaatggctcgatacgaccgtgcgatcacagtgttttcaccagatggtcatctgtttcaagtagaatacgcacttgaagctgttcgcaaaggtaacgcagctgttggtgttcgtggaaccgataacgttgttcttggtgttgagaagaaatctactgctaagcttcaagactctagatctgttaggaagattgttaacctggataatcatattgctttggcctgtgctggtctaaaagcagatgcgcgtgtccttataaacaaagcacgaattgaatgtcaaagccatagacttactgttgaagatcctgtaacagttgaatatattacacgctacattgctggccttcagcagaaatatacacaaagtggtggcgttagaccatttggtttgtcaactctgattgtaggttttgacccatatactggtgttccatcactttaccagacagatccatcaggaacattttcgtcttggaaagctaatgcgacagggagaaattccaactcgatgcgagagtatctggagaaaaattacaaggaaacatctggtcaggaaaccgttaagttggcaatccgtgctttgcttgaggttgttgagagtggaggaaagaacatagaggttgctgttatgacaaaagaacatgggctgcatcagctggaggaagctgaaatcgatgccattgttgctgagattgaagcagagaaagcagcagcagaggctgctaaaaagggacctgctaaagaaacctgatctggctcatctcgttatactacccgggcctcttcctggtttgtttctttccttggctttggggttatcaagaaggatattatggtctaatattacatttgaagtagcctatgttgacagtttatatgagctcttagttataatctgttggcatttatgttttaaaagtgc

SEQ ID NO: 3614 - DNA, 1112 bp, Persea americana
gatagcagacgaagaactgaagaagagatcgaaaagcagagagaagacgaagagaaaagaaaaaccctaaccctagatagatcgaattagcagagcatggctcgatacgaccgcgcgatcactgtcttctctcccgacggccatctgtttcaggtggagtacgctctcgaagccgtccgcaagggcaacgccgccgtcggcgtccgaggcaccgacaccatcgtcctcggcgtcgagaagaaatccaccgctaagctccaagactcaagaacagttagaaagattgtaagtctggatgatcacattgcattggcttgtgctgggttaaaagcagatgcaagggttttgataaacagggcacgcattgaatgccagagtcacagacttactgttgaggatcctgtaaccgttgaatatatcacacgttacattgctggccttcaacaaaagtatacacagagtggtggtgtaagaccttttggtctttcaacattgattgttggctttgacccatacacaggtgtaccttcactttatcagacagatccatctgggacattttcagcctggaaagcaaatgcaacgggaagaaactcaaattccatgagagagtacctggagaaaaactataaagaaacttctgggcaagaaactataaagctggccattcgcgcattgcttgaagttgttgagagcggggggaagaacatagaaattgctgtgatgacaaaagatgggctgcgtcagcttgaagaatcagaaatcgatgccattgttgcggagatagaagctgaaaaggccgcagctgaagcagcgaagaagggccctgctagagagacctgatcttaatcattcttagatgaaccaacttgcatttaccttattaaagaaatcctttcctctgggatgttggttatttacaatgatgttgggatttcatttctttagagtgctggtccttgtgtaccaatgatgcattcaggatataatcttatgttggcattttgtttgggctttctttttcctgttaacaagttagatttgaagcatatgctgaaagtctctggttttatcttatccattatatacagatctactttcaccagtctaaa

SEQ ID NO: 3615 - DNA, 1099 bp, Cynara scolymus
cgggaagctaagttcgatcccgtacgcaaacctaaattttctttaaaatctcataatctatggcgagatacgacagagctataacggttttctcgccggatggccatctcttccaagttgagtacgccttggaagccgtacgcaagggtaacgccgccgtcggtgttcgtgggaccgacaccatcgtcctcggagtggagaagaagtctaccgttaaacttcaagactcgagatcagttaggaaaattgtaagcctggatgatcatattgcattggcttgtgctgggcttaaagcagatgcccgcgttcttattaacaaggcacggatcgagtgccagagccataggcttactgttgaggatccagtaactgtagagtatatcacacgttacatagcaggtcttcaacagaaatacacacaaagtggtggtgtcaggccatttgggctttcaactctaattgtaggatttgatccttataccaatgttccatcattatatcagacagatccttcagggacattttctgcttggaaagctaatgccaccggtaggaactccaattccatgagggaatttctagaaaagaattacaaagagacctctggtcaagaaactataaaacttgccatccgtgcgctgcttgaggttgttgagagtggagggaagaacatagaagttgctgtgatgacaaaggagggactccgacaacttgaggaagctgaaatcgatgccattgttgcagagattgaagcagaaaaagctgctgccgagtctgcaaagaagggtcctgctaaggaaacataatttcgctcaccttgttctagtatgactcttcagtttgaccttttcgttacctgtatgtctattgaacccttttggcatgttcattctccagtcgttataagtaatttgtttcattcgactcgtaatttgattgaatgtatcactcattcatacccattattccgttttgcgtattagatgagaacttcatcggaatctgtttgaatttggttgacagttcgtgaatccgtgatggaagctggccaacacggagaaattgtggcagcaaatagtcgagatatgtgaaacccttt

SEQ ID NO: 3616 - DNA, 1015 bp, Epimedium sagittatum
tctctcgaaaaatctgaaaaccacagcactctaatcactagagagaatcatggcgcgatacgacagagcaatcacggtcttctcacccgacggtcaccttttccaggttgagtatgctctagaagctgtacgaaaggggaacgcggccgtcggcgtcagaggcaccgacaccatcgtcttgggcgtcgagaagaaatcaaccgccaaactacaagactccagatcagtccgaaagatcgttcacttagatgatcacattgcactggtatgtgccggtctaaaagccgatgcacgagttctaatcaacaaggctaggatcgagtgccagagccatagacttactgtcgaggatccggttactgttgagtatatcacacgttacattgctggtcttcagcagaagtatacacaaagcggtggtgttagaccatttggtctttctactttgattgttggatttgatccatacactggtgttccggcgctttatcagacagatccatctgggacgttttcagcttggaaggccaatgctactgggaggaattccaattctatgagagagtttttggagaagaattacaaggagacttctggtcaggaaactgtcaagcttgccattcgtgcattgctcgaggttgttgaaagtgggggcaagaacatagagattgctgccatgacaaaagagggtggattgcgtttgcttgaggaagctgaagttgatgccattgttgcagagattgaagcagagaaagctgcagcagaggctgcgaagaaggcaccttcaactagagaagcgtaattattgttaaaaacttctaaactatgcctgggaatttatgtcagtgtctttggttgaggtttaggacttgtgtatttattccctgatgttgtgtttcgaacgtaagtcttgggatatgttatagtagtcacaatgacaatcatccattggcttttaaaaggttgtgttttttgaataatttatctcacaaagacgtgcatcatcgtattccaa

SEQ ID NO: 3617 - DNA, 1079 bp, Fagopyrum esculentum
gtataagcttcacctccttcactccccaaatcttccgatctccgaaaaaccctaactacatcaacaacaaacatggcgagatacgacagagcgatcacagttttctccccggacggtcaccttttccaggtggagtacgctctcgaagccgttcgcaagggtaacgccgccgtcggtgttcgtggcctcgacaatgtcgtccttggagtcgagaagaagtccacccctaagcttcaggattctaggactgtgaagaagattgtaaacctcgatgatcatattgcacttgcttgtgctggcctgaaggcagatgcacgtgtgttgattaatagggctcgcattgagtgtcagagccatagacttacagttgaggatcctgtcactgttgaatatattactcgatatattgccggtcttcaacagaagtacacacaaagtggtggtgtaagaccatttgggctttcaactttgattgttggctttgacccatatagcggtgtcccatccctctaccagacggatccatcagggacattctcagcatggaaggccaatgctactggaagaaactctaattctatcagggagttcttggagaagaattacaaggaaacatctggccaagaaactgtcaaacttgccattcgtgctttgcttgaagttgtagagagtggaggtaagaacatcgagattgcaataatgacaaaggcaggtctgcgacaacttgaagaagccgaaattgacgccattgttgctgagattgaagcagagaaggctgctgccgaggctgcaaagaagggtcctgcaaaagaaacctaagttatggagatcttaattcaccatcttgaatccccacataatcaaaagatattaaatcttgaactgcttgtagcagaggtaatctggtgtttgctcgtaccaaatgatcacaattagagttgctttgtttgtgtggtttaaaattgaaattgtagacaaaagcgagagtggggaaaaagagtactttcttactttctccatcctccattttcatgtgtttctaattagacagactagcatgtgagtttggtatgaaaatt

SEQ ID NO: 3618 - DNA, 1140 bp, Fagopyrum esculentum
cgtcgaaacatttcttgtgttaaagccagagctttttccttgcatctgtataagcttcacttccttcgctccccaaattttccgatctccgaaaaaccctaactacatcaacatcaaacatggctagatacgacagagcgatcacagttttctccccggacggtcaccttttccaggtggagtacgctctcgaagccgttcgcaagggtaatgccgccgtcggtgttcgtggcctcgacaatgtcgtccttggagtcgagaagaagtccacccctaagcttcaggattctaggactgtgaagaagattgtaaacctcgatgatcatattgcacttgcttgtgctggcctgaaggcagatgcacgtgtgttgattaatagggctcgcattgagtgtcagagccatagacttacagttgaagatcctgtcactgttgaatatattactcgatatattgccggtcttcaacagaagtacacacaaagtggtggtgtaagaccatttgggctttcaaccttgattgttggctttgacccatatagcggtgtcccatccctctaccagacggatccatcagggacattctcagcatggaaggccaatgctactggaagaaactctaattctatcagggagtttttggagaagaattacaaggaaacatctggccaagaaactgtcaaacttgccattcgtgctttgcttgaagttgtagagagtggaggtaagaacatcgagattgcaataatgacaaaggcaggtctgcgacaactcgaagaagccgaaattgatgccattgttgctgagattgaagcagagaaggctgctgccgaggctgcaaagaagggtcctgcaaaagaaacctaagttatggagatcttaaattcaccatcttgaatccctacataatcaaaagatcttaaatcttgaactgcttgtagcagagttgatctggtgtttgttcgtaccaaatgatcataattaggaagtgctttgtttgtgtggtttaaaattgaaattgtagacaaaagcgagagtggggaaaaagagcacctttcgtactttttccatcctccattttcatgtgtttctaattagacagactagcatgtgagtttggtatgaaatctgagctgttttc

SEQ ID NO: 3619 - DNA, 860 bp, Flaveria ramosissima
gtgatcgatcccccattcttaaacacctctgcaacttttgctctcagatcaaaacttcaatactcaaattcgaacaaaaaaaccctaaatcttcactacaatctgatcatctatggcgagatacgacagagctatcactgttttctcgccggacggccacctatttcaagttgaatacgccttggaagccgtacgcaagggcaacgccgccgtcggcgttcgtggcaccgacaccatcgtccttggggtcgagaagaagtccactgttaagcttcaagactcaagatcagttaggaaaattgtgagccttgatgatcacattgcgttggcttgtgctggacttaaggcagatgctcgtgttcttattaaccgggcgcgaattgagtgccagagccataggcttactgttgaggatccggtaactgtagagtatattacacgttacattgcaggtcttcaacagaaatacacacaaagtggtggtgtcaggccgtttgggctctcaaccctaatcgtgggatttgatccttatactggtgttccgtcattatatcagacagatccttcaggaacattttctgcatggaaagctaatgccactggaaggaactccaattccatgagggaatttctggagaagaattacaaagagacttctggtcaagaaactattaaacttgccatccgtgctttgcttgaagttgtggagagtggaggcaagaacatagaagttgctgtgatgacaaaggagggactccgacaacttgaggaagctgagattgatgccattgttgcagaaattgaagcagaaaaagcggccgctgaagctgcaaaaaaggctcctgctaaggaaacatgaa

SEQ ID NO: 3620 - DNA, 836 bp, Flaveria ramosissima
ttcttaaacacctctgcatttttgctctcagatcaaacttcaaaactcaaatccgtatacaaaaacctaaatcttcaccacaatctgatcatcaatggcgagatacgacagagctatcacggttttctcgccggacggccacctatttcaagtcgaatacgccttggaagccgtacgcaagggtaacgccgccgtcggcgttcgtggcaccgacaccatcgtccttggggtcgagaagaagtccactgttaagcttcaagactcaagatcagttaggaaaattgtgagcctggatgatcacattgcattggcttgtgctggactcaaggcagatgcacgtgttcttattaaccgggcgcgaattgagtgccaaagccataggcttactgttgaagatccggtaactgtagagtatattacacgttacattgcaggtcttcaacagaaatacacacaaagtggtggtgtcaggccatttgggctctcaaccctaatcgtgggatttgatccttatactggtgttccgtcattatatcagacagatccttcaggaacattttctgcatggaaagctaatgccactggaaggaactccaattccatgagggaatttctggaaaagaattacaaagagacttctggtcaagaaactataaaacttgccatccgcgctttgcttgaagttgtggagagtggagggaagaacatagaagttgctgtgatgacaaaggagggactccgacaacttgaggaagctgagattgatgccattgttgcagaaattgaagcagaaaaagcagctgctgaggctgcaaagaaggctcctgctaaggaaa

SEQ ID NO: 3621 - DNA, 1155 bp, Flaveria ramosissima
gttaaagcagtaggtatcaaccgcagagttacattcgggattctttaaacacctctctcgaatttttaccctcagatcaaacttcaaactcaaatcagatttcaaaccctaaatcttcactacaatctgatcacatatggcgagatacgacagagctatcacggttttctcgccggacggccacctatttcaagtcgaatacgccttggaagccgtgcgcaagggcaacgccgccgtcggcgttcgtggcaccgacaccatcgtccttggggtcgagaagaagtccactgttaagcttcaagactcaagatcagttaggaaaattgtgagcctggatgatcacattgcattggcttgtgctggactcaaggcagatgctcgtgttcttattaaccgggcacggattgagtgccagagccacaggcttactgttgaggatccggtgactgtagagtatattacacgctacatcgcaggacttcaacagaaatacacacaaagtggtggtgtcaggccattcgggctctccaccctaatagtgggatttgatccctatactggtgttccgtcattatatcaaacagatccttcaggtacattttctgcttggaaggctaatgccactggaaggaactccaattccatgagagaatttctggagaagaattacaaagaaacctccggtcaagaaactataaaacttgctatccgtgctctgcttgaagttgtggagagtggagggaagaacatagaagttgctgtgatgacaaaggagggactccgacaacttgaggaagctgaaattgatgccattgttgcagagattgaagcagaaaaagcagctgctgaggctgcaaagaaggctcctgctaaggaaacatgaatcgtgaaatatcaacccctttactcaccaggttccgctgttgttttcttagaacttttcaatttttcgatatatctatgtctaattgggagttccattcatcttatgattggtttttaagaaagttgtctcatgtgaagtataaggagccttaatttatgttttggttcatactgttttctgcattagatgatactttgatgatactgttagattcggttaatttatacgtacgctctgtcttgtcagccaattgagaagagggtgcctgg

SEQ ID NO: 3622 - DNA, 901 bp, Flaveria ramosissima
attatctgatggcaagatacgacagagctatcacggtgttctcgccggacggacacctcttccaggtggaatacgcattggaagccgtacgcaagggtaacgccgccgtaggtgttcgtggaacagacaccatcgtccttggagtcgagaagaagtccaccgttaaacttcaagactcgagatcagttaggaaaattgtaagtctggatgatcacattgcattggcttgtgctggacttaaagctgatgcacgtgttcttattaatagggcacgaattgagtgccagagccacaggcttactgttgaggatccagtgaccgtagaatatattacacgttacattgcaggtcttcaacagaagtacacacaaagtggtggtgtcaggccatttgggctttcaaccctaatcgtaggatttgatccttatactggtgttccatcattatatcagacagatccctcaggaacgttttctgcttggaaagctaatgctactggtcggaactccaattccatgagggaatttctggaaaagaattacaaagagacctctggtcaagaaaccataaaactagccatccgtgctctgcttgaagttgttgagagtggagggaagaacatagaagttgctgtgatgacaaaagacggactgaggcaacttgatgaagctgaaattgatgccattgttgcagagattgaagcagaaaaagcagctgccgaggctgcgaagaaggctcctgctaaggaaacataatgcgtcaaagatagactccttctcacacctggttttattgttgtcttcagtttacatgcatgtctgttttcttgttctatttccagttgtatggtaggtttatggaagttttctctcatttgaagtaaagtaatttctgctttcga

SEQ ID NO: 3623 - DNA, 992 bp, Zingiber officinale
gcacgccgtgagaatctcgattcgcgatcgaatcacatggctcgccccgaccgcgccatcaccgtcttctcccccgatggccatctcttccaggttgagtacgctctagaagctgttcgcaagggaaacgccgccgtcggcgtccgtggcaccgacaccatcgttctcggcgtcgagaagaaatccactccaaagctccaagactcccgatcagtgcgtaagatcgtgaacttggacacccacatcgcgctggcgtgcgcgggactcaaggcagatgcccgcgtgctcatcaaccgtgctcggatcgagtgccacagccaccgcctcaccgtagaggatcctgtcacggtcgagtacatcactcgctacatcgccggcctgcagcagaagtacacacagagtggaggtgtccggccctttgggctctccacgctcatcgttgggtttgacccgtacactgacgtgcctgcgctataccaaacagatccctccgggaccttctcagcttggaaggcgaacgctacaggaaggaactcgaactcgatgcgggaattcctggaaaagaactatacggagacctccggacaggagacggtgaagctggctattagggcactgcttgaagtggtggagagtggaggaaagaacatagaaattgcagtaatgaccaaaaagcagggtcttcgtcaacttgaagaagctgagatagatgctattgtcgctgagatagaggcagagaaagctgcagctgaggctgcaaagaaggccccttctaaagattcctaaactttgttgttctgatgatttgctttctaattttgaaacttggaatttgtatgtgaacttatctacattttcatttgatccctaaaattaagtttgccctggcaacttattcaattgcttgcattttgctcttctttatagattgttttttttggggggtattaggtattcagcttttcatctatttttatgaaaaaattttatcg

SEQ ID NO: 3624 - DNA, 1016 bp, Gossypium raimondii
atcaaactcagtaatagcataagcaaatcctaaggaatagaagaaaaatggcgagatacgacagagcgattaccgtgttctcaccggacggccatttattccaagtggaatacgccctcgaagccgttcgtaaaggtaacgccgccgttggcgtacgcggcaccgacatcgttgttctaggcgtcgagaaaaaatccgccgccaaactccaggactcacgatcggttaagaagattgtgaatttggatgatcatattgcattggcatgtgctggactcaaagccgatgctcgtgtcctcataaacagggctcggatcgaatgtcaaagccataggctgactgttgaagatcccgttacggtcgagtatattactcgttacattgcgggtcttcagcagaagtatactcaaagtggaggtgttagaccatttggtctctcgactctgattgttggctttgatccatatagcggtacaccggcactatatcaaactgatccgtcagggacattttccgcttggaaagctaatgcaactgggagaaactcaaactcgatacgagagtttctagagaagaactacaaggaaacttctgggcaagaaaccattaagcttgcaattcgtgcattgctcgaggttgttgagagtgggggaaagaacatcgaagttgctgtgatgacaaaggaacatggtcttcggcagcttgaagaagctgaaatcgatgccattgcagccgagatcgaggcagagaaggaagcagccgaggctgcaaagaaggcccctccaaaggaaaaatgatgaagcatcaactgtttaagctatcatttcctttttcttttttttcttttctggtctgactgcttaatttctgcaattgaagtttcatttgccattgttggcattttatttgctttttagttgtttcagtttaagcaagtatcaatcacattcagataatatgcaaatatgaatcttgcaacaaggttttaaggttaaaaagaggaatttggcctcttt

SEQ ID NO: 3625 - DNA, 971 bp, Actinidia deliciosa
cacatacaaaatcgccgcttgaaccaacaaaacagagagagagagacagagagagagagagagagagagagaagtaatctgagcagaagatggcgaggtacgacagagcgatcacggtgttctctccagacggccacctcttccaggtggagtacgccctcgaagccgtccgcaagggcaacgccgccgtcggcgtcagaggcaccgacaccattgtcctcggcgtcgagaagaagtccaccgccaagctccaagactccagatcagttagaaaaattgtaaacctggataatcacattgcattggcctgtgctgggctcaaagcagatgctcgggttcttataaacagagctcgtattgaatgtcaaagccacaggcttactgttgaggatccagtaactgttgagtatattactcgatacatagctggtcttcaacagaagtacacacaaagtggaggtgtgagaccatttggtctttcgactttgattgtgggatttgacccttatactggtataccatcgctatatcagacagacccatccggaacattttctgcatggaaggctaatgcgacagggagaaactctaattcaatgcgcgaatttttggagaaaaattataaagaaacgtctggacaagaaactgtcaagcttgcaattcgtgccttgctcgaagtggtcgagagtggaggaaagaacattgaagttgctgtgatgacaaaggatcatggcctgcggcaacttgatgaagctgaaatcgatgccgtggttgccgagatcgaagccgagaaagcagctgctgaggctgcaaagaagggccctcccaaggaaacgtagtttcatttttttcccttgttcgtttccttacttttagaggcgaaattctgttgcgtcaagatgttattgtggttgatgtggattagaattatatcgattgctatttgtactgcagtgttgctttcactcttt

SEQ ID NO: 3626 - DNA, 1194 bp, Lotus japonicus
ctggtctactggaaatgctccatagcagaaccaaaaaaaaaacaagacaacacgaagaacaacacagttgcttcaccgaagaagaagagaggttgatcgatcgagcacagagatttgaatggcgaggtacgacagagcgatcacggtgttctcacccgatggccatctcttccaggtcgagtacgccctcgaagccgttcgcaaaggtaacgccgccgtcggcgtccgcggcaccgacaacgtcgttctcggtgtcgagaagaaatccaccgccaagcttcaagactccagaagtgtgaggaagattgtgaatctggatgatcacattgcacttgcttgtgcgggactaaaagctgatgcccgggtccttataaacagggcgcgtgttgaatgtcaaagtcacagacttacggttgaggatccagtgacggtcgagtacataactcgttacattgcaggtcttcagcagaagtacactcaaagtggtggggtgcgaccctttggcctttcaaccttgattgttggcttcgatccatacactgccacaccgtctctgtaccaaacggacccttctggtacattttctgcttggaaagctaatgcgactggaaggaactccaattcgattcgggagtttcttgagaagaatttcaaagaaacctcagggcaagaaactgtcaaactggctatccgagcattgcttgaagttgttgagagcggaggcaagaacattgaagttgctgtcatgactaaggagcatggtctgcgtcaactggaggaagctgaaattgatgctattgttgcagagattgaagctgagaaagcagctgctgaggctgcaaagaaagcccctcccaaggagacatgattttctatttcttttgttttgtattatgatcgttgctctcgatagggggtttcctgtgcttactgaaactaaatttgatgtcatagtgtcagaaattgatgcccagaaaagagctgcagaggctgcaaagaaaattgtttttaaagagacatgattttatgttacttatgttttagttcatgaattgtagttgctgggtgtttgccctccttaaaattactgctttattgtttctgggttatattgtctactgaattgcatgccattattaattagttgatgtcacaaatagagtcacagtgatgcctcgacaaaaaagaaaaaaa

SEQ ID NO: 3627 - DNA, 1130 bp, Tropaeolum majus
cggccgggggttctaacggcgtcgtttcgagtaaggtcaatgttgtcccgccttgtcttgtcgcccaagttcattccgctgtgaaacgaatagatcacaaccgaggagttaagaagaagaagaagggaaagtcgagcagcatttgtgtaaagaagaggaaatatcagtaatggctcgttacgatcgcgcgatcacggttttctcccccgatggacatctctttcaagtcgagtacgctcttgaagccgtacgcaaaggaaacgccgccgtcggcgtccgcggcaccgatatcgtcgtacttggtgtcgagaagaaatccgccgccaaactacaagacactagatcagttaggaagatcgtaaatttggacacacatgttgcacttgcctgtgctgggttgaaagcagatgcgcgtgttctgattaataaggcccgaattgagtgtcagagccataggcttacagttgaggatcctgtaactgttgaatacataacacggtacattgctggcttgcaacaaaagtatacgcaaagtggtggtgtgagaccatttggactttcaacattaattgttggttttgatccatacaagggtgtcccatctctatatcagacagatccatccggaacattttctgcatggaaagctaatgcaactgggagaaactcaaattcagtgagggaatttttggagaaaaattacaaagaaacatctggccaagaaactataaagttagcaattcgtgctttgcttgaagttgtcgagagtggaggaaagaacatagaaattggtgtaatgacgaaagatgggcttcggcaactcgaagaagccgaaattgatgccatcgttactgaaatcgaagcagagaaagcagaagcagaggctgcaaagaaaggtcctcaaaaggaaacataaaatggtacaccatctattatcttcttatcctatccaatcatattgttgctttccttttctctctagcattcaacactgtagtcttgcctcttttggattcttaagtaatggttagaatgttgaaacaagtttgatttttcttatttatggaaggggtttctgttaagtttcctctgtcatttaaatgagcaccatgttagtaaaaaaaaaaaag

SEQ ID NO: 3628 - DNA, 1018 bp, Papaver somniferum
aacaaaaaaaactcaatactaaattccttcagtgaagtaaagaatggcgcgatacgacagagcaatcacagtattctcaccagatggtcatcttttccaggttgagtacgccctggaggctgttaggaaaggaaacgcagctgtaggtgttagaggtactgataccgttgttcttggtgtcgagaagaaatctactgctaaacttcaagattctagatcagttaggaagattgttaacctggataatcacattgctttggcctgtgctgggcttaaggcagatgcacgtgttttgataaacaaagcaaggattgagtgtcaaagtcatagactcacagttgaggatcccgtaactgttgaatatatcactcgttacattgctggtcttcagcaaaagtatacacaaagtggtggtgtgagaccatttgggctatcaactttgatcgtgggttttgaccctcacactgatgttccatcactctatcagactgatccctcagggacattctcagcttggaaggctaatgcaacaggaagaaattccaactctatgcgtgaatttttggagaaaaactacaaagaaacttctggacaagaaactgtgaagcttgctattcgtgcattgcttgaggttgttgaaagtggtgggaagaacatagagatagctgtaatgggaaaagacaaggtgttgcgtcaactcgaagaatctgagattgatatcattgttgccgagattgaagcagaaaaagcagctgcggaagctgcaaagaaaccagctccaaagaacacctaatttccatctcctagtaagttttgtccaattggcgaaaaattctggataaaggtctggcagtggctcttttgactggcatatttccattagttttatcagatttggattgaaactgctaaagcagatctgctatcctggtttcagtgatccatttaagaattacaacgctcagtgttctgtaagagttatgtttcttttacttaaatggaccgcatctctagaaat

SEQ ID NO: 3629 - DNA, 1130 bp, Tragopogon dubius
gagttgccttgctcccaaagtcgagagatccctcattattaagagctctgtattttggtcctggatcaaaactaaaagctcgaatccgaatacaaaaacctaaatcttcgctagaatctgatcatctatggcgagatacgacagagctataacggtcttctcaccggacggccacctcttccaagttgaatatgccctggaagccgtacgcaagggtaacgccgccgtcggtgttcgtggcaccgacaccatcgtcctcggcgtcgagaagaagtccaccgttaaacttcaagactcaagatcagttaggaaaattgtaagcttggatgatcacattgcattggcatgtgctggactcaaagcagatgcccgtgttcttattaacagggcacgtattgagtgccaaagccataggcttactgttgaggatccagtaactgtagagtacatcactcgttacattgcaggtcttcaacagaaatacacacaaagtggtggtgtgaggccatttggtctttcaactttgattgtaggatttgatccgtataccggtgtgccatcattatatcagactgatccttcaggaacattttctgcttggaaagctaatgccactggtagaaactccaattccatgagggaatttcttgaaaagaattacaaagagacatctggtcaagaaactataaaacttgccattcgtgctttacttgaagttgttgagagtggagggaagaacatagaagttgctgtgatgacaaaggagggacttcgacaacttgaggaagctgaaattgatgccattgttgcagacattgaagctgaaaaagctgctgctgaggccgcaaagaagggtcctgctaaggaaacatgatgacccttttcttattattcttgtttttcttaaaactcttatatttgaccattttgtttcaagggatttgttttgtttgatgtttaagaagctttaatttgtggtttgattgaatattagccatcattctctgtagtgcattagtgttgtgattgttaaacatgaagggtaattatgtctttttgctggtggtacaaaaattcataattttgtatcattgacattagttccaggtagtgatgcttataagtaaaca

SEQ ID NO: 3630 - DNA, 971 bp, Tripterygium wilfordii
ccagatcgcatctaaacccaaatcaacaaacatcttaggaaagaagaaacatggctagatacgatcgtgccatcactgtgttctcgccggatggccaccttttccaggtggagtacgcactggaagccgtccgcaaaggaaacgccgccgtcggtgtccgcggcacagacgttgttgttctaggcgtcgagaagaagtccaccgctaaacttcaagattccaggtcagtaaggaagattgtatcgctggatgatcacattgctctggcttgtgctggattgaaagcagatgctcgggtcttggttaatagggctcgtattgaatgtcagagccataggcttaccgttgaggaccctgcaactgttgagtatataacgcgttatatcgctggactgcaacagaaatacacacaaagtggtggtgtgagaccatttggcctttcaacattgattgttggttttgacccatacacggcggtaccatctctctatcagacagacccatcaggaacattttcggcatggaaagccaatgccacagggaggaactcaaactcaatgcgggaatttctggagaagaattataaagagacttctggacaggaaacagtgaagttagcaattcgtgctttgcttgaagttgttgaaagtggtgggaagaacattgaggttgctgtgatgacaaaggagcatggactacgccagctcgaagaggctgaaattgatgccattgttgcagagattgaagcggagaaagctgcagctgaagctgcaaagaaggcccctccaagagaaacctagttctgcagtcattgagtttatattctatgtatcctcctctcttttatggtcttttaacattattgactcttcttgatttcagggcttctccatccttgctcttttggtgtgctatctagtgatttctaagtttgtcagacaggttaaacatgctatagacagtttcttttt

SEQ ID NO: 3631 - DNA, 1015 bp, Chrysanthemum coronarium
ctcagcattttcactatcaaaaacctaaatcagttgaacaaatcaaaaaccttaactataatctgataatcataattgatggcgagatacgacagagctattactgtattttcaccggatggtcatttgttccaagttgaatacgctttggaagctgttcgaaagggtaacgctgctgtcggtgttcgcggtaccgatatcgttgtcctcggtgtcgagaagaagtccactgttaaacttcaagactctagatcagttaggaaaattgtaaacttggatgatcacattgcattggcttgtgctggactcaaagcagatgctcgtgttcttattaacaaggcaaggattgagtgccagagccataagcttactgttgaggatccagtaactgtagagtatatcacacgttacattgcaggtcttcaacagaaatatacccaaagtggtggagtcaggccgttcgggctgtcaactctaatcgtaggatttgatccttatactaatgttccatcattgtatcagactgatccttcaggaacattctctgcgtggaaagctaatgccactggcaggaactccaattccatgagggaatttttggagaaaaattataaggagacctctggtcaagaaactatcaaacttaccatccgagctctgctggaagttgttgagagtggagggaagaacatagaagttgctgtcatgacaaaggagggactccgacaactagaggaagctgaaattgatactattgttgcagagattgaagctgaaaaagcagctgctgaagctgcaaagaagggtcctgctaaggaatgatgtgctaaaagttcattccctttgctcacttggttttattgttgttttcttagatcttgtcagtctgaccttttcaacgtatgtatgtcctgtgaagtctcttagcatgtcaaaaatggtagttacaaggaatttgtttcatctaagaacttaaatatatgcattgagtgaatcaatcacccttttatggtcc

SEQ ID NO: 3632 - DNA, 1273 bp, Cichorium intybus
ctaccaaagtcgagagatcccccattattaagctctgtatttcgctgccggatcaaaaccaaaagttcgaatccgtatacgaaaacctaaatctccggtagaatctgatcatctatggcaagatacgacagagctataacggtcttctcgccggacggccacctcttccaagttgaatacgctctcgaagccgtacgcaagggtaacgccgccgtcggtgttcgtggcacagacaccatcgtcctcggtgtcgaaaagaagtccaccgttaaacttcaagactcgagatcagttaggaaaatcgtaagcctggatgatcacattgcactggcatgtgctggactcaaagcagatgcacgtgttcttatcaacagggcacgaattgaatgccaaagccataggcttactgttgaagatccagtaactgtagaatacatcacacgttacattgcaggtcttcaacagaaatacacacaaagtggtggtgtcagaccatttggcctttcaaccctaattgttggattcgatccctacactggtgtcccatcattatatcaaactgatccttcaggaacattttctgcttggaaagctaatgccactggtagaaactcaaactccatgagagaatttcttgaaaagaattacaaagaaacatctggtcaagaaaccattaaacttgccatccgtgctttacttgaagttgttgagagtggagggaagaatatagaagttgctgtgatgacaaaagagggactcaagcaactcgaagaggcggaaattgatgcggttgttgcagaaattgaagcggaaaaagcggctgctgaggcggcaaagaagggtcccgctaaagaaacatgaggatgagaagggtatttgcgtcttttctcacccggtttttattgttgttttcttataagtcttcagttatatgggatttgttttattcgacttctaagaaggtttaatttgtggtttgattggatgtattgactgttagtgatgattatgattatgtcttttgaggttatattttatggtgaggatacgaagggcatttatgtcttttgcacagaccaaaagattgagagcaaatccatgtcccacctttttgtgtacgacaaataattacaatatttgtcctatcgacaacagttatattctcaatctaatacacgtcaaacacagtataacgctatcttgtctggtccattcatgggccttaatgttatttaactctatatgtttatgttttgtagcttgtttatgactt

SEQ ID NO: 3633 - DNA, 1159 bp, Cichorium intybus
gagagatcccccattattaagctctgtatttcgctgccggatcaaaaccaaaagttcgaatccgtatacgaaaacctaaatctccggtagaatctgatcatctatggcaagatacgacagagctataacggtcttctcgccggacggccacctctttcaagttgaatacgctctcgaagccgtacgcaagggtaacgccgccgtcggtgttcgtggcacagacaccatcgtcctcggcgtcgaaaagaagtctaccgttaaacttcaagactcgagatcagttaggaaaatcgtaagcctggatgaccacattgcactggcatgtgctggactcaaagcagatgcacgtgttctgatcaacagggcacgaattgaatgccaaagccataggcttactgttgaagatccagtaactgtagaatacatcacacgttacattgcaggtcttcaacagaaatacacacaaagtggtggtgtcagaccatttggcctttcaaccctaattgttggattcgatccctacactggtgtcccatcattatatcaaactgatccttcaggaacattttctgcttggaaagctaatgccactggtagaaactccaactccatgagagaatttcttgaaaagaattacaaagaaacatctggtcaagaaaccattaaacttgccatccgtgctttacttgaagttgttgagagtggagggaagaatatagaagttgctgtgatgacaaaagagggactcaagcaactcgaagaggctgaaattgatgcggttgttgcagaaattgaagcggaaaaagcggctgctgaggcggcaaagaagggtcccgctaaggaaacatgaggatgagaagggtatttgcgtcttttttctcacccggtttttattgttgttttcttataagtcttcagttataagggatttgttttatttggattcgaagaagctttaatttgtggtttgattggatgtattgactgttagtgatgattatgattatgtgttctgaggttatcttttatggtgaggatgagaagggcatttatgtcttttacacattcgagatcgagaggtattttatttaaggcttaatgcttaaaaaaccaaccaacaatctgaaatgtttaatttaacccctcgtaatttttagct

SEQ ID NO: 3634 - DNA, 950 bp, Trifolium pratense
aagatcacaatggcgaggtatgatcgagcaatcacagttttctctcccgacggtcatctcttccaagttgaatacgctctcgaagctgttcgtaaaggtaacgccgccgtcggtgttcgcggtaccgataacgttgttctcggcgttgaaaagaaatccaccgccaaactccaagactctagatcggtgaggaagattgttaacctagacaatcatattgcccttgcctgtgctgggttaaaagccgatgcacgtgtcctaataaaccgtgctcgagttgaatgccagagtcataggcttacggtagaggatccctgcaccgttgaatatataaccagatatattgcgggtcttcagcagaaatatacccagagtggcggcgtccggccctttggcctttccaccttgatcgttggatttgatccttacactgggtcaccttctctctaccaaactgacccttctggtacattctcagcatggaaagccaatgctactggaagaaactctaattcaatccgcgagtttcttgaaaagaacttcaaagaaactgctggccaggaaaccgtcaaattggccatccgggctttgcttgaggttgttgagagtggaggaaaaaacattgaagttgctgtgatgaccaaggaggatggactgcgtcaattagaggaagctgaaattgatgcaattgtggctgagattgaagcagagaaagcagctgctgaggctgcaaagaaagctcctcccaaggatacatgactctaggtttattcgtttcgtattaaccaagcatagctgttggctgtacttattgtaatctataatttgccatcatatctgagattgaaacacaaaagagagctgctgatgctacacaagaactgctgtttttctatatttgtttatctctgtgaattgttgttcttgttgggtgttggcctaacttaaaa

SEQ ID NO: 3635 - DNA, 911 bp, Trifolium pratense
aagatcaaaatggcgagatacgatcgagcaatcacagttttctctcccgacggccatctcttccaagttgaatacgctctcgaagctgttcgtaaaggtaacgccgccgtcggtgttcgtggtaccgacaacgttgttctcggcgtcgaaaagaagtccaccgccaaactccaagacactagatcagtgaggaagattgttaatcttgacaatcacattgctcttgcatgtgctggactaaaagctgatgcacgtgtccttataaaccgtgcccgagttgaatgtcaaagtcaccggcttactgttgaagatccttgtacagtggagtatattactcggtacattgcaggtcttcagcaaaaatacacacagagtggtggtgtgcgtccctttggcctttccactttgatagttggttttgatccttacaccgggtcaccgtcgctgtaccaaactgacccttctggtacattttctgcatggaaagccaatgctactggaagaaactcaaattcgatccgtgagtttcttgagaagaactttaaagaaacttctgggcaagaaactgtcaaattggctatccgagcattgcttgaggttgtggagagtggaggcaagaacattgaagttgccgtgatgaccaaggacgatggactgcgtcaactggaggaaggtgaaattgacgccattgttgctgagattgaagcagagaaagcagctgctgaggctgcaaagaaagctcctcctaaggatacatgattttaggtttcttttgttttgtattacacaaacaactgagctttttgagtgttgccgaaccgtgacagagcgaagcatatgaatggtttcacaaattaaggaatcagttgatgacacactcataaacatttggtaaaacaggactaaaagca

SEQ ID NO: 3636 - DNA, 1139 bp, Trifolium pratense
acttcattgtttacacaaaccaaaaaagcttccccaaatcataatcattcatttgaatcgcaaaaggtagaaggagaacaagaacagcaaaagattatggctagatacgatcgagcaatcacagttttctcccccgatggtcatcttttccaggtcgagtacgctcttgaagctgttcgaaaaggtaacgccgccgtcggtgttcgcggtattgataacgttgttctcggcgtcgagaagaaatccgccgccaaactccaagactctagatcagtaaggaagattgttaatctagacaatcacattgctcttgcttgtgctggacttaaagctgatgcccgtgttcttataaaccgagcccgagtagaatgtcaaagtcacaggcttactgtcgaagatccttgcactgtagagtatattactcggtacatagcaggtctccagcaaaagtacacccagagtggtggtgtgcggccctttggcctttccaccttgatagtcggctttgatccttacaccggatcaccatctctgtaccaaaccgacccttctggcacattttcagcatggaaagccaatgcaactggtcgaaactcaaattcaatcagggagtttctggagaaaaacttcaaagaaacgtccgggcaagaaactgtcaaactggctatccgggcattgcttgaggttgtcgagagtggaggcaagaacattgaagttgccgtgatgaccaaggacaatggactccgtcaactggaggaagctgaaattgacgcaattgtcgctgagattgaagctgagaaagcagctgctgaggctgcaaagaaagctccccccaaggatacatgattttaggtttcttttgttttgtattacataagcaactgaatttttagtgttgccgaaccgtgacaaaataaatgaatagttgcacaaattaaagatcggttgatgacacatcggtaaaatgggactcacatataacatggaactcacaattgtgatgtctcgagttcgaactcaggtaaagattgatattgacaattgagttagatcttacggataaaaaacatatatgaaacagaacatttgcaatattgtaatctttgagcataatattgatcagctgaaattgtgtctca

SEQ ID NO: 3637 - DNA, 1210 bp, Allium cepa
tagttacggggggttcggggattgtttatacccgatccaacagaaaaaagcccaaaaccgaaactacttcgtttccgtttctcttctcctcttttatttgtgcttctgctgcaaggcaaaatcctaatctataataaagttaatcctcaaccttcgcattaaaagaagtctgtaaaatggctcgctacgatcgtgcaatcacagtattctcaccagacggtcatcttttccaagtagaatacgcactcgaagctgtacggaaaggtaacgcagccgtcggagttcgtggtaccgataatgtggttcttggtgttgagaagaagtcaactcctaagttgcaggattctagatctgttcgtaaaattgtgaatctagacgaccacattgcacttgcatgtgcaggtctaaaagctgatgcccgtgtcttaatcaacaaggcgaggatagaatgtcagtcccacaagcttactgtagaagatcctgtcactgttgagtatatcactagatacattgcagggatgcagcagaaatacacgcaaagtggtggggtccgtccatttggattatctacattgattgtagggtttgatccatacacgggtgtgccttctttatatcaaacagatccttctgggactttctcagcttggaaagcaaatgcaactgggaggaattctaattcgatgagggagttcttagagaagaactttaaagaagtggccggacaagagactattaagcttgctattcgtgccttgcttgaagttgtggaaagcgggggaaagaacatagaaatagcagtgatgacaaaggaggaagggctaaagcaactggaagaagctgagattgatgccattgttgcagaaattgaagcagagaaagctgctgccgaggctgccaagaaagctcccagggattcctgatctcatgcttttatttctgctaccccttgttacatgttagaccataaactacttattttatttttcctctcatcttcaaattgttatgttcttatatttgctaacttttcatgctaatttgctcttttttgttatattgtgtgcttgtgcatcttttatgtaaacatgatgaagctattttaatcccacttgaggttgaagatattcgacatgtctattggtaggagtttataggcttacacatagtctgttatatgagaattattttgctttgtggtttgattcga

SEQ ID NO: 3638 - DNA, 1060 bp, Amorphophallus konjac
cggccgggggaacccaactaaacttccttcgtccctgctcaaacgctctctgcgcacacagcagttggagacgaccagaggaagccgcgtccatggcccgctacgaccgcgccatcaccgtcttctcccccgacggccacctcttccaggtcgagtacgctctcgaggccgtccgccgcggcaacgccgccgttggcgtccgcggcaacgacaccgtcgttctcggcgtcgagaagaagtccacccccaagctccaggactcccggaccgtgaggaagatcgtgagcctggacaaccacatcgccctggcctgcgccgggctgaaggcggacgccagggtcctgatcaacaaggcgcgcatcgagtgccagagccaccgcctcaccgtcgaggaccccgtcaccgtggagtacatcacgcggtacatcgccgggctgcagcagaagtacacccagagcggcggggtgaggcccttcggcctgtcgacgctgatcatagggtttgatccctacacggccgtgccctcgctctaccagacggacccctcggggacgttctcggcgtggaaggcgaatgccacggggaggaactccaattcgatgagggagttcctggagaagaattacaaggagacgtccgggcaggagacggtgaaattggctatccgtgctctgcttgaagttgttgaaagtggagggaagactattgagattgcggtgatgaccaaagagcatggacttcgtcaactcgaggaagcagagattgatgccttggttgctgaaatcgaagcagaaaaggctgccgctgaagctgcaaagaaggcacctcccaaggattcatgagtcactctgcccatccgttcttgaatttaaactatatcagattttttaagatttgttctgtttcaaactctcgctcctcatgtcagtgcaacttgttcattttcttgtaagacttgagtccggtcagttacagaccaccttcaaagattgtcttctgtctggatgagagtgccgtttgtaggagaatttttttcctttctccgctaccgtgcttttct

SEQ ID NO: 3639 - DNA, 1114 bp, Artemisia annua
cagtactccaacgggaaacatgattttcttttcttgctcaataagtcgacagatcccccattattaaaccaaaccaaacacttttctcaccattttcacaatcaaaaaacgtaaatcagttcaacaaatcgaaaaccttaaattatataatctgattctcatcataaatggcgagatacgacagagctattactgtattttcaccggatggtcatttgttccaagttgaatacgctttggaagctgttcgaaaaggtaacgctgctgtcggtgttcgcggtactgatatcgttgttctcggtgttgagaagaagtctactgttaagcttcaagactctagatcagttaggaaaattgtaaacctggatgatcacattgcattggcttgtgctggactcaaagcagatgctcgtgttcttattaacaaggctaggattgagtgccagagccataagcttactgttgaggatccagtaactgtagagtatatcacacgttacattgcaggtcttcaacagaaatatacccaaagtggtggagtcaggccgttcggactgtcaaccctaattgtaggatttgatccttatactaatgttccatcattgtatcagactgatccttcaggaacattttctgcgtggaaagctaatgccactggcaggaactccaattccatgagggaatttttggagaaaaattataaggagacctctggtcaagaaactatcaaacttaccatccgagctctgcttgaagtcgttgagagtggaggtaagaacatagaggttgctgtcatgacaaaggagggactccgacaactcgaggaagctgaaatcgatactattgttgcagagattgaagctgaaaaagcagccgccgaagctgcaaagaagggtcctgctaaggaatgatgtgccaaagtccattccctttgctcccttggttttattgttgttttcttagatcttgtcagtctgaccttttcaacatttgtatgtcctgtgaagtcttttagcatgtcatggtacggtagttacaaggaatttgtttcatttaaggaacttaaatatatgcatcgagtgaatgtatcacccttttatggccaccattttgc

SEQ ID NO: 3640 - DNA, 893 bp, Fagus grandifolia
ctggaccttggctgtcactcagttaagtttaagattgataattgattaaaaacgcactttctcgagtcagaattgatcgagaaacaaagaggggagatcagttgagtaaaaattgagaattgagaaagaggaagaatggcaaggtacgatagagcaataacagtgttctcaccagatggtcatcttttccaggtcgaatacgcactcgaagccgtccgcaagggtaacgccgccgttggtgttcgtggcaccgacaccatcgtcctcggcgttgagaagaagtccaccgccaaactccaagactccagatcggttaggaagattgtgaacctggatgatcacattgcactagcctgcgctggacttaaggcagatgctcgtgtcctaataaacagggcacggattgaatgtcaaagccataggcttacagtggaggatccagtaactgttgagtacatcactcgttatatcgctggtcttcagcaaaagtacacacaaagtgggggtgtgagaccatttggcctttcaactttgattgttggctttgatccctacactaattctccatcactgtaccagacagatccttctgggacattttcagcttggaaggctaatgcaactgggagaaactctaattcaataagagagtttttggagaaaaactataaagaaacttccgggcaagaaacagttaagcttgcaatccgtgcattacttgaggttgttgagagtgggggaaagaatatagaagttgctgtgatgactaaggagcatggcctgaggcaacttgaggaagctgagattgatgctgttgtagctgaaattgaagcggaaaaagcagctgctgaggctgcaaagaagggccccccaaaggaaacatgatcatattt

SEQ ID NO: 3641 - DNA, 1159 bp, Cichorium intybus
gagagatcccccattattaagctctgtatttcgctgccggatcaaaaccaaaagttcgaatccgtatacgaaaacctaaatctccggtagaatctgatcatctatggcaagatacgacagagctataacggtcttctcgccggacggccacctctttcaagttgaatacgctctcgaagccgtacgcaagggtaacgccgccgtcggtgttcgtggcacagacaccatcgtcctcggcgtcgaaaagaagtctaccgttaaacttcaagactcgagatcagttaggaaaatcgtaagcctggatgaccacattgcactggcatgtgctggactcaaagcagatgcacgtgttcttatcaacagggcacgaattgaatgccaaagccataggcttactgttgaagatccagtaactgtagaatacatcacacgttacattgcaggtcttcaacagaaatacacacaaagtggtggtgtcagaccatttggcctttcaaccctaattgttggattcgatccctacactggtgtcccatcattatatcaaactgatccttcaggaacattttctgcttggaaagctaatgccactggtagaaactcaaactccatgagagaatttcttgaaaagaattacaaagaaacatctggtcaagaaaccattaaacttgccatccgtgctttacttgaagttgttgagagtggagggaagaatatagaagttgctgtgatgacaaaagagggactcaagcaactcgaagaggcggaaattgatgcggttgttgcagaaattgaagcggaaaaagcggctgctgaggcggcaaagaagggtcccgctaaagaaacatgaggatgagaagggtatttgcgtcttttctcacccggtttttattgttgtttacttataagtcttcagttataagggatttgttttattcgacttctaagaaggtttaatttgtggtttgattggatctattgactgttagtgatgattatgattatgtgttctgaggttatcttttatggtgaggatgagaagggcatttatgtcttttacacattcgagatcgagaggtattttatttaaggcttaatgcttaaaaaaccaaccaacaatctgaaatgtttaatttaacccctcgtaatttttagctct

SEQ ID NO: 3642 - DNA, 1038 bp, Cichorium intybus
ggcggggaacaaaagttcgaatccgtatacgaaaacctaaatctccggtagaatctgatcatctatggcaagatacgacagagctataacggtcttctcgccggacggccacctcttccaagttgaatacgctctcgaagccgtacgcaagggtaacgccgccgtcggtgttcgtggcacagacaccatcgtcctcggcgtcgaaaagaagtccaccgttaaacttcaagactcgagatcagttaggaaaatcgtaagcctggatgatcacattgcactggcatgtgctggactcaaagcagatgcacgtgttcttatcaacagggcacgaattgaatgccaaagccataggcttactgttgaagatccagtaactgtagaatacatcacacgttacattgcaggtcttcaacagaaatacacacaaagtggtggtgtcagaccatttggcctttcaaccctaattgttggattcgatccctacactggtgtcccatcattatatcaaactgatccttcaggaacattttctgcttggaaagctaatgccactggtagaaactcaaactccatgagagaatttcttgaaaagaattacaaagaaacatctggtcaagaaaccattaaacttgccatccgtgctttacttgaagttgttgagagtggagggaagaatatagaagttgctgtgatgacaaaagagggactcaagcaactcgaagaggcggaaattgatgcggttgttgcagaaattgaagcggaaaaagcggctgctgaggcggcaaagaagggtcccgctaaggaaacatgaggatgagaagggtatttgcgtcttttctcacccggtttttattgttgttttcttataagtcttcagttataagggatttgttttattcgacttctaagaaggtttaatttgtggtttgattggatgtattgactgttagtgatgattatgattatgtgttttgaggttatatcttttatggtgaggatgagaagggcatttatgtcttttacacattcgagatcgag

SEQ ID NO: 3643 - DNA, 1067 bp, Gossypium hirsutum
aaaagtaccaggctatccaaccaagtcttgaataacaaaagcaaatccaaggaatagaagaaaatggcgaggtacgatagagcaatcacagtgttctcgccggacggccatttgttccaagttgaatacgccctcgaagcagtccgtaaaggtaacgccgccgttggtgtccgcggcactgacatcgtcgtcctcggcgtcgagaaaaaatctaccgccaagctccaggactccagatcggttaagaagattgtgaacttggataatcacattgcactggcatgtgctggcctcaaagccgatgctcgagtcctcataaatagggctcggattgaatgtcaaagccacaggctgactgttgaagatccagttactgttgagtatattactcgatacgttgcaggtcttcagcagaagtacactcaaagcggaggtgttaggccgtttggtctctcaactctgattgtgggctttgatccatactccggtgtaccgtcactatatcagacggatccatcagggacattttcagcctggaaagctaatgccactggtagaaactctaactcaatcagagagttcctagagaagaactataaggaaacctctggacaagaaaccattaagcttgcaattcgtgctttgcttgaggttgttgagagtgggggaaagaatatcgaagttgctgtgatgacgaaggagcatggtctgcggcagcttgaagaagctgaaattgatgccattgcagctgagattgaagcagagaaggaagcggctgaggctgcaaagaaagcccctccaaaggaaaaataaaacatcaactgtttgagcttcttttaacttttctctcctttgttcttttaaaggatgttgtctgggttcttttagttgacagttgatgtactcggcctcaaactttcattcacccgttggagcttcattatttaccgttgttactgtctcattttcgtttgttaatttcaagatatataattgatttgatgttagatatttgttcattttttcaaatctattacttccaccttacaatttttatttttaaaaaa

SEQ ID NO: 3644 - DNA, 985 bp, Gossypium hirsutum
agactcagtaatagcataagcaaatcctaaggaatagaagaaaaatggcgagatacgacagagcgattaccgtgttctcaccggacggccatttattccaagtggaatacgccctcgaagccgttcgtaaaggtaacgccgccgttggcgtacgcggcaccgacatcgttgttctaggcgtcgagaaaaaatccgccgccaaactccaggactcacgatcggttaagaagattgtgaatttggatgatcatattgcattggcatgtgctggactcaaagccgatgctcgtgtcctcataaacagggctcggatcgaatgtcaaagccataggctgactgttgaagatcccgttacggtcgagtatattactcgttacattgcgggtcttcagcagaagtatactcaaagtggaggtgttagaccatttggtctctcgactctgattgttggctttgatccatatagcggtacaccggcactatatcaaactgatccgtcagggacattttccgcttggaaagctaatgcaactgggagaaactcaaactcgatacgagagtttctagagaagaactacaaggaaacttctgggcaagaaaccattaagcttgcaattcgtgcattgctcgaggttgttgagagtgggggaaagaacatcgaagttgctgtgatgacaaaggaacatggtcttcggcagcttgaagaaactgaaatcgatgccattgcagccgagatcgaggcagagaaggaagcagccgaggctgcaaagaaggcccctccaaaggaaaaatgatgaagcatcaactgtttaagctatcatttcctttttctttttttcttttctggtctgactgcttaatttctgcaattgaagtttcatttgccattgttggcattttatttgctttttagttgtttcagtttaagcaagtatcaatcacattcagataatatgcaaatatgaatcttgcaacaaggttttaa

SEQ ID NO: 3645 - DNA, 1294 bp, Vigna unguiculata
actctcttcaccaaagcaaaaagcttgaatagagaggcacggagagaactacaaatcccaacccagaagtaaaactaagtagcaaacacaaagcacggcaaaatggcgaggtacgatcgagcaatcacggtgttctcccccgacggccacctcttccaggtcgagtacgccctcgaagccgtccgcaaaggtaacgccgccgtcggcgtccgaggtaccgacaacgtcgtcctcggcgtcgagaagaaatccactgccaaactccaagactccaggacggtaaggaagattgtgaatctcgatgatcacattgcgcttgcctgcgcggggctgaaggccgacgcacgtgtgctcataaaccgggcacgtgtggagtgtcagagtcacaggctcaccgtcgaggatcccgttactgttgagtatatcacccgttacatcgcggggcttcagcagaagtacacgcagagtggtggtgtgcgaccgtttgggctttccaccctcattgttgggtttgatccctacactggcgccccttcactgtaccaaacggacccttctggcacgttttccgcgtggaaggcgaacgccaccggccgaaactcgaattcgattcgggagtttctggagaagaattacaaggagacctctgggcaggagactgtcaaattggctattcgtgcattgcttgaagttgttgagagtggagggaagaatatagaagttgctgtgatgactaaggagaatggtctgcgtcaactggaggaagctgaaattgatgccatcgttgctgagatcgaagcagagaaagcagctgctgaggctgcgaagaaagcccctccgaaggagacatgattttctatttagtttgttacgcagtgtttaggttgtggctgtactcgctggagctaaaattgatgacattgtgtctgagattgaaacagagaaaacggttgttgaggctgcaaataccatttctaaggagaagacaagatttatgttacttttgtttaactcgtgaactgttcttgctagatgttggcctaacttaaaattgaattctttgctgtttttgggtactgccatatgatatagtattggtcaaattaattgcatgctattattattcaagttcaaattgagtcgggtgatacaccatgatccacaacattttcattggcaagaactcgtgctttatactagtcaatacgacaatattcaggcaatatatgtccattgtgtaaaagaaagaaagtgtatttccatctccaaaagaaattttaatgacgtgaaatgg

SEQ ID NO: 3646 - DNA, 1099 bp, Cyamopsis tetragonoloba
acttttcttacaaagcagttgctacagaagaaaaggagaagcttgacttgagacagatttgaatccgaagcagaacagaatcacaatggcgagatacgacagagcaatcacagtattctcacccgatggccatcttttccaagtcgaatacgccttagaagccgttcgtaaaggcaacgccgccgtcggcgtccgcggcaccgataacgttgttctcggcgtcgagaagaaatccaccgccaagctgcaagactctagaacggtgcggaagattgtgaatttggacgatcacattgccctagcttgtgcgggactaaaagctgatgctcgtgtcctgataaatagggctcgagttgagtgtcaaagccacagattaacagttgaggatccagttactgttgagtacataactcgttatattgcgggtcttcagcagaagtacacgcagagtggtggtgtgcgaccctttggtctttccactctgattgttggctttgatccatacactggtgcgccttccctgtaccaaacagatccttctggaacgttttctgcttggaaggctaatgcaactgggagaaactcgaattccattcgagagtttctggagaagaattacaaggaaacttctggacaagaaactgtcaaattggctatccgagcattgcttgaagttgtagagagtggaggcaagaacatagaagttgctgtgatgactaaggagcatggactgcgtcaactggaggaagctgaaatcgatgccatcgttgctgagattgaagcagagaaagcagctgctgaagctgcaaagaaagccccccctaaggagacatgattttcaatttattttattttgaatttgaattatgggagcattgctcttgctaggagttggctgtacttactgaagctaaatttgatgccattgtgtctgagatcgaaacatagaaaacagctgctgatgttgcaaaggaaaacgctttctagggagacaatgtttatgttcacttttgtttagctcgtcaattgttcttgctagatattcgccgagtttcaaatgaatgtcttgtcttacaatatagcatttgttgaaaaaaaa

SEQ ID NO: 3647 - DNA, 1006 bp, Flaveria ramosissima
ttcgaatcggaatacgaaaggttgaatcttcagtggaatctgatatcattatctgatggcgagatacgacagagctatcacggtgttctcgccggacggacacctgtttcaggtggaatacgccttggaagccgtacgtaagggtaacgccgccgtcggtgttcgtggcaccgacaccatcgtccttggggtcgagaagaagtccaccgttaaacttcaagactcgagatcagttaggaaaattgtaagtctggatgatcacattgcattggcttgtgctggacttaaagcagatgcacgtgttcttattaacagggcacgaattgagtgccagagccataggcttaccgttgaggatccagtcactgtggagtatattacgcgttacattgcaggtcttcaacagaagtacacacaaagtggtggtgtcaggccatttgggctttcaaccctaatcgtaggatttgatccttatactggtgttccatcattatatcagacagatccctcaggaacgttttctgcttggaaagctaatgctactggcaggaactccaattccatgagggaatttctggagaagaattacaaagagacctctggtcaagaaaccataaaacttgccatccgtgctctgcttgaagttgttgagagtggagggaagaacatagaagttgctgtgatgacaaaggagggactgaggcaacttgatgaagctgaaattgatgccattgttgcagagattgaagcagaaaaagcagctgccgaggctgccaagaaggctccagctaaggaaacataatgtgtcaaagatcgaccccttctctcacctggttttattgttgttatcagtttacatgtatgtctgttggcttgatctgttaccagtcgtatggtaggtttatggtaagtttctctatatttgtaagtaaagtaatttctgtcgtttgtaatgtttgtattgtaatctatctacccttccatgctcatcagttagatgaggggg

SEQ ID NO: 3648 - DNA, 1098 bp, Flaveria ramosissima
ttcttaaacacctctgcaacttttgctctcagatcaaacttcaaaactcaaattcgaacacataaaccctaaatattcactacaatctgttcatcaatggcgagatacgacagagctatcacggttttctcgccggacggccacctatttcaagtcgaatacgccttggaggccgtacgcaagggcaacgccgccgtcggcgttcgtggcaccgacaccatcgtccttggggtcgagaagaagtctactgttaagcttcaagactcaagatcagttaggaaaattgtgagccttgatgatcacattgcattggcttgtgctggactcaaggcagatgctcgtgttcttattaaccgggcgcgaattgagtgccagagccataggcttactgttgaagatccagtaactgtagagtatattacacgttacattgcaggtcttcaacagaaatacacacaaagtggtggtgtccggccatttgggctctcaaccctaatcgtgggatttgatccttatactggtgttccgtcattatatcagacagatccttcaggaacattttctgcatggaaagctaatgccactggaaggaactccaattccatgagggaatttctggagaagaattacaaagagacttctggtcaagaaactataaaacttgccatccgcgctttgcttgaagttgtggagagtggagggaagaacatagaagttgctgtgatgacaaaggagggactccgacaacttgaggaagctgagattgatggcattgttgcagaaattgaagcagaaaaggcagctgctgaggctgcaaagaaggctcctgctaaggaaacatgaagcgtgaaagatcaatccctttactcacaaggttccattgttgttttcttagaacttttcagttttccgatatatctatgtctaattgggagttccattcatcttatgatggtttttaagaaagttgtctcatgtgaagtataagaagctttaatttatgtcttttggttggtactttttttcgacattggatgatactttgatgaaactgttacattcggttaatttatacgacgctctgcttgcagccgattg

SEQ ID NO: 3649 - DNA, 1029 bp, Gossypium raimondii
gatcttcttgtcgcttaagtaaaaagtaccaggctatgcaaccaagtcttgaataacaaaagcaaatccaaggaatagaagaaaatggcgaggtacgatagagcaatcacagtgttctcgccggacggccatttgttccaagttgaatacgccctcgaagcagtccgtaaaggtaacgccgccgttggtgtccgcggcactgacatcgtcgtcctcggcgtcgagaaaaaatctaccgccaagctccaggactccagatcggttaagaagattgtgaacttggataatcacattgcactggcatgtgctggcctcaaagccgatgctcgagtcctcataaatagggctcggattgaatgtcaaagccacaggctgactgttgaagatccagttactgttgagtatattactcgatacgttgcaggtcttcagcagaagtacactcaaagcggaggtgttaggccgtttggtctctcaactctgattgtgggctttgatccatactccggtgtaccgtcactatatcagacggatccatcagggacattttcagcctggaaagctaatgccactggtagaaactctaactcaatcagagagttcctagagaagaactataaggaaacctctggacaagaaaccattaagcttgcaattcgtgctttgcttgaggttgttgagagtgggggaaagaatattgaagttgctgtgatgacgaaggagcatggtctgcggcagcttgaagaagctgaaattgatgccattgcagctgagattgaagcagagaaggaagcggctgaggctgcaaagaaagcccctccaaaggaaaaataaaacatcaactgtttgagcttcttttaacttttctctcctttgttcttttaaagggttgttgtctgggttcttttagttgacagttgatgtactcggcctcaaactttcattcacccattggagcttcattatttaccgttgttactgtctcattttcgtttgttaatttcaagatatataattgatttgatgtta

SEQ ID NO: 3650 - DNA, 1033 bp, Guizotia abyssinica
gctcccaaagtcgagagatctcttacattagtaagaactctgcatttttgatctccgatcaaacctaaaatttcaaatccgaaaacctaaatcttcagtagcagctcatcatctaatggcgagatacgacagagccatcacggtgttctcgccggacggacacctcttccaggttgaatacgctttggaagccgtacgcaagggtaacgccgccgtcggtgttcgtggaaccgacactatcgtccttggggttgagaagaagtccaccgttaaacttcaggactcgagatcagttaggaaaattgtaagtctggatgatcacattgcattggcttgtgctggacttaaagctgatgcacgtgttctcattaacagggcacgaattgagtgccagagccataggcttactgttgaggatccagtaactgtagaatatatcacgcgttacattgcaggtcttcaacagaaatacacacagagtggtggtgttaggccatttggactttcgaccctaattgtagggtttgatccttatactggtgttccatcattatatcagacagatccttcaggaacattttctgcttggaaagctaatgctactggtaggaactccaattccatgagggaatttctggaaaagaattacaaagagacctctggtcaagaaactattaaacttgccatccgtgctctgcttgaggttgttgagagtggagggaagaacatagaagttgctgtgatgacaaaggagggactgaggcaacttgatgaagctgaaattgatgcgattgttgcagagattgaagcagaaaaggcagctgccgaggctgcaaagaaggctcctgctaaggaaacataaattcggcccccttttctcacccggttctattgttgttttcttcagtttgacttttgcaatacatgtatgtctatttgcctgttctgttaccgatcgtatggtagttttatggatgttgactctcatttgaagatatttatgcttttcaagaatctatcacccttccaatac

SEQ ID NO: 3651 - DNA, 972 bp, Ipomoea nil
gctctacgtcttgaaacctagaaaagtacttgcggtaccggagaggcagaaaccggaacaaacttaaatcgaactagtaaaagataagttatggcacgatacgatagagcgatcaccgttttctcgccggacggtcatcttttccaggtggagtacgccctagaagccgtacgaaagggtaacgccgcagtgggcgttcgaggtacagatactgtcgtcctcggcgtagagaagaagtctactcccaagcttcaggattccagatctgtacggaaaatcgtaaatctagatgatcacattgcattggcttgtgctggacttaaagcagatgcacgtgttcttgtaaatagagcacgcattgagtgccagagtcacaggctcactgtggaagatcctgtaactgttgagtacataactcgctatattgctggccttcagcaaaaatacactcaaagtggtggtgtaagaccatttggtctttctaccttgattattggttttgacccatacacaggtgttccatctctttatcagacagatccatcaggtactttttcagcatggaaggccaatgcaactgggaggaactccaactcaatccgggagtttcttgagaagaactacaaggaaacctctggccaggaaactgtgaagctagccattcgtgctttgcttgaagttgttgagagtggtggaaagaacatagaagttgctgtcatgacaaaggagcatggacttagacaactagaggaagctgaaattgatgccattgttgctgagattgaggcagagaaagcagctgcagaagctgcgaagaagggcccggcaaaggaaacctagttctagaaaaaatgcaccgtgttcttctatgaagctacaactctctactattttgatgcttctttcaacatgtgaactgttaaatccggtgttagaaaaagtgtgatttgctgaacttttcctatattacac

SEQ ID NO: 3652 - DNA, 1279 bp, Papaver somniferum
aattaaaaaccccaattctttctttactctctcacaccgaaaagaaaactgaatacgaaattctttcagatcgatcctttaatcgcagtagagaagaagaattaaagaatggcacgatacgatagagccatcacagtattctcaccagatggtcatctctttcaggtggagtatgccctcgaggctgtacggaaaggaaacgcagctgttggtgttagaggtactgatactgttgttcttggtgttgagaagaaatctactgctaaacttcaagactctagatcagttaggaagattgttaacctggataatcacattgctttagcctgtgctgggcttaaggcagatgcacgtgttttgataaacaaagcaaggattgagtgtcaaagtcatagactcacagttgaggatcccgtaactgttgaatatatcacacgttacattgctggtcttcagcaaaagtatacacaaagtggtggtgtgagaccatttgggctatcaactttgatcgtgggttttgaccctcacactgatgttccatcactctatcagactgatccctcagggacattctcagcttggaaggctaatgcaacaggaagaaattccaactctatgcgtgaatttttggagaaaaactacaaagaaacttctggacaagcaactgtgaagcttgctattcgtgcattgctcgaggttgttgaaagtggtgggaagaacatagagatagctgtaatgggaaaagacaaggtgttgcgtcaacttgaagaatctgagattgatatcattgttgctgagatcgaagcagaaaaggcagctgcagaagctgcaaaaaaaccagctccaaagaatacctaatttccatctcctagtaagttggtccaatttgcgaaaaattctggataaaggtctagcagtggctctcttgactggcacattttctttagttttatcacatttggattgaaactgctaaaacagatctgctatcctggtttcaatgatacatttaagaattacaacactcagtgttctgtaaatggacatcatctcttacttaaatggacagcatctctagaaatacatatgttctcgttaaaaaaaaaaaaaaaactcgaggggggccgtaccattcgccttaagtggtcgattacatcctgcgtcgttacacgtcggactgaactgcgttaccactatcgcttgggcattccctccaggtggtatagcgaagccgacgatgcccttccacagttgccgccctgaatggcaagggcagtag

SEQ ID NO: 3653 - DNA, 1052 bp, Papaver somniferum
ttctttactctcaccccaaaaaagattcaatactaaattctttcagatcgatcgtttaatcgcagtagagaagaagaagtaaagaatggcacgatacgatagagcaatcacagtattctcaccagatggtcatcttttccaggttgagtacgccctggaagctgtaaggaaaggaaacgcagctgtaggtgttagaggtactgatactgttgttcttggtgttgagaagaaatctactgctaaacttcaagattctagatcagttaggaagattgttaacctggataatcacattgctttggcctgtgctgggcttaaggcagatgcacgtgttttaataaacaaggcaaggattgagtgtcaaagccatagactcacagttgaggatcctgtaacagttgaatatatcacacgctacattgctggtctgcagcaaaagtatactcaaagtggtggtgtgagaccatttgggctatcaactttgatcgtgggttttgaccctcacactgatgttccatcactgtatcagactgatccctcagggacgttctcagcttggaaggccaatgcaacaggaagaaactctaactctatgcgtgaatttttggagaaaaactacaaagaaacttctggacaagaaactgtgaagcttgctattcgtgcattgctcgaggttgttgaaagtggtgggaagaacatagagatagctgtaatgggaaaagacaaggtgttgcgtcaactcgaagaatctgagattgatattattgttgccgagatcgaagcagaaaaagcagctgcagaagccgcaaagaaacctgctcgaaagaatacctaatttgtatctcctaattaagttggtccaatttgcgaaaaattctggataaaggtcttgcagtggctgttttgattggcacattttctctggttttgtcaatcagctatccccaatgatacattttagaattacaaagctcaatgttctgtaagagctatgtttcctttacttgaatggaccgcatctctagaaatacaatatgtttctgtttgaaaaa

SEQ ID NO: 3654 - DNA, 1063 bp, Solanum tuberosum
tcgaggaaaaggttagagggaagagctttcaacactcaagagatcggaagaagctgaaatcacacagaccccaaatttttcaatagcttttagtactatcagataatggctagatacgacagagcgatcaccgttttctcgccggacggccacttattccaagtggagtacgccatggaagccgtacgcaaaggaaacgccgccgtcggtgtacgtggaactgacactgttgtccttggcgttgagaagaagtccactcccaagcttcaagactccaggtcagtaagaaagattgtaaatctagatgatcacattgcattggcgtgtgctgggctgaaagcagatgcacgagtgcttgtgaataaggcacgcattgagtgtcagagtcataggcttacggttgaagatcctgttactgttgagtacataactcgttacattgctggtcttcagcaaaagtacactcaaagtggtggggtgaggccatttggtctatccaccttgatcattggttttgacccacacacaggtgtcccctcactttaccaaacagatccatcaggtacattctcagcttggaaagccaatgcgactggtagaaactccaactctactcgggaattcttggagaagaattacaaagaaacatctggccaggaaactgtgaaactagcaatacgtgctttgcttgaagttgttgaaagtggtggaaaaaacatagaagttgctgtgatgacaaaagagcatgggcttaagcaacttgaggaagctgaaattgatgccattgttgctgagatcgaagcagagaaagctgctgcagaagcagccaaaaaggccccgccgaaggaaacctagttgtgctgaaatttgttcttaactatccctgaatcctttcttttttcggatcaagccaagtgcagtgttccttgaattttaagattttggtctgtctaatactttacctatgttaaaattgtctgatgggactaaaaaagtcatgctctcgcgatctgtgccctatttgtgtggtgcttgatattttaagatttatcatgctatttgg

SEQ ID NO: 3655 - DNA, 1049 bp, Sarracenia psittacina
attgggtgccttgccttgtcccctaagcctcaaatacagacaaattcgtcgattcgaaccagggaagacagagcaacaccatcaagagaaagtaagcgaaacaaacgatggcgagatacgaccgagcaatcactgtgttctcaccggacggccatctcttccaagtcgaatacgccctcgaagccgtccgcaagggcaacgccgccgtgggcgttagaggctccgacaccgttgttcttggcgtcgagaagaagtccaccgccaaactccaagactccagatcagttaggaagattgtaagcctagatgatcacatcgcattggcctgtgctggactcaaagcagatgctcgggttcttataaacaaggctcgtatcgaatgtcaaagccacaggcttactgttgaagatccagtaactgttgagtatattacacgttacattgctggtcttcaacagaagtacacacaaagtggtggtgtaagaccatttggtctttcaactttgattgtgggctttgacccttatactagtgtaccatcactttatcagacagacccatcaggtacattttctgcatggaaggctaatgctaccggaagaaactctaattcaatgcgagaatttttggagaaaaactataaagaaacttctgggcgagaaactatcaagcttgctattcgtgccttgcttgaagttgttgatagtggggggaaaaacattgaagttggtgtgatgactaaggagcacggcctgcggcaacttgatgaagctgaaattgatgccattgttgccgagatcgaagcagagaaagcagctgctgaggcagcaaagaagggccctcccaaggaaacataaacttatttttgccttgttttccttttaccgaagtattgtactccatactgataatttctcgactagacgaggcaagattctggtattagcttttctggttgatgtggattatgaaaaaagattatcggtttgtatttgactatgtattgctctttcatactttggcatctttgcatcttaatgacttgagtt

SEQ ID NO: 3656 - DNA, 1226 bp, Glycine max
gttttcttcgtctttactcttctcttcacagaagcgtaaaaacaaaaggcttgactagagaaagagagagagagagcttcgaatcgaaactcagaagtagaaaaaaacacaaatcacaatcgctatggctaggtacgaccgagcaatcaccgtgttctcccctgacggccatctcttccaggtcgagtacgccctcgaagccgtccgcaagggcaacgccgccgtcggcgtccgcggcaccgacaatgttgtcctcggcgtcgagaagaaatccaccgccaaactccaagactccaggtcggtgaggaagatagtgaatctggacgaccacattgcgctggcctgcgcggggctgaaggccgacgcacgcgtgctcataaacagggcacgtgtggagtgccagagtcacaggctcaccgtggaggatcccgtcacggttgagtacataacgcggtacattgcggggctccagcagaagtacacgcagagcggcggcgtgaggccctttgggctttcgactctgattgtcgggtttgatccctacactcactcgccctccctctaccagacggatccctctggcacgttctcggcgtggaaggcgaacgccaccgggaggaactcgaattcgattcgggagttcctggagaagaactataaggacacttctggccaggagactgtcaagttggctattcgcgcattgcttgaagttgttgagagtggagggaagaacatagaagttgcggtgatgactaaggagcagggtctgcgtcaactggaggaagccgaaattgatgccatcgttgctgagatcgaagcggagaaggcagctgcagaggctgctaagaaagcccctcctaaggagacataattttctgttttgtgttatgcgagcattgttcttgctaggtattggctgtactcactgaagctaaaaattgatgccattgtgtctgagattgatgcaaagaaaacggctgctgaggctgcaaagaataccctttctaaggagacatgattttatgttacttttatttagctcgtgaattgttcttgctagatgttggcctaacttaaaatgactgctttattgtttttgggtactgccattagtgttggtcatatttaattgcatgtcattattattgaagttcaattgagtagggtgatacacaacatcttcatagacaggagctggttctttatattgtggccaatacgac

SEQ ID NO: 3657 - DNA, 1150 bp, Fragaria vesca
gtctaataagtcgagaactgcaaatataattgggggcaccgagagagagagaagtcccaaagcaaaaagagagaggagctcacagaaatactagatcacaaggaagaagaagacgacgaagtgagcagaagagtagaaatcagatggcgaggtacgacagggccattacagtcttttcacccgacggtcatctcttccaagtcgagtacgccctcgaagcggtccgcaagggaaacgccgccgtcggcgtccgcggcaccgacaccatcgttcttggcgtcgagaagaagtccaccgccaagcttcaggactccagatcggtgaggaagattgtgaacctggacaatcacattgctctagcctgtgctgggctcaaagcagatgctcgtgtcctgataaacaaggcgagaattgaatgtcaaagccacaggcttactgttgaggatcctgtaacagttgagtatattacgcgttacattgctggtcttcagcaaaagtacacacagagtggtggtgtgaggccattcggtctttcaactttgattgttgggtttgatccatacacgaataaaccagctctttatcagaccgatccttcagggactttctctgcatggaaagctaatgcaactggaaggaactccaactcgataagggaatttctggagaagaactacaaagaaacttctgggcaagagaccataaagcttgcaatccgtgctttgcttgaggttgttgaaagtggagggaagaacatagaagttgctgtcatgacaaaggaccatggtctgcgacaacttgaagaagctgaaattgatgctatcgttgctgacatagaagcagagaaagcagctgctgaggctgcaaagaaaggccctgccagggaatcctgatcttctgtaatgatctttcgcgagttcctctctgatttctagtcaaatgtactccaccttgctgttatttttgagttgtactttgcacttgcttggcttaaactgatcagtactgttggcatttggtatgcctttagaactgctattcatcacagcttatatctttgaatggatttagatttgcttttatgaagtttgaatttgagacgaccaatatatattgtccttcaataatgcatggtaatcaaaagtgtcac

SEQ ID NO: 3658 - DNA, 1518 bp, Solanum lycopersicum
ttaggccaaatcgaagggtctttctaattaataacttaagaaggttagggtgcttggcacggcgtcgttctggaggcaattggcttgtcgcccaagaagtgtgtatttcattcagaagcaattccattttccaaaaaaaacataaaaaggttagagggaagagctttcaacactcaagagatcggaagaaactgaaatcacacagagcccaaatttttcaatagcttttagtactatcagataatggctagatacgacagagcgatcaccgttttctcgccggacggccacttattccaagtggagtacgccatggaagccgtacgcaaaggaaacgccgccgtcggtgtacgtggaactgacactgttgtcctcggcgtcgagaagaagtccactcccaagcttcaagactccaggtcagtaagaaagatagtgaatctagatgatcacattgcgttggcgtgtgctgggctgaaagcagatgcacgagttcttgtgaataaagcacgcattgagtgtcagagtcataggcttacagttgaagatcctgttactgttgagtacataactcgttacattgctggtcttcagcaaaagtacacccaaagtggtggggtgaggccatttggtctatccaccttgattattggttttgacccacacacaggtgtcccctcactttaccaaacagatccatcaggtacattctcagcttggaaagccaatgcgactggtagaaactccaactctactcgggaattcttggagaagaattacaaagaaacatctggccaggaaactgtgaaactagcaatacgtgcattgcttgaagttgttgaaagtggtggaaaaaacatagaagttgctgtgatgacaaaagagcatgggcttaagcaacttgaggaagctgaaattgatgccattgttgctgagatcgaagcagagaaagctgctgcagaagcagccaaaaaggccccaccgaaggaaacctagttgagctgaaatttgttcttaactatccctgaatcctttcttttttcggttcaagccaagtgcagtgttatttgaattttaagattttggtccgtctaaaacttttacctttgttaaaattatgggactaaaaatgtcatgcactcatgcactcgcgatctctgccctacttgtgtgttgcttgatattttaaagttttatcatgttatttggtagttcttgtagtttgaaaatttggttgtgaaatatcgacatttgttactgctcttttctttattctgaaggtatgttgtcgacaaattggtggaactcgagtagaaaagcttgtgtttgaatggtttgccatttggttttgatccacagcctaaatgcagagtatatgcaccgttctgggataaacatttaagccattcctgtagtgtgaaatgttgtggttgcttggtagagtgttagtagcaaaaataatgcgcattagctctatgtattagtggttctttgttagctctatgtattagtggttctttg

SEQ ID NO: 3659 - DNA, 1043 bp, Trigonella foenum-graecum
cttcttcaatttgtgtttgaatcggaaagaagaagaagaagaatatcgaaatggctagatacgacagagcgatcacagttttctctcccgatggtcatctcttccaagtcgagtatgctcttgaagctgtccgtaagggtaacgccgccgtcggtgttcgcggtaccgataacgttgttctcggcgtcgagaagaaatccactgctaagcttcaagattctagatcggtgaggaagattgttaacctagacgatcacattgcgcttgcatgtgctgggctaaaagctgatgcccgtgtcctgataaaccgggcgcgcgttgaatgccagagtcacaggcttactgttgaggatccatgcaccgtggagtatattacccggtacatagcaggtcttcagcagaagtatacacaaagtggtggtgtgcggccatttgggctttcgactttgattgttggctttgatccttacaccggatcaccctctctgtaccaaacagacccttctggtacattttcagcttggaaagctaatgcaactggcagaaactcaaattctatccgtgagtttctagagaagaacttcaaagaaaccgctgggcaggaaactgtgaagttggctatccgagctttgcttgaagttgttgagagtggtggcaagaacattgaagttgctgtgatgactaaggagcacggtttgcgtcaactggaggaagctgaaattgacgccattgtcgccgaaattgaagcagagaaagcagctgctgaggctgcaaagaaggctcctcagaaggatacatgattttagatttttcttttgtattacttaagcatcgttcttgtaggtgttggctctacttattgtaagcaaaaattgatgccatcatatctgagattgaaacacaaaaaagactaaggctacacaagaaatcctgagacatgattttctttatatttgtttagatcgtgaattgttcttgctgggtgttggcctaacttaaaatgacttctttaattgtttttgggtcatgtaatgtagtctttt

SEQ ID NO: 3660 - DNA, 1147 bp, Cichorium intybus
cagaaggagcccttcactaccccccaaataccactgggttgtcaaagccgaagatcaaagttcaaaccagaaattcaaattcatatacaaaaccttgaaacctcatagattccgatcagcaatggcgagatacgacagagctataacggtgttctctccggacggtcacctctttcaagtcgaatacgcccttgaagcggtacgtaagggtaacgccgcggtcggtgttcgtggcaccgataacattgtacttggcgtcgaaaagaagtcaaccgtcaaacttcaggactccagatcggttaggaagatcgtaagcctagatgatcacatcgcattagcctgtgctggacttaaagcagatgctcgtgttctcataaacagggcacgaatcgagtgccaaagccatagactcaccgttgaagatccagtaactgtagagtacatcacaagatacatcgcaggtcttcaacagaaatacacacaaagtggcggtgtcagaccatttgggctttcaactttaatcgtaggattcgatccttatactggtgttccatcactataccaaacagatccttcaggaacattttctgcttggaaagctaacgccactggtagaaactccaattccatgagagaatttctggaaaagaattacaaagaaacttctggccaagaaactatcaaacttgccattcgtgctttgcttgaagtggttgagagtggtgggaagaatattgaagttgctgtaatgacaaaggagggacttaagcaacttgaggaaggtgagattgacgccattgttgcagagattgaagcagaaaaagctgctgctgaagctgcaaagaaagctcctgttaaacaatcataatattttcatcactcatcatccatccccacacacaaataattcttttttcttggagttcattgagacatctatgtagcttttggattatgttaattggatattatcattgaagaagttttgttaaaattgtgatgtgatttgctagcaaagaggccaataggggcttttatttacaaaaatatcccaaacagagtttgaaattgggtaattcctaatacatgaattccatctacactacttatgattacctaataataataagatttgtgtctttgatgc

SEQ ID NO: 3661 - DNA, 1104 bp, Chrysanthemum coronarium
tgctccagaagacagatcccccattaaaaccaaacacttttctcaccattttcactatcaaaaacctaaatcaaatcgaaaaccttaaccgtaataatctgataatcatcagtaattaatggcgagatacgacagagctattactgtattttcaccggatggtcatttgttccaagtcgaatacgctttggaagctgtccgaaaaggtaacgctgctgtcggtgttcgcggtaccgataacgttgtcctcggtgtcgagaagaagtccactgttaagcttcaagactctagatcagttaggaaaattgtaaacctggatgatcatgttgcactggcttgtgctggacttaaagcagatgctcgtgttcttattaacaaggcaaggatcgagtgccagagccataagcttactgttgaggatccagtaactgtagagtatatcacacgttacattgcagctcttcaacagaaatacacccaaagtggtggagtcaggccgttcgggctgtcaaccctaatcgtaggatttgatccttatactagtgttccatcattatatcagactgatccttcaggaacattttctgcgtggaaagctaatgccactggcaggaactccaattccatgagggaatttttggagaaaaattataaggagacctctggtcaagaaactatcaagcttaccatccgagctttgcttgaagtcgttgagagtggagggaagaacatagaagttgctgtcatgacaaaggagggactccgacaactcgaggaagctgaaattgatactattgttgcagagattgaagctgaaaaagcagctgccgaagctgcaaagaagggtcctgctaaggaatgatgtgctaaaccacattccctttttgcttacttggttttattgttgttttcttagatcttgtcagtctgaccttttcaagatatgtatgtcctgtgaagtcttttagcatgtcatggtatggtagttccaaggaatttgtttcatttaaggaacttaaatatgtgcatcaagcgaatcttatccccaccatttgctttggtgtttgatgaaacttgccgagtgtttttctatatcatcattgt

SEQ ID NO: 3662 - DNA, 924 bp, Trifolium pratense
aatggctagatacgatcgagcaatcacagttttctcccccgatggccatcttttccaggtcgaatacgctcttgaagctgttcgtaaaggtaacgctgccgtcggtgttcgcggtactgataacgttgttcttggcgtcgagaagaaatccgccgccaaactccaagactctagatcggtcaggaagattgttaatctagacaatcacattgcacttgcctgtgccggattaaaagctgatgcacgtgtacttataaaccgtgcccgagtggaatgccagagtcataggcttacggtagaggatccctgcactgttgagtatataactcgatacattgcaggtcttcaacagaagtacacacagagtggcggtgtccgtccctttggtctttctaccttgattgttggctttgatccttacactggctcaccctccctctaccaaactgacccttctggtacattctcagcatggaaagccaatgctaccggaagaaactctaattcaatccgcgagtttcttgaaaagaacttcaaagaaactgctggccaggaaaccgtcaaattggccatccgggctttgcttgaggttgttgagagtggaggaaagaacattgaagttgccgtgatgaccaaggaggatggactgcggcaattagaggaagctgaaattgatgcaattgtggctgagattgaagcagagaaagcagctgctgaggctgcaaagaaagctcctcccaaggatacatgattctagatttttacgaagcatcattcttgttaggtgttggctctacctattgtaatctataatttgccatcatatctgagattgaaacacaaaagagagctgctgatgctacacaagaactgctgtttttctatatttgtttatctctgtgaattgttgttcttgttgagtgt

SEQ ID NO: 3663 - DNA, 1052 bp, Cocos nucifera
atcggccgtcccagaaatccgggatacccagttcagcatagccggtgtgatatcgggttcagcatatccagccccttttgcttcctcctacccgatctgcttagtcccctccttcttgctctcgccgcgagaaacaaatcacgcggagtaacagagaaagcaacccgaaggaaccgcagtagagaagaagaagaaaaggaatcgtcaccgccatggcgcgatacgaccgcgcaatcacggtcttctcccctgatggccatctgttccaggtggagtacgccctcgaggccgtccgcaagggcaacgccgccgtcggcgtccgcggcaccgacaccatcgtcctcggcgtggagaagaagtccacccccaagcttcaggactccagatcggtgcgaaagatcgtgagcctggacaaccacatcgctctggcttgcgcggggctgaaagccgacgcgcggatcctcatcaatcgggcccgcatcgagtgccagagccaccgcctaacggtggaggaccctgtcaccgtcgagtacatcacgcgctacatcgccgggctccagcagaagtacacccagagcggcggcgtcaggcccttcggcctctcgaccctcatcgttggcttcgatccctataccggggtgcccgcgctctaccagaccgatccctcggggacattctctgcctggaaggccaatgccactgggaggaactccaactccatgagggagttcttggagaagaactacaaggagacaacggggcaggagacggtgaaattggccatccgagcgctgcttgaggttgttgagagtggaggaaagaatatagaaattgctgtgatgatgagagagcagggtcttcgtcaactcgatgaagctgaaattgatgctattgttgctgagatcgaggcagagaaagctgcggctgaggctgctaagaaggcgccttctaaggaaacttgatgtcggatgtttccataaatcccaggattttgttgttttctcggttgcttgttcgttatatctcaaaaccagtttgttttttatttggtg

SEQ ID NO: 3664 - DNA, 965 bp, Ambrosia trifida
tcaaacctaaactttctaatcagaaaacaaaaccctaaaaatcaccaacaaacaatctaatggctcgatacgacagagctatcacagtcttctctccagacggtcacctcttccaagtcgaatacgcattggaagctgtacgcaaaggtaacgctgccgtcggtgtccgtggtaccgacaccatcgtccttggtgtcgagaagaagtccactgttaaacttcaggactctagatcagttaggaaaattgtaagtttggatgatcacattgcattggcttgtgctggacttaaagctgatgcacgtgttcttattaaccgggcacgaattgagtgccagagccataggcttactgttgaggatccagtaactgtagagtatatcacgcgttacattgcaggtcttcaacagaaatacacacaaagtggtggtgtcaggccatttgggctttcaactctgatcgtaggatttgatccttatactggtgttccatcattatatcagacagatccttctggaacattttctgcttggaaagctaatgctactggtaggaactctaattccatgagggaatttctggaaaagaattacaaagagacttctggtcaagaaactataaaacttgccatccgtgctctgcttgaagttgttgagagtggagggaagaacatagaagttgctgtgatgacaaaggagggactgaggcaacttgatgaagctgaaatcgatgccatcgttgcagagattgaagcagagaaagcagctgccgaggctgcaaagaaggctcctgcaactaaggaaacataatatgtcaaagatttaccccttttctcgcctggtattattgttgttttcttcagtttgacctttgcaatacatgtatgtctattgtcttgttcttttaccagtcagtatggtagttttatggactcgttgaagtaatttatgcttttgatcgaatct

SEQ ID NO: 3665 - DNA, 1007 bp, Ambrosia trifida
tattaacaacaccactctgcatactttcgtctccgaatcaaaccaaatacagaaaacaaaaccctaataaaaatcaccaacaaacgatctaatggctcgatacgacagagctatcacagtattctctcctgacggtcacctcttccaagtcgaatacgcattggaagccgtgcgcaaaggtaacgccgccgtcggtgtccgtggcaccgacaccatcgtccttggtgtcgaaaagaagtccactgttaaacttcaggactccagatcagttaggaaaattgtaagtttggatgatcacattgcattggcatgtgctggacttaaagctgatgcacgtgttcttattaaccgggcacgaattgagtgccagagccataggcttactgttgaggatccagtaactgtagagtatatcacgcgttacattgcaggtcttcaacagaaatacacacaaagtggtggtgtcaggccatttgggctttcaactctgatcgtaggatttgatccttatactggtgttccatcattatatcagacagatccttccggaacattttctgcatggaaagccaatgctactggtaggaactctaattccatgagggaatttctggaaaagaattacaaagagacatctggtcaagaaactatcaaacttgccatccgtgctctgcttgaagttgttgagagtggagggaagaacatagaagttgctgtgatgacaaaggagggactgaggcaacttgatgaagctgaaatcgatgctatcgttgcagagattgaagcagagaaagcagctgctgaggctgcaaagaaggctcctgcatctaaggaaacataatatgtcaaagatttaccccttttctcgcctggtattattgttgttttcttcggtttgacctttggaatacatgtatgtctattggcttgttcttttaccagtcagtatggtagttttatggactcattgaagtaatttatgcttttgatcgaatctatcacccttc

SEQ ID NO: 3666 - DNA, 1020 bp, Malus domestica
atcgtcagttggtcacttggaaagaaagctccccaaaacagaagacaccagctcgcacgaaaaagcccagatcagaagaaggaagacgaagaaagaagcagaagcagcagtagagagatggcgaggtacgacagagccattaccgtgttctctccagacggtcatctcttccaagtcgagtacgccctcgaggccgtccgtaagggtaacgccgccgtcggcgtccgcggcaccgacaccatcgttctcggcgtcgagaagaagtccaccgccaagctccaggactccagatcagtgaggaagattgtgaacctggataatcacattgctctagcctgcgctggtctcaaagcagatgctcgtgtgttgataaacaaggcacggattgaatgtcaaagccacaggcttactgtcgaggatccagtgaccgttgagtacataacgcgttacattgctggtcttcagcaaaagtacacacaaagtggtggtgtgagaccatttggtctttcaactttgattgtcggatttgatccgtacacagattcaccatcactatatcagacagatccttctgggactttttcagcatggaaagcaaatgcaactggaagaaactccaattcgataagggagtttctggagaagaactacaaagaaacttctgggcaagaaactgtaaagcttgcaatccgggctttgcttgaggttgtcgagagtggaggaaaaaacatagaagttgctgtgatgacaaaggatcatggtctgaagcaacttgaagaagctgaaattgatgccattgttgctgacatagaagcagagaaagcagctgctgaggccgctaagaagggaccacccagggagacatgatcttacatattttccttttgcaactttaatttaccagttgtggttgatggactccgccttgctcttcttttggagttgtactttgcacttgatttggttaaaactgatttctacagcttatatcttcaaatggattgagatttgcttgttcaa

SEQ ID NO: 3667 - DNA, 853 bp, Arnica chamissonis
caagtacaaaacctagaaatctcatcgattataatcatcaatggcgagatacgacagagctataacggtgttctctccggacggtcatctcttccaagttgaatacgcccttgaagccgtacgtaagggtaacgccgccgtcggtgttcgtggcaccgataccatcgttctcggcgtcgagaagaagtctaccgtcaaacttcaagactccagatcagttaggaagattgtaagcctagatgatcatattgcattggcctgtgctggacttaaagcagatgcccgagttctcataaaccgggcacgaattgagtgccagagccatcggcttactgttgaggatccggtgaccgtagagtatatcactcgttatatcgcaggtcttcaacaaaaatacacacaaagtggcggtgttaggccgtttgggctttcaactttaattgttggatttgatccttatacgggtgttccatcactatatcaaacagacccgtcaggtacattttcagcatggaaagctaatgctactggtagaaactctaattccatgagggaatttcttgaaaagaactacaaagaaacctctggccaagaaactgttaaactcgccattcgtgctctgctagaagttgttgagagtggggggaagaacattgaagttggtgtgatgacaaaggagggactgaagcaacttgaggaaggtgagattgatacaattgttgcagagattgaagctgaaaaagctgctgcagaggctgcaaagaaaccacctcctaaagaaacataacttgtcacccatcaattccaaataatgtatttcttagacatgttgacttcaaattgatttgagaca

SEQ ID NO: 3668 - DNA, 928 bp, Brassica oleracea
ggaagctcattttgtgcccattcagtgaaaagtgaaaacgaaagcaaagtatcggagaaggcgagagagatggctagatacgatcgagcaattacagtcttctcccccgacggccacctctttcaagtcgagtacgcccttgaagccgtccgcaagggcaacgccgccgtcggtgtccgcggccccgataccgtcgtcctcgccgtggagaagaaatctacacccaagcttcaggattctaggtcagccagaaaaattgtgagccttgacaatcacgttgccttggcgtgcgctgggctcaaggcagatgcacgtgtgttgattaacaaggcgaggattgagtgtcaaagccacaggcttacacttgaggaccctgtcactgttgagtacatcacccgctacattgccggccttcaacagaagtatacccaaagcggtggtgtcagaccctttggtctttctactcttatcgtcggctttgacccttactctcgtgtcccttcgctctatcagactgatccatctggaactttctctgcttggaaagctaatgctaccgggagaaactccaactctattagggaatttcttgagaagaacttcaaagaaacctctggccaagagactgttaaactcgctatccgtgctctgcttgaggttgttgagagcggaggaaagaacattgaggtagctgtgatgacacgggaggaaagcggtcttcgccagcttgaagaagctgaaattgatgctattgtggccgagatcgaagcagaaaaggcagccgctgaagcagccaagaaaggccctcaaaaggatacttgatattatctccacttcagtttgtctactttttgatgtttgtggttccaagacctctgttacacaacattcagcagctatttcttgcttttcgatagttatctcgacg

SEQ ID NO: 3669 - DNA, 1151 bp, Phaseolus vulgaris
ggttttcttcttcttcactctattcagcgaagcgaaaaagcttgaatagaggagcacagagagaggtagcaatcccaactcagaagtaaaacaaagtaccaaacacaaagcacagcacaatggccaggtacgatcgagcaatcaccgtcttctcccccgacggccacctcttccaggtcgagtacgccctcgaagccgtccgcaaaggtaacgccgccgtcggcgtccgaggcaccgacaacgtcgtcctcggagtcgagaagaaatccaccgctaaactccaagactccaggacggtgaggaagattgtgaatcttgatgatcacattgcgcttgcctgcgcggggctaaaggccgacgcacgtgtgctcataaaccgggcacgtgtggagtgtcagagtcacaggctcaccgttgaggatcccgttactgttgaatatatcacccgttacattgcggggcttcagcagaagtacacgcagagtggtggtgtgcgcccctttgggctttccaccctcattgttgggtttgatccctacactggctcgccctcactgtaccaaacggacccttctggcacgttttccgcgtggaaggcgaacgcgaccggccgaaactcgaattcgattcgggagtttctggagaagaattacaaggagacctctgggcaggagactgtgaaattggctattcgtgcattgcttgaagttgttgagagtggagggaagaatatagaagttgctgtgatgacaaaggagcatggtctgcgtcaactggaggaagctgaaattgatgccatcgttgctgagatcgaagtggagaaagcagctgctgaggctgcgaagaaagcccctccgaaggagacatgattttctgtttagtgagcagtgttcttgctaggttgtggctgtactcactgaagctaaaattgatgccattgtgtctaagattgaaacagagaaaacggggttgttgaggctgcaaagaataccctttctaaagagacatggtttatgttacttttctttaactcatgaattgttcttgctagatgttggcctaacttaaaattgaatgatttactgtttttgggcattgccgtataatatagtattggtcaaattaattgcatgtcattattattcaagttc

SEQ ID NO: 3670 - DNA, 1031 bp, Theobroma cacao
gtcgcttaagttgacgccaactgaaaagaaaagcttcagcgactctgcgatagcaaaagcaaatccaaggaaatggcgaggtacgacagagcgatcactgtgttctcgccggacggtcatttgttccaagtggaatatgctcttgaagcagtccgcaaaggtaacgccgccgtcggagtccgcggcaccgacatcgtcgtgctcggtgtcgagaaaaaatccaccgccaagctccaggactctagaaccgttaggaagattgtgaacttggatgatcacattgcattggcatgtgctggactcaaagcagatgctcgcgtcctcataaatagggctcggattgagtgtcaaagccacaggctaactgttgaagatccagttactgtcgagtatatcactcgatacattgcaggacttcagcagaagtatactcaaagtggaggtgttaggccgtttggtctctcaactctgattgtgggctttgatccatatactggtataccgtcactttatcagacagatccatcagggacattttccgcttggaaagctaatgcaactgggagaaactctaactcaattagagagtttctagagaagaactataaggaaacctctggacaagaaaccattaagcttgcaattcgtgctttgctcgaggttgttgagagtgggggaaagaacatcgaagttgctgtgatgacaaaggagcatggtctgcggcagcttgatgaagctgaaattgatgccattgcagctgagattgaagcagagaaggcagcagctgaggctgcaaagaaggcgcctccaaaagaaacatgaaacagcaactgttgacatccgtttacttttctctccttttttctttttaggggggattgcttggggtgcctattgatgtattcagcctcacactttcacccgtttgagcttcattatacacatcatggagttatcatccattgttggcattttatttgcttttagatatttaaattatgaattttcaacactttcccagaggttgaagc

SEQ ID NO: 3671 - DNA, 891 bp, Centaurea maculosa
aaacacaaaacctagaaatcttcactgaatctgttcatcaatggcgagatacgacagagctatcacggtgttctctccagacggccatcttttccaggtcgaatacgcacttgaagccgtacgcaagggcaacgccgccgtcggtgttcgtggcaccgataccatcgtattaggcgtcgagaagaagtccaccgtcaagcttcaggactccagatcagttaggaagattgtaagcctagatgatcacattgcactggcttgtgctggacttaaagcagatgcccgggttcttataaacagggcaaggatcgagtgccagagccataggcttactgttgaggacccggtgactgtagagtatatcacacgatacattgcaggtcttcaacagaaatacacacaaagtggtggtgttaggccatttgggctttcaactttaattgtagggtttgatccttatactggtgttccatcactatatcagacagatccttcagggacattctctgcttggaaagcgaatgccactggtaggaactccaattccatgagggaatttttggaaaaaaactacaaagaaacctctgggcaagaaactatcaaacttgctgttcgtgctctgcttgaagtggttgagagcggagggaagaacattgaagtggctgtgatgacaaaggagggacttcggcaacttgaggaagcggagatcgatgccattgttgcggagattgaagcagagaaagctgctgcagaggctgcaaagaaagctcctgctgctaaacagacataaatgttacattgtcactgccaaataattcttttcttcagttagacctttttgtatgtggcttttagactttatttaccagtgttatgaaaagtgttttagtt

SEQ ID NO: 3672 - DNA, 866 bp, Cirsium arvense
atggcgagatacgacagagctatcacggtgttctctccagacggccatcttttccaggtcgaatacgcacttgaagccgtacgcaagggcaacgccgccgtcggtgttcgcggcaccgataccatcgtattaggcgtcgagaagaagtccaccgtcaagcttcaggactccagatcagttaggaagattgtaagcctagatgatcacattgcattggcttgtgctggacttaaagcagatgcccgtgttcttattaacagggcacggatcgagtgccagagccataggcttactgttgaggacccagtcactgtagagtatatcacacgatacattgcaggtcttcaacagaaatacacacagagtggtggtgttaggccatttgggctttcaactttaattgtagggtttgatccttatactggagttccatcgctatatcagacagatccttcagggacattctctgcttggaaagctaatgccactggtaggaactccaattccatgagggagtttttggagaagaactacaaagaaacatctgggcaagaaactatcaaacttgccgttcgtgctctgcttgaagtggttgagagcggagggaagaacattgaagtggctgtgatgacaaaggagggacttcggcaacttgaggaagcggagatcgatgccattgttgcggagattgaagcagagaaagctgctgcagaggctgcaaagaaagctcctgctgctaaacagacataaatgttatattgtcactgccaaataattcttttcttcagttagaccttcttgatgtggcttttagactttatttaccagtgttatgaagagtgttttagttacatacttgttttatg

SEQ ID NO: 3673 - DNA, 1052 bp, Cirsium arvense
atcccccaaatagcatttagctctctccaatttaagagacagaaagaagaagatcaacaaatttcaaatcacaaaagttcaaattcaaacacaaaacctagaaatcttcactgaatctgttcatcaatggcgagatacgacagagctatcacggtgttctctccagacggccatcttttccaggtcgaatacgcacttgaagccgtacgcaagggcaacgccgccgtcggtgttcgtggcaccgacaccatcgtattaggcgtcgagaagaagtccaccgtcaagcttcaggactccagatcagttaggaagattgtaagcctagatgatcacattgcactggcttgtgctggacttaaagcagatgcccgtgttcttataaacagggcaaggatcgagtgccagagccataggcttactgttgaggacccagtgactgtagagtatatcacacgatacattgcaggtcttcaacagaaatacacacaaagtggtggtgttaggccatttgggctttcaactttaattgtagggtttgatccttatactggtgttccatcactatatcagacagatccttcagggacattctctgcttggaaagcgaatgccactggtaggaactccaattccatgagggaatttttggaaaaaaactacaaagaaacctctgggcaagaaactatcaaacttgctgttcgtgctctgcttgaagtggttgagagcggagggaagaacattgaagtggctgtgatgacaaaggagggacttcggcaacttgaggaagcggagatcgatgccattgttgctgagattgaagcagagaaagctgctgcagaggctgcaaagaaagctcctgctgctaaacagacataaatgttatattgtcactgccaaataattattttcttcagttggacctttttgatgtggcttttagactttatttaccagtgttatgaagagtgttttagttacatacttgttttatgcatctatgaagagttggttctactctttggagtacaaaaaagaaaaaagtaccgactgcg

SEQ ID NO: 3674 - DNA, 1038 bp, Echinacea purpurea
ttgtcttgcaaaagaaggcagaagcatccttcattacccccagggtgcattttcaaacccaaaaattttgcaccagaactttaaactcaactacaaaccctagaaatctcatcaatggcgagatacgacagagcaattacggtgttctctcctgacggtcacctctttcaggttgaatacgcccttgaagccgtacgaaagggtaacgccgctgtcggtgttcgcggcaccgataccatcgttctcggcgtcgagaaaaagtctaccgtcaaacttcaagactcaagatcagttaggaagattgtaagcctagatgatcacattgcgttggcctgcgctggactcaaagcagatgcgcgtgttctcataaaccgagcacgaattgagtgccagagccatcggctcactgttgaggatcctgtgaccgtagagtacatcacgcgttacattgcaggtctgcaacaaaaatacacacaaagtggtggtgtgaggccattcgggctttcaactttgatagtggggtttgatccttatacgggtgttccatcactatatcaaactgacccgtctggtacgttttctgcatggaaagctaatgctacaggtagaaactctaattccatgagagagtttcttgaaaagaattacaaagaaacctctggccaagaaactgttaaactcgctattcgtgctctattggaagttgttgagagtgggggaaagaacattgaagttggtgtgatgacaaaggagggactgaagcaactagaggaagctgagattgacacaattgttgcagagattgaagctgaaaaggctgctgcagaggctgcaaagaaacctccttctaaggaaacataatttgtcaccccatcaattcaaataattattgtgtaaaaaatattcagtttaagtgatttgatactggtatgtggcttattgcattgtttatgcaattttgactgtgttgtgccttgtgaaagtgttatatttaagtggattaggtaatgggtcaaaacatgttatttgctatgtgtg

SEQ ID NO: 3675 - DNA, 1548 bp, Echinacea purpurea
cggccggggggttcatttggagattttgagtaaggttaaggtggtaaaggggacaatttcaaaatctcaaggtctgttttgcttcttttccaattgagttttcttgctcccaaagtcgagagatcccccattattaagagctctgcaatttttggtctcgaatcaaacctaatcgaataccaaaacctgaatctccagtaccatctcatcttccaatggcgagatacgacagagctatcacggtgttctcgccggacggtcacctcttccaagtcgaatacgccttggaagccgtacgcaagggtaacgccgccgtcggtgttcgcggaaccgacaccatcgtcctcggtgtcgagaagaagtccaccgttaaacttcaagactccagatcagttaggaaaattgtaagtttggatgatcacattgccttggcttgtgctggacttaaagctgacgcacgtgttcttattaacagggcacgaattgagtgccagagccataggcttactgttgaggatccagtaactgtagagtatatcacgcgttacattgcaggtctccaacagaaatacacacaaagtggtggtgtcaggccgtttggcctttcaaccctgattgtaggatttgacccttatactggtgttccatcattatatcagaccgatccttctggaacattttctgcttggaaagctaacgctactggtaggaactccaattccatgagggagtttctggaaaagaattacaaagagacttctggtcaagaaactataaaacttgccatccgtgctctgcttgaagtggttgagagtggagggaaaaacatagaagttgctgtgatgacaaaggagggactgaggcaacttgatgaagctgaaatcgatgccattgttgcagagattgaagcagagaaggcagctgccgaggctgcaaagaaggctcctgcagttaaggaaacataatgtgtcaaagatagacccttctttcaccttgttttattgttgtctgtttcagtttggccattgcaatacatgtttgtcgattgacttgttcatttaccagttgtatggtagttttctgggactcgtatgaagtaatctatgctttttaccgaatctatcacccttgtagacagtctcttctggtttgtgcatcagatgatgcttgatgaaacttctgtggtttggaccagcaagacggttttgatgggcattagttctgtgatctaagcattttatgctttttatgtggtgtctgaatttaaggcttgcccggggttcgacctttggcttgggttcaacagacttttgagtcttgactcgtgattttgtggaaccttgcacaggccataatcgggacagtggtaattggtgtgccggttaaagccaacaaaccagaggtgagggtctagtattctagtcttataagaggtgttcgagcccaaaccaaaagactgggtttatcaaagttggtttgtataaatttgtttagcctacgttaaattaatgctgaaagtgggttgggtatgaaaaagatttagttagc

SEQ ID NO: 3676 - DNA, 974 bp, Eschscholzia californica
ccttcctagtcaagaaaaacaaacaagcagttaggtttagatcgatcagagaagaaagagaaaatggcgagatacgatcgtgcgattacagttttctctccagatggtcatctctttcaagtagaatacgccctagaagccgttcggaaaggtaacgccgccgtcggtgttagaggaaccgatactatcgtccttggtgttgagaagaagtccactgccaaacttcaagactctagatcagttaggaagattgttaacctagataaccacatagcactggcatgtgctggtctaaaagctgatgcacgagttttgataaacaaagcaaggattgaatgtcaaagccatagattaacagttgaagatcctgttactgttgaatatatcacacgctatattgcgggtcttcagcagaagtatacacaaagtggtggtgtgagaccatttggtctttcaactttgattgtgggttttgacccttacaccgatgttccatctctttatcagaccgatccctcgggtactttttcagcgtggaaagctaatgcaacagggagaaactccaactctatgagagagtttttggagaaaaactacaaagaaacttctggaccagaaactgtaaagcttgctatccgtgctttgcttgaggtcgttgagagtgggggaaagaacatagaaatagcagtgatgacaaaagagcacgggttacgtcaacttgaagaatccgaaattgacaccattgttgcagagattgaagcagaaaaagcagcagcagaagctgcaaagaaaggtcctgcttccaaggaaacctaattccccacaagtaacttatccaacttatgaaacaaaaaatcctggttaagtactggtaatgaatctaccaattgtcgtttcaccttcctttggatttttctgatcgcccgtgtttagaagtaaaacttgatatctttctatgtttttgtatgaaactc

SEQ ID NO: 3677 - DNA, 1034 bp, Eschscholzia californica
agagagagaaagatacaatggcaagatacgaccgtgccatcactgttttctcaccggatggacatcttttccaagttgaatatgctctcgaggctgtacggaagggcaacgccgccgtcggtgttagaggcaccgatactatcgttctcggtgtcgagaagaaatccacagctaaacttcaagattctagatcagtgagaaagattgtcaacctggataatcacatagcattggcctgtgctgggctaaaagcagatgctcgtgttttgataaacaaggcaaggattgaatgccaaagccatagactcacagttgaggatcccgtaactgttgaatatatcacacgctatattgccggccttcagcagaagtatacacaaagtggtggtgtgagaccatttggtctttcaactttgattgtgggctttgacccctacactgatgttccgtcactatatcaaacagatccctcggggacattttcagcttggaaggctaatgcaacagggagaaattccaactctatgcgagagtttttggagaaaaactataaggaaacttctggacaagaaactataaagctaactattcgtgcattgcttgaggtcgtcgagagtggcggaaagaacatagagatagctgtgatgacaaaagaacacggattacgtcaacttgaagaatctgaaatcgatgccattgttgccgaaattgaagctgaaaaagcagcagcagaggctgcaaagaaagcccctgctcccaaagaaacctaattcaaaccctagatttccttgtcaacaaatcaatagtcctgaactaagttttggtagttgttcaacaatacctggattgggttttcagattgattttgcatttaccaagcaaaactatggtttcagtgatacaatttgaaagtggaatgatctttttccgtgtttaaggttgaaactgaattttacgttcacttctatttggaaattattatagcaaaaaaaaaaagtaagtggagggcgacgacgacacagggtaggtagtag

SEQ ID NO: 3678 - DNA, 973 bp, Flaveria ramosissima
ctcccaaagtcgagagatcccccattgttgttattagtaagctctgcaattttggtgttggatcaaacctaaaacttcatacaaaaggttgaatcttcagtagaatctgatatcattatctgatggcgagatacgacagagctatcacggtgttctcgccggacggacacctgtttcaggtggaatacgcattggaagccgtacgtaagggtaacgctgccgtcggtgttcgtggcaccgacaccatcgtccttggggtcgagaagaagtccaccgttaaacttcaagactcgagatcagttaggaaaattgtaagtgtggatgatcacattgcattggcttgtgctggacttaaagctgatgcacgtgttcttattaatagggcacgaattgagtgccagagccataggcttactgttgaggatccagtaactgtagagtatatcacgcgttacattgcaggtcttcaacagaaatacacacaaagtggtggtgtcaggccatttgggctttcaactctaattgtaggatttgatccttatactggtgttccatcattatatcagacggatccttcaggaacattttctgcttggaaagctaatgctactggcaggaactccaattccatgagggaatttcttgaaaagaattacaaagagacctctggtcaagaaaccataaaacttgccatccgtgctctgcttgaagttgttgagagtggagggaagaacatagaagttgctgtgatgacaaaggagggactgaggcaacttgatgaagctgaaattgatgccattgttgcagagattgaagcagaaaaagcagctgccgaggctgccaaaaaggctcctgctaaggaaacataatgcgtcaaagatcgaccccttctcacacctggttttattgttgtcttcagtttacatgtatgtctgtttgcttgtctgttaccagtcgtatggtaggtttatgg

SEQ ID NO: 3679 - DNA, 1194 bp, Panax ginseng
gccttgttgcctaagacgagatcgtcttctcactccctttttagtcttctctctcctctcgcaacacaacactacacagagaaagcagatcaaagaaaaagaatccaccggcagacatataaagagtaaaatggcgagatacgacagagctatcacggtcttttcgccagacggccatctcttccaggttgaatatgcgctcgaagccgtccgtaaaggtaacgccgccgtcggcgttagaggcaccgataccatcgttctcggcgttgagaagaagtctactgtcaagcttcaagactccagatctgtcaggaagattgtaaatctggatgatcacattgctttggcctgtgctggtcttaaagctgatgctcgtgttcttataaacagggcacgcattgagtgtcaaagccataagctaactgttgaagatcctgttactgttgagtatataactcgttacattgctggtcttcaacagaagtacacacaaagtggtggtgttaggccatttggcctttcaactttgattgtgggttttgacccatataccggcgtgccagcactatatcagactgatccttctgggactttttctgcctggaaagctaatgctactgggagaaactccaattcaatgagggagtttttggaaaagaattataaagaaacgtctggccaagaaactataaagcttgctatccgcgcgctgcttgaagttgttgagagtggaggaaagaacatagaagttgctgtcatgacaaaggatcagggtcttcgacagcttgatgaagctgaaattgatgccgttgttgctgagattgaagcagagaaagaggctgcagaggctgcaaagaaaggaccttccagggagacataagcctgattttctttttcccttgttcccattaatggcattccatgtgaacatgtaataatcttgacttatttgagtgttggggcttcttgtgtggtttagatttggaaatatttcaatgatttatgctgttagacaatatatgaacaagtttatttcttatgaaagttggtagcaatcttcttaaacaaaaaaaaaaaaaaaaacaaaaaaaaaaaaaaaaacaaaaaaaaaaaaacaaaaaaaaaaaaacaaaaaaaaaaaacaaaaaaaaaaacaaaaaaaaacaaaaaaacaaaacaaacaacaacaacaac

SEQ ID NO: 3680 - DNA, 1121 bp, Humulus lupulus
cggggggagctgagctttttggagacggaaaactcagagcaccgatctgatcgaacttccaaagagagaaaacgaagacgaagctcaaaccacaaccatggccaggtacgacagggctataaccgtcttttcacctgacggtcatctcttccaggtcgagtacgcgctcgaggccgtgcgtaagggtaacgccgccgtcggcgttcgtggcaccgataccatcgttctcggcgtagaaaagaagtccactgctaaacttcaggactccagaacggtgaggaagattgtgaatttggatgatcacattgcattggcctgtgctgggctcaaagccgatgctcgtgtcttgataaacaaggcgagaattgaatgtcaaagccaccgacttacggttgaggatccagtaactgttgagtatataactcgctacattgctggccttcagcagaagtacacacaaagtggtggtgttagaccgtttgggctttcaactttgattattggctttgacccatacacaggtgcaccggcactatatcagacagatccttcggggactttttcagcctggaaagccaatgccactggaagaaactctaactcattgcgtgagtttcttgagaaaaactacaaggagacagctgggcaagaaaccgtcaagctcgccattcgtgctttgcttgaggttgttgaaagtggcggaaagaacatagaagttgcagttatgacaagggaacaaggtctgcgacaactagaagaagctgaaatcgacgccattgttgctgagatagaagcagagaaagccgccgcagaggctgcaaagaagggtccttcaactaaggaaacatgatttcccatttcaccttgaaattcaccttgctactattactttttatttattttatttttatcatcttttgaactctaaaaatctgcattcccagtcagtgtctttaaaaaacgattactataatcagcatttgatttggctattttggagggagtacttacttactatctagttaaaactgctcctccatacatgttgattcttacatctggattggatatggctttgaaatgatttttatttatgggatatgagtcaaagacaattttca

SEQ ID NO: 3681 - DNA, 1071 bp, Medicago truncatula
cttcagtgaaatctaaaagagaaagagaaagagaaagcttccttcgatttggtttgaatcgtagaagaagaagagaaagaatattacaatggcaagatacgatagagcgatcacagttttctcccccgatggtcatctcttccaagtcgagtacgctctcgaagctgttaggaagggtaacgccgccgtcggtgttcgcggtatcgataacgtcgttctcggcgttgagaagaaatctaccgctaagcttcaagattctaggtctgtgagaaagatcgttaatctagatgatcacattgctcttgcttgtgctgggctaaaagctgatgctcgtgtcttgataaaccgggcacgcgttgaatgccagagtcacagactcaccgttgaagatccatgcaccgtggagtatattacccggcacatagctggtcttcagcagaagtacacacaaagtggtggtgtgcggccatttgggctttccaccttgatcgttggctttgatccttacaccggatctccctctctgtaccagacagatccttctggtacattttcagcatggaaggcaaatgctactggcagaaattcgaattcgatccgtgagtttctagaaaagaattttaaagagacatctggacaggaaactgtgaagttggctatccgagctttgcttgaagttgtcgagagtggtggtaagaacattgaagttgctgtgatgactaaggagcacggtctgcgtcaattggaggaagctgaaattgacgccattgtggctgagattgaagcagagaaagcagctgctgaggctgcaaagaaagctcctcttaaggacacataattttacgtttctttatgtaagcatctgtaggtgttggctctacttattgtaaaagctaaactgatgccaacaaatctgagattgaaacacagaagaactcctgaggctatccaagaaaccctaagacatgattttctttatatttatttagctcgtgaattgttcttgctgggtgacttaaggatgactcctttaattgtttttgggtcatgttattattgtttaagttcgca

SEQ ID NO: 3682 - DNA, 1081 bp, Nicotiana benthamiana
gtttcccaagatctctctgtgctctctttgattgaaccagtagggatcaaaggaacctcaaagtctcaaaccctagctgcacatttcactattaaccaccaaaaatggctagatacgatagagccatcaccgtcttctcgccggacggccatctattccaagtagaatacgctctggaagccgtacgtaaaggtaacgctgccgtcggcgtccgcggtactgataccgttgtccttggcgttgagaagaagtctaccccgaagcttcaggactctaggtcagtaagaaagatagtaaatctggatgatcatattgccttggcctgtgctggcctgaaagcagatgcccgagtgctcgtaaatcgggcacgtattgaatgtcagagtcataggcttacagttgaggatccagttaccgttgagtacataacacgctacattgctggtcttcagcagaagtacactcaaagtggcggtgttaggccatttggtctttcaaccttgataattggttttgatccttacactggtgtcccgtcactttatcaaacagatccatctggaacattctcagcatggaaagccaatgcaacagggagaaactccaactctctccgggagttcttggagaaaaattacaaagaaacatctggccaggaaactgtgaaacttgcaatacgtgctttgctcgaagttgttgagagtggtggaaagaatattgaagttgctgtcatgacaaaggagcatgggcttaagcaactcgaggaagctgagattgatgccattgttgctgagattgaggcagagaaagcagctgcagaagctgcaaaaaaggctcctccaaaagaaacctagttctgccgaaattcttatttgaaaatgtgtctgaacttttattgctctattcaacttgtaaagactgatcctgttgtcagtcgagacctgtattgtggctattttttttggttatattgagagtcgtcatcttctatcactgattgtatactggtcatgaaatgttgcttaagatatgcgcacttgtttacattgcttgatggtttagctatggaatgtagtagttc

SEQ ID NO: 3683 - DNA, 1054 bp, Nicotiana benthamiana
caataccaaaaagcgtaaaataatttcagggaaagagcattcagtagcaacactcagagatcggaagaaacttcaacacacagagcccaaagtttcccgtagcttttacttatagccatggctagatatgatagagcgatcacggtgttctcgccggacggccacctattccaagtggaatacgccctcgaagccgtacgcaaaggtaacgccgccgttggtgtacgtggcactgatactgttgtccttggcgtcgaaaagaagtccactcccaagcttcaggactctaggtctgtaagaaagatagtaaatctagatgatcacattgcattggcctgtgctgggctgaaagcagatgcacgagttcttgttaacagggcacgcattgaatgtcagagtcataggcttactgttgaggatcctgttactgttgagtacataactcgttacattgctggtcttcagcaaaagtacactcaaagtggtggtgtaaggccatttggcctatctaccttgatcattggtttcgacccgtacaccggtgtgcccgcgctttatcaaacagatccatcaggtacattctcagcttggaaagccaatgcaactggtagaaactccaactctcttcgggagtttctggagaagaactacaaagaaacatctggccaggaaactgtgaaactagcaatacgtgctttgcttgaagttgttgaaagtggtggaaagaacatagaagttgctgtaatgacaaaagagcatgggcttaagcaacttgaggaagctgagattgatgccattgttgctgagatcgaggcagagaaagcagctgcagaagctgccaaaaaggcccccaaagaaacctagttctgctgaaattcatatctgaatgtgtttcctgaactttttctttttaatcaaaaagtgttagtgttcgctaaattttaaagttgttgctctgactaatattttgtgcttctaagactgatcttgtactcgggcaagagcaagacatttgataaaattgtttaatggggcaaaagaagtcatcatctgc

SEQ ID NO: 3684 - DNA, 1175 bp, Elaeis guineensis
ccggttcaacatattcaaccccttttccttcctcctacctgatctacaaactcctttccttcttgctctcgccgcaagaaacaaatcatacggaggagtaacagagaaagcaacctgaaggaaccgcagtagagaagaagaagagaaggtatcgtcaccgccatggcgcgatacgaccgcgcaatcacggtcttctcccccgacggccacctgttccaggtggagtacgccctcgaggccgtccgcaagggcaacgccgccgtcggcgtccgaggcaccgacaccatcgtcctcggcgtcgagaagaaggcaacgcccaagctccaggactccagatcggtgaggaagatcgtgagcctggacaatcacatcgctctggcttgcgcggggctgaaggccgacgcgcggatcctcatcaatcgggcccgcatcgagtgccagagccaccgcctaacggtggaggaccctgtcaccgtcgagtacatcacgcgctacatcgccgggctccagcagaagtacacccagagcggcggcgtcaggcccttcggcctctcgaccctcatcgttggctttgatccctacaccggggcgcccgcgctctaccagaccgatccctcggggaccttctctgcctggaaggccaatgccactgggaggaactccaactccatgagggagttcttggagaagaactacaaggagacatccgggcaggagacggtgaaattggccatccgagcgctgcttgaggttgttgagagtggaggaaagaacattgaaattgctgtgatgacgagagagcagggtcttcgtcaacttgatgaagctgaaattgatgctattgttgctgagattgaggcagagaaagctgcagctgaggctgctaagaaggcgccttctaaggaaacttgatgttggatgtttccgtaaatcccaggaatttttttgttctgtcagttgcttgttctttatatctcaaaacctacctttttttttttctggtgagttggatgctggggtaatatgggaaactcataaatcttttactagtcaattcttgttttcctgaacgacatatttttaatatgagatacagaattatgctgccaaaaaaaaaaaaaaaactagaaagaactacgaccaaacggacaacgaacgagggaagtaggaccccc

SEQ ID NO: 3685 - DNA, 1113 bp, Arachis hypogaea
atcacactcaacagaggaatcaacaaattaaaacacaaaacaaagcaaagaaagaagaaacctttttgactcaacaacacagcacaacacagatttgaatcgcaccaccacccatggccaggtacgatagggctatcactgtcttctcgccggacggccacctcttccaggtcgaatacgctctcgaggccgtccgcaagggcaacgccgccgttggagtccgtggcaccgacaacgtcgtgctcggcgtcgagaagaaatccaccgccaagctccaagactccagaacggtgaggaagattgtcaatctggacgatcacattgctcttgcttgtgcaggactaaaagctgatgcacgtgtccttataaacagggcaagagttgaatgtcaaagccataggcttactgtcgaggatccagtgacggtagagtacataactcgttacattgcaggtcttcagcaaaagtacacacaaagtggtggtgttcggccctttggcctttcaaccttgattgttggctttgatccatacactggtacaccatccctgtaccaaacggatccttctggcacattctcagcttggaaagccaatgcaaccggtagaaactcaaattccatccgggagttcctagagaagaactacaaggaagtttctggccaagaaaccataaaattggctatccgagcattgcttgaggtcgttgagagcggaggcaagaacattgaagttgctgtgatgacgaaagagcaaggcttgcgtcaacttgaggaagccgaaatcgatgctattgtggccgagattgaagccgagaaagcagcagctgaggccgcaaagaaagctcctcctaaggagacatgaattttctgtttcttttttgtattatgcgatcaatgttcttactaggtgttggccgtactttagtgaagcaaaaattaaagccactgtggctaatattgaaacaaaagaaaaacagctgctgaggcagcaaagaaagatcgtttgaggagacatttatttacttatgtttttctttttcaatttttctcatgaattgttcttgtaggtgctattggtccaacacaaaatgagtgctttattatttgtgggt

SEQ ID NO: 3686 - DNA, 1040 bp, Arachis hypogaea
acactcaacagaagaatcagcaaattaaaacacaaagcaaagcaaagaaagaagaaacctttttgactaaacaacacagatttgaatcgcaccaccacccatggctaggtacgacagagctatcaccgtcttctcgccggacggccacctcttccaggtcgaatacgctctcgaggccgtccgcaagggcaacgccgccgttggagtccgtggcaccgacaacgtcgtgctcggcgtcgagaagaaatccaccgccaagctccaagactccagaacggtgaggaagattgtcaatctggacgatcacattgctcttgcttgtgcaggactaaaagctgatgcacgtgtccttataaacagggcaagagttgaatgtcaaagccataggcttactgtcgaggatccagtgacggtagagtacataactcgttacattgcaggtcttcagcagaagtacacacaaagtggtggtgttcggccctttggcctttcaaccttgattgttggttttgatccatacactggtacaccatccctgtaccaaacggatccttctggcacattctcagcttggaaagccaacgcaactggtagaaactcaaattccatccgggagttcctagagaagaactacaaggaagtttctggccaagaaaccataaaattggctatccgagcattgcttgaggtcgttgagagcggaggcaagaacattgaagttgctgtgatgacgaaagagcaaggcttgcgtcaacttgaggaagccgaaatcgatgctattgtggccgagattgaagccgagaaagcagcagctgaggccgcaaagaaagctcctcctaaggagacatgaattttctgtttcttttgttttgtattatgcgatcaatgttcttactaggtgttggccgtactttagtgaacaaaatttaaagccactgtggctaatattgaaacaaaagaaaaacagctgctgaggctgcaaagaaagatcgtttgaggagacatttatttacttatgtttttctttttcaatttttctc

SEQ ID NO: 3687 - DNA, 1029 bp, Arachis hypogaea
acactcaacagaagaatcagcaaattaaaacacaaagcaaagcaaagaaagaagaaacctttttgactaaacaacacagatttgaatcgcaccaccacccatggctaggtacgacagagctatcaccgtcttctcgccggacggccacctcttccaggtcgaatacgctctcgaggccgtccgcaagggcaacgccgccgttggagtccgtggcaccgacaacgtcgtgctcggcgtcgagaagaaatccaccgccaagctccaagactccagaacggtgaggaagattgtcaatctggacgatcacattgctcttgcttgtgcaggactaaaagctgatgcacgtgtccttataaacagggcaagagttgaatgtcaaagccataggcttactgtcgaggatccagtgacggtagagtacataactcgttacattgcaggtcttcagcagaagtacacacaaagtggtggtgttcggccctttggcctttcaaccttgattgttggctttgatccatacactggtacaccatccctgtaccaaacggatccttctggcacattctcagcttggaaagccaatgcaaccggtagaaactcaaattccgtccgggagttcctagagaagaactacaaggaagtttctggccaagaaaccataaaattggctatccgagcattgcttgaggtcgttgagagcggaggcaagaacattgaagttgctgtgatgacgaaagagcaaggcttgcgtcaacttgaggaagccgaaatcgatgctattgtggccgagattgaagccgagaaagcagcagctgaggccgcaaagaaagctcctcctaaggagacatgaattttctgtttcttttgttttgtattatgcgatcaatgttcttactaggtgttggccgtactttagtgaagcaaaaattaaagccactgtggctaatattgaaacaaaagaaaaacagctgctgaggctgcaaagaaagatcgtttgaggagacatttatttacttatgtttttctttt

SEQ ID NO: 3688 - DNA, 1264 bp, Cajanus cajan
acacgagtttcttcggctttactctttactcttgagcgaagcgtaaaagcttgaccagagagagagagagagagattcgaatccgaactcagaagtaaaacacagagcagagaatggctaggtacgacagagcaatcaccgtgttctcccccgacggccacctcttccaggtggagtacgctctggaagccgtccgcaaggggaacgccgccgtgggcgtccgcgggtccgacaacgtggtcctcggcgtcgagaagaaatccaccgccaagctccaagactccaggacggtgaggaagattgtgaatctggacgatcacgtggcgctggcgtgcgcggggctgaaggcggacgcacgtgtgctgataaacagggcacgtgtggagtgccagagtcacaggctgaccgtggaggatcccgtgacggttgagtacataacgcgttacatcgctgggcttcagcagaagtacacgcagagtggcggcgtgaggccctttgggctttcgacgctcattgttgggtttgatccctacaccggtgcgccctccctctaccagacggatccttcgggcacgttttccgcgtggaaggccaatgccactgggagaaactccaattcgattcgcgagtttttggagaagaactataaggaaacttctggccaggagactgtcaaattggctatccgtgcgttgctcgaagtggttgagagtggaggcaagaacatagaggttgctgtgatgactaaggagcatggtctgcgtcaactggaagaagctgaaattgatgccatcgtagctgagattgaagcagagaaagcagctgctgaggctgctaaaaaagcccctcccagggagacatgattttctgttgttttacgagagcgttgttcttgctaggtgttggctgttctcactgaagctaaaattgatcccattgtgtctgggattgaaacacagaaaacggctgcaaagaataccctgtttaaggagacatgatttgttacttttgtttagctcgtgaattgttcttgctagatgttggcctaacttaaaatgactgttttattgtttctgggtactgccatatagtattggtcaaattaattgcatgtcattattattcaagttcaaattgagtcgggcgatacaatgcattttcatttgcaagaactagttctttatgctggccaatacgactatggttatgaaatgtatttttatactttaaaagaaagtttatggcgtgtctggagcgaggtagg

SEQ ID NO: 3689 - DNA, 800 bp, Carthamus tinctorius
aagaaatcaattccaatcacaagttcgaattcaaacctagaaacctcattgaatctgttcatcaatggcgagatatgacagagctatcacggtgttctctccagacggccatcttttccaggttgaatacgcccttgaggccgtacgcaagggtaacgccgccgtcggtgttcgtggcaccgataccatcgtattaggcgtcgagaagaagtccaccgtcaagcttcaggactccagatcagttaggaagattgtaagcctagatgatcacattgcactggcttgtgctggacttaaagcagatgcccgtgttcttataaacagggcacggatcgagtgccagagccataggcttacggttgaggacccagtgactgtagagtatatcacacgatacattgcaggtcttcaacagaaatacacacaaagtggtggtgttaggccatttgggctttcaactttaattgtagggtttgatccttatactggtgttccatcactatatcagacagatccttcagggacattctctgcttggaaagctaatgccactggtaggaactccaattccatgagggaatttttggaaaagaactacaaagaaacctctgggcaagaaactatcaaacttgccgttcgtgctctgcttgaagtggttgagagcggagggaagaacattgaagtcgctgtgatgacaaaggagggacttcggcaacttgaggaagccgagatcgatgccattgttgcagagattgaagcagagaaagctgctgcagaggctgcaaagaaagctcctgctg

SEQ ID NO: 3690 - DNA, 938 bp, Helianthus annuus
agaagaatccttgagtacccccagccaggtacattttgaaagtgaaaccagaagttgaatttgaaactacaaatcctccagtcatcaatggcgagatacgacagagctataaccgtcttctctccggacggccacctcttccaggtcgaatacgcccttgaagccgtacgcaaaggtaacgccgccgtcggtgttcgcggcaccgacaccatcgttctcggcgtcgagaagaaatctaccgtcaaacttcaagactctagatcagttaggaagattgtaaccctagatgatcacatagcattggcctgtgctggacttaaagcagacgcgcgtgttctcataaaccgggcgcgaattgagtgccagagccatcggcttactgttgaggatccagtgaccgtggagtacatcactcgttacattgcaggtcttcagcaaaaatacacacagagtggtggtgtgaggccgtttgggctttcaacattgatcgtggggtttgatccttatacaggtgttccggcactgtatcaaacagacccgtctggtacgttttccgcgtggaaagctaatgctactggtagaaactctaattccatgagggagtttcttgaaaagaactacaaagagacctctggacaagaaactgttaaactcgccattcgtgctctgctggaagttgttgagagtggggggaagaacattgaagttggtgtgatgacaaaggagggactgaagcaacttgaggaagctgagattgacacaattgttgcagagattgaagctgaaaaagctgctgcagaggctgcaaagaaagctccttctaaacaaacataatttcatttgtcactccatcaattccaaataattattattttagacattttcagttacaagtgagttgagacatgtatgtggcttttggcagtgtttatgcaatt

SEQ ID NO: 3691 - DNA, 1102 bp, Helianthus annuus
aatccaactacgaaaccctaaatcttcactacaatctcactactaatggcgagatacgacagagctatcacggtgttctcgccggacggtcacctcttccaagttgaatacgcattggaagccgtacgcaaaggtaacgccgccgtcggtgttcgcggaaccgataccatcgttctcggtgtcgagaagaagtccaccgttaaacttcaggactccagatcagttaggaaaattgtaagtttggatgatcacattgcattggcatgtgctggacttaaagctgatgcgcgtgttcttatcaaccgggcacgaattgagtgccagagccataggcttactgttgaggatccagtaactgtagagtatatcacgcgttacattgcaggtcttcaacagaaatacacacaaagtggtggtgtcaggccatttgggctttcaaccctaattgtaggatttgatccttatactggtgttccatcgttatatcagacagatccttccggaacgttctctgcttggaaagctaatgctactggtaggaactctaattccatgagggagtttctggaaaagaattacaaagagacttctggtcaagaaactataaaacttgccatccgtgctctgcttgaagttgttgagagtggagggaagaacatagaagttgctgtgatgacaaaggaaggactgaggcaacttgatgaagctgaaatcgatgccattgttgcagagattgaagcagagaaagcagctgccgaggctgcaaagaaggctcctgcagctaaggaaacatgatgtgtcaaagattgaccccttttctcacatggttttattgttgtttttttttcattttgacctttgcagtacatgtatgtctattggcttgttcgcttaccaatcgtatggtagttttatgaactcgttttaagtaatctatgcttttgatcgaatctatcaccctttcagacagactgttctggtttgtggattagatgaaactactgtggtgaagaccagcaagacgattttgatggcataattatgtgattcaaatattctatgctttctgtgttgtatgaatttaaggtttgcccaaggtttg

SEQ ID NO: 3692 - DNA, 1090 bp, Daucus carota
ctctgaacaaaccaacacagaaaggaaatcaagatggcaagatacgatagagcaatcactgtgttttcaccggacggtcatctgtttcaggttgaatacgcacttgaagccgtccgtaaaggtaacgccgccgtgggcgttagaggtaccgatactatcgttctcggtgtggagaaaaaatccactgtcaaacttcaggactctagatctgtcaggaagattgtaaatctggatgatcacattgctttggcctgtgctgggcttaaagctgatgctcgagtacttattaaccgggcacgtattgaatgccaaagccataagcttactgttgaagatccagttactgtggagtatatcacacgttacatagctggtcttcagcaaaagtatacacagagtggtggtgttaggccatttggtctttcaactttgattgttggattcgacccacacactggtgtgccagcactgtaccagactgatccttcagggaccttttcagcttggaaagctaacgctactgggagaaactccaattcgatgagagaattcttggaaaagaattatacagagacatctggtcaagaaaccctgaaacttgctatccgtgcattacttgaagttgtggagagtggcggaaaaaacatagaagttgcagtcatgacaagggataagggtctccgtcagcttgatgaagctgaaattgacactattgtggcagagattgaagctgagaaggaggctgcagaggctgcaaagaaggggccttccaaggagacttgagtcttcttttctttccccctttcatcaacatttcatatcaaacatgtattcagaacttatgccattatctgttgggactcgtgttttagatgtactatgtcatgtttaagctgttggactagtatgaagcttgcaattgattacctttgttgcagagaatatgatgttaaagatttgtgtcgtaggatgatttatctattggtacctaatgctgaaggcaatgtcatttgttttatcataatagtgagcttatagaaacatcactgtttctttcgaggatcagcctcttgtgggagctgaactccac

SEQ ID NO: 3693 - DNA, 1170 bp, Daucus carota
gggaagttggcttgttgcctaagtcgagatcgaaactctctttatatctctctcgctcccttcatctctccctcaaaatctctctctctgaacaaaccaacacagaaaggaaatcaagatggcaagatacgatagagcaatcactgtgttttcaccggacggtcatctatttcaggttgaatacgcacttgaagccgtccgtaaaggcaacgccgccgtgggcgttagaggtaccgatacaatcgttctcggtgtggagaaaaaatccactgtcaaacttcaggactctagatctgtcaggaagattgtaaatctagatgatcacattgctttggcctgtgctgggcttaaagctgatgctcgagtacttattaaccgggcacgtattgaatgccaaagccataagcttactgttgaagatccagttactgtggagtatatcacacgttacatagctggtcttcagcaaaagtatacacagagtggtggtgttaggccatttggcctttcaactttgattgttggattcgacccacacactggtgtgccagcactgtaccagactgatccttcagggaccttttcagcttggaaagctaacgctactgggagaaactccaattcgatgagagaattcttggaaaagaattatacagagacatctggtcaagaaaccctgaaacttgctatccgtgcattacttgaagttgtggagagtggcggaaaaaacatagaagttgcagtcatgacaagggataagggtctccgtcagctcgatgaagctgaaattgacactattgtggcagagattgaagctgagaaggaggctgcagaggctgcaaagaagggcccttccaaggagacttgagtcttcttttctttccccctttcatcaacatttcatatcaaacatgtattcagaacttatgccattatctgttgggacttgtgttttagatgtactatgtcgtgtttaagctgttggactagtatgaagcttgaaattggttacctttgttgcaggaaatatgatgttaaagatttgtgtcgtaggatgatttatctattggtacctaatgctgaaggcaatgtcatttgttttatcataatagtgagcttatagaaacatatcactgtctcttttgaggatcagcctcttgtgggagccga

SEQ ID NO: 3694 - DNA, 1142 bp, Daucus carota
gaaactctctttataatctctctcgctcccttcctctctccctcaaaatctctctgaacaaaccaacacagaaaggaaatcaagatggcaagatacgatagagcaatcactgtgttttcaccggacggtcatctgtttcaggttgaatacgcacttgaagccgtccgtaaaggtaacgccgccgtgggcgttagaggtaccgatactatcgttctcggtgtggagaaaaaatccactgtcaaacttcaggactctagatctgtcaggaagattgtaaatctagatgatcacattgctttggcctgtgctgggcttaaagctgatgctcgagtacttattaaccgggcacgtattgaatgccaaagccataagcttactgttgaagatccagttaccgtggagtatatcacacgttacatagctggtcttcagcaaaagtatacacagagtggtggtgttaggccatttggcctttcaactttgattgttggattcgacccacacactggtgtgccagcactgtaccagactgatccttcagggaccttttcagcttggaaagctaacgctactgggagaaactccaactccatgagagaattcttggaaaagaattatacagagacatctggtcaagaaaccctgaaacttgctatccgcgcattacttgaagttgtggagagtggcgggaaaaacatagaagttgccgtcatgacaagggataagggtctccgtcagcttgatgaagctgaaattgacactattgtggcagagattgaagctgagaaggaggctgcagaggctgcaaagaagggcccttccaaggagacttgagtcttcttttctttcccccttttatcaacatttcatatcaaacatgtattcagatcttatgccattatctgttgggacttgtgttttagatgtactatgtcgtgtttaagctgttggactagtatgaagcttgcaattggttacctttgttgcaggaaatatgatgttaaagatttgtgtcgtaggatgatttatctattggttgctaatgctgaaggcaaatgtcatttgttttatcataatagtaagcttgtagaaacatcactgtttctttcaaggatcagcctcttgtgggagctgaactccac

SEQ ID NO: 3695 - DNA, 950 bp, Daucus carota
cagaaagcaaatcaagatggcaagatacgatagagcaatcactgtgttttcaccggacggccatctatttcaggttgaatacgcacttgaagccgtccgtaaaggtaacgccgccgtgggcgttagaggtaccgatactatcgttctcggtgtggagaaaaaatccactgtcaaacttcaggactctagatctgtcaggaagattgtaaatctagatgatcacattgctttggcctgtgctgggcttaaagctgatgctcgagtacttattaaccgggcacgtattgaatgccaaagccataagcttactgttgaagatccagttactgtggagtatatcacacgttacatagctggtcttcagcaaaagtatacacagagtggtggtgttaggccatttggcctttcaactttgattgttggattcgacccacacactggtgtgccagcactgtaccagactgatccttcagggaccttttcagcttggaaagctaacgctactgggagaaactccaattcgatgagagaattcttggaaaagaattatacagagacatctggtcaagaaaccctgaaacttgctatccgtgcattacttgaagttgtggagagtggcggaaaaaacatagaagttgcagtcatgacaagggataagggtctccgtcagctcgatgaagctgaaattgacactattgtggcagagattgaagctgagaaggaggctgcagaggctgcaaagaagggcccttttaaggagacttgagtctatttttcttttccccttttatcaacatttcatatcaaacatgtattcagaaattatgccgttatctgttgggacttgtgtttagatgtactatttcatttttaagctgctggactagttttcaaatgatttagtgatgcatataatattgtattctaacaatttaggtagtggagtagcg

SEQ ID NO: 3696 - DNA, 1027 bp, Daucus carota
aacaaatcaacacacaaagggaaccaagatggcaagatacgatagagcaatcactgtcttttcaccggacggtcatctatttcaggttgaatacgcacttgaagccgtccgcaaaggtaacgccgccgtgggcgtcagaggcaccgatactatcgttctcggtgtcgagaaaaaatccactgtcaaacttcaggactcgagatctgtcaggaagattgtaaatctagatgatcacattgctttggcctgtgctgggcttaaagctgatgctcgagtacttattaaccgggcacgtattgaatgccaaagccataagcttactgttgaagatccagttactgtggagtatatcacacgttacatagctggtcttcagcaaaagtatacacagagtggtggtgttaggccatttgggctttcaactttgattgttggattcgacccacacactggtgtgccagcactgtaccagactgatccttcagggaccttttcagcttggaaagctaacgctactgggagaaactccaattcgatgagagaattcttggaaaagaattatacagagacatctggtcaagaaaccctgaaacttgctatccgtgcattacttgaagttgtggagagtggcggaaaaaacatagaagttgcagtcatgacaagggataagggtctccgtcagctcgatgaagctgaaattgacactattgtggcagagattgaagctgagaaggaggctgcagaggctgcaaagaagggcccttccaaggagacttgagtcttcttttctttcccccttttatcaacatttcatatcaaacatgtattcagaacttatgccattatctgttgggacttgtgttttagatgtactactgtcgtgtttaagctgttggactagtatgaagcttgaaattggttacctttgttgcaggaaatatgatgttaaagatttgtgtcgtaggatgatttatctattggtacctaatgctgaaggcaatgtcatttgttttatcataatagtgag

SEQ ID NO: 3697 - DNA, 1033 bp, Daucus carota
aaccaacacagaaagcaaatcaagatggcaagatacgatagagcaatcactgtgttttcaccggatggtcatctatttcaggttgaatacgcacttgaagccgtccgtaaaggtaacgccgccgtgggcgttagaggtaccgatactatcgttctcggtgtggagaaaaaatccactgtcaaacttcaggattctagatctgtcaggaagattgtaaatctagatgatcacattgctttggcctgtgctgggcttaaagctgatgctcgagtacttattaaccgggcacgtattgaatgccaaagccataagcttactgttgaagatccagttactgtggagtatatcacacgttacatagctggtcttcagcaaaagtatacacagagtggtggtgttaggccatttggcctttcaactttgattgttggattcgacccacacactggtgtgccagcactgtaccagactgatccttcagggaccttttcagcttggaaagctaacgctactgggagaaactccaattcgatgagagaattcttggaaaagaattatacagagacatctggtcaagaaaccctgaaacttgctatccgtgcattacttgaagttgtggagagtggcggaaaaaacatagaagttgcagtcatgacaagggataagggtctccgtcagctcgatgaagctgaaattgacactattgtggcagagattgaagctgagaaggaggctgcagaggctgcaaagaagggcccttccaaggagacttgagtcttcttttctttcccccttttatcaacatttcatatcaaacatgtattcagaacttatgccattatctgttgggacttgtgttttagatgtactactgtcgtgtttaagctgttggactagtatgaagcttgaaattggttacctttgttgcaggaaatatgatgttaaagatttgtgtcgtaggatgatttatctattggttgctaatgctgaaggcaaatgtcatttgtttaatcataatagtgagcttatagaa

SEQ ID NO: 3698 - DNA, 932 bp, Castanea mollissima
agaatggcaaggtacgatagagcaataacagttttctcaccagatggccatttgttccaggtcgaatacgccctcgaagccgtccgaaagggcaacgccgccgtcggtgtccgtggtaccgacaccatcgtcctcggcgtcgagaagaaatccaccgccaaactccaagactccagatcagttaggaagattgtgaacctggataatcacattgcactggcctgtgctggactcaaggcagatgctcgtgtcctaataaacaaggcacggattgaatgtcaaagccataggcttacactggaggatccagcaactgttgagtacatcactcgttatatcgctggtcttcagcaaaagtacacacagagtgggggtgtgagaccatttggcctttcaactttgattattggctttgatccctatactggtgctccatcactttatcagacagatccttctgggacattttcagcttggaaggccaatgcaactggaagaaactctaattcgttaagagagtttttggagaaaaactataaagaaacttctggtcaagaaacagttaagcttgcaatccgtgcattgcttgaggttgttgagagtgggggaaagaacatagaagttgctgtgatgactaaggagcatggcctgcggcaacttgaggaagctgagattgatgctgttgttgctgaaattgaagcagagaaagcagctgctgaggctgcaaagaagggcccccctaaggaaacataatcttattttcgatttcttttcccataagtttttattgatgctcgcaatgttatttggagttgtatttggtactgtggttaaacctgaatagtattgccataatgccatccatttggatgctattggagttctgatgtgcgaagcttttgaaccattagaaacatgactgcttcaagtat

SEQ ID NO: 3699 - DNA, 1042 bp, Chrysanthemum coronarium
aggagaagttgtcttgcaactcaagacagaaggagatccaaattcatcatcactaccccaaacaaattgcattataaataatatattgaatcgacaaacccaaaaaattaaaaccaataatcaatggcaagatacgatagagcgataacagtattctcaccagatggtcatctgttccaagttgaatacgcacttgaagccgttcgtaaaggtaacgccgccgttggtgttcgtggtactgacaccgttgttctcggtgtcgaaaagaagtccactgttaagcttcaggactcgagatcagttaggaagattgtaaacctagatgatcacgttgcattggcctgtgctggactcaaagcagatgctcgtgttctcataaataaggctcgaatcgagtgccagagccataagcttactgtcgaggatccagttactgtagaatatatcacgcgatatattgcaggtcttcagcaaaaatacacgcaaagtggaggtgtcaggccatttgggctttcaactttgattgtaggatttgatccctatactaatgttccgtcgctatatcagacagatccttcagggacgttttctgcttggaaagctaatgccactggtcggaactctaattccatgagggaatttttggaaaagaactacaaagaaacctctgggcaagaaactgttaaacttactattcgtgctctgcttgaagttgttgagagcgggggcaagaacattgaagttgctgtgatgacaaaggaaggactgagacaacttgaggaaactgaaattgatgtaattgttgcagagattgaagctgaaaaagcagccgctgaagctgcaaagaaaactccttcgatgcaaacataatattgtcaaagatctctcctcaatccagaataattatttctttagactgtttgattaaaccaattttcggcatttatgtggctttttgcttctttatgcaatttgactgtttgaaccttatttgctgtgtgttataaaagttgaatctgccaaatggacattagtggtggcc

SEQ ID NO: 3700 - DNA, 940 bp, Chrysanthemum coronarium
aaaaaacaaaacaataatcaatggcaagatacgacagagcgataacagtattctcaccagacggtcatttgtttcaagtggaatacgcacttgaagccgttcgtaaaggtaacgccgccgttggtgttcgtggtaccgacaccgttgttctcggtgtcgaaaagaagtccactgttaagctccaggactctagatcagttaggaagattgtaaacctagatgatcacgttgcattggcctgtgctggactcaaagcagatgctcgtgttctcataaataaggcacgaatcgagtgccagagccataagcttactgttgaggatccagttactgtagaatatatcacacgatatattgcaggtcttcaacaaaaatacacacaaagtggaggtgtcaggccatttgggctttcaactttgattgtaggatttgatccctatactaatgttccatcgctatatcagacagatccttcagggacgttttctgcttggaaagctaatgccactggtcggaactccaattccatgagggaatttttggaaaagaactacaaagaaacctctgggcaagaaactgtcaaacttactattcgtgctctgcttgaagttgttgagagcgggggaaagaacattgaagttgctgtaatgacaaaggaaggactgaggcaacttgaggaaactgaaattgatgtaattgttgcagagattgaagctgaaaaagccgccgctgaagctgcaaagaaaactccttccatgcaaacataatggtgtcaaacacctctccttaatccagaataattatttctagactctgtttgttaaaccagttttcggcatttatttggctttttgcttctttatgcaattcgtctgtttgaaccttatctgctatgtgttatgatagttgaatctgccgaacggacattagtggtggccca

SEQ ID NO: 3701 - DNA, 1336 bp, Petroselinum crispum
cggagacaacagctgtttgtctctctaaactctttataggctctttctcacacaaacacaaagaaattaaaaccacaaatatatcaaagcaggggagagatggcacgatacgacagagcaatcaccgtgttctcaccggacggtcatctatttcaagtcgaatacgctctggaagctgtccgtaaaggtaacgccgccgtcggcgttagaggtaccgacactatcgttctcggtgttgagaaaaaatccaccgtcaaacttcaagactccagatctgttaggaagattgtaaatctggatgatcatattgctttggcttgtgctgggcttaaagctgatgctcgagttcttatcaaccgggcacgtattgagtgccaaagccataagcttactgttgaagatccagttactgtggagtatatcacccgttatatagctggtcttcagcaaaagtatactcaaagtggtggtgttaggccatttggcctttcaactttaattgttggatttgacccacacacgggtgtgccagcactgtaccaaactgatccttcgggaaccttttctgcttggaaagctaatgctactggcagaaactccaactcgatgagagaatttttggaaaagaattataaggagacgtctggtcaagaaaccttgaaacttgctatccgtgcactacttgaagttgttgagagtggaggaaaaaacatagaagttgcagtaatgacaagggataagggtctccgtcagcttgatgaagctgaaattgacaccatcgtggcagagattgaagctgagaaggaggctgcagaggctgcaaagaagggcccttccagggagacttgagtctactttcaatttccctttcattcgacatttcattttgaacatgtattctgaacttgtgactttgcacgtcggggcttgtgttataaatttacgaagtcatgttttaagtgttggactagtatgaagcttgcaaattagttacctatattgcagggaatatggtgatatcaagagatttggggtcctaggatgatctttttcctaccaattgatcattgatgcaatgtcatttgttagtccaatatatagtagcatataaaaaaggatagctgtttatttaggacctacggttacaggatgaatcaaccctcatgataccttgaaacttaatacttcacttttgtgcatagacactgcagcaacatgatagggatcactagggctgcacaacaacagggtcagacctgtagaccggactgggtctttctgttcaaaaactggaccagaccggttacatccgggtcggtccccggtccatatattt

SEQ ID NO: 3702 - DNA, 2945 bp, Malus domestica
atggcggcggtgattgggctgctggacattatgatcagtgatgattgccttacaaatgaacaatactccacagttactcagatcagaaaatgctcgacagctctacttcggcttctcaacaacatattggatctcagcaaggttgaatctggaaaaatggtgttggaagaagccgagtttgatctgggaagagaactcgaggggctcttcgacatgttctccgtgcagtgcattaaccacaatgtggagactgttttagatctctctgcgggtcacgttatacttagaggatcatgcgagaacttcaacatttctggtgacaccaggagaatccttcttgatcagaaaaatttgtggccgtctcataaggcaaagctgaagcaaagcaaccatgttaacaagatgggtggagaaatcaaggttgtaaagaaggacgggcagggtaccttaatgcaattttacttggttctcaatacgcctgcagatggaacggagcaacattgtcaagtagattttgcaaagaaaaatgtagtggtgctgcttgcactacacggcagcatggggagactgattatgtcccagtggttgcgaaaaaaaggagtgttcactctggcaacatctgagtggaatgaactgacacaaattcttcgagaactctttcataacaggaattcatctcataaaaacagtttcgaaaaacagtattcgctgagtgaatctttgagaggtgaaatacgaaacacacgtgacatgaggaacccagctttcgtcatggttgtcgacatagggctgcttgacctgagcacagatatatggaaggagcagcttaacttccttaataaatactccgggaaagcaaactttgcatggatgctgaatcatgatacatccaacgccgtaaagatggagctccgaagaaaagggtatgttttgatggcgaaaatggttcatattttggaaactgtcatgacagagagagatcttgacacgcagaggagatccgcaaccagtttgacaaatagcacaaaagaaggtgacttgcacgaatgccttgagatcgattctactcatttttatgttcccagtagctctgatgattctgatatatctgaaaagaacgactctaattctgaaaacacatctcatgtcgaagaaaagcaaagagacgggatcatgaaacctagttccccgcagtaccaggcggttaacagctgcttagttgaactcacaagcgtatgctcgaaagacaataattcaaggaaagaagacacagaagatacggaacataaagcaatgagcaacaatcaagcatcccatgcaacaaaatcacaatgtgaaaactccgaagttcaagaacatcgttcgatcaccagcagtcctaaagagaatggttgttcatataaaagtagaactacaaatcaacagaaatctctcgaaggtgtgcgcattctactcgcagaagatacaccggtactgcagagagttgcaactataatgctcgaaaaaatgggggctactgtgattgctgtggctgatggactgcaggcagtagatgctctcaactgtgtgaacaaatcagaagattgtagaaaggaatttcactcgaaagatggagatacgaacttggataatcaaacatggggtttccgtccattcgacttgattctaatggactgtcagatgccgaagatggacggttatgaagcaacgaaggcaatcaggagatcggaggaggggaccgattcgcacattccgatcgttgccctaacagctcatgcaatgtcatcagatgaagcaaagtgcttggaggtggggatggatgcttatctgacaaagccaattgactacaagttgatggtgacttgtggcctaagtcgagaacagcaaaatataattgtcactgcgaaagagagctcccaggccaaaaagcaccagctcccccgaaaaccccagatcagaagaaagaagaagaagacgaggcagtagaaagatggcgaggtacgacagagccattacggttttctctcctgacggtcatctcttccaggtcgagtacgcgctcgaggcggtccgtaagggtaacgccgccgtcggcgtccgcggcaccgacaccatcgttctcggcgtcgagaagaagtccgccgctaagctccaagactccagatcggtgaggaagattgtgaacctggacaatcacattgctttagcctgtgctgggctcaaagcagatgctcgtgtgttgataaacaaggcacggattgaatgtcaaagccacaggcttactgttgaggatccagtgactgtcgagtacataacccgatacattgctggtcttcagcaaaagtacacacaaagtggtggtgtgagaccatttggtctttcaactttgattgtcggatttgatccatacacagattcaccatcactatatcagacagatccttctgggactttttcagcatggaaagccaatgcaactggaagaaactccaattcgataagggagtttctggagaagaactataaagaaacttctgggcaagaaactgtaaagcttgcaatccgggctttgcttgaggttgttgagagtggagggaaaaacatagaagttgctgtgatgacgaaggatcacggtctgaagcaacttgaagaagctgaaattgatgccattgttgctgacatagaagcagagaaagcagctgccgaggccgcaaagaagggacctcccagggaaacatgatcttacgtattttcctttggcaactttaatttacgatgaactccaccttgctgttcttttggagttgtactttgcacttgatttggctgaaactgatctctacctcctgcattctgtatgctcatgagcttcgaaattgctagttattacagcttataacttcaaatggattgagatttgcttattcaagttttaatcgaaactg

SEQ ID NO: 3703 - DNA, 1003 bp, Artemisia annua
aagatccgtttccttcatcactaccccccaaacatccttcatcttgcattttaaaaagggttcaattaagaaaccctagaagagaaaattaatcaatggcaagatacgacagagcaataacagtattctcaccagatggtcatttgtttcaagttgaatacgcacttgaagccgttcgtaaaggtaacgccgccgttggtgttcgtggtaccgataccgttgttctcggcgtcgaaaagaagtccactgttaagcttcaggactctagatcagttaggaagattgtaaacctagatgatcatgttgcattggcctgtgctggacttaaagcagatgctcgtgttctcataaataaggcacggatcgagtgccagagccataagcttactgttgaggatccagtgaccgtagagtatatcacacgatatattgcaggtcttcaacaaaaatacacacaaagtggaggtgtcaggccatttgggctttcaactttgattgtgggattcgatccatatactaatgttccatcactatatcagacagatccttcagggacattttctgcttggaaagctaatgccactggccgaaactccaattcaatgagggaatttttggaaaagaactacaaggaaacctctggacaagaaactgtcaaacttactattcgtgctctgcttgaagttgttgagagtgggggcaagaacattgaagttgctgtaatgacaaaggaaggactgcggcaactagaggaaactgaaattgatgtaattgttgcagagattgaagctgaaaaagccgccgcagaagctgcaaagaaaactccttctatgcaaacataatattgtcaaacacctaccctcaatccagaataattctctctttagactccatttgttaaaccaatttcagacatgtatgtggcttttctttatgcattttgactgtttgaactttatctgctgtgttatgaaagttgagaaacttgaagggctcttgcaaa

SEQ ID NO: 3704 - DNA, 1140 bp, Cannabis sativa
ttcaaaaaaagaagacggaaaaatctcagagcaaccgatctgatcgaactttctaaagagaaataacaaaacgaagaagacgaactcgaaaacctagccctaaccctaaccacaaccatggccaggtacgacagggctataaccgtcttttcacctgacggtcatctcttccaggtcgagtacgctctcgaggccgttcgtaagggtaacgccgccgtcggagttcgcggcaccgataccatcgtcctcggggtagaaaagaagtctactgctaaacttcaagactccagatccgtgaggaagattgtgaacctggatgatcacattgcattggcatgtgctgggcttaaagccgatgctcgtgtgttgataaacaaggcgagaatcgaatgtcaaagccatcgacttactgttgaggatccagcaactgttgagtacataactcgctacattgctggacttcaacagaagtacacacaaagtggtggtgttagaccgttcggtctatcaactttaatcattggctttgatccctacacaggtgcaccagcactatatcagacagatccttctgggacattttcagcctggaaagcaaatgcaactggaagaaactctaactcattacgtgagtttcttgagaaaaactacaaggagacagctgggcaagaaaccatcaagctcgccattcgtgctttgcttgaggttgttgaaagtggaggaaagaacatagaagttgcagttatgacaagggaacaaggtctgcgacaactagaagaagctgaaatcgacgccattgttgccgagatagaagcagagaaagccgctgcagaggctgcaaagaagggcccttcaaccaaagaaacatgatcgatgatttcccatttcaccttgctactattgtttttttaagaactcgtaaatctgcattcccggtgttcttgttataatcagcattttagagggattactatcttagttaaaactgccctttcatacatgttgttggttcttacatctaatgcctttgaaattatttttatttatggaatatgaattcaaagacaattttcataatcactgcctctgtttttttggatgttatgtccatcttaaaaaagagttagaaaaaattaatca

SEQ ID NO: 3705 - DNA, 1202 bp, Cannabis sativa
aaaagcttcaaaaagagaagacggaaaaatctcagagcaaccgatctgatcaaactttctaaagagaaataacaaaacgaagaagacgaactcctaaccctaaccctaaccacaaccatggccaggtacgacagggctataaccgtcttttcacctgatggtcatctcttccaggtcgagtacgctctcgaggccgttcgtaagggtaacgccgccgtcggagttcgcggcaccgataccatcgtcctcggggtagaaaagaagtctactgctaaacttcaagactccagatccgtgaggaagattgtgaacctggatgatcacattgcattggcatgtgctgggcttaaagccgatgctcgtgtgttgataaacaaggcgagaatcgaatgccaaagccatcgacttactgttgaggatccagcaactgttgagtacataactcgctacattgctgggcttcaacagaagtacacacaaagtggtggtgttagaccgttcggtctatcaactttaatcattggctttgatccctacacaggtgcaccggcactatatcagacagatccttctgggacattttcagcatggaaagcaaatgcaactggaagaaactctaactcattacgtgagtttcttgagaaaaactacaaggagacagctgggcaagaaaccatcaagctcgccattcgtgctttgcttgaggttgttgaaagtggaggaaagaacatagaagttgcagttatgacaagggaacaaggtctgcgacaactagaagaagctgaaatcgacgccattgttgccgagatagaagcagagaaagccgctgcagaggctgcaaagaagggcccttcaaccaaagaaacatgatcgatgatttcccatttcaccttgctactattgtttttttaagaactcgtaaatctgcattcccggtgttcttgttataatcagcattttagagggattactatcttagttaaaactgccctttcatacatgttgttggttcttacatctaaatatgcctttgaaattatttttatttatggaatatgagttcaaagacaattttcataatcactgcctctgtttttttgtatgttatgtccatcttaaaaaagagttagaaaaaattaatcatatcatcatgaatctaacaactcttctattttgttagattgattagtttgttacattaa

SEQ ID NO: 3706 - DNA, 900 bp, Centaurea maculosa
aatcacaaagttcgaattcaaaacctagaaatctcactgaatctgttcatcaatggcgagatacgacagagctatcacggttttctctccagacggccatcttttccaggtcgaatacgcccttgaagccgtacgcaagggtaacgccgccgtcggtgttcgtggcaccgataccattgtattaggcgtcgagaagaagtccaccgtcaagcttcaggactccagatcagttaggaagattgtaagcctagatgatcacattgcattggcttgtgctggacttaaagcagatgcccgtgttcttataaacagggcacggattgagtgccagagccataggcttactgttgaggacccagtgactgtagagtatatcacacgatacattgcaggtcttcaacagaaatatacacaaagtggtggtgttaggccatttgggctttcaactctaattgtagggtttgatccttatactggtgttccatcgctatatcagacagatccatcagggacattctctgcttggaaagctaatgcgactggtaggaactccaattccatgagggaatttttggaaaagaactacaaagaaacatctgggcaagaaactatcaaacttgccgttcgtgctctgcttgaagttgtcgagagcggagggaagaacattgaagtggctgtgatgacaaaggagggacttcggcaacttgaggaagcggagattgatgccattgttgcggagattgaagcagagaaagctgctgcagaggctgcaaagaaagctcctgcttctaaacaaacataaatgtggttatgttgtcaccctccaaataattcttttcttagttggaccttgttgatgtggcttttagactttatttaccagttttatgaagtagttag

SEQ ID NO: 3707 - DNA, 1178 bp, Castanea mollissima
cttaagttgagattggtaattaaaaaaaacgacagtgagagagttttaacagttttcagaaacaaacagagaggagatcagttgagttgagttgagttgaagaagaagaagaagaagaagaagaaagaatggcaaggtacgatagagcaataacagttttctcaccagatggccatttgttccaggtcgaatacgccctcgaagccgtccgaaagggcaacgccgccgtcggtgtccgtggtaccgacaccatcgtcctcggcgtcgagaagaaatccaccgccaaactccaagactccagatcagttaggaagattgtgaacctggataatcacattgcactggcctgtgctggactcaaggcagatgctcgtgtcctaataaacaaggcacggattgaatgtcaaagccataggcttacactggaggatccagcaactgttgagtacatcactcgttatatcgctggtcttcagcaaaagtacacacagagtgggggtgtgagaccatttggcctttcaactttgattattggctttgatccctatactggtgctccatcactttatcagacagatccttctgggacattttcagcttggaaggccaatgcaactggaagaaactctaattcattaagagagtttttggagaaaaactataaagaaacttctgggcaagaaacagttaagcttgcaatccgtgcattgcttgaggttgttgagagtgggggaaagaacatagaagttgctgtgatgactaaggagcatggcctgcggcaacttgaggaagctgagattgatgctgttgttgctgaaattgaagcagagaaagcagctgctgaggctgcaaagaagggcccccctaaggaaacataatcttattttcgatttcttttcccataagtttttattgatgctcgcaatgttatttggagttgtatttggtactgtggttaaacctgaatagtattgccataatgccatccatttggatgctattggagttctgaggtgcgaagcttttgaaccattagaaacatgactgcttcaagtatgaaaatggatggttttttttttttgttaaattatatttttagtgatagtgacaaggtatggaacgttatgtcctaatgtatggtttataagttggaggtctgacttgattttatagacgag

SEQ ID NO: 3708 - DNA, 1149 bp, Citrus clementina
gtaataattgaaggtaaaaaaagagaggaaaaaagaaaaagaaaaggtgagtgacttgttctctaagttggttgagaaaactcactaatcacactcaaaataagaaataattaataagctggaaagaagaaaaagaaactcaagaatcagagagacgcagaaatcgatcgagaagaggaaaatcagagagatttgacatggcgagatacgatcgagcaatcactgtattttcaccggatggccacctgttccaagtggaatacgcactagaggccgtacgcaaaggcaacgccgccgtcggcgtgcgcggcaccgacaccatcgttcttggcgtcgaaaagaaatccactgtcaagcttcaggactccagatcagtgaggaagattgtcagcttggataatcatattgcattggcctgtgctggacttaaagcagatgctcgtgtactgataaacagggctcgaatagaatgtcagagccacaggctgactgttgaggacccagtaactgttgagtacatcactcgttacattgcaggtctccagcagaagtacacacaaagcggtggtgtgagaccatttggtctttctactctgattgtgggctttgatccatacactggcgtgccatcactatatcagacagatccttctgggacattttctgcctggaaagctaatgcaactgggagaaactctaattcaatgagggagtttctggagaaaaactataaggaaacttccgggcaagaaactataaagcttgcaattcgggcattacttgaggttgttgagagtgggggcaaaaacatagaagttgctgtgatgacaagggagaagggtctgaagcagcttgatgaagctgaaattgatgccatggtagccgagattgaagcagagaaggccgccgctgaggctgcaaagaagggacctcccaaggaaacatgagtttttagttctggcttctgttttttccattgcctgttgtttttcacctttcagaattttagtatgctttttttgtggttaagttttatatgcttttagatttgcattcaaaagatataacagagcaccagattattgccagcttaaattttcttatatggtcatttaatatttatcgattatggtgagcgttgttgttggg

SEQ ID NO: 3709 - DNA, 1369 bp, Citrus clementina
aaatcaaattttgctcttaagcaagaaaggagggaaggagggagcgcggaaaaattataaataataaataataattgaccctgggtgataaaattaagaataaaaaggagatgttagacaaaacgacatcgttatgaagcagcgttcaaaactgtgtcgtatccaatcgggtttcttttgcatcagtcctgggttggcttgccctccaagaagctttactaactacttgtagactctctttctcaaaaccccagatcgcaagctttcaaaaaaaaaaaaatcaaattcaaataaaaaacaaactcgagaccgaaaaaaggaagagaaaatggctcgatacgatcgcgcgatcacggtcttttctccggacggccatctattccaagtcgaatacgcgctcgaagccgtccgtaaaggaaacgccgccgttggggtccgcggcaccgacattgtcgtcctcggcgtcgagaaaaaatcagccgtcaagctccaagactccagaatggtgaggaagattgtgtcattggataatcacattgcgcttgcctgtgcgggtctgaaagcggatgcacgtgtcttggttaacagagcgcgtattgaatgtcagagtcataggcttactgtagaggatcctgtcacagttgaatatataacgcggtacattgctgggcttcagcagaagtatacacagagtggtggggtgaggccttttggtctttcgaccttgattgttggttttgacccctatacaggtgtgccgtctctttatcagactgatccatcgggaactttttcagcatggaaagccaatgccacgggaaggaactcaaattcaataagggagttcttggagaaaaattataaagaaacctctgggcaagaaactgtgaagttggccattcgtgctttgcttgaagttgttgagagtggaggcaagaacattgaagttgctgtgatgacgagagagcatggtctccggcaacttgaagaagcagaaatcgatgccattgtctctgagattgaagcagagaaggctgctgcagaggctgcaaagaaggcccctccaaaagaaacctagagttattgattcaataaatcggtgacttcttaggatgtggacatgttcaaatttctcttacaaaaaagctgcttttaagttggcacactattgttttgccaatggtacttctatgttattaaaagttttaccagtctttcttttagcttttgaacctgaaattgcataccattgtaggcttatatgtattccttgattatgagattaaatgactgtggaaaggcatgaatttgtatgttgtatctcattgaaggatttggatacaagttgcaaatgtgagttgttgatcct

SEQ ID NO: 3710 - DNA, 1036 bp, Cleome gynandra
agaagaagaagaagaagaagagagaagagagaagagagagagagagagagagaggtgagagatggcgagatacgacagagcaatcactgtgttttcccctgatggccacctcttccaggtggaatatgccctcgaagctgttcgcaaaggtaacgccgccgtcggagttcgcggcaccgacaccatcgtcctcgccgtcgagaagaaatccaccccaaagctccaggattccagatccgccagaaagattgtgagccttgataatcacatagcgttggcctgtgctgggctcaaggcagatgctcgtgtcctgataaacagagcaaggattgagtgtcaaagtcacaggcttactgtggaggaccctgtgactgttgagtacatcacccggtacatagcaggacttcaacagaaatatactcaaagtggtggtgtgagaccctttggtctttctacgcttatcgttggctttgatccatacactggtgtgccctcactatatcaaactgatccatctggtactttctctgcctggaaagctaatgcaaccgggagaaattctaactcgattagagagtttctcgagaaaaactacaaagaaacatctggtcaagaaactgttaagctcgctatccgtgctttgcttgaggtagttgagagcgggggaaagaacattgaggttgccgtgatgacacgagagcaaggccttcggcaactagaagaagctgagatcgatgggattgtggcagagatagaagcggaaaaggcagctgcagaagccgcgaaaaaagcccctccaaaggaagcatgattgacataatgaaacgacaccggtgaaagagcttcatcatgatcactgtttggtagattcaatgggtctcgagttatacatttgacaagtagtagagtcaatcctgggtttgttcttgtttctatgaaacgtgaccaagatgaagcatatagttccgacgatatcagaaatatgaaccgtttcatgctgtttccgttcgaatttgcttttgatatatgacttttg

SEQ ID NO: 3711 - DNA, 991 bp, Coffea canephora
cggccggggggctacaggtgacttctcccccaagttccctctgaatcctcttccccttcttcacgctttcatccctctctctctcttccctggaagtctaaaagtgtcgagccagagatcccaaaccacaagcccaaccccaaaaaaaactgtacgaatacgtagcataccctatacaggcacagatagatggctagatacgacagagccattactgttttctcccccgacggacatctttttcaggtggagtacgccctcgaggccgtccggaaaggaaacgccgccgttggtgtccgtggaaccgacactatcgtccttggtgtcgagaagaagtctactcctaagcttcaagactccagatcggttagaaagattgtgaatttagatgatcatattgcattggcctgtgctggactgaaagcagatgctcgtgttttgataaaccgggcacgtattgaatgtcaaagtcatagacttacagttgaggatccggtcaccgttgagtatattacgcgctacatcgctggacttcagcagaagtatacacaaagtggtggtgtaagaccatttggcctttccactttgataattggctttgacccatacacaggtgtccctgcgttatatcagacagatccttcaggaacattttcagcgtggaaagccaatgcaactgggagaaactcaaactctatcagggagtttctggagaagaattacaaggaaacagctggccaagaaactgtaaaactagctattcgtgcattgcttgaagtcgttgagagtggtgggaagaatatagaagtagctgtgatgacgaaaaaagatgggctgaggcaacttgaagaagctgaaattgatgctattgttgctgaaattgaagaggagaaagcagctgcagaggctgccaagaaggctcctcaaaaagaaacctagattgactgcaatatttgcttagaaaatgcctgtgttttgtactctgttatgt

SEQ ID NO: 3712 - DNA, 1194 bp, Eucalyptus grandis
gtacaaaagaagaggagagctcgacgcagaagaaagtcgcagacgacgagcactcctagagagagagagatcgaagctcggaaggggtaagacgctcggagcgcgaaggatcggaaggccgccatggcgaggtacgacagggccatcaccgtgttctcccccgacggccacctcttccaggtggagtacgccctcgaggccgtccgcaagggcaacgccgccgtcggcgtccgcggcaccgacaccatcgtcctcggcgtcgagaagaagtccactgccaagctccaggactcgagatcggtgaggaagattgttagtctggatcagcacattgcattggcctgtgctggccttaaagcagatgctcgtgtattaataaacagggcacgaattgaatgccagagtcacagacttacagttgaagatccagtgactgttgagtatattacgcgttacatcgctggtcttcagcagaagtatacacagagtgggggtgtgagaccatttggtctttcaactctgattattggttttgatccctacactggcgcaccatcactgtatcagacagatccatccgggacattttcagcctggaaagctaatgccactggtagaaattccaattccataagggaattcctagagaaaaactacaaagatacttcagggcaggaaactgtgaaacttgctatacgtgcattacttgaggttgtcgagagtgggggaaagaacatagagattgctgtgatgacaagagagcatggcctgcgacagctcgaagaggctgaaattgatgccattgtcgccgaaatcgaggctgagaaagcagctgcggaggctgcgaagaaggcccctcttaaggagacttgattgcctgcggtttcttcctggcccgtgacattctcatagttttttcctctctttactcatcttctgtcgctagatgcaaactgaggatgatgctttcgagctttttaaggtcccgaacatatctgcttctgatttatagttgtgttaaggactcgtgttcacgtgtggggaagaagctggccttcgctgctccctgcattgtagttgttgttttctgcatgacgccgtgaaattctattggagaaacagcattttacgttcccggtcaaggtttgattgggctaatcgatgacttttgcttccttttggaacgcgttgcaa

SEQ ID NO: 3713 - DNA, 1097 bp, Fagopyrum esculentum
tgtcttttgtgtgaaacatttggcactttgagttcgttcttctattatacattctatctgataccttctcccccagatcaacaaacacaataaacacctacaatcaagaagtcgatggcgaggtacgacagagccatcactgtcttctctcccgacggtcacctcttccaggtggagtacgctcttgaagccgtccgcaagggtaacgccgccgtcggcgttcgcggctctgacgccgttgtcctcggtgttgagaagaagtctacccccaaacttcaggactccaggactgtgaagaagatagtaaacctggataaccatattgcacttgcttgtgctgggcttaaagcagatgcacgtgtcttgattaatagggctcgtattgagtgccagagccataagctaacggttgaggatcctgttactgttgaatacattacccgttatattgctggccttcagcagaagtacacacaaagtggtggtgtgagaccatttggtctttcaaccttgattgttggctttgacccacatactgcggtcccatctctctaccagacagatccatctgggaccttttcagcatggaaagcaaatgctacgggaaggaactctaattctatcagggagttcttggagaagaattacaaagaaacttctggccaagaaactgtcaaacttgccatccgggcattgcttgaagttgtggagagtggagggaagaacatagagattggtgtgatgacaaaagagggactacgacaacttgaagaggaagaaattgatgccattgttgctgagattgaagccgaaaaggcagctgctgaggctgcaaagaagggtcctcacaaagaagcctaagtttttatttctgcgtgtggttaactggttatgaatgcatttcattcttttctgtttggatgtttgatactttatgaactattttatggatgttttttttaatcagaaattctgacacagcaagtgtaatcacacaactcaggcatccctatagttttaacttgctgcattccgtaaattgaggatgtattgtatataccctcgcaaattaagatattaattttgtatttgtaggt

SEQ ID NO: 3714 - DNA, 1006 bp, Panax ginseng
agtggtatcaacgcagagtacatggggacaacacaacacaacacagaggaagcagatcaaagaaaaagaatccaccggcagacatataaagagtaaaatggcgagatacgacagagctatcacggtcttttcgccagacggccatctcttccaggttgaatatgcgctcgaagccgtccgtaaaggtaacgccgccatcggcgttagaggcaccgataccatcgttctcggcgttgagaagaagtctactgtcaagcttcaagactccagatctgtcaggaagattgtaaatctggatgatcacattgctttggcctgtgctggtcttaaagctgatgctcgtgttcttataaacagggcacgcattgagtgtcaaagccataagctaactgttgaagatcctgttactgttgagtatataactcgttacattgctggtcttcaacagaagtacacacaaagtggtggtgttaggccatttggcctttcaactttgattgtgggttttgacccatataccggcgtgccagcactatatcagactgatccttctgggactttttctgcctggaaagctaatgctactgggagaaactccaattcaatgagggagtttttggaaaagaattataaagaaacgtctggccaagaaactataaagcttgctatccgcgcgctgcttgaagttgttgagagtggaggaaagaacatagaagttgctgtcatgacaaaggatcagggtcttcgacagcttgatgaagctgaaattgatgccgttgttgccgagattgaagcagagaaagaggctgcagaggctgcaaagaaaggaccttccagggagacataagcctgattttctttttcccttgttcccattaatggcattccatgtgaacatgtaataatctcgacttatttgagtgttggggcttcttgtgtggtttagatttggaaatatttcaatgatttatgctgttagacaatatatgaacaagtttatttctta

SEQ ID NO: 3715 - DNA, 925 bp, Lotus japonicus
cctgtgaagcccggaacaataacaaaagcacactgaacaacacgaagaagaacacacttgcttcttttgttaaactttagagaagaagaagagagcgaggttgattgagcttagagatttgaatcagaagcagaatggctaggtatgacagagcgatcacggtgttctctcccgatggccatctcttccaggtcgagtacgccctcgaagccgttcgcaagggcaacgccgccgtcggagtccgcggcaccgacaacgtcgttctcggtgttgagaagaaatccaccgccaagctccaagactccagatctgtgaggaagattgtaaatctagatgatcacattgcccttgcttgtgcgggactaaaggctgatgcgcgtgtgcttataaatagggcgcgtgttgaatgtcaaagtcacagacttactgttgaggatcctgtgacggttgagtatataactcgttacattgcgggtcttcagcagaagtacactcaaagtggtggtgtgcggccctttggcctttcaaccttgattgttggctttgatccttacactgctacaccatccctgtaccaaactgatccttctggtacattttctgcttggaaagctaatgccaccggaagaaactcaaattcgattagggagttcctggagaagaactataaagaaacttcaggtcaagaaactgtaaaactggctatccgagcattgcttgaagttgttgagagtggaggcaagaacattgaagttgctgtcgtgactaaggagcatggtctgcgtcaactggaggaagctgaaattgatgccattgttgctgagattgaagcagagaaagcagctactgaggccgccaaaaaagcccctcctaaagagacataaatttctgtttcttttgctcggtactacgagagcactgctct

SEQ ID NO: 3716 - DNA, 1288 bp, Lupinus angustifolius
atactgaacttgttccctaagcatgtatacctcactggaatcaacaaatacaccaacacaacataactcctaacttgtaaagttgaagaatcaaaagatcgagttcaaagatttgaatcagaatcaaaagagaagaatcaatcaatggcaagatacgatagagcaatcactgttttctcacccgatggtcatcttttccaagtcgaatacgctctcgaagccgttcgcaagggaaacgccgccgtcggagttcgcggcaccgataacgttgttctcggtgttgagaagaaatccaccgctaagcttcaagattctagatcagtgagaaagattgtcaatctagacaatcacattgctcttgcttgtgcaggactaaaagctgatgctcgtgtccttataaacaaggcacgagttgaatgtcaaagccacaggcttactgttgaggatccagtcactgttgagtacataactcgttatattgcaggtcttcagcaaaagtacacacaaagtggtggtgtgcgaccctttggcctttcaaccttgattgttggctttgatccatactctggcacaccgtccttgtaccaaacagatccttctggtacgttttcagcttggaaagctaacgcaactgggagaaactcaaattctatccgggagttcctagagaagaattataaagaagtttctggtcaagaaactgtgaaattggcgatcagggcattgcttgaagttgttgagagtggaggaaagaacatagaagttgctgtggtgactaaggagcacggtttgcgtcaacttgaggaagccgaaattgatgcggttgttgctgagattgaagcagagaaagcagctgctgaggctgcaaagaaagcccctccaaaggaaacatgattttatgcttatttagtttttatattatgtgagcactgttcttgctaggttgggtagccttatataccgaataagaaattgatgccacctgctgagattgaaacagagaaaccatctcttaggctgcaaagattgccctttctaaggagacatgattttactttactttagttttctcgtgaattgttcttgtgggtgttgttcgaactttaaaaattgcttctgggtcgttaattgtagtatttatcaatgtttatctagttcacaatttgaattgtgtgtcatgatatactattatcgtctgaaagtagggatatagatgatttcattcacgttcttaaatgtgtagaaaatttgtctgggtttgatgacagtgttattaataccgtaccag

SEQ ID NO: 3717 - DNA, 1095 bp, Nicotiana benthamiana
tctagcttgtttcccaagatctctctgtgctctctttgattaaaccagtgatcaaaggaacctcgaagtctcaaaccctagctgcacattttactattaaccaccaaaaatggctagatacgatagagccatcaccgtcttctcgccagacggccatctattccaagtagaatacgctctggaggccgtacgtaaaggtaacgctgccgtcggcgtccgcggtactgataccgttgtccttggcgttgagaagaaatctacccctaagcttcaggactctaggtcagtaagaaagatagtaaatctggatgatcatattgccttggcctgtgctggcctgaaagcagatgcccgagtcctcgtaaatcgggcacgtattgagtgtcagagtcataggcttacagttgaggatccagttaccgttgagtacataacacgttacattgctggtcttcagcagaagtacactcaaagtggtggtgttaggccatttggtctttcaaccttgatcatcggttttgatccttacactggtgtcccttcactttatcaaacagatccatccggaacattctcagcatggaaagccaatgcaacagggagaaactccaactctctccgggagttcttggagaaaaattacaaagaaacatctggccaggaaactgtgaaacttgcaatacgtgctttgcttgaagttgttgagagcggcggaaagaatattgaagttgctgtcatgacaaaagagcatgggcttaagcaactcgaggaagctgagatcgatgccattgttgctgagattgaggcagagaaagcagctgcagaagctgcaaaaaaggctccttcaaaagaaacctagttctgccgaaattcttatttgaaaatgtgtctgaatttttattgctctattcaacttctaaagactgatcctgtagtcggtcgagacctgtattgtggctatttttttttgtgtggttatattgagagtcagtcatcttctctcactgattatatatactggtcatgaaatggtacttaagatatgcgcacttgtttacattgcttgatggtttagttatggaaagtagtagttcc

SEQ ID NO: 3718 - DNA, 1190 bp, Quercus alba
atggggaagttgagattggcaattaaaaaaacgcagtgagtgagagagagttttagaattgttttcagaaacaaacagagagagaggagatcagttgagttgagttgaattgaagaagacgaagaatggcaaggtacgatagagcaataacggttttctcaccagatggccatttgttccaggtcgaatacgccctcgaagccgtccgcaagggcaacgccgccgtcggtgtccgtggcaccgacaccatcgtcctcggcgtcgagaagaaatccaccgccaaactccaagacaccagatcagttaggaagattgtgaacctggataatcacatcgcactggcctgtgctggactcaaggcagatgctcgtgtcctaataaacaaggcacggattgaatgtcaaagccataggcttacagtggaggatccagcaactgttgagtacatcactcgttatattgctggtcttcagcaaaagtacacacagagtgggggtgtgagaccatttggcctttcaactttgattattggttttgatccctatactggtgctccatcactttatcagacagatccttctgggacattttcagcttggaaggccaatgcaactggaagaaactctaattcgttaagagagtttttggagaaaaactataaagaaacttctgggcaagaaacagttaagcttgcaatccgtgcattgcttgaggttgttgagagtgggggaaagaacatagaagttgctgtgatgactaaggagcatggcctgcggcaacttgaggaagctgagattgatgctgttgttgctgaaattgaagcagagaaagcagcagctgaggctgcaaagaagggccccccaaaggaaacataatcttattttcgatttctttttccccctagtttttattgatgctcgtaatgttatttggagttgtatttggtactgtggttaaacctgaatagtattgccataatgccatccatttggatgctattggagttctgaggtgcgaagcttttgaaccattagaaacatgactgcttcaagtatgaaaatggatggcttttttatttttatttttgttaaattatatttttagtgatagttacaaggtatggaacgttatgtcctaatgtatggtttataagttggaggtctgacttgattttatatacgagcagaaat

SEQ ID NO: 3719 - DNA, 1120 bp, Elaeis guineensis
ccccttttgccttcctccccaagcctgctctaccgtcgtctctctttttagttccaccgccagccgccaccaatatcggagctcagaggtaacagagagagaacgaaaccgacttaaagaatcatctttaaggtacccaaagaaacgctaggggaggagaagaagagaaggcatcaccatcgccatggccagatatgaccgcgccatcactgtcttctctcccgacggtcacctcttccaggtggaatacgccctcgaggccgtccgcaagggcaacgcagccgtgggcgtccgcggcaccgacgccatcgttctcggcgtcgagaagaaggccacccccaagctccaagattccagatcggtgaggaagatcgtgagcctggacaaccacatcgcgttggcctgcgctggactcaaggccgacgcccgggtgctcatcaaccgggcccgcatcgagtgccagagccaccgcctcacggtggaagaccccgtcaccgtcgagtacatcacccgctacatcgctgggctgcagcagaagttcacccagagtggcggtgtaaggcccttcggcctctcaaccctcatcatcggcttcgatccctacaccggggtgcccgccctctaccagacggatccctcgggtaccttctcagcctggaaggccaatgccaccgggaggaactccaactctatgagggagttcttggagaagaattacaaggagacttctgggcaggagacagtgaagctggcaatccgagcactgcttgaggttgttgagagtggaggaaagaacatagaaattgctgtgatgacaagagagacaggtcttcgtcaacttgatgaagctgaaattgatgcgattgttgctgaaattgaagcggagaaagctgcagctgaggctgctaagaaggccccatccaaggaaacttgatgttggatgtttttgtgaaatccaggagcctttttgttttccgttgcttgttctttatattccaaaaccttttattttagttgtgtgctggatgctggggtaagatagcaaactcaaacttttttccagtcaggcctggttttcatgactgacatttttatatatgacataccaaaatatgttgtc

SEQ ID NO: 3720 - DNA, 1375 bp, Citrus sinensis
aaatcaaattttgctcttaagcaagaaaggagggaaggagggagcgcggaaaaattataaataataaataataattgaccctgggtgataaaattaagaataaaaaggagatgttagacaaaacgacatcgttatgaagcagcgttcaaaactgtgtcgtatccaatcgggttttcttttgcatcagtccactgggttggcttgccctccaagaagctttactaactacttgtagactctctttctcaaaaccccagatcgcaagctttcaaaaaaaaaaaatcaaattcaaataaaaaacaaactcgagaccgaaaaaaggaagagaaaatggctcgatacgatcgcgcgatcacggtcttttctccggacggccatctattccaagtcgaatacgcgctcgaagccgtccgtaaaggaaacgccgccgttggggtccgcggcaccgacattgtcgtcctcggcgtcgagaaaaaatcagccgtcaagctccaagactccagaatggtgaggaagattgtgtcattggataatcacattgcgcttgcctgtgcgggtctgaaagcggatgcacgtgtcttggttaacagagcgcgtattgaatgtcagagtcataggcttactgtagaggatcctgtcacagttgaatatataacgcggtacattgctgggcttcagcagaagtatacacagagtggtggggtgaggccttttggtctttcgaccttgattgttggttttgacccctatacaggtgtgccgtctctttatcagactgatccatcgggaactttttcagcatggaaagccaatgccacggggaggaactcaaattcaataagggagttcttggagaaaaattataaagaaacctctgggcaagaaactgtgaagttggccattcgtgctttgcttgaagttgttgagagtggaggcaagaacattgaagttgctgtgatgacgagagagcatggtctccggcaacttgaagaggcagaaatcgatgccattgtctctgagattgaagcagagaaggctgctgcagaggctgcaaagaaggcccctccaaaagaaacctagagttattgattcaataaatcggtgacttcttaggatgtggacgtgttcaaatttctcttacaaaaaagctgcttttaagttggcacgctattgttttgccaattgtacttctatgttattaaaagttttaccagtctttcttttagcttttgaacctgaaattgcataccattgtaggcttatatgtattccttgattatgagattaaatgactgtggaaacgtatgaatttgtatgttgtatctcattgaaggatttggatacaaagttgcaaatgtgagttgttgaatcctat

SEQ ID NO: 3721 - DNA, 1069 bp, Rosa hybrid cultivar
ggagaaaagccccaaagcaaaaaagagagtactagatcacaaggaggaagaagaagaaagcaaaagatggcgaggtacgatagggccattacagtcttttctcccgacggccatctcttccaggtcgagtacgccctcgaagccgtgcgtaagggaaacgccgccgtcggcgtccgtggcaccgacaccatcgttcttggcgtcgagaagaagtccaccgctaagcttcaggactccagatcggtgaggaagattgtgaacctggacaatcacattgctctagcctgtgctgggctcaaagcagatgctcgtgtcctgataaacaaggcgaggattgaatgtcaaagccataggcttactgttgaggatccagtaacagttgagtatataacgcgttacattgctggtcttcagcaaaaatacacgcagagtggtggtgtgaggccatttggtctttcaactttgattgttgggtttgatccatacacgaataaaccagcactctatcagacagatccttcagggactttttcagcatggaaagcgaatgcaacgggaaggaactccaattcgataagggaatttctggagaaaaactacaaagaaacttctgggcaagacaccataaagcttgcgatccgtgctttgcttgaggttgttgaaagtggagggaagaacatagaagttgctgtcatgacaaaggatcatggtctgcgacaacttgaagaagctgaaatcgatgctattgttgctgacatcgaagcagagaaagcagctgctgaggctgcaaagaaaggacctgccagggaaacatgatcttctgtgatgatcctttgcaagtttctctctaatttctggtcaatgtactccaccttgctgttattttcgagttgtactttgcacttgcttggcctaaactgattggtactgttggcatttggtatgcctttgaactgctagtcatcacagcttatatcttggaatggatttagatttgcttttatgaagtttgaatttgaaactggttgaatctattgccctctaatgatggtagtcaaaagtttcaaat

SEQ ID NO: 3722 - DNA, 1092 bp, Solanum phureja
gttctggaggcaattggcttgtcgcccaagaagtgatgtatattcattcagaggcaattccattttccaaaataacataaaaaggttagagggaagagctttcaacactcaagagatcggaagaagctgaaatcacacagaccctaaatctttcaatagcttttagtactatcagataatggctagatacgacagagcgatcaccgttttctcgccggacggccacttattccaagtggagtacgccatggaagccgtacgcaaaggaaacgccgccgtcggtgtacgtggaactgacactgttgtccttggcgttgagaagaagtccactcccaagcttcaagactccaggtcagtaagaaagatagtaaatctagatgatcacattgcattggcgtgtgctgggctgaaagcagatgcacgagtgcttgtgaataaggcacgcattgagtgtcagagtcataggcttacggttgaagatcctgttactgttgagtacataactcgttacattgctggtcttcagcaaaagtacactcaaagtggtggggtgaggccatttggtctatccaccttgatcattggttttgacccacacacaggtgtcccctcactttaccaaacagatccatcaggtacattctcagcttggaaagccaatgcgactggtagaaactccaactctactcgggaattcttggagaagaattacaaagaaacatctggccaggaaactgtgaaactagcaatacgtgctttgcttgaagttattgaaagtggtggaaaagacatagaagttgctgtgatgacaaaagagcatgggcttaagcaacttgaggaagctgaaattgatgccattgttgctgagatcgaagcagagaaagctgctgcagaagcagccaaaaaggccccgccgaaggaaacctagttgtgctgaaatttgttcttaactatccctgaatcctttcttttttcggatcaagccaagtgcagtgttacttgaattttaagattttggtctgtctaatactttacctatgttaaaattgtctgatgggactaaaaaagtcatgctctcgcgatctgtgccct

SEQ ID NO: 3723 - DNA, 1315 bp, Glycine max
tgcaagtaaaaataaacagacaccaagaccaacaccaacaccaacactagcgtgtttcgtcttcttcgtctttactcttttcttcaccgaagcgaaaaagaaaaggcttgacttgagagaaatagagcttcgaatcgaaactcagaattagaaaaaaacacaaatcacaatcacaatggcaaggtacgaccgagcaatcaccgttttctcccccgacggccacctcttccaggtcgagtatgccctcgaagccgtccgcaagggcaacgccgccgtcggcgtccgcggcaccgacaacgtcgtcctcggcgtcgagaagaaatccaccgccaagctccaagactccaggtcggtgaggaagattgtgaatctggacaaccacattgcgctggcatgcgcggggctgaaggccgacgcacgtgtgctcataaacagggcacgtgtggagtgccagagccacaggctcaccgtggaggatcccgtcacggttgagtacataacgcggtacattgctgggctccagcagaagtacacgcagagcggcggcgtgcgaccctttgggctttcgactctcattgtcgggtttgatccctacactggctcgccctccttgtaccagacggatccctctggcaccttctcggcgtggaaggcgaacgccaccgggaggaactcgaattcgattagggagttcctcgagaagaactataaggacacctctggccaggagactgtcaagttggctattcgcgcattgcttgaagttgtggagagcggaggcaagaacatagaagttgctgtgatgactaaggagcatggtctgcatcaactggaggaagctgaaattgatgccatcgttgctgagattgaagcagagaaagcagctgctgaggctgctaagaaagcccctcctaaggagacataattttctgttttgtgttacgcggggcattgttcttgctacgtgttggctgtactcactgaagctaaaattgatgccattgtgtctaaagattgaaacagagaaaacggctgccgaggctgcaaagaataccctttctaaggagacatgattttattttacttctgtttagctcgtgaattgttcttgctagatgttggcctaacttaaaacaactgctttattgtttttgggtactgtcatatagtgtttggtcaaattaattgcatgtcattattattcaagttcttgttgagtaggatgatacacaacatcttcatagacaggagctggttctttatattggccaatacgactatatttaagaaatatatttccatagtttagaaaaaa

SEQ ID NO: 3724 - DNA, 849 bp, Nicotiana tabacum
ccgggggaagaaagagctttcagtagcaatactcagagatcgtaagaaagaaactgaaatcacacagagagcaaatcgttcggtaacttttagtatcagatatggctagatacgatagagcgatcaccgtgttctcgccggacggccacctattccaagtagagtacgccctcgaagccgtacgcaaaggtaacgccgccgttggtgtacgtggcactgacactgttgtccttggcgtcgagaagaagtccactcccaagcttcaggactctaggtcagtgagaaagatagtaaatctagatgatcacattgcattagcctgtgctggactgaaagcagatgcacgagtccttgtgaatagggcacgcattgagtgtcagagtcataggcttacagttgaggatcctgttactgttgagtacataactcgttacattgctggtcttcagcaaaagtacacccaaagtggtggtgttaggccatttggtctatccaccttgatcattggttttgacccatacaccggtgtccccgcgctttatcaaacagatccatctggtacattctcagcttggaaagccaatgcaactggtagaaattccaactctcttcgggaatttttggagaagaactacaaagaaacatctggccaggaaactgtgaaactagcaatacgtgctttgcttgaagctgttgaaagtggtgggaagaacatagaagttgctgttatgacaaaagagcatgggcttaagcaacttgaggaagctgagattgatgccattgttgctgagatcgaggcagagaaagcagctgcagaagctgccaagaaggcccccaaagaaacctagt

SEQ ID NO: 3725 - DNA, 922 bp, Vinca minor
tcctacacaagagctagacatctataatttccccaaaaaatggcaagatacgacagagctatcactgttttctcccccgacggccatctatttcaggtcgaatatgcccttgaagccgtcagaaaaggtaacgccgccgtaggtgtccgtggcaccgacaccgttgttctcggcgtggagaagaaatcaactcccaagcttcaagactctaggtcagtcaggaagattgtaaacctagacgatcatatcgcattggcctgtgcaggattgaaagcagatgcacgtgtcttgataaacaaggcacgtatcgagtgtcaaagtcataggcttactgttgaggatcctgctacggttgaatacattactcgttacatagctggtctccagcagaaatatacacaaagtggtggtgttagaccatttggcctttcaaccttgatcattggctttgacccgtacacaggtgccccttccctttaccagacagatccctcagggacattttcagcctggaaagccaatgcaactgggagaaactcaaactcgatcagggagtttttagagaagaattacaaggaaacatctggccaagaaactataaagttggccattcgtgcactgcttgaagttgttgagagcggcgggaagaacatagaagttgctgtgatgacaaaagagcatgggctgaagcaacttgaagaagctgagattgatgcaattgttgcagagattgaagaagagaaagctgctgcagaggctgcaaagaaaggccctccaaaagaaacttagtttgatttcaggacttgctttagagtcccttgttttgtgatatcaattccttcacctaagaccattatttgttgttgctttctcaagtagacaagtttgcctagaaggatacattgttattcaagatttcttt

SEQ ID NO: 3726 - DNA, 819 bp, Vinca minor
attgacgacgacacggcagagatcggaaccaaatcccagttttcgtagatttctctcacaaaatggcaagatacgacagagctatcacagtcttctccccagacggccatttatttcaggttgaatatgccctcgaagccgtcagaaagggtaacgccgccgtcggtgtccgtggcactgatactatcgttctcggcgttgagaagaaatcaactcccaagcttcaagactctagatcagtcaggaagattgtaaacctagacgaccatatcgcattggcctgtgcagggttgaaagcagatgcacgtgtcttgataaacaaggcacgtatcgagtgtcaaagccataggcttactgttgaggatcctgcaacagttgaatacattactcgttacatagctggtctccagcaaaaatatactcaaagtggtggtgtgagaccatttggcctttcaaccttgatcattggctttgacccatactcaggcaccccttcactttaccagacagatccttcaggaacattttcagcctggaaagccaatgcaactgggagaaactcaaactcgatcagggagtttctagagaagaattacaaggaaacatctggccaagaaaccgtaaagttggccattcgtgcactgcttgaagttgttgagagtggtgggaagaacatagaagttgctgtgatgacaaaagagcatgggttgaagcaacttgaagaagctgaaattgatgcaattgttgcagagattgaagaagaaaaagctgctgcagaggctgccaagaagggccctcctaaagaaacttaatttgatt

SEQ ID NO: 3727 - DNA, 1095 bp, Ipomoea batatas
cctagaaagtaccttcggtaccggagaggcagaaatcgaaacaaactgaaaccgaactcgtaaacgatcagttatggctcgatacgatagagcgatcaccgtttactcgccggacggtcatcttttccaggtggagtacgccctagaagccgtacgaaagggtaacgccgcagtgggagttcgaggtacagatactgttgtcctcggcgtcgagaagaagtctactcccaagcttcaggattccagatctgtacggaaaatcgtaaatctagatgatcacattgcattggcttgtgctgggcttaaagcagatgcacgcgttcttgtaaatagagcacgcattgagtgccagagtcacaggctcactgtggaagatcctgttactgttgagtacataactcgctatattgctggccttcagcaaaaatacactcaagtggtggtgtaagaccatttggtctttctaccttgattattggttttgacccatacacaggtgttccatctctttatcagacagatccatcaggtactttttcagcatggaaggccaatgcaactgggaggaactccaactcaatccgggagtttcttgagaagaactacaaggaaacctctggccaggaaaccgtgaagctagccattcgtgctttgcttgaagttgttgagagtggtggaaagaacatagaagttgctgtcatgacaaaggagcatggacttagacaactagaggaagctgaaattgatgcgattgttgctgaaattgaggcagagaaagcagctgcagaagctgccaagaagggtccggcaaaggaaacctagttctagaaaaaatgcaccgtcttcgactctactattttgatgctttcctcaacatgtgaactctgttaaatctggtgttagaaaaaagtgtgatttgctgaacttttcctatattacacagctgaatgttgatagaccgttgcttgctaagaaaattattatccttttttataacgacagagggagaggttggggtttcatttcaaaaaaaaaaacacccacccccttcctcttcttcttctttcttcttcatctccttcatattctaaaatc

SEQ ID NO: 3728 - DNA, 1301 bp, Amaranthus tuberculatus
catttgaggtgtcttgttgcccaagaagttaagagaggaaatcaacccttataaatcaacccttataaatcaaccttaagcttcacaagatcgacattgttgaaggtgaagatttaagcaaacagtacaatggcgagatacgatagagcaatcacagtcttttcacctgacggccatctctttcaagtcgaatacgcacttgaagccgttcgtaagggtaacgccgccgtcggtgttcgaggaaccgacaccgttgtccttggtgtcgagaagaaatctgctgccaaacttcaagattctaggtctgtcagaaaaattgtaaatcttgacaatcatattgctttagcatgtgctggtctcaaggcggatgcccgtgttctcattaacagggcacgtatagagtgtcaaagccacaagcttaccttggaggatccagttactgtcgagtacatcactcgttacattgctggacttcagcagaaatatacacaaagtgggggtgttagaccgtttgggctgtcaactttgattgtgggatttgacccatacaccaatgtaccagcgctgtaccagacggatccatctggtacattttcagcttggaaggctaacgcaactggaagaaactctaactcaataagggaattcctggagaagaactataaagaaacttctgggcaagaaaccatcaagctggctatccgtgctcttcttgaagtggttgaaagtggaggaaagaacttggaagttgccgtgatgacaaaagaaggtctacgccagcttgaagaagctgaaattgacgccattgttgcagagattgaagcagagaaagctgcagctgaggccgcgaagaaggctcctgctaaagatacatagatctatcatgcttccaattagcaggctattactgttcacttattaaaaagtcttcagcatatcccagttcttgcttttgtttagcttcaaactttgaactgttgatgagttaaacatagttgacggacaatgtatcgttttagtatcattagaaaagctattatgtactatttaaaagtgagcaaattgttgaatattttggtcatttacccatttggttcattatgagatttgtgaatgtaccttcttgcagccgttaatgcgagtgtgagactactatttactctctttcattttgttggattggtcatatgttggagccttaaccttaaaagattgtggttaattacatgaaacaatagcagttttaatggttgtctacatgaatttttcatctctattaatatcaattttctactatttta

SEQ ID NO: 3729 - DNA, 1052 bp, Chrysanthemum coronarium
ccttgatgagcatatcctcaatcaccattttcactatcaaaaacctaaatcaaatcgaaaaccttaaccgtaataatctgataatcatcagtaattaatggcgagatacgacagagctattactgtattttcaccggatggtcatttgttccaagtcgaatacgctttggaagctgtccgaaaaggtaacgctgctgtcggtgttcgtggtaccgatatcgttgtcctcggtgtcgagaagaagtccactgttaagctacaagactctagatcagttaggaaaattgtaaacctggataatcacattgcattggcttgtgctggactcaaagcagatgctcgtgttctcataaataaggctcgaatcgagtgccagagccataagcttactgtcgaggatccagttactgtagaatatatcacgcgatatattgcaggtcttcagcaaaaatacacgcaaagtggaggtgtcaggccatttgggctttcaactttgattgtaggatttgatccctatactaatgttccgtcgctatatcagacagatccttcagggacgttttctgcttggaaagctaatgccactggtcggaactccaattccatgagggaatttttggaaaagaactacaaagaaacctctgggcaagaaactgtcaaacttactattcgtgctctgcttgaagttgttgagagcgggggaaagaacattgaagttgctgtaatgacaaaggaaggactgaggcaacttgaggaaactgaaattgatgtaattgttgcagagattgaagctgaaaaagccgccgctgaagctgcaaagaaaactccttccatgcaaacataatggtgtcaaacacctctccttaatccagaataattatttctagactctgtttgttaaaccagttttcggcatttatttggctttttgcttctttatgcaattcgtctgtttgaaccttatctgctatgtgttatgatagttgaatctgccgaacggacattagtggtggcccaccatgatactttgctatttagctatatagtttgtg

SEQ ID NO: 3730 - DNA, 1110 bp, Chrysanthemum coronarium
gaagatccttccttcatcactcccccaaacacccaaacccaaaacaaaccacctcttgtgcattataaaatttcaattgacaaaccctagaaaatttaatcaatggcaagatacgacagagctattacagtattttcaccagatggtcatttgtttcaagttgaatacgcacttgaagccgttcgtaaaggtaacgccgctgttggtgttcgtggtaccgatactgttgttctcggcgtcgaaaagaagtccactgttaagcttcaggactctagatcagttaggaagattgtaaatctagatgatcacattgcattggcgtgtgctggacttaaagcagatgctcgtgttctcataaataaggcacggatcgagtgccagagccataagctaactgttgaggatccagtgaccgtagagtatatcacacgatatattgcaggtcttcaacaaaaatacacacaaagtggaggtgtcaggccatttgggctctcaactttgattgtcggattcgatccatatactgatgttccatcactatatcagacagatccttcagggacgttttctgcttggaaagctaatgccactggccgaaactccaattccatgagggaatttttggaaaagaactacaaggaaacctctggacaagaaactgtcaaacttactattcgtgctctgcttgaagttgttgagagcgggggcaagaacattgaagttgctgtaatgacaaaggaaggactgcgtcaacttgaggaaactgaaattgatgtaattgttgcagagattgaagctgaaaaagccgccgcagaagctgcaaagaaaactccttctatgcaaacataatattgtcaaacacctctcctcaatccagaataattctttctttagactccgtttgttaaaccaatttcagacatgtatgtggctttttgtttctgtatggaatttgactgtttgaacgttatctgctgtgttatgaaagttgagaaacttggaggcctcttacaaactgacatgaccgggggtccacatggctactttggtcaatgtttttacctaccaggtaaatatcaaacatgatctaaatcctttcattataatccc

SEQ ID NO: 3731 - DNA, 924 bp, Allium cepa
taccaaaccattctaaaatggctcgttacgatcgtgcaatcaccgtgttctcgcctgatggtcatctttttcaagtggaatacgccctcgaagctgtacggaaaggcaacgctgccgtcggcgttcgtggtaccgataatgtagttctcggtgtcgagaagaagtcggctcctaaactgcaagattctagatctgtacgtaagattgtcaatctggacgaccacattgcactcgcatgtgcaggtctcaaagctgatgcacgtgtcttaatcaacaaagcaaggatagagtgccagtcacacaagcttacagtagaagatccagttactgttgagtatatcactagatatattgctggattgcaacaaaagtacacacaaagtggtggtgtgcgtccatttgggttgtccactttgatagttgggtttgatccgtacacaggtgtgccttctttgtatcagaccgatccatctggtactttctcagcttggaaagcaaatgcaactggaaggaattccaattctatgagggagtacttggagaagaactataaagaagtagcagggcaggaaactgtcaaacttgctattcgggctttgctcgaggtcgtcgagagcggaggaaagaacattgaaattgcagtgatgacaaaagagggaggactgaagcagcttgaagaatcagagatagatgcaattgttgcagaaattgaggctgagaaagctgctgctgaagcagcaaagaaagctcctagagattgatgcatgatttaatgcaatgctattatctatcgcctaacggtcctggacctgtaatcatgaattatttttctgtgccagtttcagaaatttgtctcttttgttcagcgtagagaaatttgcttcgtttctatctttgtgactatgttaaattgttttattcggg

SEQ ID NO: 3732 - DNA, 918 bp, Ambrosia trifida
ataataataataataataataaatggctagatacgacagagctataacggtgttctctccagacggtcacctgttccaggtcgaatacgctttagaagccgtacgcaaaggtaacgctgccgttggtgttcgcggcaccgatgccatcgttcttggcgttgaaaaaaaatccaccgtcaaacttcaagactctagatcagttaggaagattgtaaccctagatgatcacattgcattggcctgtgctggacttaaagcagatgctcgtgttctcataaaccgcgcgcgaattgagtgccagagccatcggcttactgttgaggatccagtgacggtagagtacatcacgcgttacattgcaggtcttcagcaaaagtacacacagagtggtggtgtgaggccgtttgggctttcaactttgattgtggggtttgatccttacacgggtgttccgtcactgtatcagacagatccatctggtacgttttctgcgtggaaagctaatgctacgggtaggaactctaattccatgagggagtttcttgaaaagaattacaaagaaacctctggccaagaaactgttaaacttgccattcgtgctctgctggaagttgttgagagtggggggaagaacatcgaagttggtgtaatgacaaaagagggactgaagcaactcgaggaagatgagatcgacacaattgttgcagagattgaagctgaaaaagctgctgcagaggctgcaaagaaagcaccctctaaacaaacataatttcatttgtcacaccatcaattccaaataattatcattttagacattttcagttaaaagtgatttgagacatgtatgtggcctttgtcaatgtttatgcaattttactgtgctgtgtatttttgaagtgtaatacttaagcgtaagtt

SEQ ID NO: 3733 - DNA, 820 bp, Cirsium arvense
caaatcagaagttcgaattcaaacacaatatctacaaatctcgttgaatctgatcatcaatggcgagatatgacagagctataacggttttctctccagacggtcatctcttccaagttgaatacgcccttgaagccgtacgtaagggtaacgccgccgtcggtgttcgtggcaccgataccattgtattaggcgtcgagaagaagtccaccgtcaagcttcaggactccagatcggtgaggaagattgtaagcctagatgatcacattgcactggcttgtgctggacttaaagcagatgcccgtgttcttataaatagggcacggattgagtgccagagccataggcttactgttgaggatccagtgactgtagagtatatcacacgatatattgcaggtcttcaacagaaatacacacaaagtggtggtgttaggccatttgggctttcaactttaattgtagggtttgatccttatacgggtgttccatcattataccagacagatccttctggaacattctctgcttggaaagctaatgccactggtagaaactccaattccatgagggaatttttggaaaagaactacaaagaaacctctgggcaagaaactatcaaacttgccattcgtgctctgcttgaagtggttgagagcggaggcaagaacattgaagttgctgtgatgagaaaggagggactgcggcaacttgaggaagcggagatcgatagcattgttgcagagattgaagcagagaaagctgctgcagaggctgcaaagaaagctcctgcttctaaacaaacataataatatgttat

SEQ ID NO: 3734 - DNA, 1100 bp, Cucumis sativus
tggtaccttgttgctcaagttgggatttctctctataattttccttgtgaaagagaaagaaggagctgaagcaagacaacaatggctagatacgatagggcaatcaccgtcttctcccctgacggccatttgtttcaagtcgaatacgctctcgaagctgtgcgcaagggtaacgccgccgtcggtgttcgtggcaccgatactatcgtcctcggtgttgagaagaaggctacgcctaagcttcaagactccaggtctgtgagaaagattgtgaatcttgatgaccatattgcactagcctgtgctgggctcaaggccgatgcacgtgtcttgatcaatagagctcggattgagtgtcaaagccatcggcttacagttgaggatccagtaactgttgagtatattactcgttacattgcaggtcttcaacagaagtatacccaaagtggtggagtgcgaccatttggcctctcaaccttgattataggttttgatccatatactggcgctccctccctgtatcagacagatccttctgggacattttcagcttggaaagcaaatgcaactggtagaaactcgaattcaataagggaattcttagagaagaattataaggaaacttctggtcaggaaactgtgaagcttgctatccgtgcattgcttgaggttgtcgagagtggtggaaagaacatagaggtggcggtgatgacaaaggagcatggactacgacaattggaagaagcagaaattgatgctctagttgcagaaattgaagcagaaaaagcagctgctgaggctgcaaaaaaagctcctcccaaggaaacatgatccaatttcttgcatttcttcaggcattttttaatcttttagttttatagtgtaacgagtggaccgttcaatcttgttctgaacttcaaaacttgttccattttgtttatgattgacacgaggtgggtgtagctgtagcctctgagaaatgcctgtttattacccttccagcctctttcgatgatctgatttgtgtattgttgttgagattattgtttggattttactcacaaagagcatccatatatcagttgaattttaccctatgg

SEQ ID NO: 3735 - DNA, 989 bp, Cucurbita pepo
gctcaagtcgggtttctttctaagattggcgctgcaaaaagcagggtgcgaaagagctgaagcgagagaacaatggcgcgatacgatagggctatcactgtcttctcccccgatggtcatttgtttcaagtggaatacgctctcgaagccgtgcggaagggcaacgccgctgtcggtgttcgtggcactgatactgtcgtcctcggtgttgagaagaaggctgcgcctaagctccaggactcaagatctgtgaggaagattgtgaatcttgataatcatattgcacttgcttgtgctgggctcaaggcagatgcacgtgtcttgataaatagagctcgcattgagtgtcaaagccatcggcttacagttgaggatccagtaactgtggaatatattactcgttacattgcaggtcttcagcagaagtatactcaaagtggtggagtacgaccatttggcctctcaaccttgattataggttttgatccatatactggcgcaccctcactgtaccagacagatccttctgggacattttcagcttggaaagcaaacgcaactggtagaaactccaattcaataagagaattcttagagaaaaattataaggagacttctggtcaggaaactgtgaagcttgctatccgtgcattacttgaggttgttgagagtgggggaaagaacatagaggttgctgtgatgacaaaagagcaaggactgcgacaactggaagaagctgaaattgatgctctcgttgcagagattgaagcagaaaaagcagctgccgaggctgcaaagaaagctcctcccaaggaaacatgatcccttttcctccatttcttcaggcatttcttaatcttttacttttctggtgtagtgcatgaatcgttaaatcttattttgaaagttcaaacgttagcattgtgtgtatcattgacatgaggtggccatagatgtagcctctgaaaatgccctatttcaatgggatt

SEQ ID NO: 3736 - DNA, 1020 bp, Cynara scolymus
cggggagagatcaattgcaatcagaagtccgaattcaacacaatacctagcaatctcattgaatctgatcgtcaatggcgagatatgacagagctataacggtgttctctccagaccgccatctcttccaagttgaatacgcccttgaagccgtccgtaagggtaacgccgccgttggtgttcgtggcaccgataccattgtattaggcgtcgagaagaagtccactgtcaagcttcaggactccacatcagttaggaagattgtaagcctggatgatcacattgcactggcttgcgctggactaaaagcagacgcccgtgttcttataaacagggcgcggattgagtgccagagtcatagacttactgttgaggatccggtgactgtagagtatatcacacgatacattgcaggtcttcaacagaaatacacacaaagtggtggtgttaggccatttgggctttcaactttaattgtagggtttgatccttatactggtgttccatcactatatcagacagatccttcaggcacattctctgcttggaaagctaatgccaccggtagaaactccaattccatgagggaatttttggaaaagaactacaaagaaacctctgggcaagaaactatcaaacttgccattcgtgctttgcttgaagtcgttgagagtgggggaaagaacattgaagttgctgtgatgacaaaggagggactccggcaacttgaggaagccgagatcgatgccattgttgcagagattgaagcagagaaagctgctgcagaggctgcaaagaaagctcctgcttctaaacaaacataatgttatgttgtcgcccccaaataatttttttttctccagttggaccttttttgatgtggcttaatgtcctggttaaagttcatgtagtggaaatccttatcttttctaaattcgaattcagacgttgtagaagccctttacgatgactctaagccatttgtagtctgttatgcttaaattggttcggttaaaaaag

SEQ ID NO: 3737 - DNA, 1170 bp, Citrus sinensis
gtaataattgaaggtaaaaaaagagaggaaaaagaaaaagtgagtgacttgttctctaagttggttgagaaaactcactaatcacactcaaaataagaaataattaataagctggaaagaagaaaaagaaactcgaatcagagagacgcagaaatcgatcgagaagaggaaaattagagagatttgacatggcgagatacgatcgagcaatcactgtattttcaccggatggccacctgttccaagtggaatacgcactagaggccgtacgcaaaggcaacgccgccgtcggcgtgcgcggcaccgacaccatcgttcttggcgtcgaaaagaaatccactgtcaagcttcaggactccagatcagtgaggaagattgtcagcttggataatcatattgcattggcctgtgctggacttaaagcagatgctcgtgtactgataaacagggctcgaatagaatgtcagagccacaggctgactgttgaggacccagtaactgttgagtacatcactcgttacattgcaggtctccagcagaagtacacacaaagcggtggtgtgagaccatttggtctttctactctgattgtgggctttgatccatacactggcgtgccatcactatatcagacagatccttctgggacattttctgcttggaaagctaatgcaactgggagaaactctaattcaatgagggagtttctggagaaaaactataaggaaacttccgggcaagaaactataaagcttgcaattcgggcattacttgaggttgttgagagtgggggcaaaaacatagaagttgctgtgatgacaagggagaagggtctgaagcagcttgatgaagctgaaattgatgccatggtagccgagattgaagcaaagaaggccgccgctgaggctgcaaagaagggacctcccaaggaaacatgagtttttagttctggcttctgttttttccattgcctgttgtttttcacctttcagaattttagtatgctttttttgtggttaagttttatatgcttttagatttgcattcaaaagatataacagagcaccagattattgccagcttaaattttcttatatggtcatttaatatttatggattatggtgagcgttgttggggcatgagacctgtttgttccgagtcttactttc

SEQ ID NO: 3738 - DNA, 831 bp, Carica papaya
ctttttctttctcagagacccggatcatagagagcaaagctaaaatcctaatacaaaaagctagcgaaactcagttcgggaagtgaaaaggaaaataacgagaagcagaaaaggtaaattatggctcgatacgatcgtgcgatcacggtgttctctcctgatggtcaccttttccaagttgaatacgctctcgaagccgttcgcaaagggaacgcggccgtcggggttcgtggctccgacatcgtcgtcctcggtgtcgaaaagaaatctactgcgaagctccaagactctagatcagttaagaagattgtatcattagatgaacacattgcgttggtctgtgctggtttaaaggcagatgcacgggtcttgatcaacagggcacggattgagtgccagagccatcggcttacagttgaggaccctgttactgttgaatatataactcgttatattgctggtctgcaacagaagtacacacaaagtggtggtgtgaggccatttggtctctcaaccttaatagttggttttgatccatacacaggggtgccatctctttatcaaacagatccatctggaacattttctgcatggaaagctaatgcaacagggagaaactcaaattcaatgagggaatttctggagaaaaattataaagaaacatctgggcaagaaactgtgaagctagcaatccgtgccttgctggaagttgttgagagcgggggaaagaacatagaaattgccgtgatgagaaaagagcatggactgagacaacttgaggaagccgaaatcgatgccattgttgccgaaatagaagctgaaaaagcagcg

SEQ ID NO: 3739 - DNA, 1283 bp, Capsicum annuum
gcacgaggagtaatcgaaagggtttcttgatacgacgccgcagtgcctgtcgtccaactcaattggcttgttgcccaagaagtgtgtatattttgctgaggcatttcttttctaaaatcatataaataggttggagggaaaagttttcttaagcgatacgcacagatcggaaggaagtgaaatcactcaaatcccaaattgttgaatagctttatagtaagagataatggctagatacgacagagcgatcacagtattctcaccggacggccacttattccaagtggagtacgccatggaagccgtacgcaaaggtaacgctgcagttggtgtacgtggcactgacactgttgtacttggtgttgagaagaagtctactcctaagcttcaagactccaggtcagtgagaaagatagtaaatctagatgatcacattgcattggcctgtgctgggctgaaagcagatgcacgggtccttgtgaataaggcacgcattgagtgtcagagtcataaacttacggttgaagatcctgttaccgttgagtatataactcgttacattgctggtcttcagcaaaagtacactcaaagtggtggggtaaggccatttggtctatccaccttgatcattggttttgacccacacacaggtgtcccctcactttatcaaacagatccatcgggtacattctcagcttggaaagccaatgcgactggtagaaactccaactctattcgggagttcttggagaagaattacaaagaaacatctggccaggaaactgtgaaactagcaattcgtgctttgcttgaagttgttgagagtggtggaaaaaacattgaagttgcactgatgacaaaagagcatgggcttaggcaacttgaggaagctgaaattgatgccgttgttgctgagatcgaagcagagaaagcagctgcagaagcagctaaaaaggcccagccgaaagaaacctagttctgctgaaattcatccttaactttacctgaatctatcttttttctattttggatccagtaaagtgcagtgttccttgaattttaacattttggtctgactaatacttggtgcttcaaagactgttctgcttgtcggacaagacctttgttaaaatggttttatgggccaaaagaagtcacgctcccgcgatctctgccctatttgagtgttgcttaatattttaaaagttttatcatgttatttggtagttcttctagtttggaaatttggttgtgaaataacagcgttgtttgtgttctttcct

SEQ ID NO: 3740 - DNA, 1038 bp, Scabiosa columbaria
tgcctgacttgtgctctaagctgaaaattgagatcgtcttcttccttgtacaaatacaaacaacagcgccacttacaaatcacaaaccataacactcaatacaagctaagcaatggcgaggtacgatagagcaattactgtcttctcccccgatggtcatctcttccaagtcgaatacgcgcttgaagccgtcagaaagggcaacgccgccgtcggcgtcagaggcactgataccgtcgttctcggcgttgagaagaagtctaccgtcaaactccaagactccagatcagttaggaagattgtgaatctagacgatcacattgcactggcctgcgctgggttgaaagccgatgcacgtgtccttataaacagagcaagaattgaatgtcagagccacaagcttactgttgaggatcctgtgactgtggaatatatcacgcgttacattgctggtcttcagcagaagtacacacaaagtggtggtgttaggccatttggtctctcaactttgattgttggttttgacccatacactgatgtaccctcactttaccagacagatccttcagggactttctctgcttggaaagctaatgccactgggagaaactctaattcaatgagagagtttcttgaaaagaattataaagaaacatctggccaagaaactgtaaagcttgctgtacgtgcgctacttgaagttgttgagagtgggggtaagaacatcgaagtggctgtgatgacgaaagacaaaggactgaagcagcttgatgaagctgaaattgatgcaattgtttcggagattgaagctgagaaagcagctgctgaggctgcaaagaaggctccacaaagggatgcataactctgtttttccttccccgaataacaattaatgttcaatgtcattttgactttgtttgcactgcactcatttgttggagtctaaattatatttggaatcattatcagttcagtgtttgattcaggtggattatgcttatgcttaaaaatgcttatgcttatgaaagttcaggaccg

SEQ ID NO: 3741 - DNA, 989 bp, Eutrema halophilum
gggaaaaggaaagcaaaagtatcatcggacaaaagagaacggcgtgagagatggctagatacgaccgagcaattaccgttttctcccccgacggccacctcttccaagtagagtacgccctagaagccgtccgcaagggtaacgccgccgtcggagtccgcggcaccgacaccgtcgtcctcgccgtcgagaagaaatctactcctaagcttcaggattctagatcagccagaaaaattgtgagccttgataatcacattgccttggcatgcgcgggtctcaaggcagatgcacgtgtgctgatcaacaaggcaaggattgagtgtcaaagccacaggcttacactagaggacccagtgactgttgagtacatcacgcggtacatagcggggcttcaacagaagtacacccaaagtggtggtgtcagaccctttggtctttctactcttatcgtcggctttgacccttactctcatgtgccatccctctatcagactgatccttctggcactttctctgcttggaaagctaatgctaccggcagaaactccaactcgattagggaattcctggaaaagaactacaaagaatcctccggccaagaaactgttaaactcgctatccgtgctctgctcgaggtagtcgagagcggaggaaagaacattgaggttgctgtaatgactcgggaggaaagtgggctgcgccagctagaagaggctgaaattgatgctattgtggccgagatcgaagcggagaaggcagccgcagaagcagccaagaaaggccctccaaaggaaacttgataatacaatacctcaatttaacaactctggtctcctttctctgttatctacttttctatgttttgttacaagacctgctacacctcaatttagatttcgcttgaactttgatcaaaccaaggataaaattcgctgtgcacattgttagatggagaagtgaatgtcaatttgctaattagaaggaag

SEQ ID NO: 3742 - DNA, 1040 bp, Nicotiana tabacum
ggccattacggccgggggaaggaaagagcattcagtagcaacactcagagatcggaagaaacttcaacacacagagcccaaagtttccgatagcttttacttatagccatggctagatatgatagagcgatcacggtgttctcgccggacggccacctattccaagtggaatacgccctcgaagccgtacgcaaaggtaacgccgccgttggtgtacgtggcactgacactgttgtccttggcgttgagaagaagtctactcccaagcttcaggactctaggtcagcaagaaagatagtaaatctggatgatcacattgcattggcctgtgctgggctgaaagcagatgcacgagttcttgtaaacagggcacgcattgaatgtcagagtcataggcttactgttgaggatcctgttactgttgagtacataactcgttacattgctggtcttcagcaaaagtacactcaaagtggtggtgtaaggccatttggcctatctaccttgatcattggtttcgacccatacaccggtgtgcccgcgctgtatcaaacagatccatcgggtacattctcagcttggaaagccaatgcgactggtagaaactccaactctcttcgggagcttttggagaagaactacaaagaaacatctggccaggaaactgtgaaactagctatacgtgctttgcttgaagttgttgaaagtggtggaaagaacatagaagttgctgtaatgacaaaagagcatgggcttaagcaacttgaggaagctgagattgatgccattgttgctgagatcgaggcagagaaagcagctgcagaagctgccaaaaaggcccccaaagaaacctagttctgctgaaattcatatctgaatgtgttccctgaactttttcaatttgatcaaaaagtgttaagtgttcgctaaattttaacttgttgctctgactaatattttgtgcttctaagactgatcttgtagtcgggcaagacatttgttaatattgtttaatggggcaaaagaagtcatcgtctgcg

SEQ ID NO: 3743 - DNA, 1014 bp, Nicotiana tabacum
gttcaccaagatctctctgtgctctcttttgattgaccagtagtgatcacaggaacctcaaagtctcaaaccctagctgcacatttcacaattaaccaccaacaatggctagatacgatagagccatcaccgtcttctcgccggacggccatctattccaagtagaatacgctctcgaagccgtacgtaaaggtaacgccgccgtcggcgtccgcggtactgataccgttgtccttggcgttgagaagaaatctacccctaagcttcaggactctaggtcagtaagaaagatagtaaatctagatgatcatattgccttggcctgtgctggcctgaaagcagatgcccgagtcctcgtaaatcgggcacgtatcgagtgtcagagtcataggcttacagttgaggatccagttaccgttgagtacataacacgttacattgctggtcttcagcaaaagtacactcaaagtggcggtgttaggccatttggtctttcaaccttgatcatcggttttgatccttacactggtgtcccttcactttatcaaacagatccatctggaacattctcagcatggaaagccaatgcaacagggagaaactccaactctctccgggagttcttggagaaaaattacaaagaaacatctggccaggaaactgtgaaacttgcaatacgtgctttgcttgaagttgttgagagcggcggaaagaatattgaagttgctgtcatgacaaaagagcatgggcttaagcaacttgaggaagctgagattgatgccgttgttgctgagattgaggcagagaaagcagctgcagaagctgcaaaaaaggctcttccaaaagaaacctagttctgccgaaattcttatttgaaaatgtttctgaatttttactggttgctctattcaacttctaaagactgatcttgttgtcagtcgagacctgtattgtggctaaactttttgttatagtgagagtcgtcatcttctatcactgattatatactggtca

SEQ ID NO: 3744 - DNA, 870 bp, Juglans hindsii x Juglans regia
tagaataagtagaaaaaaagagcggagaaagagaaagaagcggaagatggcgaggtacgacagggcaatcacagtattctcaccagatggccatctgtttcaggtcgaatacgccctcgaagccgtgcgcaagggcaacgccgcagtaggcgtccgtggcaccgacaccatcgtcctcggcgtcgagaagaagtccactgccaaactccaagactccagatcggttaggaagattgtggacttggatgatcacattgcactagcctgcgctggactcaaggctgatgctcgcgttctagtaaacagggcacggattgaatgtcaaagccataggcttacagtcgaggatccagtgactgttgagtacattactcgttacattgcaggtcttcagcaaaagtacacacaaagtgggggtgtgagaccatttggcctttcaactctgatcattggttttgatccctattctggtgcaccatcattgtatcagacagatccttctgggacattttcagcttggaaggctaatgcaactgggagaaactctaattcgataagggagtttctggagaaaaactataaagaaacttctgggcaagaaacagtgaagcttgccatccgtgcattgctcgaggttgtggagagcggggggaagaacatagaagttgctgtgatgactagggagcatggactacggcaacttgaggaagccgagattgatgcaattgttgccgaaattgatgcagagaaagcagctactgaggctgcaaagaaggctcctccaaaggatacatgatctcattttcatttttctcatcctcctgtttattgtttttctacaactaccaccaatgttatgcggggggagtt

SEQ ID NO: 3745 - DNA, 1049 bp, Panax ginseng
gcctaagacgagagagtctttattctcgttctgaactcccctccctctcacaagcaatcgatcgatcgatccattgggaattgggcgaatctgtgggtaaagggtgaaattaaagtaaatggcgagatatgatagagcaatcactgtgttctcgccggacggccaccttttccaggtggaatacgctctggaagccgtccgtaagggtaacgccgccgtcggcgttaggggcaccgataccattgttctcggtgttgagaaaaaatccaccgtcaaacttcaagactcaaggtcagtgaggaagattgtgaatctggatgatcacattgctttggcctgtgctggacttaaagcagatgctcgagttcttataaacagggcacgtattgaatgtcaaagccataagcttacagttgaagatcctgttactgttgagtatattacacgatacattgctggtcttcaacaaaagtacacacaaagtggtggtgttaggccatttggcctttcaactttgatagtgggttttgacccatacactggcgtgccatcactatatcagacagatccttcgggaacattttctgcttggaaagctaatgctactgggagaaactccaattcaatgagggagtttttggaaaagaattaataaagaaacctctggccaagaaacgataaaacttgctattcgtgcgctgcttgaagttgttgagagtggaggaaagaacatagaggttgctgtcatgacaaaagatcagggtctccatcaacttgatgaagctgaaattgacgctgttgttgctgagattgaagcagagaaggaggctgcagaggctgcaaagaagggcccttccagggagacataactcgaatttttactttcccccataacaaattataatgggaacatgtaatctttacttatttgtgtgttgggacttctatggtgttcagattctttagaatgttaatcgttatgtgccccaagtttattctccaatattatgaaagttgcggagcagttattcttgatacaggaagtatta

SEQ ID NO: 3746 - DNA, 1029 bp, Arachis hypogaea
acactcaacagaggaatcaacaaattaaaacacaaaacaaagcaaagaaagaagaaacctttttgactcaacaacacagcacaacacagatttgaatcgcaccaccacccatggccaggtacgatagggctatcactgtcttctcgccggacggccacctcttccaggtcgaatacgctctcgaggccgtccgcaagggcaacgccgccgttggagtccgtggcaccgacaacgtcgtgctcggcgtcgagaagaaatccaccgccaagctccaagactccagaacggtgaggaagattgtcaatctggacgatcacattgctcttgcttgtgcaggactaaaagctgatgcacgtgtccttataaacagggcaagagttgaatgtcaaagccataggcttactgtcgaggatccagtgacggtagagtacataactcgttacattgcaggtcttcagcaaaagtcacacaaagtggtggtgttcggccctttggcctttcaaccttgattgttggctttgatccatacactggtacaccatccctgtatcaaacggatccttctggcacattctcagcttggaaagccaatgcaaccggtagaaactcaaattcgatccgggagttcctagagaagaactacaaggaagtttctggccaggaaaccataaaattagctatccgagcattgcttgaggtcgttgagagcggaggcaagaacattggagttgctgtgatgacgaaagagcaaggcttgcgtcaacttgaggaagccgaaatcgatgctattgtggccgagattgaagccgagaaagcagcagctgaggccgcaaagaagctcctcctaaggagacatgaattttctgtttcttttgttttgtatcatgcgatcaatgttcttactaggtgttggccctactttagtgaagcaaaattaaagccactgtggctaatattgaacgaagaaaacagctgttgaggctgcaaagaaagatcgtttgaggagacatttatttacttgtgtttttc

SEQ ID NO: 3747 - DNA, 1109 bp, Petunia hybrida
ctttttttgcctttctcgtcaattcccttctctagcttgtcccccaagatctctccatcagtctgatcagaggaacttcaaaaccctaactacacaatttacacaaataaccacaaaaaatggctagatacgatagagcgatcacagttttctcaccggacggacatttattccaagtagaatacgccctggaagccgtacgtaaaggtaacgccgtcgtcggagtccgtggaactgacaccgttgtacttggcgttgaaaaaaatctactcctaagcttcaagactccaggtcagtaagaaagatagtaaatctagatgatcatattgccttggcctgtgctggactgaaagcagatgctcgagtcctcgttaatcgggcacgtatcgagtgtcagagtcatagacttacggttgaagatccagttaccgttgagtacattacacgttacattgctggtcttcagcaaaagtacactcaaagtggtggtgtcaggccatttggtctttcaaccttgatcattggttttgatccctatacaggtgtcccttcactttatcaaacagatccatctggaacattctcagcatggaaagccaatgcaactgggagaaactccaactctattagggaattcttggagaagaattacaaagaaacatctggtcaggaaactgtgaaactagcaatacgtgctttgcttgaagttgttgagagcggcggaaagaatatagaagttgctgtcatgacaaaagagggtgggcttaggcaactcgaggaagccgagattgatgccattgttgccgagattgaggcagagaaagcagctgcagaagctgcaaaaaaggctcctgcgaaagaaacctagtttcgccgaattcttatttgactatcttccttgaattttaatttgttgctcactattctacttcgcaagactaatcttgttctcctgaaagacctgcatcgtgctaaatctctttctatagagtaaaaagaaagtctatgatcttctaccattgattataatgttcaacaaatgttgcttaagccatggtctctttttcacggtgcttgatatatgaagcatggaatgtagtggttccgtc

SEQ ID NO: 3748 - DNA, 1088 bp, Trifolium pratense
gaatagaaagaagatcaaaatggcgagatacgatcgagcaatcacagttttctctcccgacggccatctcttccaagttgaatacgctctcgaagctgttcgtaaaggtaacgccgccgtcggtgttcgtggtaccgacaacgttgttctcgaacgttgttctcggcgtcgaaaagaagtccaccgctaagctccaagactctagatcagtgaggaagattgttaatcttgacaatcacattgctcttgcatgtgctggactaaaagctgatgcacgtgtccttataaaccgtgcccgagttgaatgtcaaagtcaccggcttactgttgaagatccttgtacagtggagtatattactcggtacattgcaggtcttcagcaaaaatacacacagagtggtggtgtgcgtccctttggcctttccactttgatagttggttttgatccttacaccgggtcaccgtcgctgtaccaaactgacccttctggtacattttctgcatggaaagccaatgctactggaagaaactcaaattcgatccgtgagtttcttgagaagaactttaaagaaacttctggccaagaaactgtcaaattggctatcagggcattgcttgaggttgttgagagtggaggaaagaacattgaagttgccgtgatgaccaaggaggatggactgcggcaattagaggaagctgaaattgatgcaattgttgctgagattgaagcagagaaagcagctgctgaggctgcaaagaaagctcctttcaaggatacatgattctagatttttacgaagcatcattcttgttagttgttggctctacctattgtaatctataatttgccatcgtatctgagattgaaacacaaaagagagctgctgatgctacacaagagctgccgtttttctatatttgtttatcttgtgaattgttgttgttgggtgttggcctaacttaaaatgacttctttttattgtttttcttagttcaattgcctgttagtatcattcaagattgccaatgccaatggagttcaattttaaaaatttggcatacctatgctttatgtttattgttgttgt

SEQ ID NO: 3749 - DNA, 878 bp, Castanea mollissima
gagagatggctcggtacgatcgtgcaataacagtgttctcaccggacggccatttgttccaggtggagtacgccctcgaagccgtccgcaaaggaaacgccgccgtcggagtgcgtggcttagacgccgtcgttcttggcgtcgaaaagaaatccactcccaaactccaagactccagatcagttaagaagattgtgtcattggataatcacattgcgctagcatgtgctgggttgaaagcagatgctcgtgtcttgataaatcgggcacgcattgaatgtcaaagccacaggcttacagttgaggatcctgcaaccgtcgaatatataacacgtcacattgcaggcctgcagcaaaagtatacacaaagtgggggtgtaagaccatttgggctttcaactttgattgcaggttttgacccatacactggcacgccatctctttatcagacagatccatcaggaacatttcaggcatggaaagccaatgcgacggggagaaactcaaattcgatgagggagtttttggaaaagaattataaagaaacttctggacaagaaactgtcaagttggcaattcgtgctttgcttgaagttgttgagagtggagggaagaacatcgaaattgctgtgatgacaaaagagcatgggctgcaccaactcgaggaagctgaaattgatgccattgttgctgaaattgaagcagaaaaggcggcagcagaggctgcaaagaaggcccctgcaacaaaggaaacctaattctgttttattatcatatttcaactgcactttccgagtcaattaattttttgccattgaacatcactgtttcatgtaactttagcatccacactgagttcaatgaggacctgatttcaa

SEQ ID NO: 3750 - DNA, 1381 bp, Cocos nucifera
cggtcagcccttttgccttcctccccaagcctgctccactattatctctctttttcattccatcgccagccgccaccaatatcggagctccaaggtaacagagagagaaagaaaccgagttaaagaattctctttaaggtacccatagaaacgctaggaaagaagaagaagagaaggcattaccatcgccatggcccgatatgatcgcgccatcactgtcttctcccccgacggccacctcttccaggtggaatacgccctcgaggccgtccgcaagggcaacgcagccgtcggcgtccgcggcaccgacaccatcgttctcggcgtcgagaagaaggccacccccaagctccaagactccagatcggtgaggaagatcgtgagcctggacaaccgcatcgcgttggcctgcgccggactcaaggccgacgcccggatcctcatcaaccaggcccgcaacgagtgccagagccaccgcctcacggtggaagaccccgtcaccgtcgagtacatcacccgctacatcgctgggctccagcagaagtatacccagagtggcggtgtaaggcccttcggcctctcaacccttatcattggcttcgatccctacaccggggtgcccgcgctctaccagacggatccctcgggtaccttctcagcctggaaggccaatgccaccgggaggaactccaactctatgagggagttcttggagaagaattacaaggagacttctgggcaggagacagtgaagctggcaatccgagcactgcttgaggttgttgagagtggaggaaagaacatagaaattgctgtgatgacaagagagacaggtcttcgtcaacttgatgaagctgaaattgatgcgattgttgctgagattgaagcggagaaagctgcagctgaggctgctaagaaggccccttccaaggaaacttgatgttggatgttttcgtgaaatccgggaaacgttttgtttttcgttgcttgttctttgttccaaaaccttttattttatttgtgtgctggatgctgtggggtaagatggtaaactcaaacttttttctagtcagaccttgttttcatgactgacatttttatatatggcataccaaaatatgatgtcaattcctccagacatcttgatctgctgttaattttgtggtcatctcctaattattgagccaggtttgcttcccaccatattggtttttgtgagaaaaggagttgagctccacctacttcatcaagataattaaaggagctcaaataaagaggaatggaagaattagacagtacaaatacaatgttgggatgatattttctgtggctaagaaacacatcaagaatacaacctcataccatctgatgtttggaggcc

SEQ ID NO: 3751 - DNA, 1073 bp, Allium cepa
atttttacagaaaatttagttctttactaagtggatactgcgacaagtttttggtcttaaatcgcactgcttttctaggtactttgtttttcatttttcagcttaccaaacaattctgaaatggctcgttacgatcgtgcaatcaccgtgttctcgcctgacggtcatcttttccaagtggaatacgccctcgaagccgtacggaaaggtaacgctgccgtcggggttcgtggtaccgataatgtcgttctcggtgttgagaagaagtcagctcctaaactgcaagattctagatctgtacgtaagattgtcaatctagacgaccacattgcactcgcatgtgcaggcctcaaagctgatgcacgtgtcttaatcaacaaagcaaggatagagtgccaatcacacaagcttacagtagaagatccagtcactgttgagtatatcactagatatattgctggattgcaacaaaagtacacacaaagtggtggtgtgcgtccatttgggttgtcgactttgattgttgggtttgatccgtacacaggtgtgccttctttgtatcagacagatccgtctggtactttctcagcttggaaagcaaatgcaactgggaggaattcaaattctatgagggagtacttggagaagaattataaagaagtggcagggaaggagactgttaaacttgccattcgggctttgcttgaggttgttgagagcggaggaaagaacattgaaattgcagtgatgacaaaagaggaaggactgaagcagcttgaagaatcggagattgatgcaattgttgcagaaattgaggcggagaaagccgccgctgaagctgcaaagaaagctcctagagattgatagctgatcaatgcaatgctattgtcacctagtagtcctggatgtgtaatgtcatgaattattttccgtgctacattcagaaatttgtcttcttaagttcaacatagagaaatttgcttcttttctgtatgacttttcatgttaaattgttttattccaaagttagttgtaatgtgttaaactttttgtaatctaatgttgggatattt

SEQ ID NO: 3752 - DNA, 904 bp, Allium cepa
tagttacgggggctcctctttttattttgtgcttctgctgcaaggcaaaatcctaatctataataaagttaatcctcaaccttcgcattaaaagaagtctgtaaaatggctcgctacgatcgtgcaatcacagtattctcaccagacggtcatcttttccaagtagaatacgcactcgaagctgtacggaaaggtaacgcagccgtcggagttcgtggtaccgataatgtggttcttggtgttgagaagaagtcaactcctaagttgcaggattctagatctgttcgtaaaattgtgaatctagacgaccacattgcacttgcatgtgcaggtctaaaagctgatgcccgtgtcttaatcaacaaggcgaggatagaatgtcagtcccacaagcttactgtagaagatcctgtcactgttgagtatatcactagatacattgcagggatgcagcagaaatacacgcaaagtggtggggtccgtccatttggattatctacattgattgtagggtttgatccatacacgggcgtgccttctttatatcaaacagatccttctgggactttctcagcttggaaagcaaacgcaactgggaggaattctaattcgatgagggagtacttagagaagaactataaagaagtggctggagtagagactattaagcttgctattcgtgccttgcttgaagttgtggaaagcgggggaaagaacatagaaatagcagtcatgacaaaagaggaagggctaaagcaactggaagaggctgaaattgatgccattgtcgcagaaattgaagcagagaaagctgctgccgaggctgcaaagaaagctccaagagataattgatcccatgcttttatttctactacgccttgttatatcattagaccataaacta

SEQ ID NO: 3753 - DNA, 1098 bp, Allium cepa
gaggggcaaagtggtagaaattagaaccagccaccgaggttttgggctttaatagtcctgctgttgtaagcccttggttcttcatttctactacgctgcccgtttcccatttctcagcttaccaaaccattctaaaatggctcgttacgatcgtgcaatcaccgtgttctcgcctgatggtcatctttttcaagtggaatacgccctcgaagctgtacggaaaggtaacgctgccgtcggggttcgtggtaccgataatgtcgttctcggtgttgagaagaagtcagctcctaaactgcaagattctagatctgtacgtaagattgtcaatctagacgaccacattgcactcgcatgtgcaggcctcaaagctgatgcacgtgtcttaatcaacaaagcaaggatagagtgccagtcacacaagcttacagtagaagatccagttactgttgagtatatcactagatatattgctggattgcaacaaaagtacacacaaagtggtggtgtgcgtccatttgggttgtccactttgatagttgggtttgatccgtacacaggtgtgccttctttgtatcagacagatccgtctggtactttctcagcttggaaagcaaatgcaactgggaggaattcaaattctatgagggagtacttggagaagaattataaagaagtggcagggaaggagactgttaaacttgccattcgggctttgcttgaggttgttgagagcggaggaaagaacattgaaattgcagtgatgacaaaagagggaggactgaagcagcttgaagaatcagagatagatgcaattgttgcagaaattgaggctgagaaagctgctgctgaagcagcaaagaaagctcctagagattgatgcatgatttaatgcaatgctattatcgcctaacggtcctggacctgtaatcatgaattatttttctgtgccagtttcagaaatttgtctcttttgttcagcgtagagaaatttgcttcgtttctatctttgtgactatgttaaattgttttattcgggagttggttgtaatatgttcactttttgtaatcttttattattgtgatattttcttcccc

SEQ ID NO: 3754 - DNA, 1139 bp, Amorphophallus konjac
gaacttttgccggtgccttctctcccaagttcgctccctccctccttcgctctccggcaacttcgcacagtgaagcggcagaagcagaatccaacatctctctctctctctcctccatggctcgttacgaccgggcgatcaccgtcttctcacccgacggccacctcttccaggtcgagtatgccctggaggctgtccgccggggcaatgctgccgtcggcgtccgcggcactgacaccgtcgtcctcggcgtcgagaagaagtccacccccaagctccaagactccagaaccgtgaggaagatcgtcagcctggacaaccacatagcgctggcctgcgccgggctgaaggcggacgccaggatcctgatcaacaaggcgcggatcgagtgccagagccaccggctcaccgtcgaggaccccgtgaccgtcgagtacatcacgcggtacatcgccgggctccagcagaagtatacacagagtgggggcgtgaggcccttcggcctgtcgaccttgatcataggcttcgatccctacacgagcgtgccctctctctaccagacggacccctcgggcacgttctcggcatggaaggcgaatgccacgggaaggaattccaattcgatgagggagttcttggagaagaactataaggagacgtctgggcaggagacggtgaagctggctatccgcgctctgcttgaagttgttgaaagcggaggaaaaacaatcgagattgctgttatgacaaaggagcacggccttcgtcagcttgaggaagcagaaattgatgccctggttaccgagattgaagcagaaaaggctgctgccgaaactgctaagaaggcccttcccaaggatacatgatctatctgtatgcgcacttccttaattttaccgtcgtgtacctatgtttcactttgctttgaggtcatgctttccttatctcaactgaagccccgtgcttctggaacagaatgccttcctctgggaggattcgttccgtgacctacttctgtgtccattccaccgcggaatgctactttgactgtttcaaagcggaatcatgctgaggctttggtctttcccaactgagggcggccattttatcgcttttctttcatcacacttttatcaaac

SEQ ID NO: 3755 - DNA, 1112 bp, Brassica rapa
aggggattaaaaaccgaactggagaaatctggcttgtcgcctaagttggaatcgattttaaacaaaacgaaagagagaaagaaacactcaacagagaagaagaaaagagtgagagatggcgagatacgatcgagcaatcacagtgttctcccccgacggtcacctcttccaggtagagtacgccctcgaagctgtccgtaagggtaacgccgccgtcggagtccgcggcaccgatactgtagtcctcgccgtcgagaaaaaatccacccctaagctccaggatacaagatcagcaagaaagattgtgagtcttgataaccacgttgcattggcctgtgctgggctcaaggcagatgcgcgtgtccttataaacaaggcgaggatcgagtgtcaaagccacaggcttacgttggaggatcctgtgactgtcgagtacatcactcggtacattgctgggcttcagcagaagtatactcaaagtgggggtgtgagaccttttggtctttccactcttattgttggttttgatccatacactcgtattcccgcgctttatcagactgatccatcgggtactttctctgcttggaaggctaatgcgaccgggagaaactcaaactcgatcagggagtttctggagaagaattataaagaaacttctggtcaagaaactgtgaagcttgctatccgtgctctgcttgaggtagttgagagtgggggaaagaacattgaggttgctctgatgacacgggaggaaggtactctaaggcagctagaagaagctgaaatcgatgctattgtggccgagatcgaagcagagaaggctgctgcagaagcagccaagaaaggcccttcaaaggaaacctgagcatgagccagatcttacaataacggtctcagttttcaagttgtaactttggttcaaagtaaagatatttgcgtgaatttgttttgtcggacggaccattagcctgtttgacattcttgctttaaatctttaattttaatatttttagcgatacttggtgaacctatggcctttcttgtttctggctataaatgtggaatgtttcatgaatactcttcttgtcatctatgcatcttctccatac

SEQ ID NO: 3756 - DNA, 1146 bp, Beta vulgaris
cgaaccccctcacacctcagttctcaaactcactgatttccatcgatttcgatcccagaagagagagaaaatcaacagatacattgttgaagaagaagaagagagataaaaaatggcgaggtacgatcgagcaattacagtgttttcacctgacggtcatctctttcaagtagaatacgcacttgaagccgtgcgtaaaggtaacgccgccgtcggagttcgtggcaccgacaccgttgttcttggtgtcgagaagaaatctgctgctaagcttcaagattccaggtcagtcagaaaaattgtaaaccttgacaaccatgttgctctagcctgtgctggactcaaagcagatgcccgtgttcttataaacagggcacgtattgagtgtcaaagccacaggcttaccttggaggatccagttacagtcgagtatataactcgttttattgccggacttcaacagaaatatacacaaagtggaggtgttagaccatttggactttcaactttgattgttggattcgacccatacactgatgtgccagcactgtaccaaacagatccatctggcacattttcagcttggaaggctaatgcaactggaagaaactctaattcactaagagagtttctagagaagaattataaagaaacttctgggcaagaaactatcaagctggctattcgcgcattacttgaagtggttgaaagtggaggaaagaacttagaagttgctgtgatgactaaagaaggtctgcgtcagcttgaggaatctgagattgatgccattgttgcagagattgaagcagagaaggcagcagctgaggctgcaaagaaagctcctgctagttcatcttaacttgcaggcttttgttctaggctgttcacttaacgtcttaatgctttccaattccggctttgtttagtctaaacattgaagtgttgcaaatcagacttggatttcatttgtgttgttcgtagacgtataatatatgtgataccattgaagtagctactaatcaatgggcgattgctgattttgcttcattatgagattggtaaaagtatgttcttgctgctgttggtctgacattttacattctaagatgagttgtgccaagtttagcagggacattcacttcttac

SEQ ID NO: 3757 - DNA, 1071 bp, Cleome spinosa
ccttttttactgttaacaaatcgtaagagagagaagaaaaaacctcgaaacccagagagagtgggagagagagagaggaagacgaagaagaagggaagggagaaaggtaagagatggcgagatatgatcgagcaatcaccgtgttttcccccgacggccacctcttccaggtagagtacgccctcgaagccgttcgtaagggtaacgccgccgtcggagttcgtggctccgacaccatcgtccttgctgtcgagaagaaatccacccccaagctccaggattccagatcggccagaaagattgtgagcctcgataatcacattgcgttggcctgtgctgggctaaaggcagatgctcgtgtcctgataaacagagcaaggatcgagtgtcaaagccacaggcttactgtagaggacccagtgactgttgagtacatcacccggtacatagctgggcttcaacagaaatatactcaaagtggaggtgtgagaccctttggtctttcgactcttatcgtcggctttgacccatacactggtgtaccctcgctttatcagaccgatccatctggtactttctctgcctggaaagccaacgcaaccgggagaaactcaaactcgatcagggagtttctcgagaaaaacttcaaagaaacctctgggcaagaaactgttaagctcgctgtccgtgctttgcttgaggtagtggagagcgggggaaagaacatagaggtagcggtaatgacaaaagagcatggacttaagcagctagaagaggccgaaatcgatgcagttgtggctgagatagaggcagagaaggcagctgcagaagccgcgaaaaaggcccctcccaaggaaacatgaacgacatcatggtcactgcctgggtttgcagtcacaggtagcagagtcatttctcgtttggtaagtgttttaatgttgggtttctgatatgatcaggaatgttgaaccgtttgaatatgttccatgttgaatttgatttggtaagacattggcgtcatcgtggcacatttgattatgtcgaatcaagaaatggagaaacatttgtccg

SEQ ID NO: 3758 - DNA, 1092 bp, Gossypium hirsutum
ttgtacactttgtcttcatggctgtcttccccaagttctttcagtcaaaaacacagtccctctctttacatttttcgaaacatcagatcgcaaatcaaaaaccaaaccgatccttcaacacaatctttgtcttgtgttcgaaaaatagaccaaacaaagtaccgaaattgaacgaaaaaaaaggcgtaattatcactgggaaaaaagctttaacgaaaaatcatggcgagatatgatcgagcaattactgttttctcccccgatggtcatttattccaagtggagtacgctcttgaagccgtccgtaaaggtaacgccgccgtcggagttcgcggcactgatatcgtcgtcctcggtgtcgagaaaaaatccgccgtcaagctccaagattccagaagtgttagaaagattgtgtccttggatgatcacattgctctggcttgcgcgggtttaaaagccgatgctcgagtcttgatcaatagggctcgaatcgaatgtcaaagtcataggcttacagttgaggagcctgtaactgtcgaatatataacacgatacattgccggtttgcaacagaagtatacgcaaagtggcggtgttagaccgtttggtctctcgacgttgatcgttggctttgatccctatactggcgttccttctctttaccagaccgatccatccggaacattttcggcttggaaggctaatgcaactgggagaaactccaattcgatgagggagtttctcgagaaaaattataaagaaacttccggacatgaaacgatcaagttagcgatccgtgctttgctcgaagtcgtcgagagcgggggaaagaacatcgaagttgccacaatgacgaaagagcatggactgcggcaactagaagaatccgaaatcgatgccatcgttgccgagattgaagcggagaaagcagctgcagaggctgcaaagaaggccctggccgcccctaaagaaacctagtttgatatcggatatctctccgatcgccccagcttgtgtcctttcattagtttgcatcatgcttttgtttatagggcttgattgttgttacaattagagactaatatatatata

SEQ ID NO: 3759 - DNA, 1026 bp, Panax ginseng
gagtctttattctcgttctgaactcccctccctctcacaagcaatcgatcgatcgatccattgggaattgggcgaatctgcgggtacagggtgaaattaaagtaaatggcgagatatgatagagcaatcactgtgttctcgccggacggccaccttttccaggtggaatacgctctggaagccgtccgtaagggtaacgccgccgtcggcgttaggggcaccgataccattgttctcggtgttgagaaaaaatccaccgtcaaacttcaagactcaaggtcagtgaggaagattgtgaatctggatgatcacattgctttggcctgtgctggacttaaagcagatgctcgagttcttataaacagggcacgtattgaatgtcaaagccataagcttacagttgaagatcctgttactgttgagtatattacacgatacattgctggtcttcaacaaaagtacacacaaagtggtggtgttaggccatttggcctttcaactttgatagtgggttttgacccatacactggcatgccatcactatatcagacagatccttcgggaacattttctgcttggaaagctaatgctactgggagaaactccaattcaatgagggagtttttggaaaagaattataaagaaacctctggccaagaaacgataaagcttgctattcgtgcgctgcttgaagttgttgagagtggaggaaagaacatagaggttgctgtcatgacaaaggatcagggtctccatcaacttgatgaagctgaaattgacgctgttgttgctgagattgaagcagagaaggaggctgctgaggctgcaaagaagggcccttccagggagacataactcgaaattttactttcccccataacaaattataatggcactccttttgaacatgtaatctttacttatttgtgtgttgggacttctgtggtgttcagattctttagaatgttaatcgttatgtgccccaagtttattctccaatattacgaaagttggggagcagttatt

SEQ ID NO: 3760 - DNA, 1192 bp, Gossypium raimondii
gcgttctgatgattttcattgtacacagtgtcttcatggctgtcttgtcccccaagttctttcggtcaaaaacacagtccttctctttacatttttcgaaacatcaaatcaaaaaccaaatcgatccttcaacacaatctttgtctttggttcgaaaaatagaccaaacaaagtaccgaaattgaacgaaaaaaaaaagaggcgtaaatatcactgggaaaaaagctttaacgaaaaatcatggcgagatatgatcgagcaattactgttttctcccccgatggtcatttattccaagtggagtacgctcttgaagccgtccgtaaaggtaacgctgccgtcggagttcgcggcactgatatcgtcgtcctcggtgtcgagaaaaaatccgccgtcaagctccaagattccagaagtgttagaaagattgtgtctttggatgatcacattgctctggcttgcgcgggtttaaaagccgatgctcgagtcttgatcaatagggctcgaatcgaatgtcaaagtcataggcttacagttgaggatcccgtaactgtcgaatatataacacgatacattgccggtttgcaacagaagtatacgcaaagcggcggtgttagaccgtttggtctctcgacgttgatcgttggctttgatccctatactagcgttccttctctttaccagaccgatccatccggaacattttcggcttggaaggctaatgcaactgggagaaactccaattcgatgagggagtttctcgagaaaaattataaagaaacttccggacatgaaacgatcaagttagcgatccgtgctttgctcgaagtcgtcgaaagcgggggaaagaacatcgaagttgccacaatgacgaaagagcatggactgcggcaactagaagaatccgaaatcgatgccatcgttgccgagatcgaagcggagaaagcagctgcggaggctgcaaagaaggacctggccgcccctaaagaaacctagtttgatatcggatatctctccgatcgccccagcttgtgtcctttcattagtttgcatcatgcttttgtttatagggcttgattgttgttacaattagagactaatatatatatatcaatccatttttgggtttaattatggttttagtactttgttatgcataaatttttaaatttaatcattttactttaatttg

SEQ ID NO: 3761 - DNA, 1123 bp, Cucumis melo
gtgcttaataatgtaaaagaaaaaagaagtggggaagaaacgaggtggtgtggtaccttgttgctcaagttgggatttctctctataattttccggtgcgagagacaaagaaggagctgaagcaagacaacaatggctagatacgatagggcaatcaccgtcttctcccccgacggccatttgtttcaagtcgaatacgctctcgaagctgtgcgcaagggtaacgccgccgtcggtgttcgtggcaccgatactatcgtcctcggtgttgagaagaaggctacgcctaagcttcaagactccaggtctgtgagaaagattgtgaatcttgataaccatattgcactagcctgtgctgggctcaaggctgatgcacgtgtattgatcaatagagctcggattgagtgtcaaagccatcggcttacagttgaggatccagtaactgttgagtatattactcgttacattgcaggtcttcaacaaaagtatacccaaagtggtggagtgcgaccttttggcctctcaaccttgattataggttttgatccatatactggcgctccctccctgtatcagacagatccttctgggacattttcagcttggaaagcaaatgcaactggtagaaactccaattcaattagggaattcttagagaaaaattataaggaaacttctggtcaggaaactgtgaagcttgctattcgtgcattgcttgaggttgtggagagtggtggaaagaacatagaggtggcggtgatgacaaaggagcatggattgcgacaattggaagaagcagaaattgatgctctagtggcagaaattgaagcagaaaaagcagctgctgaggctgcaaaaaaagctcctcccaaggaaacatgatccaatttcttgcatttcttcagacattttttaatcttttggttttatggtgtaacgagtggaccgttaaatcttgttctgaacttcaaaacatataccattttgtgtatcattgacacgagatggctgtagttgtagcctctgaaaaatgcctgtttattatccttccagcctctttcgatgggatggtaaaatgatctgatttgtgtattgttaagtgagccaaaacgacatatgttaa

SEQ ID NO: 3762 - DNA, 1259 bp, Allium cepa
caagggttagaagaaggcagcgatttttacagaaaatttagttctttactaagcggatactgcgacaagttttttggtcttaaatcgcactgcttttctaggtactttgtttttcatttttcagcttaccaaacaattctgaaatggctcgttacgatcgtgcaatcaccgtgttctcgcctgacggtcatcttttccaagtggaatacgccctcgaagccgtacggaaaggtaacgctgccgtcggggttcgtggtaccgataatgtcgttctcggtgttgagaagaagtcagctcctaaactgcaagattctagatctgtacgtaagattgtcaatctagacgaccacattgcactcgcatgtgcaggcctcaaagctgatgcacgtgtcttaatcaacaaagcaaggatagagtgccaatcacacaagcttacagtagaagatccagtcactgttgagtatatcactagatatattgctggattgcaacaaaagtacacacaaagtggtggtgtgcgtccatttgggttgtcgactttgattgttgggtttgatccgtacacaggtgtgccttctttgtatcagacagatccgtctggtactttctcagcttggaaagcaaatgcaactgggaggaattcaaattctatgagggagtacttggagaagaattataaagaagtggcagggaaggagactgttaaacttgccattcgggctttgcttgaggttgttgagagcggaggaaagaacattgaaattgcagtgatgacaaaagaggaaggactgaagcagcttgaagaatcggagattgatgcaattgttgcagaaattgaggcggagaaagccgccgctgaagctgcaaagaaagctcctagagattgatagctgatcaatgcaatgctattgtcacctagtagtcctggatgtgtaatgtcatgaattattttccgtgctacattcagaaatttgtcttcttaagttcaacatagagaaatttgcttcttttctgtatgacttttcatgttaaattgttttattccaaagttagttgtaatgtgttaaactttttgtaatctaatgttgggatatttacctttgtgcgttccttctacaatagacgagagaatacatgccactaggtaaatcagggataagttaattgtttaatcggccttgatatgttattattaggggcctgcttattggtgacctcattatattccaaggggaaaaatagttggatttttctctcct

SEQ ID NO: 3763 - DNA, 1102 bp, Carica papaya
gactctgctttggcatttgcttgttcagagtacagaaccgaaacaaaaagaaaaaaaaaggcaagagaggatggcaaggtacgatagagcaataacggtgttctcgccagatgggcatctgttccaagtggagtacgctctagaagccgtccgtaaaggcaacgccgtcgtcggtgtccgtggcgccgacaacgttgtcctcgctgtcgagaagaaatcaactcccaaactccaagactccagatcagttaggaagattgtaagtctggataaccacatcgcattggcatgcgctggactcaaggcagatgctcgcgtgctaataaacagagcacggattgaatgtcaaagccataggctaacagttgaggacccagtgacagtagagtatattacccgttacattgctgggcttcagcagaagtacactcaaagtggtggagtgagacctttcggcctttcaactcttattgtgggctttgatccatattcaggtgcaccctcactatatcaaacagatccatcaggtactttttctgcctggaaagccaatgcatctgggagaaactctaactcaattcgagagtttctggagaaaaactacaaggaaacctctgggcaagaaactgtaaagcttgcaattagggcattgcttgaggttgttgaaagtgggggaaagaacatagaagttgctgtaatgacaaaggagcatggtctgcgccaacttgaagaagcagaaatcgatgccctcgtagctgaaattgaagcggagaaagcagctgctgaagctgctaaaaaggctcctcctaaagaaacatgatctcagattcccctcactgcatcttttgattcctgaatgacctttgttgtactgcaacttttataagtccatacttgggaagtcgatcagcatttgctgtgatgcctttcggagtaatggcaggataggatatttacaaaccgatgttaactggtgagatccattaattcatctgaagaacagtttagcttcagaacatgaagcagaaatgcatttgtacttgtatgggtttatgatttttaagaccgcagttggattgcatggcttctttttttatggctc

SEQ ID NO: 3764 - DNA, 1322 bp, Chenopodium quinoa
gaaaaaagcaaaagtagagtctcaaaagggtgtcttgttgcccaagttctgaaaaagcatttcgattaacaccggagacgaaccctccttcatctctcccaacactcaactcactcgatcaacttccattttcagaggagagagaaagtgaaccaaacacagtttaacaacaaactcaacaatggcgagatacgacagagccattacagtcttctcacctgacggtcatctctttcaggtcgaatacgctcttgaagccgttcgtaagggtaacgctgccgtcggtgttcgtggtaccgatactgttgttcttggggttgagaagaaatctgctgctaaacttcaagattccaggtcagtcaggaaaattgtaaacctcgacgatcatattgctttagcgtgtgctggtcttaaagcagatgctcgtgttctaataaacagggcacgtattgagtgtcaaagccacaagctgaccttggaagatccagtaacagttgagtatataactcgttacattgctggacttcagcagaagtatacccaaagtggtggtgttagaccatttgggctgtccactttgatcgtgggattcgacccacacactaatgtacctgcactgtaccagacagatccatctggcaccttttcagcttggaaggctaatgcaactggaagaaactctaactcaataagagagtttctagagaagaattataaagaaacttctgggcaagaaactgtcaagctggctattcgtgcattgcttgaagtggttgaaagtggaggaaagaacttggaagttgctgtgatgacgaaaaaaggtttgcatcagcttgaggaatctgagattgatgccatagttgcagagattgaagaagaaaaggcagcagctgaggccgcaaagaagggtccttctagttcttaacttgcagacttatgaattaggctgttcctttcgagtcttaatctattccaatttctgcttcttgtttagctctaaacttctgaagtgttgacgagtcagacttggatttcatgtatgtgctgctagcttggcttattagccccgtgatatcatttgaaaagccatcaatcagtggtagatttgttgaatcttttggtattttgcttcattatgccttagtaaaagtaccttgttgactctggcaattatttttagtttcgattaattggatggtgtgaaccgtgaaggtcagtgcgagtgtgcgatgatgaatttttgcatagttgggtactactatttgcatagccaattacacaatgatggacacttttattcaactagagaggaaagaatggct

SEQ ID NO: 3765 - DNA, 1134 bp, Chenopodium quinoa
agcatttcgattaacaccggagacgaaccctccttcatctctcccaacactcaactcactcgatcaacttccattttcagaggagagagaaagtgaaccaaactcagttaaacaacaaacacaacaatggcgagatacgacagagctattacagtcttctcacctgacggccatctctttcaagtcgaatacgcgcttgaagccgttcgtaagggtaacgctgccgtcggtgttcgtggtaccgatactgttgttcttggggttgagaagaaatctgctgctaaacttcaagattccaggtcggtcagaaaaattgtaaacctcgacgatcatattgctttagcttgtgctgggctcaaagcagatgctcgtgttctaataaacagggcacgtattgaatgtcaaagccacaagctgaccttggaagatccagtaacagttgagtatataactcgttacattgctggacttcagcagaagtatacccaaagtggtggtgttagaccatttgggctgtccactttgattgtgggattcgacccacacactaatgtaccagcactgtaccagacagatccatctggcaccttttcagcttggaaggctaatgcaactggaagaaactctaactcaataagagagtttctagagaagaattataaagaaacatctgggcaagaaactgtcaagctggctattcgtgcattgcttgaagtggttgaaagtggaggaaagaacttggaagttgctgtgatgacgaaaaaaggtttgcatcagcttgaggaatctgagattgatgccatagttgcagagattgaagaagaaaaggcagcagctgaggctgcaaagaagggtccttctagttcttaacttgcagacttatgaattaggctgttcctttcaagtcttaatctattccaatttctgcttcttgtttagctctgaacttctaaagtgttgacgagtcagacttggatttcatgtatgtgctgctagcttggcttattaggcccgtgatattatctgaaaagccatcaatcagtggtagatttgttgaatcttttggtattttgcttcattatgaccttagtaaaagtaccttcttgactctggcaattatttttagtttcgatt

SEQ ID NO: 3766 - DNA, 713 bp, Euphorbia esula
aaaatggctagatacgatcgcgcaatcacagtcttctctcccgatggacatttgttccaggtggagtacgctctcgaagccgttcgcaaaggaaacgccgccgttggcgttcgtggcactgatgtcgtcgttcttggcgtcgagaagaaatccatcgccaaacttcaagacgctagatcagtgaggaagatagtttcattggatgatcacgtagcacttgtatgtgctgggttgaaagcagatgcacgtgttttggtgaacaaggctcgcattgagtgtcagagccataagcttactgttgaggatcctgtaactgttgaatatattacgcgtttcattgctggcctacaacagaaatatacacaaagtggtggtgttagaccatttggtctttcaactttgattgtaggttttgatcctcatacaggtgttccttctctctatcagactgatccatccggagctttttctgcatggaaagctaatgctaccggtcggaactctaattctatgagggagtttttggaaaagaactttaaagaaacctcaggccaagaaactgtcaagttggctattcgggctttgcttgaggtagttgagagcgggggaaagaacatagaaattggagtgatgacaaaagagaaaggtctccggcaacttgaagaagcagaaatagatgctattgtagctgaaattgaagcggaaaaagcagc

SEQ ID NO: 3767 - DNA, 959 bp, Juglans hindsii x Juglans regia
gagcagaagaagaaaaggaaagaaagataagagccaaagagagaggaggagaaagaagaaaatggcgaggtacgacagagcaataacggctttcccaccagacgggcatttgttccaggtcgaatacgccctcgaagcagtgcgcaagggcaacgctgccgtcggtgtccgcggcaccgacaccgtcgtcctcggtgtggaaaagaagtccgccgccaaactccaagattccagatcggttaggaagattgtaaacttggacgatcacattgctctagcgtgtgcaggactcaaggcagatgctcgtgttctagtaaacagggcacgaattgaatgccaaagccataggcttaccgttgaggatccagtgactgttgagtacattactcgatacattgctggtcttcagcaaaagtatacacaaagtgggggggtgcgaccatttgggctttcaactttgattattggctttgatccctattctggttcgccatcattgtatcagacagatccttctgggacattttctgcttggaaggctaatgcaactgggagaaactctaattcgatacgggagtttctggagaaaaactataaggaaacttctgggcaagaaactgtgaagcttgctatccgtgcattgctcgaggttgttgagagtgggggaaagaacatagaagttgctgtgatgactaaagaacagggtttgcggcaacttgaggaagctgagattgacgccatcgttgccgaaattgatgccgagaaagcagctgctgaggctgcaaagaaggctccttcaaaggaaacctgatctctttttctgtctttttctttgtcttgttttgttcttttgcttgggtccaactgattgctattgtcatccatttggattttattagagtattgagtcgctagctctaaaacagctaaaacttaagttataactactctgattatgg

SEQ ID NO: 3768 - DNA, 891 bp, Petunia hybrida
gccaaaacccaaaagcataaagatttaaattgagggaagagctttcctttaccaattctcagaacaaacttttgattaattaccctaaattgcattaacataatggccagatacgacagagcaatcaccgttttttcaccagatggccacttattccaagtggaatacgctcttgaagctgtacgtaaaggtaacgcagtggtaggtgtacgtggcactgatactgttgtacttggcgttgaaaagaaatctacccctaagcttcaagactctaggtcggtaagaaagatagtaaatctagatgatcacattgcattggcatgtgctgggctcaaagcagatgcacgagttcttgtaaacagggcacgcattgagtgtcagagtcataggcttacagttgaggatcctgtaaccgttgagtacataactcgatacattgctggtcttcaacaaaagtacacccagagtggtggtgttaggccatttggtctatccaccttgatcattggttttgacccgtacacgaatgtcccctcactttatcaaacagatccatcaggtacattctcagcttggaaagcaaatgcgactggtagaaactccaattctattcgggagttcttggagaagaattataaagaaacatctggccaggaacagtgaactagcaatacgtgctttgcttgaagtcgttgaaagtggtggaaaaaacatagaagtagctgtgatgactaaagaggggcttaggcaacttgaggaagctgagattgatgccattgttgctgagattgaggcagagaaagcagctgcagaagctgccaagaagggcccgcccaaagaaaactagttgtgtgaaattcatatctgaacatgccctctgaatttttcccc

SEQ ID NO: 3769 - DNA, 887 bp, Brassica oleracea
aaagaagcaacactcaatagagaagaaagaaaagtgtgagagatggcgagatatgatcgagcaatcacagtgttctcccccgatggccaccttttccaggtagagtacgccctcgaagctgtccgtaagggcaacgccgccgtcggagtccgcggcacagatactgtagtcctcgccgtcgagaagaaatccactcctaagctccaggatacaagatcagcaagaaagattgtgagtcttgataaccacgttgcgttggcctgtgctgggctcaaggcagatgctcgtgtcctgataaacaaggcgaggatcgagtgtcaaagccacaggcttacgttggaggatcctgtgactgttgagtacatcactcggtacattgctgggcttcagcagaagtatactcaaagtgggggtgtgagaccttttggtctttccactcttattgttggttttgatccatacactcgtataccttcgctttatcagactgatccatctggtaccttctctgcttggaaggctaatgcgaccgggagaaactcaaactcgatcagggagtttctggagaagaattacaaagaaacgtcgggacaagaaactgtgaagcttgctatccgtgctctgcttgaggtagttgagagtgggggaaagaacattgaggttgctctaatgacacgggaggaaggtactctaaggcagctagaagaagctgaaatcgatgctattgtggccgagatcgaagcagagaaggctgctgcagaagcagccaagaaaggcccttcaaaggaaacctgagcatgagccagatcttacaataacggtctcagttttcaagttgtaactttggttcaaagtaaagatatttgcgtgaatttgttttgttggac

SEQ ID NO: 3770 - DNA, 903 bp, Chrysanthemum coronarium
caaaacaataatcaatggcaagatacgacagagcgataacagtattctcaccagacggtcatttgtttcaagtggaatacgcacttgaagccgttcgtaaaggtaacgccgccgttggtgttcgtggtaccgacaccgttgttctcggtgtcgaaaagaagtccactgttaagctccaggactctagatcagttaggaagattgtaaacctagatgatcacgttgcattggcctgtgctggactcaaagcagatgctcgtgttctcataaataaggcacgaatcgagtgccagagccataagcttactgttgaggatccagtaactgtagagtatatcacacgttacattgcagctcttcaacagaaatacacccaaagtggtggagtcaggccgttcgggctgtcaaccctaatcgtaggatttgatccttatactagtgttccatcattatatcagactgatccttcaggaacattttctgcgtggaaagctaatgccactggcaggaactccaattccatgagggaatttttggagaaaaattataaggagacctctggtcaagaaactatcaagcttaccatccgagctttgcttgaagtcgttgagagtggagggaagaacatagaagttgctgtcatgacaaaggagggactccgacaactcgaggaagctgaaattgatactattgttgcagaggttgaagctgaaaaagcagctgcaaagaagggtcctgctaaggaatgatgtgctgctcacttggtttaactgttgttttcttagatcttgtcagaccttttcaacatatgtatgtactgtgaagtctttatgtcactggtatggtagttgcaaggaattctatttaaggaacttaaatatatgcattgagtgactttatcaa

SEQ ID NO: 3771 - DNA, 1081 bp, Amsonia hubrichtii
agcagaggccctccctccctctctactcagtatcgacgacgaggcgagatcggaaacaaatcgacgagtacatacatccacatataaggtacagatttctctgaaaaatggctagatacgacagagctatcacagttttctctccagacgggcatctattccaggttgagtatgccctcgaagccgtccgcaagggcaacgctgccgtaggtgtccgtggcaccgacaccatcgttctcggcgtggagaagaaatcaactcccaagcttcaagactccagatcagtcaggaagattgtaaacctagacgatcatatcgcattggcctgtgcagggctcaaagcagatgcacgtgtcttaataaaccgagcacgtatcgagtgtcagagtcataggctaactgttgaggatcctgttactgttgaatatattactcgttatatagctggtcttcagcagaaatacacacaaagtggtggtgtgagaccatttggcctttcaaccttgatcattggctttgacccatacacagctgccccttcactttatcagacagatccttcaggaacattttcagcctggaaagccaacgcaactgggagaaactcaaactcaatcagggagtttctagagaagaattacaaggaaacatctggacgagaaactataaagttagccattcgtgcactgcttgaagttgttgagagtggcgggaagaacatagaagttgctgtgatgacaaaagagcatgggctgaagcaacttgaagaagctgagattgatgcaattgttgcagagattgaagaagaaaaagctgctgcagaggctgccaagaagggccccccaaaagaaacctagtttgattgcaatacttgctggagaggccctcgttttgtgatatctatttctttgctaagacagtcatttgttgttgctttgtcaagtaggcaaatcctgggtaggatacattattgttcaaggtttctttacaacagtgtttcattattatttcttttttaggcaacgttgccttaaaatagttacttttaatcgttattatgtaatgactgtactttacttat

SEQ ID NO: 3772 - DNA, 1502 bp, Aquilegia formosa
gttaaaagtgtctgcatcatttgaagcacgacgagagtttagttagattgttgcttttgatagatgacatcattaacagttgctcttgaagatatggtgtatcatctgtagaactgggttctatggattccagttccaagtgctttaactaaactttgtatcaaactttctgacaaagtagatgtatatgaatgtatctagttcacttttgttcaacatatccagtgtaaactgtaaaggaacaagtgaatgaagttgtctgacatatgggcccaagagtagtggtccgagtcaatacattgtatgtatacccaaaacattgataaaagcccaatagagatgaagtttgactttgaacatagaagtcgtgcaaggaagggggtatttgaaaatatataatatttatatttataggggtgtgaaccaaatttatatatattttcttgccttcttccccaagctactaagttcagctacaaagctttcgtttcatctctcccgccagaacagaagagaaggatttctttcaatcaatcaagtgtttttgttgaagaagaagaagaagaagatggctagatatgatcgtgctataacagtgttttcaccagatggacatttgtttcaagttgaatatgcacttgaagctgttcgaaagggtaacgctgctgttggttatagaggtattgataatgtcgttcttgctgttgagaagaaatccactgctaaacttcaagactctcgctcagttaggaagattgttaacctggataatcatatagcattggcatgtgctggccttaaagcagatgcacgtgtcctcattaacaaagcacggatagaatgtcaaagtcatagacttactgttgaagatcccgttactgttgaatatatcacacgctacattgctggtcttcagcagaagtatacacaaagtggtggtgttagaccatttggcctgtcaactctcattgtgggttttgacccatatactggtgctccatcactctatcagacagatccatccggaactttttcagcctggaaggctaatgcaacggggagaaactcaaactctttgcgagagtttttggaaaagaattataaagaaacctctggccaggaaactgtaaagctggcgattcgtgcattgcttgaggttgttgagagtggaggaaaaaacatagaggttgctgttatgacaaaagagcatgggctgcatcaactggaggaagctgaaatcgatgccatcgttacggagattgaagcagaaaaagaagcggcagaggctgcgaaaaagccccctgctaaagaaacctgatcctgctgggcttctaaaccctgccttgattttggggcctttgtttccaatcttaaatactttgtgaaagcaagatatggttggtacttttattgacattttaaatgaagccattgattgtactaatgttaacttgtgattccaaaaacttcacaactgaaaatgatggattgtgttatttctt

SEQ ID NO: 3773 - DNA, 882 bp, Brassica napus
agagaagaagaaaagagtgagagatggcgagatacgatcgagcaatcacagtgttctcccccgacggtcacctcttccaggtagagtacgccctcgaagctgtccgtaagggtaacgccgccgtcggagtccgcggcaccgatactgtagtcctcgccgtcgagaagaaatccacccctaagctccaggatacaagatcagcaagaaagattgtgagtcttgataaccacgttgcgttggcctgtgctgggctcaaggctgatgcgcgtgtccttataaacaaggcgaggattgagtgtcaaagccacaggcttacgttggaggatcctgtgactgttgagtacatcactcggtacattgctgggcttcagcagaagtatactcaaagtgggggtgtgagaccttttggtctttccactcttattgttggttttgatccatacactcgtattcccgcgctttatcagactgatccatcgggtacgttctctgcttggaaggctaatgcgaccgggagaaactcaaactcgatcagggagtttctggagaagaattataaagaaacgtcgggacaagaaactgtgaagcttgctatccgtgctctgcttgaggtagttgagagtgggggaaagaacattgaggttgctctaatgacacgggaggaaggtactctaaggcagctagaagaagctgaaatcgatgctattgtggccgagatcgaagcagagaaggctgctgcagaagcagccaggaaaggcccttcaaaggaaacctgagcatgagccagatcttacaataacggtctcagttttcaagttgtaactttggttcaaagtaaagatatttgcgtgaatttgttttgtcggaccattagcctgtttg

SEQ ID NO: 3774 - DNA, 1035 bp, Brassica napus
ggattttgaataaaacgaaagagagaaagaagcaacactcaatagagaagaaagaaaagtgtgagagatggcgagatatgatcgagcaatcacagtgttctcccccgatggccaccttttccaggtagagtacgccctcgaagctgtccgtaagggtaacgccgccgtcggagtccgcggcaccgatactgtagtcctcgccgtcgagaagaaatccactcctaagctccaggatacaagatcagcaagaaagattgtgagtcttgataaccacgttgcgttggcctgtgctgggctcaaggcagatgctcgtgtcctgataaacaaggcgaggatcgagtgtcaaagccacaggcttacgttggaggatcctgtgactgtcgagtacatcactcggtacattgctgggcttcagcagaagtatactcaaagtgggggtgtgagaccttttggtctttccactcttattgttggttttgatccatacactcgtataccttcgctttatcagactgatccatctggtacgttctctgcttggaaggctaatgcgaccgggagaaactcaaactcgatcagggagtttctggagaagaattataaagaaacgtcgggacaagaaactgtgaagcttgctatccgtgctctgcttgaggtagttgagagtgggggaaagaacattgaggttgctctaatgacacgggaggaaggtactctaaggcagctagaagaagctgaaatcgatgctattgtggccgagatcgaagcagagaaggctgctgcagaagcagccaagaaaggcccttcaaaggaaacctgagcattatcttacaataacggtctcagttttcaagttgtaactttggttcaaagtaaagatatttgcgtgaattttttttgttggaccctcagttttcaagttgtaactgtgttgacactcttgctttaaatctcagttaacattttttttttagtcaaagtaccatatctagctagccatgagaaaatagcagttcatggtactactactacttg

SEQ ID NO: 3775 - DNA, 1152 bp, Cucurbita pepo
aagtgatcgataccttgttgctcaagttgggatttttctctataattcccgctgcaagcagagcgcgaggggacagaacgaggtgaagcaagagaacaatggctagatacgatagggcaatcactgtcttctcccctgacggtcatttgtttcaagtcgaatacgctctcgaagctgtgcggaagggtaacgccgccgttggtgttcgtggcaccgatactatcgtcctcggtgttgagaagaaggctgcgcctaagctccaagactccagatctgtgaggaagattgtgaatcttgataaccatattgcactagcttgtgctgggctcaaggcagatgcacgtgtcttgataaatagagctcggattgagtgtcaaagccatcggcttacagttgaggatccagtaactgttgagtatattactcgttacattgcaggtctccaacagaagtatacacaaagtggcggagtgagaccatttggcctctcaaccttgattataggttttgatccatatactggcacaccctcactgtaccagacagatccttctgggacattttcggcttggaaagcaaatgcaactggtagaaactccaattcgataagggaattcttagagaaaaattacaaggaaacttctggtcaggaaactgtgaagcttgcaatccgtgcattgcttgaggttgttgagagtggtggaaagaacatagaggtcgctgtgatgacaaaggagcatggactgcgacaattggaagaagctgaaattgatgctctcgttgcagaaattgaagcagaaaaggcagctgctgaggctgcaaaaaaagctcctcccaaggaaacatgatcccttttcttacatgttttccaggcattatttcttaatcctttatttagttttctggtggagttagtgaataatcttatgattctgaaccttcaaacttgtaccatcattttgtgcatcgttgacacaaggtggccgtagttgtagcctctgaaaatgcctgtttatcctcacaacctctctcaatgtgatagcaaaaccatctgattttgtggattttgtgtattattgttgctgagagctgagtagggacttcctcttattgttactctaaaaatcgatcgatccatgaatgagtgctttg

SEQ ID NO: 3776 - DNA, 1149 bp, Euonymus alatus
tcttataagcttggagaaaaacgaataatcattttgcagaacagaactaggtctctttcgcagtcgactctgctgaccaaattgagctgagaaagaagaatggcgagatacgacagagcaataactgtgttttcaccggacggacatctgttccaagtggagtacgcgctcgaagctgttcgtaagggcaacgccgccgttggcgttcgtggcactgacaacatcgtccttggcgtcgagaagaaatctaccgcaaagctccaagactcccgatcggtgaggaaaatagtgaatctggatgatcacattgctttggcatgtgctggacttaaagcggatgctcgtgtcctgattaacaaggctcggattgaatgtcaaagccacaggctgactctcgaggatcccgtaactgttgagtatatcacgcgttatatcgcgggactccagcaaaagtacacacaaagtggtggtgtgagaccatttggcctatcgacattgattgtgggctttgatccatacactgatgtgccatccctttatcagactgatccatctggaacattttcagcttggaaagctaatgcaactggtagaaattcaaattctatcagggagtttctggagaaaaactataaagaaacatcaggacatgaaaccttgaaacttgcaattcgtgcattgcttgaggttgttgagagtgggggcaagaacatagaagttgctgtgatgaccaaagagcatggcctgcggcaacttgatgaggccgaaattgatgcagttgttgctgagattgaagccgagaaagcagctgctgaggctgcaaagagggggcctgtgcaagagacatgatttatctcctggtgccctctgcaagagacgtgatttatggccttgtgttgtcattgccttcgtttgttcaaatttccctgtgacaatttctgataagatacttgttattgtactttattcagctatagtcgttgttactgtcctgagcaggtttcgataacaagaactgtttgttacaggtgcattatgtttcttattatctgttgcatttaaatagattgatttggaaaccagataagctctttgctgctgagatgatttcaagtgaaggtatctgatagccattggatgaacaaaggt

SEQ ID NO: 3777 - DNA, 1277 bp, Setaria italica
acgaagcccaactagtaacagacagccctcttcttcgcagacgcccctggagtcctgaacccagaaaggcacgaccaccaccgccggccgggaagcaagctcaaaccctaaccgccggccgggaagcaagctcaaaccctaaccgccggcgacgccagcacgatggcccgctacgaccgcgcgatcaccgtcttctcccccgacggccacctctttcaggtcgagtacgccctcgaggccgtccgcaagggcaacgccgccgtcggcgtccgcggcaccgacacagtcgtcctcggcgtcgagaagaagtccacccccaagctccaggactccaggtccgtgcgcaagatcgctagcctggacacccacatcgcgctggcgtgcgcggggctcaaggctgatgcgcgcgttctcatcaaccgcgcgagggtcgagtgccagagccaccgactcaccgtcgaggaccccgtcaccgtcgagtacatcacccgctacatcgccggcctgcagcagaagtacacacagagtggtggtgttcgccccttcggcctctccaccctcatcgtcggcttcgacccctacaccgacaagccggccctgtaccagaccgacccatccggtaccttttctgcctggaaggccaacgccacggggaggaactcgaactccatgcgggaattcctcgagaagaactacaaggagacctccggcaaggagactatcaagctcgccatccgtgcacttctagaggttgttgaaagtggtgggaagaacatcgaggttgcagtgatgacaaagaaggatggtctccgtgaacttgaggaggctgaggttgatgaatatgttgccgagattgaggcagagaaggctgcagctgaggctgcaaagaagggtgccccgaaggacacctaattcttggcttctgctgtaccttcaatcaacactttgtttgtctttatcatattccatgcactatattaactgttttagaggaacgctagattgttaggtgaaactgtatgcttctatgcctgtagagtcgcatgctgtgcaatgtgcttatccacatgccttcctcggaatgcttcaatttcatctactgtatccgctggacagttgaaagttcaatccttgttcaccaaattccgttgctcgtaatgacttcggtggagctgtggtctggattttaaatcattgcagacggagatcgttcatcagttgcttattggttaaggaaaaggaaagaagatagaaagaaaacaagaagaaaaaacagc

SEQ ID NO: 3778 - DNA, 1188 bp, Setaria italica
aacagacagccctcttcttcgcagacgcccctggagtcctgaacccagaaaggcacgaccaccaccgccggccgggaagcaagctcaaaccctaaccgccggccgggaagcaagctcaaaccctaaccgccggcgacgccagcacgatggcccgctacgaccgcgcgatcaccgtcttctcccccgacggccacctctttcaggtcgagtacgccctcgaggccgtccgcaagggcaacgccgccgtcggcgtccgcggcaccgacacagtcgtcctcggcgtcgagaagaagtccacccccaagctccaggactccaggtccgtgcgcaagatcgctagcctggacacccacatcgcgctggcgtgcgcggggctcaaggctgatgcgcgcgttctcatcaaccgcgcgagggtcgagtgccagagccaccgactcaccgtcgaggaccccgtcaccgtcgagtacatcacccgctacatcgccggcctgcagcagaagtacacacagagtggtggtgttcgccccttcggcctctccaccctcatcgtcggcttcgacccctacaccgacaagccggccctgtaccagaccgacccatccggtaccttttctgcctggaaggccaacgccacggggaggaactcgaactccatgcgggaattcctcgagaagaactacaaggagacctccggcaaggagactatcaagctcgccatccgtgcacttctagaggttgttgaaagtggtgggaagaacatcgaggttgcagtgatgacaaagaaggatggtctccgtgaacttgaggaggctgaggttgatgaatatgttgccgagattgaggcagagaaggctgcagctgaggctgcaaagaagggtgccccgaaggacacctaattcttggcttctgctgtaccttcaatcaacactttgtttgtctttatcatattccatgcactatattaactgttttagaggaacgctagattgttaggtgaaactgtatgcttctatgcctgtagagtcgcatgctgtgcaatgtgcttatccacatgccttcctcggaatgcttcaatttcatctactgtatccgctggacagttgaaagttcaatccttgttcaccaaattccgttgctcgtaatgacttcggtggagctgtggtctggattttaaatcattgcagacgg

SEQ ID NO: 3779 - DNA, 954 bp, Panax ginseng
acacagagaaagcagatcaaagaaaaagaatccaccggcagacatataaagagtaaaatggcgagatacgacagagctatcacggtcttttcgccagacggccatctcttccaggttgaatatgcgctcgaagccgtccgtaaaggtaacgccgccgtcggcgttagaggcaccgataccatcgttctcggcgttgagaagaagtctactgtcaagcttcaagactccagatctgtcaggaagattgtaaatctggatgatcacattgctttggcctgtgctggtcttaaagctgatgctcgtgttcttataaacagggcacgcattgagtgtcaaagccataagctaactgttgaagatcctgttactgttgagtatataactcgttacattgctggtcttcaacagaagtacacacaaagtggtggtgttaggccatttggcctttcaactttgattgtgggttttgacccatataccggcgtgccagcactatatcagactgatccttctgggactttttctgcctggaaagctaatgctactgggagaaactccaattcaatgagggagtttttggaaaagaattataaagaaacgtctggccaagaaactataaagcttgctatccgcgcgctgcttgaagttgttgagagtggaggaaagaacatagaagttgctgtcatgacaaaggatcagggtcttcgacagcttgatgaagctgaaattgatgccgttgttgccgagattgaagcagagaaagaggctgcaaagaaaggaccttccagggagacatatgcctgattttctttttcccttgttcccattaatggcattccatgtgaacatgtaataatctcgacttatttgagtgttggggcttcttgtgtggtttagatttggaaatatttcaatgatttatgctgttagacgatatatgaacaagtttattac

SEQ ID NO: 3780 - DNA, 1035 bp, Momordica charantia
ggtggtaccttgttcctcaagttgggatttctctctataatttcggctgcaagaagcagagttcgagagaggaagaaaccgctgaagctgaagcttgacaaccatggctaggtacgatagggcaatcacagtcttctcacccgatggccatttgtttcaagtcgaatacgctctcgaagctgtgcgcaagggcaacgccgccgtcggtgttcgcggcaccgataccatcgtcctcggtgtcgagaagaaggctgcgcctaagctccaagactccagatctgtgaggaaaattgtgaatcttgataaccacattgcactagcctgtgctggactcaaggcagatgcacgtgtattgataaatagagctcgtattgagtgtcaaagccatcggcttacagttgaggatccagtaactgttgagtacattactcgttacattgcgggtcttcaacagaagtatactcaaagtggtggagtgcgaccatttgggctttcaaccttgattataggttttgatccatatactggcgcaccatcactgtaccagacagacccttctgggacattttctgcttggaaagcaaatgcaactggtagaaactccaattcgataagggaattcctagagaaaaattataaggaaacttctggacaggaaaccgtgaagcttgctatccgtgcattacttgaggttgttgagagcggagggaagaacatagaagttgctgtgatgacaaaggagcatggactgcgacaattggaagaagctgaaatcgatgctctcgttgcagagattgaagccgaaaaagcagctgctgaggctgcaaagaaggctcctcccaaggaaacataatatctcatttcttccatttcttcgggagtttttaaatcttttacttttctggtgtagtgagacgtggaccgttaaatcttattctgaactttcaaaagttaccattttgtgtatcattgacacgacgtggtctctgaaaaatgtctgtaatccatcaagcctctttcaatgggatagcaaaa

SEQ ID NO: 3781 - DNA, 1282 bp, Quercus alba
gaataaactcgctctaaaagaaagtgccttgtcgcaaaagaaattgtttagtttatttttccctctctcagaagtcagatcgcacactgaaaaaagcagaagcaaaagcaaaaacagagctaaagaagaagaagaagaagaagaagaaagagagagagagagagagatggctcggtacgatcgtgcaataacagtgttctcaccggacggccatttgttccaggtggagtacgctctcgaagccgtccgcaaaggaaacgccgccgtcggagtccgtggcttagacgccgtcgttctcggcgtcgaaaagaaatccactcccaaactccaagactccagatcggttaagaagattgtgtcgttggataatcacattgcgctagcatgtgctgggttgaaagcggatgctcgtgttttaataaatcgggcacgcattgaatgtcagagccataggcttacagttgaggatcctgcaaccgttgaatatataacacgtcacattgcaggcctgcagcagaagtatacacaaagtggcggtgtaagaccatttgggctttcaactttgattgcaggttttgacccgtacactggcacaccatctctttatcagacagatccatcaggaacatttcaggcatggaaagccaatgcgacggggagaaactcaaattcgatgagggagtttttggaaaagaattataaagaaacttctggacaagaaactgtcaagttgacaattcgtgctttgcttgaagttgttgagagcggagggaagaacatagaaattgctgtgatgacaaaagagcatgggctgcaccaactcgaggaagctgaaattgatgccattgttgctgaaattgaagcagaaaaggcggccgcagaggctgcaaagaaggcccctgcaacaaaggaaacctagttctgttttattatcatatttcaactgcactttctgagtcaattaattttttgccattgaacatcactgtttcatgcaactttagcatccacaccgagttcaatgaggacgtacctgatttcaatacttttcttttcaaaccatctgttttcttttatttattctggaattgctgatagtcatctttcagtgcagtatgttgctttttgttatttgcaggctgttgttcatagtcaaactttgaagaaataggtatgctaagatcctttagtctatggataaagaaaggatctaattggtctctgctattttttctcatactttttgtttggtaagatgctgtaagttctcaatgagatcttt

SEQ ID NO: 3782 - DNA, 1030 bp, Olea europaea
tcttccgcgagaaaggcaagagggtgatagatcaggacaatatttacagacatatatacaacaatccatttcgatctttatatacatacatatagggtaatagatggcgcgatacgacagagcaattacagtgttctcgccggatggccatctatttcaggtggagtacgcccttgaagctgtccgaaagggaaatgccgctgtcggtgttcgtggaactgataccatcgtccttgccgtcgagaagaagtctacccccaagctccaagactccagatcggtgagaaagatcgtcaatttagataatcacattgcattggcttgtgctggactgaaagcagatgcacgtgttctaataaatagggcacgtattgagtgccagagtcataagcttacagttgaggatcccgtgactgttgaatacataactcgctacattgctggacttcagcagaagtacacacaaagtggtggtgtgagaccttttggactttcaaccttgatcatcggttttgacccctactcaggtgtcccatctctttaccagacagatccctcggggactttttcagcatggaaagccaatgcaactgggagaaactcaaactcgatccgggagtttctggaaaagaattacaaagaaacatctggccaggagactgtcaaactagccatgcgggctttacttgaagttgttgagagtggtggaaagaacctagaagttgccgtaatgaccaaagatcatggactgcgccagcttgaagaagctgaaattgatgccatcgttgctgaaattgacgcagagaaagcagctgcagaggctgccaagaaggcccctcctaaggaaacttaggactatggctcagggtttgctcaacatgttgtctttcgtgatctttaattcagactgtaatttgttgcttttgacaattgatatctgttaccttcttccctctattatccatttagacaatttacaagatgatgcttaatatttagttaattggatttgctccacattaaatttaat

SEQ ID NO: 3783 - DNA, 1035 bp, Pseudoroegneria spicata
ccgttgctgtcgaccacttctccccaaagccgccgagcttgcctgcgcgcacacaatcgagcaacccagccaaggcacgaccacctccgccgcccgggaaacccaaaccaaaccctaagcctccgcgaccggctgccggcgatggcccgctacgaccgcgcgatcaccgtcttctcccccgacggccacctcttccaggtcgagtacgccctcgaggccgtccgcaagggcaacgccgccgtcggcgtccgcggcaccgacaccgtcgtcctcggcgtcgagaagaagtccacccccaagctccaggactccaggtcggtgcggaagatcgcgagcctggacacgcacgtcgcgctggcgtgcgcggggctcaaggcggacgcgcgggtgctcatcaaccgcgcccgcgtcgagtgccagagccaccgcctcaccgtcgaggaccccgtcaccgtcgagtacatcacccgctacatcgccggcctgcagcagaagtacacccagagcggtggggtccgccccttcggcctctccaccctcatcgtcggcttcgatccctacacggacaagcccgccctgtaccagacggacccctccggcaccttctccgcctggaaggccaacgccacggggaggaactccaactccatgagggagttcctggagaagaactacaaggacacctccggcaaagagaccatcaagctcaccatccgcgctctgctagaggttgttgagagtggtgggaagaacatcgagattgcagtgatgacaaagaaggatggccttcggcaactcgaggagaccgaaatcgatgaatatgttgccgagattgaggcagagaaggcagcggctgaggcggcaaagaagagcggccccaaggatacctaattactggatgtgctatatcttcattctgtcagccaaaaccttttagtgtgtcacctgttacgttccataactttctttaaactgctttaacaagatattgaagtcattcgtaaatgaattgccttgttttcttgaaaaaaaaaa

SEQ ID NO: 3784 - DNA, 1015 bp, Raphanus sativus
gaacaaaacgaaagagaaacaaagaaagagagagacagagaggagaattagaaagaacaatctagaaataacagtcaatagagtgagagatggcgagatatgatcgagcaatcacagtgttctccccagacggccacctttttcaggtggagtatgccctagaagctgtccgtaagggtaacgccgccgtcggagtccgcggcaccgataccgtcgtcctcgccgtcgagaagaaatccacccctaagctccaggatacaagatcagctagaaagattgtgagtctagataaccacgttgcgttggcctgtgctgggctcaaggcagatgctcgtgtcctgattaacaaggcgaggatcgagtgtcaaagccacaggcttacgttggaggatcccgtgactgtcgagtacatcactcggtacattgctgggcttcagcagaagtacactcaaagtgggggtgttagaccttttggtctttccactcttattgtcggttttgatccctacactcgtattccttcgctttatcagactgatccatctgggacgttctctgcttggaaggctaatgcgaccgggagaaactcgaactcgatcagggagtttctggagaagaattataaagaaacctctggtcaagaaactgtgaagcttgctatccgtgctctgcttgaggttgttgagagtgggggaaagaacattgaggttgctctgatgacacgggaggaaggtactctgaggcagctagaagaagctgaaatcgatgctattgtggctgagatcgaagcagagaaggctgctgcagaagcagccaagaaaggcccttcaaaggaaatctgagcatgatgccaggatctttacaataacggtctcagttttcaagttgtaacttttggttcaaattatgttattttgagggttgaatagaaaatcttgactgcgtgaatttgttttgttggatcattagcctgtgttgacgacattttcgctttaaatcttaatcgacaatttta

SEQ ID NO: 3785 - DNA, 879 bp, Secale cereale
ggcgatggcccgctacgaccgcgcgatcaccgtcttctcccccgacggccacctcttccaggtcgagtacgccctcgaggccgtccgcaagggcaacgccgccgtcggcgtccgcggcaccgacaccgtcgtcctcggcgtcgagaagaagtccacccccaagctccaggactccaggtcggtgcggaagatcgcgagcctggacacgcacgtcgcgctggcgtgcgcggggctcaaggcggacgcgcgggtgctcatcaaccgcgcccgcgtcgagtgccagagccaccgcctcaccgtggaggaccccgtcaccgtcgagtacatcacccgctacatcgccggcctgcagcagaagtacacccagagcggcggagtccgccccttcggcctatccaccctcatcgtcggcttcgatccctacacggacaagcccgccctgtaccagaccgacccatccggcaccttctccgcctggaaggccaacgccaccgggaggaactccaactccatgagggagttcctggagaagaactacaaggacacctccggcaaggagaccatcaagctcaccatccgcgctcttctagaggttgttgagagtggtgggaagaacatcgagattgcagtgatgacaaagaaggatggccttcggcaactcgaggagactgaaattgatgaatatgttgccgagattgaggcagagaaggccgcggctgaggctgcaaagaagagcggcccgaaggatacctaattactggatgtgctatatcttgattctgtcagccgaaaccttttagtgtgtcacctgttacgttacataactttctttaaactgctttaacaagatattgaagtcattcgtaaatgaattgcctt

SEQ ID NO: 3786 - DNA, 1203 bp, Sesamum indicum
agcgcttcttaacttgaatctgcccacctgaaacacgacttttaggacgtcgttagtttgaagcgtcttgtcgtgtcgtccaagttctctccgctcagttcccttttactacttccccagttcacctccgtcctttgtgaatcagtcttgcctcggagaagagaagggaaggaggaaatcctgagacagatcgaagcaacgcatacacccatactgttattactacacgaagaagagtgagagatggcccgatacgacagagcaattacggttttctcgccggacggccaccttttccaggtggagtacgctctcgaagccgtgcgtaaaggaaacgccgccgtaggtgttcgcgggactgacaccattgtgctggccgtcgagaaaaagtccactcctaagcttcaagattcaagatcagtgaggaagattgtcaatttagatgatcacatagcattggcttgtgctgggctgaaggcagatgcacgtgtgttgataaatagggcacgcattgaatgccagagctataagcttacaattgaggatcctgtaactgttgaatacataactcgttacattgctggtcttcagcagaagtacacacaaagtggtggtgtgagaccttttggcctttcaacattgattattgggttcgatccacatactggcactccatccctgtatcaaaccgatccatctggaacattttcagcatggaaagccaatgccactgggagaaactcaaactctatccgtgagtttctggagaagaattacaaggaaacatctggccaagaaactgtgaagttagctatacgtgctttgctggaggttgtggagagtggaggaaagaacattgaagttgctgtaatgactaaagagcacgggctgcggcagcttgaagaagctgaaatcgatgctattgttgctgatatagaagcagagaaagctgctgcagaggctgccaagaaggccccttcaacaaaggaaacttagtctgctgcagtatttaaatgcttttacgtgattacttttgtgacctctattacagattgtggtctgttgttgcctatggcaaatttatttccctcaaggatttttatcatgatacgatccaaaaattcagaggtactttatatgcttgttttctattgtatgtcttttgtcgactaagaaaacatcttgcaatgtctattcacgccc

SEQ ID NO: 3787 - DNA, 1090 bp, Sorghum bicolor
acaagaaaaggcccagatacacacagcaaaccagcaaaggcacgaccaccaccgccggccgggggaagcaagctcaaaccctaaccgccggcgacgccagcacgatggcccgctacgaccgcgcgatcaccgtcttctcccccgacggccacctcttccaggtcgagtacgccctcgaggccgtccgcaagggaaacgccgccgtcggcgtccgcggcacggacaccgtcgtcctcggcgtcgagaagaagtccacccccaagctccaggactccaggtccgtgcgcaagatcgcgtgcctcgacacccacatcgcgctggcgtgcgcggggctgaaggcggacgcgcgcgttctcatcaaccgcgcgcgggtcgagtgccagagccaccgactcaccgtcgaggaccccgtcaccgttgagtacatcacccgctacatcgctgggctgcagcagaagtatacacagagtggtggagtccgccccttcggcctctccactctcattgtcggcttcgacccctacaccgacaagccggcgctgtaccagaccgacccatccggtaccttctctgcttggaaggccaacgccacgggaaggaactccaactctatgcgtgagtttctggagaagaactacaaggagacctccggcaaggagaccatcaagcttgctatccgtgcacttttagaggttgttgaaagtggtgggaagaacatcgaggttgcagtgatgacaaagaaggatggtctccgggaactcgaggaggctgagattgatgaatatgttgccgagattgaggcagagaaggctgcagcggaggctgcaaagaagggagccccgaaggacacctaattcctgtcttgtgctatgcctcccttcaacactgtgtgcctggtttttatgttccatagcaccatcttaactgttttagaaggatgctagatctttaggtgaaactatgctcaggtgcctgtggcacaaatgatgtaatgtgctcatctacatgccttctatggaaattttcaatttcgtctactgtgtcatctggacagtaatagttcaaacgttttctacttgatgattccttg

SEQ ID NO: 3788 - DNA, 1384 bp, Panicum virgatum
cggcaaatctcgcctgaaccgacaactaatcggacccgacgccgcccccctgaagtcctgaactacgcacccaaccagcaaaggcacgagcaccaccgccggccgggaagcaagctcaaaccctaaccgccggcgacgccagcacgatggcccgctacgaccgcgcgatcacagtcttctcccccgacggccacctcttccaggtcgagtacgccctcgaggccgtccgcaaggggaacgccgccgtcggcgtccgcggcgccgacaccgtcgtcctcggcgtcgagaagaagtccacccccaagctccaggactccaggtccgtgcgcaagatcgccagcctggacacccacatcgcgctggcttgcgcggggctcaaggcggacgcgcgcgtgctcatcaaccgcgcgcgggtcgagtgccagagccaccggctcaccgtcgaggaccccgtcaccgtcgagtacatcacccgctacatcgccgggctgcagcagaagtacacgcagagtggtggagtccgccccttcggcctctccacgctcatcgtcggcttcgacccctacaccgacaagccggctctgtaccagaccgacccatctggcaccttttctgcctggaaggccaacgccacggggaggaactccaactccatgagggaattcctcgagaagaactacaaggaaacctctggcaaggagactatcaagctcgccatccgtgcacttctagaggttgttgaaagtggtgggaagaacatcgaggttgcagtgatgacaaagaaggatggtctccgtgaacttgaggaggctgagattgatgaatacgttgccgagattgaggcagagaaggctgcagctgaggctgcaaagaagggtgccccgaaggacacctaattctggcttctgctgtgccttcgatcaacactttgtgtcttttttttatgttccatacactatcttaactgttttagaggaatgttagattgttagacaaactttatgcttctatgcccagactcgcatgctgtgctatgtgctcatctgcatgccttcttccgaatgcttcaatttcatttgctacatctgctgaacagttcaaactttatcgtcatacacctgattgtgttgcctaatgactttgctgggcctgtgggagattgttcacctgttgcttattggttcacggaaaagaagaaaagacagccaggtcttataaatggattatctcccacaggtgcctgttcaccggtgggagatttctttttgccttttcagcggtgctgtgattccatggattggatcattggagcaggtttgtctagctgagccttacgcatctggctaatattaaacaggctgacatacaatggtttctctagtcg

SEQ ID NO: 3789 - DNA, 1067 bp, Tabernaemontana elegans
gttctcttgagaattcttttcctttactccatagaggttcccttcccttttccatccgagtatcagtatcgaagacgaggcgaagatcgaaagcaaatcaacgactgcatacatacatccatccataagctacagatttgtctaaacaatggctagatacgacagagctatcacagttttctcgccggatggccatctattccaggtcgagtatgccctagaagccgtccgcaagggcaacgctgctgtgggcgtccgtggcatcgacaccatcgttctcggcgtggagaagaaatcaactcccaaacttcaagactccagatcagtcaggaagattgtaaacctagacgatcacatcgcactggcctgtgcagggctaaaagcagatgcacgtgtcttgataaaccgagcacgtattgagtgtcaaagtcataggcttaccgttgaggatccagttaccgttgaatatattactcgttacatagctggtcttcagcagaaatacacacaaagtggtggtgtgagaccatttggcctttcaaccttgatcattggctttgacccttacacaggtgccccttcgctttaccagacagatccttcaggaacattttcagcctggaaagccaatgcaactgggagaaattcaaactctatcagggagtttctagagaagaattacaaggaaacatctggccaagaaactgtaaagttagccattcgtgcactgcttgaagttgtcgagagtggtgggaagaacatagaagtggctgtgatgacaaaagagcatgggctgaagcaacttgaagaagctgagattgatgcaattgtttctgagattgaagaagaaaaagccgccgcggaggctgccaagaaggcccctccaaaagaaacctagtttgattgccgtacttgcgcaagactctctttttgtgatttctatttctttgctaagacgtagctttgttgcctccttgttaaaaggcaagttctgctcagaaggacacattattgttcaaggtttctttacaacggagtttcattaatattacttttccgtccaaatt

SEQ ID NO: 3790 - DNA, 1169 bp, Zamia vazquezii
ttgcttttgcttgcggtctactcctctcctccaacgaccaaaactagagggggctcagaaccctggtgagccgtggagtaggcatttctgaatgcaaagtcaagtaaggttataatggcgagatatgacagagcaatcacagttttttccccagacggccacctatttcaggttgagtatgccttggaggctgtgcgcaagggcaatgcggccgttggggttcgtggcactgataccattgttctgggcgtcgagaaaaaatccacagctaagcttcaagattccagaacggtgcgaaagattgtaaacctagatgaccacattgcattggcttgtgcgggactcaaagcagatgcacgtgtgttgattaatagggctcggattgaatgtcaaagtcacaggcttactgttgaggatcctgctactgtagagtatatcacacggtacattgcaggtctccagcagaagtacacacaaagtggaggtgtaaggccttttggcctatccacacttattgtaggatttgatccatatacaggggttccctctctttaccaaacagacccatctggtacattttctgcatggaaggcaaatgcaacaggaagaaactcaacttctgttcgtgaattcttagagaagaactacaaagagacatcagggcaagaaactgtaaagcttgcaatccgagctctacttgaagttgttgaaagtgggggtaagaacatagagattgctgtaatgacacgtgaaaagggcttgcggcaacttgaggaatccgaggttgatgcaattgtagctgaaactgaagcagagaaagcagcagctgaagctgcaaaaaaggcccctactcctagagagtcttgaagtttgaatgttcttgcattggtagataatcattgtcaattgcaacttttcacctcagttgtttttcctatttcctgcaccccggaattttgatttccatttttgaataactgttattttatcatttacattgcacttttatgattttgtcagttggttctcctagagatctcaaagtcagttggatttgatgatctcaatggcatcagagcagacaaatttctaataaacagaatatttgatgtgctctttctgtctaattgaatcattaatgatatcctgaaggaagtcaaagcatagag

SEQ ID NO: 3791 - DNA, 868 bp, Avena sativa
ccaccggcgatggcccgctacgaccgcgcgatcaccgtcttctcccccgacggccacctcttccaggtcgagtacgccctcgaggccgtccgcaagggcaacgccgccgtcggcgtccgcggcaccgacaccgtcgtcctcggcgtcgagaagaagtccacccccaagctccaggactccaggtcgctgcggaagatcgcgagcctggacacgcacatcgcgctggcgtgcgcggggctcaaggcggacgcgcgggtgctcatcaaccgcgcccgcgtcgagtgccagagccaccggctcaccgtcgaggaccccgtcaccgtcgagtacatcacacgctacatcgccggcctgcagcagaagtacacccagagcggtggggtccgccccttcggcctctccaccctcatcgtcggcttcgatccgtacacggacaagcccgcgctctaccagaccgacccctccggcactttctccgcctggaaggccaacgccacggggaggaactccaactccatgcgggagttcctcgagaagaactacaaggacacatccggcaaggagaccatcaagctcaccatccgcgctcttctagaggttgttgagagtggtgggaagaacatcgagattgcagtgatgacaaagaaggatggccttcggcaacttgaggagactgaaattgatgaatatgttgctgagattgaggcagagaaggctgcggctgaggctgcaaagaagggtggcccgaaggatacctaattgtaggatatgttctaccttcatcctgtgaaccaaaactttgtagtgtgtcacttgttacgttctgtaacacctttttaaacagctttaacaagacatgggtctaaat

SEQ ID NO: 3792 - DNA, 1312 bp, Avena sativa
tgggccgggtaaaacaattcgagcacagaccgggtgaaacaggttaacgggctcagagttttggaaggggtcttgcttcttcttctctcccaagaaagagtctgaactgacaaaaggaattcaacagacgcaccggaactctcaaagcgaaagccgcagcggaaatctatctcgccggcgtcgtcacgcaccagtgccagccatggcccgctacgaccgcgcgatcaccgtcttctcccccgacggccacctcttccaggtggagtacgccctcgaggccgtccgcaagggcaacgccgccgtcggcgtccgcggcgtcgacaccgtcgtgctcggcgtcgagaagaagtccaccccgaagctccaggactccaggtccgtgcgcaagatcgcgagcttggacacgcacatcgcgctggcctgcgcagggctcaaggcggacgcgcgcgtgctcatcaaccgtgcgcgcgtcgagtgccagagccaccgcctcaccgtcgaggaccccgtcaccgtcgagtacatcacgcgctacatcgctggcctgcagcagaagtacacgcagagcggaggagtgcggcccttcggcctctccacgctcatcgtcggcttcgatccctacaccgagaagccagcgctgtaccagaccgacccctccggcaccttctccgcctggaaggccaacgccaccggccgcaactccaactccatgcgcgagttccttgagaagaattacaaggagacgtctgggaaggagaccatcaagcttaccatccgagccctgcttgaggttgtcgagagtggtggcaagaacatagagattgcagtgatgacacacaaggatggcctccgcaacctggaagaggctgagatcgacgagtacgtcgctgagatcgaagcagagaaggccgccgctgaggctgcgaagaagggtggcccgaaagacacctaaatgtactcatgattcagcacagtcgcagcacattgctcctctagcccggttttatgttccgccagcttgttgttttacatgtttgagaggaatttagaattgtttgttcaaagtggctggttgtttgttccggacggccaatggggtttcttggactaaacctcagttcccttgttgtaggctaaggcgttactgggctgtggacgtatgttaagaagtgggccgatttatcacgtatgggcaatatgggctgctgtatgttttgaccattgtcattcgtatatgggcaaatttgttttcttgcacttacacgcagctgctgaatacgttagaactgatgtaaaatctatgaaaatcaag

SEQ ID NO: 3793 - DNA, 1244 bp, Avena sativa
tgggccgggtaaaacaattcgagcacagaccgggtgaaacaggttaacgggctcagagttttggaaggggtcttgcttcttcttctctcccaagaaagagtctgaactgacaaaaggaattcaacagacgcaccggaactctcaaagcgaaagccgcagcggaaatctctctcgccggtgtcgtcacgcaccagtgccagccatggcccgctacgaccgcgcgatcaccgtcttctcccccgacggccacctcttccaggtcgagtacgccctcgaggccgtccgcaagggcaacgccgccgtcggcgtccgcggcgtcgacaccgtcgtgctcggcgtcgagaagaagtccaccccgaagctccaggactccaggtccgtgcgcaagatcgcgagcttggacacccacatcgcgctggcctgcgcggggctcaaggcggacgcgcgcgtgctcatcaaccgggcgcgcgtcgagtgccagagccaccgcctcaccgtcgaggaccctgtcaccgtcgagtacatcacgcgctacatcgctggcttgcagcagaagtacacacagagcggaggggtgcggcccttcggcctctccacgctcatcgtcggcttcgatccctacaccgagaagccagcgctgtaccagaccgacccctccggaaccttctccgcctggaaggccaacgccaccggccgcaactccaactccatgcgcgagttccttgagaagaattacaaggagacgtctgggaaggagaccatcaagcttaccatccgagccctgcttgaggttgtcgagagtggtggcaagaacatagagattgcagtgatgacacacaaggatggcctccgcaacctggaagaggctgagatcgatgagtacgtcgctgagatcgaagcagagaaggctgccgctgaggctgcgaagaagggtggcccgaaagacacctaaatgtactcatgattcagcacagtcgcagcacattgctcctctagcccggttttatgttccatagccagcttgttgttttacatgtttgagaggaatttagaattgtttgttcaaagtggctggttgtttgttccggacagccaatggggtttcttggactaaacctcagttcccttgttgtaggctaaggcgttactgggctgtggacgtatgttaagaagtgggccgatttatcacgtatgggcaatatgggttggtgtatgttttgaccattgtcattcgtatatgggca

SEQ ID NO: 3794 - DNA, 854 bp, Avena sativa
cgatggcccgctacgaccgcgcgatcaccgtcttctcccccgacggccacctcttccaggttgagtacgccctcgaggccgtccgcaagggcaacgccgccgtcggcgtccgcggcgtcgacaccgtcgtgctcggcgtcgagaagaagtccaccccgaagctccaggactccaggtccgtgcgcaagatcgcgagcttggacacccacatcgcgctggcctgcgcggggctcaaggcggacgcgcgcgtgctcatcaaccgggcgcgcgtcgagtgccagagccaccgcctcaccgtcgaggaccccgtcaccgtcgagtacatcacacgctacatcgccggcctgcagcagaagtacacccagagcggcggggtccgccccttcggcctctccaccctcatcgtcggcttcgatccgtacacggacaagcccgcgctctaccagaccgacccctccggcaccttctccgcctggaaggccaacgccacggggaggaactccaactccatgcgggagttcctagagaagaactacaaggacacatccggcaaggagaccatcaagctcacaatccgcgctcttctagaggttgttgagagtggtgggaagaacatcgagattgcagtgatgacaaagaaggatggccttcggcaactggaggagactgagattgatgagtatgttgctgagattgaggcagagaaggctgcggctgaggctgcaaagaagggtggcccgaaggatacttaattgtaggatatgctaataccttcatcctgtgaacgagactttgtagtgtgtcacttattacattccatgacacctttttaaactgctttagcaagacatgga

SEQ ID NO: 3795 - DNA, 880 bp, Arabidopsis lyrata
aattttgtgttgttggcttgtcgcagaagttgggattcgtctttttttgccctgaaaacgaaacgaattggaaaagtaacatcatcggatagagatggctagatacgatcgagcaattactgtcttctcccccgacggtcacctctttcaagtcgaatacgcccttgaagccgtccgcaagggtaacgccaccgtcggtgtccgcggtaccgacaccgtcgtcctcgccgtcgagaagaaatctacccccaagcttcaggattctagatcagccagaaaaattgtgagccttgacaaccacattgccttggcatgcgccgggctcaaggcagatgcccgtgtcttgattaacaaagctaggatcgagtgtcaaagccataggcttacactagaggaccctgtcactgttgagtacatcactcgctacattgctggccttcaacagaagtatacccaaagtggtggtgtcagacccttcggtctttctactcttatcgttggcttcgacccttactctcgtctgccttccctatatcagactgatccttctggcactttctctgcttggaaagctaatgcaaccggtagaaactccaactctattagggaattcctggagaagaactacaaagaatcctctggccaagaaactattaaactcgctatccgtgctcttcttgaggtagttgaaagcggaggaaagaacattgaggttgctgtaatgacacgggaggaaactgggctgcgccagctagaagaagctgaaattgatgcaattgtggcagagatcgaagctgaaaaggcggccgcagaagcagccaagaaaggccctccaaaggaaacttgataaaacaatatctcaattcagccacaaagactg

SEQ ID NO: 3796 - DNA, 1019 bp, Arabidopsis thaliana
tttttttttttctgttcttggcttgtcgcagaagttgggattcgtctttttataatttgccctgaaaacgaaaacgaaaataaaaagcggagagagagatggctagatacgatcgagcaattactgtcttctcccccgacggtcacctctttcaagtcgaatacgcccttgaagccgtccgcaagggtaacgccgccgtcggtgtccgcggtaccgacaccgttgtcctcgccgtcgagaagaagtccacccccaagcttcaggattctagatcagccagaaaaattgtgagccttgacaatcacattgccttggcatgcgcggggctcaaggctgatgcccgagtcttgattaacaaagcaaggatcgagtgtcaaagccacaggcttacacttgaggaccctgtcactgttgagtacatcactcgctacattgctggccttcaacagaagtatacccaaagtggtggtgtcagacccttcggtctttctactcttatcgttggctttgacccttactctcgcctcccttccctatatcagactgatccttctgggactttctctgcttggaaagctaatgctaccggcagaaactccaactctattagggaattcctcgagaagaactacaaagaatcctctggccaagaaactattaaactcgctatccgtgctctgcttgaggtagttgagagtggcggaaagaacattgaggttgccgtaatgacacgggaggaaactgggctgcgccagctagaagaagctgaaattgatgcaatcgtggccaagatcgaagctgaaaaggcggccgcagaagcagccaagaaaggccctccaaaggaaacttgataaaacaataactgtttctgtttctcaatctgaacttaccttcttcgctgcttctgtttctcaatcttgttttgactcgagccaactctttggcaaaagaagaacctgaccccatcgttttgttaacttgaaaatgctccaaaaaaaaactgaagaaagggtttaaaa

SEQ ID NO: 3797 - DNA, 1679 bp, Hordeum vulgare
gaacaacccgttcaaaaaagaaagggaacagaacaaaaaagaaaagaacagagcagaacagagtctcagtggaacaacatacgcaccggaactctcaaagcggaagcctctctcaccggcgacgacgcgcaccagcagcgatggcccgctacgaccgagcgatcaccgtcttctcccccgacggccacctcttccaggttgagtacgccctcgaggccgtccgcaagggcaacgccgctgtcggcgtccgaggcgtcgacaccgtcgtcctcggtgtcgagaagaagtccacccccaagctccaggactccaggtccgtgcgcaagatcgcgagcctggacacccacgtcgcgctggcctgcgcgggtctgaaggcggacgcgcgcgtgcttatcaaccgggcgcgcgtcgagtgtcagagccaccgcctcaccgtcgaggaccccgtcactgtcgagtacatcacgcgctacatcgccggcctgcagcagaagtacacgcagagcggaggggtgcgcccattcgggctttccacgctcatagttggcttcgacccctatactgagaagcccgcgctgtaccagaccgacccctccggcaccttctctgcctggaaggccaacgccaccggccgcaactccaactccatgcgcgagttccttgagaagaattacaaggagacgtccggcaaggagaccatcaagcttaccatccgagcccttcttgaggttgtcgagagtggtggcaagaacattgagatcgctgtgatgacgcacaaagatggtcttcgccaacttgaggaagacgagatcgatgagtacgttgctgagatcgaaacagagaaggctgctgctgaggctgcaaagaagggtggcccgaaagacacatgatgtactaatgatttagcacagtcgcggcacatggctcctctagctctatttatgttcacagcttgtctgcttgtcttaactgtttccgaagaacttgtttggcggaaggttgtttatttgttgctgacggaggtgcttggactaatgggcttgatcccgtcatgtgcgaactgtaagcttagctataatggccgttaccggggccgtggatgtgaagtgggctgagttatcctacaacttattcctaatagtagtatcaggcagtagccattttttaaaaaaaagaagaaaaaagagagaccgcagacggcgttgcagattggagccttggagctaggtgaaggattggagcaataaaggctggtgtatgctaaaaattttttcttttctttttttccttaaaatattagtttcatatcggcactagttgtgtgctacttttatttttcttgaaaaaatatctatgctacaggtttaaggaagaaatggattgctgcaacgggcgtacgtacgagacaatgagaacgccacatagcagccacctagttgtcgtttgtttaactgtcagcgacgaggcgacgcaggaagacaaagcccagagcaaggaccggcccaggagggagcctcgcaaatctgctcggcttgctgggccagaatgggcctaactgtagttacttacactactccctccgtttctaaatataagaccttttagagattgtactataaactacatacggatgtacatagacatattttagagtatagattcactcattttgctccgta

SEQ ID NO: 3798 - DNA, 1069 bp, Ocimum basilicum
tcattttggatccccttccccttgtcgtgtcgcccaagttccgctcaaaccccctcttttagtacttccccaatttcttcatcactccactgcaagtctctcagattattatttcaaaggggaagatcccgacagatcggaagatcagacgccaattagtttatttcgctaagaagattgagacatggcgcgatatgacagagctatcaccgttttctcgccggacggccaccttttccaggttgagtacgcactggaagccgtgcgcaaggggaatgccgccgtcggtgttcgcggcactgatactatcgtgctcgccgtcgagaagaagtccactcctaagctgcaggattctaggtcagtgaggaagatagtcaatttagatgatcatatagcattggcatgtgcaggcctgaaggcagatgctcgtgttttgataaataaggcacgtatagaatgccagagtcacaagcttactgttgaggatcctgtgactgtagaatacattactcgttatattgctggtcttcaacaaaagtacacacaaagtggtggtgtgagaccttttggtctttcaaccctgatcattgggtttgatccacacacaggcactccatcactttatcagacagatccatcaggcactttttcagcatggaaagccaatgctactggaagaaactctaactctatcagagagtttcttgagaagaactacaaggaaacatccggtcaagaaactgtgaagttagccattcgtgccctgctggaggttgtggaaagtggaggaaagaacatcgaggttgctgtaatgacgagagagcatggattgcgccaactggaagaagctgaaattgacgccatagtggttgatatagaagcagagaaagctgctgcagaagctgccaagaaggcccctgcaaccaaggagacttgagaagttgtctctacttcacgttattacatttgtatcacagattatggcttcttgttatttattcttatgattcctgttgtggattttttctggtttatgattatgacttgaagggagctttctcatcacaca

SEQ ID NO: 3799 - DNA, 1037 bp, Brachypodium distachyon
gcctacccgaccgccggcgacgccaggatggcccgctacgaccgcgcgatcaccgtcttctcccccgacggccacctattccaggtcgagtacgctctcgaggccgtccgcaagggcaacgccgccgtcggcgtccgcggcaccgacactgtcgtcctcggcgtcgagaagaagtccacccccaagctccaggactccaggtcggtgcggaagatcgcgagcctggacacgcacatcgcgctcgcgtgcgcggggctcaaggcggacgcccgcgtgctcatcaaccgcgcgcgcgtcgagtgccagagccaccgcctcaccgtcgaggaccccgtcaccgtcgagtacatcacccgctacatcgccggcctgcagcagaagtacacccagagcggtggtgtacgcccctttggcctgtcgaccctcatcgtcgggttcgatccctacacagacaagcccgccctgtaccagactgacccctccggtaccttctccgcgtggaaggccaacgccactgggaggaactctaactccatgcgggagttcctggagaagaactacaaggacacctccggcaaggagaccatcaagctcaccatccgtgctcttctagaggttgtcgagagtggtgggaagaacattgagattgcagtgatgacaaagaaggatggtcttcggcaacttgaggagactgaaatcgacgaatatgttgctgagattgaggcagagaaggctgcagctgaggctgcaaagaaaagcggaccgaaggatacctaattattggatgtgatatgctttattctgtgaaccaaaacttttagtgttacctgttaagttctataactccttttaaactgctttaacaagacatagtaaatgaattgcctttttttcttggtccccggtgtgctggtgatttctgtgtgcaaagcgtttgaacagggtgcaaatttatcgatgtatctccaaaacaattgatgggatcaggacatgctaccaaatcgtgttatctgaattcacgcttaatctcacgggac

SEQ ID NO: 3800 - DNA, 1122 bp, Brachypodium distachyon
gaaacccttcttcccgacgccaccgagcttaccaacacaccctcgaacaacccagcaaaggcacgaccacctccccgaaccctaggcctacccgaccgccggcgacgccaggatggcccgctacgaccgcgcgatcaccgtcttctcccccgacggccacctattccaggtcgagtacgctctcgaggccgtccgcaagggcaacgccgccgtcggcgtccgcggcaccgacactgtcgtcctcggcgtcgagaagaagtccacccccaagctccaggactccaggtcggtgcggaagatcgcgagcctggacacgcacatcgcgctcgcgtgcgcggggctcaaggcggacgcccgcgtgctcatcaaccgcgcgcgcgtcgagtgccagagccaccgcctcaccgtcgaggaccccgtcaccgtcgagtacatcacccgctacatcgccggcctgcagcagaagtacacccagagcggtggtgtacgcccctttggcctgtcgaccctcatcgtcgggttcgatccctacacagacaagcccgccctgtaccagactgacccctccggtaccttctccgcgtggaaggccaacgccactgggaggaactctaactccatgcgggagttcctggagaagaactacaaggacacctccggcaaggagaccatcaagctcaccatccgtgctcttctagaggttgtcgagagtggtgggaagaacattgagattgcagtgatgacaaagaaggatggtcttcggcaacttgaggagactgaaatcgacgaatatgttgctgagattgaggcagagaaggctgcagctgaggctgcaaagaaaagcggaccgaaggatacctaattattggatgtgatatgctttattctgtgaaccaaaacttttagtgttacctgttaagttctataactccttttaaactgctttaacaagacatagtaaatgaattgcctttttttcttggtccccggtgtgctggtgatttctgtgtgcaaagcgtttgaacagggtgcaaatttatcgatgtatctccaaaacaattgatgggatcaggacatgctaccaaatcgtgttatctgaattcacgcttaatctcacgggac

SEQ ID NO: 3801 - DNA, 1251 bp, Catharanthus roseus
ttctctccgagcattctttcttctacaatatagcttttctctattactcccaaaaggccgctcctacttactttgtatcgacgacgagaaggagatcggaagcaaatccaatagcacatacgtaaatccacgtaaacggtatagatttttctgagaaatggctagatacgatagagctatcactgttttctcgccagacggccatctattccaggttgagtatgccctagaagccgtccggaagggaaacgccgctgtaggtgtccggggcacagacaccatcgttctcggtgtcgagaagaaatcaactcccaagcttcaggattccagatcagtcaggaagattgtaaacctagacgatcacattgcattggcatgtgctgggttgaaagcagatgcacgtgttctgataaacagggcacgtatcgagtgtcaaagtcataggcttactgttgaggatcctgttacagttgaatatattactcgttacatagctggtctccagcagaaatatacacaaagtggtggtgtgagaccatttggcctttcaaccttgatcattggctttgacccatacacacgtgccccttcactttaccagacagatccttcaggaacattttcggcctggaaagctaatgcaactgggagaaactcaaattctattagggagtttctagagaagaattacaaggaaacatctggccgagaaactataaagttggccatccgtgcactgcttgaagttgttgagagtggtgggaagaacatagaagttgctgtgatgacaaaagaggatggtctgaaacaacttgaagaagctgagattgatgaaattgttgccgagattgaagcagaaaaagctgctgcagaggctgccaagaaggcccctccaaaagaaacttaaagtttgattgcactggctttgcagagagtcccttgttttgtcatattcacttctttgctaagacaattatttgttgttactttgtcaaagtagacaccttctgtcggaaggataacttgttgttcaaggtttctttagaacagagtttcattattaattactgtccaaagttgcctaagttgtcattcttaatcctacagtgtatttgagcatttaccgcttttccccacctttctgccgtggaaagtggcaatttgttccactttctctacatattgcgaagacccgaagccaggcttcaacgaaattacaaacagcaaaatgacgagtattttatattccta

SEQ ID NO: 3802 - DNA, 1227 bp, Lupinus angustifolius
gaatatactaaacttgttgaagaagaagaagaagcaagaaatacactttcccttaaacattgaagaaaatttgaatcagaatcgaaacacaatcatcaatggcgaggtacgatagagcaatcacagtgttctcacctgatggccatctcttccaagttgagtacgcactcgaagctgttcgtaagggtaacgccgccgtcggtgttcgcggctccgataacgtcgtcctcggcgtcgagaagaaatccaccgctaaattacaagactctagatcagtgagaaagattgtgaatctggataatcacattgcacttgcttgtgcaggactaaaagctgatgctcgtgtccttgtaaacaaggcacgagttgaatgtcaaagtcataggcttacggttgaggatccagtcactgtggagtatattactcgttacattgcaggtcttcagcaaaaatatacacaaagtggtggtgtccgaccctttggtctttcgaccttgattgttggatttgatccatactctggtaaaccgtcgctgtaccaaacggatccttctggtacattttcagcttggaaagccaatgcaactgggagaaactcaaattctattcgggagttcctagagaagaactataaagaagtttctgggcaagaaactatcaaattggcgatccgggcattgcttgaagttgttgagagtggaggcaagaatatagaagttgctgtggtgactaaggagcacggcctgcgtcagcttgaggaaaccgaaattgatgccattgtggctgatattgaagcagagaaagcagctgctgaggctgcaaagaaagggccttctaaggagacataatttatgcttatttactgtagctgaaattgatgctttggctgagattcaaacagaaaaaacagctgctgaggctgcaaagataaacctttctaaggaaacatcattttagtttactttagtttttctcatgaattggtcttgctgggttttgactaaacttaattgctttagggtcgtttcatgtattatttgtcaaacttgcatcattattaatcgagttcatagtttgagttgtgtgcatctaccctctctagaccccactaaatgggagtcgcgtacaataggcccttttatagtttgagttgtgtggcccgtcatggtacatgcttatataattgtctgatagtaggaatataaatgatcttattattctatacac

SEQ ID NO: 3803 - DNA, 1033 bp, Zea mays
aaaaaattcagcaaacaagcaaaggtacggccaccaccaccggccaggaagcaagctcaaaccctaaccgccggcgacgccagcacgatggcccgctacgaccgcgcgatcaccgtcttctcccccgacggccacctcttccaggtcgagtacgccctggaggccgtccgcaagggcaacgccgccgtcggcgtccgcggcacggacaccgtcgtcctcggtgtggagaagaagtcaacccccaagctccaggactccaggtccgtgcgcaagatcgcgtgcctggacacccacatcgctctggcatgcgcggggctgaaggcggacgcacgcgtgctcatcaaccgcgcgcgggtcgagtgccagagccaccgactcaccgtcgaggaccccgtcaccgtcgagtacatcacccgctacatcgctgggctgcagcagaagtatacacagagtggtggagtccgccctttcggcctctccacactcattgtcggcttcgacccctacaccgacaagccagcgctgtaccagaccgatccttctggtaccttctctgcttggaaggcgaacgccacgggaaggaactccaactctatgcgtgagtttctggagaagaactacaaggagacctccggcaaggagaccatcaagcttgctattcgtgcacttctagaggttgttgaaagtggtgggaagaacatcgaggttgcagtgatgacaaagaaggatggtctccgggaacttgaggaggctgagattgatgaatatgttgctgagatagaggcagagaaggctgcagctgaggctgcaaagaagggtggtcctagggacacctagtccctgtattgtggtattcctccctttgtgtgtcttgtttttatgttccatagcaccatcttaattgttttagaagaaggatgcttatatggctgtggctgccttgtgacttgtgtgggtctgtgggctgcggggtggttctaaagctctgcagccccgagtgtttatttattaattattgttgaggttgagagaa

SEQ ID NO: 3804 - DNA, 1225 bp, Mimulus guttatus
tgtgttcactttatacattttcccccattccgagtagtctccgtcttctgcaaatcatttcttaagaaaagaagaaaaaaaaaactaagtacagagacacagatcaaacccttgcacacacacaaacacttcggcattactagaagaagagtgagatatggcccgatacgacagagcaattacggttttctcgccggacggccatctcttccaggtcgagtacgctctcgaagctgtacgcaagggtaacgccgccgtcggtgttcgtggcaccgacaccatcgtactcgccgttgagaagaagtccgctcctaagctgcaggattctagatcagtgaggaagattgtcaatttagacgatcacatagcattggcttgtgctggactgaaggcagatgcacgtgtcttgataaacaaggcacggattgaatgccagagtcacaagcttacaatcgaggatcctgtaactgtcgaatacattactcgctacattgctggtcttcagcagaagtacacacagagtggcggtgtgaggccttttggcctttcaactttgatcattgggtttgatccacacacaggaattccatcgctttaccagacggatccatcggggacattttccgcatggaaagcaaatgctactgggagaaactcaaactccataagggagtttctcgagaagaattacaaggaaacatccggacaggaaaccttgaagttagccattcgtgctttgctggaggttgtggagagcggaggaaagaatatagaagttgctgtaatgactaaagaacatggactgcatcaactcgaagaagctgaaattgatgccattgttgctgagattgaagctgagaaagctgccgctgaagctgcgaagaagggcccttctaccaaggaaacttaagtctggggtactctataaatcctttacattatcgcttttgtgactttgtattacagatttttttatcgcctttttttttccgtggattttgtctgtgttttgatccataactaaaagagagactagatgttttttcttctctaaatgtaaaactatttatgctatgtcttgcaatttttattcgtttccactcactggtgcatgttaccgatttcgtgtaagcaacatcttaaaactcaattacacgcatatatacgtgtcctgtgtgtggaacctgtattgtgtgatgtacttatgttagacgattgtctaatc

SEQ ID NO: 3805 - DNA, 1194 bp, Tropaeolum majus
agaagagatggcaagatacgatagagctattacggtgttctccccagatgggcatcttttccaagtggagtacgctctcgaagctgttcgtaaaggaaacgcagcagtcggtgttcgtggatccgataacgttgttctcgccgtcgagaagaaatctgcacccaaacttcaagacactaggtcaattaggaagattgtaaacctagataatcatgttgcgttggcctgtgctggactcaaagcagatgctcgcgtcttgataaacaaggcgagaattgaatgtcaaagccacagattgactgtcgaagatccagtgactgttgagtatattactcgttatattgcagggcttcagcagaagtacacccaaagtggtggtgtaagaccgttcgggctttcaactttaattgtcggctttgatccgtatgctggtacaccctctttgtatcagacagatccatcagggactttttcagcctggaaagcaaatgcaactgggagaaactctaattcaataagggagttcttagagaaaaactataaagaaacttctggacaagagactgtaaagcttgcaattcgtgcaatgctggaggttgttgagggtgggggaaagaacattgaagttgctgtaatgacaaaggagcatggcctgcgtcaactagaagaagctgaaattgatgccattgtagctgatattgaagcagaaaaagcagctgccgaagctgcaaagaaggggcccgtcaaggaaacatgaacgtgatttcgttaacatttatttatcttttccgttgacattggttttggtgtaactttgacttgcgatttctatctttcttcatttcatccttgtgggcctttgtttgcactttacttttgaatcttacatcttatgaacccagttattctacataagggaagaacactttaaaaatttaaccaaaattattccatgtaatgataaaaccttagtttaatttgttccatcgacaccttgggtgggatgtgcgcatccagatgctcactacgaggtttagtgcaaaaccgatgattaaaatgttgtggttgctaaatgttaagaagcggaagtaacttatgtagtgtcgttatgtcgttatgatactattgacttctttcaaatctataaaattttatggaagtcaaaagataaaatatgtggatcattagaaaccg

SEQ ID NO: 3806 - DNA, 895 bp, Avena sativa
gggaagcccaaaccctaagcccctccgaccgccggcgatggcccgctacgaccgcgcgatcaccgtattctcccccgacggccacctcttccaggtcgagtacgccctcgaggccgtccgcaagggcaacgccgccgtcggcgtccgcggcaccgacaccgtcgtcctcggcgtcgagaagaagtccacccccaagctccaggactccaggtcgctgcggaagatcgcgagcctggacacgcacatcgcgctggcgtgcgcggggctcaaggcggacgcgcgagtgctcatcaaccgcgcccgcgtcgagtgccagagccaccggctcaccgtcgaggaccccgtcaccgtcgagtacatcacacgctacatcgccggcctgcagcagaagtacacccagagcggtggggtccgccccttcggcctctccaccctcatcgtcggcttcgatccgtacacggacaagcccgcgctctaccagaccgacccctccggcaccttctccgcctggaaggccaacgccacggggaggaactccaactccatgcgggagttcctggagaagaactacaaggacacatccggcaaggagaccatcaagctcacaatccgtgctcttctagaggttgttgagagtggtgggaagaacatcgagattgcagtgatgacaaagaaggatggccttcggcaacttgaggagactgaaattgatgaatatgttgctgagattgaggcagagaaggctgcggctgaggctgcaaagaagggtggcccgaaggatacctaattgtaggatatgttctaccttcatcctgtgaaccaaaactttgtagtgtgtcacttgttacgttctgtaacacctttttaaacagctttaacaagacatgggtctaaa

SEQ ID NO: 3807 - DNA, 1223 bp, Avena sativa
aggaattcaacagacgcacaggaactctcaaagcgaaagccgcagcggaaatctatctcgccggcgtcgtcacgcaccagtgccagccatggcccgctacgaccgcgcgatcacggtcttctcccccgacggccacctcttccaggtggagtacgccctcgaggccgtccgcaagggcaacgccgccgtcggcgtccgcggcgtcgacaccgtcgtgctcggcgtcgagaagaagtccaccccgaagctccaggactccaggtccgtgcgcaagatcgcgagcttggacacgcacatcgcgctggcctgcgcggggctcaaggcggacgcgcgcgtgctcatcaaccgggcgcgcgtcgagtgccagagccaccgcctcaccgtcgaggaccccgtcaccgtcgagtacatcacgcgctacatcgctggcctgcagcagaagtacacgcagagcggaggggtgcggcccttcggcctctccacgctcatcgtgggcttcgatccctacaccgagaagccagcgctgtaccagaccgacccctccggcaccttctccgcctggaaggccaacgccaccggccgcaactccaactccatgcgcgagttccttgagaagaattacaaggagacgtctgggaaggagaccatcaagcttaccatccgagccctgcttgaggttgtcgagagtggtggcaagaacatagagattgcagtgatgacacacaaggatggcctccgcaacctggaagaggctgagatcgacgagtacgttgctgagatcgaagcagagaaggccgccgctgaggctgcgaagaagggtggcccgaaagacacctaaatgtactcatgatttagcacagtcgcagcacattgctcctctagcccggttttatgttccatagccagcttgttgttttacatgtttgagaggaatttagaattgtttgttcaaagtggctggttgtttgttccggacggccaatggggtttcttggactaaacctcagttcccttgttgtaggctaaggcgttactgggctgtggacgtatgttaagaagtgggccgatttatcacgtatgggcagtatgggctggtgtatgttttgaccattgtcattcgtatatgggcaaatttgttttcttgcacttgcacgcagctgctgaacccgttagaagtgatgtaaaatctatgaaaatgaagctacgtttgcaagaactaagtt

SEQ ID NO: 3808 - DNA, 1136 bp, Oryza sativa
gcagcagcagcccaactagtcttcgctccccaccaagctccgccaccgccggaaccctagacccgccggcgatggcccgctacgaccgcgccatcaccgtcttctcccccgacggccacctcttccaggtcgagtacgccctcgaggccgtccgcaagggcaacgccgccgtcggcgtccgcggctccgacaccgtcgtcctcggcgtcgagaagaagtccacccccaagctccaggactccaggtcggtgcgcaagatcgctagcctggacacccacatcgcgctggcgtgcgcggggctcaaggcggacgcccgcgtgctcatcaaccgcgcgcgggtcgagtgccagagccaccgcctcaccgtcgaggacgccgtcaccgtcgagtacatcacgcgctacatcgccggcctgcagcagaagtacacccagagcggcggggtccgccccttcggactctccaccctcatcgtcggattcgacccttacaccgacaagcccgcgctgtaccagaccgatccctccggcaccttctccgcgtggaaggccaacgccacggggaggaactccaactccatgagggagttcttggagaagaattacaaggagacctctggcaaagagaccatcaagctcgcaatccgtgctctccttgaggttgttgagagtggcggaaagaacatcgagattgcagtgatgacacagaaggatggtcttcgccaactcgaggaggctgaaatcgacgaatatgttgctgagatcgaggcagagaaagctgcagctgaggctgcaaagaagggtgcccctaaggagacctaattcttcgctgtaccaaattttcattccatcaacacatttagcgcattacttgtgttccacagcactgtttttaactgttctagaggaacgctagattgtttggagagtgaatgattctattcttattgcacatcaagatcccttagacccaaatgccttgtgatgtacttgttttctatatacatggcttcttttgaacaaaatgctccttaggctgactgtagacttcattaagtcttgagggcaactgtcaaatcttgtggagcatgatgtttccgtttctaatctttgctagatgcctagatgttgtgcagc

SEQ ID NO: 3809 - DNA, 1042 bp, Tripterygium wilfordii
ttcctaataagcctgaagaaaaacgaagaattcattttacagaacagaacgagctctccttcgcaatcgacggtgacgaagcgatcatcaacaaattgagctgagaaagaagaatggcgagatacgacagagcaatcactgtgttttcaccggacggacatctgttccaagtggagtatgcactcgaagctgttcgtaagggcaacgccgccgtcggcgtccggggcactgacaatattgtccttggagtcgagaagaaatctgccgcaaagctccaagactcccgatcagttaggaagatagtgaatctggatgatcacattgctttggcatgtgctggacttaaagcagatgctcgtgtcctgattaacaaggctcggattgaatgtcaaagccacaggctgactgtcgaggatcctgtaaccgttgagtatatcactcgttatatcgcaggactccagcaaaagtacacacaaagtggtggtgtgagaccatttggcctatcgaccctgattgtgggcttcgatccatacactgatgtgccatccctatatcagactgatccatctggaacattttcagcttggaaagctaatgcaactgggagaaactcaaattctatcagggagttcctggagaaaaactataaagaaacatctggacatgaaactctgaaacttgcgattcgtgcattgctcgaggttgttgagagtgggggcaagaacatagaagttgctgtgatgaccaaagagcatggcctgcggcaacttggtgaggccgaaatcgatgcagttgttgctgagattgaagcagagaaagcagctgctgaggctgcaaagagggcacctgtgcaagagacatgatttatctcctggtgttctcattgccttcctttggtcaaatttccctgtgacaatttctgataagagacttgctcttgtattttatttcttatacaggtagtcatcgttactatcctgagtgctactgcagcattttcactattatcttacaacaacggcttgttacaggacactgcatt

SEQ ID NO: 3810 - DNA, 1141 bp, Citrullus lanatus
gcttaatgtgaaagaaaaaagaaagagtgaaaagaactcacaaagaaaagagtggtggtaccttgttgctcaagttgggatttccctctataatttccgctgcagcacaagcagggcagagtgcgagagagaaaggaggagctgaagcgagataacaatggctagatacgatagggcaatcaccgtcttctcccctgacggtcatttgtttcaagtcgagtacgctcttgaagctgtgcggaagggtaacgccgccgtcggtgttcgtggcaccgatactatcgtcctcggtgttgagaagaaggctgcgcctaagctccaggactccagatctgtgaggaagattgtgaatcttgataaccatattgcactagcttgcgctgggcttaaggcagatgcacgcgtcttaatcaatagagctcggattgagtgtcaaagccatcgtcttacagttgaggatccagttactgttgagtatattactcgttacattgcaggtcttcaacagaagtatacccaaagtggtggagtgcgaccatttggcctctcaaccttgattataggttttgatccatatactggtgctccctcactgtaccagacagatccttctgggacattttcagcttggaaagcaaatgcaactggtagaaactccaattcaataagggaattcttagagaaaaattataaggaaacttctggtcaggaaactgtgaagcttgccatccgagcattgcttgaggttgttgagagtggtggaaagaacatagaggtcgccgtgatgacaaaggagcatggactgcgacaattggaagaagctgaaattgattctctcgttgcagaaattgaagcagaaaaagccgctgccgaggctgcaaaaaaagctcctcccaaggaaacatgatcccatttcttaaatttcttcaggcattttttaatcttttagttttctggtgtagtgagtggaccgttaaatcttattctgaacttccaaacttacacccttttgtccatcattgacacgaggtggccatagttggttatgtagcctctaaaaaatgcctgtttatccttccagcctctttcaatgggatggcaaaatgatgtgatttgtgtactgttgttgagattattgtgt

SEQ ID NO: 3811 - DNA, 1388 bp, Triticum aestivum
cacctccgccgcccgggaagcccaaaccaaaccctaagcctccgcgaccggccgccggcgatggcccgctacgaccgcgcgatcaccgtcttctcccccgacggccacctcttccaggtcgagtacgccctcgaggccgtccgcaagggcaacgccgccgtcggcgtccgcggcaccgacaccgtcgtcctcggcgtcgagaagaagtccacccccaagctccaggactccaggtccgtgcgcaagatcgcgagcctggacacccacgtcgcgctggcgtgcgcgggtctcaaggcggacgcgcgcgtgctcatcaaccgggcgcgcgtcgagtgccagagccaccgcctcaccgtcgaggaccccgtcactgtcgagtacatcacgcgctacatcgccggcctgcagcagaagtacacccagagcggaggggtgcgcccgttcgggctctccacgctcatagtcggcttcgacccctacacggagaagcccgccctgtaccagaccgacccctccggcaccttctccgcctggaaggccaacgccaccggaggcaactccaactccatgcgcgagttcctggagaagaactacaaggacacgtccggcaaggagaccatcaagctcaccatccgagccctcctagaggttgtcgagagtggtgggaagaacattgagattgcagtgatgacaaagaaggatggccttcggcaactcgaggagactgaaatcgatgaatatgttgccgagattgaggcagagaaggccgcggctgaggctgcaaagaagagtggcccgaaggatacctaattactggatgtgctatatcttcattctgtcggccgaaaccttttagtgtgtcacttgttacgttccataactttctttaaactgctttaacaagatattgaagtcattcgtaaatgaattgccttgttttcttgatggctcatggtccaggggtttcgtttccctttcccctttccagcgtttgaaccttgcgcaaatgtattattcttcatctgctcctcttgtattcgcagatggttaaccagaagactggcaaaccgtagtttctgaagctgtggttgccatgctatatgggctcgtgttaatctcactggatagtgctggtgtgtttgttgcaatgtcaattcacttccggtcctgatgatgtcacctgagaatgctggtgctttcttggtattcttggtatgccacctcactttggttcctgataatctcatctgataatctatgctgttgcttttgaccccgccatggtatgtgattgcaagttgcaccactttgtgcaattcttttgtgtgatgaactgataggttactggctgaggtgccctgttacacgtcagggccgccctgttatcg

SEQ ID NO: 3812 - DNA, 820 bp, Echinochloa colona
gatggcccgctacgaccgcgcgatcaccgtcttctcccccgacggccacctattccaggtcgagtacgccctcgaggccgtccgcaagggcaacgccgccgtcggcgtccgcggcaccgacaccgtcgtcctcggcgtcgagaagaagtccacccccaagctccaggactccaggtccgtgcgcaagatcgcgagcctggacacccacatcgcgctggcgtgcgcggggctcaaggccgacgcgcgcgtgctcatcaaccgcgcccgcgtcgagtgccagagccaccgcctcaccgtcgaggaccccgtcaccgtcgagtacatcacgcgctacatcgccggcctgcagcagaagtacacgcagagcggaggggtccgccccttcggcctctccacgctcatcgtcggattcgacccctacacccagaagccggccctgtaccagaccgacccctcggggaccttctccgcctggaaggccaacgccaccggccgcaactccaactccatgcgcgagttcctcgagaagaattacaaggagacgtccggcaaggagaccatcaagctcgccatcaaagcactccttgaggttgttgagagtggcggcaagaacattgagattgcagtgatgacacacaaggacggccttcgcgagctcgaggaggcagaaatcgatgaatatgtcgctgagatcgaggcagagaaggccgccgccgaggctgcaaagaagggcgcacagaaggaaacatgattcagcacggcaactccagatgactcttgttccacagcatgtcttgtgattcacatcttttagacggtt

SEQ ID NO: 3813 - DNA, 1019 bp, Brassica juncea
cctaagtcggaatcgacattgaagaaaagggaagagagaggtgtattgaatcagaaagaacaaaaggagagatggctagatacgatcgagcaatcactgtgttctcaccagatggtcacctttttcaagtagagtacgccctagaagctgtccggaaaggtaacgccgccgtcggagtccgcggtaccgatactgtcgtcctcgccgtcgagaagaaatccacccctaagctccaggatacaagatcagccagaaagattgtgagtcttgataaccacattgccttggcctgtgctgggctgaaggcagatgctcgtgtcctgattaacaaggccaggatcgagtgtcaaagccacaggcttacgttggaggatccagtgactgttgagtacatcacccgctacatagcagggcttcagcagaagtatactcagagcggtggtgtgagaccttttggtctttccactcttattgttggttttgacccctacactcgtatacctgcgctctatcagactgatccatctggtacgttctctgcttggaaggctaatgcaaccgggagaaactcaaactcaatcagggagtttctggagaagaattataaagaaacatcgggacaagagactgttaaacttgcaatccgtgctctgcttgaggtagttgagagtggtggaaagaacattgaagttgctttaatgacaagggaggaaggtactttgaagcagctagaagaagctgaaatcgatgctattgtggctgagattgaagcagagaaggcggctgcagaagcagccaagaaaggcccttcaagggaaacatgagccaagatcttaccgcaacagtctcggtttctaaattgtgatgttggtttaaagtaagataatttgagttgttggatcaatagcatgtttgaaagtcttcattttaaatcttaattgacatttttagctgtttgtttgcctggctgttttatgcatgaatgttttcacgagtatttttagctgtttgtttgcctg

SEQ ID NO: 3814 - DNA, 1134 bp, Ocimum basilicum
gcccaagtccgctcaattccctcttaatacttccccaaattactcgtcactttttcagtaaatcacccaaattattacttcaaacaagaagaattcgacagatcggaagatcataccagaattctcttacattacgaacaagattgagatatggcgcgatatgaccgagctatcaccgttttctcgccggacggccaccttttccaggtcgagtatgctctcgaagctgtgcgcaagggtaacgccgccgttggtgttcgcggcactgatactatcgtgctcgcagtggagaagaagtccactcccaagctgcaggattcaaggtcagtgagaaagattgtcaacttggacgatcacatagcattggcatgtgctggcctgaaggcagatgctcgtgttttgataaacaaggcacgcatagaatgccagagtcataagcttacagttgaggatcctgtaactgttgaatacataactcgttatattgctggtcttcaacaaaagtacacacaaagtggtggtgtgagacctttcggcctttcaactttgattattgggttcgatccacacacaggcactccatcgctttatcaaacagacccatcaggaactttttcagcatggaaagccaatgctacagggagaaactccaactctatcagagagtttcttgagaagaattacaaggaaacatctggtcaagaaactgtgaagttagccattcgtgctctgctggaggttgtggaaagtggaggaaagaacattgaagttgctgtaatgacgagggagcatgggctgcggcaactggaagaaggtgaaatcgacgccattgttgttgatatagaagcagagaaagctgctgcagaagctgccaagaaggcccctgcaaccaaggagacttgaattatccctcttcttgtttagatactttgcttacattattacttttgtgacttgtactacagactatgcctgcttattcacatgattcctgtcgaggatttctttttcctttacatcatcactctctctccctcgctttacaattagtacaattttggggagcttcttattaagtttttacgagtttgtaggtgatgatcggctctttcagtttatacattttatatttgt

SEQ ID NO: 3815 - DNA, 903 bp, Festuca arundinacea
gccgaaatctccctcgccggcgtcgacacgtaccaggaccagccatggcccgctacgaccgcgcgatcaccgtcttctcccccgacggccacctcttccaggtggagtacgccctcgaggccgtccgcaagggcaacgccgccgtcggcgtccgcggcgtcgacaccgtcgtcctcggcgtcgagaagaagtccacacctaagctccaggactccaggtccgtgcgcaagatcgcgaacctggacacccacatcgcgctggcctgcgcggggctcaaggcggacgcgcgcgtgctcatcaaccgggcgcgcgtcgagtgccagagccaccgcctcaccgtcgaggaccccgtcaccgtcgagtacatcacgcgctacatcgccgggctgcagcagaagtacacgcagagcggaggggtgcggcccttcggcctctccacgctcatcgtcggcttcgatccgtacacagagaagccagcactgtaccagaccgacccctccggcaccttctccgcctggaaggccaacgccaccggccggaactccaactccatgcgcgagttccttgagaagaattacaaggagacgtccggaaaggagaccatcaagcttaccatccgagccctgcttgaggttgtcgagagtggtggcaagaacatagagattgcagtgatgacacacaaggatggcctccgcaacctcgaagaggctgagatcgatgagtacgtcgctgagatcgaagctgagaaggccgccgccgaggctgcaaagaagggtggcccgaaagacacctaatgtaatcatgattcagcacggtcgcagcacattgctcctctagcctggttttatgttccatagccagcttgttgttttacttgtttcagaggaatgaagttgttggtta

SEQ ID NO: 3816 - DNA, 1170 bp, Setaria italica
ccacgaccaggcgaccagctcgtttcttcttctctcccaagaaaagcgaaggcaacaagacttcacaagtcacagacgcgcacccgaactccctcccggaagcccctcgccggacgctctctctctctctctctctctctcgccgccggcggcaactaaatcaggcgctcaggatggcccgctacgaccgcgcgatcaccgtcttctcccccgacggccacctcttccaggtcgagtacgccctcgaggccgtccgcaagggcaacgccgcggtcggcgtccgcggcgtcgacaccgtcgtcctcggcgtcgagaagaagtcgacccccaagctccaggactccaggtccgtgcgcaagatcgcgagcctcgacacccacatcgcgctggcgtgcgcggggctcaaggccgacgcgcgcgtgctcatcaaccgcgcccgcgtcgagtgccagagccaccgcctcaccgtcgaggaccccgtcaccgtcgagtacatcacgcgatacatcgccggcctgcagcagaagtacacgcagagcggaggggtccgacccttcggcctctccaccctcatcgtcggcttcgacccctacacccagaagcccgccctgtaccagaccgacccctcggggaccttctccgcatggaaggccaacgccaccggccgcaactccaactccatgcgcgagttcctcgagaagaattacaaggagacgtcaggcaaggagaccatcaagctcgccatcagagcactccttgaggttgttgagagtggtggcaagaacatcgaggttgcagtgatgacacacaaggatggccttcgtgagcttgaagaggcagagattgatgaatatgtcgctgagattgaggcagagaaggccgccgccgaggctgcaaagaagggcgcgccgaaggaaacatgatttgggacagcaactctagataaactcttgttccacagcatgtcttatgatccacatcttttagacggatgcatgtttgtttcggtaaagtgtttttttatttctgatgaagctgcttggatggaaattctcgtgctagtgactttgtgattgttgtcccggtgacctgttggtctgtcgggtatatttctgagttctgacaatggttacataaagacgatgaaccgtagagtcgtgttgcactgaa

SEQ ID NO: 3817 - DNA, 1128 bp, Setaria italica
aaaagcgaaggcaacaagacttcacaagtcacagacgcgcacccgaactccctcccggaagcccctcgccggacgctctctctctctctctctctctctcgccgccggcggcaactaaatcaggcgctcaggatggcccgctacgaccgcgcgatcaccgtcttctcccccgacggccacctcttccaggtcgagtacgccctcgaggccgtccgcaagggcaacgccgcggtcggcgtccgcggcgtcgacaccgtcgtcctcggcgtcgagaagaagtcgacccccaagctccaggactccaggtccgtgcgcaagatcgcgagcctcgacacccacatcgcgctggcgtgcgcggggctcaaggccgacgcgcgcgtgctcatcaaccgcgcccgcgtcgagtgccagagccaccgcctcaccgtcgaggaccccgtcaccgtcgagtacatcacgcgatacatcgccggcctgcagcaaaagtacacgcagagcggaggggtccgacccttcggcctctccaccctcatcgtcggcttcgacccctacacccagaagcccgccctgtaccagaccgacccctcggggaccttctccgcatggaaggccaacgccaccggccgcaactccaactccatgcgcgagttcctcgaaaagaattacaaggagacgtcaggcaaggagaccatcaagctcgccatcagagcactccttgaggttgttgagagtggtggcaagaacatcgaggttgcagtgatgacacacaaggatggccttcgtgagcttgaagaggcagagattgatgaatatgtcgctgagattgaggcagagaaggccgccgccgaggctgcaaagaagggcgcgccgaaggaaacatgatttgggacagcaactctagataaactcttgttccacagcatgtcttatgatccacatcttttagacggatgcatgtttgtttcggtaaagtgtttttttatttctgatgaagctgcttggatggaaattctcgtgctagtgactttgtgattgttgtcccggtgacctgttggtctgtcgggtatatttctgagttctgacaatggttacataaagacgatgaaccgtagagtcgtgttgcactga

SEQ ID NO: 3818 - DNA, 1062 bp, Zea mays
caccaacgcacccagcacagacagaagaccctcgccggacgctcgctctcgccggggacaactcaatcacgaggccaggatggcccgctacgatcgcgcgatcaccgtgttctcacccgacggccacctcttccaggtcgagtacgccctcgaggccgtccgcaagggcaacgccgctgtcggcgtccgcggcgtcgacaccgtcgtcctcggcgtcgagaagaagtccacccccaagctccaggactccaggtccgtgcgcaagatcgcgagcctggacacccacatcgcgctggcgtgcgcggggctcaaggccgacgcgcgcgtgctcatcaaccgcgctcgcgtggagtgccagagccaccgcctcacagtcgaggaccccgtcaccgtcgagtacatcacgcgctacatcgccggcctgcagcagaagtacacgcagagcggaggggtgcgccccttcggcctctccacgctcatcgtcggcttcgatccctacacccagaagcccgcgctgtaccagactgacccctcggggaccttctccgcttggaaggccaacgcaaccggccgcaactccaactccatgcgcgagtttctcgagaagaattacaaggagacgtccggtaaggagaccatcaagctcgccatcagagcactccttgaggttgttgagagtggtggcaagaacatagagattgcagtgatgacacacgaggacggccttcatgaactcgaagaggctgagattgatgagtatgttgccgaaattgaagcagagaaagccgctgccgaggctgcaaagaagggtgcaccaaaggggaactgattccgcacaagcttagattgcgcctcttgttccagagcatgtcttatgattcacctcttagatggatgcccggatgtttggatacaggaatatttataaaaaaaattaagatgaagccgcttggatgaaaacatgctatgtgatgcatagtattgcaataccatggtggtttgtggcttgtgtgacttgtcgcagtggtctcttgatctgtcagtattattttctggaacctg

SEQ ID NO: 3819 - DNA, 1089 bp, Zea mays
gggtgccagacaaattcagcaaacaagcaaaaggcacgaccaccaccgccggccgggaagcaagctcaaaccctaatcgccgtccgccggcgacgccagcacgatggcccgctacgaccgcgccatcaccgttttctcccccgacggccacctcttccaggtggagtacgctctcgaggccgtccgcaagggcaacgccgccgtgggcgtccgcggcacggacaccgtcgtcctcggcgtcgagaagaagtccacacccaagctccaggactccaggtccgtgcgcaagatcgcgtgcctagacactcacatagctctggcgtgcgcggggctgaaggcggacgcgcgcgtgctcatcaaccgcgcgcgggtcgagtgccagagccaccgactcaccgtcgaggaccccgtcaccgtcgagtacatcacccgctacatcgctgggctgcagcagaagtatacgcagagtggtggagtccgccccttcggcctttccaccctcattgtcggcttcgacccctacaccgacaagccagcgctgtaccagaccgatccatccggtaccttctctgcttggaaggccaatgccacgggaaggaactccaactctatgcgtgagttcctggagaagaactacaaggagacctccggcaaggagaccatcaaacttgctatccgtgcacttctagaggttgttgaaagtggtgggaagaacatcgaggttgcagtgatgacaaagaaggacggtctccgggaactcgaggagtctgagattgatgagtacgttgccgagatcgaggcagagaaggctgcagctgaggctgcaaagaagggtgccccgaagaacgcctaatttcccgtcttgtgctatggctcccttcaacactgtgtgtgtcccgtttttatgttccatagcaccatcttaactgttctagaaggatgctagatctttaggtgaaactacgcttatatgcctgtgggttaaatggtgtacaatgagctcgtctacatgccttcgtcggaggttttcagtttcgtgtattctgtcatctggacagcgacagttcaaatattgattttacctgattc

SEQ ID NO: 3820 - DNA, 1052 bp, Pennisetum glaucum
ggccgggaagcagctcaaaccctaaccgccggcgacgccagcacgatggcccgctacgaccgcgcgatcaccgtcttctctcccgacggccacctcttccaggtcgagtacgccctcgaggccgtccgcaagggcaacgccgccgtcggcgtccgcggcatcgacatcgtcgtcctcggcgtcgagaagaagtccacccccaagctccaggactccaggtccctgcgcaagatcgccagcctcgacacccacatcgcgctggcgtgcgcggggctcaaggccgacgcgcgcgtgctcatcaaccgcgcccgcgtcgagtgccagagccaccgcctcaccgtcgaggaccccgtcactgtcgagtacatcacgcgctacatcgccggcctgcagcagaagtacacgcagagcggaggggtccgccccttcggtctctccaccctcatcgtcggcttcgacccctacacccagaagcccgccctgtaccagaccgacccctcggggaccttctccgcgtggaaggccaacgccaccggccgcaactccaactccatgcgcgagttcctcgagaagaattacaaggagacgtcaggcaaggagaccatcaagctcgccatcagagcactcctcgaggttgttgagagtggtggcaagaacatcgaggttgcagtgatgacgcacaaggatggccttcgtgagcttgaggaggcagagatcgacgagtacgtcgctgagatcgaggcagagaaggccgcagctgaggctgcaaagaagggtgcgccgaaggaaacatgattccagcatagcaactttagataactctctgttccacagcctgtcttatgattcacatcatttcgacagatgcctctggttgtttggggtaaagagattttttttctgatgctgaagctgcctggatgaaactatgtggattgttgtagcagtgccctgttgttaggtctgccggtatatttctgagttgtgacaaaatggtttaccttaagacggtggtgcactgagcttgtttgagactgctatgctgttgagag

SEQ ID NO: 3821 - DNA, 1199 bp, Orobanche aegyptiaca
tttgaaagtcgtcttgtcgtgtcgtccaagtccctcttttatacttccccagttttcctccgtctcctataaattcattcatagtctcacaccggaaaaatccagtgacggatcgaagagcgaatactcaaatttctctcactttatacacaaaaggagtgagatatggcccgatacgacagagcaattactgttttctcgccggatggtcaccttttccaggtggagtacgccctcgaagccgtccggaaggggaacgccgccgtcggtgttcgcggtaccgatactattgtgctggccgtcgagaaaaagtccaccccgaagctgcaggattcgagatcagtgagaaagattgtcaatttagatgatcacatagccttggcttgtgctgggctgaaagccgatgcccgtgttctaataaacaaggcacgtatcgaatgccagagtcataagctcactatcgaagatcctgtgactgtagaatacataacacgctacattgctggtcttcagcagaagtacacacaaagtggtggtgtgagaccttttggcctctcgactttgatcattgggtttgacccgcacacaggtattccatcactttatcaaacagacccatcagggacattttcggcatggaaagctaatgctaccgggagaaactctaattctataagagagtttctggagaagaattacacggatacatctggtcaagaaaccttgaagttagcaattcgtgctctgctggaggttgtggagagtggaggaaagaacattgaagttgctgtaatgactaaagagcacggattgaagcagcttgaagaagctgaaatcgatgcgattgttgctgagatagaagctgaaaaggctgctgctgaagctgctaagaagggcccctcggcaaaggaaacttaataatgttaaatttaccataatactttttctgaattgaaatgcggattgtggtcttatgttgtttatggcaaattgatttctgctaagggttgtattatgttatgattcatgacttgattgacaaaccaaaaatgtttcatgcttcatttttgcagtgtttattaaaaacctgtatgttagatcttctatgtgcaacatcttaaaaaatgtttgattaggaatggagagtgagactttgctcactttgagcttttactttttatcgaccacctatctttttg

SEQ ID NO: 3822 - DNA, 1200 bp, Phalaenopsis aphrodite
gcagcctccaaattccagggtgagacattgaaagagggataacaaaaccgcggccagcaaagtgctctctaggaggagatcagaagaaacaagcttaataccaatcggtgttagtccccagacgacgtcatggcccgctacgaccgcgcgatcactgtcttctcaccagatggccatctcttccaggtggagtacgctctcgaggccgtccgcaagggaaacgccgccgtcggcgtccgtggtattgataccatcgtccttggagtcgagaagaaggctactccaaagttacaggactccagaactatgaagaagatcgcgagcctcgacagccacattgccctagcatgtgcgggtctcaaagccgacgcgcgtgtcctcatcaatcgcgccaggatcgaatgccagagccaccgtcttacacttgaggatccggtcaccgtcgagtacatcactcgatacatcgccggcctgcagcagaagtacactcagagcggcggtgttaggccttttggcctctccacgctcatcgtcggcttcgatccctacaccggggcgccgtcgctttaccagacagatccctctggaactttctcggcttggaaagcgaacgccaccgggaggaactcaaattccatgagagagtttctcgagaaaaactacaaggagacttcgggccaggagacagtcaaactggctatccgggcgctgctcgaggttgtcgagagtgggggtaagaacatagagatcgctgtgatgacaaaagaggatggtcttcgccaactcgaggagtcggagatcgacgccattgttgctgagattgaatcagagaaagctgcagctgaggctgcaaagaagggaccttcaaaggaaacccaaccctaatttcactcttcttcactgtaagtcttaaattgtttgtttgcctttaagtgaaagtatttattcccagtgagaatcgaagccatcgaacattgatagaatgtttatcattgccttccatatgttaccgaaaaaaacaataacttacagatactgtattaaatcaactttgttttatctgtaaaactgcattaaaatatttacgtcttgtttcttatggtgctgctttttttgacttcatgattttatgtacttatttattttttcagttattgatctaaacgtgtatgctacacatgatgcagtgcctcattgacg

SEQ ID NO: 3823 - DNA, 1005 bp, Lippia dulcis
acagatcgaagctgaaactagtcaatttttgtaaaatttacgtaatttagagtgagatatggcccgatacgacagagcaattacggttttctcgccggacggccatctttttcaggtggagtacgctctcgaagccgtgcgtaagggaaacgccgccgtcggtgttcgtggtacagataatatcgtactcgccgtcgagaaaaagtcagctccgaagctgcaagattcgagatcagtgaggaagattgtcaatttagatgatcatatagcattggcatgtgctggcctgaaggcagatgcccgtgtcttgataaatagggcacgcatcgaatgccagagtcacaagctcacaattgaggatcctgtaactgttgaatatataacccgttacattgctggccttcagcaaaagtacacacaaagtggtggtgtcagaccttttggcctttcaaccttgatcattgggtttgatccacacacgggtattccatcactttatcagacagatccgtctgggacattttcagcatggaaagccaatgctactgggagaaactcgaactctataagggagtttttggagaagaactacaaggaagtatctggacaagagaccgtgaagttggctattcgtgctttgcttgaggttgttgagagtggaggaaaaaacatcgaagttgctgtaatgacaaaagaacacggactccatcaacttgaagaagctgaaattgatgctatagttgctgagatagaagcagaaaaagctgctgcagaagctgccaagaagggccctgcgacgaaggaaacttaggtctgccattctatttaaatgctttattactttcgtgaacttgtgttacggattatcaacttccgtggttgccgattttctcatgttactatccacaactcttttagatggttgttttcatcgtatgctttcttacaactttcaacttttcggtaacatattgatgtgaaattctagctaatcatgtttgaatc

SEQ ID NO: 3824 - DNA, 1038 bp, Raphanus sativus
gatattgaactaaaagggaagagaagagaagagaggtcttattgaatcagaaataacactcacaagggagagagttgggagttgagagatggcgagatacgatagagcaatcactgttttctcaccagacggccaccttttccaggtagagtacgccctagaagctgtccgcaaaggtaacgccgccgtcggcgtccgaggcaccgatactgtcgtcctcgccgtcgagaagaaatccacccctaagctccaggatacgagatcggccagaaagattgttagccttgataaccacgtcgcattggcctgtgctgggctgaaggcagatgctcgtgtcctgataaacaaggcgaggatcgagtgtcaaagccacaggcttactttggaggatccagtgactgttgagtacatcactcgctacatagcagggcttcaacagaagtatactcaaagtggtggtgtgagaccttttggtctttccactcttattgttggttttgacccctacactcgtataccttcgctttatcagaccgatccgtctggtaccttctctgcttggaaggctaatgcgaccgggagaaactctaactcgatcagggagtttctggagaagaattataaagaaacctcggggcaagagactgttaaacttgcaatccgtgctctgcttgaggtagttgagagtggtggaaagaacattgaggttgctttaatgacaagggaggaaggtactctgaagcagctagaagaagctgaaatcgatgcgattgtggctgagattgaagctgagaaggcggctgcagaagcagccaagaaaggcccttctagggaaacatgagccatttcttacggcattggtcttggtttctgaattgtgtgatgttggttcgaagaaaagatatttgagggttgaatagacaaaactctggactgcgtttagttcatgttgtgttggattattagcctgtttgacattcttcattttaaatcatatatttggctattttatgcatgaatacttcacgtgttgtctta

SEQ ID NO: 3825 - DNA, 1213 bp, Oryza sativa
tgcaagaaagaaaaggcggagcaggagcagcaacgagaaaaggcggaggcggcggcgcaaccgacaaggaaaagcaaagcgagagcaggaaaacctcgccggcggcgacaccaccaccaccagcaggcagggatggcccggtacgaccgcgcgatcaccgtcttctcccccgacggccacctcttccaggtggagtacgccctcgaggccgtccgcaagggcaacgccgccgtcggcgtccgcggcaccgacaccgtcgtcctcggcgtcgagaagaaatccacccccaagctccaggactccaggtccatgcgcaagatcgccagcctcgacacccacatcgcgcttgcctgcgcggggctcaaggcggacgcccgcgtgctcatcaaccgggcgcgcgtcgagtgccagagccaccgcctcaccgtcgaggaccccgtcaccgtcgagtacatcacgcgctacatcgccggactgcagcagaagtacacccagagcggcggggtgcgccccttcggcctctccaccctcatcgtcggcttcgacccctacaccgagaagcccgccctctaccagaccgacccatccggcaccttctccgcctggaaggccaacgccaccggccgcaactccaactccatgcgcgagttcctcgagaagaattacaaggacacctccggcaaggagaccatcaagcttgccatccgagccctccttgaggttgtcgagagcggtggcaagaacatcgagattgcggtgatgacacacaaggatggcctccgcgagctggaggaggctgagatcgacgagtacgtggctgagattgaagcagagaaggctgccgccgaggccgcgaagaagggcgccccgaaagaaacctgacctgatcatcatgattcagcaaagcataatctctcttagcatgtgttgtttcttttctgttcttgtttgagaggaacgcagaactgtttggttcaactgaagtggatatggctatttgctgatcagcctacctggagtaaatcctcatgctatatgctttgtgatgttgcacaacactgctgcgatgctcatcgtgtcagttgccactcagtgggtctccttttatgtatgaatatatctgttgcctgttggttgtagacagtaacgaagaatagtactatgagctagtgcgggccgctgctctccgtcgcggggatctgggccaacttct

SEQ ID NO: 3826 - DNA, 1098 bp, Secale cereale
ctcagtgaccgtgccggactgacgcaccggaactcccaaagcgaaagcctctctcaccggcgacgacacgcaccggaactcccaaagcgaaagcctctctcaccggcgacgacacgcaccagcaccgatggcccgctacgaccgagcgatcaccgtcttctcccccgacggccacctcttccaggttgagtacgccctcgaggccgtccgcaagggcaacgccgccgtcggcgtccgaggcgtcgacactgtcgtcctcggtgtcgagaagaagtccacccccaagctccaggactccaggtccgtgcgcaagatcgcgagcctagacacccacatcgcgctggcctgcgcgggtctgaaggcggacgcgcgcgtgctcatcaaccgggcgcgcgtcgagtgtcagagccaccgcctcaccgtcgaggaccccgtcactgtcgagtacatcacgcgctacatcgccggcctgcagcagaagtacacgcagagcggaggggtgcgcccgttcgggctctccacgctcatagttggcttcgacccctatactgagaagcccgcgctgtaccagaccgacccctccggcaccttctccgcctggaaggccaacgccaccggccgcaactccaactccatgcgcgagttccttgagaagaattacaaggagacgtccggcaaggagaccatcaagcttaccatccgagccctccttgaggttgtcgagagtggtggcaagaacattgagattgctgtgatgacgcacaaagatggtcttcgccagcttgaggaagaggagatcgatgaatatgttgctgagatcgaagcagagaaggctgctgctgaggctgcgaagaagggtggccgaaaagacacataatgtactaatgatttagcacagtcgcggcacatggctcctctagctctgtttatgttcacagcttgtctgcttgttttaactgtttccgaagaacttgtttggccgagggtggtttatttgttgctttcttttaggggtggtttatttgttgccgacggaggtgcttggactaatgcgcttgttctcgtcatgtttcgcgaactgtaagcttagctactaac

SEQ ID NO: 3827 - DNA, 1183 bp, Saccharum officinarum
gcgaaggaactcgccgccaccgacctggccgcaacaaggcaacgcaagcctccctgaactgacttcataaagtcacagacgcacccaattcgactcccagcacagacagaaaagcccttcgccggacgctcgctctcgccggcggcgactaaatcaggaggccagtatggcccgctacgaccgcgcaatcaccgtgttctcccccgacggccacctcttccaggtcgagtacgccctggaggccgtccgcaagggcaacgccgccgtcggcgtccgcggcgtcgacaccgtcgtcctcggcgtcgagaagaagtccacccccaagctccaggactcgaggtccgtgcgcaagatcgcgagcctggacacccacatcgcgctggcgtgcgcggggctcaaggccgacgcgcgcgtgctcatcaaccgcgcccgcgtcgagtgccagagccaccgcctcaccgtcgaggaccccgtcaccgtcgagtacatcacgcgctacatcgccggcctgcagcagaagtacacgcagagcggaggggtgcgccccttcggcctctccacgctcatcgtcggcttcgacccctacacccagaagcccgcgctgtaccagactgacccctcggggaccttctccgcttggaaggccaacgccaccggccgcaactccaactccatgcgcgagtttctcgagaagaattacaaggagacgtccggcaaggagaccatcaagctcgccatcaaagcactcctcgaggttgttgagagtggcggcaagaacatagagattgcagtgatgacacacaaggatggccttcgcgaactcgaagaggctgagatcgacgagtatgttgccgagattgaagcagagaaggccgctgccgaggctgcaaagaagggcgcgccaaaggagaactgattcagcacaagtttagatcgtgcctcttgttccacagcatgtcttatgattcacttcttttagacggatgctcggctgtttggatacagggatatttataaagtttcagatgaagccgcttggatgaaactcatgctatgtgatgcatagtagtagtgcatctaccatggtggtgcgtttgtggcttgtgtgactgttgtcgcagtggtctgttggtctgtcagtattatttcctgaaacctgacaatggtagtcagttaagagact

SEQ ID NO: 3828 - DNA, 1160 bp, Saccharum officinarum
cgaccaccaccgccggccgggaagcaagctcgaaccctaatcgccggcgacgccagcacgatggcccgctacgaccgcgcgatcaccgtcttctcccccgacggccacctcttccaggtcgagtacgccctcgaggccgtccgcaaggggaacgccgccgtcggcgtccgcggcacggacaccgtcgtcctcggcgtcgagaagaagtccacccccaagctccaggactccaggtccgtgcgcaagatcgcgtgcctggacacccacatcgcgctggcgtgcgcggggctgaaggcggacgcgcgcgtgctcatcaatcgcgcgcgggtcgagtgccagagccaccggctcaccgtcgaggaccccgtcaccgtcgagtacatcacccgctacatcgctgggctgcagcagaagtatacacagagtggtggagtccgccccttcggcctctccaccctcattgtcggcttcgacccctacaccgacaagccagccctgtaccagaccgatccatccggtaccttctctgcttggaaggccaacgccacgggaaggaactccaactctatgcgtgagttcctggagaagaactacaaggagacctccggcaaggagaccatcaagcttgctatccgtgcacttctagaggttgttgaaagtggtgggaagaacatcgaggttgcagtgatgacaaagaaggatggtctccaggaactcgaggaggctttgattgatgaatatgttgccgagattgaggcagagaaggctgcagccgaggctgcaaagaagggtgccccgaaggacacctaattcctgtcttgtgctatgcctcccttcaacactttgtgtgcctcgtttttatgttccatagcaccatctcaactattttagaaggatgctagatctttaagtgaaactatgcttatatgcctgtgaggctcaaatgtaatgtgctcatcaacatgccttctttggacgttttcaatttcgtctactgattcatctggacagtaacagttcaaactttctttacctgattccttgtcatgactcattacttctctgggccagtgggatgtggattctaagttttgcggcccgagaatgttcttttagtttgttgaggttgaaagaaggaacagggtggtctgttttgcgtc

SEQ ID NO: 3829 - DNA, 1253 bp, Panicum virgatum
gttaaacccgtcaaaataaacaaaggttaaatccagctctataaattttgccatcaaatcaaaatttacccaaacgacacgagcagcttgccttgtttcttcttctctcccaagaaaagaaaagccaagggccccctctccctcaactagacttaagacttcgcagaggggagccgcgccgcgcagaccaaactccctcccaaaagcccctcgccggacgctcgctctcgccggccgcgactgaatcaggcgcccaggatggcccgctacgaccgcgcgatcaccgtcttctcccccgacggccacctcttccaggtcgagtacgccctcgaggccgtccgcaagggcaacgccgccgtcggcgtccgcggcgtcgacaccgtcgtcctcggcgtcgagaagaagtccacccccaagctgcaggactccaggtccgtgcgcaagatcgcgagcctggacacccacatcgcgctggcctgcgcggggctcaaggccgacgcgcgcgtcctcatcaaccgcgcccgcatcgagtgccagagccaccgcctcaccgtcgaggaccccgtcaccgtcgagtacatcacgcgcttcatcgccggcctgcagcagaagtacacgcagagcggaggggtccgccccttcggcctctccaccctcatcgtcgggttcgacccctacaccaacaagcccgccctgtaccagaccgacccgtcggggaccttctccgcctggaaggccaacgccaccggccgcaactccaactccatgcgcgagttcctcgagaagaactacaaggagacgtcaggcaaggagaccatcaagctcgccatcagagcactccttgaggttgttgagagtggtggcaagaacattgaggttgcagtgatgacacacaaggatggccttcgcgaacttgaagaggcagagattgatgaatatgttgctgagatcgaggcagagaaggccgccgctgaagctgcaaagaagggcgcgccgaaggaaacatgatccagcacagcaactctagacaactcttgttccacagcgtgccttaggattcacatcttttagacggaggcctggttgtttgggtgaagggatttttatttctgttgaagttgcttcggtgaaactcctcatgctatattgctacgcggatgcacactgttgcatccgccatgctggtgaactagtaattgttgtcgcagtgttggtcttacagtatatctgagttctgatacatggttgcctaa

SEQ ID NO: 3830 - DNA, 1017 bp, Eutrema halophilum
ttttttggcttgtcgcttaagttggattcgtctctttattatttcttctccctgggaaaaggaaagcaaaagtatcatcggacaaaagagaacggcgtgagagatggccattacggccgggcaattaccgttttctcccccgacggccacctcttccaagtagagtacgccctagaagccgtccgcaagggtaacgccgccgtcggagtccgcggcaccgacaccgtcgtcctcgccgtcgagaagaaatctactcctaagcttcaggattctagatcagccagaaaaattgtgagccttgataatcacattgccttggcatgcgcgggtctcaaggcagatgcacgtgtgctgatcaacaaggcaaggattgagtgtcaaagccacaggcttacactagaggacccagtgactgttgagtacatcacgcggtacatagcggggcttcaacagaagtacacccaaagtggtggtgtcagaccctttggtctttctactcttatcgtcggctttgacccttactctcatgtgccatccctctatcagactgatccttctggcactttctctgcttggaaagctaatgctaccggcagaaactccaactcgattagggaattcctggaaaagaactacaaagaatcctccggccaagaaactgttaaactcgctatccgtgctctgctcgaggtagtcgagagcggaggaaagaacattgaggttgctgtaatgactcgggaggaaagtgggctgcgccagctagaagaggctgaaattgatgctattgtggccgagatcgaagcggagaaggcagccgcagaagcagccaagaaaggccctccaaaggaaacttgataatacaatacctcaatttaacaactcttggactcctttctctgttatctacttttctatgttttgttacaagacctgctacacaacattctggcatttgattagatataatatacttggatcattttgtgtgcgttgtctgttagttggtttgtgctccat

SEQ ID NO: 3831 - DNA, 1096 bp, Eutrema parvulum
aaagcgaattgggaatttagcttgtcgcctaagttggaatcgattttgaacaaaaggaaagaggagacacgagagagaacactcaaaagacccagaaaaaaagagagagtagagaaggagataagcgtgagagatggcgagatatgatcgagcaatcacagtgttttcccccgacggtcacctttttcaggtagagtatgctctagaagctgtccggaagggtaacgccgccgtcggagtccgcggcaccgatactgttgtcctcgccgtcgagaagaaatcaacccctaagctccaggataccagatcagccagaaagattgtgagccttgataatcacattgcgttggcctgtgctgggctcaaggcagatgctcgtgtcctgataaacaaggcgaggatagagtgtcaaagccacaggcttacgttggaggacccagtgactgttgagtacgtcacgcgatacatagcagggcttcaacagaagtatactcaaagtggtggtgtgagaccctttggtctttccactcttattgttggttttgacccgtacactcgtatcccctcgctttaccagactgatccatctggtacattctctgcttggaaggctaatgcaaccgggagaaactccaactcaatcagggagtttctggagaaaaattataaagaaacctctggtcaagaaactgtgaaacttgctattcgtgctctgcttgaggtggttgagagtgggggaaagaacattgaggttgctctaatgacacgggaggaaggtggtctgaggcagctagaagaagctgaaatcgatgctatcgtggctgagatcgaagcagagaaggctgctgcagaagcagccaagaaaggcccttcaaaggaaacatgagccaagatcttacatttgcggtctcagttcatgatttgtaatgttggttcaaagtcgtcagataattgagggttgaatagaaatctggaatgcctgaatcgctttgttggatcactagcctgtttgacgttcttgctttaaattttaattgacattgttagcagagttaccataattagctatgagaaaatagctgtttatgatactact

SEQ ID NO: 3832 - DNA, 1012 bp, Triphysaria pusilla
ctgcaaatcaattcattctgagctcggcgaaaaagaatataaaaagggcgaaatctagttacagatcgaaagcacatacactattcacttcaacattaacttaaaaaaggagtgagatatggcacgatacgacagagcaatcaccgttttctcgccggacggccacctttttcaggtggaatacgctctcgaagctgtgcgtaaggggaacgccgccgtcggtgttcgaggcaccgatacgatcgtactcgctgttgagaaaaagtccactcccaagctgcaggattctagatcagcgaggaagattgtcaatttagataatcacatagccttggcctgtgctggcctgaaagccgatgcacgtgttttaataaacagggcacgtattgaatgccaaagtcacaaactaacagttgaagatcctgtgactgtggaatacataactcgctacattgctggtcttcagcagaagtacacacaaagtggtggtgtgagaccttttggactctcaaccttgatcgttgggtttgatccgcacacgggtattccatcactttatcagactgatccgtcggggacattttcggcatggaaagctaatgctactgggagaaactcaaactcgataagagagtttctagagaagaattacacggaaacatctggccaggaaaccgtgaagttagctatccgtgctctgctggaggttgtggagagtggaggaaagaacattgaagttgccgtaatgactaaagagcatggattgcggcagctcgaggaagctgaaattgatgccattgttgctgagctagaagcggagaaagctgctgctgaagctgccaagaaggccccttcatcgagggaatcttagtatgatgtactgatttaaatgctttttcatgattatttttttctgttcgaattattgactgtggtttgtaatttgttgctgtttggattttattatgttttgacacatgacttgagaggagagtatgagtaattgaaagtt

SEQ ID NO: 3833 - DNA, 934 bp, Avena sativa
ggcgatggcccgctacgaccgcgcgatcaccgttttctccccgacggccacctcttccaggtcgagtacgccctcgaggccgtccgcaagggcaacgccgccgtcggcgtccgcggcaccgacaccgtcgtcctcggcgtcgagaagaagtccacccccaagctccaggactccaggtcgctgcggaagatcgcgagcctggacacgcacatcgcgctggcgtgcgcggggctcaaggcggacgcgcgggtgctcatcaaccgcgcccgcgtcgagtgccagagccaccgcctcaccgtcgaggaccccgtcaccgtcgagtacatcacacgctacatcgccggcctgcagcagaagtacacccagagcggcggggtccgccccttcggcctctccaccctcatcgtcggcttcgatccgtacacggacaagcccgcgctctaccagaccgacccctccggcaccttctccgcctggaaggccaacgccacggggaggaactccaactccatgcgggagttcctcgagaagaactacaaggacacatccggcaaggagaccatcaagctcacaatccgcgctcttctagaggttgttgagagtggtgggaagaacatcgagattgcagtgatgacaaagaaggatggcctccgacaacttgaggagactgagattgatgagtatgtcgctgagattgaggcagagaaggctgcggcagaggctgcaaagaagggtggccctaaggatacctaattgtaggatatgctattaccttcatcctgtgaaccaaaactttgtagtgtgccgcttgttacgttccgtaacacttctctaaactgctttaacaagacatggaagtctaaatgaattgccttattttcttggtggttcatggtcaggggcttcgttttgcctttccaggttttcaacgcag

SEQ ID NO: 3834 - DNA, 1043 bp, Fraxinus spp
cggccgggggcccaagttctctttttcttcccgtcttttattcctcactcgaccctcgcactcgcataaatcgatcaaactcttccgagagaaaaggcaagagggtgatagatcagaacaatatttacacatatatccaacaattcatttcgatctttagatacatacaaaaaggttgtagatggcgcgatatgacagagcaattacagtgttctcgccggatggccatctgtttcaggtggagtacgccctggaggccgtccgaaagggaaacgccgccgtcggtgttcgcggaaccgataccatcgtccttgccgtcgagaagaagtctacccccaagctccaagactccagatcggtgagaaagattgtcaatttagataatcacattgcattggcttgtgctggactgaaagcagatgcacgtgttctaataaatagggcacgcattgagtgccagagtcataagcttacagttgaggatcctgtgactgttgaatacataactcgctacattgctggacttcagcaaaagtacacacaaagtggtggtgtgagaccttttggtctttcaaccttgatcattggttttgacccctacacaagtgtcccatctctttaccagacagatccctctgggactttttcagcatggaaagccaatgcaactggaagaaactcaaactcgatccgggagtttctggaaaagaattacaaagaaacatctggccaggagactgtcaaactagccatgcgggcttacttgaagttgttgagagtggtggaaagaacctagaagttgctgtaatgaccaaagatcatggactgcaccagcttgaagaagctgaaattgatgccattgttgctgaaattgaggcagagaaagcggctgcagaggctgccaagaaggcccctcccaaggaaacttaggaatatggctcagggtttgctcaacgtgtcttctttcgtgatctttaattcagactgtaatctgttgtttttgacaattgatagctgttaccttcttccctctattatacctt

SEQ ID NO: 3835 - DNA, 1010 bp, Chenopodium quinoa
cagttaaacaacaaacacaacaataggcgagatacgacagagccattacagtcttctcacctgacggtcatctctttcaggtcgaatacgctcttgaagccgtccgtaagggtaacgctgccgtcggtgttcgtggtaccgatactgttgttcttggggttgagaagaaatctgctgctaaacttcaggattccaggtcggtcagaaaaattgtaaacctcgacgatcatattgctttagcttgtgctggtcttaaagcagatgctcgtgttctaataaacagggcacgtattgagtgtcaaagccacaagctgaccttggaagatccagtaacagttgagtatataactcgttacattgctggacttcagcagaagtatacccaaagtggtggtgttagaccatttgggctgtccaccttgattgtgggattcgacctgcacactaatgtaccagcactgtaccagacagatccatctggtaccttttcagcttggaaggctaatgcaactggaagaaactctaactcaataagagaatttctagagaaaaattataaagaaacttctgggcaagaaactgtcaagctggctattcgtgcactgcttgaagttagttgaaagtggaggaaagaacttggaagttgctgtgatgcgaaaaaaggtttgcatcagcttgaggaatctgagattgatgccatagttgcagagattgaagaagaaaaggcagcagctgaggccgcaaagaagggtccttctagttcttaacttgcagacttgtgaattaggctgttcctttcgagttttaatctattcctatttctgcttcttgtttagctctaaacttctaaagtgttgacgagtcagacttggatttcatgtatgtgctgctagcttggtttattagccccgtgatatcatctgaaaagccatcaatcagtggtagatttgttgaatcttttggtattttgcttcattatgccttagtaaaagtaccttgttgactctggc

SEQ ID NO: 3836 - DNA, 971 bp, Triphysaria pusilla
caaatttatatattgaaagagaaaattagatcggaattcattttacactatactcgaacaaaaggaggagaagggtaagctaagatggcccgatacgacagagcaattactgttttctcgccggatggtcatcttttccaggtggagtacgctcttgaagccgttcgcaggggaacgccgccgtcggcgttcgtggcaccgacatcatcgtgctcgcggtggagaagaagtctgctcctaaacttcaggactcaagatctgtaagaaaaattgtcaacttagatgatcacattgcactggcctgcgctggtctcaaagccgatgctcgtgtcttaataaaccgggctcgtatcgaatgccaaagccacaagctgactatcgaggaccccgtgactgttgaatatataactcgatatattgccggtcttcagcagaagtacacacagagtggtggtgtgagaccttttgggctgtcgaccttgattattgggttcgaccctcacacaggcactccatcactttatcagacggatccatcgggcacgttctcggcctggaaagcgaacgctactgggaggaactctaactctatcagggagtttcttgagaagaattacaaggaaacacacggccaagagactgtcaagttggctatccgggctttgcttgaggttgtggagagtggaggaaagaacattgaagttgcagtgatgactaaagaacatgggctccgtcaacttgaagaagctgaaatcgatgccattgctgctgagattgaagctgagaaagctgctgcagaggctgccaagaagggtccttcaactaccgacgcctagttttattttgttatctaaacactcggtatgattatctaatgacttatatccccacagatatttggtcttttattgcttgtggcttatcaggattttatgtatggttgatgagataaattctaaggggagtttgca

SEQ ID NO: 3837 - DNA, 1078 bp, Echinochloa colona
aacgccactgaggccctgaacaagacacaccaaactaacaagggcacgaccaccgccgtcggccgggaagcgagctcaaacaaaccctaaccgccggcgacgccaccacgatggcccgctacgaccgcgcgatcaccgtcttctcccccgacggccacctcttccaggtcgagtacgccctcgaggccgtccgcaagggcaacgccgccgtcggcgtccgcggcgtcgacaccgtcgtcctcggcgtcgagaagaagtccacccccaagctccaggactccaggtccgtgcgcaagatcgcgagcctggacacccacatcgcgctggcgtgcgcggggctcaaggccgacgcgcgcgtgctcatcaaccgcgcccgcgtcgagtgccagagccaccgcctcaccgtcgaggaccccgtcaccgtcgagtacatcacgcgctacatcgccggcctgcagcagaagtacacgcagagcggaggggtccgccccttcggcctctccacgctcatcgtcggattcgacccctacacccagaagccggccctgtaccagaccgacccctcggggaccttctccgcctggaaggccaacgccaccggccgcaactccaactccatgcgcgagttcctcgagaagaattacaaggagacgtccggcaaggagaccatcaagctcgccatcaaagcactccttgaggttgttgagagcggcggtaagaacatcgagattgcagtgatgacacacaaggatggccttcgtgaacttgaagaggcagaaatcgatgaatatgtcgctgagattgaggcagagaaggccgccgccgaggctgcaaagaagggcgcacagaaggaaacatgattcggcacagcaactctagatgactcttgttccacagcatgtcttatgattcacatcttttagatggtcatttgggtaaagggatatttttatttctgatgaagctgcttggatgaaactgtcgtgctatgtgaatgcacgcttctgcatctcaccatgatagtgacttcgtgtgattgttgtcgcagtaatatttctgagttctgacaatggtagca

SEQ ID NO: 3838 - DNA, 1184 bp, Ananas comosus
gagagagagagggatcggcgccatggctcgctacgaccgcgcgatcacggtgttctccccggacgggcacctcttccaggtggagtacgcgctcgaggccgtgcgcaagggcaacgccgccgtgggcgtgcgcggctccgacaccatcgtcctcggcgtcgagaagaagtcgacccccaagctccaagactccaggacggtgcggaagattgtgagcctggacacgcacatcgcgctggcgtgcgcggggctgaaggcggacgcgcgggtgctgatcaaccgcgcgcggatcgagtgccagagccaccggctgacggtggaggacccggcgagcgtggagtacatcacgcgctacatcgcggggctgcagcagaagtacacgcagagcggcggcgtccgccccttcggcctctccaccctcatcgtcggcttcgacccctacaccgccgtccccgccctctaccagaccgacccctccggcaccttctccgcctggaaggccaacgccaccggccgcaactccaactccatgcgcgagttcctcgagaagaactacaaggaaacctccggcagggacaccatcaagctcgccatccgcgccctccttgaagttgtggagagcgggggaaagaacatagaaattgctgttatgacacgcgatgagggtctaaagcaactcgaggaagccgaaattgacgagtatgtcgccgagattgaggcagagaaggctgcagctgaggctgctaagaaagcccctccgagagaaacctgaatttcagatcaccatttccttatgagctgttctctttcttttatgtctcttttacttgtgagatgaattctttaagttaccgtccgattggatttgttgctattttaggtctcgtggtctgaaaattatagattggcctactcaattgcgcgaactctttgtttattttgatcggacatggatgtgttgtttcgttagcagttaatctcatcctgctggatttactttctattattgttgtttagacaagttgaacttttaatcgcataccatgataaaaatgttttacggtttgacgaacttttatgcgaactggcttctttttgtctgatttaggttcagtcggtggtcttttggaaaacagggttttggcttccccagtttttagggaaatttggtgtgtcaaaagtgg

SEQ ID NO: 3839 - DNA, 1062 bp, Antirrhinum majus
aaaacctcaaaaaaactcaagagtaacaaacagatcgaaacaacaaacacattacacaacagattttaacactacaaaaaacacaaacagtgagggaaaatggctcgttacgatagagcaatcacggtgttctctcccgacggtcatctcttccaggtcgaatacgctctcgaggccgtacgcaaaggcaacgccgccgtcggagttcgcggtaccgacacgatcgtactcgccgtcgagaaaaaatcagctcctaagctacaggactccagatcagtgaggaagattgtcaatctggacgatcacattgctttggcctgtgctgggttgaaagcagacgcacgtgtcttaataaacagggcacgcatcgaatgccagagtcataagcttacagttgaggatcctgtaacagttgaatacattacgcgttatattgctggtcttcagcagaagtacacgcaaagtgggggggtgaggcctttcggactctccaccttaattattgggtttgatccacacacgggtactccatcgctctatcagacagatccatctgggacattttcggcttggaaagcaaatgctactggaagaaactcaaattctatcagggagttcctggagaagaactacaaggaaacatctggccaagaaactgtgaaattagctattcgtgctctacttgaggttgtggagagtggtgggaagaatattgaagttgctgtaatgactaaagaacatggattgaggcagcttgaagaatctgaaatagatgccattgctgctgacatagaagctgagaaagccgctgcggaggctgctaagaaggccccttcgaccaaggaaacttagtcttgcactactattataacatgtttggctttgttattcttgtgttggttatgccagatagcggtcgtttcgcctgtcgagaatatttattttgttattatcaatgggatttagatggtggactaatctattgtgtaccttttgcaatttacaccaagatgctttaagttacatcttgcatcgtatttgctgtcgtaaacatggattctt

SEQ ID NO: 3840 - DNA, 1206 bp, Arabidopsis lyrata
aagttgggaatcgtttgtttactgtgaaataaaaacgaaagagaggttttgaagaagaagaaagcagaagactcacaagatccagaaaaagacaaggagaaaggtaaaagatggcgagatacgatcgggcaatcactgtattttctcccgacggccacctatttcaggtggagtatgccctagaagccgtccgaaagggtaacgccgccgtcggagtccgcggcaccgatactgtcgtcctcgccgtcgagaagaaatccacccctaagctccaggattccagatcagcaagaaagatagtgagtcttgataatcacattgcgttggcatgtgctggactaaaggcagatgctcgtgtcttgataaacaaggcgaggatagagtgtcaaagccacaggcttacgttggaggacccagtgactgttgagtacattacgcgctacatagcggggcttcaacagaagtatactcagagtggtggtgtgagaccttttggtctttccactcttattgttgggtttgatccttacactcgtatacccgcgctttatcagactgatccatctggtactttctctgcttggaaggctaatgcaactgggagaaactctaactcaattagggagtttctggagaaaaactataaagaaagctctggccaagaaactgttaagctcgctatccgtgctctgcttgaggtagttgagagtgggggaaagaacattgaggttgctgtaatgacacgagaggaagaaggtgttctgaagcaactagaagaagaagaaattgatattattgttgctgagatcgaagcagagaaggctgcagcagaagcggccaagaaaggccctgcgaaggaaacatgaaccagatcttacagcagcggtctcagattctgagttgtaatgctggttcaaagtcaggatattcaagggttgaatagaaaatctagaccgcatgaaatggttttgttggattactagcctatttgacattgttgctttaaatcttaattgacattttagcggagtttcaaaacttgtcgtttggtactatggcatgttcaatatgctagatgactttgcatttgcgcacaagagcttctcaagagttgtaggtttcgtgtttggaaaatggaaacgttgtttcttacttaacatgtgtctcttttcttataacgtccgttgtgaaaaacttaccgttttt

SEQ ID NO: 3841 - DNA, 1121 bp, Arabidopsis thaliana
actgtgaaataaaaacgaaagaaaggttttgaagaagaagaaagaaggctcacaagatccagaaaaaggtaaaagatggcgagatacgatcgagcaatcactgtattctcccccgatggtcacctcttccaagtagagtatgccctagaagccgtccgaaagggtaacgccgccgtcggagtccgcggcacagatactgtcgtcctcgccgtcgaaaagaaatccacccctaagctccaggattccagatcagcaaggaagatagtgagccttgataatcacattgcattggcctgtgctggactgaaagcagatgctcgtgtcttgataaacaaggcgaggatagagtgtcaaagccacaggcttacgttggaggacccagttactgttgagtacattactcggtacatagcagggcttcaacagaagtatactcaaagtggtggtgtgagaccttttggtctttccactcttattgttgggtttgatccctacactcgtatacccgcgctttatcagaccgatccatctggtacattctctgcttggaaagctaatgcaactgggagaaactctaactcaattagggagtttctggagaaaaactacaaagaaagcgctggccaagaaactgttaagcttgctatccgtgctctgcttgaggttgttgagagtgggggaaagaacattgaggttgctgtaatgacacgagaggaaggtgttctgaagcaactagaagaagaagaaattgatatcattgtggctgagatcgaagcagagaaggctgcagctgaagcagccaagaaaggccctgcgaaggaaacatgaaccagatcttaaagtagcggtctcagattatgagttgtaatgctggttcaaagtcagggatattcaagggttgaatagaaaatctagaccgcatgaaatggtttgttggattactagcctatttgacactgttgctttaaatcttaaatgacattttagcggagtttcgatacttgtcagttggaactatggcatgttcagtattctagatgactttgcatttgcgctcaagagttgtagattttgattttggaaacgttgtttcttactaaacatgtctctcttcttattat

SEQ ID NO: 3842 - DNA, 966 bp, Brassica juncea
cgaaagagagaaagaaacactcaacagagaagaagaaaagagtgagagatggcgagatacgatcgagcaatcacagtgttctcccccgacggtcacctcttccaggtagagtacgccctcgaagctgtccgtaagggtaacgccgccgtcggagtccgcggcaccgatactgtagtcctcgccgtcgagaaaaaatccacccctaagctccaggatacaagatcagcaagaaagattgtgagtcttgataaccacgttgcgttggcctgtgctgggctcaaggctgatgcgcgtgtccttataaacaaggcgaggatcgagtgtcaaagccataggcttacgttggaggatcctgtgactgtcgagtacatcactcggtacattgctgggcttcagcagaagtatactcaaagtgggggtgtgagaccttttggtctttccacccttattgttggtttttgatccatacactcgtattccctcgctttatcagactgatccgtcgggtaccttctctgcttggaaggctaatgcaaccgggagaaactcaaactcgatcagggagtttctggagaagaattataaagaaacctctggtcaagaaactgtgaaacttgctatccgtgctctgcttgaggtagttgagagtggtggaaagaacattgaggttgctttaatgacgagggaggaaggtactctgaagcagctagaagaagctgaaatcgatgctattgtggctgagattgaagcagagaaggcggccgcagaagcagccaagaaagccccttcaagggaaacatgagtccgatcttacagtctcggtttctaaattctggtgttggttcaaagtaagataattgagggttgaatacaaaaaatctggactgctttagttcagtgttgttggattagtagcctgtttgacattcttcattattttgctattttatgcatgaatgtttgact

SEQ ID NO: 3843 - DNA, 1089 bp, Brassica rapa
ataacccaactgagacttcttaacttgtcgcctaagtcggaatcgacattgaagaaaagggaagagagaggtgtattgaatcagaaagaacaaaaggagagatggctagatacgatcgagcaatcacagtgttctcaccagacggccacctattccaggtagagtacgccctagaagctgtccggaaaggtaacgccgccgtcggagtccgcggtaccgatactgtcgtcctcgccgtcgagaagaagtccacccctaagctccaggatacaagatcagccagaaagattgtgagtcttgataaccacattgccttggcctgtgctggactgaaggcagatgctcgggtcctgattaacaaggccaggatagagtgtcagagccacaggcttacgttggaggatccagtgactgttgagtacatcactcggtacatagctgggcttcaacagaagtatactcaaagtggtggtgtgagaccttttggtctttccactcttattgttggttttgacccctacactcgtatacctgcgctttaccagactgatccatctggtacgttctctgcttggaaggctaatgcaaccgggagaaactcaaactcaatcagggagtttctggagaagaactataaagagacatcgggacaagagactgttaaacttgcaatccgtgctctgcttgaggtagttgagagtggtggaaagaacattgaggttgctttaatgacaagggaggaaggtactctgaagcagctagaagaagctgaaatcgatgctattgtggctgagattgaagctgagaaggcggccgcagaagcagccaagaaagccccttcaagggaaacatgagtccgatcttacagtctggtttcgaaattctggtgttggttcaaagtaagataattgagggttgaatacaaaatatctggactgctttagttcatgttgttggattattagcctgtttgacatttcattattttgctattttatgcacgaatgtttgactgagttttttttcttggtcatctttgcttcaccatatggttgttgtagacaaatatagcatgaacaacttaaccca

SEQ ID NO: 3844 - DNA, 947 bp, Brassica rapa
tgtcaaacaggctaataatccaacaacatgaactaaagcagtccagatattttgtattcaaccctcaattatcttactttgaaccaacaccagaatttcgaaaccagactgtaagatcggactcatgtttcccttgaaggggctttcttggctgcttctgcggccgccttctcagcttcaatctcagccacaatagcatcgatttcagcttcttctagctgcttcagagtaccttcctcccttgtcattaaagcaacctcaatgttctttccaccactctcaactacctcaagcagagcacggattgcaagtttaacagtctcttgtcccgatgtctctttatagttcttctccagaaactccctgattgagtttgagtttctcccggttgcattagccttccaagcagagaacgtaccagatggatcagtctggtaaagcgcaggtatacgagtgtaggggtcaaaaccaacaataagagtggaaagaccaaaaggtctcacaccaccactttgagtatacttctgttgaagcccagctatgtaccgagtgatgtactcaacagtcactggatcctccaacgtaagcctgtggctctgacactctatcctggccttgttaatcaggacccgagcatctgccttcagtccagcacaggccaaggcaatgtggttatcaagactcacaatctttctggctgatcttgtatcctggagcttaggggtggacttcttctcgacggcgaggacgacagtatcggtaccgcggactccgacggcggcgttacctttccggacagcttctagggcgtactctacctggaataggtggccgtctggtgagaacactgtgattgctcgatcgtatctagccatctctccttttgttctttctgattcaatacacctctctcttcccttttcttcaatgtcgattccgacttaggc

SEQ ID NO: 3845 - DNA, 1066 bp, Brachypodium distachyon
agactctgacagacctcaccggagctcccaattcccaaagcaaaagcagcagcggaaggaaacctctctcgctctcgccggcggcgaccagaccaggactagcgatggcccgctacgaccgcgcgatcaccgtcttctcccccgacggccacctcttccaggtcgagtacgccctcgaggccgtccgcaagggcaacgccgccgtaggcgtccgcggctccgacaccgtcgtcctcggcgtcgagaagaagtccacccccaagctccaggactccaggtcggtgcgcaagatcgcgagcctggacacgcacatcgcgctggcgtgcgcggggctcaaggcggacgcgcgggtgctcatcaaccgggcacgcgtcgagtgccagagccaccgcctcaccgtcgaggaccccgtcaccgtcgagtacatcacgcgctacatcgccgggctgcagcagaagtacacgcagagcggaggggtccggcccttcggcctctccacgctcatcgtcggattcgacccctacaccgagaagcccgcgctgtaccagaccgacccctccggcaccttctccgcctggaaggccaacgccaccggccgcaactccaactccatgcgcgagttcctcgagaagaactacaaggagacttccgggaaggagaccatcaagcttaccatccgtgccctccttgaggtcgttgaaagtggcggcaagaacatagagatcgcggtgatgacgcacaaggatggcctccgcaacctagaagaggccgagattgacgagtacgtcgccgagatcgaggcggagaaggccgccgccgaggccgccaagaagagcggcccgagagacacctaaatgtattcatcatgattcagcacgatgtctcctctagtcctcctgttccccagccagcattgtcgtctttctctccttttgtgtttgttgtttcaagaaagctgaattgtttggtcgaagcgagctgtttatttgttcttgatgttggatgtagctgctgcttggactgtgtggtctggacctcgggatccgtgagtgatgtacgattgggc

SEQ ID NO: 3846 - DNA, 1076 bp, Brachypodium distachyon
agactctgacagacctcaccggagctcccaattcccaaagcaaaagcagcagcggaaggaaacctctctcgctctcgccggcggcgaccagaccaggactagcgatggcccgctacgaccgcgcgatcaccgtcttctcccccgacggccacctcttccaggtcgagtacgccctcgaggccgtccgcaagggcaacgccgccgtaggcgtccgcggctccgacaccgtcgtcctcggcgtcgagaagaagtccacccccaagctccaggactccaggtcggtgcgcaagatcgcgagcctggacacgcacatcgcgctggcgtgcgcggggctcaaggcggacgcgcgggtgctcatcaaccgggcacgcgtcgagtgccagagccaccgcctcaccgtcgaggaccccgtcaccgtcgagtacatcacgcgctacatcgccgggctgcagcagaagtacacgcagagcggaggggtccggcccttcggcctctccacgctcatcgtcggattcgacccctacaccgagaagcccgcgctgtaccagaccgacccctccggcaccttctccgcctggaaggccaacgccaccggccgcaactccaactccatgcgcgagttcctcgagaagaactacaaggagacttccgggaaggagaccatcaagcttaccatccgtgccctccttgaggtcgttgaaagtggcggcaagaacatagagatcgcggtgatgacgcacaaggatggcctccgcaacctagaagaggccgagattgacgagtacgtcgccgagatcgaggcggagaaggccgccgccgaggccgccaagaagagcggcccgagagacacctaaatgtattcatcatgattcagcacgatgtctcctctagtcctcctgttccccagccagcattgtcgtctttctctccttttgtgtttgttgtttcaagaaagctgaattgtttggtcgaagcgagctgtttatttgttcttgatgttggatgtagctgctgcttggactgtgtggtctggacctcgggatccgtgagtgatgtacgattgggcccgttctttt

SEQ ID NO: 3847 - DNA, 1188 bp, Brassica napus
gaattcgtaaatttgatttcacggtacttgttaaatccagcaatctagaaaccctattagggtttgttaataacgtaaaaaggggaagaacaaacacgaaatggaaagaaataaatttggaaaatcgaagagagaggtgtattgaatcagaaagaacaaaaggagagatggctagatacgatcgagcaatcactgtgttctcaccagatggtcacctttttcaagtagagtacgccctagaagctgtccggaaaggtaacgccgccgtcggagtccgcggtaccgatactgtcgtcctcgccgtcgagaagaaatccacccctaagctccaggatacaagatcagccagaaagattgtgagtcttgataaccacattgccttggcctgtgctggactgaaggcagatgctcgggtcctgattaacaaggccaggatagagtgtcagagccacaggcttacgttggaggatccagtgactgttgagtacatcactcggtacatagctgggcttcaacagaagtatactcaaagtggtggtgtgagaccttttggtctttccactcttattgttggttttgacccctacactcgtatacctgcgctttaccagactgatccatctggtacgttctctgcttggaaggctaatgcaaccgggagaaactcaaactcaatcagggagtttctggagaagaattataaagagacatcgggacaagagactgttaaacttgcaatccgtgctctgcttgaggtagttgagagtggtggaaagaacattgaagttgctttaatgacaagggaggaaggtactctgaagcagctagaagaagctgaaatcgatgctattgtggctgagattgaagctgagaaggcggccgcagaagcagccaagaaagccccttcaagggaaacatgagtccgatcttacagtctcggttttctaaattctggtgttggttcaaagtaagataattgagggttgaatacaaaaaatctggactgctttagttcatgttgttggattattagcatgtttgacatttcattattttgctattttatgcatgaatgtttgactgagtttttttctttggttcgactcttttcgttcttcctaccactattagtttggtttgttagaacaaataatagcatagaacaaaccttactacaactttaactaa

SEQ ID NO: 3848 - DNA, 1019 bp, Cenchrus ciliaris
ctcgctcgccgccgccggcaactaaatcaggcgctcacgatggcccgctacgaccgcgccatcaccgtcttctccccggacggccacctcttccaggttgagtacgccctcgaggccgtacgcaagggcaacgccgccgtcggcgtccgcggcgtcgacaccgtcgtcctcggcgtcgagaagaagtccacacccaagctccaggactccaggtccttgcgcaagatcgcgagcctcgacacccacatcgcgctggcgtgcgcggggctcaaggccgacgcgcgcgtgctcatcaaccgcgcccgcgtcgagtgccagagccaccgcctcaccgtcgaggaccccgtcaccgtcgagtacatcacgcgatacatcgccggcctgcagcagaagtacacgcagagcggaggggtccgacccttcggcctctccaccctcatcgtcggcttcgacccctacacccagaagcccgccctgtaccagaccgacccctcggggaccttctccgcatggaaggccaacgccaccggccgcaactccaactccatgcgcgagttcctcgagaagaattacaaggagacgtccggcaaggagaccatcaagctcgccatcagagcactccttgaggttgttgagagtgggggcaagaacattgaggtcgcagtgatgacgcaccaggatggccttcgcgagcttgaggaggcagagatcgatgagtacgtcgctgagattgaggcagagaaggccgcagccgaggctgcaaagaagggcgcgccgaaggaaacatgatgatcccagcatagcaactatagataactctgttccacagcctgtcttatgattcacatcttttagaaggatgcctggttgtttgggtaaagggatttggtatttctgatgatgaagctgcctggatgaaactatgtggattattgtcgcagtggcctgttagtctgccggtatgtttctgagttctgacaatggttacataagacggtggtgcactgagcttgtttgtt

SEQ ID NO: 3849 - DNA, 1040 bp, Euonymus alatus
ggaacagaacagaacgagctcggatcgcgcgcaagtcacaatcctcgctgacggagcgatcataaccaagttgagttgaggaagaagaatggcgagatacgacagggcaataactgtgttttcaccggacggacatctgttccaggtggagtatgcactcgaagctgttcgtaagggcaacgccgccgtcggcgtccgtggcactgacaatgttgtccttggtgtcgagaagaaatctgccgccaagcttcaagattcccgatcggttaggaagatagtgaatctggatgatcacattgctttggcatgtgctggacttaaagcagatgcccgtgtcctgattaacaaggctcggattgaatgtcaaagccacaggctgactctcgaggatcctgtaactgttgagtatatcacgcgttatattgcaggactccagcaaaagtacacacaaagtggtggtgtgagaccatttggcctatcgactttgattgtgggctttgatccatacactgctgtgccatccctgtatcagacagatccatctggaacattttcagcttggaaagctaatgcaactgggagaaattctaattctatcagggagttcctggagaaaaactataaagaaacatctggtcatgacactttgaaacttgcaattcgtgcattgcttgaggttgttgagagtgggggcaagaacatagaagttgcagtgatgaccaaagagcatggcctgcggcaacttgatgaggccgaaattgatgtagttgtagctgagattgaagccgagaaagcagctgctgaggctgcaaagagggcacctgtgcaagggacttgatttatctcccggtgatctcattgcctgcctttagtaaaaatttcccatgagacaatttctgataagagtataagacacttgctcttgtactttatttcttacacaggtcattgttactgtcctgaatgccactgcagcattttcaccgttatctgttgcctttaaattgattgatttggaaacatatataagctctctgcca

SEQ ID NO: 3850 - DNA, 859 bp, Flaveria ramosissima
aaaccctaaatcttcactacaatctgatcacatatggcgagatacgacagagctatcacggttttctcgccggacggccacctatttcaagtcgaatacgccttggaagccgtacgcaagggcaacgccgccgtcggcgttcgtggcaccgacaccatcgtccttggggtcgagaagaagtccactgttaagcttcaagactcaagatcagttaggaaaattgtgagcctggatgatcacattgcattggcttgtgctggactcaaggcagatgcacgtgttcttattaaccgggcacggattgagtgccagagccacaggcttactgttgaggatccggtaactgtagagtatattacacgttacattgcagggcttcaacagaaatacacgcaaagtggtggtgtcaggccatttgggctctcaaccctaatcgtgggttttgatccttatactggtgttccatcattatatcagacagatccttcaggaacattttctgcttggaaagctaatgccactggaaggaactccaattccatgagggaatttctggaaaagaattacaaagagacttctggtcaagaaactataaaacttgccatccgcgctttgcttgaagttgtggagagtggagggaagaacatagaagttgctgtgatgacaaaggagggactccgacaacttgaggaagctgagattgatgccattgttgcagaaattgaagcagaaaaagcaagctgctgaggctagcaaagaaggctcctgctaaggaacataagtcgtgaaagatcaatccctttactcacaaggttccattgttgttttcttagtaacttttcaattttaccgatatatc

SEQ ID NO: 3851 - DNA, 1174 bp, Momordica charantia
gagctacgagctaacaacttgttcttcaagttccaaaattttcttcatttcgctctgtaaactcacaccgaaagagggagatcagaagcagagtaaagagtgaaggaagatggcgaggtacgatagggccattacagtgttctccccggacggccatctctttcaagtagaatacgctctcgaggccgtccgcaagggcaatgccgccgtcggcgttcgcggttccgacaccatcgttctcggcgtcgagaagaaatccacccccaagctccaagattccagatcagttcggaagattgtgaatcttgatgatcatattgcacttgcttgtgctgggctcaaagcagatgcacgagttctgatcaacagggctcgtgttgagtgccaaagtcacaggcttacagttgaggatccggtgaccgttgagtacataacgcggtacattgcaaggcttcagcagaagtacacacagagtggtggagtgaggccatttgggctttccaccttgattattgggtttgatccctacactggtgctccatccttgtatcagacagatccttctgggacattttcgtcttggaaagcgaatgccaccgggagaaattcgaattcgataagggaatttctagagaagaactataaggagacttcagggcaagaaactgtgaagcttgctatccgtgcattacttgaggttgttgagagtggaggaaagaacatagaggttgctgtgatgacaaaggaacatggtttgaaacaattggacgaggctgaaatcgatgcaattgtcgctgagattgaatcggaaaaagcagctgcagaggctgcgaagaaggccccgccaaaagaaccatgatcatttctctcctcttgtccctgcatctgtctcattaagtttaatcttgtgagaatctgatatagtgatatgctatatataacttatggtttagggaatgagacgtgaaagttttattttcatcatcttcttccaggtcctttagaatttcgaaaacagataccagcaaaactaagccaatgtgacacattttctctcaattagttgcttgggagcatctacaatgattctatttctccttattaaacataaaaaatggactaattacagtaactatgcacttgaatcgccagcatagacaacggtaattggcat

SEQ ID NO: 3852 - DNA, 1006 bp, Raphanus sativus
ttgaactaaaagggaagagaagagaagagaggtcttattgaatcagaaagaacactaatcacaagagagagagttgagagatggcgagatacgatcgagcaatcacagtgttttcgccagacggccaccttttccaggtagagtacgccctagaagctgtccgcaaaggtaacgccgccgtcggcgtccgaggcaccgatactgtcgtcctcgccgtcgagaagaaatccacccctaagctccaggatacgagatcggccagaaagattgttagccttgataaccacgtcgcattggcctgtgctgggctgaaggctgatgctcgtgtcctgataaacaaagcgaggatcgagtgtcaaagccacaggcttactttggaggatccggtgactgttgagtacatcacccgctacatagcagggcttcaacagaagtatactcaaagtggtggtgtgagaccttttggtctttccactcttattgttggttttgacccctacactcgtataccttcgctttatcagaccgatccatctggtaccttctctgcttggaaggctaatgcgaccgggaggaactctaactcgatcagggagtttctggagaagaattataaagaaacctcggggcaagagactgttaaacttgcaatccgtgctctgcttgaggtagttgagagtggtggaaagaacattgaggttgctttaatgacaagggaggaaggtactctgaagcagctagaagaagctgaaatcgatgcgattgtggctgagattgaagctgagaaggcggctgcagaagcagccaagaaaggcacttctagggaaacatgagccatttcttacggcattggtcttggtttctgaattgtgatgttggttcgaagaaaagatatttgaggtttgaatagacaaaaatctggactgcgtttagttcatgctgtgttggattattagcctgtttgacattcgtcattttaaatcatatatttggctattttatgcat

SEQ ID NO: 3853 - DNA, 1266 bp, Sorghum bicolor
ttgtttgcctcgtttgcgttcatcttctcccccaagaaaaacgaaggaacgcaggcccctctcgttgggcgcaacaaggcaacgcaggcctcccttctgatctgacttcataaaagtcgatgcacccaattggactcccagttcagatagaagcccctcgccggacgctcgctctcgccggcggcgactaaatcaggaggccaggaaggatggcacgctacgaccgcgcgatcacggtgttctccccggacggccacctcttccaggtcgagtacgccctggaggcggtccgcaagggcaacgccgccgtcggcgtccgcggcgtcgacaccgtcgtcctcggcgtcgagaagaagtccacccccaagctccaggactccaggtccgtgcgcaagatcgcgagccttgacacccacatcgcgctggcgtgcgcgggactcaaggccgacgcgcgcgtgctcatcaaccgcgcccgcgtcgagtgccagagccaccgcctcaccgtcgaggaccccgtcaccgtcgagtacatcacgcgctacatcgccggcctgcagcagaagtacacgcagagcggaggggtgcgccccttcggcctctccacgctcatcgtcggcttcgacccctacacccagaagcccgcgctgtaccagactgacccctcggggaccttctccgcttggaaggccaacgccaccggccgcaactccaactccatgcgtgagtttcttgagaagaattacaaggagacgtctggcaaggagaccatcaagctcgctatcaaagcactccttgaggttgttgagagtggcggcaagaacatagagattgcagtgatgacacacaaggacggccttcgcgaactcgaagaggctgagatcgatgagtatgttgcggagattgaagcagagaaggccgctgccgaggctgcaaagaagggtgcgccaagggagaactgattcagcacaagtttagatcgtgcctcttgttccacagcatgtcttatgattcacttcttttagacggatgcccggctgttcggatacagggatattttataagaaaagttcagatgaagccgcttggatgaaactcatgccatgtgatgcatggtagtacatctaccatggtggtttgtggcttgtgtgactgttgtcgcagtggtctgttgcctgttggtctgtcagaattattattattttctgaaacctgacaatgctagtcagttaagagacttttgttgttgcatatatttgttgattcgca

SEQ ID NO: 3854 - DNA, 1359 bp, Panicum virgatum
gtgacttcacagaggagagccgcagcccgcataccaaactccttcccaaaagcccctcgccggacgctcgctctcgccgccggcgactaaatcaggcgcccaggatggcccgctacgaccgcgcgatcaccgtcttctcccccgacggccacctcttccaggtcgagtacgccctcgaggccgtccgcaagggcaacgccgccgtcggcgtccgcggcgtcgacaccgtcgtcctcggcgtcgagaagaagtccacccccaagctccaggactcgaggtccgtgcgcaagatcgcgagcctggacacccacatcgcgctggcgtgcgcggggctcaaggccgacgcgcgcgtcctcatcaaccgcgcccgcgtcgagtgccagagccaccgcctcaccgtcgaggaccccgtcaccgtcgagtacatcacgcgcttcatcgccggcctgcagcagaagtacacgcagagcggaggggtccgccccttcggcctttccaccctcatcgtcggcttcgacccctacaccaacaagcccgccctgtaccagaccgacccctcggggaccttctccgcctggaaggccaacgccaccggccgcaactccaactccatgcgcgagttcctcgagaagaactacaaggagacgtcaggcaaggagaccatcaagctcgccatcagagcactccttgaggttgttgagagtggcggcaagaacattgaggttgcagtgatgacacacaaggatggccttcgcgagcttgaagaggcggagattgatgaatatgtcgctgagatcgaggcagagaaggccgccgccgaggctgcaaagaagggtgcgccgaaggaaacatgatctagcacagcaactatagacaactcttgttccacagcgtgccttatgattcacatcttttagactgaggcctggttgtttgggtaaagggatttttatttctgttgaaggtgcttgggtgaaacgctcgtgctatgcggatgcacactgctgcatccgccatgctggtgattggggaactagtaattgttgtcgcagtgttggtatatctgagttctgacacatggtagcataactgtgttgtaagaattcagatttgtgtgctggtgctgcttccttggctgtatgaggtgtttgagccttgtgatttggtgggcccaaacttagtcagcccaactgtcgccatcgagagagagtgtggccctcttaattctgggcctggcctcggtggagatgcgggccgggataccgattcctgtggaacccagaaagggatggttttcgttgatctcgtaggcaactcaactttaggagttcctataaaaaaaaatcaactataggagtt

SEQ ID NO: 3855 - DNA, 2627 bp, Eutrema parvulum
ggtacaggaaacaacaaacacagacactctccagcgatgtttagtccaatgaaggatatgactgaaattggtccaggaaatctaaagattgtgttttcttcggactctggtcttctcgaacggatgtacaactccaggacaggagctaacatactggtgcatcagaactacttctggtatgcttcaaatgtgggggacacaaaaaattcccaggtttcgggtgcatatattttccgacctaatgcttccttggcgtatgctgtttcgtcgaaaccgaagttgcagattatgagagggcctctagtagatgaggtgcatcagcagtttagtccttgggtggcacaggtgataagactgtacaaagataaagagcatgcagagtttgagtacactattggtccaattcctgttggtaaagattacatcggaaaagaggttattacacggatggtaacaaatatgagcacagataaggcgttctatactgactctaacggaagagactttctgaaacgagtcagggataacagaacagattggcttctcaaagtgaatgaaccaatagcaggaaactactatccggtaaactactgatgtgcaacagaaaactgtcaaatcaagaaaaaatgttgaatggctttcaaagtgttaatgcattgcttgtctgagtttcttcagcttaatctcggaatgtacacaaaagacgagaaagcagagctgtcggtgttggttgatcgggcaactgggggtgctagtatcaaggacggcgaaatagaattgatgcttcacagacgtacgtgcatggatgattcgagaggagtagaggagagccttgaggaaacggtgtgtgtcaatggtacctgctctggattaacggttcgtgggaatcactatgtaagcataaataaggtaggagaaggagggaggtggagacgagagactggccaggaaatctactctcctcttgtaatggcattcacacacgacaacaaggagaaatggaaagccgcctccaattctgtcaaaggttatgccatggatcctctctacaccttccctccaaacattgctctcatcactcttgaggagctggacctggggaacgttcttctccgcctggctcatctctacgaggctggagaagacagtgactactcgaaactcgctaaagttgagctgaagaagttgttttctgggaaaatcataaaagaagtgaaagaaatgagtttggcagcgaatcaagagaaggctaacatgaaggagaagatgaggtggaaagtggaaggtgagggcgaacaatcttcttctcttccgttaaaaggaggaccccttgatggctccgctttagttgtagagcttggtccaatggagattcgtacttttttgcttcggttttctcagaaacctgtaaagcaacggagaagaagaaagttgattctggggttatgattgatcttaaaatctttttagaatttcttgtatcaaacaattctcatgaatgaaaatcatcaacggtttgattgctaaaacgcgcgggaggaagcttcttcctcattctactcttaaatgggccttttctggtagctcattttaggcccattaaagggccattgttctctctcatcttaggctcatttcgggtagctcattgacatttgaagaagatctgaagctttttttttgtttttttggcttgtcgcttaagttggattcgtctctttattatttcttctccctgggaaaaggaaagcaaaagtatcatcggacaaaagagaacggcgtgagagatggccattacggccgggcaattaccgttttctcccccgacggccacctcttccaagtagagtacgccctagaagccgtccgcaagggtaacgccgccgtcggagtccgcggcaccgacaccgtcgtcctcgccgtcgagaagaaatctactcctaagcttcaggattctagatcagccagaaaaattgtgagccttgataatcacattgccttggcatgcgcgggtctcaaggcagatgcacgtgtgctgatcaacaaggcaaggattgagtgtcaaagccacaggcttacactagaggacccagtgactgttgagtacatcacgcggtacatagcggggcttcaacagaagtacacccaaagtggtggtgtcagaccctttggtctttctactcttatcgtcggctttgacccttactctcatgtgccatccctctatcagactgatccttctggcactttctctgcttggaaagctaatgctaccggcagaaactccaactcgattagggaattcctggaaaagaactacaaagaatcctccggccaagaaactgttaaactcgctatccgtgctctgctcgaggtagtcgagagcggaggaaagaacattgaggttgctgtaatgactcgggaggaaagtgggctgcgccagctagaagaggctgaaattgatgctattgtggccgagatcgaagcggagaaggcagccgcagaagcagccaagaaaggccctcaaaaggaaacttgatgaagcaagtatctcaactgaggtcaacttcggtctccattctcagtttatctacattttgatatttgtggttccaacaagagttgca

SEQ ID NO: 3856 - DNA, 883 bp, Triphysaria pusilla
tcgcgatacgacagagcaattacggtgttctcgcctgatggtcatcttttccaggtggagtacgctcttgaagccgtccgcaagggaaacgccgccgtcggcgttcgtggcactgacatcatcgtgctcgccgtggagaagaagtctgctcctaaacttcaggactcaagatctgtaagaaaaattgtcaacctagatgatcacattgcactggcctgtgccggtctcaaagccgatgctcgtgtcttaataaaccgggcccgtatcgaatgccaaagccacaagctgactatcgaggaccccgtgactgttgaatatataactcgatatattgccggtcttcagcagaagtacacgcagagtggtggtgtgagaccttttgggctgtcgaccttgatcatcgggtttgaccctcacacgggcaccccatcactttatcagaccgatccatcgggcacgttctccgcctggaaagcgaacgctactgggaggaactctaactctatcagggagtttcttgagaagaattacaaggaaacacacggccaagagactgtcaagttggctatccgggctttgcttgaggttgtggagagtggaggaaagaacattgaagttgcggtgatgactaaaaaacatgggctgcgtcaacttgaagaagctgaaatcgatgccattgctgctgagattgaagctgagaaagctgctgcagaggctgccaagaagggcccttcgactactgacgcttagttatttgtgttatgcaaatgctcggtatgattatctaatagacttatccacacagatatttggtcttttattgcttgtggcttatcaggattttatgtatggttgatgagataaattctaaggggagcttgca

SEQ ID NO: 3857 - DNA, 1080 bp, Triphysaria pusilla
ctgcaaatcaatttatttctgatctcggcgaaaaaaattaaaaaaagggcgaaatctagttacagatcgaaatcaaatacactttttacttcaacataactaaaaaaggagtgagatatggcgcgatacgacagagcaatcaccgttttctcgccggacggccacctttttcaggtggaatacgctctcgaagctgtgcgtaaggggaacgccgccgtcggtgttcgcggaaccgatacgatcgtactcgctgttgagaaaaagtccactcccaagctgcaggattctagatcagcaaggaagattgtcaatttagataatcacatagccttggcctgtgctggactcaaggccgatgcacgtgttttaataaacagggcacgtatcgaatgccaaagtcataaactaacagttgaagatcctgtgactgtggaatatataactcgctacattgctggtcttcagcagaagtacacacagagtggtggtgtgagaccttttggactctcaaccttgatcgttgggtttgatccgcacacgggtattccatcactttatcagactgatccgtcggggacattttcggcatggaaagctaatgctactgggagaaactcaaactcgataagagagtttctcgagaagaattacacggatacatctggccaggaaaccgtgaagttagctattcgtgctctgctggaggttgtggagagtggaggaaagaacattgaagttgccgtaatgactaaagagcatggattgcggcagcttgaagaagctgaaatcgatgccattgttgctgagctagaagccgagaaagctgctgctgaagctgccaagaaggccccttcatcgagggaatcttagtatgatgtactgttttaaatgctttttcatgattatttttttctgttcgaattacagattgcggtttgtaatttgttgctgtttggattttattatgttttgacacatgacttgagaggagagtatgagtaattgaaagttcattattactttctaacaagatgttgtgatactagtcaaatttatgatatttttcttgcaacttgttcc

SEQ ID NO: 3858 - DNA, 1046 bp, Utricularia gibba
tccgcgagtacatttcccttattccggtgacaaaatcagttgcctgccgctaacagaagagaaaattaggttgggttttttatcggcgtcgaggggctgcgtgcgctggtttgtctgattagtgagtgaaccgagagatggcgaggtatgatagggcaatcacggttttctcgccggacggtcatctttttcaggttgagtacgcacttgaagctgtgcgcaaggggaatgcagcggttggtgtccgggggaaggatgttatcgtgcttgctgtggagaaaaaatctacacctaagcttcaggattccagatcagtgagaaagattgtcaatttggatgatcacattgctttggcctgcgctgggttaaaggcagatgctcgagttctgataaacagggctcgtattgaatgccagagttacaagctcacagttgaagatccggtaactgttgagtacatcacccgctacatcgctggccttcaacaaaagtatacacaaagtgggggtgtgaggccttttggcctatcaaccctgatcattggtttcgatccgcacaccggcactccatcgctctaccagactgacccctctgggacattctctgcatggaaagccaatgctaccgggagaaactccaattccatccgcgaattcttggagaagaattacaaggaaacatctggtcaggaaaccgtgaagctagccattcgtgcactcatggaggttgttgagagtgggggaaagaacatcgaggtcgccgtgatgaccaaagaagaggggctgaggcagctcgaggaagctgagattgatgccattgctgccgagatagaagcagagaaggctgctgctgaggcagcccggaaaggccgtacgacaaccgagggttagtcccctccaggtccctgagcatgcagtggagccttttcttgctctgcctcagaattatccggacctatgactaaaagtatgcgtgtttgcttctatggatcattttgataattagttattctcattttccctcccaagattcaaatttgatatgat

SEQ ID NO: 3859 - DNA, 1133 bp, Amaranthus tuberculatus
cgatagagcaatcacagtcttttcacctgacggccatctctttcaagtcgaatacgctcatgaagccgttcgtaagggtaacgccgccgtcggtgttcgaggaaccgacaccgttgttcttggtgtcgagaagaaatctgctgccaaacttcaagattctaggtctgtcagaaaaattgtaaaccttgacaatcatattgctttagcatgtgctggtctcaaggcagatgcccgtgttctcattaacagggcacgtatagagtgtcaaagccacaagcttaccttggaggatccagttactgtcgagtacatcactcgttacattgctggacttcagcagaaatatacacaaagtggtggtgttagaccgtttgggctgtcaactttgattgtgggatttgacccatacaccaatgtaccagcgctgtaccagacggatccatctggtacattttcagcggggaaggctaacgcaactggaagaaactctaactcaataagggaattcctggagaagaactataaagaaacttctgggcaagaaaccatcaagctggctatccgtgctcttcttgaagtggttgaaagtggaggaaagaacttggaagttgccgtgatgacaaaagaaggtctacgccagcttgaagaagctgaaattgacgccattgttgcagagattgaagcagagaaagctgcagctgaggccgcgaagaaggctcctgctaaagatacatagatctatcatgcttccaattagcaggctattactgttcacttattaaaaggcttcatcatatcccagttcttgcttttgtttagcttcaaactttgaactgttgatgagttaaacatagttgacggacaatgtatcgttttagtatcattagaaaagctattatgtactatttaaaagtgagcaaattgttgaatattttggtcatttacccatttggttcattatgagatttgtgaatgtaccttcttgcagccgttaatgcgagtgtgagactactatttactctctttcattttgttggtttggtcatatttcatataacagtaataacatgttacagtcttaacctcaaaagattgtggttgattacatgaaacaatattagttctaatggttg

SEQ ID NO: 3860 - DNA, 905 bp, Brassica oleracea
aagggaagagagaatcagaaagaacactcgcaggagaaaaagttgagagatggctagatacgatcgagcaatcacggtgttctcaccagatggtcacctttttcaagtagagtacgccctagaagctgtccggaaaggtaacgccgccgtcggagtccgcggagccgataccgtcgtcctcgccgtcgagaagaaatccacccctaagctccaggatacaagatcagccagaaagattgtgagtcttgataaccacattgccttagcctgtgctgggctgaaggcagatgctcgtgtcctgattaacaaagcgaggatcgagtgtcaaagccacaggcttacgttggaggatccagtgactgttgagtacatcactcggtacatagctgggcttcaacagaagtatactcaaagtggtggtgtcagaccctttggtctttccactcttattgttggtttcgacccctacactcgtatacctgcgctttatcagactgatccatctggtacgttctctgcttggaaggctaatgcaaccgggagaaactcaaactcaatcagggagtttctggagaagaattataaagagacctcgggacaagagactgttaaactagcaatccgtgctctgcttgaggtagttgagagtggtggaaagaacattgaggttgctttaatgacaagggaggaaggtactctgaagcagctagaagaagctgaaatcgatgctattgtggctgagattgaagctgagaaggcggccgcagaagcagccaagaaagccccttcaagggaaacatgagtctgatcttacagtctcggtttctaaattctggtgttggttcaaagtaagatatttgagggttgaatacaaaaaatctggactgctttagttcagtgttgtt

SEQ ID NO: 3861 - DNA, 1044 bp, Brassica napus
tcccgcaggtcatggtatacgataagcttgatatcgattcgtatcggacattacgggcggggacaaaagggaagagagaatcagaaagaacactcgcaggagaaaaagttgagagatggctagatacgatcgagcaatcacagtgttctcaccagatggtcacctttttcaagtagagtacgccctagaagctgtccggaaaggtaacgccgccgtcggagtccgcggagccgataccgtcgtcctcgccgtcgagaagaaatccacccctaaactccaggatacaagatcagccagaaagattgtgagccttgacaaccacattgccttggcctgtgctgggctgaaggcagatgctcgtgtcctgattaacaaagcgaggatcgagtgtcaaagccacaggcttacgttggaggatccagtgactgttgagtacatcactcggtacatagctgggcttcaacagaagtatactcaaagtggtggtgtcagaccctttggtctttccactcttattgttggtttcgacccctacactcgtatacctgcgctttatcaaactgatccatctggtacgttctctgcttggaaggctaatgcaaccgggagaaactcaaactcaatcagggagtttctggagaagaattataaagagacctcgggacaagagactgttaaactagcaatccgtgctctgcttgaggtagttgagagtggtggaaagaacattgaggttgctttaatgacaagggaggaaggtactctgaagcagctagaagaagctgaaatcgatgctattgtggctgagattgaagctgagaaggcggccgcagaagcagccaagaaagccccttcaagggaaacatgagtctgatcttacagtctcggtttctaaattctggtgttggttcaaagtaagatatttgagggttgaatacaaaaaaatctggactgctttagttcagtgttgttggattattagcctgtttgacattcttcgttattttgctattttatcatgaatgtttgactgagttttttttt

SEQ ID NO: 3862 - DNA, 1048 bp, Triphysaria pusilla
attctcatctcggcaaaaaagaataaataaagggcgaaatctagttacagatcgaaagcaaatacactattcacttcaacataacttaaaaaagggtgagatatggcgcgatacgacagagcaatcaccgttttctcgccggacggccaccttttccaggtggaatacgctctcgaagctgtgcgtaaggggaacgccgccgtcggtgttcgcggagccgatacaatcgtactcgctgttgaaaagaagtccactcccaagctgcaggattctagatcagcaaggaagattgtcaatttagacaatcacatagccttggcctgtgctggcctgaaggccgatgcacgtgttttaataaacagggcacgtattgaatgccaaagtcataaactaacagttgaagatcctgtgactgtggaatacataactcgctacattgctggtcttcagcagaagtacacacaaagtggtggtgtgagaccttttggactctcaaccttgatcgttgggtttgatccgcatacggggattccgtcactttatcagactgatccgtccgggacattttcggcatggaaagctaatgctactgggagaaactcaaactcgataagagagtttctcgagaagaattacacggatacatctggccaggaaaccgtgaagttagctattcgtgctctgctggaggttgtggagagtggaggaaagaacatagaagttgccgtaatgactaaagagcatggattgcggcagcttgaggaagctgaaattgatgccattgttgctgagctagaagccgagaaagctgctgctgaagctgccaagaaggccccttcatcgagggaatcttagtatgatgtactgttttaaatgctttttcatgattatttttttctgttcgaattacagattgcggtttgtaatttgttgctgtttggattttattatgttttgagtaattgaaagttcattattactttctaacaagatgttgtgatactagtctaaatttattggttattttttcttttgttcgttaaaaaaa

SEQ ID NO: 3863 - DNA, 1061 bp, Tripterygium wilfordii
ttcgcaagtcgaaaatcagcggtgacggggcgatcatcaccaaattgagttgaggaagaagaatggcgagatacgacagggcaataactgtgttctcaccggacggacatctgttccaggtggagtatgcactcgaagctgttcgtaagggcaacgccgcggtcggcgtccgtggcattgacaatatcgttcttggcgttgagaagaaatctgccgccaagctccaagactcccgatcggttaggaagatagtgaatctggatgatcacattgctttggcatgtgctggacttaaagcagatgcccgtgtcctgattaacaaggctcggattgaatgtcaaagccacagactgactgtcgaggatcctgtaactgttgagtacgtcacgcgttatatcgcaggactccagcaaaagtacacacaaagtggtggtgtgagaccatttggcctatcgactttgattgtgggctttgatccatatactgatgtgccatctctgtatcagactgatccatctggaacattttcagcttggaaagctaatgcaactgggagaaattctaattctatcagggagtttctggagaaaaactataaagaaacatctggtcatgacactctgaaacttgcaattcgtgcattgcttgaggttgttgagagtggggggaagaacatagaagttgctgtgatgaccaaagagcatggcctgcggcaacttgatgaggctgaaattgatgcagttgtagctgagattgaagcagagaaagcagctgctgaggctgcaaagagagcacctgtgcaagagacatgatttgtctcctggtgttctcattacctgcccttactaaaaaaatttcccttgtgacaatttcggataagattcttgctcttgtacgtcatttcttatacaggtcattgttactgtcctgaatgccggcattatcttgcaaaaaaccctttttacaggggctttatgtttcgtattatctgttgcatttgaattgattgatttggaaacacagataagttctctgccacactactaagcatggcatgcaaa

SEQ ID NO: 3864 - DNA, 863 bp, Citrullus lanatus
gagaaagaaaaaggaggtgcaaaaggaagtgacccaaaagagcagctcagagcttaacaactccttcttcatcaagttccaaactttcttgtttcttcacaaccaaaatggccagatacgatagagccattaccgttttctcacccgacggtcatctcttccaagtagaatacgctctcgaggccgtccgtaagggcaacgccgccgtcggcgttcgcggttccgacaccatcgttctcggcgtcgagaagaaatccacccctaagctccaagactccagatcggttcggaaaattgtgaatctcgatgatcatattgcacttgcttgtgctggactcaaagcagatgcacgagttctgataaacagggctcgtgttgaatgtcaaagccataggcttacggttgaggatccagtgactgttgagtacataacgcgatatattgcagggcttcagcagaagtacacacagagtggtggagtgaggccatttggactttccactttgattattggctttgatccttacactggttctccatcattgtatcagacagatccttctgggactttttcctcttggaaagcaaatgcaactggcagaaattcaaattccattagggaatttcttgagaagaactataaggagacttctgggcaagaaactgtgaagcttgctatccgtgcattgcttgaggttgttgagagtggaggaaagaacatagaggttgctgtgatgacaaaggaacatggtttgaaacaattggatgaggctgaaattgatgcaattgttgccgagatcgaagtagaaaaagcagcagcagaggctgcaaagaaggccccggccccgccaaaggaaacatga

SEQ ID NO: 3865 - DNA, 878 bp, Chrysanthemum coronarium
ttactgtattttcaccggatggtcatttgttccaagttgaatacgctttggaagctgttcgaaagggtaacgctgctgtcggtgttcgcggtaccgatatcgttgtcctcggtgtcgagaagaagtccactgttaaacttcaagactctagatcagttaggaaaattgtaaacttggatgatcacattgcactggcttgtgctggactcaaagcagatgctcgtgttcttattaacaaggcaaggattgagtgccagagccataagcttactgttgaggatccagtaactgtagagtatatcacacgttacattgcaggtcttcaacagaaatatacccaaagtggtggagtcaggccgttcgggctgtcaactctaatcgtaggatttgatccttatactaatgttccatcattgtatcagactgatccttcaggaacattctctgcgtggaaagctaatgccactggcaggaactccaattccatgaggaatttttggagaaaaattataaggagacttctggtcaagaaactatcaaacttaccatccgagctctgcttgaagttgttgagagtggagggaagaacatagaagttgctgtcatgacaaaggagggactccgacaactcgaggaagctgaaattgatactattgttgcagagattgaagctgaaaaagcagctgctgaagctgcaaagaagggtcctgctaaggaatgatgtgctaaaagttcattccctttgctcacttggttttattgttgttttcttagatcttgtcagtctgaccttttcaacatatgtatgtcctgtgaagtcttttagcatgtcatggtatggtagttacaaggaatttgtttcatctaagaacttaaat

SEQ ID NO: 3866 - DNA, 1198 bp, Cucumis melo
caagaaagcagctcagagcttaagcaactccttctgcaatcaaagttccaatctttcttctttcttcacgaccaaaatggccagatacgatagagccattaccgttttctcaccggacggtcatctcttccaagtagaatacgctctcgaggccgtccgtaagggcaacgccgccgtcggtgttcgcggttccgacaccatcgtcctcggcgtggagaaaaaatccacccccaagctccaagattccagatcggttcggaaaattgtgaatctcgatgatcatattgcacttgcttgtgctggactcaaagcagatgcacgagttctgataaacagggctcgtgttgaatgtcaaagccataggcttacagttgaggatccagtgactgttgaatacataacgcggtacattgcagggcttcagcagaagtacacacagagtggtggagtgaggccatttgggctttccactttgattattggctttgatccttacactggtactccatcgttgtaccagacagatccttctgggactttttcttcttggaaagcaaatgcaacgggtagaaattcaaattctattagagaatttcttgagaagaattataaagagacttctgggcaagaaactgtgaagcttgctatccgtgcattgcttgaggttgttgagagtggaggaaagaacatagaggttgctgtgatgacaaaggaacatggtttgaaacaattagatgaggctgaaatagatgcaattgttgcggagattgaagcagaaaaagcagcagcagaggctgcaaagaaggccccagccccagccccgccaaaggaaacatgatcatttatctcttgtagtccctgatcatttgtcgttaagtttatgtttttgcaatgcgcttaaacgtcgaaccaagaaatgctatcatggagttattgttcctgctttaaggatctcactcaccattgaagcatagcagtgtcaaggtacatcaaattgagttttactgatacagtgatatgctataaattaactatgtttttaggaacctgaggacttgtaaaagtttgagttttatttgatcgaatcttccttgaagttcccatggaaattggagaatgaatacaagcaaaaacaaggccaatttgacaaagggttgccatgattagtaatgttttctcaggttttctttcaaaaaaa

SEQ ID NO: 3867 - DNA, 992 bp, Plantago ovata
aaaatcaaattagacgttcctcctccgatcgaatcgttttgaaatccaaaagaagaagaagcaaacagaggtgttaatggcgagatacgatagagcgatcactgtgttctcaccggacggtcatctcttccaggtggagtacgctctagaagctgtccgcaagggaaacgccgccgtaggcgtacgcggaactgacaccatcgttctcgccgtggagaagaagtctgctcctaagctgcaggattcgagatcagtaaggaagattgtcaacttggatgatcacattgccctggcctgtgctgggctgaaagcagatgcacgtgtcttgataaacagagcacgcattgagtgccagagccataagcttactatcgaggatccagttacagttgaatacataacccggtatattgctggtctccagcaaaagtatacacaaagtgggggtgtgcgaccatttggtctttccacccttattattggatttgatccacatacaggtaccccatcactctatcagacagatccgtcggggacattttcggcatggaaagccaatgctactgggaggaactcaaattctataagagaattcttggagaagaattacacagaaacatctggccaagagacattgaagttggccatccgtgctctacttgaggtggtggagagtggcggaaagaacattgaagtggctgtaatgactaaagaacatggattgcgtcagcttgaagaatctgaaattgatgctattgtagctgaaattgaagctgagaaagccgctgcagaggctgccaagaaggctccttcaaccagggaaacttaactagtccatctgtgttttgattcagagctgtaatgttcatttttctgtcagattctgtattctggtttatcaatggcacttatcatgttatgatcgactgcggaagtgagatttcacattgttccattttgtgacttaaactatttacagaaattgctttaag

SEQ ID NO: 3868 - DNA, 826 bp, Raphanus sativus
ggaatcgatattgaactaaaagggaagagaagagaagagaggtcttattgaatcagaaagaacactcatcacaagagagagatagagagttgagagatggcgagatacgatagagcaatcacagtgttttcaccagacggccaccttttccaggtagagtacgccctagaagctgtccgcaaaggtaacgccgccgtcggcgtccgaggcaccgatactgtcgtcctcgccgtcgagaagaaatccacccctaagctccaggatacgagatcggcgagaaagattgttagccttgataaccacgtcgcattggcctgtgctgggctgaaggcagatgctcgtgtcctgataaacaaggcgaggatcgagtgtcaaagccacaggcttactttggaggatccggtcaccgttgagtacatcacccgctacatagcagggcttcaacagaagtatactcaaagtggtggtgtgagaccttttggtctttccactcttattgttggttttgacccctacactcgtataccttcgctttatcagaccgatccgtctggtaccttctctgcttggaaggctaatgcgaccgggagaaactcaaactcgatcagggagtttctggagaagaattataaagaaacctcggggcaagagactgttaaacttgcaatccgtgctctgcttgaggtagttgagagtggtggaaagaacattgaggttgctttaatgacaagggaggaaggtactctgaagcagctagaagaagctgaaatcgatgcgattgtggctgagattgaagctgagaaagcggctgcagaagcagccaaga

SEQ ID NO: 3869 - DNA, 825 bp, Fraxinus spp
gcgcggtacgacagagcaattacggtgttctcaccggacggccatttgttacaggtggagtacgccctcgaggccgtccgaaagggaacgccgccgtcggtgttcgaggcaccgataccatcgtccttgccgtcgagaagaatccacccccaagctccaggactccagatcggtgagaaagattgtcaatttagataatcacattgcattggcatgtgctggacttaaagcagatgcacgtgttctaattaatagggcacgcattgagtgccagagtcataagcttacagtttaggatcctgtgaccgttgaatacataactcgctacattgctggacttcagcagaagtatacccaaagtggtggtgtgagaccttttgggctttcaaccttgatcattggttttgacccctacacaggtgtcccatctctttaccagacagatccctcggggactttttctgcatggaaagccaatgcaactgggagaaactcaaactcgatcagggagtttctagagaagaattacaaagaaacatctggccaggagactgtcaaactagccatgcgggctttacttgaagtcgttgagagtggtggaaagaacctagaagttgctgtaatgaccaaagatcatggacttcaccagcttgaagaagctgaaattgatgccattgttgctgaaattgaagcggagaaggcagctgcagaggctgccaagaaggcccctcccaaggaaacttaggactgtggcttaggattttgctcacatctctctccttttgtgatttttaattcggacttgtaatctgttgcttttgacta

SEQ ID NO: 3870 - DNA, 1161 bp, Olea europaea
aatagatggcgcggtacgacagagcaattacggtgttctcaccggacggccatttgtttcaggtggagtacgccctcgaggcagtccgaaagggaaacgccgccgtcggtgttcgaggcaccgataccatcgtccttgccgtcgagaagaaatccacccccaagctccaggactccagatcggttagaaagattgtcaatttagataatcacattgcattggcttgtgctggacttaaagcagatgcacgagttctaattaatagggcacgcattgagtgccagagtcataagcttacagttgaggatcctgtgactgttgaatacataactcgttacattgccggacttcagcagaagtatacacaaagcggtggtgtgagaccttttgggctttcaaccttgatcatcggttttgacccctacactagtgtcccatctctttaccagacagatccctcggggactttttcagcatggaaagccaatgcaacagggagaaactcaaactcaatccgggagtttctggagaagaattacaaagaaatgtggccaggagactatcaaactagccatgcgggctttacttgaagttgttgagagtggtggaaagaacctagaagttgctgtgatgaccaaagatcatggacttcaccagcttgaagaagctgaaattgatgccattgttgctgaaattgaagcggagaaagcagctgcagaggctgccaagaaggccccttccaaggaaacttaggactatggcttagcgtttgctcatcacgtcacttcttttgtgatatttaattcacaatgtaatctgctgcttttgacaattgatatctatctttagacaatttacaggatgatgtttaattttcagttaattgatttcctcctattattaaactgacgaaaaaatgacgactctgcgttgactacctatgtcttaagcaggtgtatactaacgcagagtacggcggggtaatgtaatagagactgacgagaagtaattagacgacagaggtaactagtgtcttcgtgtaggtatagtagagtagtattctagacagtacgatagtttcgacctagtgtacactaaaacttacccgaagagagcactaccgatctagtactacgaagtaatagagtaacgtagtttacg

SEQ ID NO: 3871 - DNA, 1195 bp, Fagus grandifolia
tttccaactcctcctccctcacactctctctcagatcgcacacaaaaacgctaatcaaaatctagaaaaccaaaaaaaaaaaagcaggtaaagaagaagaagaaagtatagtatagatggcgaggtatgaccgtgcaataacagtgttctcaccggacggccatttgttccaggtggagtacgccctcgaagccgtccgcaaaggaaacgccgccgttggtgtccgtggcttagacaacgtcgttctcggcgtcgaaaagaagtccacccccaaactccaagactccagatcggttaagaagattgtgtcattggatgatcacgttgcgttggcatgtgcggggttgaaagcggatgctcgtgtcttaataaaccgggcacgcattgaatgtcagagccataggcttacagttgaggatcctgtaactgtcgaatatataacacgctacattgcaggcctgcagcagaagtatacacaaagtgggggtgtaagaccatttggcctttcaactttgattgcgggtttcgacccatacacgggtgtcccatctctttatcagacggatccatcaggaacatttcaggcatggaaagccaatgcgactgggagaaactcaaattcgatgagggagtttttggaaaagaattataaagaaacttctggacaagaaactgtcaaattggcaattcgtgctttgcttgaagttgttgagagcggagggaagaacatagaaattgctgtgatgacaaaagagcatggactgcaccaactcgaggaagctgaaattgacaccattgttgctgatattgaagcagaaaaggcagcagcagaggctgctaagaaggcccctgcaaaggaacctagttctgttgcattatcatatttcacccgcactttctaaagtcaattaatttttgccattgaacatcactgttttatgtaacttaggcatctaccctcaagttcattgaggacctgatttcaatgcttttcttttcgaacacccccctgctgtttcccttctttcttctggaattgctggtagtcatctttcggttcaatggagatgcttgctttttgttatgttcatattcagtaacatttgtgttctgcaaatcgtactttgattttgttgttgaagagtcttaccactttaggattcaatactgacctcaaggtcattctgttagacac

SEQ ID NO: 3872 - DNA, 818 bp, Helianthus annuus
taacttgccttgcttccaaagtcagagagatcaccattaacataacaacctctgcaattttcttccaaattaaacctaaacctcaaatccaaatacaaaaccctaaaccgatcacatatggctcgatacgacagagctatcacagttttctcgccggacggccacctcttccaagtcgaatacgcattggaagccgtacgcaaaggtaacgctgccgtcggcgttcgcggcaccgactccgtcgtcctcggtgtcgagaagaaatccaccgttaaacttcaggattccagatcagttaggaaaattgtgagcctggatgaccacattgcattggcttgtgctggactcaaggcagatgcgcgtgttcttatcaaccgggcacgaattgagtgccagagccataggctcactgttgaggatccggtaaccgtggagtatattacacgttacattgcaggtcttcaacagaaatacacgcaaagtggtggtgtcaggccgtttgggctttcaaccctgatcgtcggatttgatccctatactggtgttccgtcattataccagacagatccttcaggaacgttttctgcgtggaaagctaatgccaccggtaggaactctaattccatgagggaatttcttgaaaagaattacaaagagacctctggtcaagaaactataaaacttgccatccgcgctttgcttgaagttgttgagagtggagggaagaacatagaagttgctgtgatgacaaaggagggactccggcaacttgaggaagcggaaattgataccgttgttgcagagatcgaagcagaaaa

SEQ ID NO: 3873 - DNA, 1653 bp, Mimulus guttatus
gttcaatttgtttggcagtgtcgcccatttcgtgttgttcaagttctgttgttcgtcttcccgatttcactctgcaaatcctcacagggaaaagaaaagtgataaattagaggaaaataagttcatagatagatcgaaaccacacttcgttttgatttgaacactgtaaaaggaaagatagagagatggcccgatacgacagagcaattacggtgttctcgccggatggtcatttattccaggtggagtacgctctcgaggccgtacgcaaaggaaacgccgccgtcggagttcgcggcaccgataccatcgtgctcgccgttgagaagaagtccgctcctaagcttcaggattcgagatcggtaaggaagattgttaatttagataatcacattgccttggcctgcgctgggctgaaagcagatgcacgtgtcttaataaacaaggcacggattgaatgccagagtcacaagcttacgattgaggatcctgtaacagttgaatacataactcgctacattgccggtcttcagcagaagtacacacaaagtggtggtgtgagaccttttggcctttcgaccttgattattgggtttgacccacatactggtactccgtcactttatcagacagatccatctggcacattttcagcatggaaagcaaatgcgactgggaggaattcgaactctatcagagagtttctggagaagaattacaaggaaacacatggccaagaaactctcaagttagcgattcgtgctttgctcgaggttgtggagagtggaggaaagaatatcgaagtaggtgtaatgacgaaagagcacggactgaagcaacttgaagaatcagaaatcgacgccgttgttgctgagatagaagcagagaaagctgctgccgaggctgctaagaaagccccttcaactaaggaaacttagtttcaaattattattattctgcacattgtgttgctgcttctgggcctgtcaaggtagtgtgattcatcaattcggccttataatttcatttcgtattgggcctctttaagtattggatttaacagaataagattcaacttggattatttttctgcaaaaaatatttaacagagtatgttattttctatttttttttttttttttaaattatttaatggcaagttgtatttgtttgtctggatgtgtgagcttatcaaactaaaaattgaaatctgataattaataaccgaccccacaacggacaagggagtagttcaatttaactgttggagcaataatttgattactgttgtctccattcattcagatttcgatctctcactctctttcttgtcataactttatatataataaaattggtttcggctaagatttgtgtgatccataaaggataattttatgtggtggttaaatgtgtgattcatatagtagataacaaatctgcaataattgacccgatttcttccgatcatttcctgaccttgctgcatttttgtcagtgcttttcaatccttttaccaaacaccggataaacaaaattgggtagttttcgaatgtgtaaacaaatagtgcaattttatttcgtagtaataaaaattgggagggataaaatggtaaatatagcctgaaaaaatattgcattggtatagataga

SEQ ID NO: 3874 - DNA, 791 bp, Gerbera hybrid cultivar
gaggtcaacacctctgcatttttggtcccagatcaaaaccaaaagttcgaatccaagtacaaaaaacctaattcttcctttgaatctgatcatcaatggcgagatacgacagagctataacggttttctcgccggacggccacctcttccaagttgaatacgcactagaagctgtacgcaagggtaacgccgccgtcggtgttcgtggcaccgacaccatcgtccttggcgtcgagaagaaatccaccgttaaactgcaagactccagatcggttaggaaaattgtgagcttggatgatcacatcgcattggcttgtgccggactcaaggcagatgctcgcgttcttattaacagggcacggatcgagtgccagagccataggcttactgttgaggatccagtgactgtggagtatatcacacgttacatcgcgggtcttcaacagaaatacacacaaagtggtggtgtgaggccatttgggctttcaactttgattgtagggtttgatccctatacaggtgttccatcattatatcagacagatccttcagggacattttctgcttggaaagctaatgccactggtagaaactccaattccatgagggaatttctggaaaagaactataaagagacctctggccaagaaactatcaaactcgccatccgtgctctacttgaagtcgtggaaagcggagggaagaatatagaagttgccgtgatgacaaaggagggactgcggcaactcgaggaagctgaaattgacgccattgttgcaggcattgaagca

SEQ ID NO: 3875 - DNA, 773 bp, Cichorium intybus
caagccgaagatcaaagttcaaccagaaattcaaattcatatacaaaaccttgaaacctcagagattccgatcagcaatggcgagatacgacagagctataacggtgttctctccggacggtcacctctttcaagtcgaatacgcccttgaagcggtacgtaagggtaacgccgcggtcggtgttcgtggcaccgataacattgtacttggcgtcgaaaagaagtcaaccgtcaaacttcaggactccagatcggttaggaagatcgtaagcctagatgatcacatcgcattagcctgtgctggacttaaagcagatgctcgtgttctcataaacagggcacgaatcgagtgccaaagccatagactcaccgttgaagatccagtaactgtagagtacatcacaagatacatcgcaggtcttcaacagaaatacacacaaagtggcggtgtcagaccatttgggctttcaactttaatcgtaggattcgatccttatactggtgttccatcactataccaaacagatccttcaggaacattttctgcttggaaagctaacgccactggtagaaactccaattccatgagagaatttctggaaaagaattacaaagaaacttctggccaagaaacgatcaaacttgccattcgtgctttgcttgaagtggttgagagtggtggaaagaatattgaagttgctgtaatgacaaaggagggacttaagcaacttgaggaaggtgagattgacgccattgttgcagagattgaagca

SEQ ID NO: 3876 - DNA, 966 bp, Linum usitatissimum
cttttctcccgatggccacctcttccaagtcgagtacgcgttggaagccgtccgtaaggggaacgccgccgtcggcgtccgtggcaccgacaccgttgtcctcggagtcgagaagaaatccgcggtcaagcttcaggactctaggtcagtgaggaagattgttaacctggacaatcatatcgctttagcatgtgctggacttaaggcagatgctcgcgtgctaatcaacaaggccaggatcgaatgtcaaagccacaggcttactgtcgaggatcctgtgactgtggagtacatcacccgttacattgcaggactccagcaaaagtacacacagagtggtggtgtcagaccatttgggctttcaaccttgataatcgggtttgatccgtatactaaggtgccatctctttatcagacggatccttctgggactttttctgcttggaaggctaatgcaactgggagaaactccaactccatcagagagtttcttgagaagaactataaagaaacctctggacaagaaactgttaagcttgccatccgtgccttactggaggttgtggagagcggaggaaagaacattgaagttgcagtgatgacgaaagaacacggcctgaagcaactcgaagaggctgaaattgatgctatcgtggctgagatcgaagcagagaaggcagctgccgaggctgccaagaaggcccctgctagagacgcctgatatctttaacctgtaccccctgaatttgtccatcaaggttattcaaaagaggcggcatcttttgttctttattttcttgttgctacaactcttgatgcatgttggaaaaaattattagaaactcgttagatttcaccgctgctaatagaacttgaaacacttggttgatttttggctttattttaacggtgagcaattcaacattgcatcatgatttccgggcttccagattttctagcccttcc

SEQ ID NO: 3877 - DNA, 805 bp, Papaver somniferum
ccagatggtcatctctttcaagtggagtacgctctcgaggctgtacggaaaggaaacgcagctgttggtgttagaggtactgatactgttgttcttggtgttgagaagaaatctactgctaaacttcaagattctagatcagttaggaagattgttaacctggataatcacattgctttggcctgtgctgggcttaaggcagatgcacgtgttttgataaacaaagcaaggattgagtgtcaaagtcatagactcacagttgaggatcctgtaactgttgaatatatcacacgttacatagctggtcttcagcaaaagtatacacaaagtggtggtgtgagaccatttgggctatcaactttgatcgtgggttttgaccctcacactgatgttccatcactctatcagactgatccctcagggacattctcagcttggaaggctaatgcaacaggaagaaattccaactctatgcgtgaatttttggagaaaaactacaaagaaacttctggacaagaaactgtgaagcttgctgttcgtgcattgcttgaggttgttgaaagtggtgggaagaacatagagatagctgtaatgggaaaagacaaggtgttacgtcaactcgaagaatctgagattgatatcattgttgccgagatcgaagcagaaaaagcagctgcggaagctgcaaagaaaccagcttcaaagaacacctaatttccatctcctagcatctcctagtaagtttgtccaattggccaaaaattctggataaaggtctggcagtggctcttttgactggcattgt

SEQ ID NO: 3878 - DNA, 968 bp, Primula obconica
acagagcaataacagtgttctcgccggacgggcatttgtttcaggttgaatacgcacttgaagcagttcggaaaggtaacgccgccgtcgccgttagaggctccgacaccatcgtcctcggcgtcgaaaagaaatccacccccaagctccaagactccagatcggtcaggaagattgtaaacctcgataatcatattgctttggcgtgtgctggactcaaagcagatgcacgtgtccttataaacaaggcgcgtattgaatgtcaaagccacaggcttaccctcgaggatccagtgactgttgagtatattacacggtacattgctggtcttcagcaaaaatatactcaaagtggtggtgtgaggccatttggtctttcaactttgatcgtggggtttgacccttacactaatgtaccatcactataccagactgatccatctggcacattttcagcatggaaagccaatgcgacaggtagaaactctaattcaatgagagaatttttggaaaagaattacaaggagacatctgggcatgaaaccaccaagcttgcaattcgtgccttgctcgaagttgttgagagtgggggtaagaacgtagaggtagcagtgatgaaaaaggaaggtctgcagcaactcgaagaagaagaaatcgatgctattgttgccgagattgaagcagaaaaagcagctgccgaggctgcaaagaagggaccatcaaaagagaattaaatctttagttttattttttttgcgtatgaatgtttcttcaaagttatttttcggattggtcatgttcagtagacgttatacactctgatgtggattgagatgattcctgttggtatttgtcctgcagtttgctgtatctttcttatattttcagatattagttatttaattttcattaacttcagtgaaaatccttggtgaatgtaattctctttgggaggttgtttactcgtg

SEQ ID NO: 3879 - DNA, 1008 bp, Abies balsamea
agaattttgaatcaatcagctctcttgccgtagtacctgcagtgagtgttgaaggcgagctcgattctcaggaaaactgtctttagctgaggagtattttgcacataaatcagagttgtgacggtgttatctgatcgttagaatggcgagatatgacagagcaataacggtattttcaccagacggccatctgtttcaggtggagtatgccctagaggccgtgcggaagggcaacgcagctgttggagttcgagggaccgataacatcgtgttggcggttgagagaaaatccacggccaagcttgaagattccagaacagtacggaaaattgtaaatctggataaccacattgcattggcttgtgcgggcctcaaagcagatgcccgtgttttgattaataaggctcgaattgagtgtcagagtcatagactgactgttgaggatcctgttactgtagaatatataactcgttatattgcaggtctccagcagaagtacacacaaagtggtggtgtaaggccctttggcctgtccacacttattgtaggctttgatccatatacaggtgctccttcactttaccaaacagatccatctggaacattttcagcatggaaggcaaatgcgactggaagaaattcaaattctatcagagactttttagaaaagaattacaaagagaccgcagggcatgaaactataaagcttgcagctagagcattactggaagttgttgaaagtaaaggaaacaacattgagattgctgtgatgacacatgataaggggttgcggcaacttgaggaatctgaggttgaggctattgtagctgaagttgaagcagaaaaagcagcagctgaggctgcaaaaaaggctcccacgcctagagattaaatctggatttatggatatcctctgctattaattgcaggtctattgatatttttggcctggttgaatttcattctaagttttataactattattttctcattatgcattctgctttt

SEQ ID NO: 3880 - DNA, 2241 bp, Pinus taeda
tgctactgctaactaaaccttcgcccttgatatgcaacggctactactgcaataataataattattatagtaacaactactgctatcatatctgctaatcctgccctttctttgtctgaagaatttggatgagcaactctcttgccgtagtagcccagtgagtgttgcaggacggcatatccatattcagggtgctctattctcaggaaaactatctttagctgaggagtacatttgcacataattttagggttctgaaggtggttttgcgatcgtaagaatggcgagatatgacagagcaattacggtgttttcaccagacggtcatctgtttcaggtggagtatgccttagaggccgtacggaagggtaacgcagctgttggagttcgagggactgataacattgtgttggctgtcgagagaaagtccacggctaagcttgaagattccagaacagtacggaaaattgtaaatctagataaccacattgcattggcttgtgcggggctcaaagcagatgctcgtgtgctgattaacaaggctagaattgagtgtcaaagtcatagactgactgttgaggatcctgttactgtggaatatatcactcgatacattgcaggtctccagcagaagtacacccaaagtggtggtgtgaggccttttggtctgtccacgctcattgtaggctttgatccatatacaggtgctccttctctttaccagacagatccatctggtacattttcagcatggaaggcaaatgcgacaggaagaaattcaaattctatcagagattttttagaaaagaattacaaagagacagcagggcatgaaactataaagcttgcagccagagcattactggaagttgttgaaagtaaaggaaacaacatcgagattgctgtgatgacacgcgataaggggttgcggcagcttgaggaatctgaggttgaggctattgtagctgaggttgaagcagaaaaagcggcggctgaggctgcgaaaaaggctcctactcctagagattaaatctgaatgtttcctttgccattaattgcaggtctactgatattttttgcctgtttgagtttcattcagttttataactgtcatttctcattatgcattctgcttttatgattttggctttttcaatcttcgaaaggcagttttcaaggaaatcactaaacaaatctccgttggagccagtgaactaataaatagcacgtttgaacagacatttctatataattggattacatgacaatatatgcctttgcacaaaaagagaacgatgcatatagggatggtgtaggatgttttctgatgttcaacatttactttacatgtagctgttggaacaatttttttacatgttgcaaatctaaacatggaatagatcataggaaggtcatcgcttacaaagagttttaaggttatgtcttttttaatctgggaccgtaggttcatatatacattttgcaaattattatgtaaatggtgttgtgaaggtgaaggttagttcattttcgtggacaaggtaattgtgattccatgccacttttaaaatgttaaactaaagaagcctctctttaccttggctctttctggttttcggtgagtgaagtgaaacacatgccccatacagagggaagtgggagtggggggtaatgatatctgccaaatgactttctccaacatgatatttatgtaagtaaacagctagcaatggcaacaagatattcatgcaatcaaacaactagcaacgacagagtcagaaaggcttctacctttctgagttcccagaagatagcaattatattgcatcctaagagtttaacaataaagaaaagctagaaatggacagatgacaaatgtgtgaatggagctggaacattgatagaagagggcttaacttatttaatgtctatctggcccaagtatctcagttttctgagtttaagccatatttataaaaccatatatattcaataattttagaatatgtacggtagactcttgagagtgttcccacaaattcgataatttactgatactgtgtacgtcatataccaattggaatttctagatgctatatacaacatatattgattggtatatataccatcaaaccacatctactttgtcttggctatgttggtatctctcctgcatgtacacatctgttaaacattcatattgcttttttaacctatttttctaaagccttgataaaatcc

SEQ ID NO: 3881 - DNA, 1158 bp, Pseudotsuga menziesii
gtttacttgttcgctactcctccccttctttgtctgaagtttttggaccaactccattgctctagtagtgcagtgagtgttgcaggcgaggcgtatacatattcaggcttttctctatttccagggtcactgcctttagctggattatttcacactaaaatttagggttgtgaagttgtttctgtgatcgcgagaatggcgagatatgacagagcaatcacggtattctcaccagacggccatctgtttcaggtggagtatgccctagaggccgtacgaaagggtaatgcagctgttggtgttcgagggactgataacatcgtgttggccgtcgagagaaaatccacggctaagcttgaagattccagaacagtacggaaaattgtaaatctggataaccacattgcattggcttgtgcggggcttaaagcagatgctcgggttctgattaataaagctcgaattgagtgtcaaagtcatagactgactgttgaggatcctgttactgtagaatatatcactcgttacattgcaggtctccagcagaagtacacacaaagtggtggtgtgaggccctttgggttatccacgctcattgtaggcttcgatccatatacaggtgctccttctctttaccaaacagatccatctggtacattttctgcatggaaggcaaatgcgacaggaagaaattcaaattctatcagagattttttagaaaagaattacaaagagacagcagggcatgaaaccataaagcttgcagccagagcattactggaagttgttgaaagtaaaggaaacaacatcgagattgctgtgatgacatgtgataaggggttgcggcaacttgaagaatctgaggttgaggctattgtagctgaagttgaagctgaaaaagctgcagctgaggctgcaaaaaaggctcccactcctagagattaaatttgaatgttttgtagatggatttatggatatcctgcctggttgaatttcattctcagttttacaactgttatttccttgttatgcattttgcttttatgattttggcttttcaatctttcaaagattgaaaaggcagttttcaaggcaatcactaaaaaaatctccattggagccagtgaaccaatagatagcacatttgaacatacattt

SEQ ID NO: 3882 - DNA, 1478 bp, Picea glauca
actcatttacatttttcattttgtccacctttactttggcgttaaagtgcgaaattaattaaaaagtagaaggcaaacgtgttgctccgttttaattttagttccttgatcgctactcctccccttctttgtctgaagaatttggatcaataactcttttgctgtagtagtgcagtgagtgttgcagacaaggcacatacatattcatgctgctttattctcaggaaaactgccgttagctgaggagtattttgcacataaatttagggttgtgcaggtggttttgtgattgtgagaatggcgagatatgacagagcaatcacggtgttttcaccggacggtcatctgtttcaggtggagtatgccctagaggccgtacggaagggtaacgcagctgttggagttcgagggactgataacatcgtgttggccgtcgagagaaaatccactgctaagcttgaagattccagaacagtacggaaaattgtaaatctggataaccacattgcattggcttgtgcggggctcaaagcagatgctcgtgttctgattaataaggctcgaattgagtgccaaagtcatagattgactgttgaggatcctgttactgtagaatatatcactcgctacattgcaggtcttcagcagaagtacacacaaagtggtggtgtgagaccctttgggctgtccacactcattgtaggctttgatccatatacaggtgctccttctctttaccaaacagatccatctggtacattttcagcatggaaggcaaatgcgacaggaagaaattcaaattctatcagagattttttagaaaagaattacaaagagacagcagggcatgaaactataaagcttgcagccagagcattactggaagttgtcgaaagtaaaggaaacaacatcgagattgctgtgatgacacgtgataaggggttgcggcaacttgaggaatccgaggttgaggctattgtagctgaggttgaagcagaaaaagcagcagctgaggctgcaaaaaaagctcccactcctagagattaaatctgaatgttttgtagacggatttatggacatcctctgctattagttgcaggtctctgatatattttgcctggttcaattttattcttagttttataacttttatttctcattatgcattctgcttttatgattttggctattcaaatttcaatctttcaaagattgaaaaagcagttttcaaggcaatcactaaaaaaatctccattggagccagtgaactaatagatagcacatttgaacagacatttctatataactggattacatgacaatatatgccttcacacaaaaagagaacgatgcatgcagggatggtgtaggatgttttctgatgttcaacatttactttacatgttgctgttggaacaatttttttacatgttgcaaatctaaacatggaataaatcatagaaaggtcatcatctgtt

SEQ ID NO: 3883 - DNA, 1292 bp, Ceratodon purpureus
gaagagaggaagagagagcgagcagagcaagatcaagggcgagacgaggacgcagttgcccatcttgttgtgatcgccgcccacactcggatccaccttcttctcgctcctctcagaacgaaatggcgcggtacgacagagcaattactgtgttctcgcccgacgggcatttgtttcaagtggagtacgcgttggaggcggtgaggaaggggaacgctgcggttggggtgcggggtacggacacgattgtgttgggcgtggagaagaagtccactgccaagttgcaggatgctcgaacggtgcggaagattttgaagctagatgagcatgtatcacttgccttcgccggcttgactgctgatgctcgtgttcttgttaatcgtgctcgaattgagtgccaaagccaccgtcttactgtagaagaccctgtgactgtggagtacatcactcgcttcattgctggtttgcagcaaaagtacactcagagtggtggagtacgtccttttggtatttccacattgattgtaggcttcgatccttacacaggtgtaccatcattgtaccaaactgatccttcgggaaccttttctgcttggaaagctaatgccacaggtcgtaactcaaactctgtgcgcgaatttctggagaagaattatactgaaacatctggcactgagacagtcaaactagctgttcgagcccttcttgaagtggtagagagtggtggcaagaacattgaaatagcagtaatgaccaagaatgagggtttgcggttgctagatgaggcagaagttgaggagatagttgctggcatagaagccgagaaggctgctgctgaggctgcaaagaagggccctcctcgtgatcagtaggatcatttttgttggtcaaacgacaaggatattcttctaggttacaaacaggttaaaagaggttattttcaagagttcaccatcacatctctatgtaaacttgtaaagcatgttgctataaccaattcagttggtcggtgaactccagctttggtttttataagatggttttcacatatgccgattcatatttgaatggattagatgtgctctctaacaaacagagcattgacatacagaaactctctaagcacatcgttagtatactcaaggccgtgaagcctctacctattcctatctaggacagcatttagattcagaccttgttcacaaggtcataaagctcgaatacattcgcttttactattgagtgaggatcgattgcgtagttttcttgctcctagttgtttaacgaatgga

SEQ ID NO: 3884 - DNA, 943 bp, Medicago truncatula
attttttactataattaaccacgaaaggtttgttgaaatcgaaagagtttagaagaatatcaaaatgtctcggtatgatagagctatcacaattttctctcctgatggtcatctcttccaagtaaagtatgctcttgaagccgttcgcaaaggtaacgccgctgtcggtgttcgaggtaccgacagcattgttctcggcgtggagaagaaatccactgccaaactgcaagactcgagattggtgagaaagattgttaaattggatgatcacattgcccttgcttgtgctggactaaaagccgatgctcgtgtccttgtaacccgggcccgagttgaatgccaaagtcatcgacttactgttggggatccttgtaccgtggaatacataacccattacatcgcaggtcttcagcaaaagtacacacagagtagtggtgtgcgaccgtttgggctttcgactttgatcgttggctttgatccttacaccgggtcactgtctttgtaccaaaccgacccttccggtacattttcggcttggaaagctaatgcaaccggaagaaactcaaattcaatccgtgagtttctagagaagaactataaagacacctctgggcaagaaactgtcaaactggctatcaggtcgttgcttgaggttgttgagagtggagggaagaacattgaagttgctgtcatgaccaaggagtatggtctgtgtcaactggaggaagctgaaattgacgccattgtcgctgagattgaagcagagaaagcagctgctgaggctgcaaagaaagttcttcccaaagacacatgattctaggtttcttttgttttgtacaagcatgatccttgttagattttgtctctagcctacgagtcaagcaactcaaagtaaaatggcattgaatactatctccgtttttaaatacatgtcgcaattcac

SEQ ID NO: 3885 - DNA, 1416 bp, Physcomitrella patens
gcacgatggagactcatggtgtgatgaaggtcacctgtgaacacccactccagcaaattctaaatgcttgggcaaggtcggtgtccacaggacaatcctttaagaaaaatccgaagcctgattcaatctcggttttcgtctttacttgcgattgtttaggttgaatcgcaaacaggattcaattgggtttctatcaaaatcgaacttttggccctttgtttttgtttttgttttttttttgttccctctgctctaggtgcgtttcctgatgtcttcgttgtgttgttaatgtaatggattttaggggtaatttggtgtagaaatgcgttttagggtttcacgtctggagtttgcttgttgcaggagctagagagatggttgggtcgaattgaggttgaatgataagatcggtgcgtcttaaactagcgttcattgtgtggactgttggtaggagccggtagaaatggcccgatacgatagagccatcaccgtgttctcgccggatgggcatctctttcaagtggagtatgctttggaagccgtcagaaagggaaacgcagcagtcggtgtgcgaggtacagacaccatcgtgttgggagtggagaagaaatctactgctaagttgcaagatgctcgcaccgtgcggaagattttgaagttagacgagcacgtatcactcgccttcgccggtctcaccgccgatgctcgtgttctcgtcaaccgtgctcgaattgagtgccaaagccatcgacttacagtagaagatcctgtgactgtcgagtatatcactcgcttcatcgccggcttgcagcaaaagtacactcagagtggtggagttcgccccttcggtatttccactctcatcgtcggcttcgacccttacacaggcgtacctgccctctaccaaaccgacccttctggaaccttttcagcttggaaagccaatgctactggccgtaactcgaactcggtacgtgaattcctggaaaagaattacactgagacatcaggcgctgagactgtcaaactagctgtccgagcacttcttgaggtagttgagagtggtggtaaaaacattgaaatagcagtaatgaccaagaacgaaggtttgcgattgctggatgaggcagaagttgaggagattgtggctggtatagaagctgagaaggctgctgtggaagcagctaagaagggtcctcctcgtgatcagtaggcttcagacggttggtggattcgggggttattcgctagggtgacggacaggtgaatgatgatccatgtaaaattgtaaagcattttgccggaactaattcagtcggacgacgagctccttcttggttattgtgagatgcaaatgctggtttatgacaaaattgaccgctcatgcaacggcaaggaataacgaaatcattatca

SEQ ID NO: 3886 - DNA, 1458 bp, Physcomitrella patens
tgaacggagctcttgtgcacagtgctgttttagagtgtgattttgtgtgtgcgcgtgtgtgagagagaggaagcgattagggttttgagggcggggttctgtttttcggaggcgcttcctcatctccgacgacctcgaggtaacgcacaagcacgagacaacagttttgaacttaggggaacgagggagatggcgcgttacgacagagcgatcactgtcttctcacctgatggacatctattccaagttgaatatgcactagaggctgtcagaaaggggaacgcagcagtcggagtgcgtggtaccgacacgattgtcttgggcgtggagaagaagtccacagccaagttacaagatgctcgtaccgtccggaagattctgaagctagacgagcatgtatcccttgccttcgctggcttgactgctgacgcacgcgtgctcgtcaatcgtgctcgaattgaatgccaaagtcatcgtcttacagtagaagatcctgtgacggtggaatacatcactcgctttattgctggcttgcagcagaagtacactcagagtggtggagtgcgtcctttcggtatctctacattgattgtaggattcgacccttacacaggggtaccttccctttaccagaccgatccctctggaaccttctcagcttggaaagccaatgctacaggtcgtaactcaaattcagtgcgtgagtttctggagaagaattatactgagacctcaggtgccgagacagtcaagctggctgtgcgagcgcttctagaggtggtagagagcggtgggaaaaacattgaaattgcagtaatgaccaagaatgaaggtttaaggttgctagatgaggcagaagttgaggggattgttgctgcgattgaagctgagaaggctgctgccgaagcagcgaaaaagggtcctcctcgtgatcagtaggcattgatattagttcattggccatggcgacagggttatacctcaaggtgacaacaggtgacagtggtcagttttcaagcaccattgtcgctttatgtaaacttgtaaagcatgctaccattaccaattcagcgttatctttagattggtttttgaattttgcaaaattctacttgttgtttaatgggtgtgatgtgctctgtacatcataggacggtcagattatgaagatctcatttatgatgaattgaatttgctaaaatccatataactagctatataaaaataggatccgcttgacttgaatccagtgggtgaaaaatagtcttgaactggctggatattcacgggcccttagccttgaatgtactcgctcctagagtgattggagtgagacgcacatgttagttcttttcctgagtcaaattgaactatcactttggtatttattaagtatagaccgaatttcctggtcttctgtggataatgaaatttgaaacttaaggttcccactcattt

SEQ ID NO: 3887 - DNA, 1115 bp, Cedrus atlantica
gtcatttcacaaaatcatttctcttgctctagtattgcagtaagtgttgcaggcaacggggaaaatatctttagccgaggagtattttgcgcataaattagggttctgaaggtgtttttgtgatcctgagaatggcgagatatgacagagcaatcacggtattttcacctgacggccatctgtttcaggtggagtatgccctagaagccgtgcggaagggtaatgcagccgttggagttcgagggactgataacatcgtgttggcggtcgagagaaaatccacggccaaacttgaagattccagaacagtacggaaaattgtaaatctggataaccacattgcattggcttgtgcggggcttaaagcagatgctcgtgttttgattaataaggctcgaattgagtgtcaaagtcatagactgactgttgaggatcctgttactgtagaatatatcactcgttatattgcaggtctccagcagaagtacacacaaagtggtggtgtgaggccctttgggctgtccacacttattgtaggctttgatccatatacaggtgctccttctctctaccaaacagatccatctggtacattttctgcatggaaggcaaatgcgaccggaagaaattcaaattctatcagagattttttagaaaagaattacaaagagacagcagggcatgaaactatcaagcttgcagctagagcattactggaagttgtggaaagtaaaggaaacaacattgagattgctgtgatgacacgtgataaggggttgcggcaacttgaggaatccgaggttgaggctattgtaactgaagttgaagcagaaaaagcagcagccgaggctgcaaaaaaggctcccactcctagagattaaatctgaatgtttggtagatggatttattgcaggtctactgatatttttgcctggttgaatttcattttaagttttataactattattttctcattttgcattctgcttgattttggctttttaacctttcaaaagattgaaaaggcagttttcaaggaaaccaccaaaagattctccattggagccagtgaacaaataggtagcacatttgaacagacatttctatataattgg

SEQ ID NO: 3888 - DNA, 962 bp, Distylium racemosum
gtttcgtgcaaagaatttaagagctttgaagagttttttcaagggtttcaagatcgaatcagagtaagaaaaggaaaaagaaaaacatggcgagatacgacagagcaatcactgttttttcaccggacggccatcttttccaggtggagtatgccctcgaggccgttagaaagggaaatgcggccgttggagttcgcggcaccgataatattgttttatgcgtggagagaaaatctacggccaagctcgaagattccagaacagtacggaaaattgtaaatctggataaccacattgcattggcttgtgcgggactcaaggcagatgctcgcgttcttattaacaaagcacgaattgagtgtcaaagtcataggctgactgtggaggatcctgttactgttgagtacatcactcgttacattgcaggtttgcagcaaaagtacacacagagtggtggtgtgaggccctttggcctgtccacacttattataggatttgacccatatgcagggtccccttcactttaccaaacagatccatccgggacattttctgcctggaaagcaaatgcgacagggagaaattcaaattctattcgggacttcctagaaaagaattacaaggagacttcaggagatgaaactataaagcttgcagccagggcattgcttgaagttgtggagagcaaaggaaacaacatagaaattgctgtaatgacacgcgataaaggtttgcggcaactagaggaatcagaagttgaggcaattgtagcagaagttgaagcagagaaagcagcagctgaagctgcaaaaaaatctcatgcacccagagagtcctaattctgatttttcacacttgaatttttagatgtctcagctaccaacttactgataatttttataattatctcattatgattctagcattaaatgttttgagatcttatttctactggagctggg

SEQ ID NO: 3889 - DNA, 1260 bp, Pinus pinaster
gtctgaagaatttggatgagcaactctcttgctgtagtagcccagtgagtgttgcaggaaggcatatccatattcagggtgctctgttctcgggaaaactatctttagctgaggagtacatttgcacataattttagggttctgaaggtggttttgcgatcgtaagaatggcgagatatgacagagcaattacggtgttttcaccagacggtcatctgtttcaggtggagtatgccttagaggccgtacggaagggtaacgcagctgttggagttcgagggactgataacatcgtgttggctgtcgagagaaagtccacggctaagcttgaagattccagaactgtacggaaaattgtaaatctagataaccacattgcattggcttgtgcggggctcaaagcagatgctcgtgtgctgattaacaaggctagaattgagtgtcaaagtcatagactgactgttgaggatcctgttactgtggaatatatcactcgatacattgcaggtctccagcagaagtacacccaaagtggtggtgtgaggccttttggtctgtccacactcattgtaggctttgatccatatacaggtgctccttctctttaccagacagatccatctggtacattttcagcatggaaggcaaatgcgacaggaagaaattcaaattctatcagagattttttagaaaagaattacaaagagacagcagggcatgaaactataaagcttgcagccagagcattactggaagttgttgaaagtaaaggaaacaacatagagattgctgtgatgacacgcgataaggggttgcagcagcttgaggaatctgaggttgaggctattgtagctgaggttgaagcagaaaaagcagcggctgaggctgcgaaaaaggctcccactcctagagattaaatctgaatgtttcctttgccattaattacaggtctactgatattttttgcctgtttgagtttcattcagttttataactgtcatttctcattatgcattctgcttttatgattttggctttttcaatcttcgaaaggcagttttcaaggaaatcactaaacaaatctccgttggagccagtgaactaataaatagcacatttgaacaggcatttctatataattggattacatgacaatatatgcctttgcacaaaaagagaatgatgcatatagggatggtgtaggatgttttctgatgttcaacatttactttacatgtagctgttggaacaattttctta

SEQ ID NO: 3890 - DNA, 1206 bp, Picea glauca
gtagtagtgcagtgttgcaggcaaggcacatacatattcatgctgctttattctcaggaaaattgccgttagctgaggagtattttgcacataaatttagggttgtgcaggtggttttgtgattgtgagaatggcgagatatgacagagcaatcacggtgttttcaccggacggtcatctgtttcaggtggagtatgccctagaggccgtacggaagggtaacgcagctgttggagttcgagggactgataacatcgtgttggccgtcgagagaaaatccactgctaagcttgaagattccagaacagtacggaaaattgtaaatctggataaccacattgcattggcttgtgcggggctcaaagcagatgctcgtgttctgattaataaggctcgaattgagtgccaaagtcatagattgactgttgaggatcctgttacagtagaatatatcactcgctacattgcaggtcttcagcagaagtacacacaaagtggtggtgtgagaccctttgggctgtccacactcattgtaggctttgatccatatacaggtgctccttctctttaccaaacagatccatctggtacattttcagcatggaaggcaaatgcgacaggaagaaattcaaattctatcagagattttttagaaaagaattacaaagagacagcagggcatgaaactataaagcttgcagccagagcattactggaagttgtcgaaagtaaaggaaacaacatcgagattgctgtgatgacacgtgataaggggttgcggcaacttgaggaatccgaggttgaggctattgtagctgaggttgaatcagaaaaagcagcagctgaggctgcaaaaaaagctcccactcctagagattaaatctgaatgtcttgtagacggatttatggacatcctctgctattagttgcaggtctctgatatattttgcctggttcaattttattcttagttttataacttttatttctcattatgcattctgcttttatgattttggctattcaaatttcaatctttcaaagattgaaaaagcagttttcaaggcaatcactaaaaaaatctccattggagccagtgaactaatagatagcacatttgaacagacatttctatataactggattacatgacaatatatgccttcacacaaaaagagaacgatgcatgcagggatggtgtaggat

SEQ ID NO: 3891 - DNA, 1158 bp, Capsicum annuum
gaatttgactcacaaaataaagaacaatttaattcttcttccagatcaaatggttgtcaaacacaatggtgagagtaaaccagagaaatgcttggtaagtgaaatttttccatctctgaaccaaaattacagatctataaggtctataaccgaaaaagctatcttagaaagtagaaatgaatttgtagatcacctaaatgaaatgttgatgaaagactacactccattttatcccttttatcttatccctaactaaaaaatgttgagttgtgtgcaccatcagtgatcataacaaagtggaatcctagttattacacacatttgactattaagcacgaaaaatggctagatacaatagagcgatcacggttttctcactcgacggccatctattccaggtagaatacacacttgaagacgtgcgaaaagatattgccaccgttggggtccgtggcactgacaccattgttcttgaagttgagaagaaatctacccccaggcttcaggactccaggtcagtaagaaagatagtaaatctagatgatcacattgcattggcctgtgctgggctgaaagcagatgcccaaatacttgtaaattgggcacgtatcgaatgtcagagtcataagcttacggttgaagatcctgttaccgttgagtatataactcgttacattgctggtcttcagcaaaagtacactcaaagtggtggggtaaggccatttggtctatccaccttgatcattggttttgacccacacacaggtgtcccctcactttatcaaacagatccatcgggtacattctcagcttggaaagccaatgcgactggtagaaactccaactctattcgggagttcttggagaagaattacaaagaaacatctggccaggaaactgtgaaactagcaattcgtgctttgcttgaagttgttgagagtggtggaaaaaacattgaagttgcactgatgacaaaagagcatgggcttaggcaacttgaggaagctgaaattgatgccgttgttgctgagatcgaagcagagaaagcagctgcagaagcagctaaaaaggcccagccgaaagaaacctagctctgctgagtttataactacttgaatatgtccctcccttgaattttaatttattgctctatttgac

SEQ ID NO: 3892 - DNA, 928 bp, Linum usitatissimum
ctcccgatggccacctcttccaagtcgagtacgcgttggaagccgtccgtaagggaaacgccgccgtcggcgtccgtggcaccgatactgttgtcctcggagtcgagaagaaatccgcagtcaagcttcaggactccagatcagtgaggaagattgttaacctggataatcatatcgctttagcatgtgctggacttaaggcagatgctcgcgtgctaatcaacaaggccaggatcgaatgtcaaagccacaggcttacagtcgaggatcctgtgactgtggagtacatcacccgttacattgcaggactccagcaaaaatacacacagagtggtggtgtcagaccatttgggctttcaaccttgatcattgggtttgatccgtatactaaggttccgtctctttatcagacggatccgtctgggactttttctgcttggaaggctaatgccactgggagaaactccaactccatcagagaatttcttgagaagaactataaagaaacctctggacaagaaactgttaagcttgccatccgtgccttgctggaggttgtggagagcggaggaaagaacatagaagttgcagtgatgacgaaagaacacggcctgaagcaactcgaagaggctgaaattgatgctatcgtggctgagatcgaagcagagaaggcagctgccgaggctgccaagaaggcccctgctagagacgcctgatatcttcaatctgtaccccctgaatttgtccatcaaggttatccaaaagaggcggaatcttttgttgttctttattttcttgttgctacaactcttgatgcatgttggaaaaattatcagaaacacgtgttagatttcaccgctgctaatagaacttgaaacacttggctgatgtttggcattattttaactgtgtgcaattcaatactgca

SEQ ID NO: 3893 - DNA, 681 bp, Hevea brasiliensis
gatacgatcgcgcaattactgtgttctctccggatggacatttgttccaagtggagtatgctctcgaagccgtccgcaagggaaacgccgctgtaggtgttcgcggcactgacgtcgtcgttctcggtgtcgagaagaaatccaccgccaaacttcaagatgctagaacggtgaggaaaattgtttcattggatgatcatatagcactagtatgtgctgggttgaaagcagatgctcgtgttttggtcaacagggctcgcattgagtgtcagagccataggcttactgttgaggaccctgtaacagtcgaatatataacacgttacattgctggcctgcaacagaagtatacacaaagtggtggtgtgagaccatttggtctttcaaccttaattgttggttttgatccctacactggtgtcccatctctttatcagacagatccatctggagcattttcagcctggaaagccaatgctactgggagaaactcaaattcaatgcgggagttcctggaaaagaattataaagaaacttcagggcaagaaactgtgaagttagcaattcgtgctttgcttgaagttgttgagagtgggggtaagaacatagaaatagctgtgatgacaaaagagcatggcctgcgacagcttgaagaagcagaaattgatgcaattgttgctg

SEQ ID NO: 3894 - DNA, 1515 bp, Physcomitrella patens
atgtgtgtctacatgagtgagtgagtgagtgtatgagtgtgtgttggtctccttcggattcgacgcaccctcttcgacaaacaagttcagtccatgagcaaaagcacctgattagggtttcagattggggtctgtttcacagctgatacctcgccttcgaagacccgaagcaacagatccaacattgaggaactactcttgaatgtagtgtatctctggttgctttcagcatttgcttcatcgtgttttgggttttgaaagaagccgggaccaatggcgcgttacgacagagcaatcacggtcttctctcctgatgggcatctcttccaagtggagtatgcattggaagcagtccggaaggggaacgcagcagttggggtgcggggcacggatactatagttctgggcgtggagaagaaatccactgccaagttgcaagatgctcgtaccgttcgcaagattttgaagcttgacgagcatgtgtcgcttgccttcgctggattgactgctgacgcacgtgtgcttgtcaatcgtgctcgaattgagtgtcaaagtcatcgtcttacagtagaagatcctgtgactgtggaatacatcactcgctttattgcgggtttgcagcaaaagtatactcagagtggtggagtgcgccctttcggtatttccacactgatcgtaggattcgatccttacacaggcgttccttccctttaccaaaccgatccctcaggaaccttctcagcttggaaagctaatgctacaggtcgtaattcaaattcggtccgtgaatttctggagaagaattatactgagacatcaggtgctgaaactgtcaaactagctgtacgagcacttctcgaggtagtagagagtggtggcaaaaacatcgaaattgcagtaatgaccaagaacgagggtttgcggttgctagatgaggcagaggttgaagagattgtttctggcatagaagctgaaaaggctgctgccgaagcagcaaagaagggtcctcctcgtgatcagtaggtgccagttatgggtcaacgcgatagggtaatcccttttggtggcaaacatgttcaaattatccgttttcaactactgttgcagatgtctatccatgtgaacttgtaaagcatgttgtcataccccgattcagtaagttgaatactggcacgatttttgtagcatgcaaattcctacacatggtataatgagtctgatcctatccattccaaacttatttatattcgctgcctcgtgggttacactgaactatcaccctgataaccattgtggagtgcagttcctgatattgtgagaacaccatgttaaaactctgaagtgtggatcttcgtgtactcgtaaatagggagggtgattttctttatgctataactcgccctatctgctgcggaatgggttaaaaagtataaatagtgcatctggtaggggtttggcgtttattattccaccaatagaacttggaagcataggtcctcgatggattcaggtcaa

SEQ ID NO: 3895 - DNA, 1514 bp, Picea glauca
ttccttgttcgctactccttcccttctttgtctgaagaatttggatcaataactctcttgttgtagtagtgcagtgagtgttgcaggcaaggcacatacatattcatgctgctctattctcaggaaaactgtcgttagctaaggagtattttgcacataaatttagggttgtgaaggtgattttgtgattgtgagaatggcgagatatgacagagcaatcacggtgttttcaccggacggtcatctgtttcaggtggagtatgccctagaggccgtacggaagggtaacgcagctgttggagttcgagggactgataacatcgtgttggccgtcgagagaaaatccacggctaagcttgaagattccagaacagtacggaaaattgtaaatctggataaccacattgcattggcttgtgctgggctcaaagcagatgctcgtgttcttattaataaggctcgaattgagtgccaaagtcatagattgactgttgaggatcctgttactgtagaatatatcactcgttacattgcaggtcttcagcagaagtacacacaaagtggtggtgtgagaccctttgggctgtccacactcattgtaggctttgatccatatacaggtgctccttctctttaccaaacagatccatctggtacattttcagcatggaaggcaaatgcgacaggaagaaattcaaattctatcagagattttttagaaaagaattacaaagagacagcagggcatgaaactataaagcttgcagccagagcattactggaagttgtcgaaagtaaaggaaacaacatcgagattgctgtgatgacacgtgataaggggttgcggcaacttgaggaatccgatgttgaggctattgtagctgaggttgaagcagaaaaagcagcagctgaagctgcaaaaaaagctcccactcatagagattaaatccgaatgttttgtagacggatttatggacatcctctgctattagttgcaggtctctgatattttttgcctggttgaattttattcttagttttataactgttatttctcattatgcattctgcttttatgactttggctattcaatctttcaaagattgaaaaggcagttttcaaggcaatcactaaaaaaatctctattggagccagtgaactaatagatagcacatttgaacagacatttctatgtaagtggattacatgacaatatatgccttcgcacaaaaagagaatgatgcatgcagggatggtgtaggatgttttctgatgttcaacatttactttacatgttgttcttggaacaatttttttacaatgttgcaaatctaaacatggaataaatcatagaaagaccaaaaaaaaaaacaaaaaaaaagtaaatactagtacgttaggtaactaaccctaaccttacggtacgtttccttacggtaagtaaccgtacggacccgtaaacgggacgtaaccaaccgaacgggggtaaaggtaacgggtagatgaatgagta

SEQ ID NO: 3896 - DNA, 1535 bp, Picea glauca
aattattaaccacgaatttgctcacctgtccctgcgttttacacatctacgcgtttcatatgcctttcggcgttcattagtaacaattatgtcaccgtgctagtcatttttcactccactcgttacattattcattttgtccacctttactttggcgttaaagtgcgaaattaattaaaaagtagaaggcaaacgtgttgccccgtttaactttagttccttgttcgctactccttcccttctttgtctgaagaatttggatcaataactctcttgttgtagtagtgcagtgagtgttgcaggcaaggcacatacatattcatgctgctctattctcaggaaaactgtcgttagctaaggagtattttgcacataaatttagggttgtgaaggtgattttgtgattgtgagaatggcgagatatgacagagcaatcacggtgttttcaccggacggtcatctgtttcaggtggagtatgccctagaggccgtacggaagggtaacgcagctgttggagttcgagggactgataacatcgtgttggccgtcgagagaaaatccacggctaagcttgaagattccagaacagtacggaaaattgtaaatctggataaccacattgcattggcttgtgctgggctcaaagcagatgctcgtgttcttattaataaggctcgaattgagtgccaaagtcatagattgactgttgaggatcctgttactgtagaatatatcactcgttacattgcaggtcttcagcagaagtacacacaaagtggtggtgtgagaccctttgggctgtccacactcattgtaggctttgatccatatacaggtgctccttctctttaccaaacagatccatctggtacattttcagcatggaaggcaaatgcgacaggaagaaattcaaattctatcagagattttttagaaaagaattacaaagagacagcagggcatgaaactataaagcttgcagccagagcattactggaagttgtcgaaagtaaaggaaacaacatcgagattgctgtgatgacacgtgataaggggttgcggcaacttgaggaatccgatgttgaggctattgtagctgaggttgaagcagaaaaagcagcagctgaagctgcaaaaaaagctcccactcatagagattaaatccgaatgttttgtagacggatttatggacatcctctgctattagttgcaggtctctgatattttttgcctggttgaattttattcttagttttataactgttatttctcattatgcattctgcttttatgactttggctattcaatctttcaaagattgaaaaggcagttttcaaggcaatcactaaaaaaatctctattggagccagtgaactaatagatagcacatttgaacagacatttctatgtaagtggattacatgacaatatatgccttcgcacaaaaagagaatgatgcatgcagggatggtgtaggatgttttctgatgttcaacatttactttacatgttgttcttggaacaattttttta

SEQ ID NO: 3897 - DNA, 1520 bp, Picea glauca
cgttaaagtgcgaaattaattaaaaagtagaaggcaaacgtgttgctccgttttaattttagttccttgatcgctactcctccccttctttgtctgaagaatttggatcaataactcttttgctgtagtagtgcagtgagtgttgcagacaaggcacatacatattcatgctgctttattctcaggaaaactgccgttagctgaggagtattttgcacataaatttagggttgtgcaggtggttttgtgattgtgagaatggcgagatatgacagagcaatcacggtgttttcaccggacggtcatctgtttcaggtggagtatgccctagaggccgtacggaagggtaacgcagctgttggagttcgagggactgataacatcgtgttggccgtcgagagaaaatccacggctaagcttgaagattccagaacagtacggaaaattgtaaatctggataaccacattgcattggcttgtgctgggctcaaagcagatgctcgtgttcttattaataaggctcgaattgagtgccaaagtcatagattgactgttgaggatcctgttactgtagaatatatcactcgttacattgcaggtcttcagcagaagtacacacaaagtggtggtgtgagaccctttgggctgtccacactcattgtaggctttgatccatatacaggtgctccttctctttaccaaacagatccatctggtacattttcagcatggaaggcaaatgcgacaggaagaaattcaaattctatcagagattttttagaaaagaattacaaagagacagcagggcatgaaactataaagcttgcagccagagcattactggaagttgtcgaaagtaaaggaaacaacatcgagattgctgtgatgacacgtgataaggggttgcggcaacttgaggaatccgatgttgaggctattgtagctgaggttgaagcagaaaaagcagcagctgaagctgcaaaaaaagctcccactcatagagattaaatccgaatgttttgtagacggatttatggacatcctctgctattagttgcaggtctctgatattttttgcctggttgaattttattcttagttttataactgttatttctcattatgcattctgcttttatgactttggctattcaatctttcaaagattgaaaaggcagttttcaaggcaatcactaaaaaaatctctattggagccagtgaactaatagatagcacatttgaacagacatttctatgtaagtggattacatgacaatatatgccttcgcacaaaaagagaatgatggtccagtgaaacaaaaaaaaaaaaaaactaaaaaagttactacgttagacggtttagtaactaccgtaacgttgtacctttacgtagtaacgtaacgtcgaccgtaagctacgacgagggtatacggatacgtacgtacgttacacgtacgctaaccggtcagtccgtatagccgttaaccgacgtttggaacttccgtagtaacgtccgttaa

SEQ ID NO: 3898 - DNA, 1383 bp, Picea glauca
tttagttccttgatcgctactcctccccttctttgtctgaagaacttggatcaataactcttttgctgtaatagtgcagtgagtgttgcagacaaggcacatacatattcatgctgctctattctcaggaaaactgtcgttagctaaggagtattttgcacataaatttagggttgtgaaggtggttttgtgattgtgagaatggcgagatatgacagagcaatcacggtgttttcaccggacggtcatctgtttcaggtggagtatgccctagaggccgtacggaagggtaacgcagctgttggagttcgagggactgataacatcgtgttggccgtcgagagaaaatccacggctaagcttgaagattccagaacagtacggaaaattgtaaatctggataaccacattgcattggcttgtgctgggctcaaagcagatgctcgtgttcttattaataaggctcgaattgagtgccaaagtcatagattgactgttgaggatcctgttactgtagaatatatcactcgttacattgcaggtcttcagcagaagtacacacaaagtggtggtgtgagaccctttgggctgtccacactcattgtaggctttgatccatatacaggtgctccttctctttaccaaacagatccatctggtacattttcagcatggaaggcaaatgcgacaggaagaaattcaaattctatcagagattttttagaaaagaattacaaagagacagcagggcatgaaactataaagcttgcagccagagcattactggaagttgtcgaaagtaaaggaaacaacatcgagattgctgtgatgacacgtgataaggggttgcggcaacttgaggaatccgatgttgaggctattgtagctgaggttgaagcagaaaaagcagcagctgaggctgcaaaaaaagctcccactcatagagattaaatctgaatgttttgtagacggatttatggacatcctctgctattagttgcaggtctctgatatattttgcctggttcaattttattcttagttttataacttttatttctcattatgcattctgcttttatgattttggctattcaaatttcaatctttcaaagattgaaaaagcagttttcaaggcaatcactaaaaaaatctccattggagccagtgaactaatagatagcacatttgaacagacatttctatataactggattacatgacaatatatgccttcacacaaaaagagaacgatgcatgcagggatggtgtaggatgttttctgatgttcaacatttactttacatgttgctgttggaacaatttttttacatgttgcaaatctgaacatggaataaatcatagaaaggtcatcatctgttt

SEQ ID NO: 3899 - DNA, 741 bp, Liriodendron tulipifera
aaagctgtaagaagaatttcctcaaagacggctgcagagcgagaagatggctcgctacgaccgtgccatcaccgtcttctccccagacggccatctcttccacgtcgaatacgccctcgacgccgtccgcaagggcaacgccgctgtcggtgtccgaggcaccgacacaatcgtcctcggtgtcgagaagaaatctaccgcaaaactacaagactcaagatcggtcaggaaaatcgttaatctggataatcacattgctttggcttgtgctgggctaaaagcagatgcacgggtcttgataaacaaggcacgcattgaatgccagagccacagacttactgttgaggatcctgtaactgttgaatacataacacgttacattgctggccttcaacaaaagtatacacagagtggtggtgtgagaccatttggcctttcaactttgattgttggctttgacccatacaccggtgttccatctctttatcaaacagatccttctggtacattttcagcttggaaagctaacgcaacaggaaggaactccaattccatgagagaatttttggagaaaaattataaagaaacttccgggcaagaaactgtaaagctgcccattcgtgcattgctggaagttgtcgagagtggaggaaagaacatagagattgctgtgatgacaaaagaggggcttcgtcagcttgatgaatcagaaatcgatgcaattgttatggagattgaagc

SEQ ID NO: 3900 - DNA, 1943 bp, Gnetum gnemon
ctgcttctgcttcttttgcttttgtctcttgctgcaacaacaactgctctctcttgagagagagagagagagagcgatctgtgctctctcaggcgcttttgatatttgctggcgttgtaaaatttcggtccgcttttggatgtaccgtgtatatctcctttggtttccatcatcgatattgggcgttttggattattattgttattcatgtcttgttccagccgcgatcctttatcgacggaaatcgccatggattcttcttcgtctctgcaggcctccaaggttcgaaagccatacacaattacaaagcagagagaaagatggacggaagaagagcacatgaagtttctcgaggctctgaagttgtacggtcgagcctggagaagaatcgaagaacatattggaaccaaaactgccgttcagatacggagccatgctcaaaagttcttttccaagttggtgaagggatcttcaggcagagggatctcctccgaaaaacttgaagatattgaaattcctcctcctcgtccaaaaaagaagccgagacacccctatcctcgcaaagcaacagcttcatctgtaaattccaacagttcccaagttagtaaggaagtgaactctttgccctctgtggtttcttctgcacctgtgcttggagacagacctcaacagcgcgcaggatttgttccatacaattcaaaaggaagaatgccgaaccacgtaaacgcacaagatggcaagttagagtcatcgaacacaagcaacagttctctttttagcctcaggctttaggtcatccaactaggcttacggttcgcagctgcttgttcgcatagagatctttttttgtttcccagaagaagagaggagaagcccaggcagcgaactgaaattcttagcctggaatatccaatcgagcagatttgattttttttaggttgggaaatggcaaggtacgacagagctatcaccgtgttctcgccggatgggcatctgtttcaggtggagtacgctctggaggccgtcaggaagggcaatgcagccgttggagttcgcggcaatgacaatatcgtccttgccgtcgagaggaaatccactgccaaattggaagattcaagaactgtacgcaaaattgtaaacctggacaaccatatagcactggcatgtgctgggttaaaagcagatgctcgtgttctgattaaccgtgctcgcatcgagtgtcaaagccataggctaactgttgaggatcctgttacagtggaatatattactcgttatattgcaggtcttcagcagaagtacacacaaagtggtggtgtgaggccatttggcttgtcaactttgattgtgggctttgatccatacacaggtgaaccggctctttaccagactgatccttctggtacattttcagcgtggaaagcaaatgccactggaagaaattctaattcaatcagagatttcttagaaaagaactacaagcccacatctggagatgaaaccatcaaactggcagcaagagcattattggaggtggttgaaagtaaaggaaacaacattgaaattgctgtgatgacacgtgataaaggtttgagacaacttgaagaatcagaggtggaggctatcatagcagaggttgaagcagagaaagctgcagctgaggctgcaaagaaagctcctgctccaagagagtgaatctttttttccctcctgggaatttacctttgctaaatcaaatgctatcatagactgatgaatctcttttgtgttccatcttttgttcttttgaaatgttattgttcaatcattctagaggtttccaagcaatcaggttatgttaatgattctcattaaatctagcacaagatggaggtaagaacattgctgaatatcgtgatttaaatgcctgctcccttgatattattttgggaaatgcgaattgc

SEQ ID NO: 3901 - DNA, 1168 bp, Podocarpus macrophillus
gtttgcttgcctaccacttccacctctgcattcattatctacgaaacatacaacgtcgtccttttctatttttcagagattccttgcaccaggttagggttttgcgtctgattcagcgtctgtccttttagggtttcaaagacgtaaagaatcgaatcatggcgagatatgacagagcgatcacggtattttcaccagacggccatctgttccaggtggagtatgcactggaggccgtaagaaagggtaacgccgctgttggagttcgaggaaccgacaatattgttctgtgtgtagaaagaaaatccacggccaagctcgaagattctagaacagtacgtaaaatcgtaaatctggatacccacatcgcattggcttgtgctggactcaaagcagatgctcgtgttctaattaataaggcccggattgagtgtcaaagtcatagactgactgttgaggatcctgttactgtggagtatatcactcgttttattgcaggtctccagcaaaagtatacacagagtggtggtgtgaggccttttgggttgtcaacgctcattatagggtttgacccgtattcaggtgcaccttccctgtaccaaacagatccatcaggcacattttcagcatggaaagcaaatgcaacaggaaggaattcaaattctatccgtgacttcttggaaaagaattacaaggagacttcaggggatgaaactataaaacttgctgccagagcattactggaagttgttgagagtaaaggaaataatatagagattgctgtgatgacacgagataaaggtttgcggcaacttgaggaatctgacgttgaggcaattgtagcagaggttgaagcagagaaggcagcagctgaggctgcaaaaaaatctcacgctcctagagagtcttaaatctaatttttcatatttaatttgatggatatatcagctacaagttgctgctattgtttggattgttcaactttgttcttattcagcaatatctgttttctgattatgacacatttatgatagcagcatcgaatctttctgagatcaaacttacagctttttcttgctgaccgtaaagttccgactggagttggtaaacttctgaaacattgatgtttttttcctacaagtttggacaacttgcattagatgataaa

SEQ ID NO: 3902 - DNA, 804 bp, Glycyrrhiza uralensis
gtagagttccttctttttgtcaaactttactgaagaagagagaaaagcttcacaaaatcactcactagagaagagacgatttttgaatcggcaagttaagaagaagaaaaatagcagaatggcgaggtatgacagagcgatcacggtgttctctcccgatggccatctgttccaggtcgagtacgccctcgaagccgttcgcaaaggcaacgccgccgtcggtgtccgcggcaccgacaacgtcgtcctcggcgttgagaaaaaatccaccgccaagctccaagactccagaacggtgaggaagattgttaatctggacgatcacattgcccttgcttgtgctggactgaaagctgatgcccgtgtccttataaacagggctcgagttgaatgtcaaagtcacaggcttactgttgaggatcccgtcactgttgagtatataacccgttacattgcaggtcttcagcagaagtacacacaaagtggtggtgtgcgaccctttggcctttcaaccttgattgttggctttgatccatacaccggttcaccatccctgtaccaaacagacccttctggtacattttcggcttggaaagccaatgcaactggaagaaactcaaattctatccgggagtttctagagaagaactataaagaaacttctgggcaagaaactgtcaaattggctatccgggcattgcttgaggttgttgagagtggaggcaagaacattgaagttgctgtgatgactaaggagcatggtctgcgtcaactggaggaagctgaaattgatgccattgttgc

SEQ ID NO: 3903 - DNA, 1344 bp, Physcomitrella patens
tgcagaattgagaactacaaagactcacaaaagcaaatgcagaatgaaggcaaagcaaagcaagggcgagggagagccccgagacaggtaatgagtgagtgagtgtgtggggtttgttagttgcttggaggctactccggctgccttcgatcgcacactccagagctctgttagggtttcccgttcggagcctggtttgggagggagcggagattgaattggacaattcaggagccctaaacccacggttgtgttttgtttttgtttttgtgttgtttttctttttggtgctcggttgataggagctgggagtaatggcgcgatacgatagagcaattactgtgttctcgcctgatggtcatctcttccaggtagagtatgctttggaagctgtgagaaagggaaatgcagcagtcggggtgcgaggcactgacaccattgtgttgggcgtggagaagaaatccactactaagttgcaagatgcccgcaccgtgtggaagatcttgagattagatgagcatgtatcgctcgcctttgcaggcctcactgccgatgctcgcgtcctcgtcaaccgtgctcgaattgagtgtcaaagccatcgtctgacagtagaagatcctgtgactgtcgaatacatcacctgcttcatcgctggattacagcaaaagtacactcaaagtggcggagtgcgtccctttggcatttccacactgatcgcggggtttgatccttgcacgggcgtacctgccctctaccaaaccgatccctctggaaccttctcagcttggaaagccaatgctacgggccataactcaaattctgtccgtgagtttctggaaaagaatcacaccgagacatcaggcgctgagactgtcaaactagccgtccgagcgcttcttgaggtggtagagagcggtggtaaaaacatcgaaatagcagtaatgaccaagaacaagggcttgcgtttgctagatgaagcagaggttgaggagattgtggctggtatagaagctgagaagattgctgctgaagcagctaagaagggccctcctcgtgatcagtaggctacaggttatattgctcatagagaggcttattttccgagagcgtcgtccaggttaaagcttacttttagaatcatttcagttggtcgatgaagtccaccccagtttatgtaaaatgcaagttctgacttacactcaagtgtatgtgacgtgctccacacaaatcatgacgtcaatatttgtaacctttcatttgggacgaacgccttgtacactactttatgatacagatggcactgaagccaatataatttcgagtctcctactcaataaacatgaa

SEQ ID NO: 3904 - DNA, 1261 bp, Cryptomeria japonica
aaagcaaaagaaagcaaaaaagaaagcaaaagaaagcaaaagaaagctgaaagggttttcaacgtgcttgcttgttctccactctacatctctacatagtctgaaggacctgccttttgctgcggaatagggttggcttccggatcatatagagaatttgtgtagggttttgttagatcagaagaatggcgagatacgatagggcaatcacggttttttcacctgacggccatctgtttcaagtggaatacgcgctggaggccgtccgcaagggtaatgcgtgtgtcggggttcgcgggactgacaatattgttctttgtgttgagagaaaatctacggccaagcttgaagattctagaacagttaggaaaattgtaaatctggataaccacattgcattggcttgtgcgggacttaaagcagatgctcgtgttctgattaacaaagctcgaattgagtgtcagagtcatagattgactgttgaggatcctgttactgtggagtatatcactcgttatattgcaggtctccaacaaaagtacacacagagtggtggagtgaggccctttggtttgtcaacactcattataggctttgatccatatacaagttccccttctctttaccaaacagatccatcgggaacattctctgcatggaaggcaaatgcaacaggaaggaattcaaattctatcagagacttcttagaaaagaattacaaggagtgttcaggggatgaaactataaagcttgcagccaaagccttacttgaagttgtggagagtaaaggaaacaacatagagattgctgtgatgacacaggacaagggtttgcgacaacttgaggaatcagaagttgaggcaattgtagcagaagttgaagcagagaaagcagcagctgaagctgcaaaaaaatcccacactcctagagagtcataaatctgatgttacaaacttggatccatggatatatcaagagtctagatgctgataattttatatcattgaatcattaccattttgtagctgcgtttttcatcatggattttgcttttatgattcaggcattaaatctttctttgttcactagagcagccttatgtgccatgtctagatatccactcgagccaatgaacttttatttgaaaagctttatcatgtcctatttgtttgaatcacttgaattgcatgacaatacaaatgattagcaatatactgtggaattcactggaatatttatttctgagaagacttaaatcttt

SEQ ID NO: 3905 - DNA, 1172 bp, Sequoia sempervirens
aaaggggctttcaacgtgcttgcttgttctccactccacatctatacatagtctgaagaacttgccttttgctgcggaatagggttttgcgtgcgatcattgttagaatttgtgtagggttttgatagatcagaagaatggcgagatacgacagggcaatcacagtattttcacctgacggtcatctgttccaggtggaatacgcgctggaagccgtccgcaagggtaatgcgtgtgtcggggttcgcgggactgataatattgttctttgtgttgagagaaaatctacggccaagcttgaagattccagaacagtacggaaaattgtaaatctggataaccacattgcattggcttgtgcgggacttaaagcagatgctcgtgttctgattaacaaagctcgaattgaatgtcagagtcatagattgactgttgaggatcctgttactgtggagtatatcactcgttatattgcaggtctccaacagaagtacacacagagtggtggagtgaggccctttggtttgtcgacactcataataggctttgatccatatacaagctccccttctctttaccaaaccgatccatcgggtacattttctgcatggaaggcaaatgcaacaggaaggaattcaaattctatcagagactttttagaaaagaattacaaggagtgttcaggggatgaaactataaagcttgcagccaaagccttacttgaagttgttgagagtaaaggaaacaacatagagattgctgtgatgacacaggacaagggcttgcgacaacttgaggaatcagaagttgaggcaattgtagcagaagttgaagcggagaaagcagcagctgaagctgcaaaaaaatcccacactcctagagagtcataaatttgatgttacgaacttggatcgatggatatatcaatagtctagatgctgataattttatatcgttgaatcatttaccatttttttaactgcttttttcatcatggattttgtttttatgattcaggcattatatctttctctgttcttgacagcagccttatgtgccattgtctagatatcgactcgagccaatgaacttttacttgaaaagctttaccatgccctacttgtttgaatcacttgaattgcatgacaatacaaatgatagcaatatattat

SEQ ID NO: 3906 - DNA, 1251 bp, Taxus baccata
gtttaacattcttattctcttcggcgtaatttacaactcatgtgcaattgctagtcatactaataaccttctttggcatttaaccgtgtcctgtgctttttagtttgaaaatataccgaaaagcaaaagatcacgaaaaggggctgtcaacgggcttacttcgtcttcactctacatcgacattcattcacaggtcttagaaatattttccttgaactggagagtagggttttgcgtgtttcggaagttttttagggtttcgagaaatcagtagaatggcgcgatacgacagagcaatcacagtcttttcaccggacggccatttgttccaggtcgagtatgctctcgaggctgttcgcaagggcaacgcctgtgttggagttcgggggactgataatattgttctatgtgttgagagaaaatcaacggcgaaacttgaagattccagaacagtaaggaaaattgtaaatctggataaccatgttgcattggcttgtgcgggactgaaagcagatgctcgtgttctgattaacaaagctcgaatcgagtgtcagagtcatagattgactgttgaggatcctgttactgtggaatatatcactcgttacattgcaggtctccaacagaagtacacacagagcggtggtgtgaggccctttggcttgtcaacactcattataggctttgatccatatacaagctccccttctctttaccaaacagatccatcaggtacattttctgcatggaaggcaaatgcaacaggaaggaattcaaattctataagggactttttagaaaagaattacaaggagtgttcggggggtgaaactataaagcttgcagccaaagcattacttgaagttgtggagagtaaaggaaacaacatagagattgctgtgatgacaaaggacaagggcttgcagcaacttgaggaatcggaagttgaggcagttgtagcagaagttgaagcagagaaagcagcagctgaagctgcaaaaaaatcccacactcctagagagtcctagatctgatagaattgatggatgtcagcaatttagttgccgacaatttataatttaatatttgaactttttcccaattttgttactgctatttttcattatggcttttgcattttatctttctatgatactaacagcggccttatgagccaatttctaaatatttatactgaaacaagtaaacttttaatacctgaaaaactgttatcatttttgcttgattgga

SEQ ID NO: 3907 - DNA, 857 bp, Cucumis sativus
aatcaaagttccaatctttcttgtttcttcaccaccataatggccagatacgatagagccattaccgttttctcacccgatggtcatctcttccaagttgaatacgctcttgaggccgtccgtaagggcaacgccgccgtcggtgttcgcggttccgacaccatcgtcctcggcgttgagaaaaaatccacccccaagctccaagattccagatcggttcggaaaattgtgaatcttgatgatcatattgcacttgcttgtgctggactcaaagcagatgcacgagttctgataaacagggctcgtgttgaatgtcaaagccataggcttacagttgaggatccagtcactgttgagtacataacgcggtacattgctgggcttcagcagaagtacacacagagtggtggagtgaggccattcgggctttccactttgattattggctttgatccttacactggtactccatcattgtatcagacagatccttctgggactttttcatcttggaaagcaaatgcaaccggtagaaattcaaattctattagagaatttcttgagaagaactataaagagacttctgggcaagaaactgtgaagcttgctatccgtgcattgcttgaggcaagttgttatggcatttctctgttatttgcttgcactttgttagttgttgagagtggaggaaagaacatagaggttgctgtgatgacaaaggaacatggtttgaaacaattagaggaggctgaaatagatgcaattgttgccgagatcgaagcagaaaaagcagcagcagaggctgcaaagaaggccccagccccgccaaaggaaacatgatcatttatctgatcttt

SEQ ID NO: 3908 - DNA, 930 bp, Secale cereale
cccgggaagaacaaacaaaccctaagcctccgcgaccggccgccggcggactggcccgctacgaccgcgcgatcaccgtcttctcccccgacggccacctcttccaggtcgagtacgccctcgaggccgtccgcaagggcaacgccgccgtcggcgtccgcggcaccgacaccgtcgtcctcggcgtcgagaagaagtccacccccaagctccaggactccaggtcggtgcggaagatcgcgagcctggacacgcacgtcgcgctggcgtgcgcggggctcaaggcggacgcgcgggtgctcatcaaccgcgcccgcgtcgagtgccagagccaccgcctcaccgtcgaggaccccgtcaccgtcgagtacatcacccgctacatcgccggcctgcagcagaagtacacccagagcggtggagtgcgccccttcggcctatccaccctcatcgtcggcttcgatccatacacggacaagcccgccctgtaccagaccgacccctccggcaccttctccgcctggaaggccaacgccacggggaggaactccaactccatgcgcgagttcctggagaagaactacaaggacacctccggcaaggagaccatcaagcttaccatccgagctctgctagaggttgtcgagagtggtgggaagaacattgagattgcagtgatgacaaagaaggatggtctccggcaacttgaggagactgaaatcgatgaatatgttgccgagatagaggcagagaaggcggcggctgaggctgcaaagaagagcggcccgaaggatacctaattactggatgtgctatatcttcattctgtcggccgaaaccttttagtgtgtcacctgttatgttccataactttctttaaactgctttaacaagatattgaagtcattcgtaaatgaattgccttgtttt

SEQ ID NO: 3909 - DNA, 1161 bp, Cephalotaxus harringtonia
cggaaaagcaacagaaaaggaaaaggggtcttcaacgggctggtttgcttgttcttcactcaatatccacgttcattcgcaggtcttaaaacactttccttcatttgcagaatagggttttgagtgcgaattaaagttcggaaagatcatttagggtttcgagcgatcaggagaatggcgagatacgacagagcaatcacagtattttccccggacggccatcttttccaggtggagtatgcgctcgaggccgtccgcaagggtaatgcctgtgttggggttcgcgggactgataatattgttctctgtgttgagagaaaatctacagccaagcttgaagattccagaacaatacggaaaattgtaaatctcgatgaccacgttgcattggcttgtgcgggactcaaagcagatgctcgtgttctgattaacaaagctcgaattgagtgtcagagtcatagattgactgttgaggatcctgttactgtggagtatatcactcgttacattgcaggtctccaacagaagtacacacagagtggtggcgtgagaccctttggtttgtcaacactcattataggctttgatccttatacaaattgcccctctctttaccaaacagatccgtctggtacattttctgcatggaaggcaaatgcaacaggaaggaattcaaattctatcagggactttttagaaaagaattacaaggagtgtgcaggggatgaaactataaagcttgcagccaaagcattacttgaagttgtggagagtaaaggaaacaacatagagattgctgtgatgacaaaggacaagggtctgcaacaacttgaggaatcagaagttgaggcagttgtagcagaagttgaagcagagaaagcagcagctgaagctgcaaaaaaatctcacactcctagagaatcctaaatctgatttccaaacttggattgatggatatatcagcaatttagttgctaacaaatttatattgtttgtacttttttcggattttgtaactgctatttttttcatcatggcttttacatttatgattcgggcattatgtctttcaattttcgtaacagtggctttatgagccaatttctaaatatttgtactcaatccagggaacctttaatacacgaatatcatttcctgctt

SEQ ID NO: 3910 - DNA, 804 bp, Avena sativa
ctgcccgcacacacgctcgctcaacccagccaaggcacgaccacctccgccgcccgggaagcccaaaccctaagcccctccgaccaccggcgatggcccgctacgaccgcgcgatcaccgtcttctcccccgtcggccacctcttccaggtcgagtacgccctcgaggccgtccgcaagggcaacgccgccgtcggcgtccgcggcgtcgacaccgtcgtgctcggcgtcgagaagaagtccaccccgaagctccaggactccaggtccgtgcgcaagatcgcgagcttggacacccacatcgcgctggcctgcgcggggctcaaggcggacgcgcgcgtgctcatcaaccgggcgcgcgtcgagtgccagagccaccgcctcaccgtcgaggaccccgtcaccgtcgagtacatcacacgctacatcgccggcctgcagcagaagtacacccagagcggcggggtccgccccttcggcctctccaccctcatcgtcggcttcgatccgtacacggacaagcccgcgctctaccagaccgacccctccggcaccttctccgcctggaaggccaacgctaccgggaggaactccaactccatgcgggagttcctggagaagaactacaaggacacatccggcaaggagaccatcaagctcacaatccgtgctcttctagaggttgttgagagtggtgggaagaacatcgagattgcagtgatgacaaagaaggatggccttcggcaacttgaggagactgaaattgatgaatatgttgctgagattgaggcagagaggctgcggc

SEQ ID NO: 3911 - DNA, 1107 bp, Sciadopitys verticillata
cattcactcattctattttcaagagattcaaacacttggatttagctgcggagcatcgtagggttttgtgtgtaaattaaatcgttaagagatcttttaggttttcgaaggtttctaagaacggaagtatcatggcgaggtatgacagagcaatcacagtattctcaccagacggccatctttttcaggtggagtatgccctagaggccgtccgaaagggtaatgcctgcgttggagttcgcggcagagacaatatcgttctatgtgtcgagagaaagtccacggcgaagctggaagattccagaacagtacggaaaattgtaaatctggataaccacattgcattggcttgtgcgggactcaaagcagatgctcgtgttctgattaacaaagctcgaattgagtgtcagagccatagattgactgttgaggatcctgttactgtggagtatattactcgttacattgcaggtctccagcagaagtacacacagagtggtggagtgaggccctttggtttgtctacgcttattataggctttgatccgtatacaggtgccccttcactttaccaaacagatccatctggtacattttctgcatggaaggcaaatgcaacaggaagaaattcaaattctattcgggactttttagaaaagaattacaaggagacttcaggagttgaaactataaagcttgcagccagagcattacttgaagttgttgagagtaaaggaaacaacatagagattgctgtgatgactcaagaaaagggtttgcggcaacttgaggaatctgaggtcgagtcaattgtagcagaagttgaagcagagaaagcagcagctgaagctgcaaaaaaatctcatactgctatctagttgctaatatttgcgatgttgaactttttttctgtattgtaacctactattttctcattatggtttttgcattatgattcaagcattaagatttttgtttgtctgaacagcagctatgaggcaattttaaagtttttctactggagccggtgaacttctaaatacattaaaactttacaactgattttgtttgaatcacttggattagatgatagtatacagtttaaac

SEQ ID NO: 3912 - DNA, 738 bp, Guizotia abyssinica
tttaaatacgaaaacctaaatcttccgagcacacatggcaagatacgacagagctatcacggttttctcgccggacggccatctcttccaggttgaagacgccttggaagccgtacgcaagggtaacgccgccgttggcgtccgtggtacagacaccatcgtcctcggggtcgagaagaagtccaccgttaaacttcaggattccagatcagttaggaaaattgtgagcctggatgaccacattgcattggcttgtgctggactcaaggcagatgcgcgtgttttaattaaccgggcgcgaattgagtgtcagagccataggcttacagttgaggatccggtaactgtagagtatattacacgttacattgcaggtcttcagcagaaatacacacaaagtggtggtgtcaggccatttgggctttcaaccctaatcgtagggtttgatccctatactggtgttccatcattatatcagacagacccttcgggaacattttctgcttggaaagctaatgccactggcaggaactccaattccatgagggaatttctggaaaagaatacaaggagacctctgggcaagaaactataaaacttgccatccgtgctctgcttgaagtgtggaaagtggagggaagacatagaagtgctgtgatgacaaaggagggctcgggcaactgaggagctgaaatgatgccatggtgcagagattgagcagaaaagcagctgccgagc

SEQ ID NO: 3913 - DNA, 965 bp, Thalictrum flavum
gtagaatacgcacttgaagctgttcgcaagggtaacgctgccgttggtgttcgtggaactgatactattgttcttggcgttgagaagaaatctactgctaagcttcaagattctagatctgttaggaagattgttaacctggataatcatattgctttggcctgtgctggtctaaaagctgatgctcgtgtcctgataaacaaagcacgaattgaatgtcaaagccatagacttactgttgaagatcctgtaacagttgaatatattacacgctacattgctggccttcagcagaagtatacacagagtggtggtgttagaccgtttggtttgtccactctgattgtgggtttcgacccatatactggtgttccatcactttaccagacagatccatcaggaacattttcggcttggaaagctaatgcaactgggagaaattccaactcgatgcgagagtatctggagaaaaattacaaggaaacttctggtcaggaactgttaagttggcgatccgtgcttgcttgaggtgttgagagtggaggaaagaacatagaggttgctgttatgacaaaagagcatgggttgcgtcagctcgaggaagctgaaatcgatgccattgtcgctgagattgaagcagagaaaacagcagcagaggctgctaaaaagggacctgctaaagaaacctgatctggctccctgcccctcctccttttcctggtttgaatctttccttggctttgggtttataaagaagcaggatattatggtatgagattatatttcaagaagccaatgttgacagtttatatgagctcttaggtaatattctgttggcttttatgtgtttaaagtgcaacacaattttaacagttgcgaggctccaatttcacaactcttgatgaaactcttttggatagggtatcggttgcacactttatgtcctcataaaattgtctgcagtc

SEQ ID NO: 3914 - DNA, 1008 bp, Cucurbita pepo
cagagaaaatcagagctaaaacccaaggaaaatggcgagatacgatagagccattacggtattctcaccggacggtcatctcttccaagtagaatacgctctcgaggccgtccgtaagggcaacgccgccgtcggggttcgcggttccgacaccgtcgtccttggcgtcgagaagaaatccacccccaaactccaagattccagatcggttcggaaaattgtgaatctcgatgatcatattgcacttgcttgtgctggactcaaagcagatgcacgagttctgataaacagggctcgtgttgagtgtcaaagccataggcttacagttgaggatccagtgactgttgagtatataacgcgatacattgcagggcttcagcagaagtacacacagagtggtggagtgaggccatttgggctttccactttgattattgggtttgatccttacactggtactccatcattgtatcagacagatccttctgggactttttcctcttggaaagccaatgcaaccgggagaaattcaaattcgattagggaatttcttgagaagaactacaaggagacttctgggcaagaaactgtgaagcttgctatccgtgcattgctcgaggttgtcgagagcggaggaaagaacatagaggttgctgtgatgacaaaggaacatggtttgaaacaattggaggaagctgaaattgacgccattgttgctgagattgaagcagaaaagcagcggcagaggctgccaagaagtcccggccgaaggaaacatgatcacttctcttgtagtactcactgacttcgtctggctaagtttatatcttttgcaatgtgcttaaacttcgaacctggaaagattgtcatggaattgaacccaccattgaagcattgcagtcagcttcatgcacccaatgaacaccaaattgagtttcctttatagagatttgctatatatattatccctatggtttcagggaatgagacatataaagtgtgttattt

SEQ ID NO: 3915 - DNA, 862 bp, Chrysanthemum coronarium
cgctttggaagctgtctgaaaaggtaacgctgctgtcggtgttcgtggtaccgatatcgttgtcctcggtgtcgagaagaagtccactgttaagctacaagactctagatcagttaggaaaattgtaaacctggatgatcatgttgcattggcttgtgctggactcaaagcagatgctcgtgttcttattaacaaggcaaggatcgagtgccagagccataagcttattgttgaggatccagtaactgtagagtatatcacacgttacattgcaggtcttcaacagaaatacacccaaagtggtggagtcaggccgttcgggctgtcaaccctaatcgtaggatttgatccttatactaatgttccatcattatatcagactgatccttcaggaacattttctgcgtggaaagctaatgccactggcaggaactccaattccatgagggaatttttggagaaaaattataaggagacctctggtcaagaaactatcaagcttaccatccgagctttgcttgaagttgttgagagtggaggaaagaacatagaagttgctgtcatgacaaaggagggactccgacaactcgatgaagctgaaattgatactattgttgcagagattgaagctgaaaaggcagctgccgaagctgcaaagaagggtcctgctaaggaatgatgtgctaaacctcattccctttgctgacttggttttattgttgttttcttaaatctcttgtcagtctgacattttcaagatatgtatgtcctgtgaagtcttttagcatgtcatggtatggtagttgcaaggaattttattaaaaacttaaatatatgcatcgagtgaatctatcaccctttt

SEQ ID NO: 3916 - DNA, 817 bp, Phalaenopsis aphrodite
cccggagcgatcaccgtgttctcgccggacggccacctgttccaggtggagtacgcctcgagccgttcacaagggaaacgctgccgtcggcgttcgcggcacggataacatcgtcctcggagtcgagaagaaagctacaccaaattgcaggactccaggactataaggaagatcgagagccttgacacccatattgccctagcatgcgcgggtctcaaagccgatgctcgcgtccttatcaaccgtgctaggatcgagtgtcagagccaccgtctcacgcttgaggatccagtgacggttgggtacattacccactatatcgctggtctgcagcagaagtatactcagagtggaggtgtcaggccgtttggcctctcgacgctgattgtgggatttgatccttatactggcgagcctgctctgtatcagactgatccttcggggactttatcggcgtggaaggccaacgccactgggaggaattccaattccatgagggaattccttgaaaaaaacttcaaggagacttcaggccaggagactgtgaaactggctatccgggcgctgcttgaggtggttgagagtggaggtaagaacatagaggttgctgtgatggcaaaagagcacggtcttcgccggctcgaggagtctgagattgatgccattgttgtggagcttgatgcagagaaagctgcatctgaagctgcgaagagagctccttcatgggagaggtgattttaatttaaattagtaataatttgttcctgttggactttactttctttctattctgtggcgagcacgcaggagaggacgc

SEQ ID NO: 3917 - DNA, 886 bp, Echinochloa colona
gtcgagtacgccctcgaggccgtccgcaagggcaacgccgccgtcggcgtccgcggcaccgacaccgtcgtcctcggcgtcgagaagaagtccacccccaagctccaggactccaggtccgtgcgcaagatcgcgagcctggacacacacatcgcgctggcgtgcgcggggctcaaggctgacgcgcgcgtgctcatcaaccgggcgcgggtcgagtgccagagccaccgactcaccgtcgaggaccccgtcaccgtcgagtacatcacccgctacatcgccggcctgcagcagaagtacacacagagtggtggtgttcgcccctttggcctctccaccctcatcgtcggcttcgacccgtacaccgacaagccggccctgtaccagaccgacccatccggtaccttttctgcctggaaggccaatgccacggggaggaactccaattccatgagggagttcctcgagaagaactacaaggagacctctggcaaggagactatcaagctcgccatccgtgcacttctagaggttgttgaaagtggtgggaagaacatcgaggttgcagtgatgacaaagaaggatggtctccgtgaacttgaggaggctgagattgatgaatatgttgccgagattgaggcagagaaggctgcagctgaggctgcaaagaagggtgcctcgaaggacacctaattcttggcttctgctgtgccttgatcaacacttgtttgtgtcttttcttatgttccatacactatcttaactgttttagaggaatactagattgttagatcaaactgtacttctatgcctgtagactcaacattttctctcatctacatgccttcttcggaatgcttcaatttcatttgctatatcagctggg

SEQ ID NO: 3918 - DNA, 1031 bp, Sarracenia psittacina
gggaagacagagcaacaccatcaagagaaagtaagcgaaacaaacgatggcgagatacgaccgagcaatcactgtgttctcaccggacggccatctcttccaagtcgaatacgccctcgaagccgtccgcaagggcaacgccgccgtgggcgttagaggctccgacaccgttgttcttggcgtcgagaagaagtctaccgccaaactccaagactccagatcagttaggaagattgtaagcctagatgatcacatcgcattggcctgtgctggactcaaagcagatgctcgggttcttataaacaaggctcgtatcgaatgtcaaagccacaggcttactgttgaagatccagtaactgttgagtatattacacgttacattgctggtcttcaacagaagtacacacaaagtggtggtgtaagaccatttggtctttcaactttgattgtgggctttgacccttatactagtgtaccatcactttatcagacagacccatcaggtacattttctgcatggaaggctaatgcaaccggaagaaactctaattcaatgcgagaatttttggagaaaaattataaagaaacttctgggcgagaaactatcaagcttgctattcgtgccttgcttgaagttgttgatagtggggggaaaaacattgaagttggtgtgatgactaaggagcacggcctgcggcaacttgatgaagctgaaattgatgccattgttgccgagatcgaagcagagaaagcagctgctgaggcagcaaagaagggccctccaaggaaacataaaacttattttgccttgttttcctttaccgaagtattgtactccatactgataatttctcgactagacgaggcaaaattctggtattagcttttctggttgatgtggattatgaaaaaagattatcggtttgtatttgactatgtattgctctttcattctttggcatctttgcaatttaatgacttgagttgttggcgtttggcattgttgaaattagttgtttatagattatagc

SEQ ID NO: 3919 - DNA, 828 bp, Selaginella moellendorffii
agattttagggttcttgagcaaaatgtcgtctgggcgctacgacagggcgatcaccgtcttctcgcccgatggccatctcttccaggtggaatacgcacaggaggccgtgcgaaagggcaacgccgccgtcggcgtccgcggcactgacacgatcgtgctcggcgtggagaagaaatccaccgccaagctccaggacgcgaggacggtgcacaagatcctgagcctcgacgagcacgtcgccctagctttcgctggcctcacagccgacgccagggtcctggtgaaccgggcgagagtggaatgccagagccacaggctcacggtggaagatccagtcacggtggagtacatcacacgctacatcgcggggctccagcagaagtacacgcagagcgggggagtgcggccattcgggatctcgacgctcatcatcggcttcgatccacacactggagctccatcgctctaccagacggatccgtccgggaccttctcggcgtggaaggcaaacgcgacgggcaggaactccaactcggtgcgcgagtacctggagaagaactacaccgagacatcgggcatggacacggtgaagctggctgtccgagctctcctggaggttgtggagagcggtggcaagaacatcgagatcgctgtgatgaccagacaaggactgaaattgctggaggagcccgagatcgaagagattgttaacgggatcgaggccgagaaggctgctgccgaggccgcgaagaaaggtccgcccagagattcttaaagtttgtgtacttccgggtaggaaaaaatgggcaccttcaactttctcggct

SEQ ID NO: 3920 - DNA, 843 bp, Selaginella moellendorffii
ggattttagggttcttgagcaaaatgtcgtctgggcgctacgacagggcgatcaccgtcttctcgcccgatggccatctcttccaggtggaatacgcacaggaggccgtgcgcaagggcaacgccgccgtcggcgtccgcggcactgacacaatcgtgctcggcgtggagaagaaatccaccgccaagctccaggacgcgaggacggtccacaagatcctgagcctcgacgagcacgtcgccctagctttcgctggcctcacagccgacgccagggtcctggtgaaccgggcgagagtggaatgccagagccacaggctcacggtggaagatccagtcacggtggagtacatcacacgctacatcgcggggctccagcagaagtacacgcagagcgggggagtgcggccattcgggatctcgacgctcatcatcggcttcgatccacacactggagctccatcgctctaccagacggatccgtccgggaccttctcggcgtggaaggcaaacgcgacgggcaggaactccaactcggtgcgcgagtacctggagaagaactacaccgagacgtcgggcatggacacggtgaagctggctgtccgagctctcctggaggttgtggagagcggtggcaagaacatcgagatcgctgtgatgaccagacaagggctcaaattgctggaggagcccgagatcgaagagattgttaacgggatcgaggccgagaaggctgccgccgaggccgcgaagaaaggtccgcccagagattcttaaagtctgtgtactccccggggtaggaaaaaatgggcaccttgaactttctcggcttgtgcttgtagct

SEQ ID NO: 3921 - DNA, 1544 bp, Solanum phureja
gtcttatgcacacttggttaactccgccattgcagctattagttttctctgttttcctccgccaccattaacagtaacaccgccgactgaatcgcctcgctcctccattaactctttctctgtaactcaacaatgagctgctcatcctctttgattcttccatccatttcttcgaatggatttcgaagatttagtccattgaaattggataagtctagggttttcatgagtagcatttccgttggatcacgaattgccgccgtcgatgatgctctgttcactgattacaagcctaccaatgcttttctcttccctggacagggggcacaagctgttggaatgggtgcagaggctcagaaggtgcctgctgcagctgaattatacaagagagcaaatgaaatcatggggtttgaccttttggatatttgtattaatggtccaaaagagaagttagactccactgttctaagccagccagctatctatgtcactagcttagctgcggtagagatactccgtgctcgtgaggggggtcagcaaataattgattcggttgacgtcacatgtggtctgagcttgggtgaatacactgctctggcatttacaggagctttcagttttgaggatgggcttaagctggttaagcttagaggagaagctatgcaggatgctgctgatgctgcaaaaagtgcaatggttagtataattggactggattctgaaaaggttcagaaactgtgtgatgcagctaatgaagaagttgatgaagccaacaaagttcagattgcaaatttcttatgccccggaaattatgcagtctctggaggtgttaaaggaattgaagcagtagaagcaaaagcaaaatcgttcaaagcacgaatgacggtacgtctagctgttgccggtgcttttcacacaagttttatgaatccagctgtctcaagattagaagctgctttgggtgcaacagagatcagaactcccagaataccagtaatatcaaatgttgatgcacaaccacatgcagatccagatacaattaagaaaatattagctagccaggtgacttcaccagttcaatgggagaccacaatgaaaactctcctatcaaaagggctaaagaagagctacgaattaggtcctggaaaggttattgccggtattgtcaagaggatggacagaggtgctgaaattgagaacattggtgcctaagctttgtattgagagacatcatcggtggttattctttgagtgagtttgagcttgagtttttgaatgttaacgtctttatgatctttgttcaagtagcataattaactcggattaaaatataactttctgaatctcagtagatattaatgtgatgaaaccatacacactatcagtacttatgtttcactttcattaaatttgaacctgggcagagaaataagctcagcagaccatgagataatgttgccttttccggcgattgtgctttcttgttgatgactaatatcatgtttggttgttttgtcacttcaatgataccaaatatttggtct

SEQ ID NO: 3922 - DNA, 2075 bp, Solanum lycopersicum
taaataataaacatattagaaataataaataaataaaaaatgagaagaaaatattaaagtaacgacacgatcacatgaaatcgatcattatataaaacaatttttttcgttattaatgatgaatcaaaacaatactatacgataaaataataatcttggaataaaatgatatttgtcattattaatgatgaatagaaatgatactatacgataaaataataatctcggaataaaatggagaattattttattttgggttgtcacttgtcttatgcacacttggttaactccgccattgcagctatattagattactctgttttcctccgccacaatcaaccgtaacaccgccgtcgccgtcgccgtcgccgtcgctcctccattacttcgttctctctaactgaacaatgagctgctcatcttcattgattcttccttccatttcttcgaatggatttcgaagatttagtccattgaaattggataagtctagggttttcatgagtagcatttccgttggatcacaaattgccgccgtcgatgatgctctgttcaccgattacaagcctaccaatgcttttctcttccctggacagggggcacaagctgttggaatgggtgcagaggctcagaaggtgcctgctgcagctgaattatacaagagagcaaatgaaatcatggggtttgaccttttggatatttgtattaatggtccaaaagagaagttagactccactgttctaagccagccagctatctatgtcactagcttagctgcagtagagatactccgtgctcgtgaagggggtcagcaaataattgattcggttgacgtcacatgtggtctgagcttgggtgaatacactgctctggcatttactggagctttcagtttcgaggatggacttaagctggttaagcttagaggagaagctatgcaggatgctgctgatgctgcaaaaagtgcgatggttagtataatcggactggattccgacaaggttcagaaactgtgtgatgcagctaatgaggaagttgatgaagccaacaaagttcagattgcaaatttcttatgtcccggaaattacgcagtctctggaggtgttaaaggtattgaagcagtagaagcaaaagcaaaatcgttcaaagcacgaatgacggtacgtctagctgttgctggagcttttcacacaagttttatgaatccagctgtttcacgattagaagctgctttgagtgcaacagagatcagaactccaagaataccagtaatatcaaatgttgatgcacaaccacatgcagatccagacacaattaagaaaatattagctagccaggtgacttcaccagttcaatgggagaccacaataaaaacactcctaacgaaagggctaaagaagagctacgaattaggacctggaaaggttattgctggtattgtcaagaggatggacagaggtgctgaaattgagaacattggcgcctaagctttgtgctgagagttgagagacatcatcgtttggttactctttgagtgagtgtttttgaatgttaacgtcgttatgatctttgtttaagtagcataatgaacgcggataaaatataactttctaaatctcagtagatattaatgtgatgaaaccatacagaacatgtgattcctgatagtttcactttcactaaatgtgaaagctgggcagagaaataagctcagtagaccatgagataggtatcgcctttttcagcgattgtgctttctgctgataactaatatcatgtttggttgttttcgtcacttcaatgatatcacatttgttgtctagttgaagagctatgctcgcggtgcttgcttgttaaacgatgggattaaacgtttaaatctccagtctaatgcatttgtaaactctattgctttgcaatttcgaaatacacaacttctaccatgcttaggctttggtcatttttgggtagtgataatgatggttaaaataatttgtccattgtttgggcatagcattttctttctagctttaattacaacaacaaaaaaactagtgtaaatctaacaagcgggg

SEQ ID NO: 3923 - DNA, 1408 bp, Solanum melongena
atgagtatataaatggtgtcctaaactgcatgcttttctccgccaccattaacagtctctttgcttcttaatcaacaatgagctgttcatcatctttgattcttccttccatttcttcgaatggatttcgaagatttagctcgaagaatttggataaatctagggttttcatgagcagcatttccgtcggatctcaaagtgccgccgccaccgccgtgaatgatgctttgttcgctgattataaacctaacaacgcttttctcttccctggacagggggcacaagctgtcggaatgggtgcagaggctcagaaggtgcctgctgcagctgaattatacaagcgagcgaatgaaatcatggggtttgaccttttggatatatgtattaatggtccaaaagagaagttagattccactgttctaagccagccagctatttatgtcactagcttagctgcagtagagatactccgtgctcgtgaggggggtcagcaaataatagattcggttggcgtcacgtgtggtctgagcttgggcgaatatactgctctagcatttgcaggagctttcagctttgaggatggacttaagctggttaagcttagaggagaagctatgcaggacgctgctgatgctgcaaaaagttccatggttagtataattggactggattctgacaaggttcagaaactgtgtgatgcagctaatgaggaagttgatgaagccaacaaagttcagattgcaaatttcttatgtcctggaaactatgcggtctctggaggtgttaaaggaattgaagcggtagaagcaaaagcaaaatcgttcaaagcacgaatgacggtacgtctagctgttgctggagctttccacacaagttttatgaatccagctgtctcccgattagaagctgctttgggtgcaacagagatcagaactcccagaataccagtaatatcaaatgtcgatgcacaaccacatgcagacccagatacaatcaagaaaatattagctagccaggtgacttcaccagttcaatgggagaccacaataaaaactcttctaacaaaagggctaaagaagagttacgaattaggacctggaaaggttattgctggtattgtcaagaggatggacagaggtgctgaaattgagaacattggtgcctgagcattgcatcgagggacatcatcggtgatttttttcctcgagtttttgaatgttaacgttgttatgatctttcatcaagtagcataatgaacttggattataagataactttctgaaactcagtagatattaatgtgatgaaaccatacacactatcagtatttatgtggttcttgataatttcacttttgtctttcacttaatgtgaagctgggcagagaaatcagctcagcagaacatgg

SEQ ID NO: 3924 - DNA, 1344 bp, Capsicum annuum
gctcagattagattcgtctttgttttaagtatataaacacttctgctaaactgcatgcttttctccgccttcaccattaacaccactgagtcgacttgctcatcaacaacaatgagctgttcatcatccactttgattcttccttctgtcgttactaagaatggatttcgaagattcagtagtaaacaacaattggataagtctagggtttttatgaccagcatttccgttggatctcgagctgctgcttctgccgtcgttgatgatgcgttgtttgctgattataagcctaccaatgcttttctcttccctggacagggagcacaagctgttggaatgggtgtagaagctcagaaggtgcctgctgcggccgaattatacaagagagcaaatgaaatcatgggctttgaccttttggatatatgtattaatggtccaaaagagaagttagattctactgttctaagccagccagctatctatgtcactagcttagctgcggtagagatgctccgtgctcgtgaggggggtcagctaataattgattctgttgatgtcacatgtggtctgagcttgggcgaatacactgctctggcatttgctggagctttcagttttgaggacgggcttaagctggttaagcttagaggagaagctatgcaggatgctgctgatgctgcaaaaagtgcgatggttagtataattgggctggattctgataaggttcagcaactgtgtgatgcagctaacgaggaagttgatgaagccaacaaagttcagattgctaatttcttatgccctggaaattatgcagtctctggaggtgttaaaggaattgaagcggtagaagcaaaagcaaaatcattcaaagcacgaatgacggtacgtctagctgttgctggcgctttccacacaagttttatgaatcctgctgtctctagattagaaactgctttgggtgcaacagagatcagaactcccagaataccagtaatatcgaatgtagatgcacaaccacacgcagatccagacacgatcaagaaaatattagctagccaggtgacttcaccagttcaatgggagaccacaataaaaactctcctaacaaaagggctaaagaagagttacgaattaggacccggaaaggttattgccggtattgtcaagaggatggacagaggtgctgaaattgagaacatcggtgcctgagctttgcattgaggacatcatcggtggttattctttgagtgaattcgagcttgagtttttgaatgttagcgccattatggtttttctgaacctcggtagttgttaacgttatgaaaccatacatactctacgcga

SEQ ID NO: 3925 - DNA, 1516 bp, Nicotiana benthamiana
gtttctcatagtataaatcgtctctctagtcccaaatgcatgcattcctccgccaacatcaataccatccactgagtcgactcgctcttccatcaactcggtctcacgctcaatccatcttcacaatgagctcatcctcctctttgcttcttccttccatttctctccataaccgcgccccgctccccctctccagctcgaattgcttcgtttcaagcaatgacacccgaagatttagccctatacatttggataagtctagggttttcatgagcgtttccgttggatctcgaactgccgtcgatgatgccttgttcgctgactataagcccaccaatgctttcctcttccctggacagggggcacaatctgttggaatgggtgcagaggctcagaaggtgcctgctgcagctgaattatacaagagagcaaatgaaattatggggtttgaccttttggatatatgtattaacggtccaaaagagaagttagactccactgttttaagtcagccagctatctatgtcactagcttagctgcggtagagatactccgtgctcgtgagggaggtcagcaagtaattgattctgttgatgtgacatgtggtctaagcttgggcgaatacactgctctggcgtttgcaggagctttcagtttcgaggatgggcttaagctggtcaagctaagaggagaagctatgcaggatgctgctgatgctgcaaaaagtgcaatggttagtataattggactggactccgagaaggtacaaaaactgtgtgatgcagctaatgaggaagttgatgaagcaaacaaagttcagattgcaaacttcttgtgcactggaaattatgcagtctccggaggtcttaaaggagtggaagtggtagaagcaaaagcaaaatcattcaaagctcgaatgacggtacgtctagctgttgctggtgctttccatacaagttttatgaatccagctgtctcaagactagaagctgctctaggtgcaacagagatcagaactcccagaataccagtaatatcaaatgttgacgcgcaaccgcatgcagatccagacacaattaagaaaatattagctcgccaggtgacttcaccagttcaatgggagaccacagtgaaaaccctcctaacaaaagggctaaagaagagctatgaattaggacctggaaaggttattgccggtattatgaagaggatggacaaaggtgctgtgattgaaaacatcggtgcctgagctttgcattaaggacatcatccgtgcttattctttgagctacttcgagcttcagttattgaatgtcaatggcagtatcggctttcgatagatattgatgcggtgaaaccgtacatattctatgcaagtgttattgttaaatcaatatttatggttgccctggtaatttttctttctttaacttaatgtgaatctgggcagagaagtaagcttagccgaccatgatatagtgttgccttttccatgtgagtagaataattaaattc

SEQ ID NO: 3926 - DNA, 1508 bp, Nicotiana benthamiana
agtataaatcatctccttagtcccaaatgcatgcattcctccgccaacatcaacaccatccactgagtcgactcgctcttccatcaacggtctcacactcactccatctccacaatgagctcatcctcctccttgcttcttccttccatttctctcaataaccgcgacccgctctccctctccaggtcgaattgcttcgtttcaggcaatggtatccgaagatttagccctatacagttggataagtctagggttttcatgagcgtctccgttggatctcgaactgccgtcgatgatgccttgttcgctgactataagcccaccaatgcttttctcttccctggacagggagcgcaatctgttggaatgggtgcagaggctcagaaggtgcctgctgcagctgaattatataagagagcaaatgaaatcatggggtttgaccttttggatatatgtattaacggtccaaaagagaagttagactccactgttttaagtcagccagctatctatgtcactagcttagctgcggtagagatactccgtgctcgtgagggcggtcagcaaataattgatactgttgatgtcacatgtggtctaagcttgggcgaatacactgctctggcgtttgcaggagctttcagtttcgaggatgggcttaagctggtcaagctaagaggagaagctatgcaggacgctgctgatgctgcaaaaagtgcaatggttagtataattggactggactccgagaaggtacaaaaactgtgtgatgcagctaatgaggaagtcgatgaagcaaacagagttcagattgcaaatttcttgtgcactggaaattatgcagtctccggaggtcttaaaggagtggaagtggtagaagcaaaagcaaaatcattcaaagctcgaatgacggtacgtctagctgttgctggtgctttccatacaagttttatgaatccagctgtctcaagactagaagatgctctaggtgcaacagagatcagaactcccagaataccagtaatatcaaatgttgatgcgcaaccacatgcagatccagacacaattaacaaaatattagctcgacaggtgacttcaccagttcaatgggagaccacagtgaaaaccctcctaacaaaagggctaaagaagagctatgaattaggacctggaaaggttattgccggtattgtgaagaggatggacaaaggtgctgtgattgagaacattggcgcctgagctttgcattaaggacatcatccatgcttattctttgagcgacttcgagcttcagtttgttgaatgttaatggcagtatagcctttcaatagatattgatgcggtgaaaccgtacatattctatgcaattgttattgttaaatcagtgtttatggttgccctggtaatttttctttctttcacttaatgtgcatctgggcagagaagtaagctcagcagaccacgagatagtgttgccttttccgagtgagaatagaataattaaattc

SEQ ID NO: 3927 - DNA, 1363 bp, Plantago ovata
aagaattcagctgctgttggaagctccttcaggagctacaatggtttgggattcaggaacgatgtacgccgtatttctccttggaatgtggagaaatctagggttttaatgagtgtcgccgtcggatcgcaggctaccaccgccgtcgaggacacgctttttaaggattacaagccttcttctgttttcctctttcctggtcagggtgcacaagctgttggaatgggcgttgaggctcaaaaggtgcctgctgcagctgaactgtacaaaagagcaaatgatatattggggtttgacctgttggatatttgcataaatgggcctaaagagaagcttgattctacggttctaagccagccagcgatctatgtcacaagtttagctgcggttgaggtgctccgtgcccgtgatgggggccagcagattattgattcagtagatgttacttgtggcctgagtttaggagaatacactgcccttgcatttgctggagctttcagctttgaggatgggttgaagctagtgaagttaaggggtgaagccatgcaggatgctgctgatgcagctaaaagtgccatggttagcatcattggactagactccgcaaaagtgcaactactttgtgatgctgccaatgaagaagtagatgaggcagatagagttcaaattgcaaatttcttgtgcacaggaaattatgccgtctctggtgggcttaaaggaattgaagctgtggaagcaaaggcaaaatccttcaaggctaggatgacggttcggttagccgtagctggtgcttttcacaccagttttatggaaccagctgtatcaagactagaagctgctttggcatcaacggagctcagagtccccagaataccagttatatctaatgttgatgcagagccacacgcaaatccagacacaattaagaaaatacttgctcgccaggtgacttctccagttcaatgggaaacgacggtaaagacattgttgagccgaggactgaagaagagctatgaattaggacctggaaaggtcattgctgggattgttaaaaggatggacaaaggtgctgaaatcgagaacattggagcataagcatttctggtttccacagtctgagcctttcgttaatgctttgccaaaatttactgcttaagcaagcagaagcttcacccaattgccgttctattctgtcactcagatattgtgactaaatgcgttattaaaagtgtatgtctagtaacttcaattttgagcatgagccataaatgtaatagtagcaatatgtacaagtctgtcatttctttgtaactttgccgacgtgttctaatttaatgtgaaagcattgatttacatacttgaa

SEQ ID NO: 3928 - DNA, 1622 bp, Mimulus guttatus
taggactagtagtaccgtcgactggcgagatttctgaagcgagtgttcttggttaactccgccaaacatcaccttaatttattaatgcatgcaagaacaacacttgttttccaccactacaccgccattaatcagctaattcgattcaatccaatcgccaaattctcccctctctctacagccatggcttcttcgatcgtacttccgtcgatctctctcgccaccaaatccctcagaagctccagctgtttgggttacaaaaatgagattcgaatggctccccggttgaatttggagaaatctagggttttcatgagcgtcgccgtcggatcggaggcggttgttgtcgacgatgcgttgttcaaggactacaccccttcttccgctttcctctttcccggtcagggtgcacaaactgttggaatgggtgtggaagctcaaaaagtacctgctgcagctgaattgtacaagagagccaatgatatcttggggttcgaccttttggatatttgtgttaatggaccaaaagagaagcttgattccactgttctaagccagccagctatctatgttacaagtttagctgcagttgaggtgctccgagctcgtgatggaggccagcaaataattgattctgtcgacgtaacttgtggtttaagtttaggagaatatactgcccttgcatttgctgaagctttcagctttgaggatgggctgaagctagtcaagttaaggggtgaagcgatgcaggatgctgctaatgctgccaaaagtgcgatggttagtattattggacttgattctgctaaagtccaactgctttgtgatgccgccaatgaagaagtagatgaagctaataaagttcaaattgcaaatttcttgtgcacgggaaactatgctgtgtctggggggcttaaaggaatagaagcagttgaagcaaaggcaaaatcatttaaggctcgaatgacagttcggctagctgtagctggtgctttccacactggttttatggagcccgctgtgtcaagactagaagctgttttggcgtcaactgtaatcagaccgccgagaattccagttatatccaacgttgatgcacaaccacatgcagatccagatactatcaagaaaatactagctcgccaggtgacttctccagttcaatgggagacaacggtgaagactttgttaagcaaagggttgaagaagagctacgaattaggacctggaaaggtcatagccgggatcgtcaaacggatggataaaagtgctgaaattgagaatattggtgcctaagcactatcttcggagttgctaatttaatagcattttgtcattgctttttcggcaaaatctttcttcttaggcaaactgcttcttatagagccaataggagcttcatttatcgttgtttattacagggttatgtcgttaaaaaactaagcagatgtatctgtagtttcaattttgagcaccaaatatgtaatgactaaatcaaaaggagtaataaaatgcaattgtagccgttattttggagatttgagtacgtaagctcgacattctggcattgttacgatcaccgaatctggccatggaattcaattaagttattttggtgttta

SEQ ID NO: 3929 - DNA, 1688 bp, Theobroma cacao
ccggtttcattggttttgaagccaatccccaacgtctgcctttgtaatctccgctaaacacctatatgtatatatattggaacaacgattccgtatgcacactctgcttcacctgcgccttgcttcttccgccaattcccactactctctcttcgcaatgtctgctgcctctctcgctctcccttcttctctttcttcgctccgcgccaatggagctgctccacctcgatgcttccgcctccacaatccctctcgatctagggttttcatgagcgtttccgtcggatctcaagctgtcgtcgatgatgccttgttcgctgattacaagcccacctccgctttcctctttcccggtcagggcgcacaagcagttggaatgggaaaagaggcgcagagtgtgcctgctgctgcagaattgtacaagaaggcaaatgatatattaggttttgatcttctggatgtttgcatcaatggtcctaaggaaaagttagattcaactgtcattagtcagcctgctatttatgtcacaagtctagctgctgtggagctgcttcgaactcgtgatggaggccagcagattattgactctgttgatgtgacatgtggcctcagcttgggagaatatactgcactagcatttgccggggcctttagctttgaggagggactgaagctggtcaaactaagaggagaagcaatgcaggaagctgctgatgctgctaaaagtgctatggtcagtgtcataggacttgattctgagaaggttcagcagttatgtgatgctgccaaccaagaagttgatgaagctgataaagttcagattgcaaattatttgtgtcccggaaattatgcagtatctgggggtgtcaaaggagtggaggcagttgaagctaaagcaaagtcattcaaggctcggatgacggtgcgtttagctgttgctggtgcttttcacactagtttcatggatcctgcagtctcaagactggaggctgcattggcagcaacccaggttagaaccccaagaatacctgttatatcgaatgttgatgctcagccacatgcagattctgagacaataaagaacatactagcacgtcaggtgacatctcctgttcaatgggaaacaacagtgaaaactttgctgaccaaagggctgaagaagagttatgagttggggcctggaaaggttatagctggcattgtgaagagaatggataaaggtgccgagattgagaacattggtgcttgaggaatcattagatgtaactatttgagttattccatacaaccatgtcaaaaaacggtgtaccattttgttctgagggcagagtttacgtattcaatccaagccaaggaaaatctagttgcggttttgcactgttagttatgaccagattgaggactgtctagccatgttccgagacttgttgtttgtgtttgctgagcgtcggatttcaggaaacaaatgagcaagttaattaggcaggaagaaatacctaagaacacatgcttaagttcatcatcttcaattcttttaagctgcagtggcaacattcttctagttaatttccttaggcatatcttgtgttataagaactcacactagtttgtttcctgagttccactgttggacaatgtcattgatgcttttctaaatttgttcaataacagttccagcattccccaaa

SEQ ID NO: 3930 - DNA, 1991 bp, Gossypium raimondii
acagatcacaccatctgaaggacatacggaaaatactaaacaattatcttgcttaatctgccttgattgcccaaggtccttcctaataattccctttataacaatctagcaagctcgacatctaaaacatgagtccattttgaagttatttgttaaaatttattaatagatatttcaacttgggtagtaattatgttggcgagtaggcagtggcagatgggcggtttctttggttttcaagccaatctccaacgtctaccttcgttatctccgccaacattaacacaaaacgtatttatttaagatagaaaaaatatcaaacaattggcatgcacagtctccgccttgcttcttccgctcattcccagtctctcttcacaatgtccgccgcctccgcttccctcgctctcccttctcccctttcttcgtttcgctccaatggacctcttccttctagatgcttcctccgcctcaacaacccctcaagatctagggttttcatgagtgtctccgttggatcccaaactgtcgtcgatgatgccttgttcgctgattacaagcccacctccgccttcctctttcccggtcagggcgctcaagccgttggaatgggaaaagaagctcaggctgtgcctgctgctgcagaattgtataagaaggcaaataatatattaggttttgatcttctagatctttgcatcaatggtcccaaggaaaagttagattcaactgtcataagccagcctgctatttatgtcacaagtctagctgctgtggagctgcttcgtgcccgtgatggaggcccgcagattattgattctgttgatgtcacttgtggtctcagcttgggtgaatatactgcactagcttttgctggggcttttagctttgaggatggactcaagcttgtcaaactaagaggagaagcgatgcaggaagccgcagatgctgctaaaagtgctatggtcagtatcataggacttgattcggagaaggttcagcaattgtgtgatgctgccaaccaagaagttgatgtagctgataaagtgcagattgcgaattacttgtgtcctggaaattatgcagtatctgggggtctcaaaggagtggaagcagtggaagctaaagcaaagtcattcaaggctcggatgacggttcgtttagctgttgctggtgcttttcacactagtttcatggacccagcagtctcaagattggaggctgcattggcagcaacccagattagaactccaagaatacctgtcatatcaaatgtcgatgttcagcctcatgcagatcctgagactataaagaaaatactagcacgtcaagtgacttctcctgttcagtgggaaaccacagtgaaaactttgctgaccaaagggctgaaaaagagttatgaattggggcctggaaaggtcatagctggcattgtgaagagaatggataaaagtgctgagattgagaacattggtgcttgaggagtgtttttttattagttgtggctactccaccattcatattgaatgatgtgttaatgcaacttggaagttttgaggttttatgaccagacatattgcaaatctagcttgtaatgatggtgtcggttgtgtctatgtgtgtgtttttgttagcattgtttcattagaaagaaataggccaagtaaacaacactcctgtgtcattcatcgtttcaactgcagtgcctacattctgctattcaatttcccaacccatctcttaagccacgactcattcactgtataaatataatttttgggggatattatgtttttcgaggagtgaacaaagtggtttaacttatagttgtcggctaagttggttagaatggttaattatgactgttaaaatagattaactggatctgttatgccctaaaacaaacgagtctaattttatttattatttattatttttaatgtaatttaaagatacgagtgtaattgagcaaagctaaatctgaatggtga

SEQ ID NO: 3931 - DNA, 1488 bp, Catharanthus roseus
atataagatcccagcttaattagatgcatgtttttttccatcgccccttcatcggttttcgcttcaatcccaccatttcttcagctagcttttgttcttgctcgttttcacaatcgaattccattttcacaaacaccatgagtgcgtcatctttggtgcttccttcttccatttctgtcaacaagaagaagctcgcttttgggtcttcagaatctttcaagttgtgcaattctttgggttttaagaatgggattcgtggctttagccttaaaaatttggataaatctagggtttttatgagtattgcagttggatctcaaactactgttgatgatgccttgtttaatgattataaacccacctgcgcttttctctttcctggccagggtgcacaagctgttggaatgggtgcagaggctcagaaagtgcctgcagctgctgaattatacaagaaggcaaatgaaatattggggtttgaccttttggatatttgcctaaatggaccaaaggaaaagctggattccactgttctgagccagccagctatctacgtcaccagcttagctgcagttgaggtactccgtgctagtgaaggaggtcaacaaataattgattctgtggatgttacatgtggtctgagtttgggagaatacactgctcttgcattttctggagctttcagctttgaggatggcctcaagctggtcaagcttaggggtgaagctatgcaggatgcttcagatgctgcacaaagtgctatggttagtgtcataggattggattctgaaaaggtgcaacagctttgtgatgcagccaatgaagaagttgacgaggctaacaaagttcaaatcgcaaatttcttatgtcctggaaattacgcagtctctggaggagtgaaaggagtagaagccgtggaagccaaggcaaaatcattcaaagctagaatgacggtgcggctagctgttgccggtgctttccacactaggtttatggaaccagccgtctcaagcttagaagctgctttagcagcaacagaaatcagaaccccaagaataccagttatatcgaatgttgatgcacagcctcatgctgatccagatacgatcaagaaaatcttggcgcgccaggtaacttcccctgtacaatgggagacaacagtgaagacactgcttactaaaggagtgaaaaagagttatgaattaggacctggaaaggtcattgccggaatcgtgaagagaatggataaaagtgctgtccttgaaaacattgtcgcttgagtacacttgtctgtcctagtttagacaatttttgcctgatttaggaccttatcattttttgtaacctgaaaatgcttcattcttctcttttgtagacttcttttttttgaactcaatatgctaatttgattgtgttaagagatttgctatgtaagagagcttatcaatggaagtatcctttcaataaaaaatgaatcatcattctatccta

SEQ ID NO: 3932 - DNA, 1726 bp, Gossypium hirsutum
aaaaatactcaacaattatcttgcttaatctgccttgattgcccaaggtccttcctaataattccctttatatcagtctagcaagctcgacatctaaaaacatgagtccactttgaagttatttgttaaaatttattaatagatatttcaacttgggtagtaattatgttggcgagtaggcagtggcagatgggcggtttctttggttttcaagccaatctccaacgtctaccttcgttatctccgccaacattaacacaaagcgtatttatttaagatagaaaaaatatcaaacaattggcatgcacagtctccgcctagcttcttccgctcattcccagtctctcttcacaatgtccgccgcctccgcttcccttgctctcccttctcccctttcttcgtttcgctccaatggacctcttccttctagatgcttcctccgcctcaacaacccctcaagatctagggttttcatgagtgtctccgttggatcccaaactgtcgtcgatgatgccttgttcgctgattacaagcccacatccgccttcctctttcccggtcagggcgctcaagccgttggaatgggaaaagaagctcaggctgtgcctgctgctgcagaattgtataagaaggcaaataatatattaggttttgatcttctagatctttgcatcaatggtcccaaggaaaagttagattcaactgtcataagccagcctgctatttatgtcacaagtctagctgccgtggagctgcttcgtgcccgtgatggaggcccgcagattattgattctgttgatgtcacgtgtggtctcagcttgggtgaatatactgcactagcttttgctggggcttttagctttgaggatggactcaagcttgtcaaactaagaggagaagcgatgcaggaagccgcagatgctgctaaaagtgctatggtcagtatcataggacttgattcagagaaggttcagcaattgtgtgatgctgccaaccaagaagttgatgtagctgataaagtgcagattgcgaattacttgtgtcctggaaattatgcagtatctgggggtctcaaaggagtggaagcagtggaagctaaagcaaagtcattcaaggctcggatgacggtacgtttagctgttgctggtgcttttcacactagtttcatggacccagcagtctcaagattggaggctgcattggcagcaacccagattagaactccaagaatacctgtcatatcaaatgtcgatgctcagcctcatgcagatcctgagactataaagaaaatactagcacgtcaagcgacttctcctgttcagtgggaaaccacagtgaaaactttgctaaccaaagggatgaaaaagagttatgaattggggcctggaaaggtcatagctggcattgtgaagagaatggataaaagtgctgagattgagaacattggtgcttgaggagggtttttttattagttgtggctagtccaccattcatattgaataaggtgttaatgcaacttggaagttgaggttttatgaccagacatattgcaaatctagcttgtaatgatggtgtcggttgtgtctatgtgtgtgtttttgttagcattttttcattagaaagaaataggccaagtaacaacactcctctgtcattcatcgtttcaactgcagtgcctacattctgctattcaatttcccaatccatctcctaatatccccaaaaa

SEQ ID NO: 3933 - DNA, 1785 bp, Sesamum indicum
gtagtcaattagtgaattatagggcaagaaaggcagtttactggcaatgtcgatagcttatgcagcagcatagccgttggcctaataccgcctgacgacatttctgaagccacttcttcgttaactccgccaaacacctcttttaattaatgcatgcacttgttctccaccacaaccatcgattgcccctctatctcgttcgattcaatcttccgtctgccaaatcttcctctctctccagagcaatgagttcctcagttgtgcttccttcgatttctctgactaaacccgctctcggctcctccgaatccttcagaagctccacctgtttgggtttcaagaatgagattcggagggtttcccggttgggtttggggaaatctcgggttttcatgagcgtcgccgtcggatcggaggcggttgtggtagacgatgcgttattcaaggattacaagccttcttctgctttcctctttcctggtcagggtgcgcaagctgttggaatgggtgtggaggctcaaaaagtgcctgctgcagctgaattgtacaagagagctaacgatattttggggtttgaccttttagatatttgcattaatgggccaaaggagaagcttgattccaccgttctaagccagcctgctatctatgtcacaagtttagctgcagttgaggtgctccgagctcgtgatggaggtcagcagataattgattctgtggatgtaacatgtggtctaagtttaggagaatacactgctcttgcatttgctggagctttcagctttgaggatgggctgaagctagtcaagttaaggggtgaagcaatgcaggatgctgctgatgctgccaaaagtgctatggttagtattattggactagactctgctaaggtgcaacaactctgcgatgcggccaacgaagaagtagatgaagcaaataaagttcaaattgccaatttcttgtgccctggaaattatgctgtttctggaggccttaaaggaattgaagcagttgaagcaaaggcaaaatcatttaaggctcgaatgacggtccggttagctgtagctggtgctttccatactggcttcatggaaccagctgtgtcaagactggaagctgctttggcatcaacagtaatcagaagcccaagaataccagttatatcaaatgtcgatgcagaaccacatgcagacccgaacacaatcaagaaaatactagctcgccaggtgacttctccagttcaatgggagacaacagtgaaaactttgttaaacagaggacttaaaaagagctacgaattaggacctggaaaggtcatagctggcatcgttaaaaggatggataaaggtgccgacatcgagaatatttgtgcctgagcctatccttaaggtgcttattctgtgccttttcatccatgctttgccaacatctttattctgagccatttcatcagtgcttcggcaaaacctttcttggtgaaactgcgtaggataaatgccagtaggagctccaatttggattgttacctctaaaattagggtataaaacgctatcgagatgtatctgtagtttcaattttgagcatgagtgtcacatatatatataaaaggggacagtaaatgttattgtttccatatttgtgagtaatcatttgaaattgaggtgtgcaacttgagattttgaccttattacaatttgatcaagctaggaatgtggaggtatgagcaagatcaaccagattgaaaattttaagttgctacttggtgttgatatttaaagattatg

SEQ ID NO: 3934 - DNA, 1827 bp, Panax ginseng
aagcagtggtatcaacgcagagtacatgggggataaatccgaggcttgaatgcatgcatttcttcacagtcgaatcattcgattgaatccatctacctcttcgtttggatttctcagtctctcatcaccttcaatttctctctccataatgagttcctctctcatccttccttccatttctacccaaaagctcactttttcggatgcccctgagtcgttgaggagctcaaattatttgtgttttaggggtttcaagaatggaattcgcgaatttagtcctagaaatttggataaatctagggcttttatgagcgtttctgttggatctcaaactgccgtcaatgatgatttgttctcggattataagcccacctctgcttttctctttcctggccagggtgcacaagctgttggaatgggtgtggaggctcagaaagtcccagctgccgctgaattgtacaataaagcaaatgaaattttggggtttgaccttttggatgtttgcattaatggaccgaaagagaagctagactccactgttttgagccagccagctatttatgtcactagcttagctgcagttgaggtcctacgtgcccgtgatggaggtcagcagataattgattctgtagatgttacatgtggtctaagcttgggagaatacactgctttagcatttgctggagccttcagcttcgaggatggactcaagctggtgaaactaaggggtcaagccatgcaggaagctgcagatgctgctaaaagtgctatggtcagtgtcattggactggattcagaaaaggtgcaactgttgtgtgatgctgctaatgaagaagttgatgaagcaaataaagtcaaaattgcaaatttcttatgccctggtaattatgcagtctctggaggtgttaagggagtggaagccttagaagctaaagcaaaatcattcaaggctcgaatgacggtacgtctagcagttgctggtgcttttcacaccagtttcatggatccagccgtctcaagattggaagctgctttggctgcaacagaaattagaattccaagaataccagttatatccaatgttgatgcacaaccacatgcagatcctgaaacaattaagaagatattagcacgtcaggtgacttctcctgttcaatgggagacaacagtgaagactctcctaaccaaagggttgaggaagagctatgaattaggacctggaaaggttatagctggcattgtgaagagaatggatagaggtgctgagattgaaaatattagtgcttaaggagcttaacagtggtccgtcttcctcgaactttactgggaataacatttggagctccagttttggagtgatgaccacttagaagttgttgtattgtagacttgagctttaagtagagtgttttcccccttttaccgtgcaggtgaattttgatagatgttgtgcaagagagctaaatgatgatgcttattatttggttggcatagttttagatcgctgcattgtaaagttaaaaataaaatacaaaattgtaatcatgctgatttgaggttgtattagctcacaattggaatttagtcggtggttatttagtatcgtcaacaattttattgggaaaagtcgatctcccccagagtcgtctcatttccctctgtaggagttccttcatatcataattctcacaattatgtatatcgaactgttagcatgagcttggccgcttgggcatcttagttttacaagttaaggcaaaatatatccagattaggattcactaccataatatgcacctttgttaatctttttcatatgatgccagg

SEQ ID NO: 3935 - DNA, 1699 bp, Vitis vinifera
caaaatgtttggaaagcatcgctagaatcgaacaacctaagcccacattccttatggcgttggccagttcctttggttttaaagtcacctccaccggctccattcagctttgtaaactccgctaacctacgcatgctgcacgctatatagtcctctgctcccattgcatgcctctccaccttctcgctcaccctcacctccttatcctacgccgtcctcgttcccattcagtctccgccatggcttcttcgcttcttctcccatcagtctctcccaggaacctctctttcagcgcttctcactcgttccgcggctttaacctctcgggtttcagccctagaaatgtaggcagatccagggtttccatgagcgtttcggtggggtccaggacctgcgttgatgacgcgttgtttgcggattacaagcccacttgtgcttttctctttcctggtcagggtgctcaagctgttggaatgggttcagaggctcaaagtgtgccagctgctgcggacttgtataagaaagcaaatgacattctcggatttgaccttctggatgtttgcatcaatggaccaaaagaaaagctagattctactgttttaagccagccggccatatatgtcacaagcctagctgcagtagaggtgcttcgtgctcgtgatggaggtcagcagataattgattctgtagatgtcacatgcggtctaagcttgggagaatacactgctttagcatttgctggagctttcagctttgaggatggactcaagctggtcaaattaaggggtgaagcaatgcaggatgctgccgatgctgctaaaagtgctatggtcagtgtcattggactagattcagaaaaagtccaactgttgtgtgatgcagccaatgaagaagttgatgaagataataaagtccaaatcgcaaatttcttatgccctgggaattatgcagtctctggaggagtgaaaggagtggaagcggttgaagctaaggctaagtcattcaaggcccgaatgacggtgcgtcttgcagtggctggtgctttccacactcatttcatggaacctgctgtctcaagattggaagccacactggcagctacggaaatcagaactccaagaatcccagttatatcaaacgttgatgcacagccacatgcagatcccgacacgattaagaagatattggcgcgtcaggtgacttccccagttctatgggaaacaacagtgaagactctcctaaccaaaggactaaaaaagagttacgaattggggcctggaaaggttatcgctggcattttcaagagaatggacaaaactgccgacttagagaatgttagtgcttgattgagctgggaatcagaggttatgcgctgcgttttgtttcttcccatttctgccgtgaatcgaatctttagcttcttggtgcagtgggtataggttcctttttgaagccaaaccaagccaagatcttgaatttttaagatttgttcaaccgtattgtaccttcagtttatcattggagagcttgttggattcatgtagtttcggagagttatattgaatattgtttattaccaatgtcttagaattgctgcattactcaaagaaatgaagtggaactactagagtcttcagttttcccttttcaacttcaatttcaatgcccttcatttgctgaatcggtcgtttataaagat

SEQ ID NO: 3936 - DNA, 1467 bp, Olea europaea
cactgtaaccatttcccctccctcaatatcaatagatccgtagcatcttccttttcacccttttttatcgactatggcttcttcatctcttgtgcttccttctatttccctcagaaggagctcaatttcaactattaatttgggtttcaggaatgaaatttcaagaatttccctcaagaatttggatagaggaggtaaggttttcatgagcgtcgctgttggatctcaagccactgtcgtcgacgatgcgctcttcaaagattataagctttcccgtgctttcctctttcctggccagggtgcacaagctgttggaatgggtgtggaggctcaaaatgtgactgctgcagctgaattatacaagagagcaaatgatattttggggtttgaccttttggatgtttgcatcaatggaccaaaagaaaagcttgattccacggttttaagccagcctgctatctacgtcacaagtttagctgctgttgaagttcttagagctcgtgatggaggtcaggcaataattgattctgtggatgtcacatgcggtctaagcttaggggagtacactgctcttgcatttgctggagctttcagctttgaggatgggctcaagctggtcaagttaaggggtgaagctatgcaggatgctgctgatgctgctgaaagtgccatggttagtatcattggactggactctgaaaaggtgcaacagctgtgtgatgcagccaatcaagaagtggatgaagcggacaaagttcaaattgcaaatttcttatgtcctggaaattatgcagtctctggaggcttgaaaggaattgaagcagtggaagcaaaggcaaagtcattcaaggcccgaatgacggttcgtttagcggtagctggtgctttccacactagttttatggacccagctgtctcaagattggaagctgctctggcatcaacagaattgaggactcccagaataccagttatctccaacgttgatgcccaaccacatgcagatccagacacgataaagaaaatactggctcgtcaggtgacttctcctgttcaatgggagacgacagtgaagactctgttaaacaaaggagtcgaaaagtgttatgaattgggacctggaaaggttatagctggcattgtcaaaagaatggacaaaagtgctgacattgagaacattggtgcctaggcatgaacgttacctctaattgctcaatctatgccttcccatcaaagatatggcatatttttatcgctgtaagttaatagaaactcaagttctgactgatttggatgagtgtgggtcaaacaccattcactagtatctatctgtgaactggaattttgagcattgcattcactcggatgagatctaaataacacaacttcgaatcttgtctgttgccaaacaaagacctctaccaattcaatggtgagtcgtgatatcaacgggacgtggtatgttct

SEQ ID NO: 3937 - DNA, 1796 bp, Quercus alba
atgggggaaacccgaaaggcagttggcagttatcgttggttttcaagcccaattccaacgactttttaacttggtaaactccgccactctaaaacctctcggactctccaaagcattatatctgtctcacacaacacactcactcgtacatgcactcccacctccaccgttctcttattcagcgcacactttcttcttcgtcttcacgctttgctcttccacccttctcaaattcactttcaacaatggcttcctcttctctcactctcccttccatttctctccacaagcagcttcctttcaatgcctcctcctccaattccctgcggattcgaagccttcgacctcggaatccagaccgatctagggttttcatgaccagcgtctcggttggatctcaggccctcgttaatgattccttgttctccgattacagccccacctcagctttcctttttcccggccagggtgcccaagcagttggtatgggaaaggaggctcaaaatgtacctgctgctgcagaattgtacaagaaagcaaatgacatattagggtttgaccttctagatatttgcatcaatggaccaaaagagaagctagattcgactgttataagccagccagctatctatgtcacaagtctagctgcagttgagctatttcgtgtgcgtgatggaggtcagcagattattgattcagttgatgtcacgtgtggcctaagcttgggagaatatactgctctagcatttgctggggcttttagctttgaggatggactaaagctggtcaaattaaggggagaagccatgcaggaagctgctgatgctgctaaaggtgccatggtcagtataataggactggattcagaaaaggttcaacagttgtgtgatgcagccaatcaagaagttgacgaagctgataaagttcagattgcaaattacctgtgtcctggaaattatgctgtatctggaggtgtgaaaggagtggaagcattagaagccaaagcaaagtcattcaaggctcgaatgacggtgcgcctagctgttgctggtgctttccacaccagttttatggaaccagctgtctcaagattggaagctgcattagcagctacggagatcagaactccaaaaataccagttatatccaatgttgatgcacagccacatgcagatcctgacacaattaaaaagatattggctcgtcaggtgacttctcctgttcaatgggaaacaacagtgaagactctcctgaccaaggggctgaagaagagttatgaattggggcctggaaaggttatagctggcattgtgaagagaatggacaaaagtgcagtcattgagaatgttggtgcttgagaaggccattaaagggtagctacttcactagcatccccatcaccttgtgaacacatctgtagcatttgaagtttgagctgaggatccatattcaagtcaaacccagagaagacatttggaaattcaatttttggttagcatagaccagtcttagatttttcattccgcatgataatggaccgatttgagagttgtttcagtcaaattgtcaattgttgtccagagttccaaaatggttctgtactatcatggttatctacttgtaatggtagtgcatgagagttagtggtggccatatttatagattgctgcattgtatgagataagatgagtgaataaatcatatgagggaggttgtagtggcaactgccattggtttgaaatttttatcagctcgttatggatggtatggaattttattttggatttccgatcaca

SEQ ID NO: 3938 - DNA, 1438 bp, Castanea mollissima
aattccctgcagattcgaagccttcgacctcggaatccagaccgatctagggttttcatgaccggcgtctcagttggatctcaggccctcgtcaatgattccttgttctccggttacaaccccacctcagctttcctttttcccggccagggtgcccaagcagttggtatgggaaaggaggctcaaaatgtacctgctgctgcagaattgtacaagagagcaaatgacatattagggtttgaccttcttgatatttgcatcaatggaccaaaagagaagctagattcgactgttataagccagccagctatctatgtcacaagtctagctgcagttgagctatttcgtgtgcgtgatggaggtcagcagattattgattcagttgatgtcacgtgtggcctaagcttgggagaatatactgctctagcatttgctggggcttttagctttgaggatgggctaaaactggtcaaattaaggggagaagccatgcaggaagctgctgatgctgctaaaagtgccatggtcagtgtaataggactggattcagaaaaggttcaacagttgtgtgatgcagccaatcaagaagttgacgaagctgataaagttcagattgcaaattacctgtgtcctggaaattatgctgtatctggaggtgtgaaaggagtggaagcagtagaagccaaagcaaagtcattcaaggctcgaatgacggtgcgcctagctgttgctggtgctttccacaccagttttatggaaccagctgtctcaagattggaagctgcattggcagctacagagatcacaactccaaaaataccagttatctccaatgttgatgcacagccacatgctgatcctgacacaattaaaaagatattggctcttcaggtgacttctcctgttcaatgggaaacaacagtgaagactctcctaaccaaggggctgaagaagagttatgaattggggcctggaaaggttatagctggcattgtgaagagaatggacaaaagtgcagtcattgagaatgttggtgcttgagaaggccattaaagggtagctacttcactagcatccccatcaccttgtgaacacatctgtagcattttggagtttgagctgagaatccatattcaagtcaaacccagagatgacatttggaaattcaatttttgggtagcatagaccagtattagatttttcaatctgcatgataatggaccaatttgagagttccaaaaatggttctctactatcatggttatctacttgttatggtagtgcatgagagttagtggtggccatatttatagattgctgcattgtatgagataagatgagtgaataaatcatacgagggaggttgtagtggcaactgccattggtttggaatttttatcagctcgtaatggatggtatgaaattttatttttgattt

SEQ ID NO: 3939 - DNA, 1248 bp, Flaveria ramosissima
gggggtattaaaagtgggtttcagcggcttaatttggagaaatctagggtttctatgagcgtatctgttggatccgccactgctgttgatgatgctttgtttgctgattataagcctaccacagccttcctcttccctgggcagggggcacaagtagttggaatgggacaggaggctcacaaggtgcctgctgctgcagagttgtacagtaaggcaaatgaaattttagggtttgacatcttggatgtttgcattaacgggccaaaagaaaagttggattccactgttttaagccagccagctatctatgttactagtctagctgctgtagagatactacgtgctcgtgatggtggtcaacacataattgattctgtagatgttacttgcggattaagtttaggggaatacacagctcttgcatttgctggggcatttagctttgaggacggtctcaagctggtcaaactaagaggtcaagcaatgcaggaagctgcagatgctgctaaaggtgctatggtcagtatcattggactagattcagataaggtgcaacaactctgtgatgcagccaatgaagaagtcgaggaagctgagagagttcaaattgcaaatttcttgtgcactggaaattatgcagtctcgggaggcgtgaagggaattgaagctgtggaagcaaaagcaaagtcattcaaggctcgaatgacggtgcgccttgctgttgctggggctttccacaccagattcatgaaccctgctttatcccaactggagtctgctttgtcagcaacccaaatcaaaactcctagaataccagttatatctaatgtcgatgcgcagccacatgctgacccagagacaatcaagaaaaatcttggctcgccaggttacatcaccggtccagtgggaaacaacggtcaagactcttttatcaagaggactggaaaagagttatgaacttggacctggaaaggttattgctgggattgtgaagagaatggacaaaacatcaccaattgagaacattagcgcctgaacgtgggcttgatttgttgccattctacataacggatgaattaaagtttcattgtggtaggagcataaagcgattttggagcttatatttgaccaaatttatgcagcccagcttttgtgtatgattataaagtttgttagtgatgtatttgtatcacgattacacgctctctgactagtgatggttattatgagtcgttttcaagtgatttg

SEQ ID NO: 3940 - DNA, 1498 bp, Tabernaemontana elegans
ctaactaacaataccaacgctcactctacactctagccatgctctttctcactatataacatccagctacacttaatgcatgctctcttccactggcctctcattggtttttgcttcaagcccaccatttcttgcgctcgcttttgctctacttcgctctcaggatcaaattgcattttcacgaacaccatgagtgcatcgtctttggtgcttccttcttcgatttctgtcaacaataagctcgcttttgggccttcagaatcgttcaagtgttgcagttctttgggttttaagaatgggattcgcggctttagtcttaaaaatctggataaatctagggtttttatgagcgttgctgttggatctcaaactacggtggatgatgccttgtttaaggattataagcccagctgtgctttcctctttcctggccagggtgcacaagctgttggaatgggcgcagaggctcagatggtgcctgccgctgctgaattatacaagaaggcaaataaaatattggggtttgaccttttggatatttgcctgaatggaccaaaggataagctggattccactgttctgagccagccagctatctatgtcaccagcttagctgcagttgaggtactccgtgctcgtgaaggaggtcaacaaattattgattctgtggatgttacatgtggtttaagtttgggagaatacactgctcttgcatttgctggagctttcagctttgaggatgggctcaagctggtcaagctcaggggtgaagctatgcaggatgctgcagatgctgcacaaagtgctatggttagcgtcataggattggattccgaaaaggtgcaacaactgtgtgatgcagccaatgaagaagttgatgaagctaacaaagttcaaattgcaaatttcttatgtcccggaaattatgcggtctctgggggtgtgaaaggagtggaagctgtagaggccaaggcaaaatcattcaaggctcgaatgacggtgcgcctagctgttgctggtgctttccacactagttttatggaaccagctgtctcaagattagaagctgctttagcagcaacagaaatcataactccacgaataccagttatatcaaatgttgatacacagccacatgccgatccagatacaatcaagaaaatattggcacgccaggtaacttcccctgttcaatgggagacaacagtgaaggcactcttgaccaaaggagtgaaaaagagttatgaattaggacctgggaaggtcattgctggcattgttaagagaatggataaaggtgctgacctggaaaacattgttgcctgagtgccctcctggtctagtttagagtctttaccttctttaggagtcctgtttcatttctgtaatctataaactgctcattcttctgttatgtacacttcaattttgaaccttaatatgctatatgctagctttgtatttgattgaatgagagattgctacgtaagagcttatt

SEQ ID NO: 3941 - DNA, 1645 bp, Arachis hypogaea
tagggactagggagtgaagtaattgagagattgacaccctggtttgtggtttctttggttttgaagaggaacaatccaacatctttgaaatctccgtctcactacaatacccccaagcaacatattttcttatttctgcaaccgaatgcaagctttgcttcaccattcccctcttatccgaacctcacattcttccttctcagctatggcttcttcttcttccctcactctcccttctctctctctcaacaacttcccttcttccccatcaaatgcacattctagaaccttcaaccttcccctccttcgatctagggttttcatgagcgtcgcttccggatctcaggtctccgttctcaacgatgctcccttctccgattacaaaccctccaatgcttttcttttccccggtcagggtgcacaagccgttggaatgggaaaagaagctcagaatgtgcctgctgctgctgttctgtataagaaggcaaatgagatattggggtatgatcttcttgatatatgcatcaatggcccaaaggataagttagattcaactgttcttagtcagcctgctatttatgtcacaagtctcgctgctgtggagctacttcgtgcaagagatggaggacaacagattattgattctgttgatgttacgtgtggtctaagtttgggagaatacactgctcttgcttttgctggggctttcagctttgaagatggacttaagttggtcaaattgaggggagaagccatgcaggatgctgctgatgctgctaaaagtgccatggttagtgtcataggactggactcagagaaggtccaacaattgtgtgatgcggcgaatcaggaagtacccgaagctgagaaggttcaaattgccaattacctttgtcctggtaactatgctgtctcggggggcttaaaaggagtagaagtgctggaatctaaggcaaagtctttcaaggctcgaatgactgttcgcttagctgttgccggtgcattccacactagttttatggaaccagctgtgtcaaggttggaagcagcattggcagcaacagaaatcagaacaccaagaataccagtcatctccaatgtggatgcacaaccacatgcagatcccgagactatcaagaagatattggcacgtcaggttacttcccctgttcaatgggaaacaacagtgaagactcttctaaacaaggggctgaagaaaagttatgaactaggacctggaaaggtaattgctggtattatcaagagagtggacaaaggtgctgatattgagaatataggtgcctgagaagtgagaaggcagtgaaaccttgcttcttctgtgacttccaaattccaatcaacccaatagtaaaccaacattttgtctcgtacaatgtgggagaaaaggttgcatccccaaatcaagagaacatggagcttgggaattttgtaaacatagattagctacagttggatttgaatgccaattttaaagttcagttttagttttaactttcaagaattgacactatcatgatgaacgtgttggactgttgaataatgggtttatttattaaaagatatgtacctaataaacaaaaaaaaaaaaaaacaaaagtactctgcgttgataccactgcttcgc

SEQ ID NO: 3942 - DNA, 1456 bp, Arachis hypogaea
aagcaacactttttcttatttctgcaaccgaatgcaagctttgcttcaccattcccctcttatccgaacctcacattcttccttcccagctatggcttcttcttccctcactctcccttctctctctctcaacaacttcccttcttccccatcaaatgcacattctagaaccttcaaccttcccctccttcgatctagggttttcatgagcgtcgcttccggatcccaggtctccgttctcaacgattctctcttctccgattacaaaccctccaacgcttttcttttccccggtcagggtgcacaagccgttggaatgggaaaagaagctcagaatgtgcctgctgctgctgttctgtataagaaggcaaatgagatattggggtatgatcttcttgatatatgcatcaatggcccaaaggataagttagattcaactgttcttagtcagcctgctatttatgtcacaagtctcgctgctgtggagctacttcgtgcacgagatggaggacaacagattattgattctgttgatgttacgtgtggtctaagtttgggagaatatactgctcttgcttttgctggggctttcagctttgaagatggacttaagttggtcaaattgaggggagaagccatgcaggatgctgctgatgctgctaaaagtgccatggttagtgtcataggactggactcagagaaggtccaacaattgtgtgatgcggcgaatcaggaagtacccgaagctgagaaggttcaaattgccaattacctatgtcctggtaactatgctgtctctgggggcttaaaaggagtagaagtgctggaatctaaggcaaagtctttcaaggctcgaatgactgttcgcttagctgttgccggtgcattccacactagttttatggaaccagctgtgtcaaggttggaagcagcattggcagcaacagaaatcagaacaccaagaataccagtcatctccaatgtggatgcacagccacatgcagatcccgacacaatcaagaagatattggcacgtcaggttacttcacctgttcaatgggaaacaacagtgaagactcttctaaacaaggggctgaagaaaagttatgaactaggacctggaaaggtaattgctggtattatcaagagagtggacaaaggtgctgatattgagaacataggtgcctgagaagtgagaaggcagtgaaaccttgctccttctgtgacttcgaaattccaatcaacccaatagtaaaccaacattttgtctcgtacaatgtgggagaaaaggttgcatccccaaatcaagagaacatggagcttgggaattttgtaaacatagattaggtacagttggatttgaatgccaattttaaagttcaattttagttttaacttttaagaattgacactatcatgatgatgaacgtattggactgaataatgggtttattta

SEQ ID NO: 3943 - DNA, 1506 bp, Echinacea purpurea
cggccgggggacattaaagaatttggcatgttgtttacccaccctacactacagccaccccttgtgatctccgcaacaattttaaaaccctcgtatattaattcaaaaccataaccactgaatgcatgcttgttcctcattttctcagacccttttctagtttcaatcctctctcaacaacaatggcatcttcatcttctctactgcttccatctgtttcactcaaccatcatcagctgaagaacacctcatcttctgtttgtttcggaggccttaaacatggattccgacgtcttaatctggataaatctagggtttctatgagcttatcagttggatccaccactgcggttgatgacgcattgttcgctgattataagcctaccactgctttcctcttccctggtcagggtgctcaagcggttggaatgggacaggaggctctcaaggtaccagctgctgcagagttgtacaatcaggctaatcaaattttggggtttgatatcttggacgtttgcattaacgggccaaaggaaaagttggattccactgttttaagtcagccagctatatatgttactagtctagctgcagtagagatactacgagcccgtgatggtggtcaacagattattgattctgttgatgttacatgtggattgagtttaggggaatacacagctcttgcatttgctggtgcttttagcttcgaggatggtctcaagctggtcaaactaagaggtcaagcgatgcaggaagctgcagatgctgctaaaggtgctatggtcagtattattggactagattcagataaagtgcaacaactctgtgatgcagccaatgaagaagtcgaagaagccgaaaaagttcaaattgcaaactttttatgcaatggaaactatgcagtctctggaggggtaaagggaatcgaagctgtcgaagcaaaagcaaaatcatttaaggctcgaatgacggtgcgccttgctgtcgctggggccttccacaccagattcatgaatccagctttatcccaactggagtccgctttgtcagcaaccgaaatcaaaactccaagaataccggttatatctaatgttgatgcacaaccacatgctgaccctgagacaatcaagaaaatattggctcgccaggttacatcaccggttcaatgggagacaacggtaaagacccttttatcaaggggactagtaaagagttatgaactcggacccggaaaggttattgccggcattgtgaagagaatggacaaaacatcgccgattgagaacattagtgcgtaaggcgcgcttgatttgttgatgttttacaataactgatgaatcaaagttttccttgtggtaagagcataaaaagggattatggagcttatatagagcaaattaatgtagttgagtttttgtgtattatcataagctttgttagtaattgtattcgaatcgattatattatctttgagtctgattattatatcatgagttattttcg

SEQ ID NO: 3944 - DNA, 1484 bp, Helianthus annuus
caaatttggcatcttcatagttcatacccaccctaccctacacccattctagtgatctccgctacaatttcaaaaccctcatttataaatccaaaaccacaaccaccgaatgcatgcttgtttccaactcccctcaatttctcagacatttttctagtttcaatcttctctcaacaacaatggcttcttcttcttcatcatctctactgctcccatcagtctcactcaaccatcatcagctcaagacctcatcttccgtttgtttcggaactcttaaacatggattccgacgtattaatctggacaaatctagggtttctatgagcctatcagctggatccaccactgcaattgatgacgcattgttcaccgattataaacccaccactgctttcctcttccccggtcagggtgcacaagcggttggaatgggacaggaagctcttaaggtgccagctgctgcagagttgtataataaggctaatgagattttagggtttgatatattggacgtttgcattaacgggccgaaagaaaagctggattccactgttttaagtcagccagctatatatgttactagtctagctgcagtggagatactacgtgctcgcgatggtggtcagcagataatcgattctgttgatgttacatgcggattaagtttaggagaatacacagctcttgcatttgctggagcttttagtttcgaggacggtctcaagctggtcaaactaagaggtcaagcaatgcaagaagccgcagatgctgctaaaggtgcgatggtcagtattattggactagattccgataaggtgcagcaactctgcgatgcagccaatgaagaagtcgaggaagccgaaaaagttcaaattgcgaatttcttatgcactggaaactatgcggtatctggaggggtaaaggggatcgaagctgtggaagcaaaagcaaaatcattcaaggctcgaatgacggtgcgtcttgctgtcgctggggccttccacaccagattcatgaatccagctttatcccaactggagtccgctttgtcagcaaccgaaatcaaaactccgagaatacccgttatatctaatgttgatgcacaaccgcatgctgaccctgagacaatcaagaaaatattggctcgccaggttacatcaccggttcaatgggaaacaacggtaaagacacttttgtcgaggggactagtaaagagttatgaactcgggcctggaaaggttattgctgggattgtgaagagaatggacaaaacatcgccgattgagaacattagcgcttgatttgtcgccatttacaataatcgatgagttaaagttttccttgtggtaaaattatgaaaggaggttatggagcttatacagagcaatttaatgtagcttgagttttcgtgtatgatcgtatgctttgttagtaattgtattcggatcgttatattctgttttgggtatgattattattattat

SEQ ID NO: 3945 - DNA, 1062 bp, Flaveria ramosissima
aacgtgggtttcagcggattaatttggagaaatctagggtttctatgagtgtgtctgttggatccaccactgctgttgatgatgcgttgtttgctgattataagcccaccactgccttcttgttccctgggcagggtgcacaagtagttggaatggggcaggaggctcataaggtgcctgctgctgcagagttgtacaataaggcaaatgaaattttagggtttgacatcttggacgtttgcattaacgggccaaaagaaaagttggattccactgttttaagccagccagctatctatgttactagtctagctgctgtagagatactacgtgctcgtgacggtggtcaacagataattgattctgtagatgttacttgcggattaagtttaggggaatacacagctcttgcatttgctggggcatttagcttcgaggacggtctcaagctggtcaaactaagaggtcaagcaatgcaggaagctgcagatgctgctaaaggtgctatggtcagtatcattggactagattcagataaggtgcaacaactctgtgatgcagccaatgaagaagtcgaggaagctgagagagttcaaattgcaaatttcttgtgcactggaaattatgcggtctcgggaggcgtgaagggaattgaagccgtggaagcaaaagcaaagtcattcaaggctcgaatgacggtgcgccttgctgttgctggggctttccacaccagattcatgaaccctgctttatcccaactggagtccgctttgtcagcaacccaaatcaaaactccaagaataccagttatatctaatgtcgatgcgcagccacatgctgacccagagacaatcaagaaaatcttggctcgccaggttacatcaccggtccagtgggaaacaacggtcaagactcttttatcaagaggactggaaaagagttatgaacttggacctggaaaggttattgctgggattgtgaagagaatggacaaaacatcaccaattgagaacattagcgcctgaacgtgggcttgatttgttgtcattctacaataacgga

SEQ ID NO: 3946 - DNA, 1604 bp, Cucumis sativus
ggattttgctgccatcttcacaacgtctatactctttgagaactccgcaaaaacctttgttatttccattgaacactacaaacaaacctccattttttccatagctttcctcttcacattcccaatttgatcttcatccccgtcatggcctcttctttcgctctcccttccactatttctctcaagaaattccctctcaatgcatcctcctctttcagaaatggattccgcactgcatccatttctcgatctagggttctcatgagcgcttctgttggatcccagactttagttgatgattccctgttcttggattacaaacccacttcggcttttttgtttcctggtcagggtgcacaagctgtgggcatgggaaaggaatctcatagtgttcctgctgcagctgacttgttcaacagagcaaatgatatcttagggtttgatcttcttgatgtctgcacaaatgggccaaaggagaaactagattcaactgttataagtcagccagctatctacgtcactagtctagctgcagttgagctacttcgtgcacgtgatggaggccaacaaataatcgactctgttgatgtcacttgtggtctaagcttgggggagtatactgcattagcatttgcaggggctttcagttttgaggatggactcaggctggtcaaactgaggggcgaggcaatgcaggcagctgctgatggtgctaaaagtgccatggtcagtatcatagggttagattcagagaaggttcaacagctgtgtgatgcagctaatcaagaagtcgatgaagccaataaagttcagatagcaaatttcttatgtcctggcaattatgccgtatcaggaggtcttaaaggaatagaagcagtggaagccaaggcaaagtcattcaaagctcgaatgacggtacgtctagctgtagcaggtgcattccatactagtttcatggaacctgctgtttcaagattagaagctgcacttgcagcaacagagattagaactcccagaataccagtcatctccaatgttgacgcacagccacatgcagatcctagcacaatcaagaaaattttggcacgccaggtgacttctcctgttcaatgggaaacaacagtaaaaactctactctccaaggggctgaagaagagttatgaattgggccccggaaaggttatagctgggattgtcaagagagtggacaaaagtgcagaaattgagaatattgcagcttaatcaagtgtagattgaagcaaacagctcactgatggttgcagagttctttccctatctgctctggctatctccctatccatcattgccaaaagcatctaacataaattagtgcaatgctcattgtttagcccccttttcctccgaatgttacaattagttctagagctgcaagtttctaaacaaatgcacgataatctttattagttactaggataattcatcatagttggaagctttccatgagaaataatgtgcaaaatgagttgtatttggtttggttttcaattttgatttgtttgagattgtttcgattagttcagtttgtattctcatcggacttgtttttatgaaacaattaaact

SEQ ID NO: 3947 - DNA, 1651 bp, Gossypium hirsutum
taataattccctttataacaatctagcaagctcgacatctaaaacatgagtcctattttgaagttatttgttaaaatttattaatagatatttctacttgggtagtaattatgttggtgagtacgcagtggcagatgggtggtttctttgatttttaagccaatctccaacgtctaccttcgttatctccgccaacattaacacaaaacgtatttatttaacatagaaaaaatatcaaacaattggcatgcacagtctccgccttgcttcttccgctcattcccagtcgctcttcacaatgtccgccgcctccgcttccctcgctctcccttctcccctttcttcgtttcgctccaatggacctcttccttctagatgcttcctccgcctcaacaacccctcaagatctagggttttcatgagtgtctccgttgaatcccaaactgtcgtcaatgatgccttgttcgctgattacaagcccacctccgccttcctctttcccggtcagggcgctcaagccgttggaatgggaaaagaagctcaggctgtgcctgctgctgcagaattgtataagaaggcaaataatatattaggttttgatcttctagatctttgcatcaatggtcccaaggaaaagttagattcaactgtcataagccagcctgctatttatgtcacaagtctagctgctgtggagctgcttcgtgcccgtgatggaggcccgcagattattgattctgttgatgtcacttgtggtctcagcttgggtgaatatactgcactagcttttgctggggcttttagctttgaggatggactcaagcttgtcaaactaagaggagaagcgatgcaggaagccgcagatgctgctaaaagtgctatggtcagtatcataggacttgattcggagaaggttcagcaattgtgtgatgctgccaaccaagaagttgatgtagctgataaagtgcagattgcgaattacttgtgtcctggaaattatgcagtatctgggggtctcaaaggagtgcaagcagtggaagctaaagcaaagtcattcaaggctcggctgacggttcgtttagctgttgctggtgcttttcacactagtttcatggacccagcagtctcaagattggaggctgcattggcagcaacccagattagaactccaagaatacctgtcatatcaaatgtcgatgttcagcctcatgcagatcctgagactataaagaaaatactagcacgtcaagtgacttctcctgttcagtgggaaaccacagtgaaaactttgctgaccaaagggctgaaaaagagttatgaattggggcctggaaaggtcatagctggcattgtgaagagaatggataaaagtgctgagattgagaacattggtgcttgaggagtgtttttttattagttgtggctactccaccattcatattgaatgatgtgttaatgcaacttggaagttttgaggttttatggccagacatattgcaaatctagcttgtaatgatggtgtcagttgtctctatgtgtgtgtttttgtcagcattgtttcattagaaagaaataggccaagtaaacaacactccggtgtcattcatcgtttcaactgcagtgcctacattctgctattcaatttcccaat

SEQ ID NO: 3948 - DNA, 1358 bp, Castanea mollissima
ctccacaagcagcttcctttcaatgcctcctcctccgactcctcctccaattccctgcagattcgaagccttcgacctcggaatccagaccgatctagggttttcatgaccggcgtctcagttggatctcaggccctcgtcaatgattccttgttctccggttacaaccccacctcagctttcctttttcccggccagggtgcccaagcagttggtatgggaaaggaggctcaaaatgtacctgctgctgcagaattgtacaagagagcaaatgacatattagggtttgaccttcttgatatttgcatcaatggaccaaaagagaagctagattcgactgttataagccagccagctatctatgtcacaagtctagctgcagttgagctatttcgtgtgcgtgatggaggtcagcagattattgattcagttgatgtcacgtgtggcctaagcttgggagaatatactgctctagcatttgctggggcttttagctttgaggatgggctaaaactggtcaaattaaggggagaagccatgcaggaagctgctgatgctgctaaaagtgccatggtcagtgtaataggactggattcagaaaaggttcaacagttgtgtgatgcagccaatcaagaagttgacgaagctgataaagttcagattgcaaattacctgtgtcctggaaattatgctgtatctggaggtgtgaaaggagtggaagcagtagaagccaaagcaaagtcattcaaggctcgaatgacggtgcgcctagctgttgctggtgctttccacaccagttttatggaaccagctgtctcaagattggaagctgcattggcagctacagagatcacaactccaaaaataccagttatctccaatgttgatgcacagccacatgctgatcctgacacaattaaaaagatattggctcttcaggtgacttctcctgttcaatgggaaacaacagtgaagactctcctaaccaaggggctgaagaagagttatgaattggggcctggaaaggttattgctggcattgtgaagagaatggacaaaagtgcagtcattgagaatgttggtgcttgagaaggccattaaagggtagctacttcactagcatccccatcaccttgtgaacacctctgtagcattttggagtttgagctgagaatccatattcaagtcaaacccagagatgacatttggaaattcaatttttgggtagcatagaccagtattagatttttcaatctgcatgataatggaccaatttgagagttccaaaaatggttctctactatcatggttatctacttgttatggtagtgcatgagagttagtggtggccatattta

SEQ ID NO: 3949 - DNA, 1482 bp, Olea europaea
cgcattttatcgactatggcttcttcatctcttgcgcttccttctgtttccctcagaaggagctcaatttcaactaggaatttgggtttcaggaatgaaatttcaagaatttccctcaagaatttggatagaggaggtaaggttttcatgagcgtcgctgttggatctcaagccactgtcatcgacgatgcgctcttcaaagattataagccttcccgggctttcctctttcctggccagggtgcacaagctgttggaatgggtgtggaggctaaaaatgtgactgctgcagctgaattatataagagagcaaatgatattttggggtttgaccttttggatgtttgcatcaatggaccaaaagaaaagcttgattccacggttttaagccagcctgctatctacgtcacaagtttagctgcagttgaagttcttagagctcgtgacggaggtcaggcaataattgattctgtgaatgtcacatgcggtctaagcttaggggagtatactgctcttgcatttgctggagctttcagctttgaggatgggctcaagctggtcaagttaaggggtgaagctatgcaggatgctgctgatgctgcggaaagtgccatggttagtatcattggactggactctgaaaaggtgcaacagctgtgtgatgcagccaatcaagaagtggacgaagcagacaaagttcaaattgcaaatttcttatgtcctggaaattatgcagtctctggaggcttgaaaggaattgaagcagtggaagcaaaggcaaagtcattcaaggcccgaatgacggttcgtttagcggtagctggtgctttccacactagttttatggacccagctgtctcaagattggaagctgctctggcatcaacagaattgaggactcccaggataccagttatatccaacgtcgatgcccaaccacatgcagatccagacacgataaagaaaatactggctcgccaggtgacttctcctgttcaatgggagacaacagtgaagactctgttaaacaaaggagtcgaaaagtgttatgaattgggacctggaaaggttatagctggcattgtcaaaagaatggacaaaagtgctgacattgagaacattggtgcctaagcacgagcatgacctctaattgctcaagctgtgccttcccatcaaagatatggcatatttttatcgctgtaagttaatagaaactcaagttctgactgatttggatgagtgtgggtcaaacactattcactagtatctatctgtgaactggaattttgagcattgcattcactcggatgagatctaaataacacaacttcgaatcttgtctgttgccaaacaaagacctctaccaattcaatggtgagtcatgatatcaaagggacgtggtatgttcattcacagagttactttaagccataatacacaatccggtgctattagaccccctactttgaagaatatgtgatt

SEQ ID NO: 3950 - DNA, 1803 bp, Glycine max
agtattctcagtttgtgaattgaaatgatgtcatcaactatgttctaaattcaccaacccaacgtcttgtaagctccgcccctggacaaaatcaaggtcccatttatgcaagctttgattcacattcctgttcgtttttccttcgcaccttttcttcttcttcgctccgtgccatgtcttcctctctcgctcttccttccactcccttcttcgccaatggaacaagaatcttcgctctcaagcactctctccctcgctctagggtttccatgagcgtctccgctggatctcaggcttccgttcaccaggctttgttcgccgattacaaggcctccacttcattcctcttcccgggccagggtgctcaagctgttggaatggggaaagaagctcaaaatgtgcctgctgctgcggttttgttcaacaaggcaaatgacattttggggtttgatcttcttgatatatgcatcaatgggccaaaagaaaagttagattccaccgttattagccagcctgctatttatgtcacaagtcttgctgctatagagctacttcgtgcacgtgaaggaggtcagcagattattgactcagttgatgttacatgtggtttaagcctgggagaatatactgctctggcatttgctggggctttcagctttgaagatggactcaagttggtcaaactgaggggagaggccatgcaggatgccgctgatgctgctagaagtgctatggttagtgtgataggactggactcagagaaggtccaacaattgtgtgatgcagccaatcaggaagttcctgaagctgagaaggttcagattgccaattacctgtgcccaggaaactatgctgtctctgggggattaaaaggagttgaagtgctagaatccaaggcaaagtctttcaaggctcgaatgacggtgcgcctagctgttgctggtgctttccacactagttttatggaaccagctgtgtcaagattggaagcagcattggcaacaacagaaatcagaaccccaagaataccagtcatctccaatgtgaatgcacagccacatacagatcctaacacaataaagaagatattggcacgccaggttacttcacctgttcaatgggaaacaacagtgaagactcttctaaccaagggtctgaagaaaagctatgaactgggacccggaaaggttattgctggaatcgtcaaaagaatggacaaaggtgctgatattgaaaatatcggtgcttaatgtggggaccttgctccttcttcgggttggaatgaacaaaactaaattgtgttagctataaatcaggatgcgtggaacttgaagctttgaaagcaaggagcagctacagtcatatttgaatgccagttttgaagttaaaatgttaaattataattcacgagttagataagtgattgtacttggcactagaattttttagtttttctaatcttatattcaatctgtctcggagttaattatgcctatgcttctttgtaccaaatatagcttttggcctttacacaggcttaataataattagaagaaacaacactttccattcaattgttatggcaggtagaatttgtaaggcgtattttgcacagcttcaaacatcggttcatgtgtttcaaagcgacaaacggagaagtaactgtatcattggattccaaaaacgtgaattccgttgaaccaaattattttgatgaggtttgaaatatttctaattagaaaagtgaattacgtttttttttatgatgccaaccaaacaacactttctaacttttcaactctt

SEQ ID NO: 3951 - DNA, 1517 bp, Ananas comosus
cggccacctcgaggccgtgttccacgtcgtcctccaccccgccgtccatggcgtctcccgcgtcgccaggcccctcggccccgtccccgtccacgtcgacgtcgcctgctccctccgccgcgcccccggccatgtcgccgccgcagcagctcgaatctcgccgtttccgaggagcttatggagatctagggtttccatgagcgtctccgtcggatcggaagtgtccgtgtcacatgatgcgctcttcaaggattgcaagcccacctgcgccttcctcttccccggccagggtgcccaaactgtcggaatgggtgtggaagctcagagtgtgccggcagctgctgaactatacaagaaagcgaacgacattcttggatttgatctgttagatgtttgcaccaatgggccaaaagagaaacttgattccacagttataagccagccagctatatatgtaaccagccttgctgcagttgaggttcttcgtgcacgtgatggaggtcaagagataattgattctgtggatgtcacttgtggtctgagtttgggagaatatacagctcttgcttttgctgatgcttttagctttgaggatggtctcaagcttgtaaagctaagaggagaagccatgcaggatgctgcagatgctgctagtagtgctatggttagtgtgattggacttgattcagagaaggtgcagttgttatgtgatgctgccaatgaggaagttgacgaggaaaataaagtccagatagcaaacttcttatgccctggtaattatgcggtttctggtggggtgaaaggaattgaagcggttgaagcaaaggcaaagtcattcaaggctcggatgacggtacggcttgcggtggcgggtgctttccacacaagcttcatggagccagcagtctcaagattggaagctgctttggtttcaactgaaattagaactccaaaaatacctgtgatttctaatgtggatgcgcaagctcactcggatcctggtacaatcaagaagattttggctcgtcaggtgacctctcctgtacagtgggaattgacggtgaagacactgttgggtaaaggtctaaagaaaagctatgaattgggacctggaaaggttatagctggaatactgaagaggatggataagggtgctgcgattgaaaatatcggagcttaagcttgctataaaaaagctcattccacttgcatatttctccatcgatgcgaattagaccaaatcgacctttagggtattcaatagttcgcaagcgagagggaatctttgactcataagttatgcgcaatagagtaaagtccatacaagatggttaaatcagtcggtcggggttttattgttcttccatcatgtatgtaattgttctaatcatgattcggcttagaaaacttgccttgtgcactgctgtaatatctcctggctttttcagaaattttgttggatcatttaatctgaacatatgttgtgtgttatctgtttagtcaacaatatgagctag

SEQ ID NO: 3952 - DNA, 1124 bp, Flaveria ramosissima
gggggtcttaaacgtgggtttcagcggattaatttggagaaatctagggtttctatgagtgtgtctgttggatccaccactgctgttgatgatgcgttgtttgctgattataagcccaccactgccttcctgttccctgggcagggtgcacaagtagttggaatggggcaggaggctcataaggtgcctgctgctgcagagttgtacaataaggcaaatgaaattttagggtttgacatcttggacgtttgcattaatgggccgaaagaaaagttggattccactgttttaagccagccagctatctatgttactagtctagctgctgtagagatactacgtgctcgtgatggtggtcaacagataattgattccgtagatgttacttgcggattaagtttaggggaatacacagctcttgcatttgctggggcatttagcttcgaggacggtctcaagctggtcaaactaagaggtcaagcaatgcaggaagctgcagatgctgctaaaggtgctatggtcagtatcattggactagattcagataaggtgcaacaactctgtgatgcagccaatgaagaagtcgaggaagctgagagagttcaaattgcaaatttcttgtgcactggaagttatgctgtctcaggaggcgtgaagggaattgaagccgtggaagcaaaagcaaagtcatttaaggctcgaatgacggtgcgccttgctgttgctggggctttccacaccagattcatgaaccctgctttatctcaactggagtccgctttgtcagcaacccaaatcaaaactccaagaataccagttatatctaatgtagatgcacagccgcatgctgaccccgagacaatcaagaaaatcttggctcgccaggttacatcaccggtccagtgggagacaacggtcaagactcttttatcaagaggactggaaaagagttatgaacttgggcctggaaaggttattgctgggattgtgaaaagaatggacaaaacatcacctattgagaacatcagcgcctgaacgtgggcgtgtatttattgccattctacaataacggatgaattaagtttcattgtggtagagcataaagtgattttggagcgtatatt

SEQ ID NO: 3953 - DNA, 1576 bp, Vigna unguiculata
ggacgatgaagatggtaatgaagtagttgcgcagtttgaacactaacaccaacgttcttcttgtaatttccgccttcaaaaactatctatattggtatcatatgcaagctctgattcaccattctcattcctattccctcttccttcgccacgcttcttctacttctctctctgcaatgtcttcttctctcattcttccttccgctcccttcctcgccccttcttcctccaatggaagagccaccctccctctcactcgatctagggtttccatgagcagtgtttccaccggatctcagccttccgttcaacaaactctgttcgccgattacaaaccctctacttcgttcctcttccccggtcagggtgctcaagctgttggaatggggaaggaagcccagaatgtgcctgctgctgcccttttgttcagcaaggccaatgacatattggggtttgatcttcttgatatatgcatcaacgggccaaaagaaaagctagattcgactgttattagccagcctgcaatttatgtcacaagtcttgctgctgtagagctacttcgtgcacgtgaaggtggtcagcagattatcgactctgtggatgttacatgtggtttaagcttgggagaatatactgctctggcatttgctgggtctttcagctttgaagatggacttaaattggtcaaactgaggggtgaggccatgcaggatgccgccgatgctgctaaaagtgccatggttagtgtgataggactggactcggagaaggtccaacaattgtgcgatgcagccaatgaggaagtttctgaagctgagaaggttcagattgccaattacctgtgtccaggaaactacgctgtctctggaggattaaaaggaattgaagtggtggaatccaaggcaaagtctttcaaggctagaatgatagttcgcctagctgttgctggtgctttccacactagttttatggaaccagctgtgtcaagattggaagcagcattggctgcaacagaaatcagaaccccaagaataccagtcatctccaatgtgaatgcgcagccgcatacggatcctgtcacaataaagaagacattggcacgtcaggttacgtcaccggttcagtgggaaacaacagtgaagacccttctaaccaagggtctgaagaaaagctatgaactaggacccggaaaggttattagcggaattgtcaaaagaatggacaaaggcacggatattgaaaatattggtgcttaagaaggcaataggaacttgctcctgcttcccatgaacaaagtaacatataacattttttactagagaaaatgtgcgtgggctgaatcaagagatcgattacatggatcatgaacttctgttagcaaggagcagctacagtcacatttgaagttttgaagttgaattataattctcatattgacattattatgaacaagtcagataaagtgattgtactcggctttagaaacattcatttcttgtaatcttataaaacgtatctcggagttaattgagttttgtgcttttcagcctttacgtggcttaatagtcaatagaag

SEQ ID NO: 3954 - DNA, 1467 bp, Amsonia hubrichtii
cagctatgctttcactatataaaatccagtcaaagctaaatgcatgctttcttccactaatcccctcattaatttccgcttcaatcccaccatttctacctctcgcttttgtactacttcgctctcagaatcaaattacattttcacaaacatcatgagtgcatcatctttggttcttccttcttccatttctgtcaataagaagctcgcttttgggacttctgaatcgttcaaatgttgcaattctttgggttttaagaatgggattcgcggctttagtcttaaaaatctggataaatcgagggtatttatgagcgttgctgttggatctcaaactaccgtgaatgatgccttgtttaaagattataagcccagctgtgctttcctctttcctggccagggtgcacaagctgttggaatgggtgcagaggctcagaaggtgcctgctgctgctgaattgtacaagaaggcaaatgaaatcttgaggtttgaccttttggatatttgcctaaatggaccaaaggataagctggactccactgttctgagtcagccagctatctacgtcaccagcttagctgcagttgaagtactccgtgcttgtgaaggaggtcaacaaataattgattctgtggatgttacatgtggtctaagtttgggagaatacactgctcttgcatttgctggagctttcagttttgaggatggtctcaagctggtcaagcttaggggtgaagcaatgcaggatgctgcagatgctgcacagagtgccatggttagtgtcataggattggattctgaaaagttgcaacagctgtgtgacgcagccaacgaagaagttgacgaggctaacaaagttcaaattgcaaatttcttatgccctggaaattatgcggtctctggaggtgtgaaaggagtggaagctgtagaagccaaggcgaaatcattcaaagctcggatgacggtgcgactagctgttgctggtgctttccacactagttttatggaaccagccgtctcgagattagaagctgctttagcagcaacagaaataaaatctccaagaataccagttatatcaaatgttgatgcacagccacatgcagatccagatacaatcaagaaaatattggcgcgccaagtaacttcacctgttcaatgggagacaacaatgaagacactcctgactaatggagtgaaaaagagttatgaattaggacctgggaaggtcattgctggtatcgttaagagaatggataaaggtgctgaccttgaaaacatcgttgcctgagtaccctggcctagtttagtgcttttgccttgtttagaactctgtcattttttgtaatctaaagattgtgaactccaatttcgaacctcaattttgtatcccctgaatgagagattgctgcataacagcttattgataagaataattcttctccttacagataaaaaaaaaaaaaa

SEQ ID NO: 3955 - DNA, 1531 bp, Tripterygium wilfordii
accgccctcctatcctccgcacttccgccttctgctcctctggttcgctcgctctctcctcaaccgccaccatggccactttctccctcgctcttacttctgtttctcccacgaagctttccttcttcgattctattaagagctgtaatgggaacggaatccggatcaggaatctcaaccgatctagggttttcatgagcgtttcggttggatctcaaactgttgttgatgatgccttattcgctgactataaacccaactgcgctttcttgtttcccggtcagggtgcgcaagcgattggaatggggaaggaggctcaaagcgtgcctgctgctgcagatttgtacaagaaagctaatgatgttcttggatttgatattcttgatgtttgtgccaatggaccaaaagagaaactagattcaactgttataagccagcctgctatctatgtcacaagccttgctgcagtcgaggttctccgtgctcgtgatggtggtcagcagataattgattcagttgatgtcacatgtggtctcagcctaggggaatatacagcgctagcatttgctggagcctttagctttgaggatggactcaagctggttaaactaagggggcaagcgatgcaggaagcttctgacgctgcaaaaagtgccatggtaagtgtcgttggactggattcggagaaggttcagctattatgtaatgcagccaatgaagaggttgatgaagctaataaagttcagattgcaaattacctatgccctggcaattacgcggtttctggtggtgtcaaaggaattgaagcagtagaagctaaggcaaagtcatttaaagccagaatgacggtgcgcctagctgttgctggagctttccatactagtttcatggaacctgctgtatcaagattggaagctgcattggcagccacagtgatcaaacctccaagaattcctgttatatctaatgttgatgcgcaaccacatgcagatcctaatataatcaagaagatattggcacgtcaggtgacgtctcctgtccaatgggaaacaacagtgaagactctcctttctagagggctgaagaatggttatgaattaggacctggaaaggttatagctggcattctgaagagaattgacaaaggtgctagcattgagaatattggtgcttgaggtagtgagtcgtgaccaatgctgttttgagtggttcgccttgaagtttagagtaccggttttttcttagagatttggttgattttagtcttggaccttaattgatttgtattgatagcttattatctgtagatgtattgccggcatgttgtggagggctattcaagtattaaaacagggaatgagctgtctctgatctactgttcttgaaatccagctttagcagtgatgagagcaattacctagttatggatttgatttcaatttttatgctatgtcaaggacaaagttgttaattgtactataatagtaaactacgaacaaatggatttccataaagaagtaaggtaagagat

SEQ ID NO: 3956 - DNA, 1441 bp, Brassica napus
cccatcttcgttaactccgcttaagatttttttaaaaaggagacaaaacattgtctgaatgcgctcactgcttcaccttactatcctacgcactcatcctttgaaagctcattgtcttatcctgcgcaccaccacgatggccacctcctactcttcttccttgctcctccctccttccgtatctctcaacaagtcccgaaatggctcctccctcggactctccgtcaaccgatctagggtttccatgagcgtctccgctggatctcagaccactctcaacgactctctcttcgccgattacaaaccctcctctgcttttctctttcccggtcagggagctcaagcaatagggatgggcaaagaggctcagagtgttgctgcagctgcagacttgtataccaaagccaaccatatcttagggtatgatcttctggatatttgtgttaatggaccaaaagagaagcttgattccactgtcattagccagcctgctatttatgtcacaagtctagcagcagttgagttgcttcgtgtccgtgaaggcggcgagcagataattaactccgtcgatgtcacttgtggtctcagcttgggagagtacactgctctcgcatttgctggagccttcagctttgaggatgggctaaagcttgtaaaactcagaggagaagccatgcaggctgctgcagatgctgcaaagagtgccatggttagtatcatagggttggactctgaaaaagttcagcagttgtgtgatgcagcaaatcaagaagtagaagaagctgacaaagttcagatcgctaatttcttatgtccgggtaactacgcagtatctggaggtcttaagggaatcgaggctgttgaagcaaaagctaagtcgttcaaggcccgcatgacggttcgtctagctgttgcaggtgctttccacactagtttcatggagccagcagtgtcgagattagaagctgcattggcatcaacggagatcagaagtccgaggatcccagtgatctccaacgtcgacgcacagcctcatgcggatccagacactatcaagaagatacttgcacgccaggtgacatctccagtgcaatgggagacaacggtgaagactctcttatccaaagggcttaaaagcagctatgaactgggacctgggaaggtgattgcagggatattcaagagagtagacaaaagcgccagtgtcgaaaacataagtgcttgagttgagaatccctctgctgcttcggaatttaaagttttgtatcaaaatatttatgtaacacttagcactgttgagatatctttatttaagtttcagttgatgaaagggcaaagttcacttcatagacaacaaaaagattgtgtatccagtgggttttgggttggcttcacattaactcggatggagattagtaaactttttattgttttttttact

SEQ ID NO: 3957 - DNA, 1217 bp, Brassica oleracea
aaggacacaaaaaaaacttgtctgaatgcgctcactgcttaactgtactaaactacgcactcctcctttgaaagctcattctcttatcctgcgcaccaccaccatggccacctcctactcttcttcttccttgctcctctctccttccgtatctctcaacaagtcccgaaatggctcctccctcggattctccgtcaaccgatctagggtttctatgagcgtctccgctggatctcagaccactgtcaacgactctctcttcgccgattacaaacccacctctgcttttctctttcccggtcagggagctcaagcaatagggatgggcaaagaggctcagagtgttgctgcagctgcagacttgtataccaaagccaaccatatcttagggtatgatcttcttgacatttgtgttaatggaccgaaagagaagcttgattccactgtcattagccagcctgctatttatgtcacaagtctagcagcagttgagttgcttcgtgtccgtgaaggcggcgagcagataattaactccgttgatgtcacttgtggtctcagcttgggagagtacactgctctcgcatttgctggagccttcagcttcgaggatggcctaaagcttgtaaaacttagaggagaagccatgcaggctgctgcagatgctgctaagagtgccatggttagtatcatagggttggactctgaaaaagttcagcagttgtgtgatgcagcaaatcaagaagtagaagaagctgacaaagttcagatcgctaatttcttatgtccgggtaactacgcagtatctggaggtcttaagggaatcgaggctgtcgaagccaaagctaagtccttcaaggcccgcatgacggttcgtctagctgtagcaggtgctttccacactagtttcatggagccagcagtgtctagattagaagctgcattggcatcaacggagatcagaagtccgaggatcccagtgatctccaacgtggatgcacagcctcatgcagatccagacactatcaagaagatacttgcacgccaggtgacatctccagtgcaatgggagacaacggtgaagactctcttatccaaagggcttaagagcagctatgaattgggacctggaaaggtgattgcagggatattcaagagagtagacaaaaccgccagtgtcgaaaacataagtgcttgagttgagaatccctctgctgctt

SEQ ID NO: 3958 - DNA, 1486 bp, Centaurea maculosa
ctcttcgaaatctccgctgcaattttcagctctataaattcaaaatcaaaacccactgattgaaacgaatgaatgctattttctcaccaatctctccttactagattcagctctcctcgatttctcagacgtttttccagctccaatctccttcctacaatggcgtcctcatcgtctctactgcttccttcggtttcactgaatcatcatcatcaggtgtctcttgattcaaggagttcgtcttctgtttgctttggaggttttaagcatggaggagttcgacgtcttaatttggagaaatctagggtttctatgagcgtatctgttggatctaacactgtagtagttgatgatgcgttgtttgccgattataaacctaccaatgccttcctctttcctggccagggtgcacaagccgttggaatgggacaggaagcccaaaaggtgccagctgctgcacagttgtacaacaaagccaatgaaattttagggtttgacattttggatgtttgcattaacggcccaaaagaaaagttggattccactgttctaagtcagccagccatctacgttactagtctagctgcagtagagatactacgtgcccgtgatggaggtcaacagataattgattctgtggatgttacatgtgggctaagcttgggagaatacacggctcttgcatttgctggagcatttagcttcgaggatggtctcaagctcgttaaattgagaggtgaagcaatgcaggcagctgcggatgctgctaaaggtgctatggtcagtatcatcggactagattcagataaggtgcaacaactctgtgatgcagcaaatgaagaagttgaggaagccgagaaagttcaaatcgcgaatttcttatgcactggaaactacgcagtctctggaggggtgaagggaattgaagctgtggaagcaaaagcaaaatcattcaaggctcgaatgacggtgcgccttgctgttgctggggccttccacaccagattcatgaatccggctgtttccaaactggaatccgctttggccgatacccaaatcagaactccaagaataccagttatatctaacgttgatgctcaaccacatgcagaccccgacacaatcaggaaaatcttggcttgtcaggttacatcgcccgttcaatgggagacgaccgtgaagactcttctatcaaggggactggaaaagagttatgaactcggacctggaaaggttattgccgggattgtgaagagaatggacaaaacatcgccgattgagaacattggcgcgtgagaagttgtcatctttgcaataatcgcagcgttttcttcttctgataagaacataaagggattttgatggtagagagaagaatttcgatatagttgagttttcgtgtatgattataagctgttgttagtgattgtatttgaatcgtgattttattctctccgagtgatatttattacgagttccattaagc

SEQ ID NO: 3959 - DNA, 1476 bp, Cirsium arvense
atttcaagcctactctcaatatcatcactcttcgaaatctccgctgctaattttcagctctataaattcaaaatcaaaacccactgattgaaacgaatgaatgctattttctcaccaatctctccttactagattcagctctcctcgatttctcagacgtttttccagctccaatcttcttcctacaatggcgtcatcgtctctactgcttccttcggtttcactgaatcatcatcaggtgtcctttgattcaaggagttcgtcttctgtttgctttggaggttttaagcatggaggagttcgtcgtcttaatttggagaaatctagggtttctatgagcgtatctgttggatctaacactgtagtagttgatgatgcgttgtttgccgattataaacctaccaatgccttcctctttcctggccagggtgcacaagccgttggaatgggacaggaagcccaaaaggtgccagctgctgcacagttgtacaacaaagccaatgaaattttagggtttgacattttggatgtttgcattaacggcccaaaagaaaagttggattccactgttctaagtcagccagccatctacgttactagtctagctgcagtagagatactacgtgcccgtgatggaggtcaacagataattgattctgtggatgttacatgtgggctaagcttgggagaatacacggctcttgcatttgctggagcatttagcttcgaggatggtctcaagctcgttaaattgagaggtgaagcaatgcaggcagctgcggatgctgctaaaggtgctatggtcagtatcatcggactagattcagataaggtgcaacaactctgtgatgcagcaaatgaagaagttgaggaagccgagaaagttcaaatcgcgaatttcttatgcactggaaactacgcagtctctggaggggtgaagggaattgaagctgtggaagcaaaagcaaaatcattcaaggctcgaatgacggtgcgccttgctgttgctggggccttccacaccagattcatgaatccggctgtttccaaactggaatccgctttggccgatacccaaatcagaactccaagaataccagttatatctaacgtcgatgctcaaccacatgcagaccccgacacaatcaggaaaattttggcttgtcaggttacatcgcccgttcaatgggagacgaccgtgaagactcttctatcaaggggactggaaaagagttatgaacttggacctggaaaggttattgccgggattgtgaagagaatggacaaaacgtcgccgattgagaacattggcgcgtgagaagttgtcacctttgtaataatcgcagcgttttcttcttcttctgataaaaacataaagggattttgatggtagagagaagaatttcgatatagttgagttttcgtgtataagctgttgttagtgattatatcttaatcgtgattttattctctccg

SEQ ID NO: 3960 - DNA, 2399 bp, Prunus mume
atgaccaaaacaagacggaaaatctaaaaagcagttggccggtgtctctttgattttgatgtccaacgtccaccttcgtaaactccgctaacctcaacacccccggcgcactatatcactgaatctgcctgcacttcatttatatgcacaccttcctcaggcttaaccttcaccaccctcttatcctgctcacctccctccccaccatgaccgcctttctcgccctcccctccatttctctcaactcctcctccgtttcgggcctccgaaatggaaaaggagccccgctcggtatccggagcctcgggcgatctagggtttccatgaccgcctccgttggatcgcagactctgcaaagcgatgccttgttcgccgattacaagcccaacttcgctttcctcttccctggtcaaggtgcgcaagcagttggaatgggaagggaagctcaaagcgtgcctgctgctgcggagttatacaagaaagcaaacgatattttagggtttgatcttttggatgtttgtttcaatgggccaaaagagaagctagattcaactgttataagccagccagctatttatgtcacaagtctagctgctgttgagttacttcgtgcacgtgatggaggccagcagatcattgattctgttgatgtcacatgtggcctaagtttgggagaatatactgctctagcatttgctggctcattcagctttgaggatggtcttaacctggtcaaactgaggggagaagccatgcaggaagctgccgatgctgccaaaagtgccatggtcagtgtcatagggttggactcggacaaggttcaacagttgtgtgacgcagccaatcaagaagtcgatgatgctaacaaagttcagattgcaaattatctatgtactggcaattatgctgtatctggtggtgtgaaaggagtggaagcagtagaggccaaagcaaagtcattcaaggcccgaatgacggttcgactagctgttgctggcgctttccacactagttttatggaacctgctgtatcaagattggaagctaaattggcagcaacacagatcagaacaccaagaataccagttatctccaatgttgacgcacaaccacactcagatcccgagacaattaagaaaatattggctcgtcaggtgacttcccctgttcaatgggaaacgactgtcaagactctccttagcaaggggctgaagaagagctacgaattgggacctggaaaggttatagctggcatcgtgaagagaatggagagaagtgcagagattgagaacattgccgcatgaaaaggcaaccggagatgtggcttcaatgatatccagttaccatgtggtggtacatatgccgatggggcagttgagggaggagcacgggaagaagcggctttttcggccaaatcttttcgacagtttactactctttagagttttgttaggtgattagaaatcctattttcagtataataaagtttggtttctcctcaaagtaagcttctatcaatcaatgtagcagtgcataagctgaaaaattcgatttttgtagattggctcagaattatgtgaattgctgaatactaagttgttgttgtgacatagaaatgtgatgaaatgaacatgattgataaattatttatatttcatagattgttctacatttcatggactggtaacatgcaaatccagtgatttgataatttccaatccaattcaaaccgggcgccggagttggtgaatgcggtctatcaagttgccctcggggacccgatcagcccaagggggaggagttccagcgaaggaaattccccgcatcgcctccctaaccctcgtcgcgttctccggcggcaacggcgcatttctgcgattctcgtcttctctgaacgccctcattatcgccgaatcagaagcctcctcctcctctttgtcttcttcgtcttcgctgctcatgctcatgttatgattattagtaccctcgacgttgtcgtttaggcggagagacgaaatccctctctgtacctgattcacagtcacgccgttggagagcacctgctgctggtgctgctgcgggtggatcgagacggtatcgtttctgctctgatcttcatcttcggaatcgacggcggagactggctggtagtactcgccggccacttcgtcctcatcgatgtttgtgtccgaatcgcttccgttgaggtagtccgtaactgaaaaccacaaaacgcataatgaataacaattaatcacaatggttagagagaaaacaaataaaaaaagaaacataaaactgaaaccttcgatgaaatcaggatcagctggagcggtagcgttcatgctttcagtcttccagagaacccaagaatctgagaagtgagtgagcgcgttttg

SEQ ID NO: 3961 - DNA, 1535 bp, Triphysaria pusilla
acagatcatttccaaagccgttggcctaatactacccgccgacgacatttctgaagccaaattcttcgttatctccgccaaacaaccccttcttcatttttatgcatgatcttattattcctcactaaaaccatcccctgcatttcatttcctctcattcgattcagttcaatctatccgcggaatcaattttcatctctccatacagcaatgtcatcctcaatcgcgcttccttccatttccgtctccaaagccgctttcggcgcttccgaatccttcagaagctccacttgtctgggtttcaggaacgagatccgaaggaattcgagtttcaatttgaagaaatctagggtttcgacgagcgttgccgtcggatcggatgtggtggtcgttgatgacgcgttgttcaaggattacaagccttcttctgctttcctctttcctggtcagggtgcacaagctgttggaatgggagtggaggctcaaaaagtgcctgctgcagctgagttatacaagagagctaatgatattctggggtttgaccttctggatatttgcattaatgggccaaaagagaagctcgattctactgttttaagccagccagctatctatgtaacaagtttagctgcagttgaggtgctccgagctcgtgatggtggtcagcaaatcatcgaatccgtggatgtgacatgtggtctaagtttaggagaatacactgctcttgcattcgctggagctttcagctttgaggatgggttgaagctagtcaaattaaggggtgaagcaatgcaggatgctgctgacgctgctaaaagtgccatggtcagtatcatcggactcgactcggctaaggtgcaacaactttgtgatgcggccaacgaagaagtagatgaagcgagtaaagttcaaattgcaaattttttatgcacggggaactacgctgtatctggaggccttaaaggaattgaagcagttgaagcaaaggcaaagtcgttcaaggcccgaatgacggttcggttagctgtagctggtgcattccacacaggttttatggaaccggcagtgtcaagactagaatctgctttggcatcaacagtaatcaaaacccccagaataccagttatatcaaacgtcgatgctgagccacatgcagatccagccacaatcaagaaaattctagctcgccaggtgacatctccagttcaatgggagacaacggttaagactttgttaagtagaggtttgaaaaagagctacgaattaggacctggaaaggtcatagctggcatcgtcaaaaggatggataaaggtgctgacttggagaatatcggcgcctaaacatagcccctttgacatgcttgtgaaattatgcttattaccaagacgagtggagcttcacgatttatagttattttagggttattggatgtactctaagcttgggtaaacaataaattgcaattgcgtttgagtgtgtcaattttttttttcaatttaattaaactgaggtttgagtgggtgacacctccatt

SEQ ID NO: 3962 - DNA, 1603 bp, Fragaria vesca
tcccaaaatctccaacgtctagtccctctaaccttcgtaaactccgctaacctgaacccccaccgcgcattatatcactcccctctcccttctctgatatgcgcacccttcataacctgcaccaccaccgctcccttatcctacgcacctctctctccaccatgtccgccgcctctctcgccgtatcccccatttctctcaacttctcggggctccgaaatggcaccgcccgccccgtcctcggtgtccgcaacctctcccgatctagggtttccatgagcgtctccgttggatcatcgccgactgtaaccgacgacgccttgttcgccgattacaagcccaccaatgctttcctcttccccggccaaggtgcacaagcacttggaatgggaaaggaagctcagagcgtgccggcagctgcagagttgtacaagaaggcaaatgatattttagggtttgatcttttagatgtttgtatcaatggaccgaaggagaagctggattctactgttataagccagccagctctttatgtcacaagtctagctgctgttgagttgctccgtgcacgcgatggaggtcagcagatcattgattctgttgatgttacatgtggtctaagtttgggagaatacactgctcttgcatttgctggttcatttagctttgaggatgggctcaagctggttaaactgaggggagaagctatgcaggaagctgccgatgctgccaaaggtgccatggtcagtgtcatagggttggactcagacaaggttcaacagctgtgtgacgcagccaatgaagaagttgatgacaaggacaaagttcaaattgcaaattacctatgtactggaaactatgctgtatctggaggtgtgaaaggagtggaagcactagaagccaaggcaaagtcattcaaggcccgaatgacggtgcgtctagctgttgctggtgctttccacactaggtttatggacccagctgtatcaagattggaagcgaaattggcagcaacacagattagaactcccagaataccggtaatctccaacgttgatgcacagccacattcagaccctgaagtgattaagaaaatactggctcgccaggtgacttcccctgttcagtgggaaacaacagtcaagactctcctttctaaggggctgaaaaagagttacgaattgggacctggaaaggtcattgctggcattgtgaagagaatggacagaagcgccgaaattgaaaacattggagcttaaaaaagcaacccggatgcaaattctactactccagttgagtacccaattaccaaattgatacagttgccaatggctgcagttcagagagagttaggcagcagttgtttgttcagtcagaccgagacgatgcctgaatttcaagttttccgggaaagtagttactagcatttagagttttgtttgggttagaaattcctgttatcattatcaaataaaagatgggtgttcttctcattttgtaagctttgtgattcagtgtagaatagtgtactaagctgaaaatctggttcttgtaatgatattactctcagtaatcaaaacgaacaatcttacattacattcaa

SEQ ID NO: 3963 - DNA, 1573 bp, Prunus persica
ccaacgtccaccttcgtaaactccgctaacctcaacaccccctgcgcactatatcactcaatctgcctgcacttcatttatatgcacaccttcctcaggcttaaccttcaccaccctcttatcctgctcacctccctccccaccatgaccgcctctctcgccctctcctccatttctctcaactcctccttcgtttcggggctccgaaatggaaaaggagccccgctcggtatccggagcctcgggcgatctagggtttccatgaccgcctccgttggatcgcagactctgcaaagcgatgccttgttcgctgattacaattccaacttcgctttcctcttccctggtcaaggtgcgcaagcagttggaatgggaagggaagctcaaagcgtgcctgctgctgcggagttatacaagaaagcaaacgatattttagggtttgatcttttggatgtttgtatcaatgggccaaaagagaagctagattcaactgttataagccagccagctatttatgtcacaagtctagctgctgttgagttacttcgtgcacgtgatggaggccagcagatcattgattctgttgatgtcacatgtggcctaagtttgggagaatatactgctctagcatttgctgggtcattcagctttgaggatgggctcaacctggtcaaactgaggggagaagccatgcaggaagctgccgatgctgccaaaagtgccatggtcagtgtcatagggttggactcagacaaggttcaacagttgtgtgatgcagccaatcaagaagtcgatgatgctaacaaagttcagattgcaaattatctatgtactggcaattatgctgtatctggtggtgtgaaaggagtagaagcagtagaggccaaagcaaagtcattcaaggcccgaatgacggttcgactagctgttgctggcgctttccacactagttttatggaacctgctgtatcaagattggaagctaaattggcagcaacgcaaatcagaacaccaagaataccagttatctccaatgttgacgcacaaccacactcagatcccgagacaattaagaaaatattggctcgtcaggtgacttcccctgttcaatgggaaacgactgtcaagactctccttagcaaggggctgaagaagagctacgaattgggacctggaaaggttatagctggcattgtgaagagaatggagagaagtgcagagattgagaacattgccgcgtgaaaaggcgtgaaaaggcaaccggagatgtggtttcaatgatatccagttaccatgtggtggtacatttgccgatggggcagttgagggaggagcatgggaagaagcggctttttcggccaaatcttttcgacagtttactactctttagagttttgttaggtgattagaaatcctattttcagtattataaagtttggtttcttctcaatgttgcagtgcataagctgaaaatttcgattttgtaaattgcctcagaattatgtgaattgctgaatactaagttgttgtgacatagaaatgtgatgaaatgaacatgattgataaattattt

SEQ ID NO: 3964 - DNA, 1756 bp, Elaeis guineensis
ggggcgcttcgtgcactccgccgcccctcaccgtcgagataggatataaacgcacatgggaccgccctcgatctcaccgcgcgctgccctcgcctctcgctctccctctcctctctctcccgtctatctagccgcccgccgtctctgcgatcgcgccccgatggcatccgcttctgtcgctctcatcccctccgcccgcctccccaggatctccgtccatggcggcctgaggtcgctccccaggaacctctcgagatcgagggtttccatgagcgtctcggtcggatctcgcgcgtctgccgccgaggataccctctttcaggactacaagccttcctgcgcctttcttttccccggtcagggtgcacaaactgtgggaatgggggtggaagctcagagtgtgccagcagctgctgatttattcaagaaggcgaatgatttacttggtttcgacctcttggatgtttgcaccaatggaccaaaagaaaagcttgattcaacagttataagccagccagctatctatgtcactagtctagctgctgtggaagtgctacgtacacgtgatggggggcaggatataattgattctgtagatgtcacttgtggtttgagtttgggtgaatatacatcccttgcatttgctggtgctttcagctttgaggatggtctcaagcttgtcaagctaagaggagaggccatgcaggatgctgcagatgctgctagtagtgccatggttagtgtaataggactggattcagaaaaggtacaattgttatgtgatgctgctaatgaggaagtagacgacaaggagaaagttcagatagcaaatttcttatgtccaggtaattatgctgtttctggtggtgtgaaaggagtggaagctgttgaagcaaaggcaaagtcatttaaggcgcgaatgacggtacgtcttgctgttgctggtgcttttcatactagattcatggagccagctgtctcaagattggaagcagcattggcaacaacagaaattagaactcctaaaataccagttatttccaatgtggatgcacaaccgcactcagatcctgatatgatcaaaaagattctagcacgtcaggtgacttcaccagttcagtgggagttgacggtgaagactctcttgagcaaagggctgaagaaaagctatgaactggggcctggaaaggttattgcaggaatcgtgaagagaatgaataagggtgctgacattgaaaatgttggtgcttgagagcttccttaaaataatgcctttctagacaatctttctgtaactgcctttctttgtcgttggtgatgctcggactgctgcccaaattgctgcttcaagtccagaggccggcttgctgtgcaaaacccacaaggcatgcaggagcgtagatcatgagttgagctgcacctttttaaattattaatttttaggcaccgtgatgcttagctttggagcctacgaaatagcccaagaagacaatatgttttgtaatagtgtcttttacattgcagcttgacagcagcacttcttttagttccaagccatcacgtgagaacgtgtggtcggtccattctaattttcaagtcagttggaataatcaagatcatgattagtgggcggctccttgttgaggtttccatgttatactcaggtctttctcgccagttgtctaaccatattcttttatctatatttgttggtcttgttgcaatcaaaatatatgcagatccgtttgtttttttg

SEQ ID NO: 3965 - DNA, 1559 bp, Triphysaria pusilla
cttcttcgttaactccgccaaaaacctctttaattcaatggatattcgtcaatataccaatcttctaccttacatttcttctcattcgatttaattcaatcatctacgaaatcaattttcatctctctaagcaatgtcatcctcaatcgtgcttccttctatttctctctccaaagccgctttcggcgcctccgaatccttcagaagctccacctgtctgggtttcaggaacgatccgaagggcttcacgtttcaatgtggagaaacataaggttttcatgagcgtcgcagtcggatcggacccggtggttgtcgatgatgcgatgtttaaggactacaagccttcttcttctttcctctttcctggtcagggtgcacaagctgttggaatgggggtggaggctcaaaaagtgcctgctgcagctgagttatacaagagagctaatgatattctggggtttgaccttctggatatttgcattaatgggccaaaagagaagctagattctactgttttaagccagccagctatctatgtaacaagtttagctgcagttgaggtgctccgagctcgtgacggtggtcagcaaatcattgactccgtggatgtgacatgtggtctaagtttaggagaatacactgctcttgcattcgctggagctttcagctttgaggatgggctgaagctagtcaaattaaggggtgaagcaatgcaggatgctgctgacgctgctaaaagtgccatggtcagtatcatcggactcgactcggctaaggtgcaacagctttgtgacgcggccaacgaagaagtagatgaagcaagtaaagttcaaattgcaaatttcttatgcacggggaactatgctgtatccggaggccttaaaggaattgaagcagttgaagcaaaggcaaagtcgttcaaggcccgaatgacggttcggttagctgtagctggtgcgttccacacaggttttatggaaccagcagtgtcaagactagaatctgctttggcatcaacagcaatcaaaacccccagaataccagttatatcaaacgtcgatgctgagccacatgcagatccagccacaatcaagaaaattctagctcgccaggtgacatctccagttcaatgggagacaacggttaagactttgttaagtaggggtttgaaaaagagctatgaattaggacctggaaaggtcatagctggcatcgtcaaaaggatggataaaggtgctgacttggagaatatcggcgcctaaacatagcccctttgatatgttcgtgaaattattcttcttaccaagacgagtggagcttcacgatttatagttattttagggttagtggatgtactctgagcttgaggaaacaataaattgcaattgcctttgagtgtgccaattttttttttcaatttaattaaactgaggtttgagtgggtgacacctccattactattagaattgagttaaacctacaattgaatgcatcgtcatacttaaaaatgaatcataaaaaaaacatgattcaaattgatcatacaaaaaaaaaaaaaa

SEQ ID NO: 3966 - DNA, 1534 bp, Brassica napus
gcgctcactgcttaaccgtactaaactacgcactcctcctttgaaagctcattctcttatcctgcgcaccaccaccatggccacctcctactcttcttccttgctcctccctccttccgtatctctcaacaagtcccgaaatgcctcctccctcggattctccgtcaaccgatctagggcttctatgagcgtctccgctggatctcagaccactctcaacgactctctcttcgccgattacaaacccacctctgcttttctctttcccggtcagggagctcaagcaatagggatgggcaaagaggctcagagtgttgctgcagctgcagacttgtataccaaagccaaccatatcttagggtatgatcttcttgacatttgtgttaatggaccgaaagagaagcttgattccactgtcattagccagcctgctatttatgtcacaagtctagcagcagttgagttgcttcgtgtccgtgaaggcggcgagcagataattaactccgttgatgtcacttgtggtctcagcttgggagagtacactgctctcgcatttgctggagccttcagcttcgaggatggcctaaagcttgtaaaacttagaggagaagccatgcaggctgctgcagatgctgctaagagtgccatggttagtatcatagggttggactctgaaaaagttcagcagttgtgtgatgcagcaaatcaagaagtagaagaagctgacaaagttcagatcgctaattacttgtgtccgggtaactacgcagtatctggaggtcttaagggaatcgaggctgtcgaagccaaagctaagtccttcaaggcccgcatgacggttcgtctagctgtagcaggtgctttccacactagtttcatggagccagcagtgtctagattagaagctgcattggcatcaacggagatcagaagtccgaggatcccagtgatctccaacgtggatgcacagcctcatgcagatccagacactatcaagaagatacttgcacgccaggtgacgtctccagtgcaatgggagacaacggtgaagaccctcttatccaaagggcttaagagcagctatgaattgggacctggaaaggtgattgcagggatattcaagagagtagacaaaaccgccagtgtcgaaaacatcagtgcttgagttgagaatccctctgctgcttcggaatttaaagttttgtatcagaatatttatgtaacacttagcactgttgagatatctttatttgagtttcagttgatgaaagggcaaagttcacttcatagacaacataaagattgtgtgttattattatatctagtcggttttgggttggcttctcaatttttctttgtgctgtttgttttctttcttctctctactattcttacttattttattttagttagttactacttactttacttactaaacaaataatatataataagtacgtctacacaccacgatagagtacactatagtatttacgttaaaccttacggtacggtggggcgggaggacggacaa

SEQ ID NO: 3967 - DNA, 1376 bp, Ocimum basilicum
tcttctccaccacaactgccatttcccctttcacctgattcgctccacctcttcctccgcattttcctctctctccgccgcaatggcttcctcaatcgcgctcccctcgatctctctctctaaatccgccttcgccgactctgcttccttacggagctccgccagcttttgcttcagaaatgagattcggagggtttcgcgcttaaatttggagaaatctaggcttctcatgagcgtcgccgtcggatcggaggcggcgattgtcgatgacgcgctgttcaaggactacaagccttctactgctttcctctttcccggtcagggtgcacaagcagttggaatgggattggaggctcaaaaggtgcctgctgcagctgaattgtacaagagagctaatgatattttagggtttgaccttttggatatttgcattaatgggccaaaagagaagcttgattccactgtcttaagccagccggctatctatgttacaagcttagctgcagttgaggttcttcgagctcgtgaaggaggtcagcagatcattgattctgtggatgtaacatgtggtctaagcttaggagaatacacagctcttgcatttgctgaagcattcagctttgaggatgggcttaagctagtcaagctacggggtcaggcaatgcaggatgctgctgatgctgcacaaagtgccatgactagcattattggactagactctgctaaagtgcaggagctctgtgatgctgccaatgaagaagtagatgaggcaaataaagttcaaattgcaaatttcttatgcactgggaactatgctgtctccggaggccttaaaggaattgaagcagttgaagcaaagtcgaaatcattcaaggctcgaatgacagtccgattagctgtagctggggccttccacacaagtttcatggagcctgcagtgtcaagattagaagctgctctggcatcaacaccaatcagaaaacccagaatcccagtcatatccaacgtcgatgcagaaccacacgcagacccagaaacaatcaagaaaatcctcgcccgccaggcgacttctcctgtccaatgggagacaacggtgaagaccttgttaagcagaggattgacaaagagctatgaactaggacccggaaaggtcattgctggtatcgtcaaaaggatggatagaagtgctgacattgagaacattggtgcctaagcaggcatatttatagatgaaaagcgaaaaggagttcctttgttttaatagttattttgtaactattaatgtcgatgatccagctgctttactgaaagttttaatacttcaaataatatattttgtaatttgataactgattatttttaattaagcaatcaaa

SEQ ID NO: 3968 - DNA, 1673 bp, Petroselinum crispum
aagaaagttgttagttggaaacttggaagccatctccaacgccctcactctaatttgcgcacccacacacaaacaaacatccccttgtaaactccgtcccctccattacacacaatatacatacaaaccccaaacaaatcttgaatgcaagctgctattcttgcaaaaccaacttcatcatcatatcatcttctaaaaatggcttcttcatctcttcttcttccttccatttctccacaccccatctcttcaaaaacccctgcttctctgtgtttaacgaggttctctaattatgggattaagggttgtagaaactttaataaatctagggtttttatgagtgtttctactggctctcaaactgctactgtggatgatgctttgtttcttgattacaatcccacctcagcttttttgtttcctggacagggtgctcaggctgttgggatgggcgtggaggctcagaaggtacctgctgctgctgaattgttcagtaaagcaaatgaaattttagggtttgacttattggatgtttgcgttactggacctaaagagaagctagactccactgttttgagccaaccagcaatatatgtcaccagtttagctgcagttgaggtactacgtgcccgtgaaggaggtcagcaaattattgattctattgatgttacatgtggtctaagtttgggagaatacactgctttggcatttgctggagcttttagctttgaggatggactcaagctggtaaaattgaggggtcaagccatgcaggaagctgcagatgctgctaaaagtgccatggttagtgtcattggactggactccgaaaaggtgcaacttttgtgtgatgctgctaatgaagaagtagatgaagcagacaaagttcaaattgcaaatttcttatgctcaggaaactatgcagtctcaggaggagtcaagggagtggaagtcttagaagctaaagccaagtcttttaaggctcgaatgacggtccgtctagctgttgctggtgctttccacacccgtttcatgaacccagctgtctcaagattggaagctgctttggcagcaacagaaataaaaattccaagaataccagttatatccaatgtcgatgcacaaccacatgcagaccctgaaacaattaagaaaatattagctcgtcaggtaacttcccccgttcaatgggagacaactgtaaagaccctcctaaataaaggtttgaaaaagagctacgagttagggcctggcaaggttatagcgggcattcttaagagagtggacagaagtgctgagattgagaatattagtgcttgagtaataaactattcatcctgtgaggcactgagcaggttttgtaccatttggttccttgaaattcaacaagagaaagatggagttaagtggctagtttaaagttgttatctgaatctttgtgttgaacattcctcggaattttcttgtcggatgtgtggataatattgtgtaagagctaaataatagttttaataatttaaatgattcggaaatttgtaatgactgagaaattgtgatgaatttttatttgctacattcttatatgtattgaataggtttatggtatttatagttatgtttttagaattctagctatgcaggttgaccctgcttgcggaatccacattaactag

SEQ ID NO: 3969 - DNA, 1583 bp, Cirsium arvense
cagttggcatatttcataggatttcaagccctctccgtatcttcactctctttttctctttgaaatctccgctgcaatttcacctatataaattcaaaatcaaaccactgaatgaatgctcttttctcaccaatctatccatagattcaaccctcctcgatttctcagacccttttctagtttcaatcttctccctgcaatggcttcatcgtctctactgcttccttcggtttcactgaatcatcaggtctcttttgatgctcctgattcgttgtcatccaagagttcgtcttctgtttgttttgggggttttaagcatgggtttcgacgtcttaatttggagaaatctagggtttctatgagcgcctcatctgttggatctacaattgcagttgctgatgctttgtttgctgattataaggctaccaatgccttcctctttcctggtcagggtgcacaagccgttggaatgggacaggaagcccagaaggtgccagctgctgcacaattatacaacaaagcaaatgaaattttagggtttgacattttggatgtttgcattaacggcccaaaagaaaagttggattccactgttttaagtcagccagctatctatgttactagtctagctgcagtagagatattacgtgcccgtgatggaggtcaacaaataattgattctgtggatgttacctgtgggctaagcttgggagaatatacagctcttgcatttgctggagcatttagcttcgaagatggtctcaagctggttaaactgagaggtgaagcaatgcaggaagctgcggatgccgctaaaggtgctatgatcagtatcatcggactagattcagataaggtgcaacaactctgtgatgcagcaaatgaagaagttgaggaagccgggaaagttcaaattgcgaatttcttatgcactggaaactatgcagtttctggaggtgtgaagggaattgaagctgtggaagcaaaagcaaaatcatttaaggctagaatgacggtgcggcttgctgttgctggggccttccacaccagattcatgaatccggctgtgtcgagactggagtccgctttggcagcaacccaaatcagaactccaagagtaccagttatatctaacgtcgatgcacaaccccatgcggatcctgaaacaatcaagaaaatcttggcttctcaggttacatcacccgttcaatgggagacgactgtgaagactcttctatcaaggggactggaaaagagttatgaacttggacctggaaaggttattgctgggattgtgaagagaatggacaaaacatcgcccattgagaacattagcgcgtgagaatttgtttgccgttaacaataattgcagcaactcaagtcgtcttcttcttcttcttcttctagtaagagcttctatgatagagagagagagagagagagagcaaatcgaaatagttgtgtatgattataagctgttgttagtaattgtatttgaatcgtgattttatgctcttcaaactgatatttattacaaattttccgagcatacgatcgattaatgctgcaatatataatcctat

SEQ ID NO: 3970 - DNA, 2193 bp, Cocos nucifera
ttcgaataccgtccggacctctctctcttcccaccgtctataagcaacaatgggggcgcttcgtatactccgccgcccctcacagtcgagatttgatataaacgaacatgcgaccgccctcgatctcatcgcgcgctgccctcgcccctcgctctccctccgctctctttcccgtctatctcgcctcccgccgtctctgcgatcgagtcccgatggcatccgcttccgtctctctcatcccgtccgcccacctccccaggatatccgcccatggcggcctgaggtcgctccccaagaacctctcgagatcgagggtttccatgagcgtctcggtcggatctcgcgcgtctgccgccgaagataccctcttccaggactacaagccctcctgcgcctttcttttccccggtcagggtgcacaaactgtgggaatgggggtggaagctcagagtgtgccagcagctgctgatttattcaagaaggcgaatgatatacttggttttgacctcttggatgtttgcaccaatggaccaaaagaaaagcttgattcaacagttataagccagccagctatctacgtcgctagtctagctgccgtggaagtgctacgtgcacgtgatggaggacaggatataattgattctgtagatgtcacttgtggtctgagtttgggtgaatatacatcccttgcatttgctggtgctttcagctttgaggatggtctcaagcttgtcaagctaagaggagaggccatgcaggatgctgcagatgctgctagtagtgctatggttagtgtcataggactggattcagaaaaggtacaattgttgtgtgatgctgctaatgaggaagtagatgaaaaggataaagttcagattgcaaatttcttatgtccgggtaattatgctgtttctggtggtctgaaaggagtggaagctgttgaagtaaaggcaaagtcatttaaggcgcgaatgacggtacgtcttgcggttgctggtgcttttcatactagcttcatggagccagctgtctcaagattggaagctgcaatggcaacaacagaaattagagcacctaaaataccagttatttccaatgtggatgcgcaaccgcactcagatcctgatacgatcaaaaagattctagcacgtcaggtgacttcaccggttcggtgggagctgacggtgaagactctcttgagcaaagggctgaagaaaagctatgaactggggcctggaaaggttattgcaggaatcgtgaagagaatgaacaagggtgctgacattgaaaatgttggtgcctgagagcttccttaaaataatgccttctctgcacaatcttttttgaggaaatccttaaattaactgtcgttggtgacgctcggactgctgcccagattgctgcttcaaagtccagaggccggcttgctgtgcaaaacccacaaggcatgtgggagagtcgagcttcacactcttttaaattattaaagccaggcaccatgatgcttagcttaggcgcctgtacgaaacagccaaataagacaatatgcttttgcaatttcaaggcagttagaattatcaagatcttgattagcgagttgcggtttccattttatagtccgggtctatcttgcccgttgtctgatcatattttttccccccccccccccccccccccccccccccccccccccccccccccccccccccccccccccccccccccccccccccccccccccccccaaaaagcaataatttagggggatcgggcattgcttctgccagggttccaaaattggtgagactgtttgattacaacatgcacaaaatttgtttgcagtaaggtgcccggtaattcatgaatggaaaattttattatacctgctgacgctgtatttggagctagttcggttaaatctgtctcggagctgctgtctataggatatcccccgtatgatgctcgttagggcagctaatcaatttgaagcatccatgttttgtcataactccaatctcgatccccaagattgagtcttgagggttgataggaatggcattcttcaaacagcctctcgcatcataaagatcaccaaaaatgccttgtagtccacttctgcatcacactccagaaacttttccacaatttcatctaataactcattgcagctttcaaaaatgatgagcaactctc

SEQ ID NO: 3971 - DNA, 1246 bp, Flaveria ramosissima
gggggtcttaaacgtgggtttcagcggcttaatttggagaaatctagggtttctatgagcgtatctgttggatccaccactgctgttgatgatgctttgtttgctgattataagcctaccactgccttcctcttccctgggcaggggcacaagtagttggaatgggacaggagtctcacaaggtgcctgctgctgcagagttttacagtaaggcaaatgaaattttagggtttgacatcttggatgtttgcattaacgggccaaagaaaagttggattccactgttttaagccagccagctatctatgttactagtctagctgctgtagagatactacgtgctcgtgatgggggtcaacagataattgattctgtagatgttacttgtggattaagtttaggggaatacacagctcttgcatttgctggagcatttagcttcgaggacggtctcaagctggttaaactaagaggtcaagcaatgcaggaagctgcagatgctgctaaaggtgctatggtcagtatcattggactagattcagataaggtgcaacaactctgtgatgcagccaatgaagaagtcgaggaagctgagagagttcaaattgcaaattcttgtgcactggaattatgcagtttcaggaggcgtgaagggaattgaagctgtggaagcaaaagcaaaatccttcaaggctcgaatgacggtacggcttgctgttgctggggctttccacaccagattcatgaaccctgctttatctcaactggagtccgctttgtcagcaacccaaatcaaaactccaagaataccagttatatctaatgtagatgcacagccgcatgctgaccccgagacaatcaagaaaatcttggctcgccaggttacatcaccggtccagtgggaaacaacggtcaagactcttttatcaagaggactggaaaagagttatgaacttgggcctggaaaggttattgctgggattgtgaaaagaatggacaaaacatcacctattgagaacatcagcgcctgaacgtgggcgtgatttattgccattctacaataacggatgaattaaagttttcattgtggtaagagcataaagcgattttggagtgtatattagtccaaatttatgcagtcgagcttttgtgtatgaacataaagtttgttaatgatgtatttgtatctcgatcacacgccctctgactagtgatggttattatgagttgttttcaagtgatttgt

SEQ ID NO: 3972 - DNA, 1608 bp, Panax ginseng
cactaccaccctttttattctctctccacaatgagttcctctctcctcccttccatttctccccaaaatctcgtccatttttgaagctccagaatctctgaggacctctaattcggtttgtttcacgggtttcaagcatggaattcgaggttttggttcgaggaatttggataaatctagggtttttatgagcgtatctgttggatctcaaactgccgctaatggtgcattgttcttggattacaagcccacctctgctttcctatttcctggccagggtgcacaagttgttggaatgggtgtggaggctcagaatgtccctgctgcttctgacttgtacaataaagcaaatgaaattttagggtttgaccttttggatgtttgcattaatggaccaaaagaaaagctagactccactgttttgagccagccagctatctatgtcaccagcttagctgcagttgaggtactacgtgcccgtgatggaggtcagcagataattgattctgtagatgttacatgtggtctaagcttgggagaatacaccgctttagcatttgctggagctttcagctttgaggatggactcaagctggtgaaactaaggggtcaagccatgcaggaagctgcagacgctgctaaaagtgctatggttagtgttattggactggattcagaaaaagtgcaactcctgtgtgatgcagctaatgaagaagttgatgaaacaaacaaagtccaaattgcaaatttcttatgccctggaaattatgcagtctcaggaggtgttaagggagtggaagccttagaagctaaagcaaagtcattcaaggctcgaatgacggtccgattagctgttgctggtgctttccacactagtttcatgaatccagctgtctcaagattggaagctgctttggcagcaacagaaattagaattccaagaataccagttatatctaatgttgacgcacaaccacattcagatcccgcaacaattaaaaaaatactagcacgtcaggtaacttcccctgttcaatgggagacaacagtgaagactctcctaaccaaagggttgaagaagagctacgaattaggaccaggaaaggttatagctggcattgtcaagagaatggacagagctgcagagattgagaatattagcgcttaaggagttgacaagtggttccttctacgccatttcaataacaaagggtgagcatgtctgtaccatataagtttcttcaggaaagaaatttggagcttcagttttgggctataatgaccagtctgaagtttcttccagatgttacatagagttttttcctacttcgttgcgaggataacttttgaatgatgtttgcaagagctataaatgatgcttattatttggtagtcatagttttagactttggcattgtaagaactgagaagttttaataatgtcatctgatgttgttttagctcacccttgtgtttgtattcacttgttatttagtcagagataatagaacattgccaagtgttgtaacatttttatgaaatagttaagctgattgggttaagaaaacaaaaaaaaaaaaaaaaaaaaaaaaaaaaaaaaaaaaaaaa

SEQ ID NO: 3973 - DNA, 1456 bp, Olea europaea
aaatttggatagacgaggtagggttttcatgagcatcgctgttggatctcaatccactgtagtcgacgatgcgctcttcaatgattataggccctcccgtgctttcctttttcctggccagggtgcacaagctgttggaatgggtgtggaggctcaaaaggtgcctgctgcagctgaattatacaagagagcaaatgatattttagggtttgaccttttggatgtttgcatcaatgggcctaaagaaaagcttgattccacagttttaagccagccagctatctacgtcacaagtttagctgcagttgaagtgctacgagcttgtgatggaggtcaggcaataattgattctgtggatgtcacgtgtggtctaagcttaggggaatacactgctcttgcatttgctggagctttcagctttgaggatgggctcaagctggtcaagttaaggggtgaagctatgcaggatgctgctgatgctgctaaaagtgccatggttagtatcattggattggactccaaaaaggtgcaactgctgtgtgatgctgccaatcaagaagtggatgaagcagacaaagttcaaattgcaaatttcttatgtcctggaaattatgcagtgtctggaggcttgaaaggaattgaagcagtggaagcgaaggcaaagtcattcaaggctcggatgacggttcgtttagctgtagctggtgcttttcacactagttttatggacccagctgtctcgagattggaagctgccttggcttcttcagaattgaggactcccaaaataccagttatatccaatgttgacgcccaaccgcatgcagatccgaacacgataaagaaaatactggctcgccaggtgacttctcctgttcaatgggagatgacagtgaagactctgttaaccaaaggagtcgaaaagtcctatgaattgggacctggaaaggttattgctggcattgtaaaaagaatggacaaaggtgctgagattgagaacattggtgcctaagcatgaccacttcctcttgttgcttagtctgtaacttcccaatggcgcagtttttattgctgcgagttaatggaagctagagttttgattgattgggctagtgtgggtcatatgcaaattcagctgtatctgtaaactggaattttgagcattgtgttgacttggatgagatctatataacacgactttaattcttgtctatttccaaaccattaacttaaagggatgtggtatatttattagaagagttacttttaagccatgatacacttgttgaacaacatgaacctacgacaataaaagcagagtcttcatcgctccggttgcccattgagtgtattggtgtaacttagtttggtggtttgtcaaaaatgccactgtttggtttgaacaaagcgtagtcaagggttttctcggaagcaatccgaagttacaggaaggggc

SEQ ID NO: 3974 - DNA, 1711 bp, Triphysaria pusilla
atgcacggaaataccgccattacggacggaggaatatgtgatagtctaacgtagtatcgacctgccgaagacatttctgaagccaacttcttcgttaactccgccaaaaacctctttaattcaatggatattcgtcaatataccaatcttctaccttacatttcttctcattcgatttaattcaatcatctacgaaatcaattttcatctctctaagcaatgtcatcctcaatcgtgcttccttctatttctctctccaaagccgctttcggcgcctccgagtccttcagaagctccacctgtctgggtttcgggaacgacatccgaagggcttcacgtttcaatttggagaaatctaaggttttcatgagcgtcgccgtcggatcggacctggtggttgtcgatgacgcaatgtttaaggactacaagccttcttcagctttcctctttcctggtcagggtgcacaagctattggaatgggggtggaggctcaaaaagtgcctgctgcagctgaattatacaagagagctaatgacattatggggtttgacattttgaatatttgcattaatgggccaaaggagaagctcgattctactgttctcagccagccagccatctatgtaacaagtttagctgcagttgaggtgctccgagctcgtgacggtggtcagcaaataattgactccgttgatgttacatgtggcctaagtttaggagaatacaccgctcttgcatttgctggagctttcagctttgaggatgggctgaagctagtcaagttaaggggtgaagcaatgcaggatgctgctgatgcttctaaaagtgctatggtgagtatcattggactcgactcggctaaggtgcaacagctttgcgacgcggccaacgaagaagtagacgaagcaagtaaagttcaaattgcaaatttcttgtgcactggaaactatgctgtatctggaggcctcaaaggaattgaagcagttgaagcaaaggcaaaatcgttcaaggctcgaatgacggttcggttagctgtagccggtgcgttccacacaagttttatggaaccagcagtgtcaagactagaatctgctttggcatcaacagtaatcaaaaccccgagaataccagttatatcaaatgtcgatgctgagccacatgcagacccagctacaatcaagaaaattttagctcgccaggtgacatctccagttcaatgggagacaacggttaagactttgttaagtagaggtttgaataagagctatgaattaggacctggaaaggtcatagctggcatcgtcaaaaggatggataaaggtgcttacttagagaatatcggtgcctaaagagtctctttgatgtgttctgtgaaattatccttcttaccaacccgtatgtacctgcttcaaaccgagacgagtaggagcttcacagcttatggttgttattctagggtgtatttttagagaatgggatcacagaatgactaaaagtaaaaggaaacaataaattgcaattgttttagaatttgtgagaggcattattttggagatcgatatatatgagattcttggtggcattgtgtaagttagcctgatcaaaccaagaaaatccagtgcaaagctaaataattgttatttcaattcttttctatctttattcgcggttaactgaaatgtgtgttccaattctttttcgaatttaatt

SEQ ID NO: 3975 - DNA, 1481 bp, Brassica rapa
agttgggtggggtggggttctctcaagtctcaacttactccatctaacccatcttcgttaactccgcttaggcttttgttttataaaaaggatactacaaaacttgtctgtctgaatgcgctcactgcttcaccgtacacctcgtttgaaagctcattgtcttatcctgcgcaccaccacgatggccacctcctactcttcttccttgctcctccctccttccgtatctctcaacaagtcccgaaacggctcctccctcggattctccgtcaaccgatctagggtttccacgaacgtctccgctggatctcagaccactctcaacgactctctcttcgccgattacaaaccctcctctgcttttctctttcccggtcagggagctcaagcaatagggatgggcaaagaggctcagagtgttgccgcagctgcagacttgtataccaaagctaacaacatcttagggtatgatcttcttgacatttgtgttaatggaccaaaagagaagcttgattccactgtcattagccagcctgctatttatgtcacaagtctagcagcagttgagttgcttcgtgtccgtgaaggcggcgagcagataattaactccgtcgatgtcacttgtggtctcagcttgggagagtacactgctctcgcatttgctggagccttcagctttgaggatgggctaaagcttgtaaaactcagaggagaagccatgcaggctgctgcagatgctgctaagagtgccatggttagtatcatagggttggactctgaaaaagttcagcagttgtgtgatgcagcaaatcaagaagtagaagaagctgacaaagttcagatcgctaatttcttatgtccgggtaactacgcagtatctggaggtcttaagggaatcgaggctgttgaagcaaaagctaagtcgttcaaggcccgcatgacggttcgtctagctgttgcaggtgctttccacactagtttcatggagccagcagtgtcgagattagaagctgcattggcatcaacggagatcagaagtccgaggatcccagtgatctccaacgtcgacgcacagcctcatgcggatccagacactatcaagaagatacttgcacgccaggtgacatctccagtgcaatgggagacaacggtgaagactctcttatccaaagggcttaaaagcagctatgaactgggacctgggaaggtgattgcagggatattcaagagagtagacaaaagcgccagtgtcgaaaacataagtgcttgagttgagaatccctctgctgcttcggaatttaaagttttgtatcaaaatatttatgtaacacttagcactgttgagatatctttatttaagtttcagttgatgaaagggcaaagttcacttcatagacaacaaaaagattgtgtatccagtgggttttgggttggcttcacattaactcggatggagattagtaaactttttatttgttttt

SEQ ID NO: 3976 - DNA, 1419 bp, Arabidopsis lyrata
ttaactccgctaaagcttttttaaaaagggttacttctgttacttctctgaatgcgttcactgcttcaccatactatcctacgcacttctcggtctcattttcttatcctgcgccctcctctctcccccatggccaccgccgcctcctcttccttgctcctcccttccgtatctctcaacaatctccccggctctaaaaatgcctccttttgcttcgccgccaagaatctcaaccgatctagggtttcaatgagtgtctccgctggatctcagtctactactgttcatgattcttttttcgctgattacaaacccacctctgcttttctctttcccggtcagggagctcaagcagtaggaatggggaaagaggctcagagtgttgcagcagctggagagttgtataagaaagctaatgatatcttagggtatgatcttttggatatttgtgttaatggaccaaaagagaagcttgattctacggtcataagccagcctgctatttatgtcacaagtttagcagcagtggaattgctccgtgttcgtgaaggcggagaacaaataattaactcagttgatgtgacttgcggtctcagtttgggagagtacactgctctggcatttgctggagccttcagcttcgaggacgggctgaagcttgtaaaacttagaggagaagccatgcaggctgcggcagatgctgctaagagtgccatggttagtatcatagggttggactcagaaaaggttcagcagttgtgtgatgcagcaaatcaggaagtagatgaagctgacaaagttcagatcgcaaattatttatgtccgggtaattacgccgtatctggaggtcttaaaggaatcgaagttgttgaagccaaagctaagtcattcaaagcccgaatgacggtgcgtctagctgttgcgggtgcattccacactagtttcatggaaccagcagtcacgagattagaagcagcattggcagcaacagagatcagaagtccgaggatcccagtgatatccaatgtcgatgcacagcctcatgcagatccagacacgatcaagaagatacttgcacgccaggtgacatctccagtccaatgggagacaacagtaaagactctcttatccaaaggacttaaaagcagctatgaattgggacctggaaaggtaattgcagggatattcaagagagtagataaaagcgcaagtgtcgaaaacatcagtgcttgagagtcttggtagctttttgttcacatgtatttgagttgagaatcactaataataagtaaatttaaaacgtatgtctgtggaatctctctagtgcttcagtagtttggaattcaaagttttgtatggaatatttatgtgacactttacatgatatatgtattgagatatctttttagtttcagttaa

SEQ ID NO: 3977 - DNA, 1402 bp, Arabidopsis thaliana
ctaaagcttttttaaaaaggattactactgtttacttctctgaatgcgttcactgcttcaccgtactatcttactcacatctccgtctcattctcttatccggcgcacttctctctccgccatggccaccaccgcctcctcttccttgctcctcccttccatatctctcaacaatctctcctcctctaaaaatgcctcctttggcttcgccgccaagaatctcagccgatctaggatttctatgagcgtctctgctggatctcagagtactactgttcacgattctctgttcgctgattacaaacccacctctgcttttctctttcccggtcagggagctcaagcagtaggaatgggaaaagagtctcagagtgttggagcagctggagagttgtataagaaagctaatgatatcttagggtatgatcttttggatatttgtgttaatggaccaaaagagaagcttgattctacggtcataagccagcctgctatttatgtcacaagtttagcagcagttgaattgctccgtgttcgtgaaggcggagaacaaataattaactcggttgatgtgacttgcggtctcagtttgggagagtatactgctctggcttttgctggagccttcagcttcgaggacgggctgaagcttgtaaaacttagaggagaagctatgcaggctgctgcagatgctgctaagagtgccatggttagtatcatagggttggactcagaaaaggttcagcagttgtgtgatgcagcaaatcaagaagtagatgaagctgacaaagttcagatcgcaaattacttatgtccgggtaattacgcagtatctggaggtcttaaaggaatcgaagttgttgaagccaaagctaagtcattcaaagcacgaatgacggtgcgtctagctgttgcaggtgctttccacactagtttcatggaaccagcagtctcgagattagaagctgcattggcagccacagagatcagaagtccgaggatcccagtgatctcgaatgtcgatgcacagcctcatgcagatccagacacgatcaagaagatacttgcacgccaggtgacatctccagtccaatgggagacaacagtaaagactctcttatccaaaggacttaaaagcagctacgaattgggacctggaaaggtaattgcagggatattcaagagagtagataaaagcgcaagtttcgaaaacatcagtgcttgagagtattgctagctttttgttcacatgtatttgagttgagaatcattgataataagtaaatttacaacgtatgtctgtggatctctctagtgcttcaatagtttggaattcaaagttttgtatggaatatttatgtgacactttacaggatatatgtattgagatatctttttagtt

SEQ ID NO: 3978 - DNA, 1685 bp, Phaseolus vulgaris
ctgaagtgaaacgaaacatgtaatttttggagataatattatgatatgacgaagaaggtgaagatggtagtgaagaagtagttgaagaatttgaacagcgataccaacgttcctctttgaaatttccgccttcaaaaactatatgaaagctctgattcaccattctcattctcattctcattccctcttccttcgccacacttcttcttcttcttcgctctctgcaatgtcttcctctctctttcttccatccgctcccttcctcaccccttcctctaatggaagacccaccctacctctccctcgatctagggtttccatgagcgtctccaccggatctcagccttccgttcaccaaacgctgttcgccgattacaaaccctccaattcattcctcttccccggtcagggtgctcaagctgttggaatggggaaggaagcccagaacgtgcctgctgctgcgcttttgttcagcaaggcgaatgacatattggggtttgatcttcttgatatatgcatcaatgggccaaaagaaaagctagattcaactgttattagccagcctgcaatttatgtcacaagtcttgctgctgtggagctacttcgtgcacgtgaaggtggtcagcagattattgactcggtggatgtaacatgtggtttaagcctgggagaatacactgctctggcatttgctgggtctttcagctttgaagatggacttaaattggtcaaactgaggggtgaggccatgcaggatgccgctgatgctgctaaaggtgctatggttagtgtgataggactggactcggagaaggtccagcaattgtgtgatgcagccaatcaggaagtttctgaagctgagaaggttcagattgccaattacctgtgtccaggaaactatgctgtctctggaggactaaaaggaatagaagtggtggaatccaaagcaaagtctttcaaggctcggatgatagttcgcctagctgttgctggtgcttttcacactagttttatggaaccagctttgtcaagattggaagcagcattggcaacaacagaaatcagaaccccaagaataccagtcatctccaatgtgaatgcgcagccgcatacagatcctgtcacaataaagaagacattggcacgtcaggttacgtcacctgttcagtgggaaacaacagtgaagacccttctagccaagggtctgaagaaaagctatgaactgggacccggaaaggttattactggaattgtcaaaagattggacaaaggcgcggacattgaaaatattggtgcttaagaaggcaataggaccttgctccttctgcttccaatgaacaaaagtaatataacattttttacaatagaaaatgtgcgtgagctgaatcaagagattgattgcatggatcatggaactcttagcaggagcagctacagtcacatttgaagttttgaagttaaattataattcacgaattgacattattatgaacgagtcagaaaaaagtgattgtactcggctttagaaacattcatttcttgtaatatcataaaacgtatctcggagttaattaagctttatgtttctgtgtgccagatatagctttaagcctattagaagaaactatagttatattatattacaattgttattgctggtatattgtgtaagacttatggagaac

SEQ ID NO: 3979 - DNA, 1315 bp, Flaveria ramosissima
tccatctgtttcactgaatcatcaggctcacgattcatttccattgaagagctcgtcttccgtttcttttggaggtcttaaacatggatttcgacggcttaatttggagaaatctagggtttcaatgtgtgtatcggttggatccaccactgcggttgatgatgcgttgtttgttgattataagcctaccactgctttcctcttcccagggcagggtgcacaagctgttggaatgggacaagaggctctcaaagtaccagctgctgcagagttgtacaataaggcaaatgagattttagggtttgatatcttggacgtttgcattaacgggccaaaagagaaactggattcaactgttttaagtcagccagctatatatgttactagtctagctgcagtagagatactacgagctcgtgatggtggtcaacagataattgattctgttgatgttacatgtggactaagtttaggggaatacacagctcttgcatttgctggagcttttagtttcgaggatggtctcaagctggttaaactaagaggtcaagcaatgcaggaagctgcagatgctgctaaaggtgctatggtcagtattattggactagattcagataaggtgcaacaactctgtgatgcagccaatgaagaagttgaggaagctgaaaaagttcaaattgcaaatttcttatgcaatggaaactatgcagtatcaggagggataaagggaattgaagctgtggaagctaaagcaaaatcgttcaaggctcgaatgacggtgcgtcttgctgtcgctggggccttccacacccaattcatgaacccagctttatcccagctggagtcggctttgtcagcaacccaaatcaaaactccaagaataccagttatatctaatgttgatgcacaaccacattctgaccctgaaactatcaagaaaatcttggctcgtcaggttacatcaccggtacaatgggagacaacggtgaagactcttttgtcaaggggacttgcaaagagttatgaactcggacctggaaaggttattgccggaatagtgaagcgaatggacaaaacatcgccaattgagaacattggcgcgtgaacacgggcttgaattgttgctgttttacaataattgatgagttacagacttctttgtggtaagagtataaaaagggactatggggcttatatagagcaaaatagtgtagttgagttatcgtgtatgatcatagcttctttttgaatttgtattatgtacgtgattatatactcttcgaagtgattattatagttatttactaaaaaaaaa

SEQ ID NO: 3980 - DNA, 1458 bp, Eutrema halophilum
cttccttcatctaccatcatcttcgttaactccgtcttaaagcatttttaaaaaaggatactcctttctcttctctgaatgcgctcactgcttcaccgtactatcctacgcactcctccggctctttctcttatcctgcgcactcttccctcctccgccgccgccaccgccatggccgccgccgcctcttccttgctcctcccttccgtatctctcaacaacctctgctcctcctccagaaatgcctcctccctctgcttacccgtcaagaatatcagccgatctagggtttccatgagcgtctccgctggatctcagactaccgtcaacgacactttgttcgccgattacaaacccacctctgcttttctgtttcccggtcagggagcacaagcagtagggatggggaaagaggctcagagtgttgcagcagctgaagagttgtataagaaagctaatgatatcttggggtatgatcttcttgacatttgtgttaatggaccaaaagagaagcttgattccacagtcataagccagcctgctatttacgtcacaagcctagcagcagttgaattactccgtgttcgtgaaggcggtgaacaaataattaactctgttgatgtgacttgcggtctcagtttgggagagtacactgctcttgcatttgctggagccttcagtttcgaggatgggctaaagcttgtaaaactaagaggagaagccatgcaggctgctgcagatgcagctaagagcgctatggttagtatcataggattggactcggaaaaggttcagcacttgtgtgatgcagcaaatcaagaagtagatgaagctgacaaagtccagatcgcaaattacttatgtccgggtaattatgcagtatctggaggtcttaaaggaatcgaagctgttgaagccaaagctaagtctttcaaggctcgactgactgttcgtctagctgttgcaggtgcattccacacaagtttcatggaaccagcagtgtcgagattagaagctgcattggcagcaacggagatcagaagtccgaggatcccagtgatctctaatgtcgatgcacagcctcatgcagatccagacacgatcaagaagatacttgcacgccaggtgacatctccagtccagtgggagacaacagtaaagacactcttgtccaaaggacttaaaagcagctatgaattgggacctggaaaggtgattgcaggaatattcaagagagtagataaaagcgcgagtgtcgagaacatcagtgcttgagactctctggctagccattttgttaatgtatttgaattgagaatcactcactaataagtaaattgaaaaactttatgtttgtgtaatctctcaggtgcttcagtagttttggagaattcaaagttttgtatcgaatacttatgtaacactttgcacgatatttatgttgagatatctttttac

SEQ ID NO: 3981 - DNA, 1661 bp, Musa acuminata
aatttgtggtggctcggatattgactcggcctgggccggaggcggagaaaacaagaaggccgctgggttgggaccgctttctcttctgtcactcatcttgtgagctccgccgctctcttttatctccccctttgtttttgctcctctcttccgatctcggcgaccgctttcttccccctccacgatgtcgtcggcttcaactgctctgatccccttggccccgctccaccggttctcctcggttaatggtgcccggagatcgttcctgtgtcacaggaacccctggagatctagggtttccatgagcgtctcggtcggatcgcgagctacagtgggaaatgatgccctcttccaagattataagccctcttgtgctttcctctttcctggccagggagcacaaactgttggaatgggggtggaagctcagaatgtgaatgctgctgctgaattgtttaagaaagcaaatgatatacttggttatgatctcttggatgtttgtgccaatgggccaaaagaaaagcttgattcaacagtaataagccagccagccatatatgttaccagtctagctgcagttgaagtattgcgggcacgtgatggaggtcaggatataatcaattctgtagatgtcacttgtggcttgagcttgggagaatatacagcccttgcatttgctggtgcattcagttttgaggatggtctcaagcttgtcaagttaagaggagaagcaatgcaggatgcagctgatgctgctaaaagtgctatggtcagtgtcatcggactggactctgaaaaggtgcagctgttatgtgatgctgctaacgaagaagttgatgaccaaaataaagttcagatcgcaaactttttatgtccaggtaattatgctgtttctggtggtgtgaagggagttgaagcagtggaagctaaggcaaagtcttttaaggctcggatgacggtacgccttgctgttgctggtgcttttcataccaactttatggaaccggctgtctccagattagaagctgcgctcgcgacaacagaaatcagaacgccaaggattccagttatatcaaatgtggatgcccagccacactcggatcctgatacgatcaaaaaaattttggcacaacaggtgacgactcctgtgcaatgggaactgacgctgaagactctgttaaacaaagggttgaagaaaagctatgagttgggacctggaaaggttatcgccggaatcttgaaaaggatggataaatcggctgatcttgagaacattggtgcttgatattgtttctaaagaaactcgaatgttgaaacttcaaaagatgagactctaaagtcttcatttgcatttatcctggatgagcttgacatgcagaattccggagtagcacaaagaggccagcgacttaggtacggtgtcgaatgcccatttttatgactttctttttattgttgccttttttttcttttgttacggtctatgcttttgattttgagctcggtctgtccgtgttgtttagtcagtcagacgtttatgcatttaccaattgaacacgtcaaatctgcttagatttgttcccaagttgttgcacttttttatatttgatcgctcagaagcctattaagctacagtttgttgcccgtagcaaaccatagag

SEQ ID NO: 3982 - DNA, 1604 bp, Cichorium intybus
tatacaaacatcaatccaaacgttggcagttggcatgctccataggatttctagttacccttgtaatctccgctgcaatttcaaaaccctggtataaattcaaatacattaccactgaatgcatgcttgtttcccaccaatctctcatttggttcaactccctcgacttctcagaccctgttgtagtttcaatcttctctcaactatggcttcatcttcccttgtgcttccttcggtttcgctgaatcagaaggcgtcctttgatgttcatgattcgtatccgttgaagagctcatcttcgctttgttttgggggttctagacatgggtttcgacgtcttaatttggataaatctagggtttccatgagcgtatctgttggatctaccactgctgttagtgatgcactgttcgccgattataagccgaccaccgcctttctcttccccggccagggcgcacaagcagttggaatgggacaagaggctcaaaaggtgccagctgctgcagaattgtacaataaagcaaatgaaatcctggggtttgacatcttggacgtttgcattaatgggccaaaagaaaagttggattccaccgtattaagtcagccagctatatatgttactagtttagctgcagtagaaatactacgtgcccgtgaaggaggtcaacaaataattgattctgtagatgttacatgtggactaagcttaggtgaatacacagctcttgcatttgctggtgcatttagctttgaagatggtcttaaactggtcaaactaagaggtcaagcaatgcaagaagctgcggatgcttctaaaggtgctatggttagtatcattggactagattcagataaggtgcaacaactgtgtgatgcagctaatgaagaagttgaggaagctgagaaagttcaaattgcgaattatttatgcactggaaactatgcggtctctggaggtgtgaagggaattgaagcggtggaagcaaaagcaaaatcattcaaggctcgaatgacggtgcgccttgcagttgcgggtgcatttcacaccagtttcatgagcccggcattgtccaaactggaatcggcattggcagcaacacaaatcacaactccaagaatcccagttatatctaatgtagatgcacaaccacatgccgaccccgataccatcaagaaaatcttggcacgccaggttacatcacccgttcaatgggagacaacagtgaagactcttttatcaaggggactggaaaagagttatgaacttggacctggaaaggtgattgctgggattgtgaagagaatggacaaaacatcacccattgagaacattattgcatgaatgtggacttgatttgttgctatacaataatattggagtaagggcataaagggaattttgagcttgattgatgtagttgagtttttgtgtatggttataacggttagtgatatttattatgagttctattcaagggaatgtaatcagaccaggataataagctttagttgttcttgtcacattgagtcatttcatcgaacattatgtatgcacttgcaatattgcatgattaacttgtcaaagatgcagttcacttgtt

SEQ ID NO: 3983 - DNA, 1448 bp, Euphorbia peplus
tcacattttcatctgccatggcctgcaccatctccctcccttccgtctccctcaaaagcaacctctctttcgcttcctcgagctccgatgggagtggaattcgaagattcggtgttaaatttcccgctcgatctagggtttttatgagtgtctctactggatctcaaattagcgttgttgatgatgccttgtttaaggattataagcctcagtttgcttttctgtttcctggtcagggtgcacaagccattggaatgggaaaggaggcccaaagtgttcctgctgcagcagacttgtataaaaaagcaaatgatatactaggatacgatcttctagaactttgcaccagtggtccaaaagagaagctggattcaactgtcataagccagcctgcaatttatgtcactagtcttgctgcagttgagttgctccgagctcgtgatggaggccagcaaataattgattctgtcgatgttacatgtggtctcagcttgggagagtatactgctctagcatttgctggagctttcagcttcgaggacggactcaagctggtgaaattgaggggtgaagccatgcagaaagctgctgatgctgcaagaagcgccatggtcagtatcataggactggattccgacaaagttcaacagctgtgtgatgcagccaatgaagaagttgacgaagcggatagagttcagattgcaaattatttatgtcctgggaactatgctgtatccggaggtctgaagggaatcgaagctgtagaagctaaggcaaaatcttttaaagcccgtatggcggtacggctagctgttgctggtgctttccatactagtttcatggaacctgctgtctcgagattagaagctgcattagcagcaacagagatcaaatctccaagaatacccgttatatccaatgtcgatgctcagccacatgcagatcctgctgaaatcaagaagatattggcacgccaagtgacttctcctgtccaatgggaaacaacagtgaaaacccttctaaataacgggttgaagaagagttatgaactaggaccaggaaaggttattgctggcattgtgaagagagtgaacaagggtgctgaaattgaaaacataagtgcttaaacggcgcaccttggctgcttcctaatcggcggattgattatacttatcaaagttttccttagtcgagagagaaatatatttggagctgaaattattctcacaaaacccagccgtctgagtttttcttttagcatatttttcggctttagttttgagtttagattaacatgtaccgagacacttattactattttgtactgcccgatttctttcgagtcctcttgactctttacaaactttgaatgtatttgtagacatacaattgttgtttccatttctgtaaaggaataaatatgagcagaataaaatcgaagtgtattc

SEQ ID NO: 3984 - DNA, 1640 bp, Lippia dulcis
gtgttgagcgtgttaaggtagagtggccgttggcccaattccgcccccggacgacatttctgaagccactttcttcgtttcctccgccaaataaatcctctctttatttaattctggttaatgcatgcattttcttctccaccaccacaatcgattccatctccatctaattcgattcaatcgccccgcgaaattttcctctcgctccgcatcaatgagttcttcggtcgtgcttccatcgatttctctcactaaaacctctttcggcgcctcagaatcctctttcagaagctcgagctgtttgggtttcaggaatgacattcggagggcttcacggtggaatgtcgagaaatctaggcttttcatgagcgtcgccgtcggatcggaggcggctgttgtcgatgatgggttgttcaaggactacaagccttcgacggctttcctctttcctggacagggtgcgcaagctgttggagtgggggtggaggctcaaaaggttcctgctgcagctgagttatacaagagagctaatgatattttggggttcgaccttttggatatctgcattaatgggccaaaagagaagctcgattcaactgttttaagccagccagctatctacgttacaagtttagctgcaattgaggtgctccgagctcgtgatggaggtcagcaaataattgattctgtggatgtaacatgtgggctaagtttaggagaatacacggctcttgcatttgccggagctttcagctttgaggatgggctgaagctagtcaagttaagaggtgaagcaatgcaggatgctgctgatgctgcaaaaggtgccatggttagtattgtcggactagactctgctaaggtgcaagcactctgtgatgctgccaatgaagaagttgatgaagcagataaagttcaaattgcaaattacttgtgcactgggaactatgctgtctctggaggccttaaaggaattgaagcagttgaagcaaaggcaaaatcttttaaggctcggatggcggttcggttagctgtagctggtgctttccacacaagttttatgaatccagctgtatcaagactagaagctgctttggcagcaacagtaatgaggagccccagaataccagttatatccaacgttgatgcagaaccacatgcagatcccgccacaatcaagaaaatactagctcgccaggtgacatctcctgtacagtgggagacaatggtgaagacattgttaacccgaggattgcaaaagagctacgaattaggacccggaaaggtgatcgctggtatcgtcaaaaggatggataaaggtgctgcgattgagaatattggtgcttaacgcttatagtgaagtagcctatttttcggcaaaattctttcttcaattgcaatggctacgggatagagtgcactaggaactttaagtttcatctattgtttattttaggctatccagatgtatctgtaattccagtttgggcatgatgcttcgaatatattatgagaaaagtcaaagtaaacaataaatgtgttagttttctgcatttgtgaaacattaatttgcaggtttacattgtcacctttttaaggactaaattggaatttgatccttgatcgggtctaaaaaagaa

SEQ ID NO: 3985 - DNA, 1826 bp, Solanum lycopersicum
tcgcagttaataataaggcacacatttctagtgaccctcacctcttctcttcgtctccaaagtccactctctgatcactcatcagctcccggagattaacgaaatcggaaaaccaatccaactattttttgatttccgattgaagaaaatgtctcagagccttaatccgaatccaacttacgacgtgataatcttaggggcttcaggttttactgggaagtacgtcattagagaagctctcaaattcctcaatgttccctcttcccccttgaagaacttagccattgctggccgtaacaattctaagctttcccaggctcttcaatgggcttcccgtccaaacccaccacccgaaattcccattatcactgccgataccactgacccatcttccctccgcgaccttgcttcacagactaagatcattcttaactgtgtcggaccgtttcggctttatggtgagcctgtttttgaggcctgtgctgattctggatgcgattacttggatatttctggggagcctgagtttatggagaggatggaggtgaagtatcatgataaggctgtggaaaatggatccttacttgtttcggcatgtgggtttgattctattcctgctgaattggggttgatgttcaattcgagacagtggctgccgccggctgttcctaacagtgttgtggcctaccttagtctagaatcggataagagaattgttggaaacttggggacgtatgagtcagcggtgcttggtgtggctaatgtggacaaattacaggagctgcgacggagcagaccaaagagccctcgtcctgtgattcctggtcctcgtcctcctaaaggtcctttgatggaccacctaaaggaagttggtgtttgggccgtaaagttaccatcagcagatgcgattgtggtccgaagaacactttcatgtttggctgaaaatcctcatggtttacctggtgttaatgaaagcactgaacaagttgagaggagggaggcattttggtcaagcataaagccagctcactttggtgtgaagatagcttcaaagtctccgttaggagttgttcgtttcattatagtcgggctgttcattggtctctttggtaaaattggtttagggaggtggctgctattgaaattcccttcattgttcagtcttggatggttcaggaaaaaaggtccaactgaagatgaagtggcaagtgctacctttaagatgtggtttgttggacacgggtttagcgatggcagtcttgcatcacaaggaaacaggaagcctgatacagagataattacaagagtaatgggacctgagattggttatttaacaactccaatcattcttgtccagtgtgctctcattttgctcaaggaacgaaacaatcttccaaagggaggtgttttcccacctgggattgtgtttggcccaaccgacctccaagacaggcttcaacacaatgggatatcttttgacgttatttcaaagaaaacaatctaactaaatggaagtgttcccttctattcacagaggaaattttgattttcttctgaagggagaaagatactagttacttatgctttcattgtacgtttttctgaatgtttatatgcttgtttaataacttaaggtgcttcctcaacatttttctttccgtatttagattactggataagctctactttgtttaacaatttgttaggtctgttaactcctgtggatctctgatatcaggagcttccactttacacctataaccttgctataatttagtgcatttgattcttattgtgcttgaacttcttcgtgtgttgttggcctg

SEQ ID NO: 3986 - DNA, 2891 bp, Capsicum annuum
ttctcttcgtcttcaaagtccaactctctgatcaacactcttcccttccattaacccaaaatcgataaacaaatccaacaaaaatgtctcagaatccaacatacgacgtgataatcttaggtgcttcaggttttactggtaaatacgttattagagaagctctcaaattcctcaacgttccatcttcccctttgaaaaacttagccatagctggccgtaacacttccaaactttcccaggctctacaatgggcctccggcccaaacccaccaccccaaatcccaatcctcgccgccgacacaaccgacccgttttctctccggcacctcgcttcccagactaagatcattctcaactgtgtcggcccgtttcgtctttacggcgagcccgttgctgaagcatgtgttgattcgggctgcgattacttggatatatctggagagcctgagtttatggagaggatggaagtgaagtatcatgataaggctgtggaaaatggttcgttggttgtttcggcttgtgggtttgattctgttcctgctgaattggggttgatgttcaattcaaggcagtggttgtccccggctgttcctaattcggttgaggcttacgttagtttagaatcggataagagaattgttggaaactttgcaacgtatgaatcagcggtgcttggcgtggctaatgcggataaattactggagttaagacggaacagaccaaagaggcctcgtcctgtgattcctggtcctcgtcctcctaatggtccgttgatggaccaccaaaaggaaattggcgtttgggctgtaaagttaccatcagcagatgccattgtagtccgaagaacactttcatgtttggctgaaaatcctaatggtttaccaggtgttaatgaaagcactgaacatgttgagaggagggaggcattttggtcaagcataaaaccagctcacttcggtgtgaagatagcttcaaaatctgtattaggtgttgttcgtttcattacagttggtgtgttcattggtctctttgctaaaattggtatagggaggtggctgctattgaaattcccttcattgttcagtcttggatggttcaggaaaaaaggtccaactgaagatgaagtggcaagtgctacctttaagatgtggtttgtcggacacgggtttagcgatggcagtcttgcatctcaaggaaacaggaagcctgatacggagataattacaagagtaatgggacctgaggttggttatttgacaactccgatcattctagtccagtgtgctctcattttgctcaaggaacgacacaatcttccaaagggaggtgttttaccgcccgggatcgtgtttggaccaacagacctccaagacatgcttcaacagaatggaatatcttttgatgttatttcaaagaatactgtctaacttaatgtttgtgcccttttagtcgcatggggaaacccgaacttcttcctaagggaaaatgaaactaattacttttgctttaattgcattgtttcttccgactgttttcgtaaattttgatatgctttcttaatgggggtgtgggagtgtaggggggacgtggatgttatgtgggaaataaggcggccaactgcatcagggaggcggctagagaggtgttgggtgtttcgaggggtcgagcaggatgacataagggggactggtggtggaatgaggaagttaacaagaaagtggagatcaagaagggggcgtatgttcagttgattgagagtaaggatgaagaggagaagcgggtgaatagggaggtctacaaagtagcaaggaaagaggctaatttagcagttacggcgactaagacagcagcatttgagggtttgtatgcgggttagaggagaaaggcggggaaaaaaggttgtatggcttgctaaggctaggtagaggaagggtcgtgacctcgatcaagtgaagtgcattaagggggaggaaggtagagtgttggtgaaagatgttcacattaagaagagatggcaggagtattttcataggcttttaaacgaggaaggggacagaggcattgtgttaggggagttggagcgctcggagaagagccgcgatttcagttactggagacgttttaaggttgtggaggtcagagaggctattcgtagaatgcagagtggtagggtgacggggcccgacgagatcccggtggatttttggaagtatgctagtggggcaggcttaaggtggctgactgatttgttcaacgccattttcactactgcgagaatgtctgaggcttggagatggagtacgatgattccttcgtataaaaacaagggtgacattcacagttgcaataactataggggaattaagctgttgagtcacactatgaagatttgggagagggtggttgagcggagattgaggagggtcgtgtccatttcagagaatcagtttggttttatgcctggtcgctcgacgacagaggcaattcacctggtgagaagattggtggaagcaattcacctggtgagaagattggtggagcagtatagggaaaggaagagggatttgcccatgatgtttatcgatctggagaaggcggtatgacagagtccctagggaggttctttggagatgcttggaggtgagaggagtgcaggtggcgtacatcagagctattaaggacatgtacgatggagggaaaagtcgggtgaggacggcgggaggagactcatggcattttccggtagagacaggtttgcaccagggatcgactcttagcctgttcctttttgcgttggtgatggacgtgttggcgcggagtattcaaggtgaggtgccgtggtgtatgttatttgcggatgatgtagtgctgattgatgagataagggaggg

SEQ ID NO: 3987 - DNA, 2912 bp, Capsicum annuum
aagctttctataaaaagaaatgaaaagttaaattaatttgatgaaaaaacaatatctcgccttaatgcacgttcataaatcatagtcataaatttttggtcctggcaaaattctcagttaggaaatatttgagcttgtccactcttgccaaattttgtaaccttctatccccatttaaaaccccccaaaaacaaccacaaagaatacgtaacctttgaagggttgctcttcctcactctctcattttcttgtttactctcatcaggtgattcttcttcttcaacaattattctcactttaatatctcaaaattaaagagagttaatttaagcaaagcaatcacatgaatattggagtatggggaggagcagcagcattgagattagtttggcgggaaagaaaaaaataacgtgaggcatatatacgtggagaccgttaacaaattgacggaagctgggtcataagtgctttgctttaccaaaagatgtggactattaatgctacatacaaaagcaataggaccattttgccaaaaatattggaccattttggatactatccaacatgttatacaattattaccaatcgagccatgtcacaaaaactcagtccaaatccaacttacgacgtcataatcttaggcgcttcaggttttactggcaaacacgtcattagagaagctctcaaattcctcaacgtttcatcttccccattgaaaaacttagccatagcaggccgtaacgcttccaggctttcccgggctctacaatgggcctccggcccgaacccgccacccgaaattcccattatcgccgccgacaccaacgatccatcttcacttcgtcaccttgcttcccggactaagatcattctcaactgtgtcggcccgtttcgcctttacggcgagcccgttgttgaagcgtgtgttgattcgggctgcgattacttggatatttgtggagagcctgagtttatggagaggatggaagtgaagtaccatgataaagctgtggaaaatggctcgttggttgtttcggcctgtggatttgattctgttcctgctgaattaggatggatgttcagttcgagacagtggacgccgccggcaatttgcagtacgattgaggcgtacattagtttagaatcggataagagaattgttggaaatttggggacgtatgagtcagccgtgcttagtgtggctaatgcggataaattacaggaactaaggcgctccagacccaagaagcctcgtcctgtgattcttggtacttcttctaaaggtccaatgataaatcacctaaaagaagttgggctttgggctgtaaagttaccatcagcagatgcaactgtggtgcggagaacactttcatgtttggctgaaaatcttcatggtttacctggtgttaatgaaagcactgaacagattgagaggagggaggaattttggtctaccataaagccagctcactttggtatgaagatagcttcgaaatatctgttaggtgttgttcgtttcattacagtaggcaagttcattgctctctttggtaaaactggtataggcaggtggctgctcttgaacttcccttcagtattcagtcttggatttttcaggaaaaaaggtccaactgaggatgaagtggcaagtgctacctttaagatgtggtttgtcggacatgggtttactgatgggagtcttgcatcacaaggaaaccggaaacctgatatgcagataattacaagagtaatgggacctgagattggttatttgacaactccaagcattctagtccagtgtgccctcatattgctcaaggaacgagacagtcttccaaaaggaggtgttttccctcctgggattgtgtttggcccgacagacctccaagacaggcttcaaaagaatgggatatcttttgatgttatttcaaagaaaacggttgttcatctaaccatttaggaagagaagtgttttcacaaacggatttgtgatacttgaaaggtccaattggcagaaactgtggaagagtgatcattgtcctaccactattgagggcttcaatcgtctctggttcaaaccagtggaacgtgttggcaacaacacctttaaccttggagacagctcgaaggtttgatatcaaccgcgttgtgaagatattctctggattgaataaaacaggaggaatatttgacactgaaaatgagggtaaactaggaagctgcaagttgttgcaactgccttcaagagtcaagtggggtaggtgggtaataagagaataaaatctagcagaagttatacttaagatgtaataggatatagacaatgatggttcatcagcaagttgatcaacacattctgcagcagcaatgtcaagaaaaagagcggaaactggtggagataaagaagatagaagaggaggaagaagatgaacagaacgaacaatagcctcaaactggagggcaaaaggatcatcgtgaggattcgatgagtggaggggaatgacatgaaaatcaaggcgctgaatgtgtggatgcgcggaaaagaagctattcaaatggttagattcagcagcggagacagtaggctgggcagtgagtatagtaaccttacaattacgagaagctaacatggcagcgaggcgaagagatggcatcaaatgccccattccagcacttggaagtagcgcgacatgagtttccatctttcaaaatctatcgattgaagttgttgcttgacctgagtctcagttaaaaacggtgatgatataggtttaaaaaacctgagaatctttatatttatcggagaagactggactttgtaagcctcacattctacctaacacaacaaccaccctgcatgttggtggctgttaattgttggaatcatgtttcatttaagatctcaactacca

SEQ ID NO: 3988 - DNA, 3261 bp, Solanum lycopersicum
atggtattctacgtggaagaatttcagaataatgtaactgacaaacggaggaggagcattgatattgaagtttggcgggaaagaaaagaatcacgtgaggtgtacgtggaatttttctctccgttaaaagtaactgacggaatctgggtcataagtgcatcattttgccaaaagatgtggaccattgttactgcatacaaaagaaataggaccattctgccaaaaatattagactatccaacatattttacaatttccaatcgggccatctcacaaaagcccagcccgaacccaagcccaacttacgatatgataattttaggtgcttcaggttttacaggcaaacacgtaattggagaggctctcaaattccttaaccttccttcttcaccattgaagaacttcgccattgcaggccgtaatacttcgaaactttcacaggctttgcaatgggcctccggtccaaacccgccacccgaaattccgatcctcaccgccgacaccaccgactcggcttcacttcgtcacctcgcttcccggactaagatcatcctcaactgtgtcggaccatttcgtctttatggagaaccggttgttgaggcatgtgttgattccgggtgcgattacttggatatatgtggagaaccggagtttatggagaggatggaggtgaagcaccatgataaggctgtggagaatggatcgttagttgtttcggcttgtggatttgattctattcctgctgaattaggctggatgttcaattcgagacagtggatgccgccggcaatatttagtacggttgaggcctacattagtctagaatcagacaagagaattgttggaaatttggggacgtacgagtcagcggtgcttagtgtggcaaacgcagacatattgcaggaattgagacgctccagacccaagaagcctcgtcctgagattcctggtacttttcctaaaggtccattggtaaatcacctaaagagagttgggctttgggcggtaaagttgccatcagcagatgcaactgtggtacggagaacactttcatgtttggctgaagattctcatggtttacctggtgttaatgaaagcaccgaacagattgagaggagagaggcatattggtctgcaataaagccagctcactttggtatgaagatagcttcgaaatctctgttaggtgttgttcgtttcattacagttggcaagttcattgctctatttggtaaaagcgatatagggaggtggctgctcttgaacttcccttcagtgttcagtcttggatttttcaggaaaaaaggtccaactgaggatgaagtggcaagtgcttcctttaagatgtggtttgtcggacagggttttagtgatggcagccttgcttcacaaagaaacaggaaacctgatatggagataattacaagagtaatgggacctgagattggttattcgacaactccaatcattctagtccagtgtgccctaatgttgctcaaggaacgaggcaatcttccaaaaggcggtgttttccctcctgggattgtgtttggcccgactgacctccaagataggcttcaagagaatggaatatcttttgatgttatttcaaagaaaattgtctaacgaaatcatagttccctgctgttagtcgtatgaaatggttgtttgacattatataattaggtctgtcaagtcctgtgtatcttgatttcttgctaaagtagcgaaggcaagcctcaatgcctcaatcctccaaaatttcaaccctctccaatagacagattttgaattttaagtttgtgttttggattctaagaggggtgacattggccgattcagattggaatagataagaaattaacgggagctttaacatcacatgcaagaaatgtgacaaaatataatatggaagttaaagagatgtagtttagatgtgctcctccaaacttccatacccatagatgaagaggctatcacataacctgaagtaaatcgtaaaagcttcatgcaatataaaagtggaattggagacattgaaactgaagataaatttgatttgatttttcgattcgaaaaaaacaaaaatcgaataacaaagttcactgctgttttgatttatttttttttttttatctttaatttggaacagtcaaggaattaattttagtatctgtatcatatcacaaaactgatgtattgagtaatataagttttgattatcttgattggacttggcagccaatcttattaactgttaagttacttcttgtaagaagaggaaaaacccattaggtgagattaaacattccaaactttgagcttgagcatttcaattaattgtccaacaactttttctgatgtaccaccaaatttcccaagcccgttttggcctcttcgccccaccttctgagccatggacctcaacttgtgatcttgcattagctcttcaatcttctcctcaatctcttccgacttcaccaatctctcgcccagccaaccccaatgttttggccacaaccccaaccctgccttctccaccacctctgcgttaaacctttggtccccgttaagtgtccatgcaagcattggtactcctctctgagctgcttccatcgttgaattccaaccacagtggctaaagaatcctcctattgcatgatgtgttaaaatttcttcctgtttcacccactctttaacaactatcccctgtttcttctcttcaattttttcaaggagtgattgtcctaccaattctttcagctctgtttcctctgctttatcaactttgacggacttcaatacccaaaggaacttttgcttgctctttaacaatccctctcctatttcttttgtttggtcctttgacatagctgttctacttccaaagctaacatatacaactgatttggcaggttgttcatctaaccaagaaagggaagagcattttccagggtcttcgtaatgcttgaaaggtccaattggcagaaactgaggaagagtaatagaggtcttgccactgttgagggcttcaattgtctcagcctcaaaccaatggaacgtattggaaacaacacctttaactctggagatagctcgagcgtttgagatcaactgagttgtgaagagattctgtgggttgaaaataggaggagggatgttcgatattgaaaatgagggtagaccatgaagcttcaagttcacgcaactgctttcaagagtcaaatgaggtaggtgggtaataagagaaaaaaatctagc

SEQ ID NO: 3989 - DNA, 1826 bp, Capsicum annuum
aattttgatcttaattaattaaagttatgaccatttttaaagtttctaccttagcaccatttataatttgaagactttttatcacctcccacttaatttaatcgttgttttcatttgtagttcccttgttctcttcaccttcgaagtccaactctctgatcaacactactgttccctttcattaaccaaatcgataagcaaatccaacaaaaatgtctcagaacctcaatccgaatccaacatacgacgtgataatcttaggcgcttcaggttttacacgttattagagaagctctcaaattcctcaacgttccatcttccccattgaaacttagccatagctggccgtaacgcttccaaacttttccaggctctacaatgggcctccggaccgaacccgccacccgaaattcccatcctcaccgccgacaccagtgatccatcttcacttcgtcacctcgcgtcccagactaagatcattctcaactgtgtcggcccgtttcgtctttacggtgagcccgttgtttaagcatgtgttgattcgggcttcgattacttggatatatgtggagagcctgcgtttatggagaggatggaagtgaagttccatgataaggctgtggaaaataggtcgttggttgtttaagcttgtgggtttgattctgttcctgctgaattggggttgatgttcaattccagacagtggatgtccccgtctgttcctaattcggttgaggcctaccttagtttagaatcagataaaagaattgttacaaactttacgtcgtatgaatcagctgtgctaggtgaggctagtgttgataaattacaagagctaaggcagaatagaccgaagaggcctcgtcctgtgattcctggtcctcgtcatcctaatggtccgttgatggaccaccaaaaggaaattggtgtttgggctgtaaagttaccatcagcagatgcaattgtagtccaaagaacactttcatgtttggctgaaaatcctaatggtttaccgggtgttaatgaaagcaccgaacatgttgagaggagggaggcattttggtcaagcataaaaccagctcactttggtgtgaagatagcttcaaaatctgtgttaagagttgtttgtttcattacagttggtatgttcattgatctctttggtaaaactggtttagggaggtggctgctattgaaattcccttcattggtcagtctcggatgatttaggaaaacaagtccaactgaagatgaagtggcaagtgctacctttaagatgtggtttgtcggacacgggtttagcgatggcagtcttgcatcaccaggaaacaggaaggcctgatacggagataattacaagagtcatagggcctgagactcccatcattctagtccagtgtgctctcattttgctcaaggaacgacacaatcttccaaagggacgtgttttaccacctgggatcgattgtgtttggcccaacaaacctccaagacaggattcaacagaatggaatgtcttttgatgttatttcaaagattactgtctaacttaatgtttggatggtggtttccatggtatgtcatgtataattattaagagaataatgtttgttttgattatttcttaaaatgtatggtatggtttaattgtatagtttgataatcatgaaaatcctcattatatgtaatcactaatttggtgtatcactgatttacttttttttttttcagttatgttcttacttaatattatataatcttattttatcctctacttatattatttaactcccactccacaagtctcgctccccccaccctcctac

SEQ ID NO: 3990 - DNA, 1406 bp, Solanum phureja
gcccaaacccaaacccaaacccaaacccaaacgcaatcccaagcccaacttacgacgtgataattttaggtgcttcaggttttacaggcaaatacgtcattagagaagctcttaaattcctcaacgttccttcttcccccttgaagaacttcgccattgcaggccgtaacacttccaaactttcccaggctttgcaatgggcctccggcccaaactcgccacccgaaatcccgattctcatcgccgacaccaccgacccggcttcactccgtcacctcgcctcccagactaagatcatcctcaactgtgtcggaccatttcgtctttatggagaacctgtcgttgaggcctgtgttgattctgggtgcgattacttggatatatgtggagagccggagtttatggagaggatggaggtgaagtaccatgataaggctgtggtgaatggatcgttagctgtttcggcgtgtggatttgattatattcctgctgaattaggctggatgtttaattcgagacagtggatgccgccggcaatttgctgtaaggttgaggcctacattagtctagaatcggacaagagaattgttggaaatttggggacgtacgagtcagcagtgcttggtgtggctaatgcggacaaattacaggaactaaggcgctccagacccaagaggcctcgtcctgtgattcctggtacttttcctaatggtccaatggtcaatcacctaaagaaagttgggctttgggctgtaaagttaccatcagcagatgcaactgtggtatggagaacactttcatgtttggctgaagattcccgtggtttacctggtgttaatgaaagcaccgaacagattgagaagagggaggcattttggtctaccataaagccagctcactttggtatgaatataacttcgaattctctgttaggtgttgttcgtttcattacagttggcaagttcattgctctttttctttctcaaaaaagttcattgctctttttggtaaaactggtatagggaggttgctgctcttgaacttcccttcagtgttcagtcttggatttttcaggaaaaagggtccaactaaggatgaagtggcaagtgctacctttaagatgtggtttgttggacaggggtttagtgatggcagccttgcgtcacaaggaaacaggaaacctgatatggagataattacaagagtaatgggacctgagattggttatttgacaactccaatcattctagtccagtgtgcccttattttgctcaatgaacgagacaatcttccaaaaggaggtgtttttcctcctgggattgtgtttggcccgacagacctccaagacaggcttcaacagaatggaatatcttttgatgttatttcaaagaaacctgtctaccgaa

SEQ ID NO: 3991 - DNA, 1640 bp, Nicotiana benthamiana
attatttttagatttgtcgctagtaaaacgaaagttttgaagttaaaagtttggcccaaaattttcaatcattttattttgaaataagacggacagtgacataaatggaacatagggacaagtgaagaacactagtcctttattccttaaaacccttttatataccctcttccttccttcttctttctacttacatctactacttctttctgcaaatatggtggtgaaggtttcaatcttccttcttttcttatttctcttcactgtctctgccgttcgcccagctcctcctcttgaaggactactttcaaatgggaatttcgaagagcaaccaaagccaaaagacctcaagaaaaaaacagtacttgtaggcaaatatgctttgcccaaatgggaaatcaacggtttggtagagtacatctctggcgggccacagcctggcgggatgtacttcccagtcgcccacggcgtccatgccgtgaggctagggaatgatgcctcaatttctcaaacaattccagtaaagaaaggctctttgtatgcactcacatttggggcatcaagaacctgtgctcaagatgaggtcttgagggtgtcggtacctcctcaaaccggggaccttccattgcagaccctttatagcagcaatggcggtgatacctatgcttggggtttctatgctacttctaatgtagttaaagttacctttcataatcctggagttcaagaggatccagcttgtggtccactcttggatgctgttgctatcaaagaactcttccctcctcagcccaccagagttaatttggttaaaaatcctggttttgaagaaggacctcacctcttgataaactcttcgcacggagttcttctccctcccaaacaagaagatttgacatccccacttccaggctggatcattgagtcactcaaagcagtgaaattcttggattcagctcatttcaatgtcccgtttggccgagctgcagttgaactacttgcagggagagaaagtgccattgcccaaatcattaggacagtccctaagaaggtgtatgcctttgcattcactgttggcgatgcaaagaacggttgccatggcgatatgatgattgaagcattcgctgctaaagaaacattcaaagttcccttcaagtcacaaggaaaaggcagctttaagactgttagtttcaagttcacagctattgcagacaggacaagaattactttctacagctcttattaccatacaaagatcaatgactatggatctctttgtggtcctgttgtggatgaagttaaggtgacccctgttgcttagaagtacactcagagcttttgtaatggtcagtagagttttttttgcaatgttcatttcatacttttcaagctaccactgtgaggcaattgctgtattttacctatgtgattgcttaaaactatgaattagatgcctgctgtgagacttgtgtactattgctttcaaggaagtgaggatctagttgaacttcctctcctttactgtgtgcactttttgatcttgattcttagatagtcaagtaatatataaaattgtactagtatatttcgaacttttcatgtttcttgaaggaggaaatataaattacactactagtctt

SEQ ID NO: 3992 - DNA, 1417 bp, Panax ginseng
aagcagtggtatcaacgcagagtacatgggggccatcccaaacccatttcactccctcttcttttctcccttattttgtgtcctttctctttgaaaatggccacatttttctcacttttcttagcatgcttcttgttcttcactggttctgcttttgcagctgttcctcttgaaggattactcccaaatggaaactttgaagagccaccaaaaccagctgatctccaaaaaacagtactcaaaggaaaatacgcattacccaaatgggaaatcaatggcttagtcgagtacattgccggtgggccacagcccggcggcatgtaccttccagttgcccacggcgtgcacgccgttcggcttggaaacgaagcctcggtctctcaaacaattccagttaaaaatgggtcactttatgcactaacatttggggcatcaagaacttgtgcacaaaacgaggttttgagggtctcagtacctcctcaaacaggggatcttcctctgcagactctgtatgatagtttgggtggtgacatttatgcttggggattcagagcaacgtctaatgttgctaaggtgacttttcacaatcgtggagttcaagaggatccgagctgtgggccactcttggatgtcgttgcaatcaaggagcttttccctccaaggcctactagagttaacttggtcaaaaatggtggcttcgaggagggtccccatctgttgataaatgcttctcacggcgttctcctcccacccagaatcgaagacctcacctccccacttcctggatggatcattgaatcccttaaagctgtcaaattcatcgacgcaaagcatttcaacattccctcaggactagcagctattgaattggtagcaggaagagaaagtgcaattgcccaaatcatccgaaccgtccccaagaaggtttacagtctcacatttactgtcggcgatgcaaagaacggctgccatggatccatgatggttgaagcattcgccgcaaaggagatgtttaaagttccattcacatccaaaggaaagggcatttccaagactgagagtttcaagttcacagcaatctcggacagaactagattaactttcttcagctctttttaccatactaagaaggaagatatcggatctttgtgcgggccggttcttgatgaagttaaggtacttcatgttgcttaaattaaatgtttgattaatctattattgcggaactataccaggaggagtagctaatttgtactatagagcttatgaaacggtcatttttgatcgatccctcttttctgcatatgtaatcgtcttaaaactattagatgcccatcatgatgtttgttaaagtattaatacttcacatttgatcactgtctcatctccattgggtatatttgactatattttgaaa

SEQ ID NO: 3993 - DNA, 1289 bp, Panax ginseng
tttcactccctcttcttttctcccttattttgtgtcctttctctttgaaaatggccacatttatctcacttttcttagcatgcttcttgttcttcaatggttctgcttttgcagctgttcctcttgaaggattactcccaaatggaaactttgaagagccaccaaaaccagctgatctccaaaaaacagtactcaaaggaaaatacgcattacccaaatgggaaatcaatggcttagtcgagtacattgccggcgggccacagcccggcggcatgtaccttccggttgcccacggcgtgcacgctgttcggcttggaaacgaagcctcagtctctcaaacaattccagttaaaaatgggtcactttatgcactaacatttggggcatcaagaacttgtgcacaaaacgaggttttgagggtctcagtacctcctcaaacaggggatcttcctctgcagactctgtatgatagtttgggtggtgacatttatgcttggggattcagagcaacttctaatgttgctaaggtgatttttcacaatcctggagttcaagaggatccgagctgtgggccactcttggatgtcgttgcaatcaaggagcttttccctccaaggcctactagagttaacttggtcaaaaatggtggcttcgaggagggtccccatctgttgataaatgcttctcacggcgttctcctcccacccagaatcgaagacctcacctccccacttcccggatggatcattgaatcccttaaagctgtcaaattcatcgacgcaaagcatttcaacgttccctcgggactagcagctattgaattggtagcaggaagagaaagtgcaattgcccaaatcattcgaaccgtccccaagaaggtttacagtctcacatttactgtcggtgatgcaaagaacggctgccacggatccatgatggttgaagcattcgccgcgaaggagatgtttaaagttccattcacatccaaaggaaagggcatttccaagaccgagagtttcaagttcacagcaatctcggacagaactagattaactttcttcagctctttttaccatactaagaaggatgatatcggatctttgtgcgggccggttcttgatgaagttaaggtacttcatgttgcttaaatgtttgattaatctattattgcggaactataccaggaggattagctaatttgtactatagagcttatgaaacggtcatttttgatcgatccctcttttctgcatatgtaatcgtcttaaaactattagatgcccatcatg

SEQ ID NO: 3994 - DNA, 1418 bp, Panax ginseng
aataccctgcggtttaatcctatttccttggccaacgttaagattgaactttaacctctttcttgctagggcttacagtaccactgagcctttcgtctcttccatattgtataaatgtaagtacagcatagaagctcctctgccatcccaaacccatttcactccctcttattttctcccttattttgtgtcctttctctttgaaaatggccacatttatctcacttttcttagcatgcttcttgttcttcaatggttctgcttttgcagctgttcctcttgaaggattactcccaaatggaaactttgaagagccaccaaaaccagctgatctccaaaaaacagtactcaaaggaaaatacgcattacccaaatgggaaatcaatggcttagtcgagtacattgctggcgggccacagcccggcggcatgtaccttccggttgcccacggcgtgcacgctgttcggcttggaaacgaagcctcagtctctcaaacaattccagttaaaaatgggtcactttatgcactaacatttggggcatcaagaacttgtgcacaaaacgaggttttgagggtctcagtacctcctcaaacaggggatcttcctctgcagactctgtatgatagtttgggtggtgacatttatgcttggggattcagagcaacttctaatgttgctaaggtgatttttcacaatcctggagttcaagaggatccgagctgtgggccactcttggatgtcgttgcaatcaaggagcttttccctccaaggcctactagagttaacttggtcaaaaatggtggcttcgaggagggtccccatctgttgataaatgcttctcacggcgttctcctcccacccagaatcgaagacctcacctccccacttcccggatggatcattgaatcccttaaagctgtcaaattcatcgacgcaaagcatttcaacattccctcaggactagcagctattgaattggtagcaggaagagaaagtgcaattgcccaaatcatccgaaccgtccccaagaaggtttacagtctcacatttactgtcggcgatgcaaagaacggctgccatggatccatgatggttgaagcattcgccgcaaaggagatgtttaaagttccattcacatccaaaggaaagggcatttccaagaccgagagtttcaagttcacagcaatctcggacagaactagattaactttcttcagctctttttaccatactaagaaggatgatatcggatctttgtgcgggccggttcttgatgaagttaaggtacttcatgttgcttaaattaaatgtttgattaatctattattgcggaactataccaggaggagtagctaatttgtactatagagcttatgaaacggtcatttttgatcgatccctcttttctgcatatgt

SEQ ID NO: 3995 - DNA, 1375 bp, Amsonia hubrichtii
aagtctatttggttcgtccttccctttaggtcctaaaaccctattcttttaactacttccccctacctcccctgcccttttgaagtttcactgttcgagcatttctttcttctggtgcacaagaatggcagtaaatatttctctcttgctttctttgggcttgctcttcatttcctctgcttttgctgctgctgctgctcctctagaagggctacttgcaaatggcaactttgaggagaaaccgaagccaacttaccttaagaaaggtgtactccaaggaaaatatgcacttcccaagtgggaaatcacaggcctagtcgagtatatccagggagggccacagcctggtgggatgtactttgctgttgcacacggtgatcacgctgttaggctaggcaacgaggcaacaatatctcaaacaattccagtaaaaaatggatccctttatgctctcacatttggggcttcaagaacatgtgcccaagatgaagtcttgagggtttctgtccctcctcaatcaggggaccttcctctgcagactctctatagtagcaatggtggtgatacgtatgcttggggcttcagagccacttctaactttgcaaaaatcatcttccacaatcctggtatgcaagaggatcctgcttgtggccctctcttggatgctgttgctataaaagaacttttccctccgaggcccacaagagtgaacttggtcaagaatggagattttgaggaaggccctcataggctaatcaactcatcccatggtgtcctcctcccaccaaagcaggaagaccaaacatccccacttcccggatggatcattgaatcactcaaggctgtaaaatacattgattcaatgcatttcaatgtaccctatggccatgcagcagtagaactgcttgcaggaagagagagtgcgattgcacaaatcatcaggacaatccccaacaaagtatacaattgcacattcacagtaggagatgcaaagaatggttgccatggatctatgatggttgaagcatttgctgcacaacagaccttgaaagctcccttcaaatcggaaggaaagggccattttgagacagttagcttcaaattcaaagcagtttcacccaggacaagactaacttttttcagctctttttaccacaccaaaatcaatgactttggaactctctgcggacctgttcttgatcaagttagggtgttccctgttgcttagatttcaaacaaagagttcctcgtaatagtgccttgatcttctttttgataagccatattcaacaactctgtattttgcttaaaatagaaacagcggcctgcctcattgaggctcacatgaatgttgttgacagactaattcgcaata

SEQ ID NO: 3996 - DNA, 1623 bp, Quercus alba
tctgagacagacagacatattcaccaggtcttacttcagtaaacagtagctttttcaacgtgatttaagctacccttttcttcatcatttcctaaacccactttttcttatccagcttgaatataataaaggacttcacagctcactatacagaacagaaaacccatttcagctgcctagctctttttcctcttgcctagttttccttatggaaatgtcactgaatatcacacttttgcttgcttccttcttgttgttgttcactagtactgctttggcagctacaggtttggaaggattggtaggaaatggcaactttgaagaacaaccaaaatccactgacatcaagaaaacagtactcataggaaaatatgcactgcccaaatgggaaatcaatggcttggtggaatacatctctggggggccacagcctgggggcatgtactttgctgtggcacatggtgtccatgctgtaaggcttggcaatgaggcctcaatctctcagagtatcaaagttaaaccaggctccctgtatgctctaacctttggggcatcaagaacatgtgcacaagaagaggttttgaggatctcagtgcctcctcagaaaggagaccttcctttgcagacactctacagcagtaatggaggtgatacttatgcttggggattcattgccacttctaatgttgctaacttgacattccacaaccctggggttcaagaggaccctgcttgtggaccactcttggatgcagttgctatcaaggagctctttcctccaaggcccacaagagataacttggtgaagaatccaggctttgaagagggtccccatcgtttaataaactccaccaatggtgttctcctccctccaaagcaagaagatctcacatccccactccctggttggatgattgaatcccttaaagccgtgaagttcatagactcaaagcacttcaacgtcccttttggacttgccgcagttgagcttgttgcaggtagagaaagtgccattgcccaggttctcagaacagttcccaacaagttctacaatcttacattcactgttggcgatgcaaagaatggctgccatggatcaatgatggttgaagcatttgctgccaaagacaccttaaaagtacccttcaaatctgaaggcaagggcaagttcaagacagccagcttcaagttcaaagcactgtcacccaggaccagaatcacattctacagctctttctaccatactagaattgatgactttggatctctttgtggccctgtgcttgatcaagtccgggttttgccagtagcttagatgttatttctgttatctacttcccacttgttatcttgatagagattttgcaacggttactagatcctgcttttttggtaaattagaccgttgatgaggcccatcttctacttaaacttgttatctaaactgtttgaattatgttttatggtactagtaatattccattgtcacttggtgtcagattagaaagctatgtgattttctattcagagaaaaatgtaatgggaagatcttgtgtatgtgatccatgtagtaatgcagacttggaaaatgaataatgttgagtgacatccatatgtagaggc

SEQ ID NO: 3997 - DNA, 1129 bp, Tabernaemontana elegans
ctgctgttcctgctcctctggaagggctacttccaaatggcaacttcgaagagaggccaaagccaactaatcttaagaaaactgtactcataggaaaatatgcactacccaagtgggaaatcacaggcctagtcgagtatatccatggagggccacagcctggtgggatgtacttcgctgttgcacacggcgttcatgctgttaggctaggcaacgaggcaacaatatctcaaacaattcctgtaaaaaatggatccctttatgctctcacatttggggcttcaagaacatgtgcccaagatgaagtcttgaggatctctgtccctcctcaatcaggggaccttcctctgcagactctctatagtagcaacggtggggatacttatggttggggcttcagagccacttctaactttgcaaaaatcaccttccacaatcctgggatgcaagaggatcctgcttgtggccctctcttggatgctgtagctattaaagaacttttcccaccaatgcccacaagagtgaacttggtaaagaatggtgattttgaggaaggccctcatcgactaatcaactcatcccatggtgtactcctcccaccaaagcaggaagaccagacatccccacttccaggatggatcattgaatcactcaaagctgtaaaatacatagattcaatgcatttcaatgtgccctacggccgtgcagcagtagaactgcttgccggaagagagagtgcaattgcacaaatcatcagaacaatccccaagaaggtatacaattgtacattcacagtaggagatgcaaagaatggttgccacggatcaatgatggttgaagcatttgctggaaaacagacgttgaaagctcccttcaaatccgaaggaaagggccattttgagacggttagcttcaaattcacagcactttcattcaggacaagactaactttcttcagctccttttaccacactagaatcaatgactatggaactctatgtggacctgttcttgatcaagttggggttttccctgttgcttagatttcaaaaggaatttcttgtattagtccttaaagatcttttgacgagtcatacacagaagctctttaagttgcttaaactagaaa

SEQ ID NO: 3998 - DNA, 1179 bp, Castanea mollissima
cccatttcagctgcctagctctttttcctcttgcctagttttccttatggaaatgtcactgagtatcacacttttgcttgcttccttcttcttgttgctcactagtgctgcttttgcagctacaagtttggacggattggtaggaaatggtaactttgaagagcaaccaaaatccactgacctcaagaaaacagtactcataggaaaatatgcactgcccaaatgggaaatcaatggcttggtggaatacatctctggggggccacagcctgggggcatgtactttgctgtggcacatggtgtccatgctgtaaggcttggcaatgaggcctcaatctctcagagtatcaaagttaaaccaggctccctgtatgctttaacctttggggcatcaagaacatgtgcacaagaagaggttttgaggatctcagtgcctcctcagaaaggagaccttcctttgcagacactctacagcagtaatggaggtgatacttatgcttggggattcattgccacttctaatgttgctaacttgacattccacaatcctggggttcaagaggaccctgcttgtggaccactcttggacgcagttgctatcaaggagctctttcctccaaggcccacaagagataacttggtgaagaatccaggctttgaagagggtccccatcgtttaataaactccaccaatggtgttctcctccctccaaagcaagaagatctcacatccccactgcctggttggatgattgaatcccttaaagccgtgaagttcatagactcaaagcacttcaacgtcccttttggactcgctgcagttgagcttgttgcaggtagagaaagtgccattgcccaggttctcagaacagttcccaacaagttctacaatcttacattcactgttggtgatgcaaagaatggttgccatggatcaatgatggttgaagcatttgctgctaaagacaccttaaaagtacccttcaaatctgaaggcaagggcaggttcaagacagccagcttcaagttcaaagcactgtcacccaggaccagaatcacattctacagctctttctaccatactagaattgatgattttggatctctttgtggccctgtgcttgatcaagtccgggttttgccaatagcttagatgttatttctgttatctacttccca

SEQ ID NO: 3999 - DNA, 1410 bp, Lippia dulcis
ctcttccaaatggtagtgaagatttcttgcttccttactctgtttctctacacggtttctgctcttgcaccgcctgctcctctcgaaggtctgttggccaatgggaatttcgaggagaaaccgaatcctaaaagcctgaagaagacggtgctcaagggcaaatacgcgctgccgaaatgggagataaacggcctggtggagtacatctccggcggcccgcagcccggcgggatgttcttcgccgtcgcacacggcgtccacgctgtccgcctcgggaacgacgcctccatctcccagacgattccggtgaagaacggctccctgtacgcgcttacgttcggcgcgtcgaggacatgcgcgcaggaggaggtgcttagggtttcggtcccccctcaaacaggggatctcccgttgcagacactgtacagcagcaatggcggcgacacctacgcctggggatttagggctaattccaactcggttaaggtgatttttctcaatcctgggaagcaggaggatcctgcttgtggccctctattggatgccgtcgccattaaagaacttttcccgcctaggcccagtagagtgaacctagtcaagaacaatggattcgaagagggtcctcatatgttattcaactcatcccacggcgttctcctccctccaaagcaagaagacaccacctccccgcttcccggctggataatcgaatccctaaaagctgtcaaattcatcgactcaaaccatttcaatgtcccattcggaaaagctgcagtagaacttctagcgggtagagaaagcgccatagcccaagtcatcagaaccgtcccaaacaaactctacaatctcaaatttgcagttggtgatgccaagaacgactgtcatggctccatgatgatcgaagcctttgctgctaaatcggccctaaaagcacccttcaaatcagaaggaaaagggaagtttatgacctttagttttcaattcaccgcaacatcggcccggacgaggttgactttcttcagctcgtattatcacacgaaggttaacgatttcgggagtctctgcggtcctgttcttgatgaagtgcatgtttttcctgctgctgctaaggtctgatgtatcccttacatgagtggtgatattttgagtgaactcgtgagttgtgatatctgttgtaatagaggtttgaaggtgtgttttgcagatgcgtaattgcattaagagttaggtttttgcttagtgtagttgcttgagttgatttgagcaatatgcttgaaaagggtagttaattatggagaataatttgtactaatgcttgagtttacttgcctatgtgtgagttcgttcattaggcaattgtcgtgcctcaaacagcgtatttcaagcaaaagaggactctttattggtaac

SEQ ID NO: 4000 - DNA, 1161 bp, Petunia hybrida
gggaatcaatggcttggtggagtacatatctggcgggccacagcccggtgggatgtacttccctgtcgcccatggtgtccacgccgtgaggcttggaaatgacgcctcaatatctcagacaattcctgtcaagaaaggctctttgtatgcgctcacatttggtgcatcaagaacctgtgctcaagatgaggtcttgagggtgtcagtacctcctcaaactggagaccttcctctgcagaccctttatagcagcaatggtggtgatacttacgcttggggtttctatgctacttctaatgttgttaaagttatgtttcacaatcctggagtccaagaggatccagcttgtggtccactcttggatgctgttgctatcaaagaactcttccctcctcggcctactagggcgaatttggtaaaaaatgctggttttgaagaaggacctcacctcttgataaactcttctcatggagtcctcctccctcccaagcaggaagatttgacatctccacttccaggatggatcattgagtcactcaaagcagtgaaattcttggattcagctcatttcaatgtcccattcggccgagctgcagtggaactgcttgcaggaagagaaagtgccattgcacaaatcattaggacagtccctaagaaagtttacacctttgcattcacagatggggatgcaaagaatggttgccatggcgatatgatggtcgaagcatttgctgctaaagaaacattcaaagttcccttcaagtcgcaaggaaaaggcagctttaaaactgtgagtttcaagttcacagccattgcagacaggaccagaattactttctacagctccttttaccacacaaagatcaatgactatggagctctttgtggccctgttgtggatgaagttaaggtgacccctgttgctaaggctctttagaagtactcgaagagcttttgtgatggtcatagagtttttgtaatgttcatttcatacttcactcatcaacttttcatcgtgaggcaattgctgtattttacctatgtgattgcttaactatgaattagatgcctgctctgagacctatatagtatgtattattgctttgaaaaaagtgtgagactagttgtagaacttcctttcctttactatgagcacttttg

SEQ ID NO: 4001 - DNA, 1377 bp, Setaria italica
ctccgcggctccgcccactgatcccgtcgtcctattcgctcccccaccatcccccgcctcgtcccggtcgttcgcggcctcgctccggcaaacacaatggccgccgccgccgtccccaacggccaccctgccgccgcctccagcgacgacgcggccccgccctcctcctcgtcttcgctggtgttcctgggcacggggtgctcgagcgccgtcccgaacgcgcggtgcctgatccagccccccgacccgccctgccccgtctgctcccagtccctctccgtcccgcccgagctaaaccctaactacaggtgcaatacttctcttttgattgattattgccaagatgaaggtgcacataagtatattataatagatgttgggaagacattcagagaacaagttctgcgatggtttgttcaccacaaaatcccttgtgttgattctattcttctgactcatgagcatgcagatgcaatcttaggccttgatgatgttcgggtcgtacagccgtttagtcccacaaatgatattgatccaaccccaatttatctctctcaatttgctatggacagcatctcccaaaagttcccttatttggtcaaaaagaaactaaaggaaggggaggaggtcaggcgagttgctcaactggactggagaataattgaaagtgatcttcagaaaccatttacaacttcagggctagagtttgttcccttgccggtgatccatggtgaagactacatttgtttgggtttccttttcggaagaaaatcaaaagttgcttacatatcagatgtttcgcggtttcctccaagcactgaatatgcaatttcaaagtctggagggggccaactggatttgctcatcttggactgcctatacaggacaggttctcacaatgtgcacctttgttgggaccagactctagatgctgttaaaaggatttgccccaaaagagcattgctcattgggatgactcatgagatggaccatcacaaggacaaccaaacattggaagaatggtccaggagggaggggatagatgtgcaattagctcatgatggcttgcgtgtctacattgatctgtagccgtgaaaggaccattgcatactcagtgagctgtactaggtttcctgctgctgttaacattcagccccctcttgtgaagaaagtacaaactgacttggcgcaccaatcttcgtgtgataccagtagatatagtccctatttacatttcgaatagtcaacacgcgattcgaataaaaaggttcgttcatgttggcttcttcagatcgattttacggtgccatccattgttgttgcacggccctcatttctccatctgggccgggctaaaccacacacagatgacagaac

SEQ ID NO: 4002 - DNA, 1679 bp, Brachypodium distachyon
cgcatcttccctccctctcgccgactcgccggacggggctcccgccccggcaaacccggacaccaatggccgccgccgtccccaacggccaccccgaagggacgcccgcgccgccgccgtcctactcctcctcctcctcgctggtgttcctgggcacgggctgctccagcgccgtcccgaacgcgcgctgcctgatccagccccccgacccgccctgcgccgtctgctcccagtccctctccgtgccccccgagctaaaccctaactacaggtgtaatacttctcttctgattgactattgccaagatgaagatgtgcacaaatatattcaaattgacgttgggaagacattccgtgaacaagttctacggtggttcgtttgccacaaaatccctcgtgttgattctattattctcactcatgagcatgcagatgcgatcttgggtcttgatgatattcgcgttgtacagccatttagccctacaaatgatattgatccaacccctatttatctctcccaatatgccatggacagcattgccatgaagttcccttacttggtcaaaaagaaactgaaggaaggagaggaagtcaggcgagttgctcaacttgactggagaataattgagagtgaccttcagaaaccgtttactgcctcagggctagagtttgttcccttgccggtgatccatggtgaggactacatttgtcttggtttccttttcgggagaaaatctaaagttgcttatatatcagatgtttcacgatttcctcccagcactgaacatgcaatttcaaaatctggaggggggcagctagatttgctcatcttggactgcctatacaggactggttctcataatgtgcatctttgttgggatcagacactagacgctcttaagaggatatgtcccaaaaaggcattgctcattgggttgactcatgagatggaccaccacaaggacaaccaaacattggaagaatggtccagaagagaggggattgatgtgcaattagctcgtgatggcttgcgtgtctacattgatctgtaaatgcgataaggccattgttgattcagtgttccgcgccaagtttccagctgctttgacaatgcagcccctattggaaatgaaaaaggaaagatcaaatgttgctttgcaaacttccctggccaaccagtagatacatcttagtataatcatctacaaaatgaataaaaagtgaagaagtcgctcacaaatcctgttcttttatcttctggtacccccatgcttgaattgctctcatcatctcccacaacggatgggtctcagtgcgatagatagcaaatggtgcaatgtactccctccgtttctaaatacttgtagtggttctaggccaactttgcactaaaaccacgacaagtatttagaaacagagggagtaatatgatcgtttcggatgaacaatgttgaagaattcctgggactttttggcgccatgcgaacgcatctcacggtcactggcagttgcattactgtgattttggaaccgtcgatgtttttttttaatgttcctagtgattgttctgactggagaatggtataaaaaacggtttaaggtgcaacatcccatttttggggaactttatttcctgcaagtcgctgagacaactgtgcaaagaaattcttgatttacac

SEQ ID NO: 4003 - DNA, 1976 bp, Brachypodium distachyon
cacgcatcttccctccctctcgccgactcgccggacggggctcccgccccggcaaacccggacaccaatggccgccgccgtccccaacggccaccccgaagggacgcccgcgccgccgccgtcctactcctcctcctcctcgctggtgttcctgggcacgggctgctccagcgccgtcccgaacgcgcgctgcctgatccagccccccgacccgccctgcgccgtctgctcccagtccctctccgtgccccccgagctaaaccctaactacaggtgtaatacttctcttctgattgactattgccaagatgaagatgtgcacaaatatattcaaattgacgttgggaagacattccgtgaacaagttctacggtggttcgtttgccacaaaatccctcgtgttgattctattattctcactcatgagcatgcagatgcgatcttgggtcttgatgatattcgcgttgtacagccatttagccctacaaatgatattgatccaacccctatttatctctcccaatatgccatggacagcattgccatgaagttcccttacttggtcaaaaagaaactgaaggaaggagaggaagtcaggcgagttgctcaacttgactggagaataattgagagtgaccttcagaaaccgtttactgcctcagggctagagtttgttcccttgccggtgatccatggtgaggactacatttgtcttggtttccttttcgggagaaaatctaaagttgcttatatatcagatgtttcacgatttcctcccagcactgaacatgcaatttcaaaatctggaggggggcagctagatttgctcatcttggactgcctatacaggactggttctcataatgtgcatctttgttgggatcagacactagacgctcttaagaggatatgtcccaaaaaggcattgctcattgggttgactcatgagatggaccaccacaaggacaaccaaacattggaagaatggtccagaagagaggggattgatgtgcaattagctcgtgatggcttgcgtgtctacattgatctgtaaatgcgataaggccattgttgattcagtgttccgcgccaagtttccagctgctttgacaatgcagcccctattggaaatgaaaaaggaaagatcaaatgttgctttgcaaacttccctggccaaccagtagatacatcttagtataatcatctacaaaatgaataaaaagtgaagaagtcgctcacaaatcctgttcttttatcttctggtacccccatgcttgaattgctctcatcatctcccacaacggatgggtctcagtgcgatagatagcaaatggtgcaatgtactccctccgtttctaaatacttgtagtggttctaggccaactttgcactaaaaccacgacaagtatttagaaacagagggagtaatatgatcgtttcggatgaacaatgttgaagaattcctgggactttttggcgccatgcgaacgcatctcacggtcactggcagttgcattactgtgattttggaaccgtcgatgtttttttttaatgttcctagtgattgttctgactggagaatggtataaaaaacggtttaaggtgcaacatcccatttttggggaactttatttcctgcaagtcgctgagacaactgtgcaaagaaattcttgatttacacagaaaaaagagagtctatttccttatttcccatcttctctttctcattttggatgtgccatagaaattttgtcttggttctgaattaaccatttctattggttaagccagttgtggaaaaaccattctgccctgatgtggttgcaaacaccatttttgagaaacaccgattacaagagagacgcacccacatccacatgcacgcagcgcctgtagaagaatggtgttgtggggactcgaggttgacaaggtcagcgccattttgcaccttaatactaataaagtggtcttctgac

SEQ ID NO: 4004 - DNA, 1546 bp, Setaria italica
tcccgtcgtcctattcgctcccccaccatcccccgcctcgtcccggtcgttcgcggcctcgctccggcaaacacaatggccgccgccgccgtccccaacggccaccctgccgccgcctccagcgacgacgcggccccgccctcctcctcgtcttcgctggtgttcctgggcacggggtgctcgagcgccgtcccgaacgcgcggtgcctgatccagccccccgacccgccctgccccgtctgctcccagtccctctccatcccgcccgagctaaaccctaactacaggtgcaatacttctcttttgattgattattgccaagatgaaggtgcacataagtatattataatagatgttgggaagacattcagagaacaagttctgcgatggtttgttcaccacaaaatcccttgtgttgattctattcttctgactcatgagcatgcagatgcaatcttaggccttgatgatgttcgggtcgtacagccgtttagtcccacaaatgatattgatccaaccccaatttatctctctcaatttgctatggacagcatctcccaaaagttcccttatttggtcaaaaagaaactaaaggaaggggaggaggtcaggcgagttgctcaactggactggagaataattgaaagtgatcttcagaaaccatttacaacttcagggctagagtttgttcccttgccggtgatccatggtgaagactacatttgtttgggtttccttttcggaagaaaatcaaaagttgcttacatatcagatgtttcgcggtttcctccaagcactgaatatgcaatttcaaagtctggagggggccaactggatttgctcatcttggactgcctatacaggacaggttctcacaatgtgcacctttgttgggaccagactctagatgctgttaaaaggatttgccccaaaagagcattgctcattgggatgactcatgagatggaccatcacaaggacaaccaaacattggaagaatggtccaggagggaggggatagatgtgcaattagctcatgatggcttgcgtgtctacattgatctgtagccgtgaaaggaccattgcatactcagtgagctgtactaggtttcctgctgctgttaacattcagccccctcttgtgaagaaagtacaaactgacttggcgcaccaatcttcgtgtgataccagtagatatagtccctatttacatttcgaatagtcaacacgcgattcgaataaaaagtaagtagttgtttcattgccccaacaagttgctgtccatctccttggtaaagcaattgaacggctcttgtcaatttggaagccaaactgcaccgtatgcatcttgatgttaactgcccgccagttgtagcccagtattgccttccgagagaagcgtggcctcgaatgaattttgaaagcagctctggaaggatgtctagaaaacttcctggtggctggctgggttgcacaatccctggaaaagccagctagtgaaagagcaatggagatggttgcaattttttttccacgaagtataggg

SEQ ID NO: 4005 - DNA, 1451 bp, Zea mays
gttcctattctgctgttactttgtctccgcaggccccacattctccgtctcgccacggtcgcggtcgtggtctcgctccggcaaacccaatggccgccgccgtccccaacggccacaccgccgccgccggagacgacgacgcaccacccgccgcttcgtcgtcgttggtgttcctgggcacggggtgctcgagcgcggtcccgaacgcgcggtgcctgatccagccccccgacccaccctgccccgtctgctcccagtccctttccgtcccgcccgagttaaaccctaactacaggtgcaacacttctcttttgattgactattgccaagatgaacgtgcacataagtatattataatagatgttgggaagacattcagagaacaagttctgagatggtttgttcgccacaaaatcccttgcgttgattctattcttctgactcatgagcatgcagatgcgatcttgggccttgatgatgttcgggtcgtacagccatttagtcccacaaatgatattgatccaaccccaatttatctctctcaattcgctatggacagcatctgccaaaagttcccctatttggtcaaaaagaaattaaaggaaggggaggaggttagacgagttgctcaacttgaatggaagataattgagagtgatattcagaaaccattcacaacttcagggctagagtttgttcccttgccggtgatccatggtgaagactacatttgtttgggtttccttttcggaaggaaatcaaaagttgcttacatatcagatgtttcacggtttcccccaagcacagaatatgcaatttcaaaatctggaggagggcaacttgatttgctcatcttggattgcctatacaggacgggttctcacaatgtgcacttgtgttgggaccagacactagatgctgttaggaggatttgccccaaaagagcactgcttattgggatgacccacgagatggatcatcacaaggacaaccaaacattggaagaatggtccaggagggaggggattgacgtgcagttagctcgtgatggcttgcgtgtctacattgatctgtagccgtgaaaggaaaatatgccatactcagcgaaccgcgccaggctttctggctgatgtaacatccattcccacttgtgaagaaagtgcaaactgactaaaaaggcgagcctatttggtgcatcattttacgtttcgctagtttatacgtgaatctctgaataaaaaagagaaaaagaaaagaaaagagagagagtagccacttgctagtagctggttcagtgccccggcaaattaatggccatctccctggtaaaggtagtcgaatgttcttgtaatcttgtcaattggaagctacactgcactggatgcatgcccaccagtcgaactgagcatgcgattttttttccctcggtcgcgcccgggtcatgtattgta

SEQ ID NO: 4006 - DNA, 1471 bp, Avena sativa
caacccaacccaacccaatggccgcttccgtccccaacggccaccccgccaccgccgacgacggtacgcccccgaacccaccgccctcctcgtcctcactggtgttccttggcacgggctgctcgagcgccgtccccaacgcgcggtgcctgatccagccccccgacccgccctgcgccgtctgctcccagtccctctccgtgcccccggagctaaaccccaactacagatgttgtacttctcttctgattgattattgccaagatgaaggtgcacacaagtatattatcattgatgttgggaagacattccgtgaacaagttctgcggtggtttgttcgccacaaaatcccttgcgttgattctattcttctgactcatgagcacgctgatgcgatcttgggtcttgatgatattcgggttgtacaaccatttagtcctacaaatgatattgatccaacccctatttatctctcccaatatgccatggacagcatttcccaaaagtttccgtacttggtcaaaaagaaactaaaggaaggggaggaggtcaggcgagttgctcaacttgactggagaataattgagagcgatcttcagaaaccatttactgcctcagggttggagtttgtaccattgccagtgattcatggagaggactacatctgtctgggtttcctttttggaagaaaaactaaagttgcctatatatctgatgtttcacggtttcctcctagcacggaagatgcaatttcaaaatctggaggggggcagctagatttgctcatcttggactgcctatacaggactggttctcataatgtgcatctttgttgggatcagacactagatgctcttaagaggatatgccccaagaaggcattgctcattgggttgactcatgagatggaccatcacaaggataataagacattggaagaatggtccagaagagaggggatcgatgtgcagttagctcgcgatggcttacgtgtgtacattgatctttaagtgtggaccgtcataggatcatcgacacgtaccaagattccagttgctgttacatttcagccccttttgagaagaaaacgaaggagagatgaaatgtttcttcgcagagccagcttaatttcttggccaaccagaagacaaagactagccgaatcatttatgaactgattcaaaatgaataacaagtgaagaagttgctcacgaagttgcagagtatctctcttttttggtagtcccacacagttgaatgttctcattatccggaaagtctcctacacaggatgcatcttgatcttactgcagcaggtagcaaatggtgtaatgtaaatataatcttttggcaccaacagtcagccttctctgcgtgaactcatcacatggcttcgatttggaacgttgaagttttgatgttgtcttgttgagctttctgactggagaatgtactccctctgatcctaaac

SEQ ID NO: 4007 - DNA, 1436 bp, Festuca arundinacea
ggcacgaggccaacccaatccaatggccgccgccatccccaacggccaccccgccaccgcctgcgacggcacgcccccgtccccgccgccgtcctcgtcctcgctggtgttcctgggcacgggctgctcaagcgccgtccccaacgcgaggtgcctgatccagccccccgacccgccctgcgcggtctgctcccagtccctctccgtgcccccggagctaaaccccaactacagatgttgtacttctctcctgattgattattgccaagatgaaggtgcacacaagtatattataattgatgttgggaaaacattccgggaacaagttctgcggtggttcgttcgtcacaaaatcccttgcgttgattctattattctgactcatgagcacgcagatgcgatcttgggtcttgatgatgttcgggtagtacagccatttagtcctacaaatgatattgatcccactcctatttatctctcccaatatgccatggacagcatttcccaaaagtttccgtacttggtcaaaaagaaactgaaggaaggggaggaggtcaggcgagttgctcaacttgactggagaataattgagagtgatcttcagaaaccatttactgcctcggggctagagtttgttcccttgccggtgatccatggagaggactacatttgtctgggtttcctttttggaagaaaatctagagttgcttatatatccgatgtttcacggtttcctcctagcacggaagatgcaatttcgaagtctggaggggggcagcttgatttgctcatcttggactgcctatacaggactggttctcataatgtgcatctttgttgggatcagacactagatgctcttaagaggatatgccccaaaaaggcattgctcattgggttgactcatgagatggaccattacaaggacaaccagacattggaagaatggtccagaagagaggggatcgatgtgcagttagctcgcgatggcttgcgtgtctacatggatctgtaaatgtggcaaggaccttcgttgatccagcgaccctcaccaagttcacagttgttacaattcagctgctgttgagaagaaaaatgaaggatacgaaatttcgctcagcggtgccagcttaatccatggccagccaacagacaaaggctatgaatcatctatgaactgattcaaatgaatacaagtgaagaagtcgctcacagattatgtctcttttttggtagccccacacttgaatgtagcccctacattggatgtattttagtgccgacagatagcaaatagtgttatgtaaatatacggctgtttcgaaaccctcaggcgttgtttagtactaccaaagtttttgtggggataatccccagttgttcctaacaacatggttggttccagtatatttggctagtttaaaaaaaaaaaaaaa

SEQ ID NO: 4008 - DNA, 1429 bp, Sorghum bicolor
tcccgtcgtcgtattgtactccgtgccgcaggcttcacatcctccgcctcgccacggtcgctcgcggtctcgctccggcaaacccaatggccgctgccatccccaacggccacaccgccggcggcgacgacgcgccccctcccgcttcgtcgtcgctggtgttcctgggcacggggtgctcgagcgcggtcccgaacgcgcggtgcctgatccagccccccgacccgccctgctccgtctgctcccagtccctctccgtcccgcccgagctaaaccctaactacagatgcaatacttctcttttgattgactattgccaagatgaaggtgcacataagtatattataattgatgtggggaagacattcagagaacaagttctgcgatggtttgttcgccacaaaatcccttgcgttgattctattcttctgacccatgaacatgcagatgcaatcttgggccttgatgatgttcgggtcgtacagccatttagtcccacaaatgatattgatccaaccccaatttatctctctcgatttgctatggacagcatctcccaaaagttcccttatttggtcaaaaagaagttaaaggaaggggaggaaatcaggcgagttgcccaacttgactggaaaataattgagagtgatattcagaaaccatttataacttcagggctagagtttgttcccttgccggtgatccatggtgaagactacatttgtttgggtttcctttttggaagaaaatcaaaagttgcttacatatcagatgtttcgcggtttcccccaagcacagaatatgcaatttcgaagtgtggagggggccaactggatttgctcatattggattgcctgtacaggacaggttctcacaatgtgcacctatgttgggaccagacactagatgctgttaggaggatttgccccaaaagagcattgctcattgggatgacccatgagatggatcatcacaaggacaaccaaacattggaagaatggtccaggaggcaagggatagatgtgcagctagctcgtgatggcctgcgtgtctacattgatctgtaaccgtgaaaggaccatgccatactcagtgaaccgcgccaggctttttggctgatgttaacatccagtccctcttgtgaagaaagtacaatacaaactgactaaaaaggcgaacaacctgtttggtgcatcattcttcgtgcgcaacaagtagatatataatagcctattttatgtttcgctagtttatacgtgaatccccgaataatagttggatgttcttgtcaattgtaagctacgctgcactagacgcatgtgcaccaatcgaattgagcatgtgaattttccctccgacgcgcctgagtcgagtactgtatttcgtaagaggaaaatcgattgagcatgtgagtaccacacagcttttt

SEQ ID NO: 4009 - DNA, 1656 bp, Panicum virgatum
attccgagcatctccgcccaccgatcccgtcgtcctattcgccccccccccccccctcgccacggcctctcgcggtctcgaggagaggactcgctccggcaaacccaatggccgccgacgccgtccccaatggccacgccgccgccgacgcgccccctccctcctcgtcgtcgctggtgttcctgggcacggggtgctcgagcgccgtcccgaacgcgcggtgcctgatccagccccccgacccgccctgtcccgtctgctcccagtccctctccgtcccgcccgagctaaaccccaactacaggtgcaatacttctcttttgattgactattgccgagatgaaggtgcacataagtatattataattgatgttgggaagacattcagagaacaagttcttcgatggtttgttcgccacaaaatcccttgtgttgattctattcttctgactcatgagcatgcagatgcaatcttaggccttgatgatattcgggttgtacaggcatttagtcccacaaacgatattgatccaacccctatttatctctctcagtttgctatggacagcatctccctaaagttcccttatttggtcaaaaagaaactaaaggaaggggaggaggtcaggcgagttgctcaactggactggagaataatcgagagtgatcttcagaaaccatttaccacttcagggctagagtttgtcccccttccggtgatccatggtgaagactacatttgtttgggtttccttttcggcagaaagtcaaaagttgcatacatatcagatgtttcacggtttcctccaagcacagaatatgcaatttcaaagtctggtgggggccaactggatttactcatcttggattgcctatacaggacgggttctcacaacgtgcatctttgttgggaccagactctggatgctgttaagaggatttgccccaaaagagcattgctcattgggatgactcatgagatggaccatgacaaggacaaccaaacattggaagaatggtccaggagggaggggatatatgcgcagttagctcgtgatggcctgcgtgtctacattgatctgtaaccgtgaaaggaccatgacatgctcagtgaactgtactaggtttcctgccgctgttaacattcccctcttgtgaagaaagaaagcacgaactgacttggcgcaccaatcttcgtgtgaaaccaggagatattctatttttacatttcatagtctacacgtgattcgaaataaaagtaagtaatatagtagttgaatggttcctgtcaattggaagctacactgcagcagatgcataatgccaaccggcagcaacaggtattgtctttgggagagaagcatgactcgaatgaatctgtgaataccgcaagctttctgaagctctgtcatagaatgtgtggacttcaatcgatgaatttcgtggtgactggctgggttgcacaatctctggaaaagcccgctattaaacagtaggtcaatgactagatgccaaagttagaaagtctagatgccaggaaggtgcatttttcgtgatgttcattcaatagggaagggagatggttttatccttttttcaatataaataaatatgccttttgcagcttcgtgaggtaaaattaattctgcagtaatg

SEQ ID NO: 4010 - DNA, 1141 bp, Pseudoroegneria spicata
ccaatggccgccgccgtccccaacggccacccgtacgccgccggcgaagataatcccccgcccccaccgccgtcctcgtcctcgtcctcgctggtgttcctgggcacgggctgctccagcgccgtccccaacgcgcggtgcctgatccagccctccgacccgccctgcgccgtctgctcccagtccctcaccgtgccccctgagctaaaccccaactacaggtgtaatacttctcttctgattgattattgccaagatgaaggtgtacacaagtatattataattgatgttgggaagacattccgagaacaagttctgcggtggtttgtttgccacaaaatcccttgtgttgattctattattctgactcatgagcacgcagatgcgatcttgggacttgatgatattcgggttgtacagccatttagtcctacaaatgatattgatccaacccctatttatctctcccaatatgccatggacagcatttcccaaaagtttccatacttggtcaaaaagaaactaaaggaaggggaggaagtcaggcgggttgctcaacttgactggagaataattgagagtgatcttcagaaaccgtttactgcctcaggcctacagtttgttcccttgccggtgatccatggagaggactacatttgtctgggtttccttttcggaagaaaatctaaagttgcttatatatccgatgtttcacggtttcctcctagcacagaagatgcaatttcaaagtctggaggggggcagctagatttgctcatcttggactgcctatacaggactggttctcataacgtgcatctttgttgggatcagacactagatgctattaagaggatatgccccaaaaaggcattgctcattgggttgactcatgagatggaccatcacaaggacaaccaggcattggaagaatggtccagaagagaggggattgatgtgcagttagctcgcgatggcttgcgtgtctacattgatctgtgaacatgttaaggaccatcgtcgaagcagcgacctgtaccaccaagtttgcagttgctgttacaattcagcccctattgagaagaaaaaatggaggagacgtcaaatgttcgtgcattcaaaacgattgaatcatttacaa

SEQ ID NO: 4011 - DNA, 1662 bp, Panicum virgatum
aaaactccaaacaaattccgcgcatcttcggccccctgatcccgtcgtcctattcgctcccccaccatcccctgcgcctcgtcgcggccgctcgcggtgtcgctccggcaaacccaatggccgccgccgccgtccccaacggccacgccgccgccgacgcgccccctccctcctcgtcgtcgctggtgttcctgggcacggggtgctcgagcgccgtcccgaacgcgcggtgcctgatccagccccccgacccgccctgccacgtctgctcccagtccctctccatcccgcccgagctaaaccccaactacaggtgcaatacttctcttttgattgactattgccaggatgaaggtgcacataagtatattataattgatgttgggaagacattcagagaacaagttcttcgatggtttgttcgccacaaaatcccttgtgttgattctattcttctgactcatgagcatgcagatgcaatcttaggccttgatgatattagggttgtgcaggcatttagtcccacaaatgatattgatccaacccctatttatctctctcagtttgctatggacagcatctccctaaagttcccttatttggccaaaaagaaactaaaggaaggggaggaggtcaggcgagttgctcaactggactggagaataatcgagagtgatcttcagataccatttacaacttcagggctagagtttgttccccttccggtgatccatggtgaagactacatttgcttgggtttccttttcggaagaaaatcaaaagttgcttacatatcagatgtttcgcggtttcctccaagcacagaatatgcaatttcaaagtctggtgggggccaactggatttactcatcttggattgcctatacaggacgggttctcacaatgtgcatctttgttgggaccagactctggatgctgttaagaggatttgccccaaaagagcattgctcattgggatgactcatgagatggaccatgacaaggacaaccaaacattggaagaatggtccaggagggaggggatagatgtgcagttagctcgtgatggtttgcgtgtctacattgatctgtaaccgtgagaggagtcaggaccatggcatgctcagtgaactgttaccaggtttcctgccgctctacattccccctcttgtgaagaaagtacaaactgacttggcgcaccaatcttcgtgtgaaaccagtagatattctgttttttcatttcatagtctacacgtgattcgaataaaaagcaagtaatatagttgtttcagtgccccccacaagttgctctccatctccttgataagtagttgaatggttcttgccaattggaaactacactgcaccagatgcataatgccaaccggcggcaacaagtattgcctttggactcgaatgaatctgtaaatactgcaagctttctgaagcagctctgtcatagaatgtgcggacttgaatggatgaatttcgtttgcacaatctctggaaaagctcgctagtaaaacagcaggtcgatgactagatacagaaagtctagataccagaaaggtggattttttttgtgatgtccactagggaatggagatgatttaatcttttttccaataataataaataaatatgccttttgcagtgttcgtt

SEQ ID NO: 4012 - DNA, 1602 bp, Secale cereale
ccgccgccgccgtccccaacggccacccctccgctgccggcgacggtaaccccccgcccctgtccccgccgccgtcatcgtcctcgtcctcgctggtgttcctgggcacgggctgctccagcgccgtcccaacgcgcggtgcctgatccagccctccgacccgccctgcgccgtctgctcccagtccctctccgtgcccccggagctaaaccccaactacaggtgtaatacttctcttctgattgattattgccaagatgaaggtgcacacaagtatattataattgatgttgggaagacattccgagaacaagttctgcggtggtttgtttgccacaaaattccttgcgttgattctattattctgactcatgagcacgcagatgctatcttgggacttgatgatattcgggttgtacagccatttagtcctacaaatgatattgatccaacccctatttatctctcccaatatgccatggacagcatttcccaaaagtttccatacttggtcaaaaagaaactaaaggaaggggaggaggtcaggcgggttgctcaacttgactggagaataattgagagtgatcttcagaaaccgtttactgcctcaggcctacagtttgttcccttgccggtgatccatggagaggactacatttgtctgggtttccttttcggaagaaaatctaaagttgcttatatatctgatgtttcacggtttcctcctagcacagaagatgcaatttcaaaatctggagggcgtcagctagatttgctcatcttggactgcctatacaggactggatctcataacgtgcatctttgttgggatcagacactagatgctattaagaggatttgccccaagaaggcattgctcattgggttgactcatgagatggaccatcacaaggacaaccagacgctggaggaatggtccagaagagaggggattgatgtgcagttagctcgcgatggcttgcgtgtctacattgatctgtaaacgtgttaaggaccatcgtcgaagcagcggcctgtaccaccaagtttgcagttgctattacaatccagcccctattgagaagaaaatgaaggagacatcaaatgtccgtgcgttcaaaatgattgaatcatttacaaaccgattcaaaatgaataacaagcgaagaaatcccacgcagattctgtttcggtttttgaatgttttcattatctagaggattcctacactggacacatcttagtgcagacggtacaacgaacactcagacccatccaaagtttagaacacaggaaaatagaaaaccataggaatgtatcattggtttcttgtaggaaccaagaccataggtggaattatgagacacaaagaaaggaaaaaaaaacatgaggtaaggcctcatggcctcgtgtttggttccctctgaaattcaattaatctaaggcggtcattttgttgtttaacagtatactacagggatttttcaagcttgtgtaatcagaggaagaagatgagcaccaatatgggttttgatgtaaaaaaaaaaactggtagttttgtgtcctgctataatttcattgttctttgctaccaaaaaagtc

SEQ ID NO: 4013 - DNA, 1703 bp, Hordeum vulgare
gtcgcacctcgcccaccttccacttccagccgtccacacaccttgcgtctcgccgccggtgccggtcggggtcccgctccggcgaacccagcccaatggccgccgccgccgccgacgtacccaacggccacccctccgcctccggcgacggtaacccccctcccccgccgccgccgccgtcctcgtcctcgtcctcgctggtgttcctgggcacgggatgctccagcgccgtccccaacgcgcggtgcctgatccagccctccgacccgccctgcgccgtctgctcccagtccctctccgtgcccccggagctaaaccccaactacaggtgtaatacttctcttctgattgattattgccaagatgaaggtgcacacaagtatattataattgatgttgggaagacattccgagagcaagttctacggtggtttgtttgccacaaaatcccttgcgtcgattctattattctgactcatgagcacgcagatgcgatcttgggacttgatgatgttcgggttgtacagccatttagtccttcaaatgatattgatccaacccctatttatctctcccaatatgccatggacagcatttcccaaaagtttccgtacttggtcaaaaagaaactaaaggaaggggaggaggtcaggcgggttgctcaacttgactggcgaataattgagagtgatcttcagaaaccatttactgcctcaggcctacagtttgttcccttgccagtgatccatggagaggactacatttgtctgggtttccttttcggaataaaatctaaagttgcttatgtatccgatgtttcacggtttcctcctagcacagaagatgcaatttcaaagtctggaggagggcagctagatttgctcatcttggactgcctatacaggactggatctcataacgtccatctttgttgggatcagacactagatgctattaagaggatatgccccaagaaggcattgctcattgggttgactcatgagatggaccatcacaaggacaaccagacactggaagaatggtccagaagggaggggattgatgtgcagttagctcgcgatggcttgcgtgtctacatcgatctgtaaacgtgttaagtcgttgaagcggcgacatgtaccaccaagtttgcagttgctgttagcctgttacaatccagcccctattgagaagaaaatggaggagacatcgaatgttcatgcattcaaaatgattgaatcatttacagcccgattcaaaatgaatgacaagcaaagaaatccctcacagattctgtttttttttgggtagtcccacgtttgaatgttctcattatctagaggcttcctgcaccggacacatcttagtgcagacggtacaacaaacactcggcccatcaaagtttaggaaaatagaaaatcataggaatgtatcttggtttcttgtaggaaccaagaccataggtggaattgtgagaccattttgttaacctaaggtgaccattttgttgtttagcaatatactataggagcttctcgagctcgtgcaatcaaaggaagaagatgataaatttggcttttgatgtaatatgtttttctggtagttttgtgtcgtgctatattttcattgtacttactactgtaccattttgtacttgttaattatcagatgactttaggtgtgtttttcttgaaaaggaaaat

SEQ ID NO: 4014 - DNA, 1520 bp, Triticum aestivum
cgtcctcgtcctcgtcctcgctggtgttcctgggcacgggctgctccagcgccgtccccaacgcgcggtgcctgatccagccctccgacccgccctgcgccgtctgctcccagtccctctccgtgcccccggagctaaaccccaactacaggtgtaatacttctcttctgattgattattgccaagatgaaggtgcacacaagtatattataattgatgttgggaagacattccgagaacaagttctgcggtggtttgtttgccacaaaatcccttgtgttgattctattattctgactcatgagcacgcagatgcaatcttgggacttgatgatattcgggttgtacagccatttagtcctacaaatgatattgatccaacccctatttatctctcccaatatgccatggacagcatttcccaaaagtttccatacttggtcaaaaagaaactaaaggaaggggaggaggtcaggcgggttgctcaacttgactggagaataattgagagtgatcttcagaaaccgtttactgcctcaggcctacagtttgttcccttgccggtgatccatggagaggactacatttgtctgggtttccttttcggaagaaaatctaaagttgcttatatatccgatgtttcacggtttcctcctagcacagaagatgcaatttcaaagtctggagggggtcagctagatttgctcatcttggactgcctatacaggactggttctcataacgtgcatctttgttgggatcagacactagatgctattaagaggatatgccccaagaaggcattgctcattgggttgactcatgagatggaccatcacaaggacaaccagacattggaagaatggtccagaagagaggggattgatgtgcagttagctcgcgatggcttgcgtgtctacattgatctgtaaacgtgttaaggaccatcgtcgaagcagcgacctgtaccaccaagtttgcagttgctgttacaatccagcccctattgagaagaaaatggaggagacatcaaatgttcgtgcattcaaaatgattgaatcatttacaaaccggattcaaaatgaataacaagcaagaaatacctcgcagattctgtttcgattttatttgggtagtcccacgtttgaatgttctcattatctagaggcttcctacaccggacacatcttagtgcagacggtacaacgaacactcgacccatcaaagtttagaacacaggaaaatagaaaatcataggaatgtatcttggtttctcgtaggaaccaagaccataggtggaattgtgagacacaaagaaaggaaaaaacacgaggtaagacctcatgttttgttccctctgaaattcaattaatctaaggaagaagacgaccaatatgggttttgatgcagtatgttttttctggtagttttgtgtcctgctatgttttcattgtacttactactgcaccattttacttgttaactacgtatcagatataagatgactttttggtgtcttt

SEQ ID NO: 4015 - DNA, 979 bp, Lolium multiflorum
cgtcctcgtcctcgctggtgttcctgggcacgggctgctcaagcgccgtccccaacgcgaggtgcctgatccagccccccgacccgccctgcgccgtctgctcccagtccctctccgtgcccccggagctaaaccccaactacagatgttgtacttctctcctgattgattattgccaagatgaaggtgcacacaagtatattataattgatgttgggaaaacattccgagaacaagttctgcggtggttcgttcgccacaaaatcccttgcgttgattctattattctgactcatgagcacgcagatgcaatcttgggtcttgatgatgttcgggtagtacagccatttagtcctacaaatgatattgatcccactcctatttatctctcccaatatgccatggacagcatttcccaaaagtttccgtacttggtcaaaaagaaactgaaggaaggggaggaggtcaggcgagttgctcaacttgactggagaataattgagagtgatcttcagaaaccatttactgcctcggggctagagtttgttcccttgccggtgatccatggagaggactacatttgtctgggtttcctttttggaagaaaatctagagttgcttatatatccgatgtttcacggtttcctcctagcacggaagatgcaatttcgaagtctggcggggggcagcttgatttgctcatcttggactgcctatacaggactggttctcataatgtgcatctttgttgggatcagacactagatgctcttaagaggatatgcccgaaaaaggcattgctcattgggttgactcatgagatggaccattacaaggacaaccagacattggaagaatggtccagaagagaggggatcgatgtgcagttagctcgcgatggcttgcgtgtctacatggatctgtaaatgtggcaaggaccttcgtcgatccagcgacccgcaccaagttcacagttgtt

SEQ ID NO: 4016 - DNA, 3951 bp, Triticum aestivum
gggctgcaatggcttggcagttaagtgcccttgtgatggccataacctgtttgatgttatgccgaacaagcgagcagtcctcagaaagtgagctgctgcagcagctcaggaagcagctggagtaccctaggcagctggaagtctggaacaacccaagtggcaacccctgctacactcagcccacttcggtggtcaccgtaacgtgcgagggggatgccgttacggagctcaagatcgtcggtgataggatcaccaagccaccaaagttcagtggctatcctcttccaaatgttagcctctctgaagcctttgttatcgactcatttgtcactacgctgacaaggttaactaccttgcgggttgtgatcctggtgtctttgggcttatggggccctctccccgacaagattcaccggctgtcttcgcttcaagtgcttgacctgagctcaaattttctgtatggatcgatccctccgaagctgtcagccatgtcgaggcttcagaccctgacactggatggtaactacttcaatggaactgtgccagactggtttggttcgctctcgaacctcacggtccttcgtttgcagcgtaaccggttgaaggggtcaataccagcatcagttggtaaagctacaatgcttaccgagctagctcttgctggcaacaatatctcaggcgaggttccagctttgggtagtttggtaaaacttgagatgttggatttgagggacaacgagttggacggagagcttccagacatgcctacagcattggtgacagtcctgcttagcaagaactcattcaagggtgaaattcctgaaaagtttggtcaactgaaaaggctccaacaccttgatctctcattcaactttctcgagggcagtcctcctgaagaactctttgatctcccaaacatcagttacttgaacctggcagcaaacatgctcagcggatcactttcgagtagtttaacatgcagcagcaccctgggctttgtggatctgtctactaaccgaatcacaggtgacctgcctgcttgtctaagcgccaacttgaataacagggttgttaagtttgacgggaattgctttagtgctgaccctgaacaccagcatgaggctaactattgtcaacaacctcataaggggggaagatcaggcaaggatgttggacttgtggttactattgtcggtatagtgctgattgtgcttgttctttctcttctactaatggcatcaaacaaaagaaactgtcagagagttacagcagaacaacagttgctgcaaaagcaaatgcaagataattcgactccaggaatgtcctccgaactgctagaaagtgcaaggtacatatctcaagccgtgaagtttgggtcgcaaataatgcccacacatcgtgtattttctttagaagagctgaaagaagcaacaaaatgctttgaacggtcagcatttttaggcgagggatccattggaaagctatacaagggaaaactagagaatggaaccgtgattgcgataagatgtttggcattgcaccacagatattcaataagaaatctaaagcttcgattagatctactcgcgaagcttcgccacccaaatttggtttgcctcttggggcactgtactgacaacgcagttgatgagtcaagtgtaaaaagggtctttcttgtttatgaatatgtacctaatgggactctgtcttcttatctttctggctctactcctgagaaaacactgaaatggtgtgatagactacatgtgctgatcggcattgcaagggctgttcatttcttacatacaggaataattcctggttccttgtataatcggttgaaaacttctaatattttgcttgatgaacaccatattgcaaaactgagtgactacggtttgtccataatcacagaggagatatacaaacatgaggcaataggagaaaggcagagatacatacaaaataacgctgaagaattggaaactttgcaggatgatgtatgttcttttggttgcattatacttgaagcacttatgggctccaaattacatagaaaaggagatccttttattttaagtgaactggttatgtctctatcatgccaggaagagcgtgagcacgttctggatccggtcgtgctcgggacctcatcgcaggactcactgtcaatggtggtctccatcacgatcaaatgcctatccgttgaatcctcaacccggccctccatcgaagaggttctctggaacctgcagtacgccgcgcaggtccaggggacggccgacggcgatctgagatcagaagtttcttcgcaagcctgttagcacaagtgagcagcatagcggcatggaaaccatgaccggccgtttgctcagcagaccaggaaatgactaagctaacttttgcattgcgcatttgctcagcaccatttgtatatcagtacaggatcgcaaattcccgcttgtttttgcatcgtacgttactagtgttttggcaccacttagtaaagcaaatctgcttgttcagatattaatatcacacttcccctcgttacaaaggtaaattggcaagctcacacttacgaaacagtaatatcagctactggcatcatactgagtgcagtgctacatgattataataaaacacgataaatcgctaaaacctgttcacacagctcatggtttcaattcaatatcacatctgtgtgcaatgaggagcttactttacagttatacatacactctaccaaggcaaacagtgtcgcggaaagcctaacgacacatgagagatgagaggccaacatctagacatacaatgtgctacaacagcttattcttcctcatattcacagctgaatgccagtggaaagtcgatcatccttgctacctagatatgcatacttgataagccgcattgatccgtcaaatgtcagtataagaacaatcagtttacttggtaacggcaaacgatcccagcttcgataggtccgggacccagcaggatagttctgaagatccagtcaagaacatcaacgatcctggagcccacctaaccaatggtggctcgctatctgtgctcccccaccgcgcaaccttctttccacttctaacgctccaagcataaacactaccatcaccagagccagatataatatggtttccatcagggctgaatgatgcctccaatgtcgaattggttacaactggcttaacattgaaagttgctagactgttgccatgaaatgaatctagcacatgaatacaccctgctttggtggttaaaagaagccgccttccatcactgctgaactttatcatattggcttctgattcatcattaccaacggagaaaatatcaaaaggccccttctcaaattttcgagcatcaaacatccttacataaccaccataagcaactgcgaaaactaaaccctgatcatcatatgaaactgcgggcctcccttgcacacgcagcaagccctgtgctttgtcagccctcagatcccataggagaacagttcgatcaagtgaaccagagagaaaactgtctttctcataacataatgacatagcaacaaccctgtcaagatggcctttaaaatatcttacaaaccggttatcatttagagagagtagacgcagagattcatcccaaccatttttcgaggaatacaagacaagagttgggttagtagtgaagcacaccagttcaaccccatactttttgctattaatggtcttcaaacatacagcattttgaatgtcatataggcgtatcgattcatcatcactggctgtcaccagatagtttgtagccttgctgtggaaatccatagaactaattctgccaatatagtcccggaaggccaagccgacctccatggtcttgagcatctcgtcggtgacctccatggtcaccctctcctccttttccccggctggcatcttggca

SEQ ID NO: 4017 - DNA, 1729 bp, Sorghum bicolor
aagctggactaaaaaattgcctttgcccgcacgcccctttggcccaccgcctggactcgtctcgcccgcgggcgatctcctccatccgctcgccgcgccgcaacccggagaggagactgcgctcggccgagcaccacctggggtccagcatcctcgcaaccatctccggcacggcgtccgccctctgcagccccggtgtccttgcgaccgtcgctgctgtcctacttcgccactggccactttgcccggcgacgagcaccaccaggacactagattaaggtttggttgcagaagatattggagggttgcccaccatgacgagtccgccaagggtgagcatggagatcaccgacgacatgctcaagagcatggaggtcggcctagccttccgggactataatggcagaattagttctatggattttcacagcaaggctaccagctatctcgtgacagctagcgatgacgaatcaatccgcctatatgacactcaaaatgcagtatgtttgaagactattaatagcaaaaaatatggggtcgaactagtgtgcttcactgataacccaactattgtcttatattcatcaaaaaatggctgggatgaatctctgcgtctactctcactgaatgataaccggtttcttagatattttaaaggtcaccttgacagggttgtctgcatctcattttgctctgagaaagaaaactttctctctggttcacttgaccgtactgttctcttatgggatcaacgagctgaaaaatcacagggcttactgcgtgtgcaagggaggcctgcagtttcatatgatgatcagggcatggtatttgcagttgcctatggtggtcacataaggatgtttgatgctcgaaaatttgaaaaggggccttttgagatcttctctgttggtaataatgattcagaagcccatgtcataaagttcagtagtgatggcaggcggattctgttaaccactaaagctggacgtgttcatgtgctagattcattccatggcaatagcattgcatcgtacaatgtgaagccagtggtaaccaattcaacactggaggcatcgtttagtcctgatggaaaccatatcatatctggctctggtgatggtagtgtttatgcttggaatgttaggagtggaaaggtcgcacgctggggaagcacagataacgaaccgccactggtaaggtgggctccaggatccttgatgtttgtgacaggatcatcagaactgtcatgttgggttccggatctgtccaagctgggatcctttaccattagcaagtagatgcaaatgataagaggtggactgcccttgcaagccctgcttgtctctgtatattctgttgcggttgaagggactcgttaagcattcaccaccgatcctttagcaagctgttgtatctctcatttctggatgtctcggctcggagaaatcttgtaattcagaccagatgggtatatagagagagcaaagaaacaaggcggatgggcttgggcaacggttggttagtttgtttcagttggattccttgtactgatgtgctatttcattgtgcatccacctcttcatatttctggttcgattgtttgtactgtgatacgatgccgtaggctccagtggggatgcaccgattcatgagctgccagctcattcaatgaatcggtttgcaaaggccaccgtcagctgtgaacgaggaaacacaaactatagagaag

SEQ ID NO: 4018 - DNA, 1605 bp, Zea mays
aacccgcccccacggcccacgccatcctccgcaccccccacgccggacaaccggggctcgccgcgccgctacgctcccaagccggaactccgaactcgccgcgccgttctcactgtggcaccagagctgctcgatctgccccgccctcgcccctcgcccctcgcccccttgccggaggggcgcgaactcgcaaaaattattgggtgtgcatttatacacccatgttctttgctgaccctgtctggtagcagattaaggtttggttgcggaaaatattggtgggttgtccaccatgacgagtccgccaagggtgagcatggagatcaccgacgacatgctcaagagcatggaggtcggcctagctttccgggactataatggtagaattagttctatggattttcacagcaaggctaccaactatcttgtgacagctagcgacgatgaatcaatccgcctatacgacactcaaaatgcagtatgtttgaagactattaatagcaaaaaatatggggtcgaactagtgtgcttcactgataacccaaatattgtcttatattcatcaaaaaatggctgggatgaatctctgcgtctactctcactgaatgataatcggtttcttagatattttaaaggtcaccttgacagggttgtctgcatctcattttgctctgagaaagaaaattttctctctggttcacttgaccgtactgttctcttatgggatcaacgggctgaaaaatcacagggcttactgcgtgtgcaagggaggcctgcagtttcatatgacgatcagggcatggtatttgcagttgcctatggtggtcacataaggatgtttgatgctcgaaaatttgaaaaggggccttttgagatcttctctgttggtaataacgattcagaggcccatgtcataaagttcagcagtgatggcaggcggattctgttaaccactaaagctggacgtgtccatgtgctagattcattccatggcaatagcattgcgtcgtgcaatgtgaagccagtggtaaccaactcaacactggaggcgtcgttcagccctgatggaaaccatatcatatctggctccggtgacggtagtgtttatgcttggaatgttaggagtggaaaggtcgcgcgctggggaagcacagacgacgaaccgccgctggtaaggtgggctccaggatccttgatgttcgtgacaggatcatcagaactgtcatgctgggttccggacctgtctaagctgggatcctttaccattagcaagtaggtgaaaatgatgagaggtggactgcccttgcaaaccctgttcgtccctgtatggtatgtcgtgtggctggttgaagcgactcatcctttagccaggtggccgtggtaaacttgcaacctgttacaattgaatgacttgtatagagcatcggctgtggcgatctggcttctgaagccagcggctagacaatgaagatggatccatgctttagttctgtaaaccggagattgtagctgagtattgctgtatctctttgtttctggaaggcgtcttggctcgtaaagattctgcaactcagagcagatggctaatatatagagagagcaaag

SEQ ID NO: 4019 - DNA, 1770 bp, Setaria italica
cacttagccaagcctggctgtgcgccgccgtgcgggcgagtgccgccacgggggctccgccggccgtacggagtcaagctcgagtggattgccgtagccgcgtaggcttgagccaagctggaatcgccgaatcggctcttgagttggctccagagctccgacaggctagtagatagagctcggctcggaaacctcttaccgccgcggcgccggacaagcaaagccgccgccgccgccgccgggcgctccccaggcctgtttccgccgctcttcgctccgccgccgctcctcctctctgcgtaaccgggctaagggtccatccatcgtgccagccgggcgtcaatcggtttggttccttcgtttcgtggtccctggtgccgattaaggtttacttgaggaaaaatttggggaactgacaccatgacgagtccgcccagggtgagcatggagatcaccgatgagatgctcaagagcatggaggtcggactggccttcagagactataatggcagaattagttctatggattttcacagcaaggctacgaactatctcgtgacagccagtgatgatgaatcaatccgcctatatgacactcaaaatgcattgtgtttgaagactattaatagcaaaaagtatggggtcgaacttgtttgcttcactgataacccaggcattgtcttatattcatcgaaaaatggctgggatgaatctctgcgtctactctcactgaatgataaccggtttcttagatattttaaaggtcaccttgacagggttgtctgcatctcattttgctctgaaaaagaaaattttctctctggttcaattgatcgcaccgttctcttatgggatcagcgggctgaaaaatcacagggcttactgcgtgtgcaagggaggcctgcagtttcatatgatgatcagggcatggtatttgcagttgcctatggtggtcacataaggatgtttgatgctcgaaaatttgaaaaggggccttttgagatattctctatcggtaatgatgattcagaagcccatgtcataaagttcagtagtgatggcaggcggattctggtaaccactaaagctgggcgtgttcatgtgctagattcattccatggcagcagcattgcatcatacaatgtgaagccagtggtaaccaattcaacgctggaggcatcattcagtcctgatggaaaccatatcatatctggctctggtgatggtagtgtttatgcctggaatgttaggagcggaaaggttgcacgctggggaagcacagataatgaaccaccactagtaaggtgggctccaggatccttgatgttcgtgacaggatcttcagaactgtcctgctgggttccggatctgtccaagctgggatcctttaccgttaccaagtagatgcaaatgataagaggtggactgacttttcttgggagtcccgcttgtctctgtagattctgccgtgtggctggtttatgtgactcgttaagaacaagcataccagcctaaccttcttttcatgcttcgtactcatcttcctgtggtaaccttttacaattaaatggattcttaccatcagctgcgactgcgagcctgaggaacagctatagctaaatgagttgtgatccttgggtggttgttcttgatagcagtattttagttttactctttggctggtgacgacttttaccgatgtacttatcatggattcgcaggctttcatgtcacctaacatgaagcatggctggcttgactttagcaggc

SEQ ID NO: 4020 - DNA, 1636 bp, Setaria italica
gccgaatcggctcttgagttggctccagagctccgacaggctagtagatagagctcggctcggaaacctcttaccgccgcggcgccggacaagcaaagccgccgccgccgccgccgggcgctccccaggcctgtttccgccgctcttcgctccgccgccgctcctcctctctgcgtaaccgggctaagggtccatccatcgtgccagccgggcgtcaatcggtttggttccttcgtttcgtggtccctggtgccgattaaggtttacttgaggaaaaatttggggaactgacaccatgacgagtccgcccagggtgagcatggagatcaccgatgagatgctcaagagcatggaggtcggactggccttcagagactataatggcagaattagttctatggattttcacagcaaggctacgaactatctcgtgacagccagtgatgatgaatcaatccgcctatatgacactcaaaatgcattgtgtttgaagactattaatagcaaaaagtatggggtcgaacttgtttgcttcactgataacccaggcattgtcttatattcatcgaaaaatggctgggatgaatctctgcgtctactctcactgaatgataaccggtttcttagatattttaaaggtcaccttgacagggttgtctgcatctcattttgctctgaaaaagaaaattttctctctggttcaattgatcgcaccgttctcttatgggatcagcgggctgaaaaatcacagggcttactgcgtgtgcaagggaggcctgcagtttcatatgatgatcagggcatggtatttgcagttgcctatggtggtcacataaggatgtttgatgctcgaaaatttgaaaaggggccttttgagatattctctatcggtaatgatgattcagaagcccatgtcataaagttcagtagtgatggcaggcggattctggtaaccactaaagctgggcgtgttcatgtgctagattcattccatggcagcagcattgcatcatacaatgtgaagccagtggtaaccaattcaacgctggaggcatcattcagtcctgatggaaaccatatcatatctggctctggtgatggtagtgtttatgcctggaatgttaggagcggaaaggttgcacgctggggaagcacagataatgaaccaccactagtaaggtgggctccaggatccttgatgttcgtgacaggatcttcagaactgtcctgctgggttccggatctgtccaagctgggatcctttaccgttaccaagtagatgcaaatgataagaggtggactgacttttcttgggagtcccgcttgtctctgtagattctgccgtgtggctggtttatgtgactcgttaagaacaagcataccagcctaaccttcttttcatgcttcgtactcatcttcctgtggtaaccttttacaattaaatggattcttaccatcagctgcgactgcgagcctgaggaacagctatagctaaatgagttgtgatccttgggtggttgttcttgatagcagtattttagttttactctttggctggtgacgacttttaccgatgtacttatcatggattcgcaggctttcatgtcacctaacatgaagcatggctggcttgact

SEQ ID NO: 4021 - DNA, 1597 bp, Pennisetum glaucum
gtgcgggggatgggggggagctgcctgaggggaggcggccgaggggtggagggaccccggtccggatgtgaagaaagctgaagagaagggagaagaagaagaagcagtgaggaggaagaaggagaagaatcccccggccagcagtgaaggagaataatgttggtgcttctccgcttttacatgcatcacttgtagcagcgagccgtcatctgttgacaagttacttctcttcccagtggcatgaactcgtagcaaggccgcgcgctccgtctctcgtcgacctgcttcggtcttgcaccgtccgctctgggcctcggcgcatcgttccctcaacggccttttctgcttcggtctcggtgcgttgcggcacccgcgcgctgctctgctccctcaccgtgctccctggttgccgattaaggtttacttgaggaaaaaatttgggggttgccaccatgacgagtccgcccagggtgagcatggagatcaccgatgagatgctcaagagcatggaggtcggactggccttcagagactacaatggcagaattagttctatggattttcacagcaagtctacgaactatctcgtgacagccagtgatgatgaatcaatccgcctatatgacactcaaagtgcattgtgtttgaagactattaatagcaaaaagtatggggttgaacttgtgtgcttcactgataacccaggcattgtcttatattcatcgaaaaatggctgggatgaatctctgcgtctgctctcactgaatgataaccggtttcttagatattttaaaggtcaccttgacagggttgtctgcatctcattttgctctgaaaaagaaaattttctctctggttcacttgatcgtactgttctcttatgggatcaacgggctgaaaaatcacagggcttactgcgggtgcaagggaggcctgcagtttcatatgatgatcagggcatggtatttgcagttgcctatggtggtcatataaggatgtttgatgctcgaaaatttgaaaagggacctttcgagatattctctgttggtaatgatgactcagaagcccatgtaataaagttcagtagtgatggaaggcggattctgttaaccactaaagttgggcgtgttcatgtgctagattcattccatggcaacagtattggatcatataatgtgaagccagtggtaaccaattcaacactggaggcatcattcagtcctgatggaaaccatatcatatctggatctggtgatggtagtgtttatgcctggaatgttaggagcggaaaggttgcacgctggggaagcacagataatgaaccaccactagtaaggtgggcaccaggatctttgatgttcgtgacaggatcttcagaactgtcctgctgggttccggatctctccaagctgggatcctttaccgttaccaagtagatgcaaatgataagaggtagactgactttacttgggagtcccgcttgtctctgtagattctgccgtgtggctggtttaagtgaccaagaacaagcataccagcctaaccttcttttcttccttggtacagatcttcctgtgataacctgttacaattaaaa

SEQ ID NO: 4022 - DNA, 1570 bp, Triticum aestivum
cgccgccgagtgtatgccaagatgccagccggggagaaggaggagagggtgaccatggaggtcaccgacgagatgctcaagaccatggaggtcggtctggccttccgggactatattggcagaattagttctatggatttccacagcaaggctacaaactatctggtgacagccagtgatgatgaatcgatacgcctatatgacattcaaaatgctgtatgtttgaagaccattaatagcaaaaagtatggggttgaattggtgtgcttcactactaacccaactcttgtcttgtattcctcgaaaaatggttgggatgaatctctgcgtctactctctctaaatgataaccggtttgtaagatatttcaaaggccatcttgacagggttgttgctatgtcattatgttatgagaaagacagttttctctctggttcacttgatcgaactgttctcctatgggatctgagggctgacaaagcacagggcttgctgcgtgtgcaagggaggcccgcagtttcatatgatgatcagggtttagttttcgcagttgcttatggtggctatgtaaggatgtttgatgctcgaaaatttgagaaggggccttttgatattttctccgttggtaatgatgaatcagaagccaatatgataaagttcagcagtgatggaaggcggcttcttttaaccaccaaagcagggtgtattcatgtgctagattcatttcatggcaacagtctagcaacttacaatgttaagccagttgtaaccaattcgacattggaggcatcgttcagccctgatggaaaccatatcatatctggctctggtgatggtagtgtttttgcttggagcgtcagaagtggaaagaaggttgcgcggtgggggagcacagatagcgagccaccattggttaggtgggctccaggatcgttgatgttcttgactggatcttcagaactatcctgctgggtcccggacctatcgaagctgggatcgtttgccgtgaccaagtaaactgattgttcttatactgacatttgacggatcaatgcggcttatcaagtatgcatatctaaggtagcaaggatgatcaactttccactggcattcagctgtgaatacgaggaagaataagctgtagcacattgtatgtctagaccgtggcctctcatctctcatgtgtcgttaggctttccgcgacactgtttgccttggtagagtgtatgtataactgtaaattgagctcctcattgcgcacagatgtgatactgaatctaaactatgcgccgtgtgaacaggttttcgcgatttatcatgttttatcatatcatgtagcacttcactcagtatgatgtcagtagttaatattactgtttccaagtgtgcgtttgccaaatttacctttgcaacgaggtgaagtggtgatatcaatatttgaacaagcagatttgttttgctaagtggtgccaaaacactattaacgtacgatgcaaaaacaagcagaaatttgcgatgctaatcaatctgtactgatatacaaatgctgctgagcaaatgcgcaatgcaa

SEQ ID NO: 4023 - DNA, 2025 bp, Brachypodium distachyon
agccataaccctagtgtcgccagaccgccggcgccgttcgcccccagaatctgtccctcggcgtcatccctctccttatactcgtccgtctcgtcgttcccaggcgctaggccggttcaaaaacttcaccaccggcggctgttcctcatcggcggcatcttccagctgcagcagcgacccgcaaaattttccggagcggagaaatttgagctgtgccccgcgcccccgtctcgtctccttccctgcctggcctcacagcctttacggcacaaccgccgccgccactcccctcgcacggcggtttgctccgttcagcagacgctcctgctgctgtccggccacagcactgccgcctcagtcgcagggcagtgctccccttcaattgcttgtcctgccgcctcaatatgccacgtggtgagaaggaggagagggtgaccatggaggtcaccgatgaggtgcttaagatcatggaggtcggattggcctttcgggactataatggaagaattagttctatggatttccacagcagagctacaaattatcttgtgacagccagtgatgatgaatcaatccgcctatatgacattcaaaatgccacatgtttgaagaccattaatagcaaaaagtatggggttgaactggtatgcttcaccactaacccaacacttgtcttgtattcttcgaaaaatggctgggatgaatctctccgtctactctcgctgaatgataaccgatttgtaagatattttaagggtcatcttgacagggttgtttctatgtcattatgctacgagaaagacaattttatctctggttcacttgatcgaactgttctcctttgggatctgagggctgacaaagcacagggcttattacgcgtgcaaggcaggcctgcagtttcatttgataatcagggtttagtttttgctgttgcatacggtggttacgtaaggatgtttgatgctcgaaaatttgagaaggggccttttgatattttctccgttggtaatgatgattcagaagcccatgtaataaagttcagcagtgacggaaggcggcttcttttaaccaccaaagctgggcgtattcatgtgctagattcattccatggcaataatatcgcaacttacagtgttaagccagttttaggtaattcaacattagaggcatcattcagccctgacggaaaccacatcatatctggctctggggatggcactgtttatgcttggagtgttagaagcggaaaggttgcacgctggggaagcacagataatgagccaccacttgttagatgggctccaggatcgttgatgttcttgactggatcttcagaactatcctgctgggtcccagatctatccaagctgggatcgtttgccgtcactaagtaaattcatatgatacaggattgatatccttgagcaggtacatttcttgggccggctttaattgcaaggtcatctagaagctgatgactctgctagctgttgctcaattaattggggatcctgcagctgcgtggatttcgccggccgatccctggcaatggcctaatgctccccatcgtcatcgtggacctgcctaattccatgaagaactgattgtcgtcgtcaatgtacagcaaattcctcagcgccaaagaggccctggttgaagaataggaagcccttcttgatcaggtacagtaatgcttgtcgaacagcagagtcgatgtccagcatggtcgtctagttgcggtcctacttgcgcaggctgaggatgtggtggacatgaggagattgctgaacaatacgcaccgggccacatgattgtttatgtttttgacaaaacaataatttaattttcatggtatccatcagattatgagaactgtataatgattgttcaaatatattattggctgtttccatagctagctatgaaatttaggaagtgggagtttcttctgctatgtattaagcatgcatcgtctgacacacgggcagtttcaggaattgaagtagcaaagaatttaaagaa

SEQ ID NO: 4024 - DNA, 2068 bp, Brachypodium distachyon
cctcgtctctccaaaggcgatagtcatggagccataaccctagtgtcgccagaccgccggcgccgttcgcccccagaatctgtccctcggcgtcatccctctccttatactcgtccgtctcgtcgttcccaggcgctaggccggttcaaaaacttcaccaccggcggctgttcctcatcggcggcatcttccagctgcagcagcgacccgcaaaattttccggagcggagaaatttgagctgtgccccgcgcccccgtctcgtctccttccctgcctggcctcacagcctttacggcacaaccgccgccgccactcccctcgcacggcggtttgctccgttcagcagacgctcctgctgctgtccggccacagcactgccgcctcagtcgcagggcagtgctccccttcaattgcttgtcctgccgcctcaatatgccacgtggtgagaaggaggagagggtgaccatggaggtcaccgatgaggtgcttaagatcatggaggtcggattggcctttcgggactataatggaagaattagttctatggatttccacagcagagctacaaattatcttgtgacagccagtgatgatgaatcaatccgcctatatgacattcaaaatgccacatgtttgaagaccattaatagcaaaaagtatggggttgaactggtatgcttcaccactaacccaacacttgtcttgtattcttcgaaaaatggctgggatgaatctctccgtctactctcgctgaatgataaccgatttgtaagatattttaagggtcatcttgacagggttgtttctatgtcattatgctacgagaaagacaattttatctctggttcacttgatcgaactgttctcctttgggatctgagggctgacaaagcacagggcttattacgcgtgcaaggcaggcctgcagtttcatttgataatcagggtttagtttttgctgttgcatacggtggttacgtaaggatgtttgatgctcgaaaatttgagaaggggccttttgatattttctccgttggtaatgatgattcagaagcccatgtaataaagttcagcagtgacggaaggcggcttcttttaaccaccaaagctgggcgtattcatgtgctagattcattccatggcaataatatcgcaacttacagtgttaagccagttttaggtaattcaacattagaggcatcattcagccctgacggaaaccacatcatatctggctctggggatggcactgtttatgcttggagtgttagaagcggaaaggttgcacgctggggaagcacagataatgagccaccacttgttagatgggctccaggatcgttgatgttcttgactggatcttcagaactatcctgctgggtcccagatctatccaagctgggatcgtttgccgtcactaagtaaattcatatgatacaggattgatatccttgagcaggtacatttcttgggccggctttaattgcaaggtcatctagaagctgatgactctgctagctgttgctcaattaattggggatcctgcagctgcgtggatttcgccggccgatccctggcaatggcctaatgctccccatcgtcatcgtggacctgcctaattccatgaagaactgattgtcgtcgtcaatgtacagcaaattcctcagcgccaaagaggccctggttgaagaataggaagcccttcttgatcaggtacagtaatgcttgtcgaacagcagagtcgatgtccagcatggtcgtctagttgcggtcctacttgcgcaggctgaggatgtggtggacatgaggagattgctgaacaatacgcaccgggccacatgattgtttatgtttttgacaaaacaataatttaattttcatggtatccatcagattatgagaactgtataatgattgttcaaatatattattggctgtttccatagctagctatgaaatttaggaagtgggagtttcttctgctatgtattaagcatgcatcgtctgacacacgggcagtttcaggaattgaagtagcaaagaatttaaagaactgttttgctattg

SEQ ID NO: 4025 - DNA, 1671 bp, Secale cereale
ccgcgacggcgagccgccgccacgctccgccctagtccctgctacctggctgctgcgccccttcccctaaaaaggaaacttattctccgtccgtccttgcgcccgcgaccgccgccgccgctggccctctcccggcggtcggctctgtgtacaagcgctgtcctggtgctacacggcaaccgcacgccgcctcagtccggggacagctcgccttcagttgcccgttccgccgccgagtgtatgccaagatgccagccggggagaaggaggagagggtgaccatggaggtcaccgacgagatgctcaagaccatggaggtcggtctggccttccgggactatattggcagaattagttctatggatttccacatgaaggcaacaaactatcttgtgacagccagcgacgatgaatcaatacggctatatgacattcaaaatgctgtatgtttgaagaccattaatagcaaaaagtatggggttgaactggtgtgcttcactactaacccaactcttgtcttgtattcctcgaaaaatggctgggatgaatctctgcgtctactctctctgaatgataaccggtttgtaagatatttcaaaggccatcttgacagggttgttgctatgtcgttatgttacgagaaagacagttttctctccggttcacttgatcgaactgttctcctatgggatctgagggctgacaaagcacagggcttgctgcgtgtgcaagggaggcctgcagtttcatatgatgatcagggtttagtgtttgcaattgcttacggtggttatgtaaggatgtttgatgctcgaaaatttgagaaggggccttttgatattttctccgttggtaatgatgaatcagaagccaatatgataaagttcagcagtgatggaaggcggcttcttttaaccaccaaagcagggtatattcatgtgttagattcatttcatggcaacaatctagcaacgttcaatgttaagccagctctaaccaattcgacattggaggcatcattcagccctgatggaaaccatatcatatccggctctggtgatggtagtgtttatgcttggagtgttagaagtggaaagaaggttgcgcgctgggggagcacagataacgagccaccactggttaggtgggctccaggatcgttgatgttcctgactggatcttcagagctatcctgctgggtcccggacctatccaagctgggatcgtttgccgttaccaagtaaactgattattcttatgctgacaatttgacggatgaatgcggcttatcaagtatgcatatctaggttacaaggatgatcgagtttccactggcattcagctgtgaatatgaggaagaataaggaagctgtagcacattgtatgtctagatgattgtggcctctcacctctcatgtgtcgttaggctttccgcgacgctgtttgccttggtagagtgtatgtataactgtaaagtaagctcctcattgcgcacagatgtgatattgcattgaaactatgagccgtgtgaacaaattttagcgatttatcgtgtttagcactgcactcagtatgatgtcagtagctgatattactgttttgaaagtgtgagcctgccaaatttacctttgtaacgaggtgaagtggtgatattaatatttgatgaacaag

SEQ ID NO: 4026 - DNA, 1282 bp, Secale cereale
gctccgccctagtccctgctacctggctgctgcgccccttcccctaaaaaggaaacttattccccgtccgtccttgcgcccgcgaccgccgccgccgctggccctctcccggcggtcggctctgtgtacaagggctgccctggtgatacacggccacagcacgccgcctcagtccgaggacagctcgccttcagttgcccgttccgccgccgagtgtatgccaagatgccagccggggagaaggaggagagggtgaccatggaggtcaccgacgagatgctcaagaccatggaggtcggtctggccttccgggactatattggcagaattagttctatggatttccacatgaaggcaacaaactatcttgtgacagccagcgacgatgaatcaatacggctatatgacattcaaaatgctgtatgtttgaagaccattaatagcaaaaagtatggggttgaactggtgtgcttcactactaacccaactcttgtcttgtattcctcgaaaaatggctgggatgaatctctgcgtctactctctctgaatgataaccggtttgtaagatatttcaaaggccatcttgacagggttgttgctatgtcattatgttacgagaaagacagttttctctctggttcacttgatcgaactgttctcctatgggatctgagggctgacaaagcacagggcttgctgcgtgtgcaaggaaggcctgcagtttcatatgatgatcagggtttagtgtttgcagttgcttacggtggttatgtaaggatgtttgatgctcgaaaatttgagaaggggccttttgatattttctccgttggtaatgatgaatcagaagccaatatgataaagttcagcagtgatggaaggcggcttcttttaaccaccaaagcagggtatattcatgtgctagattcatttcatggcaacaatctagcaacgttcaatgttaagccagctctaaccaattcgacattggaggcatcattcagccctgatggaaaccatatcatatccggctctggtgatggtagtgtttatgcttggagtgttagaagtggaaagaaggttgcgcgctgggggagcacagataacgagccaccactggttaggtgggctccaggatcgttgatgttcctgactggatcttcagagctatcctgctgggtcccggacctatccaagctgggatcgtttgccgttaccaagtaaactgattgttcttatgctgacatttgacggatgaatgcggcttatcaagtatgcatatcta

SEQ ID NO: 4027 - DNA, 1820 bp, Hordeum vulgare
gggggcttacggatttgtagcagccgccttacttagcagtccagcgggccacgctccgaccagcccaattcgctcgcacttcttcttccttcgttcacctcaattcgtcccccttcctccagaaaaataagaacttttgcccctccgcgacggcgagccgccgccactctccaccctcccccgccctcctccgccctagtccctattacctggctgctgcgctccttcccctaaaaaggaaaaatattccccgtccttccttgcgctcccagtctgtgccgcgcgaccgccgccgccgcctgccctctcccggcggtcggctccgtgtacaagggctctcctggtgctaccccggccgccgagtgcataccaagatgcccgccggggagaaggaggagcgggtgaccatggaggtcaccgacgagatgctcaagaccatggaggtcggcttggccttccgggactatattggcagaattagttctatggatttccacagcaagtccacaaactatcttgtgacagccagtgatgatgaatcaatacgcctatatgacattcaaaatgctgtatgtttgaagaccattaatagcaaaaagtatggggttgaactggtgtgcttcactacaaacccaactcttgtcttgtactcctcgaaaaatggctgggatgaatctctgcgtctactctctctgaatgataaccgttttgtaagatatttcaaaggccatcttgacagggttgttgctatgtcattatgttacgagaaagacagttttctctctggttcacttgatcgaactgttctcctatgggatctgagggctgacaaagcacagggcttgctacgtgtgcaagggaggcctgcagtttcatatgatgatcagggtttagtttttgcagttgcttacggtggttatgtaaggatgtttgatgctcgaaaatttgagaaggggccttttgatattttctccgttggtaatgatgaatcagaagccaatatgataaagttcagcagtgatggaaggcggcttcttttaaccaccaaagcagggtgtattcatgtgctagattcatttcatggcaacaatctagcaacttacaatgttaagccagctgtaaccaattcgccattggaggcatcattcagccctgatggaaaccatatcatatctggctccggtgatggtagtgtttttgcttggagtgttagaagtggaaagaaggttgcgcgctgggggagcacagataacgagccaccactggttaggtgggctccaggatcgctgatgttcttgactggatcttcagaactatcctgctgggtcccggacctatcaaagctgggatcgtttgccgctactaagtaaattgattgttcttatactgacatttgacggatcaatgtggcttatcaagtatgcatatctatgtagcaaggatgatcaactttccacaggcattcagctgtgaatatgaggaagaataagctgtagcacattgtatgtctagatgttggcctctcatctctcatgtgtcgttaggttttctgcgacactgtttgccttggtagagtgtatgtataactgtaaagtaagctcctcattgcgcacagatgtgacattgaattgaaactatgagctgtgtgaacaggattttgcgatttatcgtgttttattatagtatcatgtagcactgcactcagtatgatgtcagtagctgacattactgtttccaagtgtgagcttgccttttgtaacgaggtgaaatagtgatattaatatttgaaccatgcatcagttagacatgggctctcttcg

SEQ ID NO: 4028 - DNA, 1246 bp, Sorghum bicolor
accggctccggcctccggcctccggctatcccattcccatgagagccgtcgcggctgccgcttctccctcccggctccgcgccctcctcctcctcctctccccccacctcccagctcgaaccccgcgcccccggttcgccatgaacccttcgtcgtcctcatcctcctcctctggcggctaccactccagggccgctgcctttgcttccccgcagccgcgcggcggtggcgggaggcggcgcggtggtggcggtggcggcggccgcggcggtggagacgggagcgagcgcatcgacgccctcggccgcctcctgacgagggtgttgcggcacatggcggcggagctgcgcctggatatgaggaccgatggatacgtgcgcgtccgtgacctgctcaagcttaaccttcagaccttcgccaaggtccctctcaagtctcacacagtggacgagatcagggaggcagtcaggcgggataataagcagaggtttagtctgctggaggaagatggcgaactgttgatccgggcgaaccaggggcacacagtaacaactgttacttcagagagcctgctgaaacccattttgtcccctgatgaagtgtcagtttgtgtgcatggaacttacagaaagaatcttgactcgattttgcaatctgggctaaagcgtatgacaaggttacatgtacatttctcaagtggcttaccgttagatggaggagtaattagtggtatacggcagaatgtaaacatcttgatacatttggatgttagtaaggcacttaaagatgggatgaagctttatatttcagacaacaaagtgatcttgacagaaggttttgatggcgtcgtccctgtgaaatactttgaaagaatcgaaacatggccaggacgagctccaataccgttccaaagataacagcccacggtggcagcaatgtagattcagcgttgctgcttcatacatactgaaaatttgatttgtcgtgctgtaatctcagcagttgcgtacagtgtttgctccgttatgtaattgatgatttctggactctgtaaaaagctgtggtacccagcatccagcagattctggtgtagtacatgtatggtcacagactgcacttgtcaaggcctctccaatctgaaagtgaggttctttcagacaagacgccttcgaaatcaaagagcactagtagtgcattatggtggtataccacgaacacaaagaactaaggtcaatagtggggtttt

SEQ ID NO: 4029 - DNA, 1507 bp, Secale cereale
gttcttccaggcccgggaagagcccgtgaggttaccgtagcgcaagcccaggcagcaacccggccaagctcagccgtcttcatcagcaggggtcgtccggccgccaccgcgcgtcgccggtcgtgtcaccgcggccacttctgctgcttatgagagccctcaccgccgccacaatctcctccccgatacgcgccctcctcctcctctcctccttcccctcaaccctccgcccccttctcaccatgaacccctcctcctcctcctctggttaccgctccaatgctgccgccttcgcctccatgcaccagccacgtggtggccgtggtggtggcaggcggccgggtggacgtggcggcggtggcggcgacggtggaaaccgcatcgatgccctcggccgcctcctgacaagggtcttgcggcacatggcgccggagctgaggctgaacatgaggagcgacgggtatgtgcgggtccgtgacctgctccgcctcaacctggagaccttcgccaaggttccgctcaactcccacacggtggatgaaatcagggaggcggtcaggcgagacaacaagcagaggtttggtctgttggaggaggatggcgagctgctgattcgagctaaccaggggcacactgtgacaactgttacatcagagagcttgttgaaaccaattctatcggctgatgaagtctcagtctgtgtccatggaacttacaggaaaaatgttgattcaatactgaaatatgggcttaaacgtatggcaaggctacatgtacatttctcaagtggtttaccatcagacggtggagttattagtggtatgcggagtggcgcaaacatattgatatatttgaatgtcagaaaggcactgcaagacgggatgaagctatacatctcagacaacaaggtgatactgacggagggcttcgacggcgtcgtccccgtcaagtacttcgagaagatcgaaacatggccaggacgtgcaccgataccggtccagaggtagaagaggccttaccgtagcactggggttcctgcacggcctctcgctcagcgaaaacttgggatgaatggactgcacgacaagattctccttgccgaaaaggaaatcaaccgtgctgtaatgtctgaaagagttccatcgtgtaaccctggtactgtatatgagagggagcgttattctgctgctggttgtgcaaaacctgtttacgatgatggtttccagacgttatagagtaccaaattccgtttatgatgtgtagacctgcgaagtttcatccgaaaacatgtaaattttgcatgcattttacggtggtttcaaaaaataatcacaacgtaaaatttgcatagagcgatttctgctggcttgctgaattttcagaatttctggtcatcatcatcaggggggcaatcactggcctgcccaacgggggctgcccactaccgtgttgtctgaatttgtaccacaccacagttaaaaccatctgttttgttccgtttaaaaaa

SEQ ID NO: 4030 - DNA, 1287 bp, Brachypodium distachyon
ttagggtgcccggtgcccgctgaagatgcatgagagctctcacggccgccgcctcctcgctccgttccctcctcttcctccacatctcctcaccccccggcccctcgctcgccatgaaccgccctgagtcctcctcctccacctctggctaccgctcccaggcggcacccttcgcctccccgcgcggcggcggcggcgggagccggcgaccctgtggccgtggcggcggcggcggcggcggcggcggcgggaacgaccgcatcgacgccctcggccgcctcctgacgagggtgttgcggcacatggcgtcggagctgcgcctggacatgaggagcgacggctacgtgcgggtccgcgacctgctcactctcaacctccagaccttcgccaaggttcccctcaagtcccacaccgtggacgaaatcagggaggcggtcaggcgggataataagcagaggtttggtctgttagaggaagatggggagctgctgattcgggctaaccaggggcacaccgtgagaactgttacttcagagagcttattgacaccaattttatcagctgacgaagtctcagtttgtgtccatggaacttacaggaaaaatcttgattcaatcttgaaatctggtctaaaacgtatggaaaggttacatgtacatttctcgagtggtttaccctcagacggggaagtgattagcggtatgaggcgaagtgctaacatcttgatatatttggatgtcagcaaggcactgcaagatgggatgaagctatacatctcagaaaacaaggtgatactgacagagggtttcgacggcgtcgttcctgtcaagtacttcgagaagattgaaacatggccaggacgagcgcctataccgttccaaagatagagagatatcctctacaagtacaactgtagtctttgtatggcttcttgttgaggtcttcagatgcacacacacgtttacacctttctcctcacctgtaagtacctaaaagggtgctgttagtatctgaaaaaagggctgctttgtcgcgtaccaacacgagctggagacttgtatttctgctgctcttgtggttgttacaaatcgttaatgacctgatttgcaccattgatgatgcctgtcaaatctattcaccgtgtcaatatgtttcattgccctgtttgggtattattattactagctgacacttgctcgatgtatccatcagaatcaggtgtagggatcaatgtttaatttgacagggagcggagataaataaaatttgcgcttgatgatttggcta

SEQ ID NO: 4031 - DNA, 1289 bp, Brachypodium distachyon
ttagggtgcccggtgcccgctgaagatgcatgagagctctcacggccgccgcctcctcgctccgttccctcctcttcctccacatctcctcaccccccggcccctcgctcgccatgaaccgccctgagtcctcctcctccacctctggctaccgctcccaggcggcacccttcgcctccccgcgcggcggcggcggcgggagccggcgaccctgtggccgtggcggcggcggcggcggcggcggcggcgggaacgaccgcatcgacgccctcggccgcctcctgacgagggtgttgcggcacatggcgtcggagctgcgcctggacatgaggagcgacggctacgtgcgggtccgcgacctgctcactctcaacctccagaccttcgccaaggttcccctcaagtcccacaccgtggacgaaatcagggaggcggtcaggcgggataataagcagaggtttggtctgttagaggaagatggggagctgctgattcgggctaaccaggggcacaccgtgagaactgttacttcagagagcttattgacaccaattttatcagctgacgaagtctcagtttgtgtccatggaacttacaggaaaaatcttgattcaatcttgaaatctggtctaaaacgtatggaaaggttacatgtacatttctcgagtggtttaccctcagacggggaagtgattagcggtatgaggcgaagtgctaacatcttgatatatttggatgtcagcaaggcactgcaagatgggatgaagctatacatctcagaaaacaaggtgatactgacagagggtttcgacggcgtcgttcctgtcaagtacttcgagaagattgaaacatggccaggacgagcgcctataccgttccaaagatagagagatatcctctacaagtacaactgtagtctttgtatggcttcttgttgaggtcttcagatgcacacacacgtttacacctttctcctcacctgtaagtacctaaaagggtgctgttagtatctgaaaaaagggctgctttgtcgcgtaccaacacgagctggagacttgtatttctgctgctcttgtggttgttacaaatcgttaatgacctgatttgcaccattgatgatgcctgtcaaatctattcaccgtgtcaatatgtttcattgccctgtttgggtattattattactagctgacacttgctcgatgtatccatcagaatcaggtgtagggatcaatgtttaatttgacagggagcggagataaataaaatttgcgcttgatgatttggctata

SEQ ID NO: 4032 - DNA, 1675 bp, Hordeum vulgare
aggaaaagagaagagaagagagaaaaaagaaaaaaatcgcggctcgggctcgggctcgcacggtcgtagcaggatttgatttgttcccctcgctccgtccctcgcaccgcatctcctcgctccgccgccgccgccgctcctccgccgtgcgcgccctcctcccgcgcctcccacgccgtcccgtcggatgcagcgctcgttccgccccgccgccccgctgctcctccgccgcgcgtgcccaccgccgcctcctccgccgccgccgcggcctcgttcttccaggcccgggaggagcccgtgaggttaccattgcgcaagcctaggcagcaacgacgcccagctcacccgccttcatcaataggggtcgtccgtccaccaccgcgcgtcgccagtcgtgtcaccactgccacttccactgcttatgagagccctcactgccgccacaatatcctccccgacccgcgccctcctcctcctccacctctccttcccttcaaccctccgcctccctctcaccatgaacccctcctcctcctctggctaccgctccaatgctgctgcctccgcctccacacaccagccgcgcggtggccgtggtggcgccaggcgaccgggtggccgtggtggcggtggcggtggcggtgacggcagagaccgcatcgacgcccttggccgcctcctgacgagggtcttacggcacatggcaccggagctgaggctggacatgaggagcgatggctacgtgcgggtgcgcgacctgctccgcctcaacctgcagaccttcgccaaggttccgctcaactcccacacggtggacgaaatcagggaggcggtcaggcgagacaacaagcagaggtttggtctgttggaggaggatggagagctgctgattcgagctaaccaggggcacactgtgacaactgttacatcagagagcttgttgaaaccaattctatcggctgatgaaatctcagtctgtgtccatggaacttacaggaaaaatgttgattcaatattgaaatatgggcttaaacgtatggcaaggctacatgtacatttctcaagtggtttaccatcagatgggggagttattagtggtatgcggactagcgcaaacatattgatatatttgaatgtcagaaaggcactgcaagacgggatgaagctatacatctcagaaaacaaggtgatcctgacggagggcttcgacggcgtcatccccgtcaagtactttgagaagatcgaaacatggccaggacgtgccccgataccgttctagaggtagaagagaccttaccgtagcaccggagttcccgctcagcctcctgttcagcgaaaacttgggatgaaatgtgcaaaataaccgtggtttcatcatgttaccctggtaatagtttctccttgccgaaaaggaaatcaaccatgttgtgcaaaataaccgtggtttcatcatgttaccctggtatatgaggaggaccttgtactggttgtgcaaaaccctgtgtatgatgatgatgatgaccagatgttatggagtagcagatttggtttatgatgtgtggacctggggcagtctcatccaaaaacctgtgtggacccattactgtgttgtctgaatttttaccacaccaagcacactcctttcagttaagcgaaatgttaatttgtggttaac

SEQ ID NO: 4033 - DNA, 2646 bp, Brachypodium distachyon
ccgcccacagcaagaagccgtgattccaaaatcagacctcattgcgctctccatccggggagcggcggcttctctccatccccccgctctctctccatacaccccggcgccggcgatggatcaggacgtcgacgacctcgcggcggcatcgcccctggcggcggcggcgcgctcgctgcgagccggcgtggagcggtcgcgcgcgatggggcaggcgatggcgcgcggggcgccccggctcgaggagatccaggcggcgctgccggcgctggaggccgccgtgcgcccgatccgggcgccccgggccgagctggtcgccgccggcccgcacatcgaccgcgccgtcggccccgccgccgcggtcctcaaggtgttcgacgccgtgcacgggctcgagccttcgctgctcgaggccggcgaggggggccctggcccggcgggcgacctacccgggtacctcgccgtgctcggccggctcgaggaggcgctgaggttcctgtcggataactgcggcctcgccgcccagtggctcgccgacatcgtcgagtatcttggtgaccacgacctcgccgacccgcggttcctcgccgaggtcggggtcgctctggatgagctcaggaaaccgtccgggtacctcgatggggggctcctggcagccgcgctggacatgcttgagggcgtgttccgccgcctcctagccgagcactccgcgccgctcgcgatgcagcagcacggcgccaccagctccgcatccatttcgtcgtcgtctcgcatccccgccaccgcggtccgcaagctcagcctgattctggaccgccttgtggccaatggccggcgagacagctgcatttccatgtatgccgatgcacgcggtggcgtggtcagtgccagcgttcgtgcccttggcctcgattacttgcgcaacccggcggatgatgcacaggcattgggacctggtgtcgagttgtgggggcagcatttggagtttgtggtgcgccgcctcctcgagtctgagcggcagctctgcgccaaggtgtttggccagcacaaggatgtttcatcagcgtgcttcgccgaggtggcagcacaggctagtgttcttgatttcttgaggtttggccgtgcagttgcggatgtcaagaaggaccccatcaagctcctgcgtttgctggaggtgtttgattctttgaataagctgaggttggacttcaaccgattgttcggtggaaaggtctgtgcggatattcagtgccagacaagggaccttgtgaaattgttggtggatggtgccgttgaaatctttgaggagttgctcgtgcaggtggagcttcagcggcacatgcctcccccagctgatgggggtgtgccgcgcctggtttcttttgttgttgagtactgcaaccggctccttagtgagaagtataggcctgtgcttgcacaggtgctcaccatccaccggagctggcgcaaggaggtattcaatgacaatatgcttgttgccgcagtgcttaacattgtcaaggcccttgaagccaactttgatgtttggtccaaggggtacgggaatgttactctatcgtatatcttcatgatgaacacacactggcatttctttaaacatttgaaggctactaagctaggtgagctcttgggtgatgtgtggctcagggatcgtgaacagtttaagggttactacctggagatgtttatgaggagtagctgggggccactgtcaccgctgctcaaccgggaggggctaatcttgttctccaagggtcgggccacagcaaaagacctcgtgaagcagcgcctcaaaactttcaatgcaagattcagtgagatgtttcatgaacaatcggcatggatcataccagacaaggatttgagggcggaggcatgtgaccttgtgctacaggcaatagttcctgcctaccggagctacatgcagaactacgggccgctagtggagcaggatgtaagtgctagcaagtatgtgaagtacaccgtcgatggtttggaaaagatgctcagtacgctcttcatgccccgtcccaggagggctgggagcttccagatcggccactccaatggcaggcccagtagtgtgacggcagggttctatcggagtgcttccgcagtgaattaactccagttgaagaaccaaaagattggttataatatttatggaataactgggtaagtgagaacaattcatttttcaccagtcagcaggcagctccgcctctcactgaggcgtaacaatggacctctatgatgagggcaatgctggcatatgaacaataataagctcttcttgatggcgaacagaacaaagcaggaagcatttcctcggcacgcatctgagatgtacctagtaccattgtagctatttgtttaggaacatctgtagggggctggaggtgtggtgtatgtaaaaccggttgcaattttagtagggctgtagacaattctatcagttccatgtgctacaaattgaactctagtaatgcggtgtatatgaaaaaccagagtttgaagtactggcgggagctaactggttactatctgttcctggtttcctcggtggagaagctgtttttattaaaccggagtaatattactgaatcaatgaagtgaacctttcaa

SEQ ID NO: 4034 - DNA, 4914 bp, Sorghum bicolor
atggctaaaaacataaggggtggcaacgactggagaggtttgttaaagtaatctacaaggcttacaacaaaatgtcaagtgtcctatgatgggtaaacaatgacaaatagtgactagagcctcagagtgtttacgctgagaacctttaataacaaaatagtgtatcgaatcaattgctggattccatctgaagacatcaccattgcatatagtgagacatcaaactgtgtaaatgctacaacaaccctattttgtaaaatctcgaaaagggtttcaatgtcttaattttgtcaccccttacattttgtaatccatgcccactctaatgaagcggtaggacacatgacatgattttgctaaaaaaatagagatagatatcaaaacacattactcttttacctatatctctatggctagatgttgcttctggcttagccattcacatttttttacctatatctctatggctcttgtcgcttgcggcttagccattggcacgagtaaaatgatggcttcttattgcatcaatagtctcatttgcttacacgtttagaaatcacttcctaataatttctaataataatgaaatagcataacaagtttcatgatttgcttaaaaacatgatacaaccacataaaagcatgtaaaatgatggctttctatagtatacaaacaaaattatccgatgtcattgtaaaaaaaggttcagatatggtattattttgcaaaaaatattttagagaaagttttgtacaaagtgataatttctcctcactttttttgtgtgtttattatcactttttttttacaaaagtgtttttatcacttttcatacaaccaagaaaaggcaaacccacgcgcgggcatatcatcttttcctcccctcttcgattcgatccatccatccttcccaaccaaacccaaacctccgtcccaaaaaaaaaaaaaaaaaaaaaaactttttctctccgtctcgtctctctcctcccctctgggtcgccactcgccagcaatccacacgaaagcgagaagccgcttccagcaagaggaggagagtagagggagagggggaaggagggaggctccagggggccctgcattgcgacgggctcgggcgccgtcgattcgtccgccgggatggatcacggcggcggcgagggccgcgtcgtgacggcgagcctggcggcggcgcgacgcaccctgcgtgccggcgtggacaagtcgcgcgcgctgggccacgcgctggcccgcgcgggtccccgcctggaggagatccagacggcgctgccggcgctggaggccgcggtgcgcccgatccgcgcgccgctggccgagctcgccgccgccgggccccacatcgaccgcgccgtgggccccgccgccgccgtgctcaaggtgttcgacgccgtgcacggcctcgagccgccgctcctggcgcccggcgccgcgggctccggcgcggccggggacctgccggggtacctcgccgtcctggcgcagctcgaggaggcgcacaggttcctcgccgacaactgcgggctcgccgcgcagtggctcgccgacattgtcgagtacctcggcgaccgcgacctcgccgacccgcgcttcctcgcggaactcggggtcacgctcgacgagctcaggacgccccccgccggcgacctcgacggcgggctcctggccgccgccctcggtatcctcgaggccgagttccgccgccttctcgccgaccactccgcgccgctcgcgatgccgcagcccggcgcctccgctggctcggtcgcgccgtcccgcgtgcctgccgccgctgtccacaagctcaccctcattctcgatcgcctcgtggccaacggcaggcaagaccgctgcgtggccgcttatatcgatgcgcgcgggggtgtggtcagtgccagtcttcgcgctctcggcctcgactacctgcacgacccgtctcaggacgcccaggcattgggacctgctcttgagctgtgggggcggcacttagagtttctggtgcgccgtctcctcgagtcagagcggcagctctgtgccaaggtgtttgggcagcataaggatgccgcgtctgcatgctttgcagaggtggcggcacaagccagggttcttgaattcttgaggtttggccgtgcagttgctgatgccaagaaggatcccatcaagctccagcgtctgctggaggtgtttgattctttgaataagctgaggctggacttcaataggttgttcggtggcaaagcctgcgcggagattcagagccagacaagggaccttgtcaagttgttgatagacggggctgtcgagatctttgaggagttgattgtgcaggtggagctgcagcggcacatgcctcccccagttgatgggggcgtgccgcgcttagttacctttgtcgtcgagtactgcaaccgactgcttagtgagcaatacaggactgtgcttgggcaggtgctaactatccatcgcagctggcgcaaagaggtgttcaatgacaggatgcttgttgacgtggtgctaaacattgtcaaggcccttgaagctaactttgatgtttggtccaaggcatatgacaatgctacactgtcgtatctcttcatgatgaatacccattgtcatttctttaggcatctgaaggctactaagctaggagaggtcttgggtgatgtgtggctgcgagagcatgaacaatacaaggaatactacttgtcaatgttcatcagggagagctggggagcactttcgccgctactgaaccgggagggattaatattgttctccaagggccgggccacggcaagggacctggtgaagcagcgcctcaaaacattcaattcgagctttgatgagatgcattgcaggcaatcgtcgtgggttatacctgacaaggatttgcgggagaggacatgtaatcttgtggtgcagactattgttcctacctaccggagctacatgcagaactatgggccacttgtggagcaagagggaaatgccagcaagtatgtaaggtacactgtcgatggtttggagaagatgctcagtgccctctacatgccccggcccaggagggctggaagcttccagatcaagcactccagtggcaatattgccagtgcaatgactgggttgcatcggagtgcttctgcagtgaaatagcctccgttgaagaaccccaaaaaattggatcaatatgatgcaatgtccggtatgtggcaaatgattcatttgacccagttggcaaacagtcccgcactggataggtgacccaataatggaaccctggtcggatcagtggtgtcatatgaacataagttactctttagttagcatggagaatagagggtggtgatcatttctgcagctcctatttgagatgttacatcctcctgagctatcttctcttcttttgtacttctgttagtgaccctgctagtgaccctggcaccatatcattcatttggagatattttatcagctgtgtagctatgtaaaattggttgtattttaggtgacctgtgggcattacctttccatgtaccaaaaactagaccctggatttttcagtgaggatttgctatttgtttggtaaactagagcagatatataccccaatacaattgcattacatttacacagtacagcttgatcataactaacgctgttgcatttcttcttcttctcctttctcatcagttcacaatatggcagtccctggatctgtcagtgaggatgtgctatttgtttggtaaactggaacagatatataccccaatatacaattgcactactacatttaaacaaagaatagtttgatcataacaaatttgtttgcatatatttttattttgcccccttcagttcacaatatggttaaagaaaagattacagaacaggtaattcttgcatgatcccttttgtttagacccaaaactgatttgttgccatccctgtcagttcaaggctgctaggctgagaccagctgtaagtgaagctggcatccaatctattgggatgaattgaaggaacttgaaattgtggacactgcactgttgggcattcaggagtaatataagcatctgaaatatgtttggaaaattttgtttgtttatccctccttgcgctaaaattccttggagcaatctgacagtggggcctgagccgctttttgttcggtctgaaaagggcttaatgggcagcagaaagtttgggccagaaacagacacataatggcaataagaacgtgcttacagctgctttgatgtggactgttaatttcacatggaatggctggggcacccctcttgttccacgcctgcagtgcatagatgaagcttcctcctgagttaaaatccacctctagtgtcgttgccatccccgcagatcatccaccttattgttaggttaagtcagctatgtcaaccaattatgtcatataatttggagttctgcttagctgactcattctcccccattttaaattgtttgtgttgaattcatgggatattgggagagtatccttggggaaatttggatttaagattttccatgtgtgggctcatatccttaagatctattattccttttttctggatctttcctttgttacattaatgatttgcacgcagactagtgttgcgaatggaccgtttatgggataagttagacgcacgagaatctgcagcatcctggcaaactccccatttagttcagcaccaggcaccaggaggaatggaagttaccgacaaactggaagctccaagttgatgccaggaccaggacactgactggatgagcatagggatttcagaaggaacggttcaaaccagaacatgccagttggcgtggaggtgctctggcggatcaattgaaggccagaagcttacaaacgtgcaaatacaaaa

SEQ ID NO: 4035 - DNA, 2915 bp, Zea mays
ttcgttcacggttcaccctttcgattcgatccattcccaagttcccaatcccaaccaacccccctcgaacctccgtcagtctcagtttctccttgctctttcggtcgcaagcaatccacagcgcttccagcgagacgaagagaggagagagaggggaggaagggcccgagagggaggctccaggggccctgcattgcgtagggcgcagccgccgggatggatcacggcggcgagggccgcgttgcggcggctcggcgcacgctgcgtgccggtgtggacaagtcgcgcgctctgggccactcgctggcccgcgcggggccccgtctagaggagatccaggcggcgctgctggcgctggaggccgcggtgcgcccaatccgcgcgccgcatgccgagctcgccgccgcggggccccacatcgaccgcgccgtaagccccgccgccgccgtgctcaaggtgttcgacgccgtgcacggcctcgagccgccgctcctggcgccaggcgccgcgggctcgggcgcggccggggacctgccggggtatctcgccgtcctggcgcagctcgaggaggcgcacaggttcctcgccgataactgcgggctcgccgcgcagtggctcgccgacatcgtcgagtacctcggcgaccgcgacctcgccgaccagcgcttcctcgccgacctcggggtcacgctcgacgagctcaggacaccccccgccggcgacctcgacggcgggctcctggcagccgccctcagtatgctcgaggccgagttccgccgcctcctcgccgaccactccgcgccgctcgcgatgccgcagaccggcgccgccgctggatcggccacgccttcccgcgtgcctgccgtcgccgtccacaagctcaccctcatcctcgatcgcctcgtggccaacggcaggcaagacagctgcgtggcctcttatatcgatgcgcgcgggggtgtggtcagtgcaagtcttcgtgctctcggcctcgactacctgcgcgacccttctcaggacgcgcaggcattgggacctgctcttgatttgtggaggcggcatttggagtttgtggtgcgccgtctcctcgactcggagcggcagctctgtgccaaggtgtttgggcagcataaggatgtcgcgtccgcgtgctttgcagaggtggcggcacaagccggggttcttgacttcttgaggtttggccgcgcggttgctgatgccaagaaggaccccatcaagctccagcgtctgctggaggtgtttgattctctgaataagctgagactggacttcaacaggttgttcggtggcaaagcgtgcgcggagattcagagccagacaagggaccttgtcaagttgttgatagacggcgccgtcgagatctttgaggagttgattgtgcaggtggagctgcagcggcacatgcctcccccagttgatggaggcgtgccgcgcttagttacctttgtcgttgagtactgcaaccgactgcttggtgagcaatacaggcctgtgcttgggcaggcgctaactatccatcgcagctggcgcaaggaggcgttcaatgacaggatgcttgttgacgcggtgctaaacatcgtcaaggcccttgaagctaacttcgatgtttggtccaaggcatatgacaacgctacgctgtcgtatctcttcatgatgaatacccattggcatttcttcaggcatctgaaggctactaagctaggagaggtcttgggtgatgtgtggctgcgagagcatgaacaatacaaggaatactatttgtcaatgttcatcagggagagctggggagcactttcagcgctactgaaccgggagggattaatattgttctccaagggccgggccactgcaagggacctggtgaagcagcgcctcaaaacattcaattcgagctttgatgagatgcatcgcaggcaatcgtcgtgggttataccagacaaggatctgcgggagaggacatgtaatcttgtggtgcagactatcgtccctacctaccggagctacatgcagaactatgggccacttgtggagcaagagggaaatgccagcaagtatgtaaggtacactgtcgatggtttggagaagatgctcagtgccctctacatgccccggcccaggagggctgggagcttccagatcaagcactcgagcggtaagattgccagtgcaatgactggcttgcatcggagtgcttctgcagtgaaatagcctatgttaaagaacccaaagattggatcaatatgatagtatgtggcaattggcaaatgattcatttggcccagtcaagcaaagagtcccgcactggataggtgaccgaataatggacccatggtcggagcagtggtgtcaagtgtcatatgaacataagttactctttagttagcatggagaatagaggctggtgatcagttccgtagctcctgttagtgtccctgaacataagttacccatggtctgagatgttaccattctcctgagctattttctcttgttgtgtacttctgctggtgtccctggcaccataatcattcatctggagatattcaatcagctgtgtagttatgtaaaatcgatttgtaattttagttttaggtgacctgtgggcattaccttttaatgtaccaagaatcgagcttaatagatgcaatggattatatggggggggaaaaaactagacccctcgagcgagtgaggatgtgctatttgtttggtaaactagagcagatatgtacccccaatacaattgcattacatttactgaaagtacaacttgatcataacaaatgcggttgaatttcttttttttctccatcagttcacaatatggtagtccctggatctctcagtaaggatttcctatttgtttggtaaactggtacagatatatgccccca

SEQ ID NO: 4036 - DNA, 2675 bp, Secale cereale
ctcaatctccgccagcctcctctccccttccttccacgccgcgcatgcgccggcgcggctgctgctagctaggcggcggtgcagacgacaaacccagcgacgagcagcccgtccgtccgccctagcagcccatcccagccatggcgacgctgcaggacctcggggtgtcggccttcatcaacatcctgggggccttcgtcttcctcctgctcttcgccgtgctccgcatccagcccatcaacgaccgcgtctacttccccaagctctacatcgccgggaagcgcgccgccgaccaccgcggcctccgcagggccatcaacctcaacctctgcacctacttcaagttcctcagctgggtccccggcgcgctccgcatgacccagaccgagctcatacaccacgccggcctcgactccgccgtctacctccgcatctacacgctcggcctcaagatttttctgccggtcatggttgtcgccttgctggttctcattccagtcaatgtctctggtgggacattactgaacctgagaaaagatgtcatgtttagtgatattgataagctatccatatcaaatgttagcccgggctccaacaggttttttattcatcttttaatggcatatgtgttcacattttggacatgctttatgctgtacaaagagtacagtaatgtggccttcatgagattacatttcctggcttctcagaaacgttgtgccgatcagttcactgtgattgttagaaacatacctcgtgtttcaagccattcgacatctgagacagttgacgagttcttccgcaggaaccatccagaccactatcttggtcagcaggctgtttacaatgcaaaccggtatgctaaacttgtaaagcaaaaggagagacttcaaaactggctggattactaccagctaaagtttgaaaggcatcctgagaaaagaccaactggaaggacaggatgctttggtttctgcggtagacaagtggatcaaatcgactactaccgggctagaattagcgaacttgataagaggattgcatcagagcgtcagagagttttgaatgatccaaaagccgttatgccagtttcttttgtgacatttgactcaagatggggtgctgctgtatgtgcacagacacaacagtcaaagaatcccacacaatggctgaccaattgggctcctgaaccacgcgacgtttattggcagaatcttgctattccatttttctccctgagcatacgcaagtttctcatatcaatcgcggtctttgctttggtgttcttctacatgataccgattgcatttgtgcaatcacttgccaatctcgagggtattgaaagagttgcgcctttcttgaggcccgtaatagaagtaaaggtggtgaagtccttcctgcagggtttccttcccggtctggctttgaagctctttctctatatcctccctacggttcttatgatcatgtcaaaagttgaaggctatgtctctttgtcatcgctggaaagaagaactgcttcgaaatattactacttcatgctggtgaatgtttttcttggaagcataattgctggcacagcttttgagcagctagactctttttttcacgatcctccttcacaaataccaaggaccattggagtggctgtaccaatgaaagcaacattcttcatgacatacataatggtcgatggctgggccggtatcgccaatgagattcttcgggtgaagccactggtcatctaccatctgaagaacatgttcatcgtgaaaaccgagcgggacagggagagggcgatggatccacgcagcatcgcgctgggagaaaaccttccatccctgcagctgtacttcctccttgggctcgtgtacgcggtggtcacccccattctcctccctttcataatcgtcttcttcgccttcgcttaccttgtctacaggcatcagatcatcaatgtgtacaaccaggagtacgaaagcgcggcggcgttctggcctcaggtccattcgcgcatcatagcgagcttgctcatctctcatgtgactctctttgggctgatgagcacgatgaaggccgcctactccactccgctgctcatcttcctgccgttgctgacactatggttccacaagtactgcaagagtcggttcgagcccgcgttccgaaagtatcctctagaggaagcgatggagaaggacgtgatggagcacgcgtcggagccgagcctgaacctcaagacctacctggcaaacgcatacctgcaccccatcttccatatgtttgagcaggaggatcagaaggaggaggccaccatagaggtgagaatcgacaaatcggagcagcagcagcatgtgagaagctcacactcacagtatgaggaggagatgagcgcacagtcgcattaccaccatgaggagaggagcagcagccagtaccagtaccagcaccagtatcagtaccagcacgaggaaactcacatgaggagtgagcagtcgccgccacactttgtctaccaccctggagtcgagcactgatgctgcgaatttagttacccctccctaacttgaccttttgcctcgcattttcgtggaaatgattgcccctctagtccagatgacgctgatgattgatgtacatgccaatatgtagcgtgatgataatcttatctgtcc

SEQ ID NO: 4037 - DNA, 2798 bp, Triticum aestivum
cctactcccctcgtgtgccttgagagacgccgaccacaccacgactctcattccgcccgccttctctccccttcctcgccgcgcatgcgccggcgctgctgctgctaggcggcgcagacgacagcccagcgccgagcagcccgtccgtccaccctaggaggccacagccatggcgacgctgcaggacctcggggtgtcggccttcatcaacatcctgggggccttcgtcttcctgctgctcttcgccgtgctccgcatccagcccatcaacgaccgcgtctacttccccaagctctacatcgccggcaagcgcgccgccgaccaccgcggcgcccgcagggccatcaacctcaacctctgcacctacttcaagttcctcagctgggtgcccggcgcgctccgcatgacccagaccgagctcatacaccacgccggcctcgactccgccgtctacctccgaatctacacgctcggcctcaagatttttctgcccgtcatggttgtcgccttgctggttctcattccggtcaatgtctctggtgggacactactgaacctgagaaaagatgttatgttcagtgatattgataagctgtccatatcaaatgttagcccgggctccaacaggttctttattcatcttctaatggcatatgtgttcacattttggacgtgctttatgctgtaccaagagtacagtaatgtggcgttcatgagattgcatttcctggcttctcagaaacgttgtgctgatcagttcactgtgattgttagaaacatacctcgtgtttcaagccattcgacgtctgagacagttgatgagttcttccgcaggaaccatccagaccactatcttggtcagcagtctgtttacaatgcaaaccggtatgctaaacttgtaaagcaaaaggagagacttcaaaactggctggattactaccagctgaagtttgaaaggcatcctgagaaaagaccaactggaaggacaggatgctttggtttctgtggtagaaaagtggatcaaatcgactactaccgggctagaattagcgaacttgataagaggattgcatcggagcgtcacagagttctgaatgatccaaaagccgttatgccagtttcttttgtgacatttgactcaagatggggtgctgctgtatgtgcacagacacaacagtcaaagaatcccacacaatggctgaccaattgggctcctgaaccacgcgacgtttattggcagaatcttgctattccatttttctctctgagtatacgcaagtttctcatatcaatcgcggtctttgctttggtgttcttctacatgatacctattgcatttgtgcaatcacttgccaatcttgagggtattgaaagagtcgcgcctttcttgaggccagtaatagaagtaaaggtggtgaagtccttcctgcagggtttccttcccggtctggctttgaagctctttctctatatcctccctacggttcttatgatcatgtcaaaagttgaaggctatgtctctttgtcatctctggaaagaagaactgcttcgaaatattactacttcatgctggtgaatgtatttcttggaagcataattgctggcacagcttttgaacagctggactctttttttcacgatcctccttcacaaataccaaggaccattggagtggctgtaccaatgaaagcaacattcttcatgacatacataatggtcgatggctgggccggcatcgccaacgagattcttcgagtgaagccactggtcatctaccatctgaagaacatgttcatcgtgaaaaccgagcgtgacagggagagggcgatggatccacgcagcattgcgcttggagaaaaccttccatccctgcagctgtacttcctccttgggctcgtgtacgcggtggtcacccccattctcctccctttcataatcgtcttcttcgccttcgcctaccttgtctacaggcatcagatcatcaatgtgtacaaccaggagtacgagagcgcggcggcattctggcctcaggtccattcgcgcatcatagcgagcctgctcatctctcatgtgactctctttgggctgctaagcacaatgaaggccgcctactccactccgctgctcatcttcctgccattgctgacaatatggttccacaagtactgcaagagtcggttcgaacccgcgttccgaaagtatcctctagaggaggctatggagaaggacaggatggagcacgcatcggagccaagcctgaacctcaagacctacctagcaaatgcatacctgcaccccatcttccacatgtttgagcaggaggatcagaaagaggaggccaccatagaggtgagaatcgacaaatcggagcatcagcagcagcagcatgtgagaagctcacactcacagtatgaggaggagacgagcgcacagacgcattaccaccatgaggagaggaccagcagccagtaccagtaccagtaccagcaccagtatcagtaccagcttgaggaaactcacatgaggagtgagcagtcgccgccacactttgtctaccaccctggagtcgatcattgatgctgccaatttaccactccctaacttagaccttttgcctcgcattttggtgaaaatgattgcccctctagtccagtccagatgatgctgatgattgatgtacatgccaatatgtagtcgtgtgatgataatcttatgagttgattgatttttcctctgcaaagggagaaagcaattacctttgagtactaatgcgaatcggcgttggatggcgatactt

SEQ ID NO: 4038 - DNA, 2973 bp, Setaria italica
cacgcaccactacaactagctagcgccgccgcgtgctcggccctctgctaccgcgcgccgcgcttcgactcgagacacgctccgtcgccgcgcacgcgtctcccgctttctgaattccctccgctgctccttcccttcctttaatttccctgctctcgccacccacccaccgatcgatctcccttcccatccccttctccctcttctcccctgcaaacaacagcaagcggcgcagctagcggtgcggcggaatggcgacgctggaggacctgggcgtctccgccttcatcaacatactgagcgccttcgtcttcctcctcctcttcgccgtcctccgcatccagcccatcaacgaccgcgtctacttccccaagctctacctcgcccacaagcgcacccacgaccactcctcccgctccgccgtccgccgcttcgtcaacctcaacatctgcacctacatcaccttcctcagctgggtacccggcgcgctccgcgtgaccgagcccgagctcatcgcgcacgcgggcctcgactccgccgtctacctacgcatctacacgctcggtctcaagatgtttttgcccattgcagctctcgcactgctggttcttgttccagtcaatgtatcaggcggcacattacttaatctaaaaaaagaagttgttttcagtgatatcgataagctttccatatcaaatgtaaaccctggatccaacagattctttgttcatctcctgatggcatatgtgttcacattctgggtgtgcttcatgctgtataaagaatacagcaatgttgcatttatgagattgcatttcctggcttcccagaagcgttgcgccgatcagtttactgtgattgttagaaacattcctcgcatctcaagccattcaacttctgaaacagttgacgagttcttccgaagaaatcatccagaccactatcttggtcagcagcctgtttacaacgcaaatcggtacgctaaacttgtgaagaaaagggataggcttcaaaattggttggattactatcagctgaagtttgaaaggcatcctgagaaaagaccaactagaaggacaggatgccttggtttctgtggcagggaagtggatcaaattgactactatcaggctagaatcagcgagcttgagaggaagatggcatccgagcgccagaaagttctcaatgacccaaaagctattatgccggtttcttttgttacgtttgactcaagatggggtgctgctgtgtgtgcacagacacaacagtcgaagaacccaacccaatggctgactgattgggctcctgaaccgcgggatgtttattggcagaatcttgccatcccatttttctctctcagtatccgcagatttctgatatccgttgcggtctttgctttggtgtttttctacatgatacctatcacatttgtgcaatcacttgccaatcttgagggtcttgaaaaagttgctccttttctgaagccagtaatagaagtaaaagtggtaaaatccttcctgcaggggtttgttcccggtctggctctgaagatctttctctatatcctccctacagttttactgatcatgtcaaaagttgaaggctacatctctttatcatcgctggaaaggaggactgcttcgaaatattattacttcatgctggtgaatgtattccttggaagcataatcgctggcacagcctttgaacagctatacactttcctccacaagcctgctacacaaataccaatgacaatcggagtagctataccaatgaaggccacatttttcatgacgtacataatggttgatggctgggctggtattgcaaacgagatccttcgagtgaagcctctggtgatataccatctgaaaaacatgtttatcgtgaaaacggagagggacagggagagggcgatggatcctggtagcattgggcttggagaaaaccttccaaccctgcagctgtatttcctccttgggcttgtgtacgccgtcgtcacccccattctcctgccattcattatcatcttctttgcctttgctttcctcgtctacagacatcagatcatcaatgtttacaatcaggagtacgagagcgctgctgcattttggcctcaggtgcattcccgaataatagcaagcctgttgatctctcacctaactctgtttgggttgatgagcacaaaggaagctgctttctccacccctctactcatcttcctgccactgctgacaatatggttccacaaatactgcaagagccggttcgagcctgctttcaggaagtatccgctagaggaagcgatggagaaggataacatggagcacgcgtcagagcctaacctgaacctgaaatccttcctggctaacgcctacctgcatcccatcttccatctttttgaggaagcggcgaaagaggaggagacggtggaggtgaggatcgacaaagcccagaagcaacagcatcatcaccgtcaggaggaggagactcatgtgaggagctcatctcagtaccatgaggagagtcacttgagaagcacccacgagacgcactaccaccacgaggagagccaatacagcaggagcacccagtaccatgaggggatccacgtgaggagcgacatggactcgccgtcgccgccgcacttcgtctatcactacgacatccagccctgaatgatactgaaaaagcagtggtctctaacttgattttggttttcctggtcctgtgaattcttctcttagttaccttacccttaaaaaggatgctgaattgccaatgattgatgaattgttcgatgtacatgctagtgtgtagtgtggtagtgactgtaaaagtaaaccctgatgtgccagatgaggagtcagctctagtgttgcgtattctatgagtgtgtctcgcgctgaattgtgattctagctgatcgagagcagaagaatgagaatggtgtgtctcggtagagcagcc

SEQ ID NO: 4039 - DNA, 2912 bp, Setaria italica
gcgccgccgcgtgctcggccctctgctaccgcgcgccgcgcttcgactcgagacacgctccgtcgccgcgcacgcgtctcccgctttctgaattccctccgctgctccttcccttcctttaatttccctgctctcgccacccacccaccgatcgatctcccttcccatccccttctccctcttctcccctgcaaacaacagcaagcggcgcagctagcggtgcggcggaatggcgacgctggaggacctgggcgtctccgccttcatcaacatactgagcgccttcgtcttcctcctcctcttcgccgtcctccgcatccagcccatcaacgaccgcgtctacttccccaagctctacctcgcccacaagcgcacccacgaccactcctcccgctccgccgtccgccgcttcgtcaacctcaacatctgcacctacatcaccttcctcagctgggtacccggcgcgctccgcgtgaccgagcccgagctcatcgcgcacgcgggcctcgactccgccgtctacctacgcatctacacgctcggtctcaagatgtttttgcccattgcagctctcgcactgctggttcttgttccagtcaatgtatcaggcggcacattacttaatctaaaaaaagaagttgttttcagtgatatcgataagctttccatatcaaatgtaaaccctggatccaacagattctttgttcatctcctgatggcatatgtgttcacattctgggtgtgcttcatgctgtataaagaatacagcaatgttgcatttatgagattgcatttcctggcttcccagaagcgttgcgccgatcagtttactgtgattgttagaaacattcctcgcatctcaagccattcaacttctgaaacagttgacgagttcttccgaagaaatcatccagaccactatcttggtcagcagcctgtttacaacgcaaatcggtacgctaaacttgtgaagaaaagggataggcttcaaaattggttggattactatcagctgaagtttgaaaggcatcctgagaaaagaccaactagaaggacaggatgccttggtttctgtggcagggaagtggatcaaattgactactatcaggctagaatcagcgagcttgagaggaagatggcatccgagcgccagaaagttctcaatgacccaaaagctattatgccggtttcttttgttacgtttgactcaagatggggtgctgctgtgtgtgcacagacacaacagtcgaagaacccaacccaatggctgactgattgggctcctgaaccgcgggatgtttattggcagaatcttgccatcccatttttctctctcagtatccgcagatttctgatatccgttgcggtctttgctttggtgtttttctacatgatacctatcacatttgtgcaatcacttgccaatcttgagggtcttgaaaaagttgctccttttctgaagccagtaatagaagtaaaagtggtaaaatccttcctgcaggggtttgttcccggtctggctctgaagatctttctctatatcctccctacagttttactgatcatgtcaaaagttgaaggctacatctctttatcatcgctggaaaggaggactgcttcgaaatattattacttcatgctggtgaatgtattccttggaagcataatcgctggcacagcctttgaacagctatacactttcctccacaagcctgctacacaaataccaatgacaatcggagtagctataccaatgaaggccacatttttcatgacgtacataatggttgatggctgggctggtattgcaaacgagatccttcgagtgaagcctctggtgatataccatctgaaaaacatgtttatcgtgaaaacggagagggacagggagagggcgatggatcctggtagcattgggcttggagaaaaccttccaacactgcagctgtatttcctccttgggcttgtgtacgccgtcgtcacccccattctcctgccattcattatcatcttctttgcctttgctttcctcgtctacagacatcagatcatcaatgtttacaatcaggagtacgagagcgctgctgcattttggcctcaggtgcattcccgaataatagcaagcctgttgatctctcacctaactctgtttgggttgatgagcacaaaggaagctgctttctccacccctctactcatcttcctgccactgctgacaatatggttccacaaatactgcaagagccggttcgagcctgctttcaggaagtatccgctagaggaagcgatggagaaggataacatggagcacgcgtcagagcctaacctgaacctgaaatccttcctggctaacgcctacctgcatcccatcttccatctttttgaggaagcggcgaaagaggaggagacggtggaggtgaggatcgacaaagcccagaagcaacagcatcatcaccgtcaggaggaggagactcatgtgaggagctcatctcagtaccatgaggagagtcacttgagaagcacccacgagacgcactaccaccacgaggagagccaatacagcaggagcacccagtaccatgaggggatccacgtgaggagcgacatggactcgccgtcgccgccgcacttcgtctatcactacgacatccagccctgaatgatactgaaaaagcagtggtctctaacttgattttggttttcctggtcctgtgaattcttctcttagttaccttacccttaaaaaggatgctgaattgccaatgattgatgaattgttcgatgtacatgctagtgtgtagtgtggtagtgactgtaaaagtaaaccctgatgtgccagatgaggagtcagctctagtgttgcgtattctatgagtgtgtctcgcgctgaattgtgattctagctgatcgag

SEQ ID NO: 4040 - DNA, 3588 bp, Sorghum bicolor
gttgttccgcactcgccactgagcagcgcgttcttctctttgtcatgttgtccctgcccctgtgctggcctggctggcgctcctccctgcccgcccggcgctgaacaagaagtagagggcagcaggaccgcaaggacatcatccacgggccggaccgggccgcacagcaagcaacacacagaactggccagcaccacgcgacagctactactcctagccgccgcgtgctccgcgtccgctctgcctgcctcggtgctactgctacccgcgccgcgcttcaattcgggcggcgcacgcggacgcggccctctggtttctgatttcccggattccctttccctccctgcattttgcattcctctcctttccttaattccttgccttgccaccgatcgatcctccatctcgccttccctttcttcctccctcccgctcctgacccgtaacctcaccaaggccaacgagggagagagagagaggagacaacaacaacaacaacaacaacaagccaacaacaatggcgacgctgcaggacctgggggtgtccgccttcatcaacatcctgagcgccttcgtcttcctcctcctcttcgccgtcctccgcatccagcccgtcaacgaccgcgtctacttccccaagctctacctcgcgcacaagcgccagcacgaccacaccgcccgctccgccgtccggcgcttcgtcaacctcaacatctgcacctacatcaccttcctcagctgggtgcccggcgcgctccgcatgtccgagacggaactcgtcgcccacgccggactcgactccgccgtctacctgcgaatctacaagctcggtctcaagatatttttgcccattgcaactctcgcccttctggttcttattccagtcaatgtatctggcggcacattacttgatctaaaaaaggaagttgttttcagcgatatcgataagctttctatatcaaatgttaaccctggatccaacagattctttattcatctcttgatggcatatgtgttcacattttgggcatgctttatgctgtacaaagaatacagcaatgtagcatttatgagattgcatttcctggcttcccagaagcgttgtgcagatcatttcactgtgattgttagaaacattcctcgtgtctcaagccattcaacttctgaaacagtggacgagtttttccgaagaaatcatccagaccactatcttggtcagcagcctgtttacaatgcaaatcggtacgctaaactcgtgaagcaaagggagaggcttcaaaactggttggattactacgaactgaagtttgaaaggcatcctgagagaagaccaacaggacggacaggatgccttggtttctgtggcagggaagtggatcaaatagactactaccgggctagaatcagcgagcttgagaagaggatggcatcagagcgccagaaagttctcaatgacccaaaagctgttatgccagtttcctttgtgacatttgactcgagatggggtgctgctgtgtgtgcacaaacacaacagtcaaagaacccaacccaatggctgactgattgggctcctgaaccacgggatgtttattggcaaaatcttgccatcccatttttctctctcagtatccgcaggtttctgatatctgtcgcagtctttgctttagtgtttttctacatgatccccatcgcgtttgttcaatcacttgccaatctcgagggtcttgaaaaagttgctccttttctgaagccagtaattgaagtaaaggtggtgaaatctttccttcagggatttcttcctggtctggctctgaagattttcctctatgtcctccctacagttctgctgatcatgtcaaaggttgaaggctatgtctctttatcatcgctggaaagaaggactgcttcgaaatattattacttcatgctggtgaacgtattccttggaagcataatcgctgggacagcatttgaacagctacattcgtttctccacgagcctcctacacaaataccaaggaccatcggggtagctataccaatgaaggccacatttttcatgacatacataatggttgatggctgggctggtattgctaacgagatccttcgagtgaaggctctggtgatataccatctgaagaacatgtttatcgtgaaaacggagagggacagagagagggcgatggatccaggtagcataagacttggagaaaaccttccatcccttcagttgtatttcctcctcggcctcgtatacgccgtcgtcaccccccttctcctgccattcataatcgtcttctttgcctttgctttccttgtctacagacaccagatcatcaacgtgtacaatcaggagtatgagagtgccgctgcattttggcctcaggtgcatacccgaataatagctagcctgctcatctctcatgtaactctgtttgggttgatgagcacaaagaaagctgcatactccacccctctgctcatctttctgccactactgacgatctggttccacaagtactgcaagagccggttcgaaccagctttcaggaagtatcctctagaggaagcaatggcgaaggataccatggagcacgcatcggagcctaacctgaacctgaaatccttcctggctaacgcttacctgcaccccatcttccaccttttcgagcaagcagagaaagaggaggagatggtggaggtgagggtcgacaaagccgagaagcagcggcacctccatgaggaggatgagactcaggtgaggacctcatcgcagtaccgggaggagactcacttcaggagcacgcacgagacgcattaccaccacgaggagagccatgtcagcaggagcacgcagtatcatgaggggatccacgtgaggagcgacacggattcgccgtcgccgccacacttcgtctaccactacgacatccagccctgatgacgctgaacagcagccgtctctaacctttgttttcctgggtgtcttgtgaatgcttctcttggctaacctgtcccccagaggttgctaaaattgctgatgattgatgaattgttgggtgtacatgcaggtgtagtgaggtagtgactgtaaaaattctggtgtgccatgggacctgaacattgattccatgcagaaaaaaaaatgtggaggaatcaagtttgaagtattgtgcgtggtatatatgagaatgtctcgcgctgaatcttcacaatttgtttgaaaccacggaaaacggaaagcataatagtgttcggagattaaaaaaaggcttgataaaaatttaacaggctctggcagattggaggaagtgttggaggtctttcctgtggaattcattgcctgaatgcaaataagttcattgcctgtggagaaagtattggcgtgagtgggcaagcctaaagttagcaggaggagtaactactcctatacattgtctcatgcaaacaccaagctgggcatggatatatggtgggttcaaataccaagtgttgtgacgagaaacagaaaaaagaaggtgttttaaagacaagtatgagacaacttactgtataacttgtctctaattacttggcttatagtca

SEQ ID NO: 4041 - DNA, 2970 bp, Zea mays
ccgatcccgagtgcatgctacctcacctgcgtgtgcgccgcgtttcaactcgagaaagaagacacaccgtcgcggcgcacgcggcctctggtttctgatttcctggttaccctttccctccctgcatttgcctttcagatcaggcggcagcaccttcctctcctccccttcccttccgtctcatcttcgttcccttccggggtcatcccttccgtcctcctcctaccaagtcccaaggccgcgagacagacagacagacagacagaaagagagagcagagcagacaatggcgacgctcgaggacctgggcgtctccgccttcatcaacatcctgggcgccttcgtcttcctgctcctcttcgccgtcctccgcatccagcccgtcaacgaccgcgtctacttccccaagctctacctcgcgcacaagcgccaccagcacgaccacgccgcccgctccgccttccgccgcttcgtcaacctcaacctctgcacctacgtcaccttcctcagctgggtgcccggcgcgctccgcatgtccgagccggacctcgtcgcccacgccgggctcgactccgccgtctaccttagaatctacacgctcggcctcaagatatttctgcccattacgactctcgcccttctggttcttatcccagtcaacgtatctggcggcacattacttgatctaagaaaggaagttgttttcagtgatatcgataagctttccatatcaaatgttagccctggatccaacagattctttatccatctcttgatggcatatgtgttcacattctgggtgtgctttatgctgtacaaagaatacagcaatgtagcatttatgaggttgcatttcctggcttcccagaagcgctgtgccgatcatttcacagtgattgttagaaacattcctcgtgtctcaagtcattcaacttctgaaacagtggatgagttcttccgaagaaatcacccagaccactatcttggtcatcagcctgtttacaatgcaaatcggtatgctaaacttgtgaagcaaaaggagaggctccaaaactggttggattactacgaactgaagttcgaaaggcatcctgagagaagaccaacaagacggacaggatgccttggtttctgtggcagggaagtggatcaaatagactactaccgggctagaatcagcgagcttgagaggaggatgacatcagaacgacagaaaattctcaatgacccaaaagctgttatgccagtttcttttgtgacatttgactcgagatggggtgcggctgtgtgtgcacagacacaacagtcaaagaacccaacccaatggttgactgattgggctcctgaaccgcgggatgtttattggcaaaatcttgccatcccatttttctctctcagtatccgcaggtttctgatgtctgtcgctgtctttgctctagtgtttttctacatgatccccatcgcgtttgttcaatcgcttgccaatctcgagggtcttgaaaaagttgctccttttctgaagccagtaatagaagcacatgtggtaaaatctttccttcagggatttcttcctggtctggctctgaagatttttctctatattctccctactgtcctgctaatcatgtcaaaggttgaaggctatgtctctttatcctcgctggaaaggaggactgcttcgaaatattactacttcatgctggtgaacgtatttcttggaagcataatcgctggcacagcatttgaacagctatattcgtttctccaccagcctcctacacaaataccaaggaccattggggtagctataccaatgaaagccacatttttcatgacatacgtaatggtagatggctgggctggtattgctaacgagatccttcgagtgaaggctctggtgatataccatctgaagaacatgttcatcgtgaagacggagagggacagggatcgggcgatggatcccggcagcataggactcggagaaaacctcccgtcccttcagctgtatttcctcctcggcctcgtgtacgccgtcgttaccccgcttctcctgccgtttataatcgtcttcttcgcctttgctttcctcgtctacagacaccagatcatcaacgtgtacaatcaggagtacgagagtgctgctgcgttctggcctcaggtgcactcccggataatagctagcctactcatctctcatgtaactctgtttgggttgatgagcacaaaggaagctgcgtactccacccctctgctcatcttcctgcctctgctgacgatctggttccacaaatactgcaagagccggttcgaaccagctttcagaaagtatcctcttgaggaagcaatggcgaaggacaccatggagcacgcatcggagcctaacctgaacctggaatccttcctggctaacgcttacctgcaccccatcttccgccttttcgaggaagccgggaaagaggaggagacggtggaggtgaggatcgacaaagccgagaagcagcagcatcgccatgaggaggacgaggctcacgcgaggagctcgtcgcagtaccgggaggaggagactcacttcaggagcacgcacgagacgcattaccaccacgaggagagccacgtcagcaggagcacccagtatcatgagggcatccacgtgaggagcgacacggactcgccgtcgccgccacacttcgtctaccactacgacatccagcagtgatgatgtcgtctctaactttgttttcctgggtgtcttgtgaatgcttctcttggctaacctgtccagccccccccccccccccccccaagaggtttgctaaagtcgctgatgattgatgaattgttgcgtgtacatgcagggtagggtctagtgttgtagtgactgtaaaagttctggtgtgccatgggacctgaacattgattccatgcaggaaaaaaaagaagtggatgaatcaagttgagtattgcgtg

SEQ ID NO: 4042 - DNA, 2499 bp, Brachypodium distachyon
cacgcgtgggcgcatcgcgggctcctccccctgttcgtccgcgcgccttcaagcctctcgccgccgtgactccttcgcccgagccgctccctaattctctcccaccaccgaagccaacggaactcttccgcgtaggcgtccttctcctcctcaacctctgctggactggcgtggagtggaagtggcgatccatccggacgcgattgctttttgttggaatttgcaacagccacatgtcaggggtccaggaacagcgatatgaagaactgtttggtgggtttttctttgacgaagatgccttaagcgaggatttttcattggatgggttggacaaggagcttgaggagcacaagaactacgatgttctagtaagtattctagccaacggtgaaaaacagcgagacatggcaaccatggtggaaggcaacctaggccatattgagcaggatctgatccaagattatattgaagacaatgatagcctagttctcttgcgtgatcagattcatgactgcgacattattttatctgaaatgggatcacttcttagtggatttcaggttcacattggttctataaactcagaacttaggagtctccaggagaaatccttggatttgggtctgagactgaagaatcgtaagttggttgagacaaagcttgcagaatttgtcgaagaaattgttgctcctcctggtttggtgaaggttatcattgatggagaggtaaatgatgattatattagaagtctaaacattttgagcaaaaagttgagattttctgaagttgatctgatgattaatgcatcaaaggctctgaaagatattaagcaagaattggaaaggcttcggaaaaaggcactatcaaaggtgtctgattatatcattgagatattctctgccatgagaaagcctggaactaatatccagatactccaacaaaatttgcttcagaaatacaggtatcttgttctctttcttaaagagcaaggactcgagacttacaatggtgtctgtgcagcatatgttgatacgatgaacaaggtgttgagtgcatattttcatgtgtacgtagaagcactggaggggttgaagctagatattggtgtatccagtgatttgattggatatgacactaatatggttgaccttataacaagggggagagagcatttgagaagtcaccgtttcatgttttctttaggtgaaagagcaaacattttgaagcatattgatcagcctggcttggtacctcgtatatctgaagccaattctctgaaatacccatacgaagttatttttaggagcctacaaaagcttctgatggacactgctagctctgagtatctttttgtcgaagcattctttggtgaagagtcattgttttatcgagtttttgaaggaccttttgctgtaattgatgaacatttgaatattacacttccaaactgtcatgatgcagtatgcctgatgctcatgatctgcataactaggaagcaccagttggttatgtccaacaggcagcttccttgtctagaaacatatttggataaggctctcctctatctctggccacgtttcaagacagtgtttgacatgtatcttcaaagcttgtaccgatgcgatgtgaaaatgttatctgtggatgggactcgtccacaccacattgtaaggtgctatgtggagttcacagcatccctagttcaacttaatgctgaatgtggagatggccagcttgatatgagcttggaacggttgcgcttagctgttgacgacctacttgtaagatttgctgaaaagtttgcaactcccaaactgcaacacctgtttcttttgaataattatgacatggccatctctatcctgaaggaagctggcgaagaagcaaaaaaactgcaaagatattttgaagagaagctggaatgtaacctgatatcgtttgtggatgaattgcttatggagcattttggtgacttaattaaatttgtgaagattcacatttctgaagacctaatttcttacactgagcccccaaacattgctgatgttgagccagttgtaaagaacttcgcagtgaagtggaaaaatgctctagagctcatgcacaatgaagttgtaacttgttgcagtaaccttctgtctggtatggcaattctaaaagcagcaatggctcagttgcttaatgattataacagactctcagaatgtgtgaagatgatcccaggggggtcttctttgaacaggaatctggtttctattacttccatttcatatgaaatcaggaaatattcgagaacactctagttccttgaatggtttcatagatggatgcatatcctctgcataaagggtcaaatgtttggctaatggactgtcaagatcaaagctggagagaaactgagagtttatagcttctgacgagatactgaaatcatctcgagtgcctcaagccaagctgtccaacgctggatccagcggcaaggataaaggagtgtggttc

SEQ ID NO: 4043 - DNA, 2494 bp, Brachypodium distachyon
cacgcgtgggcgcatcgcgggctcctccccctgttcgtccgcgcgccttcaagcctctcgccgccgtgactccttcgcccgagccgctccctaattctctcccaccaccgaagccaacggaactcttccgcgtaggcgtccttctcctcctcaacctctgctggactggcgtggagtggaagtggcgatccatccggacgcgattgctttttgttggaatttgcaacagccacatgtcaggggtccaggaacagcgatatgaagaactgtttggtgggtttttctttgacgaagatgccttaagcgaggatttttcattggatgggttggacaaggagcttgaggagcacaagaactacgatgttctagtaagtattctagccaacggtgaaaaacagcgagacatggcaaccatggtggaaggcaacctaggccatattgagcaggatctgatccaagattatattgaagacaatgatagcctagttctcttgcgtgatcagattcatgactgcgacattattttatctgaaatgggatcacttcttagtggatttcaggttcacattggttctataaactcagaacttaggagtctccaggagaaatccttggatttgggtctgagactgaagaatcgtaagttggttgagacaaagcttgcagaatttgtcgaagaaattgttgctcctcctggtttggtgaaggttatcattgatggagaggtaaatgatgattatattagaagtctaaacattttgagcaaaaagttgagattttctgaagttgatctgatgattaatgcatcaaaggctctgaaagatattaagcaagaattggaaaggcttcggaaaaaggcactatcaaaggtgtctgattatatcattgagatattctctgccatgagaaagcctggaactaatatccagatactccaacaaaatttgcttcagaaatacaggtatcttgttctctttcttaaagagcaaggactcgagacttacaatggtgtctgtgcagcatatgttgatacgatgaacaaggtgttgagtgcatattttcatgtgtacgtagaagcactggaggggttgaagctagatattggtgtatccagtgatttgattggatatgacactaatatggttgaccttataacaagggggagagagcatttgagaagtcaccgtttcatgttttctttaggtgaaagagcaaacattttgaagcatattgatcagcctggcttggtacctcgtatatctgaagccaattctctgaaatacccatacgaagttatttttaggagcctacaaaagcttctgatggacactgctagctctgagtatctttttgtcgaagcattctttggtgaagagtcattgttttatcgagtttttgaaggaccttttgctgtaattgatgaacatttgaatattacacttccaaactgtcatgatgcagtatgcctgatgctcatgatctgcataactaggaagcaccagttggttatgtccaacaggcagcttccttgtctagaaacatatttggataaggctctcctctatctctggccacgtttcaagacagtgtttgacatgtatcttcaaagcttgtaccgatgcgatgtgaaaatgttatctgtggatgggactcgtccacaccacattgtaaggtgctatgtggagttcacagcatccctagttcaacttaatgctgaatgtggagatggccagcttgatatgagcttggaacggttgcgcttagctgttgacgacctacttgtaagatttgctgaaaagtttgcaactcccaaactgcaacacctgtttcttttgaataattatgacatggccatctctatcctgaaggaagctggcgaagaagcaaaaaaactgcaaagatattttgaagagaagctggaatgtaacctgatatcgtttgtggatgaattgcttatggagcattttggtgacttaattaaatttgtgaagattcacatttctgaagacctaatttcttacactgagcccccaaacattgctgatgttgagccagttgtaaagaacttcgcagtgaagtggaaaaatgctctagagctcatgcacaatgaagttgtaacttgttgcagtaaccttctgtctggtatggcaattctaaaagcagcaatggctcagttgcttaatgattataacagactctcagaatgtgtgaagatgatcccaggggggtcttctttgaacaggaatctggtttctattacttccatttcatatgaaatcaggaaatattcgagaacactctagttccttgaatggtttcatagatggatgcatatcctctgcataaagggtcaaatgtttggctaatggactgtcaagatcaaagctggagagaaactgagagtttatagcttctgacgagatactgaaatcatctcgagtgcctcaagccaagctgtccaacgctggatccagcggcaaggataaaggagtgt

SEQ ID NO: 4044 - DNA, 1244 bp, Sorghum bicolor
cacggccgcgttcgtctcgacaggagccgatggccaccatcgcgccacggtcgcatctcctcctcctcggcctgacaaggccgcagcagccgacagcgcttcgtgcctgcgccgccttctcccgctcgcgcggcgcgccagtcccaccgcgggccgcgcagccgcggcgcgtcttcctcggcctcggcgccaccttcatcgaccaggtcacccgcatggcctccggcggcacctcgtcccgctctttcgttgccggagcgcggccgaggcagggggtttccccagtcgagcagattctgaagaatgtggagtggcccgacgagttccctttcaagcctgaggacttcagccgtttcgacgaatcatcagatactctgttctactcagttccacgttttgtcactcacattgatgaccaagcaatccgagctctcacagagtactactctgaagttcttcctccaattaatactcctggggcgaccattctcgacatgtgcagcagctgggtgagccattatcctcccggttacaaacaggagaagatcgtggggatgggtatgaatgaagatgaactgaaaaagaactcggtattaactgagtatgttgtgcaagacctcaatgtgaacccaaagcttcctttcgaagataacactttcgatgttatcaccaatgtggttagtgtagattacctgacaaaaccaatagatgtttttaaggagatgcgacgaatactcaagccaagcggccttgctataatgagcttttcaaatcggtgcttttggacaaaagctatatctatatggacatcaactggtgatgtcgatcatgcctggatagttggcgcttacttccattatgctggaggttttgaacctcctcaggcagttgatatatctcctaatccaggacgaactgacccaatgtatgctgtatgctcaagaaagaaaatagggtaaattaaatagtgtattttgcaagtgctatcaagaaacaaataaaggggaaaacaagaagaagcaagttgcttggcccagatcgcctggacttgatgattggtgagctgaggcaggcagcgcacgtgcatgtttccgtgagcaatgcaaccataggaaaaggaagcaacactgctgcacagactatttatagaggcggtcagattcatgttttttttttggataaacagattcatgtaggttgtagcgaccgtctttactaaagctctctagaattgatattttttt

SEQ ID NO: 4045 - DNA, 1387 bp, Zea mays
cgagatttgtctgcgcccctgcggcgcgcatggcgccacgactgaccgtggccttgggcggcgctcgggcatgagtacatggcgctcggtggcctcgcgtcgcgttactcacccaccggcaccgcgccacggccgcgttcgtctcaacaggagccgatggccactctcgcgccacggccacatatcctcctcggcttgacaaggccgcagcccatagcgcttcgtgcctgcgccgccttctcccgctcccgccacgcgccagtcccaccgcgggccgcgcagccgcggcgcgtcttcctcggccttggcgctgccttcatcgaccaggccacccgcatggcctccggcggcacctcgtcccgctctttcgttgccggagcgcggccgaggcaaggcgtttccccagtcgagcagattctcaagaatgtcgagtggccagatgagttccctttcaagcctgaggacttcagccgcttcgacgaatcatcagatactctgttctactcggttccacgttttgtcactcacattgatgaccaagcaatccaagctctcacagagtactattctgaagttcttcctccaagtaatactcctggggtggccattctggacatgtgcagcagctgggtcagccattatcctcccggttacagacaagagaagatcgtggggatgggtatgaatgaagatgaactgaaaaagaactcggtactgactcagtatgtcgtgcaagacctcaatgtgaacccaaagcttcctttcgaagataacacttttgatgttatcaccaatgtggttagtgtagattaccttacaaagccaatagatgtttttaaggagatgcgacgaatactcaagccaagcggccttgccataatgagcttttcaaaccggtgcttttggacaaaagctatatctatatggacctcaactggtgatgctgatcatgcatggatagttggtgcttacttccattatgttggaggttttgaacctccccaggcacttgatatatctcctaatccaggacgaactgacccaatgtatgttgtatgctcgagaaagaaaatagggtaactaaacaatatatttggcaagtgctatcaagaaacaaatagaaggaaaaatacaagaagcaagttgtttggccctgatcgcaggacctattggtgagctgatgtttccgtgagtaatgtaacgacagaaaaaagaagcaactactacataaactatttatagaagcggcagattcacttcataggttgtagcaactgtctttactaaaagtgtgtttggtttgaggaatgaagtgatccatcttcttctcactcctcacttttttatttggtttgtgtaatagaatgagttgatccatcaccactcc

SEQ ID NO: 4046 - DNA, 2003 bp, Panicum virgatum
ttttcacttaaggaggatagcttactcttttcgttggatgtgtccagacctggatgattcatgattatactgtccgaactgactgcaatccgaatacttcgcaaaaaaaaaaagagactgcaatccgaatgttgatggttatgcaagtttgtgctaggtagcactagcagactccacagccccagccaaatttctgaatatataatttaatcatgctttaaaaagagtgacaccatctaagctaaacggagtttacgcagaagattaggagaagcaggaagaacattggcagacgttttggtattcgaaattcatcttacggacctgacggaagtactaccagcggaggacgctttctcgtgccctcactgaaaccgtggacccgcatgacagcgagcgatggacaaggaacgaccaacccgaccccaatccggcaaatcatccgagaatagatgtgcctgcgtgcgctcctgcgccgcgcgcgccgccacgacgccccgtggccaggggcgcaccgcgctcggacatgacgctctcgacggcgtcacggcctcgcgtcgcgcaacgctggcgcacctacccaccgcgccacggccgccgttcgtctcgacaggagtccatccatggccaccctcgcgccacggccccgtcttctcctcgccctgagaaggccgcagcctagaaggctcagcgcccgcgccgccgccccctgcgctcgccgcgcccccgtgtcaccgcaggccgcgcggccgcggcgcgtcttcctcggccttggggccaccgtcatcgatcaggtcgcccgcatggcctccggcggcacctcgtcccgctctttcgttgccggagcgcggccgaggcaaggggtttccccagtcgagcagattctgaataatgtggagtggcccgatgagttccctttcaagcctgaggacttcagccgcttcgacgaatcatcagatactctgttctattctgttccccgttttgtcactcacattgatgacgaagcaatccgagctctcacagagtactactctgaagttcttcctccaagtaatactcctggggtgtccattctggacatgtgcagcagctgggtgagccattatcctcccggttacagacaggagaagattgtggggatgggtatgaatgaagatgaactgaaaaggaactcggtattgaccgagtatgttgtgcaagacctcaatgtgaacccaaagcttccttttgaagataacactttcgatgtcatcaccaatgtggttagtgtagactacttgacaaaacccatagatgttttcaaggagatgcggcgaatactcaagccagccggccttgccataatgagcttttcaaatcggtgcttttggacaaaagctatatctatatggacatcaactggtgatgctgatcatgcttggatagtgggtgcttacttccattatgctggaggctttgaacctcctaaggcagttgatatatctccaaatccaggacgaactgacccaatgtacgttgtatactccagaaagaaaacagcgtaaaccaaataatgtactttgcaaggtgacaggtacccaatgcaaacttaaaaggcatcatgacattaggactctgtcaatgacacgttattggaagttagggatctgccggagaaactctaacgcaccgactagaaacaacacggtgtgtaatctgtacgatgtctgccatgggagtcccatacggaaagaatatactaatccaagtacggggccgaatcagagatatatactaagattgtgtttagatccgtaaaatagtggtaaaaagggttacatcagacactgtagcacactatagcacttttcatttgtttgtgataattgttgtcctaccatgacctaactaggctcaaaagattcgtcacgtcgtgtacatcaaaactatgcaattagtttttttatttatctacatttagtgctccacatgaggtaaaagatttgatgtgataggtgaat

SEQ ID NO: 4047 - DNA, 1455 bp, Setaria italica
cgcgtggcgccacgacgccccgaggccttggcgcgcggacatgacgctcggcggcctcgcgtcgcgttactcaacgcactacggccgccgttcgtctcggcaggagtccatggccaccctcgcgccacggccccgccttctcctcgcgctgagaaggccgcagcctagaaggctccgcgcctgcgccgccgccccctgcgctcgccgcgctcccgtgccaccgcaggcggcgcggccgcggcgcgtcttcctcggcctcggcgccaccgtcatcgaccaggtcgcccgcatggcctccggcggcacctcgtcccgttccttcgttgcaggagcgcggccgaggcaaggggtttccccagtcgagcagattttgaagaatgtggagtggcccgatgagtttccttttaagcctgaggacttcagccgcttcgacgaatcatcagatactttgttctactcggttccccgttttgtcactcacattgacgaccaagcaatccgggctctcacagagtactactctgaagttcttcctccaagtaatacccctggggtggccattctggacatgtgcagcagctgggtgagccactatcctcccgggtacaaacaggagaagattgtggggatgggtctgaatgaagatgaactcaaaaggaactcggtattgaccgagtatgtcgtgcaagacctcaatgtgaacccaaagcttccttttgaagataacactttcgatgttatcaccaatgtggttagtgtagactacttgacaaaacccatagatgtttttaaggagatgcagcgaatactgaagccagccggccttgccataatgagcttttcaaatcggtgcttttggacaaaagctatatctatatggacatcaactggtgatgctgatcatgcttggatagtcggtgcttactttcattatgctggagattttgagcctccacaggcagttgatatatctcctagtccaggacgaactgatccaatgtatgttgtatactccaggaaaagaatagcctagaccgtatactgtattttgcaaggtctttccctccttcctagttcctctaccctccctgctgattatggcagctgtattcgagtcaagccatgtgtcatggttcaatttttatgtggcattctatgttccagttagtcgtccttttattttaaaacttgttatccattttagggcgtgatgtgggactgtgggagctcatgaaagtaagtgtgacccgcgcgcatgtgtggaagcgtttctaaactgtgttttggaaaaatgtttttgcataacatcttttgttgttggcatagtgacaattggatgagacaataatttcaaatataggaaaacatcattgtgttagatttgaaattcttgtccacgcatgttttaaattaaagggacagaaggaaaatgtcaatgtaaaaagtgaagaaaag

SEQ ID NO: 4048 - DNA, 1705 bp, Setaria italica
tggaattcgaaattcatctcacggaagtaccaggaagctttctcgcaccgtcactgaaatcgtggacccgcatgacagcgaaatacggagccgatggacaacgaaacgaccaatctagaaatccgagatgtgtctgcgctcctgcagtcctgcgacgcgcgtggcgccacgacgccccgaggccttggcgcgcggacatgacgctcggcggcctcgcgtcgcgttactcaacgcactacggccgccgttcgtctcggcaggagtccatggccaccctcgcgccacggccccgccttctcctcgcgctgagaaggccgcagcctagaaggctccgcgcctgcgccgccgccccctgcgctcgccgcgctcccgtgccaccgcaggcggcgcggccgcggcgcgtcttcctcggcctcggcgccaccgtcatcgaccaggtcgcccgcatggcctccggcggcacctcgtcccgttccttcgttgcaggagcgcggccgaggcaaggggtttccccagtcgagcagattttgaagaatgtggagtggcccgatgagtttccttttaagcctgaggacttcagccgcttcgacgaatcatcagatactttgttctactcggttccccgttttgtcactcacattgacgaccaagcaatccgggctctcacagagtactactctgaagttcttcctccaagtaatacccctggggtggccattctggacatgtgcagcagctgggtgagccactatcctcccgggtacaaacaggagaagattgtggggatgggtctgaatgaagatgaactcaaaaggaactcggtattgaccgagtatgtcgtgcaagacctcaatgtgaacccaaagcttccttttgaagataacactttcgatgttatcaccaatgtggttagtgtagactacttgacaaaacccatagatgtttttaaggagatgcagcgaatactgaagccagccggccttgccataatgagcttttcaaatcggtgcttttggacaaaagctatatctatatggacatcaactggtgatgctgatcatgcttggatagtcggtgcttactttcattatgctggagattttgagcctccacaggcagttgatatatctcctagtccaggacgaactgatccaatgtatgttgtatactccaggaaaagaatagcctagaccgtatactgtattttgcaagggcgtgatgtgggactgcatcaacattgacaaagactatccgatctcaagctccatccagctagtcggcgtcgagggcctggagccttcgctggcaccaggagcggtttccccggcaattgatctgctcgtgcgcgtcgacaacgggcatatctacgacgagtaccgcgagggcggcggcatcacggtcttttacgcgggcgtccctctagcgcacggccgcactcccaatttccgcgtgggcgcaaaggccacgctaaccttcaccgtgaacgcgacggccgagtcggtgggcgtgcccgaagatctgtttcggctcatgtcggcggagcggaggtggagcgcggcgcagctggaagttcacatgcagctgggttgccccggctgggagtcatacgcttggagcgttgatttggatgggtagtaagctcgtttaggtttggaattgtatagacactgttacacttattattgagataaattaagaactatcc

SEQ ID NO: 4049 - DNA, 3442 bp, Zea mays
aaacgctcgacctgccaagccggactgaaccctaggccccgatccggcgtctcgccgtgctgcttggatttgatcgggcggggttggggtcgtatcggcggcgggatgaccatcccgagcgcggaggggttcctccaggcgtcgagctgcctcccgtgcacggcgacggaggagcgggaggtcgttgacgcgcttaccaaggaggccgagaagaatgtcaagcacggcgatctccgctatctcgtctcgcagagctggtggatggagtggcaaggatatgtgggtctagtcaattatggagaaagtggcaccgagcagtttcctcaggccacaaatagacctggagagattgataactcgaagcttgttttggcagaaaggatcaatggtagtgaggagccagagcttcaaaggaccttgagagaaggggagcactatactttggtgccgcaagaagtttggcaaaggctatatgaatggtataaaggtggaccagaaatccctagaaaagttatttttgacaatccaactgacaagacttacgtagtggatgtctaccctctctgtctaaaactaattgatgcaagggacgactctgagaaagtttttaggataagtagaaaggccaaagttcatgagctttactcaatggtttgctcgctcatgtcagtagagcagtctgagattgtcatctgggattattatcggaggacaaagggcaaggagttgactaatcaaaatgatacactagaagaagctcaacttagtatggaccaggagatcctcttggagatgaagctaggcgggggcagttcaggtttcagtgcaagatccacaaatgatgaattggcattaattccattagaaccctcaacatcatcattttctattgctggagggcctacattttcaaatggtttttcatctgggattggttctagtttttcgcaagataatagctttagtcctttattaagggatggagaagatggttacaatagtctcagcaatggaactaaagatgacactcacggattgagtggattacataacttgggtaatacatgcttcatgaatagtgccatacaatccttggttcatacacctccattggtacagtactttttggaggactatacttgtgaaataaacaaggaaaatccactaggcctccagggggaacttgcaatagcatttggagagctacttagaaaactttggtcgtctggtcgaacttctattgctccacgggcatttaaatcgaaactttctcgatttgccccccagttcagtggatataatcagcatgattctcaggagctacttgcgtttctgttggatggtctgcatgaagatctgaaccgtgtaaaagagaaaccatatattgaggcaaaagatgcagatggccgcccagatgatgaatttgctgaagaatgctggaattaccataaagctcgaaatgactccataattgttgataagtttcaaggtcaatacaagtccacattggtgtgcccagtttgtaacaaaatctctgttacctttgatccatttatgtatttgtcgctaccattgccatcaacagttactcggatgattactgtaactgtattcagtggtacgggagatgttcttccaatgccttacactgtgactgtacagaaaaatggaaactgccgtgatcttactaaagcccttgctgatgtctgctgcttaaaaaattctgagacattgttgcttgcagaggtatacgaacgtcggatctaccgctacctaacaaatccaattgagggacttcatatcataaaagatgaagatatacttgttgcatacaggctccctgttggtcatgaaaaacttttgaggttggagattctgcattcgagggcagacagatttcttgtggagcctcagtttaatatcaataggaagctcattgggtgccccattgtgacttgtattccaaatgactctactgcaaaatctgatatttatgcggctgtatcttctgtcttggttccatttgtaagagcaaaagcacatagccctgatgtgtctgctgtcaagttaaatggcaatgggccaagtttggacggtattgtcctgaccgataatggcaccaccagtgaggagggtctctctacatcaagatcaagggaggacgataatgcagctgacaatgagcttttaccgtttcagctttcattgactgatgaaaaaggtagtacaagaaatgctatagacatggattctaatcgtgttctaggactagttattagggttttgatggattggggtgagaaagagcatgggatgtacaatattgatcacatggatgtacttcctgaagtcttcaagcctggttttatgtcaaagaagacccgtcaagaagcagtcaatttattttcatgcttggatgcttttctgaaggaggagcctctagggccagatgatatgtggtactgtcctgggtgcaaggaacacaggcaagctagcaagaaactggacttgtggaggttgcctgagatattggtagttcatttgaaaaggttctcgtacagccggtatatgaagaataagcttgatacatttgtgaactttccgatccatgacctcaatatgagcaagtatgtgaagcctacatcaagaggtgaccagcaccccgtgtatgaactctatgcagtgataaatcattatggcggtctcggtggtggacactactctgcatatgcgaagctagttgaagaggacaattggtatcattttgatgacagtcatgtttcctctgttaatgaggatgagatcaggcgatctgcagcatatgttcttttctaccgacgagttggaggttcaagtacagcggcaaacggtggtccagttgacattgaaatggttgattcgctagagacatagttccccagatcaaagcctgagtataacatgtggatcgagatatggagatcagaagagttatggaatttgcatgtctgctccggaatggaatatttgtgtatgaagcctttgacattttgaggcatggcagacaactgaggtcgaaatagcgtggtagcttggatctgcacatctatatgattgagggcctggtgtttaggattataatctgcccagattatataacctatcttattttgaactaagtgttagttcaaaataagttagattatataatatggacaaattatattcccaatcaaacaggctatgattggacttactgatacccatttgagtagaactgatcttgacaggtatccgagaaaacgatgaccttaattgaaaattttgctgatacgctgatgcagcacttagggtctactattgttattggtgtagccaagggattgcaactgggaaaaatggtgtaaaaacgctgcatatttttttttgcctaagctacagctgtgctacagcaaattttgat

SEQ ID NO: 4050 - DNA, 3581 bp, Setaria italica
atttagaacgcgcttttcatcacaactccatccaaataaattaccgtattttcttattccattttcaccttcattttctttccttggtttctccctcatcccaccttccctcgtcgtccgaattaaaacgctcgacctgccaagccggaccaaaccctaggtcccgattcggcatctcgccgtgctagctcggattcgatcgggctgggcgcggggtcggatcggcggcggcggcgggcggcgggatgacgatcccgagcgcggagggcttcctccaggcgtcgagctgcctcccgtgcactgcggaggaggagcgggagctcgtggccgcgctcaccagggaggccgaggagaatgtcagggacggggatctccgttacctcgtctcacagagctggtggatggagtggcaacgttatgtgggcttagtcagtgatgaggagaatgacaccgagcagcttcctcaggctatgaatagacccggagagattgataactcgaagcttatttcagcagaaacaatcaatggtagtgaagagccagagcttcaaagaaccttgagagaaggggaggactacactttggtgccgcaaggagtttggcggaggctatatggatggtataaaggtggaccagaaatccccagaaaagtaattttggatagtcaacctaacaaggtttacatagtggatgtctatcctctctgtctaaaactaattgatggaagagataattctgaacgaaatatcagaataagtagaaaggccaaaattaatgagctttactcaatggtttgctcaatcatgtcagtagagcagtccgagattgtcatctgggattattatcagaagttaaagagcaagaagttggctaatttcaatgagacactagatgaagctcaaattactatggaccaggagatccttttggaaatgaagctagatgagagccgtacaggttttaatacaagatccacaaataatgagttggcactaatcccattaggaccctccacatcttcattttcgattgctggggggcccacctattcaaatggtttttcatctggaattggttctagtttttcgcaagataatagcttcggtcctttactaagggactcaacagatggttacaacagtttcagcaatggaactaaagatgatactcatggattgagtgggttacataacttgggtaatacatgcttcatgaatagtgccatacaatccttggtccatacacctcccttggtagagtactttttggaggactatactcgtgaaataaatacagaaaatccactagggctccagggtgaacttgcgatagcatttggagagcttcttagaaaactttggtcatctggtcgaacttctgttcctccacgtgcatttaaatcaaaactttctcgttttgctccacagttcagtggatataatcagcatgattctcaggagctacttgggtttctgttggatggtctgcatgaagatctcaaccgtgtcaaaaagaaaccatatattgaggcgaaggatgctgatggccgtccagatgatgaatttgctgaggaatgctggaattaccataaagctcgaaatgactcaataattgtagataagtttcaaggtcaatacaagtctacgttggtgtgcccagtttgtaacaaaatctctgttacctttgacccatttatgtacttgtcactaccattgccatcaacagttactcgaatgattactgtaactgtattcagtggtactggagatgctcttccaatgcctttcactgtgacgatacagaaaaatggaaactgccgagatcttactaaagcccttactgatgcctgctgcttaaaaagttccgagacattgttacttgcagaggtgtatgatcaccgtatctatcgctacctaacaaatccaattgagggactttacactataaaagatgaagatatacttgttgcatataggctccctgttggtcatgaaaaacttttgaggttggagatcctgcaccggagggcagatagatttggtgcggacccccagtttaatatcaaccggaagctcattgggtgcccccttgtgacttgtattcctaatgactctactggaaaatctgatatatatgcggctgtctctgatgttttggttccatttgtacgagcaaaagcacatggccctgatgtgtctgcagtcaagttgagtggcaatgggccaagtctggatggtattgtactgacagataatggcaccacctgcgaggagggtctctctacatcaagtggtgatgataatgcagttgatgatgaccttttgccttttcagctttccttgactgatgaaaaaggtattgcgaggaatgctataaacacggattctaatcgtgttttaggaatagttatgagggttttaatggattggtctgatagagagcgtgagatgtacaataccgattacatggatgaacttcctgaagtcttcaagcctggttttttgtcaaagaaaacccggcaagaagcagtgaatttattttcatgcttggatgcctttctgaaggaggaacctctggggcctgatgatatgtggtactgccctggctgcaaggaacacaggcaagctagcaagaaactggacttgtggaggttgcctgagatattggtagttcacttgaaaaggttctcatacagccgctatatgaagaacaagcttgacacttttgtgaactttccaatccatgacctcaatatgagcaagtatgtgaagcatacatcaagaggtaatctgcagcccatgtatgaactctatgcagtcatcaatcattatggtggtctgggtggtggacactactctgcatacgcaaagctagtagaagaggataactggtatcattttgatgatagtcatgtctcctctgttagtgaggatgacatcaggacgtctgcagcatatgtgcttttctaccgacgtgttggaggttcaagcgcagtggcaaacagcgttccagttgacattgagatggttgattcgctggagacatagcttcccaaatcaaagcaaatgtcagtgtaatattgtggatggagatatgtagctcagaatattgctcaaatttgcatgtctgcactggggagtattgctatatggttcagtcaagctgttgacagatattttgagggcgcagcagagatcaatttagcatagtggcatggatctgtagccctctatctgaccaattagggttcctgatatctttgttgatatctgtctgttacccgacccttttgagtagaacagatcctggcaggtaaattgataactacgttgacggcaacaggtttgcctattcgatattttttgctgatatgcagatgtagctcttgggtctactattattattggtgtaatgtagccaagggattgcaactgggaagaaagaaggatgtaaaaacgctgcatattctttttgccttgctaagctatggccaagttttgattccgattgcctttgttatagacactacgatcctcagcacctgctaagtgtgattttgcgagcaatcatttctgggtaat

SEQ ID NO: 4051 - DNA, 3881 bp, Setaria italica
caactccatccaaataaattaccgtattttcttattccattttcaccttcattttctttccttggtttctccctcatcccaccttccctcgtcgtccgaattaaaacgctcgacctgccaagccggaccaaaccctaggtcccgattcggcatctcgccgtgctagctcggattcgatcgggctgggcgcggggtcggatcggcggcggcggcgggcggcgggatgacgatcccgagcgcggagggcttcctccaggcgtcgagctgcctcccgtgcactgcggaggaggagcgggagctcgtggccgcgctcaccagggaggccgaggagaatgtcagggacggggatctccgttacctcgtctcacagagctggtggatggagtggcaacgttatgtgggcttagtcagtgatgaggagaatgacaccgagcagcttcctcaggctatgaatagacccggagagattgataactcgaagcttatttcagcagaaacaatcaatggtagtgaagagccagagcttcaaagaaccttgagagaaggggaggactacactttggtgccgcaaggagtttggcggaggctatatggatggtataaaggtggaccagaaatccccagaaaagtaattttggatagtcaacctaacaaggtttacatagtggatgtctatcctctctgtctaaaactaattgatggaagagataattctgaacgaaatatcagaataagtagaaaggccaaaattaatgagctttactcaatggtttgctcaatcatgtcagtagagcagtccgagattgtcatctgggattattatcagaagttaaagagcaagaagttggctaatttcaatgagacactagatgaagctcaaattactatggaccaggagatccttttggaaatgaagctagatgagagccgtacaggttttaatacaagatccacaaataatgagttggcactaatcccattaggaccctccacatcttcattttcgattgctggggggcccacctattcaaatggtttttcatctggaattggttctagtttttcgcaagataatagcttcggtcctttactaagggactcaacagatggttacaacagtttcagcaatggaactaaagatgatactcatggattgagtgggttacataacttgggtaatacatgcttcatgaatagtgccatacaatccttggtccatacacctcccttggtagagtactttttggaggactatactcgtgaaataaatacagaaaatccactagggctccagggtgaacttgcgatagcatttggagagcttcttagaaaactttggtcatctggtcgaacttctgttcctccacgtgcatttaaatcaaaactttctcgttttgctccacagttcagtggatataatcagcatgattctcaggagctacttgggtttctgttggatggtctgcatgaagatctcaaccgtgtcaaaaagaaaccatatattgaggcgaaggatgctgatggccgtccagatgatgaatttgctgaggaatgctggaattaccataaagctcgaaatgactcaataattgtagataagtttcaaggtcaatacaagtctacgttggtgtgcccagtttgtaacaaaatctctgttacctttgacccatttatgtacttgtcactaccattgccatcaacagttactcgaatgattactgtaactgtattcagtggtactggagatgctcttccaatgcctttcactgtgacgatacagaaaaatggaaactgccgagatcttactaaagcccttactgatgcctgctgcttaaaaagttccgagacattgttacttgcagaggtgtatgatcaccgtatctatcgctacctaacaaatccaattgagggactttacactataaaagatgaagatatacttgttgcatataggctccctgttggtcatgaaaaacttttgaggttggagatcctgcaccggagggcagatagatttggtgcggacccccagtttaatatcaaccggaagctcattgggtgcccccttgtgacttgtattcctaatgactctactggaaaatctgatatatatgcggctgtctctgatgttttggttccatttgtacgagcaaaagcacatggccctgatgtgtctgcagtcaagttgagtggcaatgggccaagtctggatggtattgtactgacagataatggcaccacctgcgaggagggtctctctacatcaagtggtgatgataatgcagttgatgatgaccttttgccttttcagctttccttgactgatgaaaaaggtattgcgaggaatgctataaacacggattctaatcgtgttttaggaatagttatgagggttttaatggattggtctgatagagagcgtgagatgtacaataccgattacatggatgaacttcctgaagtcttcaagcctggttttttgtcaaagaaaacccggcaagaagcagtgaatttattttcatgcttggatgcctttctgaaggaggaacctctggggcctgatgatatgtggtactgccctggctgcaaggaacacaggcaagctagcaagaaactggacttgtggaggttgcctgagatattggtagttcacttgaaaaggttctcatacagccgctatatgaagaacaagcttgacacttttgtgaactttccaatccatgacctcaatatgagcaagtatgtgaagcatacatcaagaggtaatctgcagcccatgtatgaactctatgcagtcatcaatcattatggtggtctgggtggtggacactactctgcatacgcaaagctagtagaagaggataactggtatcattttgatgatagtcatgtctcctctgttagtgaggatgacatcaggacgtctgcagcatatgtgcttttctaccaacgtgttggaggttcaagcgcagtggcaaacagcgttccagttgacattgagatggttgattcgctggagacatagcttcccaaatcaaagcaaatgtcagtgtaatattgtggatggagatatgtagctcagaatattgctcaaatttgcatgtctgcactggggagtattgctatatggttcagtcaagctgttgacagatattttgagggcgcagcagagatcaatttagcatagtggcatggatctgtagccctctatctgaccaattagggttcctgatatctttgttgatatctgtctgttacccgacccttttgagtagaacagatcctggcaggtaaattgataactacgttgacggcaacaggtttgcctattcgatattttttgctgatatgcagatgtagctcttgggtctactattattattggtgtaatgtagccaagggattgcaactgggaagaaagaaggatgtaaaaacgctgcatattctttttgccttgctaagctatggccaagttttgattccgattgcctttgttatagacactacgatcctcagcacctgctaagtgtgattttgcgagcaatcatttctgggtaatgtgcactcagcttccaagatgatctcatgcttagagacattgattcatccaaatataatactccctccgttctgataattgttttgatttttctaagttcatagatattattatatatctagatatacactttctaagttcatagatattattatatatctagatatacactatctagattaaaataaagttacaatttgggagggagtagatgccaaccgaataaatagtatatctggttctgtgtggccaattttaatttgggctgaagtttgcaagtccatggtgatatatatctgcatctgctttgtctccattgtta

SEQ ID NO: 4052 - DNA, 3220 bp, Echinochloa colona
ggctgggcgcgggttcggatcggcggcgggatgacgatcccgagcgcggagggcttcctccaggcgtcgagctgcctcccgtgcacggcggaggaggagcgggatatcgtggccgcgctcaccagggaggccgaggagaatgtcaaggacggggatcttcgctacctcgtctcgcagagctggtggacggagtggcaacgttacgtgggcttagtcagttatgacgaaaatgacactgagcagcttcctcaggctacgaatagacctggggagattgataactcgaagcttgttcggcagagacaatcaatggtaatgaagagtgggagcttctaaggaccttgagagaagggcacgactacactttggttccacaagaagtttggaggaggctatacgaatggtataaaggtggaccagaaatccccagaaagtaatatttgatggtccaactaacaaggcttacacagtggacgtctatcctctccgtctaaaattaattgatggaagagacagttctgaacggattatcagaataagtagaaaggccaaaattcatgatctttactcaatggtttgctcacttatgtcagtagagcaatctgagtctgtcatctgggattattaccaaaagtcaaagagcaagaagttgactaatctcaatgagacactagatgaagctcaaattaacatggaccaggagatcctcttggagatgaagctagatgagagcagttcaagtttaagtacaagatccacaaataatgagttggcactaattccattaggaccctccacgtcatcaatttcgattgctggagggcccaccttttcaaacgggttttcatctggaattggttctattttttcgcaagataataggttcagtcctttactaagggactcagcagatggttacagcagtttcagcaatggcactaaagatgacactcatggattgagtgggttgcataatttgggtaatacatgcttcatgaatagtgccatacaatccttggttcatacacctcccttggtagagtactttttggaggactatactcgtgaaataaacaaagaaaatccactaggactccagggtgaacttgcagtagcatttggagagctacttagaaaactttggtcatctggtcgaacttctgttgctccacgtgcatttaaatccaaactttctcgtttcgctccacagttcagtggatataatcagcatgattctcaggagctacttgcttttctgttggatggtctgcatgaagatctcaaccgtgtcaaaaagaaaccatatattgaggcaaaggatgctgatggccgtccagatgatgaatttgctgatgaatgctggaattaccataaagctcgaaatgactcaataattgttgataagtttcaaggtcaatataagtccacattggtgtgcccagattgcaacaaaatctctgttacctttgacccgtttatgtatttgtcactgccattgccatcaacggttactcgaatgattactgtaactgtattcagtggtactggagatgctcttccaatgcctttcactgtgacagtgcagaaaaatggaaactgccaagatcttattaaagcgcttagtgatgtttgctgcttaaaaagttctgagacattgttacttgcagaggtatacgagcgtcgaatctatcgctacctaacaaatccaattgagggactttacactataaaagacgaagatatacttgttgcgtatagactccctgttggtcatgaaaaacttttgaggttggagatccttcaacggaggtcagacagatttgctgtggagccccagtttaatgtcaatcggaagctcattgggagcccccttgtgacttgtattcctaatgactctaccggaagatctgatatttatgcggctgtctctgctattctggttccatttgtacgagcaaaggcacatggctctgatgtgtctgcagtcaagttgaatggcaatggaccaagtctagatggtattgtattaacggataatggcaccacctgtgaagagggtctctctacgtcaagtgtggatgataatgcagttgatgatgagcttttaccttttcagctttccttgactgatgaaaaaggtattgcaagaagtgctataaacacggattctaatcgttctttaggagccatgagggttttgatggagtggtctgatagagagcatgagatgtacaatatcgactacatggatgaacttcctgaagtcttcaagcatggttttttgtcaaagaagacccggcaagaagcagtgaatttattttcatgcatggatgcctttctgaaggaggaacctttggggcctgatgatatgtggtactgccctggctgcaaggaacacaggcaagctagcaaaaaactggatttgtggaggttacctgagatattagtagttcacttgaaaaggttctcatacagccgatatatgaagaacaaacttgatacttttgtcaactttccaatccatgaccttgatatgagcaagtatgtgaagcagacgtcaagaggtgatcagaaccctatgtatgaactctatgcggtgatcaatcattatggtggtctaggtggtggacattactctgcatacgccaagctagtagaagaggataactggtatcattttgatgatagtcatgtctcctctgttaatgagaatgagatcaggacgtctgcagcatatgtgcttttctaccgacgcgttggaggttcaagtacagtggcaaacggtgcttcagtcgacattgaaatggttgattcgctggagtcatagctcccaaaatcaaagcaaatgtcagtgttattttgtggacagggatatggagctaggaatattgcttgaatgaaaggtcaaggacagagtatggttcaatgagccgttgacaggacattttgagggcgtacgagagaagagatctatctagcacggtagcatggatctgcagcacgtctatacagccgattagggttcctaatatcttgtctgttacccagcccttttgaatagaattgatcctggcaggtaaattgagaaaacaatgacaggcaacaggtttgccaatttgattttttgctgatatgcagatgtagctcttggggtctactattattattgctgtaatgtagccaagggattgcaactgggaagagaatgtaaaaatgctgc

SEQ ID NO: 4053 - DNA, 971 bp, Saccharum officinarum
tgtccctgcggtgccggtcgcggaagttttgggtcgacgcacgcgtccgctggaccgcgcgcctgtctgcactcttcttcctagcagaagagatacaaagattgtccaagatggcggaggagaaggcggcggccgtgggcggactcggaggagccggggcggcggacgcggcgccggcggtggaggccgcggcggcacgcgtgcggcccgttgagacgcttctgcgcgcggcgccgctggggctgtgcgtggccgccatgaccgtcatgctccgtgaccagcagagcaacgagtacggcaccgtcgcctactccgacctggggggcttcaagtacctcgtctacgccaacggcatctgcgccgcctactcgctggtgtccgcgttctacacggccgtgccgaggcccgccaccgtgtcgcgctcctgggtcgtcttcctcctcgaccaggtgttcacgtacctgatcctggcggcaggtgcggcggcggcggagctgctgtacctcgcctacaacggcgacaaggaggtgacgtggagcgaggcgtgcggcgttttcggcagcttctgccatcaggcgcgcacctccgtcgccatcaccttcggcaccgtactctgtttcatcctcctctccctcatctcctcgtaccgcgtcttcagcgcctacgaggcgcctccgtcgtcggcgctcggcagcaagggcgtcgagatcgccgcatacccacgctgaagtcgccggccatccatccatggagactctagggagacgtggttgcaaatctctattatgtgtaggcgatcaagtaataagggcttatatattatatatatacacttcgttcatagtagttgtttgctgctacatatgcttagtacagtgctgctgctgctaaattgtgctggactgggtaattaattatatagtttgccacgttcttgtgtgctgatggattgatcctaaaattcttactac

SEQ ID NO: 4054 - DNA, 1375 bp, Setaria italica
ttcctagagagagagagagagagagagagagagttgagctgcgtgccctgccgcgactcttcacgttgcttcttgagagagaggaagagagagagaggggcggagatgtccaagatggcggaggagaaggcggtgggcggagcggccggggcggcggacgcggcgcagcagcagcagctggcggcgggcgaggcagcggcggcgcgggtgcggcccgtggagacgctgctgcgcgcggcgccgctggggctgtgcgtggccgccatggccatcatgctcaaggaccagcagaccaacgagtacggcaccgtcgcctactccgacctcggcggcttcaagtacctcgtctacgccaacggcctctgcgcggcctactccctcgtcacggccttctacaccgccgtgcccaggccagccaccgtgtcacgctcctgggtcgtcttcctcctcgaccaggtgttcacgtacctgatcctggccgccggcgcggcggcagcggagctcctgtacctggcctacaacggcgacaaggaggtgacgtggagcgaggcgtgcggcgtgtttggcgtcttctgccgcaaggctcggacctcggtggccatcaccttcggctccgtgctctgcttcatcctcctctccctcatctcctcttaccgcctcttcagcgcctacgaggcgcccccgtcgtcggcactcggcaacaagggcgtcgagatcgctgcctacccgcgctgaagccgccgccagcgaccagaggctgccttccatccagcgtggtggcataatctctattatgtgtaggtgatcaagtaataagtaagggcgtattatatatataaattcatagtagtttgctgctacatatgatgattagtacagtgctgctgcttctggtaaattgtgcttgactcggtaattatatactagtttgcatggttcttgtgtgtagtgggtgaattgatccttcaactcttgaaaggcacatctttgagactgtaaacatctgtagcaaacaaatcgtttggagacatcagtaagccattgcgatgaaccgttgtatttagaaaaacaattccccttcacgaatcccatgtttttcagctccactccaccaaatctagaaaaacaagtctagaaaaaaatatctccaccaaatctagaaaaaaagtctagaaaaaaatatagagtggttgtacgtgtttagctgattgaaatatagatagagtggttgtacgtgtttagctgattgaaatatagagtggttgtacgtgtttagctgaaaaatatagagtggttatacgtgtttagctgattgaaatatggaatgattgtatgtgtttaactgattgcagtgctccagcgctaaaaacacgag

SEQ ID NO: 4055 - DNA, 1302 bp, Setaria italica
cccacgcctccgcccttaaatgcgctctcttccctcccttccggctagcactactactacttcctagagagagagagagagagagagagagagttgagctgcgtgccctgccgcgactcttcacgttgcttcttgagagagaggaagagagagagaggggcggagatgtccaagatggcggaggagaaggcggtgggcggagcggccggggcggcggacgcggcgcagcagcagcagctggcggcgggcgaggcagcggcggcgcgggtgcggcccgtggagacgctgctgcgcgcggcgccgctggggctgtgcgtggccgccatggccatcatgctcaaggaccagcagaccaacgagtacggcaccgtcgcctactccgacctcggcggcttcaagtacctcgtctacgccaacggcctctgcgcggcctactccctcgtcacggccttctacaccgccgtgcccaggccagccaccgtgtcacgctcctgggtcgtcttcctcctcgaccaggtgttcacgtacctgatcctggccgccggcgcggcggcagcggagctcctgtacctggcctacaacggcgacaaggaggtgacgtggagcgaggcgtgcggcgtgtttggcgtcttctgccgcaaggctcggacctcggtggccatcaccttcggctccgtgctctgcttcatcctcctctccctcatctcctcttaccgcctcttcagcgcctacgaggcgcccccgtcgtcggcactcggcaacaagggcgtcgagatcgctgcctacccgcgctgaagccgccgccagcgaccagaggctgccttccatccagcgtggtggcataatctctattatgtgtaggtgatcaagtaataagtaagggcgtattatatatataaattcatagtagtttgctgctacatatgatgattagtacagtgctgctgcttctggtaaattgtgcttgactcggtaattatatactagtttgcatggttcttgtgtgtagtgggtgaattgatccttcaactcttgaaaggcacatctttgagactgtaaacatctgtagcaaacaaatcgtttggagacatcagtaagccattgcgatgaaccgttgtatttagaaaaacaattccccttcacgaatcccatgtttttcagctccactccaccaaatctagaaaaacaagtctagaaaaaaatatctccaccaaatctagaaaaaaagtctagaaaaaaatatagagtggttgtacgtgtttagctgattgaaatatagatagagtggttgtacgtgtttag

SEQ ID NO: 4056 - DNA, 925 bp, Panicum virgatum
ctccaactaccctcccccactcacccacgccacggtccttaaatgtgctctcccccttgcctcctgtttcttcctagagagagagagtgagttgagctgcgtgcctcgccgggactcttcgcgttgcctctttggagagagaagagagagcggggaagtcgggcggagatgtccaagatggcggaggagaaggcggtcggaggggccggtgcggcggacgcggcgcagcagcagcagcagctggctgcgggcgaggcggcggcggcgcgggtccggcccgtggagacgctgctgcgggcggcgccgctggggctgtgcgtcgccgccatggccgtcatgctcaaggaccagcagaccaacgagtacggtaccgtcgcctactccgacctcggcggcttcaagtacctcgtctacgccaacggcctctgcgccgcctactcgcttgtcacggccttctacaccgccgtgccaaggcccgccaccgtgtcgcgctcatgggtcgtcttcctcctcgaccaggtgttcacgtacctgatcctagcggcgggcgcggcggcggcggagctactgtacctagcctacaacggcgacaaggaggtgacatggagtgaggcgtgcggcgtgttcggcagcttctgccgccaggcccggacctcggtgggcatcacctttggctccgtggtctgtttcatcctcctctcagtcatctcctcctaccgcctcttcagcacctacgaggcgcccccgtcatcggcgctcggcaacaagggtgtcgagatcgccgcctacccgcgctgaagccgctgcgggcgtacaagaggctgccgtccatggtccatccactggaggctccaaagggaggcggggttgcatcatctctctgtaatgtgtaggcgatcaagtaataagcaaggacttattatat

SEQ ID NO: 4057 - DNA, 914 bp, Pennisetum glaucum
cgggactcttcactcttggcgttgcttattgagagagagagagagaggcggagatgtccaagatggcggaggagaaggcgttgggcggagcggcggcggcggtggacgcggcgcagcagcagcagcagcagctggcggcgggcgaggcggcggcggcgcgggtgcggcccatggagacgctgctgcgcgcggcgccgctggggctgtgcgtggccgctatggccatcatgctcaaggaccagcagaccaacgagtacggcaccgtcgcttactccgacctcggcggcttcaagtacctcgtctacgccaacggcctctgcgccgcctactcgctcgtcacggccttctacaccgccgtgcccaggcccgccaccgtgtcacgctcctgggtcgtcttcctcctcgaccaggtgttcacgtacctgatcctggcagccggcgcggcggcagcagagcttctgtacctggcctacaacggcgacaaggaggtgacatggagcgaggcgtgtggagtgtttggtggcttctgccgccaggctcggacctcggtggtcatcaccttcgtctccgtgctctgctttatccttctctccctcatctcctcctaccgtctctttagcgcctacgaggcgcctccgtcgtcggcgctcggcaacaagggtgtcgagattgctgcctacccacgctgaagctgcctccagtgaccggagggcggagggtgccatgcatccagcgtggtggcattaatctctactatgtctaattgtgatcaagtcataagggcatattatatataaaaactcatagtagtttgctgctacatatgattactggagtgctgctgttgtgctaaattgtacttgacttggtaattatataatactagtttgcatgtttcttgtgtgtagtgggtg

SEQ ID NO: 4058 - DNA, 1055 bp, Cenchrus ciliaris
gagagagagagacttgagctgcgtgccctgcccggactcttccttcgcgttgcttcttggccggagagaaagagagaggagagcggatcggagatgtccaagatggcggaggagaaggcggtgggcggagcggccgtggcggcggacgcagcgcagcagcagcagcagctggcggcgggcgaggcggcggcggcgcgggtgcggcccgtggagacgctgctgcgcgccgcgccgctgggcctgtgcgtggccgctatggtcatcatgctcaaggaccagcagaccaacgagtacggcaccgtcgcctactccgacctcggcggcttcaagtacctcgtctacgccaacggcctctgcgccgcctactcgctcgtcaccgccttctacaccgccgtgcccaggcccgccaccctgtcacgctcctgggtcgtcttcctcctcgaccaggtgttcacgtacctgatcctggctgccggcgcggcggcagcggagcttctgtacctggcctacaacggcgacaaggaggtgacatggagcgaggcgtgcggcgtgtttggtggcttctgccgccaggctcggacctcggtgaccatcaccttcgcttccgtgctctgctttatcctcctctccctcgtctcctcctaccgactgtttagcgcctacgaggcgcccccgtcgtcggcgctcggcaacaagggcgtcgagatcgctgcctacccgcgctgaagctgccgccagcgagcggagggtgccgtgcctccagcgtggtggcataatctctattatgtgtaattgtgatcaagtcataaaggcgtatcatatatataaactctagtagtttgctgctacatatgattagtgaaatgctgctgttgtacttgacttggtaattatatactctactagtttgcatgtttcttgtgtgtagtgggcgaattgatccttcaactcttgaatatgtctttgaggctctggatgtacgcccattagcaaacaaatcatttggaaatatctgtaacgtttggatgtagatatatgaaccttcaaatttaggg

SEQ ID NO: 4059 - DNA, 1075 bp, Zea mays
accactccctctttttgtttaaaatgcaatattcccctcccattctgctagttcccatctcagactcagggagagacgagagaagtggacacctcgcctgcctggactcgtctactctagtatacagaaaaaagcagaagagatacggggatgtctaagacggcgggcgtcggcagactcggaggagccggggcggcggacgcggcgcagcagcagcagctggcggcgggtgatgctgcggtggcgcgggcggcgcggcccatcgagacgctgctgcgcgcggcgccgctggtgctgtgcgtggccgccatgaccctcatgctccgtgaccagcagagcaatgagtacggcaccgtcgcctactccgacctggggggcttcaaatacctcgtctacgccaacggcctgtgcgccgcctactcgctggcgtccgcgttctacacggccgtgccgaggcccgccaccgtgtcgcgctcctgggtcgtcttcctcctcgaccaggtgttcacgtacctgatcctggcggcaggtgctgcggcggcggagctgctgtacctcgcctacaacggcgacaaggaggtgacgtggagcgaggcgtgtggtgttttcggcagcttctgccgccaggcgcgcacatccgtggccatcaccttcggcgccgtgctctgtttcatcctcctctccctcctctcctcctaccgcctcttcagcgcctacgaggcgcccccgccgtcggcgctcggcagcaagggcgtcgagatcgccgcgtacccacgctgaagccgccggccattcatcggaggctctggagggcgatcaagtaacgaagggagtaacgaaggctgaattgtgcttgactgcatcgttcttgcgtgtactgggtggattgaccttgaacttcttactacagccgtaaattctgtgtatgtttcgttatggcaacatctttctgtggaaagaatgtttgtaacaagcagacgagaagttgtgtgggtaggaaattgtagcaaaattgtttgccagcatcagcttcgacttctatcgttgggccttcaatttgaaggtgccaggactt

SEQ ID NO: 4060 - DNA, 661 bp, Echinochloa colona
gctcagcagcagcagctggcggcgggcgaggccgcggcggcgcgggtgcggcccgtggagacgctgctgcgcgcggcgccgctgggcctgtgtgtggccgccatgaccgtcatgctcaaggaccagcagagcaacgagtacggcaccgtcgcctactccgacctcggcggcttcaagtacctcgtctacgccaacggcctctgcgccgcctactcgctgctgtccgccttctacaccgccgtgcccaggcccgccaccgtctcgcgctcgtggatcgtcttcctcctcgaccaggtgttcacgtacctgatcctggcggccggcgctgcagcggcagagcttctgtaccttgcctacaacggcgacaaggaggtgacatggagtgaggcgtgtggcgtgttcggcagcttctgccgccaggcccggacctcggtggccatcaccttcgcctccgtgctctgcttcatcctcctctccctcatctcctcctaccgcctcttcagcgcctacgagacacccccatcgtcggcgctcggcaacaagggcgtcgagatcgccgcctacccgcgctgagatcgccgccatccagtggaagcggggctgcatccaaaaaagatctctcttgtgtgtgtaggcgatcaagtaataagtaagggattac

SEQ ID NO: 4061 - DNA, 1136 bp, Secale cereale
agcaagcaagcagcagaggagagggaccgggaccgggagtgagaggaagttgagctattttcttcgtcgacgctggtttttggccccagaccgctggtcgagatgtcgaagatggcggacgagaaggtgatttcggcgccggcgaccggcggaggggaggacgggctgatcgcaggcgacctgtcagccgcggaggcgcgggtccgtccgttggagacgctgctgcgcgccgcgcctctggggctatgcgtcgccgccatggccgtcatgctccgcgacacgcagaccaacgagtacggcaccgtctcttactccgacctcggcggattcaagtacctggtttatgccaacgggctgtgcgcggcctactccctggtctccgcgttctacactgccgtgccgcgaccggcgacgctgtcccgctcctggatcgtcttcctcctagaccaggtgttcacgtacctgatcctggcggccggtgcggcgtcggcagagctgctctacctggcgtacaacggcgacaaggaggtgacgtggagcgaggcgtgcggcgtgttcggcggcttctgcaggcaggcccggacgtcggtagccatcaccttcggctccgtcgtctgctacatcctcctctccctcatctcgtcctaccgcctcttcagcgcctacgatgcacccatgccctcgctcggcaacaagggcgtcgagatcgctgccttcccgcgctgagccgagaggatccctagctgctgcggcttgcctactcgatggtgggtcaaaactcaaaacacgtacgtacgtagtagtattgctgtgtgtgtaggcgaacgaaataatctgtaagggctcatagttaatttcaagctacatatagtgcatccgcctctcttctttttacttgattctatatacactgtactagctttcaatcttctgctgtaaggctatggtggattcatttattcgttccaaaaatgtgaacttaattccgttgcagggcaccaaggtgatctatgtaactacaatgagcttcctcatttaaggagttcatttgaggagttcagttgcttgtaaggtgcttgaagcaaagcaaaaaaatactctttcctttcacaaatataagatacagtataagatat

SEQ ID NO: 4062 - DNA, 1221 bp, Triticum aestivum
ctgccaccgcgccattaactgcgcgcattcaagccaccccgctgcgctccaactaacctccccagctccacgccttaaatgcgcgcctcccctcgtcccgatcccctttctttcaagcaagcaagcaagcagaggagagggaccgggaccgggagtgagaggaagttgagctcttttcttcgtcgacgctggtttttggcccctgactgctggtcgagatgtcgaagatggcggacgagaaggtgatttcggcgccggcgaccggcggaggggaggacgggctgatcgcaggggacctgtcagccgcggaggcgcgggtccgtccgttggagacgctgctgcgcgccgcgcctctggggctctgcgtcgccgccatggccgtcatgctccgcgacacgcagaccaacgagtacggcaccgtctcctactccgacctcggcggattcaagtacctggtttatgccaacgggctgtgcgcggcctactccctggtctccgcgttctacactgccgtgccgcggccggcgacgctgtcccgctcctggatcgtcttcctcctagaccaggtgttcacgtacctgatcctgggcggccggcgcggcgtcggcagagctgctctacctggcgtacaacggcgacaaggaggtgacgtggagcgaggcgtgcggcgtgttcggcggcttctgcaggcaggcccggacgtcggtggccatcaccttcggctccgtcgtctgctacatcctcctctccctcatctcgtcctaccgcctcttcagcgcctacgacgcacccatgccctcgctcggcaacaagggcgtcgagatcgctgccttcccgcgctgagccgagaggatccctagctgctgtggcttggctactcgatgacgggtcaaaactcaaaacacgtacgtacgtagtagtatcgctgtgtgtgtaggcgaacgaaataatctgtaagggctcatagttaatttcaagctacatatagtgcatctgcctctcttctttttacttgattctatatacactgtactagctttgaatcttctgctgtgaggctgtggtggattcattgatgcgttccaaaaatgcgaacctagttccgttgcaggcacccaggtgatctatgtaactacgatgagcttcctcatttaaggagttcagttgcttgtaaggtgcttgaagcaaagcaaaatcaataccctttccgttcacaaatac

SEQ ID NO: 4063 - DNA, 1120 bp, Avena sativa
cgatcaatcgattcgtctcgtcgctcccttcgactcgcccatacggtaccgccaccgcgccattaactccgcgcattcaagccaccccgctgcgctccaaccaccagccctgctcctcgccttaaatgccctccccctcgtcccgattcccttccctttgaagcagaggagagggaccagcactgggactgtgagggagtcgagctattgtactgcttcgtcgacgttggttgttgctgctgctcgagatgtcgaagatggcggacgaaaaggtgatggggccgccggcgaacggcggaggggaggacgggatgctcgctggggagttgtcgtccgcggagggccgggtccggccgctggagacgctgctgcgcgccgcgccgctggggctctgcgtggccgccatggccgtcatgctccgcgacacgcagaccaacgagtacggcaccgtctcctactccgacctcggcggattcaagtacctggtttacgcgaacggcctgtgcgcggcctactccctggtctccgcgttttacaccgccgtgccgcgcccggcgacgctggcccgctcctggatcgtcttcctcctagatcaggtgttcacgtacctgatcctggcggccggcgcggcgtccgcagagctgctctacctggcctacaacggcgacaaggaggtgacctggagcgaggcgtgcggcgtgttcgggggattctgccggcaggcccggacgtccgtggccatcaccttcggctccgtcttatgctacatcctgctttccctcatctcctcctaccgcctcttcagcgcctacgacgcgcccgtgccgtcgcacggcagcaagggcgtcgagatcgccgccttcccgcgctgagccatgatcgcggacggacggtgttgctagctacctgatggatcaaaacacgtactgtatgtacttggtagtatcgtcgggtgtgtgtgtgtaggcgaacgaaataatctgtatgggtttatagtcaatttccagctacatatagtgcatcagctcctctgcttttcacttcaatatatactactactaccactagcttcgattcttctgctgtgacggattaattgatgcgttccaaggatgcaaac

SEQ ID NO: 4064 - DNA, 947 bp, Avena sativa
ggaccagcactgggactgtgagggagtcgagctattgtactgcttcgtcgacgttggttgctgctgctgctggagatgtcgaagatggcggacgaaaaggtgatggggccgccggcgaacggccgaggggaggacgggatgctcgctggggagctgtcgtccgcggagggccgggtccggccgctggagacgctgctgcgcgccgcgccgctggggctctgcgtggccgccatggccgtcatgctccgcgacacgcagaccaacgagtacggcaccgtctcctactccgacctcggcggattcaagtacctggtttacgcgaacggcctgtgcgcggcctactccctggtctccgcgttttacaccgccgtgccgcgcccggcgacgctggcccgctcctggatcgtcttcctcttagatcaggtgttcacgtacctgatcctggcggccggcgcggcgtccgcagagctgctctacctggcctacaacggcgacaaggaggtgacctggagcgaggcgtgcggcgtgttcgggggattctgccggcaggcccggacgtctgtggccatcaccttcggctccgtcttatgctacatcctgctttccctcatctcctcctaccgcctcttcagcgcctacgacgcgcccgtgccgtcgcacggcagcaagggcgtcgagatcgccgccttcccgcgctgagccatgatcgcggacggacggtgttgctagctacctgatggatcaaaacacgtactgtatgtacttggtagtatcgtcgggtgtgtgtgtgtaggcgaacgaaataatctgtatgggtttatagtcaatttccagctacatatagtgcatcagctcctctgcttttcacttcaatatatactactactaccactagcttcgattcttctgctgtgacggattaattgatgcgttccaaggatgcaaac

SEQ ID NO: 4065 - DNA, 1431 bp, Hordeum vulgare
caatgcagagggaggagggcaaattcacaaacgcgacgcaacacgcagctgccgattagtggactcaactcgactcgtcactgccctctgctcgcccatacggtactgccaccgcgccattaactgcccgcattgaagccaccccgctgcgctccaactaacctccccagctccacgccttaaatgcgcgcctcccctcgttccgatcccctttccttcaagcaagcaaccgggaccgggagtgagaggaagttgagctcttttgcttcgtcgacgctggtttttggtccctgactgctagtcgagatgtccaagatgacggacgagaaggtgatttcggcgccggcgacgggcggaggggaggacgggctgatcgcaggggacctgtcagccgcggaggcgcgggtccgtccgctggagacgcttttgcgcgccgcgcctctcgggctctgcgtcgccgccatggccgtcatgctccgcgacacgcagaccaacgagtacggcaccgtctcctactccgacctcggcggattcaagtacctggtctatgcgaacgggctgtgcgcggcctactccctcgtctccgcgttctacactgccgtgccgcggccggcgacgctgtcccgctcctggatcgtcttcctcctagatcaggtgttcacgtacctgatcctggcggccggcgcggcatcggcagagctgctctacctggcatacaacggcgacaaggaggtgacgtggagcgaggcgtgcggcgtgttcggcggcttctgcaggcaggcccggacgtcggtggccatcaccttcggctcggtcgtctgctacatcctcctctccctcatctcgtcctaccgcctcttcagcgcctacgacgcacccatgccctcgctcggcaacaagggcgtcgagatcgctgccttcccgcgctgagcggaggggatccctagctgctgtggcttcaggctttggctgcttcatgggtcaaaactcgaaagtcgaaacacgtacgtacgtagtagtatcgctgtgtgtgtgtaggcgaacgaaataatctgtaagggctcatagttaatttcaagctacatatagtgcatctgcctcttctttttacttgattctatatactgtactagctttgaatcgtctgctgtggtggattcattgatgcgttccaaaaatgagaacttagttccgatgcagggcacccaggtgatcaatgtatctacaacgagcttcctcctcatttgatgatttcagttgcttgtaaggtgcttgaagcaaagaaaaaaaagagtactcgcttggttcataaatatacaagatgttctaactttttgttgaatcggacctatataaaaaaaggttttcatgttttatattacaaagcaaccaaccaaaacattcatcgatacatgtcatgttcaaaaaaaa

SEQ ID NO: 4066 - DNA, 1192 bp, Leymus cinereus x Leymus triticoides
ccgttgctgtcgagcaagcaagcagagtagagcgaccgggaccgcgagtgagaggaagttgagctcttttgcttcgtcgacgctggtttttggtccctgactgctggtcgagatgtccaagatggcggacgagaaggtgatttcggcgccggcgaccggcggaggggaggacgggctgatcgcgggggacctgtcagccgcggatgcgcgggtccgtccgctggagacgctgctgcgcgccgcgcctctggggctctgcgtcgccgccatggccgtcatgctccgcaacacgcagaccaacgagtacggcaccgtctcctactccgacctcggcggattcaagtacctggtttatgcgaacgggctgtgcgcggcctactccctggtctccgcgttctacactgccgtaccgcggccggcgacgctgtcccgctcctggatcgtcttcctcctagatcaggtgttcacgtacctgatcctggcggccggcgcggcgtcggcagagctgctctacctggcgtacaacggcgacaaggaggtgacgtggagcgaggcgtgcggcgtgttcggcggcttctgcaggcaggcccggacgtcggtggccatcaccttcggctccgtcgtctgctacatcctcctctccctcatctcgtcctaccgcctcttcagcgcctacgacgcacccatgccctcgctcggcaacaagggcgtcgagatcgctgccttcccgcgctgagctgagccgagaggatccctagctgctgtggcttggctacttgatgggtcaaaactcaaaacacgtacgtacgtagtagtatcgctgtgtgtgtgtaggcgaacgaaataatctgtaagggctcatagttaatttcaagctacatatagtgcatctgcctctcttctttttacttgattctatactgtactagttttgaatcttctgctgtgagcctgtggtggattcattgatgcgttccaaaaatgccaacttagttccgctgcagggtacccaggtgatctatgtaactacgatgagcttcctcgtcatatgaggagctcagttgcttgtaaggtgctttaagcaaagcaaaaacaatactctcttcgttcacaaatacaagatataagatgttctaacttctctctaaatcgaaggtatataaaaacgtttgtgtgtttgttcaaaaaaaaa

SEQ ID NO: 4067 - DNA, 1209 bp, Lolium multiflorum
catcaatccactcgtctcgtcgctgccttggactcgcccatacggtaccgccaccgcgccattaactccgggcattcaagccactccgctgctctccaacaacctaccctgctcctcgccttaaatgcgcgcctcccgctcggcccgacctccttcccttcaatcagagagagggaccagcgcgcgctagaattgtgagtgagttgagttcttggagtacttcttggtcgacgttggccgttgctgctgctgctcgagatgtccaagatggcggacgagaaggtgatgggggcgccggcgagcggcggcggagtggaggacgcgggggagctgtcgcccgcggaggcgcgggtccggccgctggagacgctgctgcgcgccgcgccgctgggcctctgcgtcgccgccatggccgtcatgctccgcgacacgcagaccaacgagtacggcaccgtctcctactccgacctcggcggcttcaagtacctggtttacgccaacgggctgtgcgccgcctactccctggtctccgccttctacactgccgtgccgcgcccggccacgctgtcccgctcctggatcgtcttcctcctagatcaggtgttcacctacctgatcctggcggccggcgcggcgtcggcggagctgctctacctggcgtacaacggcgacaaggaggtgacctggagcgaggcgtgcggcgtgttcgggggattctgccgccaggccaagacgtccgtcgccatcaccttcggctccgtcctctgctacatcgtcctctccctcatctcctcctaccgcctcttcagcgcctacgacgcccccgtgccatcgcacggcaacaagggcgttgagatcgctgccttcccgcgctgagccatgcatgatcaccggacggaccgacggtgttgctagctactacctcatggatcaaaacacgtagtacgtgtacttagtactatcgctgggtctgtgactgagttgtgtaggccaatgaaataatctgtatgggtttatagttaatttccagctacatatagtacaatctcctcctctgctttttcacttgattatatactactccgcttctactggtagctttggttgttttgctgtgatggataattggtgcattctaagaatgcgatctcagttttgctgcaaacagcctagcaagcagtacattgatgtcatcaatagaactcggca

SEQ ID NO: 4068 - DNA, 1086 bp, Pseudoroegneria spicata
agcaggcccgcaggcaagcagaggagagggactgggaccaggagtgagaggaagttgagctattttcttcgtcgacgctggttttgggcccctgattgctggtcgagatgtcgaagatggcggacgagaaggtgatttcggcgccggcgactggcggaggggaagacgggctgatcgcgggggacctgtcagccacggaggcacgggtccgtccgctggagacgctgctgcgcgccgcgcctctggggctctgcgtcgccgccatggccgtcatgctccgcgacacgcagaccaacgagtacggcaccgtctcctactcggacctcggcggattcaagtacctggtttatgccaacgggctgtgcgcggcctactccctggtctccgcgttctacactgccgtgccgcggccggcgacgctgtcccgctcctggatcgtcttcctcctagatcaggtgttcacgtacctgatcctggcggccggcgcggcgtcgtcagagctgctctacctggcgtacaacggcgacaaggaggtgacgtggagcgaggcgtgcggcgtgttcggcggcttctgcaggcaggcccggacgtcggtggccatcaccttcggctccgtcgtctgctacatcctcctctccctcatctcgtcctaccgcctcttcagcgcctacgacgcacccatgccctcgctcggcaacaagggcgtcgagatcgctgccttcccgcgctgagccgaggcgagaggatgcctagctgctctggcttggctacttgatgggtcaaaacacgtacgtacgtagtagtattgctgtgtgtgtaggcgaacgaaataataatctgtaagggctcagagttaatttcaagctacatatagtgcacctgcctcctttttacttgattctatatacactgtactagctttgaatcttctgctgtgacgatgagcttcctcgtcagttgcttgtaaggtgcttgaagcaaagcacaaaacaatattctcttcattcacaaatacagtataaaatataagatgttctaacgtttttctgaatcgggtgtatatggaaacgtttgtgtgtttgttca

SEQ ID NO: 4069 - DNA, 723 bp, Cenchrus ciliaris
cggcggcgcgggtgcggcccatggagacgctgctgcgcgcggcgccgctggggctgtgcgtggccgctatggccatcatgctcaaggaccagcagaccaacgagtacggcaccgtcgcttactccgacctcggcggcttcaagtacctcgtctacgccaacggcctctgcgccgcctactcgctcgtcacggccttctacaccgccgtgcccaggcccgccaccgtgtcacgctcctgggtcgtcttcctcctcgaccaggtgttcacgtacctgatcctggccgccggcgcggcggcagcagagcttctgtacctggcctacaacggcgacaaggaggtgacatggagcgaggcgtgtggtgtgtttgggggcttctgccaccaggctcggacctcggtggccatcaccttcggctccgtgctctgctttatccttctctccctcatctcctcctaccgcctctttagcgcctacgaggcgcccccgtcgtcggcgctcggcaacaagggtgtcgagatcgctgcctacccgcgctgaagctgccgccagcgagcggagggtgccgtgcctccagcgtggtggcataatctctattatgtgtaattgtgatcaagtcataaaggcgtatcatatatataaactctagtagtttgctgctacatatgattagtgaaatgctgctgttgtacttgacttggtaattatatactctactagtttg

SEQ ID NO: 4070 - DNA, 992 bp, Brachypodium distachyon
aactccagacgagacgagagggacatccccaggaaaaggagagtgagagtgttgtggttcgggtcgacaacatcatgtcgaagatggcggacgagaaggtgatggcggcgccggagagcgccggggttggggaggacgcgggggagcagacggtggcggaggcgcgggtccggccggtggagacgctgctgcgcgcggtgccgctggggctctgcgtcgccgccatggccgtcatgctccgcgacacgcagaccaacgagtacggcaccgtctcctactccgaccttggcggattcaggtacctggtgtacgccaacgggctgtgcgcggcctactccttggtctccgcgttctacactgccgtgccacggccggcgaccctgtgccgctcctggatcgtcttcctccttgaccaggtgttcacgtacctgatcttggcggccggtgcggcgtcggcggagctgctgtacctggcgtacaacggcgacaaggaggtgacgtggagcgaggcgtgcggcgtgttcgggggattctgccggcaggcccggacgtcggtgggcatcaccttcggctccgtcctctgctacatcctgctctcgctcatctcctcctaccgcctcttcagcgcctacgacgcgccgctgccggccggcagcaagggcatcgagatcgccgccttcccgcgctagctgacgcgtggccgatcggacgacgacaatgcgactactggctactagcttagctacttgattgtggatcaaaacacggacgtgctactgcagtatctatcgctcagtgtgtgtgtgtaggtgaacaaaataagtatggatgtgttcatagtacccgtacttgatatgcagctacatataatggtgcatctgctcctcgtttgacttgattattttgctcaccacgtttaccacgtagtactgctagctttgcttcttcgatcgatcatctgctgtgataaattgatgctttccaaaaatgca

SEQ ID NO: 4071 - DNA, 1015 bp, Brachypodium distachyon
caactccagacgagacgagagggacatccccaggaaaaggagagtgagagtgttgtggttcgggtcgacaacatcatgtcgaagatggcggacgagaaggtgatggcggcgccggagagcgccggggttggggaggacgcgggggagcagacggtggcggaggcgcgggtccggccggtggagacgctgctgcgcgcggtgccgctggggctctgcgtcgccgccatggccgtcatgctccgcgacacgcagaccaacgagtacggcaccgtctcctactccgaccttggcggattcaggtacctggtgtacgccaacgggctgtgcgcggcctactccttggtctccgcgttctacactgccgtgccacggccggcgaccctgtgccgctcctggatcgtcttcctccttgaccaggtgttcacgtacctgatcttggcggccggtgcggcgtcggcggagctgctgtacctggcgtacaacggcgacaaggaggtgacgtggagcgaggcgtgcggcgtgttcgggggattctgccggcaggcccggacgtcggtgggcatcaccttcggctccgtcctctgctacatcctgctctcgctcatctcctcctaccgcctcttcagcgcctacgacgcgccgctgccggccggcagcaagggcatcgagatcgccgccttcccgcgctagctgacgcgtggccgatcggacgacgacaatgcgactactggctactagcttagctacttgattgtggatcaaaacacggacgtgctactgcagtatctatcgctcagtgtgtgtgtgtaggtgaacaaaataagtatggatgtgttcatagtacccgtacttgatatgcagctacatataatggtgcatctgctcctcgtttgacttgattattttgctcaccacgtttaccacgtagtactgctagctttgcttcttcgatcgatcatctgctgtgataaattgatgctttccaaaaatgcagactttttttttgtaaagaggc

SEQ ID NO: 4072 - DNA, 1133 bp, Oryza sativa
ctcacctccacctccacctagctctagagccttccctctcctcctcctccacatccaccggagagagtgtgtttcttggttcttggaggagagatgtccaagatggcggaggagaaggtgctggcggcgccggccaccgtcgacggcgggatgcagtcctccggggacctgcaggcttcgtcggcggcggcggcgcgtgtgcggcccgtcgagacgctcctccgcgccgcgccgctggggctctgcgtcgccgccatggccatcatgctccgcaactcggtcaccaacgagtacggcaccgtctcctactccgacctcggcggcttcaagtacctggtgtacgcgaacgggctctgcgccgcctactcgctggcgtcggcgttctacatcgccgtgccgaggccggcgacgttgtcccgctcctgggtcgttttcctcctcgaccaggtgttcacgtacctgatcctggcagcgggggcggcgtcggcggagctactgtacctggcgtacaacggcgacaaggaggtgacgtggagcgaggcgtgcggcgtcttcggtggattctgccggcaggcgaggacgtcggtggccatcaccttcgcctccgttgcctgctacatcctcctctccctcatctcctcctaccgcctcttcagcgcctacgacccaccccagccttccctcggcaacaagggcgtcgagatcgccgccttcccccgctgatcgccgccgccgccggagacgaagaagaagacgaccacccagacgaccaccaccaccacgacatccccagctactaagcttgagctgctgcgtgcttgggtactactactagctaggcgagagcatgattaagtaataataataagtacttttatctctccagctaaatatatagtgatgagtgctttttaatttcttcttgtgctctgttatatatatatgtgattatctctgacctgatcatgatcatcgtcgtcatatactcatatatctctactcgaactcgtggtatgtatggttgttgattcgatcagctgtggtgaactgattgacccgttacaaagattgcaaactggatatgtatctgcggttagagaatgggtggtgtaatttgagatcttgaatgggtg

SEQ ID NO: 4073 - DNA, 966 bp, Saccharum officinarum
cacgcacacgcacctccgatccatctgccacctttatttatccaatcggaggcaaccccaacccaacaatcaagggagctggcggcgtcttctgcttctaagctggagagagctggagctggagcagtgcgcggcgccaccgccggagagggcgacgacataggaggcatcgacccgctgccggacgcctcctccgagactccggagcagcgcaacaagttcctggtcctccgcctgtacgaggcgctcaacgcccgggaccacgccgccgtgcagtcgctgctcgcgcccgacctcgagtggtggttccatggcccgcccaagcaccagcacatgatgcgcctcctcaccggcggcagcggcagcggcagcggcttccgcttcgtcccgcgctccgtcgacgcgctcggcgcccccaccagcaccgtcatcgccgaggggcaggagcgagggtgctactgggtgcacgcctggaccgtgggcgccgatggggtgatcacccagctccgcgagtacttcaacaccgacctcaccgtcacccgcctcgccgccgtcgccgccttcgccaagtgcgtgtggcagagccgccgccccgacagcgccaccaactccctgccgggactcctcctcgccctctgatcaccgtcatcgatccattcccagatcagatcacccaagtcgtcgtcgtatattggatttttgcttgcgccttttctttcactatcgtcgtcgtcgtcattgagtactactgtagtcatcgtgtgtatatcctgtacgtaccgtatactcctacctacgtattgtatgtacgtgggccacacggtgggaccaccccaccccaccccacccacaccaaggcccacctagtagctgatccatggcgacgccgcgttgctcctcgtgtcctttattgtactgcaacctactactagtattattgtactccaataaaacagtattattatt

SEQ ID NO: 4074 - DNA, 646 bp, Saccharum officinarum
cccgcccaagcaccagcacatgatgcgcctcctcaccggcggcagcggcggcttccgcttcgtcccgcgctccgtggacgcgctcggcgcccccaccagcaccgtcatcgccgaggggcaggagagagggtgctactgggtgcacgcctggaccgtgggcgccgatggggtgatcacccagctccgcgagtacttcaacaccgacctcaccgtcacccgcctcgccgcctccgccaagtgcgtgtggcagagccgccgccccgacagcgccaccaactccctgccgggactcctcctcgccctctgactctgatcaccgtcatcgatccattcccatccagcacccaagtcgtcgtcgtaggtatattggatttttgcttgtgccttttctttcactatcgtcgtcgctctagtcgtcgtgtgtgtatcctgtacgtaccgtatacctacgtacgtattgtatgtacgtgggccacacggtgggaccaccccaccccacccacaccaagggccacctagtagcttcgtcgccgccgctgatccatggcgacgtcgcgttcctcctcgtgtcctgctgctacggcgtgtaccactgcaacctactattattgtactccaataaaacagtatcattattgtgtttcgt

SEQ ID NO: 4075 - DNA, 1409 bp, Zea mays
attagtggcatccatacatatggatgcccaaacaattatcggttgaggaagtcaacaggaaagtatcttaaaggttggaaacgtggcaaatcgaggagcatgagctggtagggcactcgcagtgggtggagccggtttgctgacgcggaaggaaccgaccattcatgactcgcttggcacgcggtgaagtgagtgtgtgtgagtcagcctctcgatctgggttgggttttggtctataaaataccaaggccttccatctctgggttgtggttgtggcctcctatccttgcacgcacacgcaaacgcatcccatcctgtcctcgcgttactactagttagttagagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgcccgacctggagtggtggttccatggcccgcccaagcaccagcagcacatgatgcgcctcctgaccaccaccaccagcagcttccgcttcgtgccccgctccgtggacgccctcgccgcctcgtccggcaccgtgatcgccgagggccacgagaggggttgctactgggtgcacgcctggaccgtgggacccgatggggtgatcacccagctccgtgagtacttcaacaccgacctcaccgtcacccgcctcgccgccgccgtcgccgccaagtgcgtctggcagagccgccgccccgacagcgccaccaactccctgccgggactcctgctcgccctctgatcactctgagggataaattaaataccatctctatctatatactacgtatcatccttgtcgtcgtcagtcagtcagtgcaaccgtgtgtatgtatgtatctacgtacgtattgtatttgtatcccatccatggccgtatgtcactattatatatatacagtatatctcatcaactttgaccacgcgcgtgcatcttataccttgcaagcaaattctaatttgatttatatttaaaaaaacataaatatctcccggttactggctaccacaaacaagcaagcactggctaaactgtccttgtcatttgacaagcgagcaacgatatgattttctctcccttccctgctacctacacctacctactgctaccaggcatcttgaatcctgagggtggtttcagatgccaaccacgctattattatctgtcacaaactcttatctaccactcctaaactcttatctaccgcacctcttgtgtatagcctttatcacagcctatacacatcagcttttttagacttttatttaaaataaaa

SEQ ID NO: 4076 - DNA, 3568 bp, Pennisetum glaucum
cctggaattctaggaaacatttttgatggtatccagcgccctctaaaaaccattgctattaaatcaggagatgtctacattcctcgtggtgtttcagttcctgcccttgacaaagatacattgtgggagtttcagccaaataaactaggtgttggagatgccatcacaggtggagatctatatgctaccgtctttgagaacacattgatgcagcaccatgttgctcttccacctggtgctatggggaaagtgagttacattgcgccagctggtcagtacagcctgcaggatacagtgctagaattggaatttcagggcataaaaaaggatttaccatgcttcagacatggcctgtgcgatcaccaaggcctgttgcatcaaaggttgctgcagatacacctcttctgacagggcagcgtgtactcgatgcattgttcccctcagttctgggaggaacttgtgctattcccggagcttttggttgtgggaaaactgtcattagtcaggcactttcaaagtactccaattcccaagctgtggtttacgtgggctgtggtgaaagaggaaatgagatggctgaggttcttatggacttcccccagttgacaatgacattgccagatggccgtgaggagtctgtcatgaagagaacaaccctcgtggctaacacatctaacatgcctgtcgctgctcgtgaagcctctatctatacaggaatcacaatcgctgagtatttccgtgacatgggctacaatgtcagtatgatggctgattccacctctcgatgggctgaggcattgcgtgaaatctcagggcgtttggctgaaatgcctgctgatagtggttacccagcttatttggctgcacgactggcatccttttatgaacgtgctggtaaggtgaaatgtctaggaagtccagacaggactggcagtgtcacaattgttggagctgtctctcctcctggtggtgatttttcagaccctgttacctctgcgaccctcagtattgtgcaggtcttctggggtttagataaaaagcttgctcaaaggaagcatttcccatctgtgaattggctcatctcctattcaaaatactctcaggccctcgagtccttctatgagaaatttgatcaagatttcattgatattaggacaaaagcccgtgaggtgttgcagagagaggacgatctaaatgaaattgtgcagcttgttggtaaagatgcgctggcagaatctgacaagattacgctggagactgcaaagcttctgagagaagattatttggcacaaaatgcatttaccccatatgataagtactgcccattctacaaatctgtttggatgatgcgcaacattattcacttcaacacattggcaaatcaggctgtggagcgggcagctggtactgatggccagaagataacatacagtgtcataaagcatcgtttgggcgatctgttctatcgcttagtgtctcaaaagtttgaggatcctgcagaaggcgaagatgctttggttgccaaatttaagaaactatatgatgaccttaccgctgggttccgcaatctagaggatgaggcacggtgaactgttgtagattttgtgtaaacaataaggactgccagatgtttcataagatacggaagttgtagattgagatcgtgtatgagatttttccgcgccgcaactctttgccatatcactgttttggccatcagtgctcgacggacaccctgtttatttctgtgtatcatttattgccatcatcattgtaataagcgatgggcatgcttgtagttgaataagtacaatgtccatgtatttaaacatcaatgccatctttatttgttgtcaagacacatccgactatccaataaatatcgtgtaacaggcaaagtcgtttccgctgcaattcgaaagacataggccaaagctagggtggtgtaccaaacacgccataacatcacctcatgcaactcgcacataacaagaactaaccgctatttacatttattccctcgtataaatcactcgatagaaatcactcaactcttaagggaaaatagtgaactacgagacatttattccctcgtataaatctatcacattagtgtcaccatcactaggctaaaggtattgcttcatccatccattactctttcatgaggctcgtcattctgcagagtaatatgcatgtttttcttactcggtcaacaacacggcagcaatgtggctttggagaggtcaaaaacacactatgatacgtcagatgcctgctgctctcgtcaaggagactgcctctgctgcaaaatcacacaggaagaagcggttgcctctcgtcagatccatgacggtgtttagcctcacttgccactgaatcagtcacattgacgtaagcagattcctttactctgctgtgatcatgagcttcagccatttcaattttgctgctaggcacttcgtctttaatttggttagaaagatactgatgcatagatatgattactattgaaattccaagaacaaaatttattgtcaatgtgtgtccaaataatacagcagaggctactccggtgaagatagttgcaattgttgatgagtacttcttcaaaattgtatctgcatacttgaagaaaaatgatgacagtatgccctgtgcagcattgttgcagataagaaacattgtggcctttgaatgtccttccagaatgttaaagctactgggcccttggatgatggcagtgattacaagcccaaaaaaattgaatattgcaccataaccatacagaaataagttctgaaggtaaatacttgtatcaaactggcttttaagagccttttcattgtaaactgaagccaacgcaggaactgttacaaaaaagagtgtatagaggtaggctccagcagcaacaggaagacctagtgcgctagaaccttcaggcaatgatttcagctgattaacagatattccaattaacaaaagggcaagggcctcccactgaattgtggaaaatcgcctcctcattattatctttagaagcacagcgattactagaaccttgagattactcagcattttcacactcgcaggattaaaatataactgcattatgaacttcaaatagttgttgatagcatagagaaaagcaggaactgcaagaagaacattgttgcgagcagcctgcataaacgttgacactgtgagaagtggcttgtcccccacctttagacgtcgagcctggatgaatagcatgatgatggcgaagataatttttgtaatctccgtcaagaaatttacacttattgggctaaatttgaatttcccatccacttttgacatgtacacaagtataggctggaggcccgcaaggacgcagtcgccggagacgaggagcacgttgagcgcgcgctgccgcgacgagacggtgctccggtggctgtcgtacgccttggagaccgccggcggcaccggcaccttcgcgtggcacacgctacattccacctccccgttcatctccgccgccgccgccgccaaaggctcgccgacacatcgcggttccaatcag

SEQ ID NO: 4077 - DNA, 1932 bp, Zea mays
ccccattgccgcattgctctccctcggctcggtccctctccggctctccctcacggcctcgcccactgcgccttcgaggagctccgaatcccgatcgcctcggtccccgcgagctcacatggtgggggcgcgcaccagaggctagggttcccagttcccatcattctcctgctgattaaaaccgtggggttttggagagcctgaggctgtggcggcggcaggaatgaacggggaggtggaatgcagcgtgtgccatgcgaaggtgccggtgccgccgccggtgtcgaaagcgtacgacagccaccggagcactgtgtcgtcgcggcaacgtgcgctaaacgtgctcctcgtctccggcgactgcgtccttgccggcctccagcctatattagtgtacatctcaaaagtggatgggaaattcaaatttagcccaatcagcgtgaatttcttgacagagattacaaaaattatgtttaccattgtaatgctattcatccaggctagacgtctaaaggtgggagacaagccactttttacagtttcaatatttatgcaggctgctcgcaataatgttcttctttcagtacctgcttttctctatgctatcaacaactatttgaagttcataatgcagttatattttaatcctgctagcgtgaaaatgctgagtaatctcaaggttctggtaatcgcagtgcttcttaagatgataatgaggaggcgattttccgtaatccagtgggaggcccttgcccttttgttaatcggaatatctgttaatcagctgaaatcattgccagaaggttctagtgcgctaggtcttcctgttgcagctggagcctacctatatacattgttttttgtaacagttcccgcattggcttcagtttacaacgaaaaggctcttaaaagccagtttgataccagtatttaccttcagaacttgtttctgtatggttatggtgcgatatttaactttattgggcttgttgtcactgctatcatccaagggcccagtagttttaacattctagaaggccactcaaaggccacgatgtttcttatctgcaacaatgctgcacagggcatattatcatcatttttcttcaagtatgcagatacaattttgaagaagtactcatcaacaattgcgactatcttcaccggagtagcctctgctgtgctgtttggccacacactgacgataaattttgttcttggaatttcaatagtaatcatatctatgcatcagtatctttctaaccaaattaaggacgaagtgcctagcagcaaagttgaaatggctgaagctcatgatcacagcagaaaggaacctagttatgtcaacgtgcctgattcaggggcaagtgagtctaaacaccgccatggatctgacgagaggcagccacttcttcccgtatgattttgtagaagaggcgcactgtttcctcaacagagcagcatgtaaagagagtatttttagcgggtatttgacctaattgtctctgaagcaacattggtgccatgctgttggcggggtaaagtatatgcatattcggcggcagtgacgagcttcgtgaagtacactaatagagtaatggtctttggatgaatgagtcgatacctttagcctaatgggtggtaaaactagtgtgataagatcagcgaggaataaagtcaccaccattttttcctgtcttgtgagttggtgagttgatattgatacagccatcagccgtggttctactctctctctctctttctcgcggcaccatgtaaatagaaatatcagttcatttctgatggcgcgtgccacggtgccaaccagagattttattcttgtatgtgcgtgttgcatgagagatactacggcgtgtttactgatcactgagctttgcatgtcttctgaattacagcaaaacgcctaattgg

SEQ ID NO: 4078 - DNA, 2021 bp, Setaria italica
gaataatttaattatttctacattttccgctcccctcctccgctccccattgcggcattgccctcctccccgtcgcggcctcgcccaccgcgccttcgaggagcttcgaatcgcgatcgcttcggtccccacgagctcacatggtgggtgcgcgcgccagaggctagggttcccagttctcaacattcccctgctgattggaaccgcagtgtttcggcgagcctgtggcggtggtggtggcggagatgaacggggaggtggaatgcagcgtgtgccacgcgaaggtgccggtgccgccggcggtgtccaaggcgtacgacagccaccggagcaccgtgtcgtcgcggcagcgcgcgctcaacgtgctcctcgtctccggcgactgcgtccttgctggcctccagcctatactagtgtacatgtcaaaagtggatgggaaattcaaatttagcccaatcagcgtaaatttcttgacggagattacaaaaattatctttgccatcatcatgctattcatccaggctcgacgtctaaagatgggggacaagccacttctcacagtgtcaacgtttatgcaggctgctcgcaacaatgttcttcttgcagttcctgcttttctctatgctatcaacaactatttgaagttcataatgcagttatattttaatcctgcaagcgtcaagatgctgagtaatctcaaggttctggtaatcgctgtgcttctaaagataataatgaagaggcgattttccacaatccagtgggaggcccttgcccttttgttaattggaatatctgttaatcagctgaaatcattgcctgaaggttctagcgcactaggtcttcctgttgctgctggagcctacctctatacattcttttttgtaacagttcctgcgctggcttcagtttacaatgaaaaggctcttaaaagccagtttgataccagtatttaccttcagaacttatttctgtatggttatggtgcaatattcaattttcttgggcttgtaatcactgccatcatccaagggcccagtagctttaacattctggaaggacattcaaaggccacaatgtttcttatctgcaacaatgctgcacagggcatactgtcatcatttttcttcaagtatgcagatacaattttgaagaagtactcatcaacaattgcaactatcttcaccggagtagcctctgctgtattatttggacacacactgacaataaattttgttcttggaatttcaatagtaatcatatctatgcatcagtatctttctaaccaaattaaagacgaagtgcctagcagcaaaattgaaatggctgaagctcatgatcacagcagagtaaaggaatccgtttacgtcaacgtgactgattcagtggcaagtgaggctaaacaccgccatggatccgacgagaggcagccgcttcttcctgtatgattttgcagcagaggcagtctccttgacgagagcatcaagcatctgacgtatcttagtgggtttttgacctctctgaagccacattgccgccgtgttgttgggcgagtaagaacatgcatattacgtggcagaatgatgagcttcatgaaagagtaatggatggatgatgcaatacttttagcctagtgatggtgacactaatgtgatagatttatacgaggaataaagtctcgtatttcgccattttttccctctcttgagagttgagtggttctatcgagtgattttttttatgcggctccaatgtaaatagcggttagtttcttgttatgtgcgagttgcatgaggtgatgttatggcgtgtttggtacaccaccctagctttgcctatgtctttcgaattgcagcggaacgacttgcctgttacaggatatttatcggatactctgatagtcggatgcgtatctgatattctgatttactggcaaaaggcaatcgccgcggttctggtgatcccatttactgtgtgtgaacgttccattgtcattgtagtgctgttcgcaaattgctcac

SEQ ID NO: 4079 - DNA, 1927 bp, Setaria italica
tttaattatttctacattttccgctcccctcctccgctccccattgcggcattgccctcctccccgtcgcggcctcgcccaccgcgccttcgaggagcttcgaatcgcgatcgcttcggtccccacgagctcacatggtgggtgcgcgcgccagaggctagggttcccagttctcaacattcccctgctgattggaaccgcagtgtttcggcgagcctgtggcggtggtggtggcggagatgaacggggaggtggaatgcagcgtgtgccacgcgaaggtgccggtgccgccggcggtgtccaaggcgtacgacagccaccggagcaccgtgtcgtcgcggcagcgcgcgctcaacgtgctcctcgtctccggcgactgcgtccttgctggcctccagcctatactagtgtacatgtcaaaagtggatgggaaattcaaatttagcccaatcagcgtaaatttcttgacggagattacaaaaattatctttgccatcatcatgctattcatccaggctcgacgtctaaagatgggggacaagccacttctcacagtgtcaacgtttatgcaggctgctcgcaacaatgttcttcttgcagttcctgcttttctctatgctatcaacaactatttgaagttcataatgcagttatattttaatcctgcaagcgtcaagatgctgagtaatctcaaggttctggtaatcgctgtgcttctaaagataataatgaagaggcgattttccacaatccagtgggaggcccttgcccttttgttaattggaatatctgttaatcagctgaaatcattgcctgaaggttctagcgcactaggtcttcctgttgctgctggagcctacctctatacattcttttttgtaacagttcctgcgctggcttcagtttacaatgaaaaggctcttaaaagccagtttgataccagtatttaccttcagaacttatttctgtatggttatggtgcaatattcaattttcttgggcttgtaatcactgccatcatccaagggcccagtagctttaacattctggaaggacattcaaaggccacaatgtttcttatctgcaacaatgctgcacagggcatactgtcatcatttttcttcaagtatgcagatacaattttgaagaagtactcatcaacaattgcaactatcttcaccggagtagcctctgctgtattatttggacacacactgacaataaattttgttcttggaatttcaatagtaatcatatctatgcatcagtatctttctaaccaaattaaagacgaagtgcctagcagcaaaattgaaatggctgaagctcatgatcacagcagagtaaaggaatccgtttacgtcaacgtgactgattcagtggcaagtgaggctaaacaccgccatggatccgacgagaggcagccgcttcttcctgtatgattttgcagcagaggcagtctccttgacgagagcatcaagcatctgacgtatcttagtgggtttttgacctctctgaagccacattgccgccgtgttgttgggcgagtaagaacatgcatattacgtggcagaatgatgagcttcatgaaagagtaatggatggatgatgcaatacttttagcctagtgatggtgacactaatgtgatagatttatacgaggaataaagtctcgtatttcgccattttttccctctcttgagagttgagtggttctatcgagtgattttttttatgcggctccaatgtaaatagcggttagtttcttgttatgtgcgagttgcatgaggtgatgttatggcgtgtttggtacaccaccctagctttgcctatgtctttcgaattgcagcggaacgacttgcctgttacaggatatttatcggatactctgatagtcggatgcgtatctgatattctgatttactgg

SEQ ID NO: 4080 - DNA, 1994 bp, Panicum virgatum
tttttcgctccgctcctccgctccccattgcggcattgccctcttccccgtcgcggcctcgcccaccgcgccttcgaggagcttcgaatcgcgatccctccggttcccgcgagctcacatggtgggcgcgtgcgccggaggctagggttcccagttctcatcattcccctgctgattggaaccacagtgtttcggcgagcctgtggcggtggtggaggcggagatgaacggggaggtggaatgcagcgtgtgccacgcgaaggtgccggtgccggcagcggtgtccaaggcgtacgacagccaccggagcaccgtgtcgtcgcgacagcgcgcgctcaacgtgctccttgtctccggcgactgcgtcctcgcgggcctccagcctatactagtgtacatgtcaaaagttgatgggaaattcaaatttagcccgatcagcgtgaacttcttgacggagattacaaaaattatctttgccatcatcatgctatccatccaggctcgacgtctgaaggtgggcgacaagtcacttctcacagtatcaacatttatgcaggctgctcgcaataatgttcttcttgcagttcctgcttttctctatgctaccaacaactatttgaagttcataatgcagttatattttaatcctgcaagcgtgaaaatgctgagtaatctcaaggttttggtaatcgctgtgcttctaaagataataatgaagagacgattttccacaatccagtgggaggcccttgcccttttgttaatcggaatatccgttaatcagctgaaatcattgcctgaaggttctagggcactaggtcttcctgttgcagctggagcctacctatatacactattttttgtaacagttcctgcattggcttcagtttacaatgagaaggctcttaaaagccagtttgataccagtatttaccttcagaacttatttctgtatggttatggtgcaatattcaattttcttgggcttgtaatcactgttatcattcaagggcccagtagctttaacattctggaaggacattcaaaggccacaatgtttcttatctgcaacaatgctgcacaaggcatcctgtcatcatttttcttcaagtatgcagacactattttaaagaagtactcgtcgacaattgcaactatcttcaccggagttgcctctgctgtactgtttggacacactcttacaataaattttgtccttggaatttcaatagtaatcatatctatgcatcagtatctttcgaaccaaattaaggacgaagtgcctagcagcaaagttgaaatggctcaagttcacgatcacagcagagttacggaatctatttgcatcaatgtgactgattcagtggcaagtgaggctaaacaccgccatggatctgacgagaggcagccactccttcctgtatgattttacagcagaggcacaccgtcttgatgagagcagcaggtatccgacctaccttagtggttttctgacctatgtctctgaagccacattgctgccgtgctgttggccgagtaagaacatgcatgttgcacggcagaatgacgagcttcgagtaaaagatgaatgaggccaatacatttaacctagtggtggtaacactaatttgataggattcgcgaggaatggtcctatcgagttttttttttccagttggggcaccaatgtaaatagtagctcgtcttcatattatgtgagagtcgcatgaggagatgttatggcgtatttggtaagctttgaatatgtctttcgatttactacagaggaacgatacaggttgtctagtcgatttctgattttctggtaaaacgttgtctaagagtcgccgcagttctgggtggttcccttacgcctggtgggcaagacggccattgtcgttctgttcgcaaattactcacggccaagaatagtagcatttgttttaactctttatagccagtatactctgactatcaagttctcatatattata

SEQ ID NO: 4081 - DNA, 1620 bp, Brachypodium distachyon
gctcctcattgcccctcttccgtcgcccgctcgcgcctccgagaagcttcgcatcgcgatcgcttccgcctccacgagctcccatggtggatgcgcccaccgacggctagggttccaactcccccccctggttttggcgagcctcttgcggcggaggcggggagatgaacggggaggtggaatgcagcgtgtgccacgcgaaggtagcggtgccggcggcggtgtcgaaggcgtacgacagccaccggagcaccgtgtcgtcgcggcagcgcgcgctcaacgtcctcctcgtctccggtgactgcatcctcgccggcctccagcctatattagtgtacatgtgtaaagtggatgggaaattcaaattcagcccagtcagtgtgaacttcttgacagagatcacaaaagttatctttgccatcatcatgctgttcatccaggctaggcgtctaaaggtgggagagaagccacttcttacagtttcaacatttgtgcaggctgctcgcaacaatgttcttcttgctgttcctgcttttctctatgctatcaacaattatttgaagtttacaatgcagctatatttcaatcccgctacagtgaaaatgctgggtaatctcaaggttctgataatcgctgtactcctaaaggtgatattgagaaggcgtttttccacaattcagtgggaagcccttgctctcttgttaatcggtatatccgttaatcagctaaagtcactgcctgaaggttccactgcacttggtcttcccgttgcagctggagcctacatgtatacactattttttataacagttcctgcattggcttcagtttacaatgaaaaggccctgaaaagccagttcgataccagtatatatcttcagaacttatttctgtatggatatggtgcaatatttaatttccttgggcttgtgatcactgccatcatccaagggcctagtagctttcacattctggaaggacattcaaaggcaacgatgttccttatttgcaacaatgctgcacagggaatactttcgtcatttttcttcaaatatgcagatacaattttgaagaagtactcatcaacaatcgccacaatctttactggggtagcgtctgctgtactgtttggccatactctgactataaattttgttcttggaatatcaatagtaattatatctatgcaccagtatctatctaaccaaattaaggaccaagtgcctagcagtaaagttgagatggctgatgctgaggatcacagcggattaaaggaatctgtatacgtcaaagtcgattcagtggcaggcgaggctaaacaccgacatggatctgaagagagacagccacttcttcccgtctgatgttgtctaagaggttttcgtcttgttgtctagagtgccagaagtgtgcacctgagcatgggaagatttatatagccttttgacctaatgttccccaagccacgctatggcgatgatgtttagaggactatggcacgatggcgagcttgctgaaacactttggggggggggggggggggggggggggacaaaataccggccttgttgtcgtaaactgttgtgatgagatgagcaagaataaatatatttagtccac

SEQ ID NO: 4082 - DNA, 1613 bp, Brachypodium distachyon
ttccactgctcgcctctcctctccgctcctcattgcccctcttccgtcgcccgctcgcgcctccgagaagcttcgcatcgcgatcgcttccgcctccacgagctcccatggtggatgcgcccaccgacggctagggttccaactcccccccctggttttggcgagcctcttgcggcggaggcggggagatgaacggggaggtggaatgcagcgtgtgccacgcgaaggtagcggtgccggcggcggtgtcgaaggcgtacgacagccaccggagcaccgtgtcgtcgcggcagcgcgcgctcaacgtcctcctcgtctccggtgactgcatcctcgccggcctccagcctatattagtgtacatgtgtaaagtggatgggaaattcaaattcagcccagtcagtgtgaacttcttgacagagatcacaaaagttatctttgccatcatcatgctgttcatccaggctaggcgtctaaaggtgggagagaagccacttcttacagtttcaacatttgtgcaggctgctcgcaacaatgttcttcttgctgttcctgcttttctctatgctatcaacaattatttgaagtttacaatgcagctatatttcaatcccgctacagtgaaaatgctgggtaatctcaaggttctgataatcgctgtactcctaaaggtgatattgagaaggcgtttttccacaattcagtgggaagcccttgctctcttgttaatcggtatatccgttaatcagctaaagtcactgcctgaaggttccactgcacttggtcttcccgttgcagctggagcctacatgtatacactattttttataacagttcctgcattggcttcagtttacaatgaaaaggccctgaaaagccagttcgataccagtatatatcttcagaacttatttctgtatggatatggtgcaatatttaatttccttgggcttgtgatcactgccatcatccaagggcctagtagctttcacattctggaaggacattcaaaggcaacgatgttccttatttgcaacaatgctgcacagggaatactttcgtcatttttcttcaaatatgcagatacaattttgaagaagtactcatcaacaatcgccacaatctttactggggtagcgtctgctgtactgtttggccatactctgactataaattttgttcttggaatatcaatagtaattatatctatgcaccagtatctatctaaccaaattaaggaccaagtgcctagcagtaaagttgagatggctgatgctgaggatcacagcggattaaaggaatctgtatacgtcaaagtcgattcagtggcaggcgaggctaaacaccgacatggatctgaagagagacagccacttcttcccgtctgatgttgtctaagaggttttcgtcttgttgtctagagtgccagaagtgtgcacctgagcatgggaagatttatatagccttttgacctaatgttccccaagccacgctatggcgatgatgtttagaggactatggcacgatggcgagcttgctgaaacactttggggggggggggggggggggggggggacaaaataccggccttgttgtcgtaaactgttgtgatg

SEQ ID NO: 4083 - DNA, 2053 bp, Oryza sativa
gggatattcctccgaataattatttattttatatttacataattttttttcccactcctctccctctccgggcctccgctccccgtgtctccccccacctcgccgactcgcgccttctagaatcttcgaatcgcgatcgcctcctcccacctcggcccagcaacgagctccctcccatggtggcctccagaggatagcgggagagatcggaatcgtagggttttgggggaggcggcggtgggggagatgagcggggaggtggaatgcagagtgtgccacgcgaaggtgcaggtgccgatggcggcggcggcggtgtcgaaggcgtacgacatccaccggagctccgtgtcgtcgaggcagcgcgcgctcaacgtcctcctcgtctccggcgactgcgtcctcgccggcctacagcctatattggtgtacatgtgtaaagtggatgggaagttcaaatttagcccagttagtgtaaacttcttgacagagattacaaaaattatctttgccatcatcatgctatgcatccaggccaggcgcctaaaggtgggagagaagccatttctcacagtttcaacattcatgcaggctgctcgcaacaatgttcttcttgcagttcctgctcttttctatgctatcaacaattacatgaagtttgtaatgcagctatattttaatcctgcaacagtgaaaatgttgggtaatctcaaggttctggtgattgctgtgctcctaaaggtgataatgaggaggcgtttctccacaattcagtgggaagcccttgctcttttgttgattggtatatcggttaatcagctcaaatcactgcctgaaggttctagtacacttggtcttcctgttgctgctggtgcctacctatacacattatttttcgtaacagttcctgcattggcttcagtttacaatgaaaaggctctgaaaagccagtttgataccagtatatatcttcagaacttatttctgtatggatatggtgcaatatttaatttcctagggcttgtgatcactgccatcatccaaggtcctagtagctttaatattctggaagggcattcaaaggccacaatgtttcttatttgcaacaatgccgctcagggcatactatcgtcatttttcttcaaatatgcagatacaatattgaagaagtactcatcaacaatcgccacaatctttactggagtagcatctgctgtgttgtttggtcatactctgaccataaattttgttcttgcaatatcaatagtaattatatctatgcatcagtatctctcgaaccaaattaaggatgaagttccgagcagtaaaattgagatgggtgatgctcatgagcacagatcgaaggaatctgtagtcgtcaacgtgtctgattctattgctactgaggctaaacacaggcacggtactgatgagaggcagccacttcttcctgtttgatcctctattcctgagagctgccaactgatacaattcagcttggttccacaccaaggagaagcagcatacatcttaccaacacagtcctcattagagaagtagagagttgaaagcttataatggtgttcatagccttctttttgacctaatgttcgccattttgagttaactgtggcaagaacacctctgcatatctaattcagtggcgcaaccgaatcgtgtgagtttactgatatagagtagcggggggatgaaggataccttcagcgttgttacgtgtgatgagatcacacttacaaagcttgaatcgaagcagcattcatccattccattcgtttgtgttggttttgtagatagcagcagcaatatgttcccttgcaagtcttgcatagtaatttaaacagatgctgttccgtgctgtacttactgtacagttgttgcatgacaagagccgactgatttgctgagaaaggctcgtcctttatggatggattaaatgtgtttttcgagcatcctgcctgggtgtaaagggcaagcgttcgagcgcggaccagaaaagtttatacgtacaaatttttaatattaaaacatttaactt

SEQ ID NO: 4084 - DNA, 1763 bp, Hordeum vulgare
tccagaagcttcgcatcgcgatcgcctcggccgccgcgagctcccgtcccatggtgggcgcgcccgccgccggatagggctgccgcctccccccggttcgtcccggcccggcccgcaattccccgcgatttctcgggcgattcccccggaaccctccgccatttgtcggcgctgctcccccgaaccgcacgcagggttttggcgaggcttttctcggcggaggggatgagcggggaggtggaatgcagcgtgtgccacgccaaggtggccgtgccggcggcggccgtgtccaaggcctacgacagccaccggagcaccgtctcgtcgcggcagcgcgcgctcaacgtcctcctcgtctccggcgactgcgtccttgccggcctccagccgatattggtatacatgtgtaaagtggatggaaaattcaaatttagcccagtcagtgtgaacttcttgacagagattacaaaagttatctttgccatcatcatgctgttcttccaggctaggcgtgtaaaggtgggagagaagccacttctcacagtttcaacatttgtgcaggctgcccgcaacaatgttcttctcgcggtacctgcttttctgtatgctatcaacaattatttgaagtttataatgcagctatactttaatcccgcgacagtgaaaatgctgggtaatctcaaggttctgataatcgctgtgctcctaaaggtgttactgaggaggcgcttttccacaattcagtgggaagcccttgctctgttgttaattggaatatctgttaatcagctgaaatcactgcctgaaggttctactgcacttggtcttcctgttgcagctggggcctacatgtacacactattttttataacagttcctgcattggcttcagtttacaatgaaaaggctctgaaaagccagttcgataccagcatatatcttcagaacttatttctgtatggatatggtgcaatatttaatttccttgggcttgtgatcactgccctcatccaagggcctcgtagctttcacattctggaagggcattcaaaggccaccatgtttcttatttgcaacaatgctgcacaaggcatactatcatcatttttcttcaaatatgcagatacaattttgaagaagtactcatccacaatcgccacaatctttactgggatagcgtctgctatactgttcggtcatactctgactataaattttgttcttggaatatcgatagtaattatatctatgcatcagtatctcgcaaaccaaattaaggatcaagtgccaagcagcaaaattgagatgtctgatgctgaggatgacagattagaggaatctgtaattgtcaaagttgacacggtggcaagtgaggctaaacaccgccatggatctgatgagaggcagccacttcttcccgtctgatgacgtctcggagtaggaatgtgtatcagacaatttcagttcctctgatccatatgtatatccgagctcttcccgtcgacagggagacgagcagcatagatgttgccgacacagcttctgcaactgagcattggatgatttatagccatatagccttttgacctaatgttcgtgaggctgcactatagtgatgatgtttagagtgctattacagaattgattgttgagtggctcggttgtgaacttgctgagatactttagaagggaccaatgccatgatcttgttgtcgtgaaactgatgtgatggatgagggaataaatatattcagcatttcagc

SEQ ID NO: 4085 - DNA, 1939 bp, Secale cereale
gactctccctactgacctcctccctacttccctccgctaccccattagccccccctacggccccttccgcctcgccgcccctcctcgggccttccaggagcttcgtcgtcgcgactcgcctccgccgccgcgagctcccgtcccatggtgggcgcgcccgccggcggctagggctcccgcctccccccccggttcgtcccggcccggcccgcaatttcccgcgatttctggggcgatttccccggaaccctccgccatttgtcggcgctgctcccccgaatcgtacgtagggttttggcgggactcctcctaaggcggaggagatgagcggggaggtggaatgcagcgtgtgccacgccaaggtggccgtgccggcggcggcggtgtccaaggcctacgacagccaccggagcaccgtgtcgtcgcggcagcgcgcgctcaacgtcctcctcgtctccggcgactgcgtcctcgccggtctccagccgatattggtatacatgtgtaaagtggatgggaaattcaaatttagcccagtcagtgtgaacttcttgacagagattacaaaagttatctttgctatcatcatgctgttcttccaggctaggcgtgtaaaggtgggagagaagccactgctcacagtatcaacatttgtgcaggctgcccgcaacaatgttcttctcgcggtgcctgcttttctctatgccatcaacaattatttgaagtttacaatgcagctatactttaatcccgcgacagtgaaaatgctgggtaatctcaaggttctgataattgctgtgctcctaaaggtgttactgaggaggcgtttttccacaattcagtgggaagcccttgctcttttgttaattggaatatctgttaatcagctgaaatcactgcctgaaggttctactgcacttggtcttcctgttgcagctggggcctacctatacacactattttttataacagttcctgcattggcttcagtttacaatgaaaaggctctgaaaagccagtttgatacaagcatatatcttcagaacttatttctgtatggatatggtgcgatatttaatttccttgggcttgtggtcactgccctcatccaagggcctcgtagctttcacattctggaagggcattcaaaggccaccatgtttcttatttgcaacaatgctgcacaaggcatactttcgtcatttttcttcaaatatgcagatacaattttgaagaagtactcatccaccatcgccacaatcttcactgggatagcgtctgctatactgttcggtcatactctgactataaattttgttcttggaatatcgatagtaattatatctatgcatcagtatctcgcaaaccaaattaaggatcaagtaccaagcagcaaaatcgagatgtctgatgctgaggatgacagcagactagaggaatctgtaattgtcaaagttgacacggtggcaagtgaggctaaacaccgccatggatctgatgagaggcagccacttcttcccgtctgatgtcgtctcagaggaatttgtatcgacaatttcagttcctccggtccatatgtatacccgagctcttccctttgacagggagacgagcagcatagatgttgccgacacagcttctgcacctgagcatgggatgatttatatagccctataagccttttgacctaatgttcctgaggctgcaccatggcgatgatgtttagagggagtcctattacagagatgcttgttgagtggctcggttgtgaacttgctgagatactgtagaagggaacggatgccgtgatcttgttgtcgtgaaactgatgtgatggatgagagaataaatatattcaacatttcagcccacattcacattcttttcatccttattttgttgcccaacctggcaacctactgtagtacgtagcaactga

SEQ ID NO: 4086 - DNA, 1621 bp, Secale cereale
accctccgccatttgtcggcgctgctcccccgaatcgtacgtagggttttggcgggactcctccggcggaggaggagatgagcggggaggtggaatgcagcgtgtgccacgccaaggtggccgtgccggcggcggcggtgtccaaggcctacgacagccaccggagcaccgtgtcgtcgcggcagcgcgccctcaacgtcctcctcgtctccggcgactgcgtcctcgccggtctccagccgatattggtatacatgtgtaaagtggatgggaaattcaaatttagcccagtcagtgtgaacttcttgacagagattacaaaagttatctttgctatcatcatgctgttcttccaggctaggcgtgtaaaggtgggagagaagccactgctcacagtatcaacatttgtgcaggctgcccgcaacaatgttcttctcgcggtgcctgcttttctctatgccatcaacaattatttgaagttcacaatgcagctatactttaatcccgcgacagtgaaaatgctgggtaatctcaaggttctgataattgctgtgctcctaaaggtgttactgaggaggcgtttttccacaattcagtgggaagcccttgctcttttgttaattggaatatctgttaatcagctgaaatcactgcctgaaggttctactgcacttggtcttcctgttgcagctggggcctacctatacacactattttttataacagttcctgcattggcttcagtttacaatgaaaaggctctgaaaagccagttcgatacaagcatatatcttcagaacttatttctgtatggatatggtgcgatatttaatttccttgggcttgtggtcactgccctcatccaagggcctcgtagctttcacattctggaagggcattcaaaggccaccatgtttcttatttgcaacaatgctgcacaaggcatactttcgtcatttttcttcaaatatgcagatacaattttgaagaagtactcatccacaatcgccacaatcttcactgggatagcgtctgctatactgttcggtcatactctgactataaattttgttcttggaatatcgatagtaattatatctatgcatcagtatctcgcaaaccaaattaaggatcaagtaccaagcagcaaaatcgagatgtctgatgctgaggatgacagattagaggaatcggtaattgtcaaagttgacactgcggcaagtgaggctaaacaccgccatggatctgatgagaggcagccacttcttcccgtctgatgttgtctctgagtaggagtgcctatcgacaatttcagttcctccggttcatatgtatacccgagctcttccctttgacagggagacgagcagcatagatgttgctgacacagcttctgcgcctgagcgtgggatgatttatatagccctatagccttttgacctaatgttcctgaggctgcactatggcgatgatgtttagagggagtcctattacagagatgcttgttgagtggctcggttgtgaacttgctgagatactgtagaagggaacgaatgccgtgatcttgttgtcgtgaaactgatgtgatggatgagagaataaatatattcaacatttcagc

SEQ ID NO: 4087 - DNA, 1229 bp, Saccharum officinarum
ggtgcaccgccggagtatccgggtcgagacacacgcgcgcgcgcggccttgcccaccgcgccttcgaggagcttcgaatcccgatcgcctcggtccccgcgacctcacatggtgggggcgcgcaccagaggctagggttcccagttcccaccattctcctgctgattggaaccgcggggttttggcgagcctgaggcggtggcggcggcaggaatgaacggggaggtggaatgtagcgtgtgccatgcgaaggtgccggtgccgccggcggtgtcgaaggcgtacgacagccaccggagcaccgtgtcgtcgcggcagcgcgcgctaaacgtgctcctcgtctccggcgattgcgtcctcgccggcctccagcctatattagtgtacatgtcaaaagtggatgggaaattcaaatttagcccaatcagtgtgaatttcttgacagagattacaaaaattatctttgccattgtcatgctattcatccaggctagaggcctaaaggtgggagacaagccactcttcacagtatcaatatttatgcaggctgctcgcaataatgttcttcttgcagtacctgcttttctctatgctatcaacaactatttgaagttcataatgcagttatattttaatcctgctagcgtgaaaatgctgagtaatctgaaagttctagtaatcgctgtgcttctaaagatgataatgaggaggcgattttccataatccagtgggaggcccttgcccttttgttaattggaatatctgttaatcagctgaaatcattgccagaaggttctagtgcactaggacttcctgttgcagctggagcctacctatatacactattttttgtaacagttcccgccttggcttcagtttacaatgagaaggctcttaaaagccagtttgataccagtatttaccttcagaacttgtttctgtatggttatggtgcgatatttaactttcttgggctcatgatcactgccatcatccaagggcccagtagctttaacattctggaaggacactcaaaagcgacaatgtttcttatctgcaacaatgctgcacagggcatactgtcatcatttttcttcaagtatgcagatacaattttgaagaagtactcatcgacaattgctactatcttcactggagtagcctctgctgtattgtttggccacacactgacaataaatttgctcctggaatttcaataagtatcata

SEQ ID NO: 4088 - DNA, 1425 bp, Triticum aestivum
ttaacgtcctcctcgtatccggcgactgcgtcctcgccggcctccagccgatattggtatacatgtgtaaagtggatgggaaattcaaatttagcccagtcagtgtgaacttcttgacagagattacaaaagttatctttgccatcatcatgctgttcttccaggctaggcgtgtaaaggtgggagagaagccacttctcacagtttcaacatttgtgcaggctgcccgcaacaatgttcttctcgcggtgcctgcttttctctatgccatcaacaattatttgaagtttacaatgcagctatactttaatcccgcgacagtgaaaatgctgggtaatctcaaggttctgataattgctgtgctcctaaaggtgttactgaggaggcgtttttccacaattcagtgggaagcccttgctctgttgttaattggaatatctgttaatcagctgaaatcactgcctgaaggttctactgcacttggtcttcctgttgcagctggggcctacctatacacactattttttataacagttcctgcattggcttcagtttacaatgaaaaggctctgaaaagccagttcgataccagcatatatcttcagaacttatttctgtatggatatggtgcaatatttaatttccttgggcttgtgatcactgccctcgtccaagggcctcgtagctttcacattctggaagggcattcaaaggccaccatgtttcttatttgcaacaatgctgcacaaggcatactttcgtcatttttcttcaaatatgcagatacaattttgaagaagtactcatccacaatcgccacaatctttactggggtagcgtctgctatactgttcggtcatactctgactataaattttgttcttggaatatcgatagtaattatatctatgcatcagtatctcgcaaaccaaattaaggatcaagtgccaagcagcaaaattgagatgtctgatgctgaggatgacagattagaggaatctgtaattgtcaaagttgacacggtggcaagtgaggctaaacaccgccatggatctgatgagaggcagccacttcttcccgtctgatgtcgtctcggagttcctccggtccatatgtatatccgagctcttcccctcgacagggagatgagcgatgtcgccaacgcagcgtctgcacctgaagcagagcatgtgatgatttatatagccttgtagccttttgacctgatgttcctgaggctgcactatgatgtttaaaggagtaccatcagagagagatgcccattcggtggcacgatggcgagcttgctgagatactgtagaggggaacaaatgaattgaccttgttgtcgtgaaactgatgtgatggattaaagaataaatatattcagcatttcagcccacattcaaatgttttcatcttttt

SEQ ID NO: 4089 - DNA, 1314 bp, Saccharum officinarum
ccgccacctccgcgccgccgtcgccggcctcagacccggagcagcagcagcagcaggagccgtcctcgtgggaggaggcgccgctgatcccgggcctcccggacgacgcggcgctcaactgcctgctccgcctgcccgtgtcggcccacgacgcgtgcaggctggtgtgccgccgctggcgcgtgctcctcgccgacaaggcccagttcttcgcgcagcggaggcagctgggcctccggacgccctggctcttcacgctggcgttccaccgctgcacgggcaagatccagtggaaggtgctagacctgggccacctcacctggcacgccatcccggccatgccgtgccgcgaccgggcctgcccacgcgggttcggctgcgtcgccatccccggtgccggcgatggcggcgacggcgcgctcctcgtctgcggcggcctcgtctccgacatggactgcccgctgcacctcgtgctcaagtatgacatctataaaaacaggtggaccgtcatgacccggatgctcactgcccggtctttcttcgccggcggcgtgattgatggccgggtttatgttgctggagggtatagcgcggaccagttcgagctcaattctgctgaggttcttgatcctgagaagggtgtttggcagcccattgctagtatggggatgaacatggcgtcgtccgactcggcggtcatcggcggtaggctctatgtcaccgaaggatgcgcttggccattcttctcgtcgccgagaggccaagtgtatgatccgaaaatcgaccggtgggaggcgatgccggttggcatgcgtgaagggtggacggggctaagcgtggtcattgaggggtgcctgtttgtgatttcagagtatgagaggatgaaggttaagtgtatgatccggagacggattcatgggactcagtcagcggccctcggatgcccgagcggattatgaagcccttctcggtcagttgtctcgacagcaagatcgtcgtcgttggacgaggtctccacgtcgcgattggccatgttcagaaggaacctgctggcgatccagctgatagtaggagttcgggctactccatttgctggcaagatgtggatgtccctagggaattcagtgatctcacaccttcaagcagccagatcctgcatgcttagctgctcgttgagcgagccattggtaatctgcagaacgaccgcagctcatcaacctggttgcttactttcccatttgagctgcacaattgctgtgttctgtacagtaggatgttttccagtcaaatatctatgtattatatctggagttg

SEQ ID NO: 4090 - DNA, 2582 bp, Panicum virgatum
aaatcgcaggctgctgcgttcgagctgctagccctagcctgctagtggaggagtggtggtggtactaattggcagctttgacctcacccttctggttctcctatcctttccttccccatcctcttctctctctgcctgctgctggtttggtgtcgctgccgcctgccagtccgtctggtctgctggtggtggtggtagttgttggaacgagagcgtcagctggcagtagagccaatcaatggcggggctggggaggtgaaggtcttcgccgcttccaggagaaggcgccggccccaaccccaaggaacaagaggggtctccaggtgggctgctgtagatccttcctccggcgatcgtttcttttttctctctctactcgtggtcgaggaattggggattttttccccgcagcaagtagcagcacgtttgaggctcgctgctgcaggtaggcagagcatgcgccacgtccgggtgtcctcccaccaggcccccgtccacaagctcggccacgcgcagatggcgctcacgcccaagttccgcctcgccaccgccgcccccgcgccgccctcgcccacggaggcccagcagccggcctgggagacgccgctgatcccggggctccccgacgacgccgcgctcggctgcctcctccgcctccccgtcgaggcgcacgcggcctgccgcctcgtgtgccgccgctggcgccgccacctcgccgacaaggcgcgcttcttcgcgcagcggcgggcgctgggcctccgcaccccctggctcttcaccctcgccttccaccgctgcacgggcaagatccagtggaaggtgctcgacctcggccacctcacctggcacgccatccccaccatgccgtgccgggaccgggcgtgcccccgggggttcggctgcgtcgccatccccagcgacggcacgctcctcgtctgcggcggcctcgtctccgacatggactgcccgctgcacctggtgctcaagtatgacatctacaggaacaggtggaccgtcatgacgaggatgctcgccgcccgctccttctttgccggcggcgtgatcgatggccgggtttatgtcgccggaggctatagcaccaaccagtttgagctcaattccgcggaggttcttgatccggacaagggcgtttggcagccaatcgctagtatgggcatcaacatggcctcctcggactctgctgtcatcagtggtaggctctatgtcactgaaggttgcgcgtggccgttcttctcgtcgccgagaggacaggtttatgatccgaagatcgaccggtgggaggcaatgccggttggaatgcgcgaaggttggacgggacagagtgtggtcatcgatgggcatctgtttgtcatttcagagtatgagaggatgaaggttaagatctatgatccgcagacggattcatgggactcggtcagtggtcctccgatgcccgagcggattatgaagcccttctccgtcagttgtctggacagcaagattgtcgttgttggccgaggtctccatgtagcgattgggtatgttgagaagcaacctgctgctggtggcaattctggtagcaggagttcaagctactccatttgttggcaagatgtggatgttcctaaggaattcagtgatctgacaccttcgagcagccagattctgcatgcttaatttatcttcgagcccgccgtggtgattcatctgcaaaagtaccccagctgatcaaccttctccggtactgtctatgactgatctgatcaactccttaaattgcccctttgagctgtacaattgttgtgttctgtatagtaggctcttttccagtcagatctctatgatctggagctgttgtaccttgttgtaaagaaataaatcgagtttctctagaacagagacaaattaagaccccgttgtaagtatatgcttgtcagttttttttttgagattatatgcttgtcagttcttgaacaggaagttctatttggctgtgtttagatgaggtgaaaaggggagaaaaaaatcacatcagtcactgtagtacactgtagcactttttcgtttgtttgtggtaaatattgtcctaccatgacctaactaggctcaaaagattcgtctcgcaacgtacatcaaaactatacaattagtttttttatttaactacatttagtactccatgcatgagttatttgctatatttaatgtttcgatgtgataggagatgtgatggatgtgatggaaagtttggaaatttggtgggaactaaacacaccctttctttctttggtctttacatttgttagaactgttgctgaatgcactctgccaaatgctgcttgccttgtcgacaagctgatttttttgaaaggaaatgtcgacaagctgatagcataactgtgcttgtaaccaaggctccttctgcaccagatggataacgtaagctgatttgtgattagagtccagagctacaagtaattgattccttcattttacacgtttctgtcattctgtcgtcgatgtgcagtgatgctgtaatatcgtaacgctaccgcttgagtacatgtgctgtgttcacttcc

SEQ ID NO: 4091 - DNA, 2392 bp, Panicum virgatum
tcgacttcgagctgctactcctacccactaccgtgtggtggtggtggtggcattaattggcagctttgactgacctcacccttctagttctccacttctccttcccttccccattctccttctcttcctctctctggctgctgctggtttgggtttggtgtcgctgccggtggctgttggaacgagagcgtcagctgccagtcgcgccaatcaatggcggggccggggaggtgaaggtgctttccccccctctcttcgccgtcgcttcggcttcgagaaggcgccggccccaaccccaacgaagaacaaggtgggctgccgtcgatccttctccttcctccggcgatcgtaggtcgaggaattggggatttttttttgcccccagcaagcagcagcgacgagcctcgctgccgaagcagcaggcggagcatgcgccgcgtccgggtgtcctcggaccaggcccccgtccgcaagctcggcgacgcgcagatggcgctcacgcccaagttccgcctcgccaccgccgccgtccccgcgcccccggagggcccccagcagcagcagctgccggcctgggagacgccgctcatcccggggctccccgacgacgccgcgctcggctgcctcctccgcctccccgtcgaggcgcacgcggcctgccgcctcgtgtgccgccgctggcgccacctcctcgccgacaaggcgcgcttcttcgcgcagcggcgggcgctgggcctccgcgccccctggctcttcaccctcgccttccaccgctgcacggggaagatccagtggaaggtgctcgacctcggccacctcacctggcacgccatccccgccatgccgtgccgggaccgcgcgtgcccgcgggggttcggctgtgtggccatccccagcgacggcacgctcctcgtctgcggcggcctcgtctccgacatggactgcccgctgcacctcgtgctcaagtatgacatctacaggaacaggtggaccgtcatgacgaggatgctcgccgctcgctccttcttcgccggcggcgtcatcgatggccgggtctatgtcgccggaggctacagcaccaaccagtttgagctcaattccgccgaggttcttgatccagacaagtgcgtttggcagcccattgctagtatgggcatcaacatggcctcctcggactctgctgtcatcagtggtaggctgtatgtcactgaaggttgcgcgtggccgttcttctcgtcgccgagagggcaggtttatgatccgaagttcgaccggtgggaggcgatgccggttggaatgcgcgaaggttggacggggcagagtgtggtcatcgatgggcatctgtttgtcatttcagagtatgagaggatgaagattaaaatctatgatcctcagactgattcatgggaatcggtcagtggccctccgatgcctgagcggattatgaagcccttctccgtcagttgtctggacagcaagattgttgtcgttggccgaggtctccatgtagcgattgggcatgttgagaagcaacctgctgctggtgccaattctggtagcaggagtgcaagctactccatttgttggcaagatgtggatgttcctaaggaattcagtgatctgacaccatcaagcagccagattctgcatgcttaatttatcttcgagcccgccgtggtgattcatatgcaaaagtaccccagctgatcaaccttctccggtactatgactgatctgatcaactgtttaaactgcccctttgagctgtacaactgttgtgttctgtatagtaggctcttttccagtcagatctctatgatctggagctcttgtacccgtaaagaaataaatcgagtttctcctgaacagagagacaaactgagaccctgttgtaagtatatgcttgtcagttcttgaacaggaaattctatttggttctttggtctttacattcgttagaattgttgctgaatgcactctcccaaatgctgcttgccttgtcgacaagcagatagcgtaactgtgcttgtaaccaggcttctgcaccagatggaaatcttaagctgatttgtgatcagaattcagagctaaaagtagttgattccttcattttacacgtttctgtaattctgccatcgttgtgcactgatgctgctatatcgtgacactactgcttaagtacatagctagcattctgccctcctgaactctgcaagtataatgctttagttctgtatctgtacctcgcatcgcttcatcacacatggcaacgatttttgaaaagctttgcaactgcagatttttctttgggtatctatttctattttgatgccttttaaccgcataaaggtcgattgtgctacttctccaggggtcaaaaggggagctgaga

SEQ ID NO: 4092 - DNA, 2011 bp, Setaria italica
aggccgaccctattaattgcctgctttgacctcacccttccccttcctctatctggttccggcgtcgctcgctgggctggtggcggtggttggaacgacggcgtcagctgcttcgccgaatccaacacccgaaaccaatggccgcgagctgagctgaggtgaggtcttgtctccgagagaagggcatctgagagattccaagccggcgaggttcaggctgctcgattccccggcgattgaatcctccggaagggcaaggaattgtgtggggggatcttcttcgcgcacgcaggaacaagaacaagccagctgaattcctcgccggcgcagcagcagcaacccggcggagcatgcgccgcgtccgggtctcctcccacaacgcccccgtccacaagctcggcgacgcgcagatggcgctcacgcccaagttccgcctcgccaccaccaacacccccgcgccgccgccgcccccggaggacctgcagcagccggcctgggacacgccgctgatcccgggcctccccgacgacgccgcgctgacctgcctcctccgcctccccgtcgcggcgcacggcgcctgccgcctcgtgtgccgccgctggcaccacctcctcgccgacaaggcccggttcttctcccagcggcgggcgctgggcctccggtccccctggctcttcaccctcgccttccaccgctgcacggggaagatccagtggaaggtgctcgacctcggccacctcgcctggcacgccatcccggccatgccgtgccgggaccgggcctgcccgcgcggcttcggctgcgtcgccgtccccggcgacggcgcgctcctcgtctgcggcggcctcgtctccgacatggactgcccgctccacctcgtgctcaggtacgacgtctacaggaacaggtggaccgtcgtgacccggatgctcgccgcccgctccttcttcgccggcggcgtcattgatggccgggtctatgtcgccggaggctacagcaccaaccagtttgagctcaattcggctgaggttcttgatccggacaagggcgtttggcagccgatcgctagtatgggcataaacatggcttcatctgattcagctgtgatcagtggtaggctgtatgtcactgaaggatgcgcgtggccgttcttctcgtcgccgagagggcagatctatgacccaaagatcaaccagtgggaggcgatgccggtcgggatgagggaaggttggacagggcagagtgtggtcattgacgggcgtctgtttgtgatttcagagtatgagaggatgaaggttaagatctatgatccggagacagattcatgggactcggtcagtggtcctccgatgcccgagcggattatgaagcccttctcggtcagttgtctggacagcaggatagttgtcgtcggccgaggtctccatgtagccattgggtatgttgataagcagcctgctggtggcggcaattctggtaacaggagttcaagctactccgtttgttggcaagatgtggatgttcccaaggaattcagtgatctgacaccttcaagcagccagattctgcatgcttaattcatcttttgagccaccttctccggtactatgatcgatcaactgtttaaactgcccatctgagctgtgcaactggggtgttctgtatagtaggctctttcccagtcagatctctatgatctggagctgttgtattctatacctgtcaagaaataaatcgagtttcttcaaaaccgagggacttatataagtaggtgcttgtcagttcatgaacagtaagttgttctatttctctgtgggtctttatattggtcagaattgtttgctgaatgcattgtgccaaatgcgttttgctttgttgacaaactgatagcataactgcacttgtaacgagtctctctctataaattacttgcagattgcagtacattgcataaatgtgcttattgcagttagcaagctgttgattccttcattttacacgtctatttcac

SEQ ID NO: 4093 - DNA, 2122 bp, Setaria italica
cgcatccacgaccaaaaaatgtggcagagaaaaatggagattgggagacgggattgtggggcccggccaccgagttgaagctgctggtgtggtgactggtgagtgagctgccactgccactgccaggccgaccctattaattgcctgctttgacctcacccttccccttcctctatctggttccggcgtcgctcgctgggctggtggcggtggttggaacgacggcgtcagctgcttcgccgaatccaacacccgaaaccaatggccgcgagctgagctgaggtgaggtcttgtctccgagagaagggcatctgagagattccaagccggcgaggttcaggctgctcgattccccggcgattgaatcctccggaagggcaaggaattgtgtggggggatcttcttcgcgcacgcaggaacaagaacaagccagctgaattcctcgccggcgcagcagcagcaacccggcggagcatgcgccgcgtccgggtctcctcccacaacgcccccgtccacaagctcggcgacgcgcagatggcgctcacgcccaagttccgcctcgccaccaccaacacccccgcgccgccgccgcccccggaggacctgcagcagccggcctgggacacgccgctgatcccgggcctccccgacgacgccgcgctgacctgcctcctccgcctccccgtcgcggcgcacggcgcctgccgcctcgtgtgccgccgctggcaccacctcctcgccgacaaggcccggttcttctcccagcggcgggcgctgggcctccggtccccctggctcttcaccctcgccttccaccgctgcacggggaagatccagtggaaggtgctcgacctcggccacctcgcctggcacgccatcccggccatgccgtgccgggaccgggcctgcccgcgcggcttcggctgcgtcgccgtccccggcgacggcgcgctcctcgtctgcggcggcctcgtctccgacatggactgcccgctccacctcgtgctcaggtacgacgtctacaggaacaggtggaccgtcgtgacccggatgctcgccgcccgctccttcttcgccggcggcgtcattgatggccgggtctatgtcgccggaggctacagcaccaaccagtttgagctcaattcggctgaggttcttgatccggacaagggcgtttggcagccgatcgctagtatgggcataaacatggcttcatctgattcagctgtgatcagtggtaggctgtatgtcactgaaggatgcgcgtggccgttcttctcgtcgccgagagggcagatctatgacccaaagatcaaccagtgggaggcgatgccggtcgggatgagggaaggttggacagggcagagtgtggtcattgacgggcgtctgtttgtgatttcagagtatgagaggatgaaggttaagatctatgatccggagacagattcatgggactcggtcagtggtcctccgatgcccgagcggattatgaagcccttctcggtcagttgtctggacagcaggatagttgtcgtcggccgaggtctccatgtagccattgggtatgttgataagcagcctgctggtggcggcaattctggtaacaggagttcaagctactccgtttgttggcaagatgtggatgttcccaaggaattcagtgatctgacaccttcaagcagccagattctgcatgcttaattcatcttttgagccaccttctccggtactatgatcgatcaactgtttaaactgcccatctgagctgtgcaactggggtgttctgtatagtaggctctttcccagtcagatctctatgatctggagctgttgtattctatacctgtcaagaaataaatcgagtttcttcaaaaccgagggacttatataagtaggtgcttgtcagttcatgaacagtaagttgttctatttctctgtgggtctttatattggtcagaattgtttgctgaatgcattgtgccaaatgcgttttgctttgttgacaaactgatagcataactgcacttgtaacgagtctctctctataaattacttgcagattgcagtacattgcataaatgtgcttattgcagttagcaagctgttgattccttcattttac

SEQ ID NO: 4094 - DNA, 1834 bp, Hordeum vulgare
aaaggttcagctcagccgctttgctgaccctctgttttgtttttgggtggctaaaaggagcaggcagtatcagctagtagtaggaagcaagatagcagggagatttttgcctctcctcctcctgcagacgtctcctcattgaagattccttcaacacactaccaggctctctctccttgcagcaggcatcggttgtatcgatcggcaagcaatccaggtcggcaggtttctttgtccggaaaaaattggggattttttccttgtgcagtcagtgttctgttctccctttctcctctcctcgccataacagaacggagaagattggagacgggcatgcgccgggttcgagtgtcgtcccaccaatctccagtccagaagctgggagattcgcacatgaagctgacgcccaagttccggcttgccgccacggcctcaccgtcctctgaaccggagcaacctccatgggagacgcccctcatgcccggcctcccggacgacgccgcgctcaactgcctcctccggctgcccgtggaggcccacgacgcctgcaggctcgtgtgccgccggtggcgccacctcctggccgacaaggcgcgcttcttcacgcagcggaaggcgatgggcctccggtcgccgtggctcttcaccctcgcgttccaccgctgcaccggcaagatacagtggaaggtgctggacctcgactgcctcacctggcacaccatccccagcatgccgtgccgggaccgggcctgcccccgcggcttcggctgcatcgccatccccggcgacggcgccctgctcgtctgcggcgggctggtctccgacatggactgcccgctgcacctcgtgctcaggtacgacgtttacaagaaccgctggaccgtcatgacccggatgctctcggcgcggtccttcttcgccggcggcgtcatcgacggccgggtgtacgtcgccgggggctacagcacggaccagttcgagctcaactcagcggaggttcttgatccggtcaagggcgtctggcagcccgttgccagcatgggcaccaacatggcttcctcggactccgccgtcatcggcggcaggctttatgtcaccgaaggctgcgcatggccgttcttctcctcgccgagagggcaggtgtacgacccaaagatcgaccgctgggaggcgatgccggttgggatgcgcgaagggtggacagggctgagcgtggtcatcgacggacgcttgttcgtcatctcagagtacgagaggatgaaggtcaaggtctacgatccagagatggattcctgggatcctgtcaacgggcctcccatgcccgagcggatcatgaagcccttgtctgtgagttgcctggacagtaagatcgtcgtcgttggccgaggtctccatgtagtgatcggccatatcaagaagcaatcagctggcaacgccggtggcagcagttcttgtaactacttgattcgttggcaagatgtggaggttcccagggcgttcagcgatctgacaccttcaagtagtcagattttacatgcttgatgactatatatgcatctaaaataagagacagctctggtgatctgcaaagcaaccacagctgatcaaactgtttgcccaacaccccaactatgtcatttaaacgaacaaccatcgattgatgtttctgtatattgttttttattagactctttcctgccatcttctataatttgcaaatgatgtatcagtaaagaaatacagtagtaattctgagaatgtactgttgttgtaagtagatgtttctgggggctcaactaaactagcaaactgttgcattgcacctcttaagcat

SEQ ID NO: 4095 - DNA, 1685 bp, Oryza sativa
ggggaggaggagcttttcctctcctccatactatcttctgttggagaacagcagcaagcagaaaagggaccagggaatcaaaggcttcctgtatagatctttggaggaaagatcctttctttctgcaggaattcagggcattgctggtgtcctcttcagttgtgctaaatctgtgacgagtatgcgccgcgtccgggtctcatcccaccaatctccagtccacaagcttggtgattcacagatgaaattgacacccaaattccggcttgccacaacctccgcattgccgtcgtcgatgccggcctctgatttggagcaagcctcatgggagacacccctcatacctggccttcctgatgatgctgctctcaactgtctcctccggctacctgttgagacccatgaggcatgcaggcttgtgtgtcgccggtggcatcacctcctagctgacaaggcgcggttcttcatgcagaggaaggtgatgggttttcggtcaccgttgttgttcaccctggctttccaccgttgcactggtaagatacagtggaaggtgctggacctgaactacttgacctggcatacaattcctgccatgccgtgtcgggatcgggcttgcccccgaggtttcggttgcgttgctatccccagtgacggcaccctccttgtttgcggcgggttggtctcggacatggattgcccattgcacttggtccttaagtatgatgtttataagaaccgatggaccgtgatgactcgaatgcttgctgcacggtctttctttgcgggtggcgtcattgatggacgggtttatgtagctggaggttatagtactgaccagtttgagctcaattcagcagaggttcttgatccggttaagggtgtgtggcaaccagttgctagtatgggcatgaacatggcatcctcggattctgctgtcatcagtggtaggctttatgtcactgaaggctgtgcatggcctttcttctcctcgccgagaggtcaggtttatgatccaaagattgaccgctgggaggttatgccagttggaatgcgtgaagggtggaccggtttaagtgttgtcatcgacaaacatttgttcgtcatttcagaatatgagaggatgaaggttaaagtctacgatccagaaacggactcatgggactctgtaaaaggccctcctatgcctgaacgaattatgaagccattttcggtgagttgtttggagaataagattgttgttgttggccgaggcctccatgtagctattggccatgtcaagaagcaacctggcagccatcctgatagtaggagctcaagctacttaattcagtggcaagatgtggatgttcctagggaatttggtgatctgacaccttcaaacagtcagattttgtatgcttaactgctgaaaatgccggatctgcagagaggccattgttgttctttcattttatttggccaactgggtaaagccctattctgagctgtaaaattgttctcctctgtatgttagtctctttcccagttaattttacagcctgtaagtgttatgtcagtaaataaataaaaaaattcaagagattgttgtaagtagaagtttgccggtacttgagacaatttgttgtatttgctctttaaactgattttgacttcttgttcagtgcactgccagactctgaatattc

SEQ ID NO: 4096 - DNA, 1939 bp, Brachypodium distachyon
ctgctttggtcactcactctatgtggttggtttggctttgactctcttgttcggcggttggttaagaggagcagcatcggcttggaaaaagaaaattggtgggggcatcttttcctctctcgcagacctcccttcctccctgaatcagaggcagagcttcaggggaaagaaagaggcaggacacaagtctccgtgtagaccccaaggaggcacaccttggttctataagcaattcaggttggtggctgcttcggatgtaaaattgggcgcagttcggtcaagaaattggggaattttaacttctcgagagtaggtgtcgagctcttcttgatgccataattatcctcaccaaaattggagagtgttctgtgggaagacctggattggtgtggtgttcttgaggggatggttgttggtgtcctcctcaattgagcaatttgggacgagcatgcgtcgtgtccgagtctcgtctcaccagtctccagtccacaagctcggcgattcgcagatgaaactgacgcccaagttccggctcgccgccgccgcctctgcattgccatctccgacaccgtcctcggatttcgagccatcgtcatgggagacacccctcattcctggcctccctgacgacgccgcactgaattgcctcctcaggctacctgtggaagcccatgaggcctgcaggctcgtgtgtcgccggtggcaccacctcctggccgacaaggcgcgcttcttcacgcagaggaaggcgatgggcttccggtcgccgtggctcttcaccctggcgttccaccgttgcactggtaagatacagtggaaggtgctggatctgaaccacttaacctggcacaccattcccaccatgccgtgccgggaccgggcttgccctcgggggttcggctgcgttgctatccccagcgacggcacccttctcgtctgcggcgggctggtctctgacatggattgcccgctgcacttggtcctcaagtatgatatttacaagaaccgctggaccgtgatgacccggatgctttcggcacgatctttctttgctggtggcgtgatcgatggacaggtttatgttgccgggggctatagcacagaccagtttgagctgaattcagcagaggttcttgatccggttaagggtgtctggcaaccggttgctagtatgggcatgaacatggcatcatcagattctgctgtcatcagtggtaggctctatgtcactgaaggatgtgcatggcctttcttctcctcgccaagagggcaggtgtatgatccaaagattgaccgctgggaggccatgtcggtcggaatgcgtgaagggtggacaggattaagcgtggtcatcgacgaacgtttgtttgtgatttcagaatatgagaggatgaaggttaaggtctatgatcaggagacggattcatgggattctgtcaatgggcctcctatgcctgagcgtatcatgaaacctttatctgtcagctgcctggacagtaagatagtcgttgtcggccgaggtctccaagtagcgatcggccatgtcaagaggcaacctggcagtggcagcggtgctaacaatacgagctcgagctacttgatttgttggcaagatgttgatgttcctaggacattcagcgatctgacaccttcgagcagtcagatcttgcatgcttaacctgctctaaagctctggcaatctgcaaggtgacaacatcaactgatcaactgcttaaatttgttcagctgttcaaaccgtttatccgggctctacaactgttgttttattatgtgtatattagactttaccatcatatttgtaatgtacgaatgttgtatcagtaaataaataaatcgggacattgctagaagtatcagtagaagttttgtcattggtactgaacaaaattgtcgcatttcgccatttacactaatctga

SEQ ID NO: 4097 - DNA, 1969 bp, Brachypodium distachyon
aagctcagctcagcttagctgctttggtcactcactctatgtggttggtttggctttgactctcttgttcggcggttggttaagaggagcagcatcggcttggaaaaagaaaattggtgggggcatcttttcctctctcgcagacctcccttcctccctgaatcagaggcagagcttcaggggaaagaaagaggcaggacacaagtctccgtgtagaccccaaggaggcacaccttggttctataagcaattcaggttggtggctgcttcggatgtaaaattgggcgcagttcggtcaagaaattggggaattttaacttctcgagagtaggtgtcgagctcttcttgatgccataattatcctcaccaaaattggagagtgttctgtgggaagacctggattggtgtggtgttcttgaggggatggttgttggtgtcctcctcaattgagcaatttgggacgagcatgcgtcgtgtccgagtctcgtctcaccagtctccagtccacaagctcggcgattcgcagatgaaactgacgcccaagttccggctcgccgccgccgcctctgcattgccatctccgacaccgtcctcggatttcgagccatcgtcatgggagacacccctcattcctggcctccctgacgacgccgcactgaattgcctcctcaggctacctgtggaagcccatgaggcctgcaggctcgtgtgtcgccggtggcaccacctcctggccgacaaggcgcgcttcttcacgcagaggaaggcgatgggcttccggtcgccgtggctcttcaccctggcgttccaccgttgcactggtaagatacagtggaaggtgctggatctgaaccacttaacctggcacaccattcccaccatgccgtgccgggaccgggcttgccctcgggggttcggctgcgttgctatccccagcgacggcacccttctcgtctgcggcgggctggtctctgacatggattgcccgctgcacttggtcctcaagtatgatatttacaagaaccgctggaccgtgatgacccggatgctttcggcacgatctttctttgctggtggcgtgatcgatggacaggtttatgttgccgggggctatagcacagaccagtttgagctgaattcagcagaggttcttgatccggttaagggtgtctggcaaccggttgctagtatgggcatgaacatggcatcatcagattctgctgtcatcagtggtaggctctatgtcactgaaggatgtgcatggcctttcttctcctcgccaagagggcaggtgtatgatccaaagattgaccgctgggaggccatgtcggtcggaatgcgtgaagggtggacaggattaagcgtggtcatcgacgaacgtttgtttgtgatttcagaatatgagaggatgaaggttaaggtctatgatcaggagacggattcatgggattctgtcaatgggcctcctatgcctgagcgtatcatgaaacctttatctgtcagctgcctggacagtaagatagtcgttgtcggccgaggtctccaagtagcgatcggccatgtcaagaggcaacctggcagtggcagcggtgctaacaatacgagctcgagctacttgatttgttggcaagatgttgatgttcctaggacattcagcgatctgacaccttcgagcagtcagatcttgcatgcttaacctgctctaaagctctggcaatctgcaaggtgacaacatcaactgatcaactgcttaaatttgttcagctgttcaaaccgtttatccgggctctacaactgttgttttattatgtgtatattagactttaccatcatatttgtaatgtacgaatgttgtatcagtaaataaataaatcgggacattgctagaagtatcagtagaagttttgtcattggtactgaacaaaattgtcgcatttcgccatttacactaatctgacttgttgatgag

SEQ ID NO: 4098 - DNA, 1571 bp, Pennisetum glaucum
gttcaggcagctcgattccccggcgattgattccttctccggaagggcaaggaggaattgggggatcttcttggcgcacgcaggaacgagaacacgaacaagcctgctggattccgcgccggcgccggcagagcatgcgccgcgtccgggtctcctcccaccacgcccccgtccacaagctcggcgacgcgcagatggcgctctcgcccaagttccgcctcgcaaccaccaacacccccgcgccgccgccggcggccccggaggacccgcagcagccggcgtgggacacgccgctcatcccggggctccccgacgacgccgcgctgagctgcctcctccgcctccccgtcgccgcgcacgccgcctgccgcctcgtgtgccgccgctggcaccacctgctcgccgacaaggcccgcttcttctcccagcgccgggcgctgggcctccggtccccctggctcttcaccctcgcctaccaccgctgcacggggaagatccagtggaaggtgctcgacctcggacacctcgcctggcacgccatcccggccatgccgtgccgggacagggcgtgcccgcgcggcttcggctgcgtcgccgtccccggcgacggcgctctcctcgtctgcggcggccttgtctccgacatggactgcccactccacctcgttctcaggtacgacgtctacaggaacaggtggaccgtcgtgacccggatgctcgccgcacgctccttcttcgccggcggcgtcatcgatggccgggtctatgtcgccggaggctacagcaccaatcagtttgagctcaattcggccgaggttcttgatcctgataagggtgtttggcagccgatcgctagtatgggcataaacatggcttcatcagattcggctgtcatcagtggaaggctctatgtcactgaaggatgtgcttggccgttcttctcgtcaccgagagggcagatttatgatccaaagatcgaccagtgggaggcaatgcccgttgggatgagggaaggttggacagggcagagtgtggtcattgacgggcgtttgtttgtcatttcagagtatgagaggatgaaggttaagatctatgatccggagacagattcatgggactcggtcagtggccctccgatgcccgagcaaattatgaagcccttctcgatcagttgtctggacagcaagataattgtcgtcggccgaggtctccatgtagcaatcgggcatatcgagaagcagccatctggtggctgccattctggtagcaggagttcaatctactccatttcttggcaagatgttgatgttcccaaagaattcagtgatctgacaccttcaagcagccagattctgcatgcttaattgatcgtttgagccttgatgatctgcacaaacacccccacctgattatcagccttctccaatgctatgatcgaccaactatttaaaaatttgaactgcccctttgagctgtacaactgttgtgttctgtatagtaggctcttttcctgtcagatctctatgatctgaagctgttgtattctacctgcaaggaaataaatcaagttt

SEQ ID NO: 4099 - DNA, 2232 bp, Zea mays
cttaccggcactctttgcctccgtctgctctgctgccctgctggcttggtctggcgttacggcggcctcgctgctggcgctgttcggtggtttggaccaaccgatcgaggaagactatcgtcatcacccctcctcggcgccactcaccatcaccaccaccaccgggcgtcaagggaagaaggcgtccccgaggccgagcctgctcttaccgggcttggggagcgagcgtccagcaccagcaggctaggccggcggccgattgaattcctcgtcgaggcccccctcggcaataaattggtgcggggatttcctccctgacctaaccggccagccagcaggtcgcggtcgaggttctcttctcggctcgatttcctcccgcggcggagggccggccgggtggagcatgcgtcgcgtgcgggtgtcctcgcaccaggcgcccgtccacaagctcggcgacggccagatgaagctgacgccgaggttccgcctggcggcgaccccggcttcgtcgtcgggtccgcagcaggcgtcgtgggaggcggcggaggcgctgatcccggggctccccgacgacgcggcgctgaactgcctgctgcggctggccgtggagtcccacggcgcgtgcaggctggtgtgccggcgctggcgccatctcctggcagacaaggcccggttcttcgcgcagcggcgggcgctggggctgcgcgcgccgtggctgttcacgctggcgttccaccgctgcacgggcgagatccagtggaaggtgctggacctggggcagcgcagctggcacgccatcccggccatgccgtgccgcgaccgcgcctgcccgcgcgggttcggctgcgtggccgtccctgctgccggcgacggcggggacgcgctcgtggtctgcggcgggctggtctccgacatggactgcccgctgcacctcgtgctccggtacgacgtgtgccggaacaggtgggccgtgatggcgcggatgctggcggcgcggtccttcttcgccggcggcgtcatcgacggccgcgtgtacgtcgcgggagggtacagcgcggaccagttcgagctgagctccgccgaggtgctcgaccccgctggcgccggcgcgtggcggccggtcgccagcatgggggccaacatggcgtcggccgactccgccgtgctcggcggcaggctgtacgtgaccgaggggtgcgcgtggcccttcttctcggcgccgaggggccaggtgtacgacccgagggcggaccggtgggaggcgatgccggcggggatgcgggaagggtggacggggctgagcgtcgtcgtcgcgggacgcctgttcgtcgtctcggagtacgagaggatgaaggtcaaggtgtacgacccggagacggactcgtgggacacggtcggcggcgcccccatgcccgagcgcatcatgaagcccttctcggtgagctgcgtcgacagtaggatcgtagtcgtcgggcgaggcctccacgtcgcgattgggcatgtgcgggaggagcccgctggcggcggtcctggtagcaggggagcgccaggctactccgtttgctggcaggacgtggacgctcctaaggagttcagcgacctgacaccttcgagcagtcagattctgcatgcttagctgcttgttgagccagccagccactgcccactgatgagacgcgcaatcgagtaggatcttttcgagtctctattataaggagggagctggagatgtaaagaaataaaccgaggcttttcaaatcggggagagacgaattgaggctcttctgcctggttgtaagtagatttgcttgtccagtttctccaacatatctgttgctgtgtttcgctctttggtgtttcattggtcagaaaaaagaactgttgctgtcttgctgaatccaccctgcaaaataaacgctcgctgcttcgtagcttgtacgctgcccattgcctagctgttttgcttaatgatagcatgttaggagttgattggggttctggtatcctcatcctgcactctctgcaggtgcaatgcttagcattgcttccgcagtcgtcacacagaatggcaacagttcctgtaaagtttgaacctgcacatcttcttttttgtatgtagggaggtctgtaccctgctggctggttgaatttcactatgtgctttgctgatatgtacttgtatgctagaagatgctttttatctagataaaacgggaacaagaggaggattgg

SEQ ID NO: 4100 - DNA, 1819 bp, Zea mays
agacagcaacagttcttttttttctgaccaatgaaacaccaaagagcgaaacacagcaacagatatgttggagaaactggacaagcaaatctacttacaaccaggcagaagagcctcaattcatctctccccgatttgaaaagcctcggtttatttctttacatctccagctccctccagataatagagactcgaaaagatcctactcgattgcgcgtctcatcagtgggcagtggctggctggctcaacaagcagctaagcatgcagaatctgactgctcgaaggtgtcaggtcgctgaactccttaggagcgtccacgtcctgccagcaaacggagtagcctggcgctcccctgctaccaggaccgccgccagcgggctcctcccgcacatgcccaatcgcgacgtggaggcctcgcccgacgactacgatcctactgtcgacgcagctcaccgagaagggcttcatgatgcgctcgggcatgggggcgccgccgaccgtgtcccacgagtccgtctccgggtcgtacaccttgaccttcatcctctcgtactccgagacgacgaacaggcgtcccgcgacgacgacgctcagccccgtccacccttcccgcatccccgccggcatcgcctcccaccggtccgccctcgggtcgtacacctggcccctcggcgccgagaagaagggccacgcgcacccctcggtcacgtacagcctgccgccgagcacggcggagtcggccgacgccatgttggcccccatgctggcgaccggccgccacgcgccggcgccagcggggtcgagcacctcggcggagctcagctcgaactggtccgcgctgtaccctcccgcgacgtacacgcggccgtcgatgacgccgccggcgaagaaggaccgcgccgccagcatccgcgccatcacggcccacctgttccggcacacgtcgtaccggagcacgaggtgcagcgggcagtccatgtcggagaccagcccgccgcagaccacgagcgcgtccccgccgtcgccggcagcagggacggccacgcagccgaacccgcgcgggcaggcgcggtcgcggcacggcatggccgggatggcgtgccagctgcgctgccccaggtccagcaccttccactggatctcgcccgtgcagcggtggaacgccagcgtgaacagccacggcgcgcgcagccccagcgcccgccgctgcgcgaagaaccgggccttgtctgccaggagatggcgccagcgccggcacaccagcctgcacgcgccgtgggactccacggccagccgcagcaggcagttcagcgccgcgtcgtcggggagccccgggatcagcgcctccgccgcctcccacgacgcctgctgcggacccgacgacgaagccggggtcgccgccaggcggaacctcggcgtcagcttcatctggccgtcgccgagcttgtggacgggcgcctggtgcgaggacacccgcacgcgacgcatgctccgcccggccggccctccgccgcgggaggaaatcgagccgagaagagaacctcgaccgcgacctgctggctggccggttaggtcagggaggaaatccccgcaccaatttattgccgaggggggcctcgacgaggaattcaatcggccgccggcctggtacaatcggtaagtgacgaggaatcaatcgctgcacagctttgactggaaaaataatcgcggagaagaagagaaggggaactggcctagcctgctggtgctggacgctcgctccccaagcccggtaagagcaggctcggcctcggggacgccttcttcccttgacgcccg

SEQ ID NO: 4101 - DNA, 1598 bp, Secale cereale
gactctctgttttggttgggttcgacgctgcctctgttttttgtggctaaaaggagcagtatcggctagaaagaaaccacgatggcagggagatttttgcccctcgtgcagacgtctcccccttgaatcagacacgccaccgggcagcaggaaagagaggcaggagaagagaaggctctcctccttgtagcaggcatcggttctgttctatcagcaagcaaattcaggtcggcagggcgcaaaaagattggggatttctccctgtctgctcaccagaacagaaccaagaagcttggaggcgggcatgcgccgggttcgagtctcgtcccaccactctccggtccagaagctgggcgattcacacatgaagctgacgcccaagttccggctcgccgccaccacctccgatgaaccggagcagcctccatgggagacgcccctcatgccgggcctcccggacgacgccgcgctcaactgcctcctccggctgcccgtggaggcccacggcgcctgcaggctcgtgtgccgccgctggcgccacctcctggccgacaaggcgcgcttcttcacgcagcggagggccatgggtctccgctcgcctctcctcttcacgctggccttccaccgctgcacgggcaagatccagtggaaggtgctggacctcgaccgcctggcctggcacgccatccccgccatgccctgccgggaccgcgcctgcccgcgcggcttcggctgcatcgccgtccccggcgacgccgccgccctgctcgtctgcggcgggctcgtctccgacatggactgcccgctgcacctggtgctcaggtacgacgtctgcgggaaccgctggaccaccatggcccggatgctctcggcgcgctccttcttcgccggcggcgtcatcgacggccgggtgtacgtcgccgggggctacagcacggaccagttcgagctgaactccgcggaggttctcgacccggcgaacggcgtctggcagcccatcgccagcatgggcaccaacatggcctcctcggactccgccgtcgtcgggggcaggctctacgtgaccgaaggctgcgcgtggccgttcttctcgtcgccgagagggcaggtgtacgacccgaaggccgaccgctgggaggcgatgccggccgggatgcgcgaggggtggacggggctgagcgtggtcatcgacggccgcctgttcgtcatttcggagtacgagaggatgaaggtgaaggtctacgatccggagacggactcctgggatcctgtcagcgggcctcccatgcctgagcggatgatgaagcctctgtccgtgagttgcctcgacagtaggatcgtcgtcgtcggccgaggtctccatgtggtgatcggccatgtcaagaagcaatcagctggtgatgattacttggttcgttggcaggatgtggaggttcccacggccttcagcgatctcacgccttcaagcagccagattctgcatgcctaactcttcttctgcctctaaaaaataaaagatctgagtagtctgcaaagccctgttcgatgtttctgtatatttgttattattagactctgtcatcttgcataatctgcaa

SEQ ID NO: 4102 - DNA, 1840 bp, Secale cereale
gggggtaggtcgtccaactgatggtgggacccagtcaccgaacaaggtgttgaaagtgcagaagagaagacggggaaaggttcagctcagccgctttgctgaccctctgtttttggttgggttcgacgctgcctctgttttttgtggctaaaaggagcagtatcggctagaaagaaaccacgatggcagggagatttttgcccctcgtgcagacgtctcccccttgaatcagacacgccaccgggcagcaggaaagagaggcaggagaagagaaggctctcctccttgtagcaggcatcggttctgttctatcagcaagcaaattcaggtcggcagggcgcaaaaagattggggatttctccctgtctgctcaccagaacagaaccaagaagcttggaggcgggcatgcgccgggttcgagtctcgtcccaccactctccggtccagaagctgggcgattcacacatgaagctgacgcccaagttccggctcgccggcacgacctcaccaccgtcctcctctgaaccggagcagcctccatgggagacgcccctcatcccgggcctcccggacgacgcggcgctcaactgcctcctccggctgcccgtggaggcgcacggcgcctgcaggctcgtgtgccgccgctggcgccacctcctggccgacaaggcgcgcttctttacgcagcgcaaggccatgggcctccgctcgcctctcctcttcacgctggccttccaccgctgcacgggcaagatccagtggaaggtgctggacctggaccgcctcgcctggcacgccatccccgccatgccctgccgggaccgcgcctgcccgcgcggcttcggctgcatcgccgtccccggcgacgccgccgccctgctcgtctgcggcgggctcgtctccgacatggactgcccgctgcacctcgtgctcaggtacgacgtctgcgggaaccgctggaccgtcatggcccggatgctctcggcgcgctccttcttcgccggcggcgtcatcgacggccgggtgtacgtagccgggggctacagcacggaccagttcgagctgaactccgcggaggttctcgacccggccaacggcgtctggcagcccatcgccagcatgggcaccaacatggcctcctcggactccgccgtggtcggcggcaggctctacgtcaccgaaggctgcgcgtggcccttcttctcgtcgccgagagggcaggtgtacgacccgaaggccgaccggtgggaggcgatgccggccgggatgcgcgaagggtggacggggctgagcgtggtcatcgacgggcgcctgttcgtcatttcggagtacgagaggatgaaggtgaaggtctacgacccggagacggactcctgggatgctgtcagcgggcctcccatgcctgagcggatgatgaagcctctgtccgtgagttgcctcgacagcaggatcgtcgtcgtcggccgaggtctccatgtggtgatcggccatgtcaagaagcaatcagctggtgatgattacttggttcgttggcaggatgtggaggttcccagggccttctccgatctcacgccttcaagcagccagattctgcatgcttaactcttcttctgcctctgaaaaataaaagctctcggtagtctgcaaagccctgttcgatgtttctgtatatttgttagtattattagactatgtcatcttgtataatctgcaaatgatgatgtatcagtaaggaaacaattcgaaactgtattgtactgttgttgtaagtagatgtttctgcctgtctgggtactgaactaaactgactaaaaccatggcatttcaacttcttaacaaa

SEQ ID NO: 4103 - DNA, 1852 bp, Avena sativa
agctgcttcctcatcctctggtttgacccaactcggtggttaagaggaaagagaaatggcagggagatcttttgctctcctgcagacctcccctccttgaatcagagcgcaccaccacgcagggagcctcggctcgctcagcgattcaggttggctgcttctttgaaatgctatggatgtaacactgccaataaattggggagttttccttgtgcaagaatagtgttgccattctcttcgccgtagtagaactaacattggagggtgttctggggaaaaacttgggtttgtgtgttcatctgctggctgttcaggagatggtcgttggtgtcttcctcaatcttgcaatctgagacgagtatgcgccgcgttcgagtctcatctcaccagtctcctgtccaaaagcttggtgattcacagatgaaactcactcccaagtttcggcttgccacagcctccgcattgccaccgccgacaccatccgctgattttgataattgttcatgggagactcccctcatacctggcctcccagacgacgccgcgctcaattgcctcctccggctacctgtggaggcccatgatatgtgcaggctcgtgtgtcgacggtggcaccacctcctggcagacaaggcgcgcttcttcacgcagaggaaggcgatgggcttccgatccccgtggttgttcaccctggcattccaccgatgcactggtaagatacagtggaaggtgctggacctagactgcttaacctggcacacgattcccaccatgccgtgccgggaccgggcttgcccccgtgggttcggctgcattgctatccccagcgatggaacccttcttgtctgcggtgggcttgtctccgacatggattgcccgttacacttggtactcaagtatgatgtttacaagaaccgctggaccgtgatgacccgcatgctttcggcacggtctttctttggtggtggcgtgatcgatggacgggtctatgttgctgggggctatagcacagaccagtttgagctgaattcagcagaggttcttgatccggttaagggtgtctggcaatcggttgctagtatgggcaccaacatggcttcatcagattctgctgtcatcaaaggtaggctttatgtcactgaaggctgtgcatggcctttcttctcctcgcctagagggcaagtgtatgatccaaagattgaccgctgggaggcgatgccagtaggaatgcgtgaaggatggaccggattaagtgtggtcatcgacgagcgtttattcgtcatttcagaatacgagaggatgaaggttaaggtctatgatgcagagatggattcatgggattctgtaaacggcccacctatgcctgaacgaattatgaaacctttgtctgtgagttgcctggacagtaagattgtcgttgtcggccgaggcctccaagtagcaattggccacatcaagaagcaatctggcagtggtagcagttctaatcatagggcttcgagctacttgattcgttggcaagatgtggacgttcctagggcattcagtgatctgacgccttcaagcagtcagatcttgcatgcttaactgcctctaaagctctcgtaatctgcaaagagagcacagctgataaattatctcaatatgattgtacaactgttgtattctgtatattagactctttcttcctgctatgtcctataatctgtaaatgttgtatcagtaaggaaataattcaagacattgttgtaagtagtactagatgtttgtgggtactgaacaaaactgttctgtttgactctttacgctgatctgactctttgttgagcgcactcatgctcaagttgtaaga

SEQ ID NO: 4104 - DNA, 1703 bp, Triticum aestivum
aagcacgatggcagggagatttttgcccctcctcctgcagacgtctcctccttgaatcagacacaccacgccacaccaccaggcaggaaaaggaggcaggagaagagaaggctctcctccttgtagcaggcatcatcggttctatcagcaagcaattcaggttggcagggcgcaaagaaattggggatttttccgtgtgcagtcagtgttcttggagacgggcatgcgccgcgttcgagtctcgtctcaccactctccggtccagaagctgggcgattccgacatgaagctgacgcccaggttccggctcgccggcaccacctcaccgtcctcaaccgaaccggagcagcaacctccatgggagacgcccctcatcccgggcctcccggacgacgcggcgctcaactgcctgctccggctgcccgtggaggcccacggcgcctgcaggctcgtgtgccgccgctggcgccacctgctggccgacaaggcgcgcttcttcacgcaccgcaaggccatgggcctccgctcgccctggctcttcacgctcgccttccaccgctgcacgggcaagatccagtggaaggtgctggacctcgactccctcgcctggcacgccatccccggcatgccctgccgggaccgggcctgcccccgcggcttcggctgcatcgccgtccccggcgaggacgccgcccacctgctcgtctgcggcgggctcgtctccgacatggactgcccgctgcacctggtgctgaagtacgacgtttgcaagaaccgctggaccgtcgtgccccggatgctctcggcgcgctccttcttcgccggcggcgtcatcgacggccgcgtgtacgtcgccgggggatacagcacggaccagttcgagctggactcggcggaggtcctcgacccggtgaacggcgtgtggcagccgatcgccagcatgggcgccaacatggcctcctcggactccgccgtcatcggcggcaggctctacgtcaccgagggctgcgcgtggcccttcttctcgtcgccgagagggcaggtgtacgaccccaaggccgaccgctgggaggcgatgccggccgggatgcgcgaggggtggacggggcagagcgtggtcatcgacggacgcctcttcgtcatttcagagtacgagaggatgaaggtgaaggtctacgatccggagatggattcctgggaccctgtcgacgggcctcccatgcccgagcggatcatgaagcctctgtccgtgagctgcctggagagtaagatcgtcgtcgttggccgtggtctccatgtggtgatcggccatgttaagaagcaatcttcttgtgattacttggttcgttggcaggatgtggaggttcccagggcgttcagcgatctcacgccttcgagcagtcagattttacatgcttaaaactctgcctccagaatgaaagctctcgtagtctgcaaaaaagccttgtttcatattcgtgtatgttgttactattagtggactctttcctgctgtcatcttgtatatataatctgcaaatgatgatgtatcagtgaagaaacagttcgaaactgtactgtactgttgttgtaagtagtatagatgtttctgggtactgaactaaacttaactgttgcatttcacttcttatcttacactgatccgactggctgctgaatttcaaacagatggatactaactt

SEQ ID NO: 4105 - DNA, 1826 bp, Zea mays
tgttcgagcagagccccatcccctgatccccgtgccaggccgctcggccctcgacgccgtgagtcaggcaggcaggcgcctctttctgtccctccactcgggtctccacgccgccgccgccgccgccgcctcgaccgccccacgcatccgccgctcctctacccatcctcggcccgcggcccagggagaagaccgcacgggcgggcgagatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcaaacagtcttgccatcttaactgatgcggcgcaccttctttctgatgtggcagcatttgccatatcgttattctctctctgggctgctggatgggaagcaacaccgcagcagtcatatgggttcttccggattgagattcttggtgccttggtctccattcagctcatatggctacttgctggcatactggtatatgaggctattgtaaggctcattaacgagagtggcgatgtgcagggctccctcatgtttgctgtgtcggcgtttggactgtttgtcaacattataatggctgtattgctaggccatgaccacgggcacggccatggacacagccatggacatccacatgaccatggtcatggtgattcagacgatggccattctcaccatgaagaaccagaacagggccatgttcatcatcatgagcatagccatggaagttctattactgtcacaacacatcaccaccaccactcaggcactggacaacaccatgacgctgaggagccactgatcaagcacgaggccgactgtgagggcacccaatctgctgctaagaagcctcgacgcaatataaacgtacacagcgcttaccttcatgtgcttggggactccatccagagcatcggggtgatgatcggcggggctatcatctggtacaagcccgagtggaaaatcatcgatctgatctgcaccctcatcttctcggtggtcgtgctgttcaccacgatcaggatgctgcgcaacatcctcgaggtcctgatggaaagcacgccccgtgagatcgacgccaccaggctggagagggggctctgcgagatggaaggcgtggttgccgtccacgagctgcatatctgggccatcacagtggggaaggtgctactggcttgccatgtgacggtcgccagggaagccgacgcagacgagatccttgacaaggtgattgggtacatcaagacggagtacaacatcagccatgtgaccattcaggtcgagcgtgaatagagggggagctgtcttttgggctgtcagggcataaatggcgtcacgccttcactggttatcttactctgtcggttaaaacttttttttggcacctgggaaggcatcaggcagccatcggagtcttgatgtgcttgcaagttcatctgtggttcaagctttgatggtcagtagtgttatctgttactactagtctattaggcgggggtaggcgtcaaccagtgtgtacgggtttgattttcggtcatgctgttaacagcattgcggttcgtcgaactggatatgtagtttagtacgctgtgtcatcacctcttgtgtaagggaacgcttcttttctgtggtatggaagatgtgaacttcgtgattggcctgtta

SEQ ID NO: 4106 - DNA, 2910 bp, Panicum virgatum
ctttggattgcctgacgaccgaaaattaccaggttgcccctcggttcctcttcctcttctggccccttccctcgccccttgtggctggtgtcccgcctccacgccacgagatataagtataaccgccgcctgccagccccgcgacacccccaagcctcgacgcgttccgccccgtgagccagcgccaggcgcccctctccggttgggtgcggccgggttcgggtctcgacgccgccgcagacgacccccccccccccgccccatctcggcgggcggcgggagatcgcgaccacgaggtacgcaccggcatcgtctctcttctctctctgcatccgcatccgcgtctcacctgaaatcccaatccggcgccgccgctcgagcgggcgacccggccgggaagagcggggagcgaaagcggcgcggcgcggcccctgattgcagcgacgctcccgatctgatgatgctcgcgcgctgggtggcggcaatcgctgccccgggccccccaccaccgatcggtgagggagggcgccgccactctaacctcgctagggaattcccgtagttggtatggagttttgtcggacggatggtgctttgttgattgatttgggggaaaggacgaatgccgcggtcggggtcacggcgagggatcaaaacgaatcttcattccgtcgatccgacaactacgtgggcgtcaattgccggtcgttttctccgcattattcttcaggactgcgattccgttggtcttccccccttgtccgggaccgcgcgacgtggtggataggttcactcagtagggtagggtcggctggttccatcgtatcatcatgctgctcggctacttcgcttctttcatgtcatgtcaaatgccaccgctgcgtggtaagtgtaccagtactgtgtgtccgtggttgtgttttggtggcttctagacggagatgttcctctgattactctctcccgtggtgtctacaaataccaccagcccgtggttgattccagatggggaacggcagtccagtggttcgcgtgtcatttgttttggctgagttacataggaaatcttgggttgcagagtcatcgttgtcgctgaatctttgtttgatggaaagccatagttcatcacatcctcagattgctgaagtgaaaatggacatctcaccatcagcttctggagcagcagggaacaaaatctgcagaggtgctgcctgtgatttctctgattccagtaacagctcgaaagatgccaaggagagatccgcatccatgaggaagcttataattgctgtgatcctttgcatcgtattcatgacagtggaagtggttggaggcatcaaagcaaacagtcttgcaatcttaactgatgcagctcatcttctttctgacgtggcagcttttgccatatcattattctctctttgggctgctggatgggaagcaacaccacaacagtcttacgggttctttcgtattgagattcttggtgcattggtctccattcagctcatatggctgcttgctggcatactcgtatatgaggctattgtaaggctcattaatgagagcggtgaggtgcagggctccctcatgtttgctgtatcagcttttggattgtttgtcaacatcataatggctgtactgctagggcatgatcatggacacggccatggccatggccatggacattcgcatgatcatagccatggtgattcagatgatgaccattcacaccatgaagaacaagaacagggccatgtgcatcgccacgagcacagccatggaagttctattactgtcacaacccatcaccaccaccacccaagcactggacaacatcatgatgctgaggaaccattgcttaagcatgaagccagctgtgagggcacccaatctgctgccaaaccagctaagaaacctcgccgcaatatcaatgtacacagtgcttatcttcatgtgcttggagattcaatccagagcatcggggtaatgataggtggggctatcatctggtacaagcctgagtggaagatcatcgatctcatctgcaccctcatcttctctgtggttgtactgtttaccacaatcaggatgctgcgcaacatacttgaagtactgatggagagcactccccgtgagattgatgccaccaggctcgagatggggctctgcgagatggatggtgtggttgctgtccacgagcttcatatctgggccatcacagtagggaaggtgctcctagcatgccatgtgacaatagcaagggaagccgatgccgatcagatccttgacaaggtgatcggatacatcaagacagagtacaacatcagccatgtgaccattcagattgagcgtgagtagggatataaagggtgtcttcgctggttatcttgttcatgtcagttaatactgctttttgcaccaggtaaggcatcagccactcaaccgagccataatgtgctcacaggttcatcagctttgatgctggttaatataatctattactagtctattaggtgaaggagttattcgggtggcgtagttgtcggtctgtgcattcacatggatgaatttttcggacatgttgtgagttcatcgaattgcatctgtagtgagaaataatttagcaacctgtgtcgtcacctttgtgtaagataatgtttatggcatgaaaggtatgaagttagtgagtggaatatgaccgtttgttttgagctctgctttgcttgttgcaattgaacggagcgagccggaaaggcacgcttctcagctgaccactgaattctcggtggctgttacactttgcctatgatgggtctgtgcacctttgttccttgtctctattgctatgtacatctgctgggacaagcagatgggaagttcttttttttccctcgagtggaattactc

SEQ ID NO: 4107 - DNA, 2035 bp, Setaria italica
tttggctcgtgttccgccgcctcctcggggcctcgccacaccgggccacgcgacgcgccaccagagatataaccgccgcactgccagccctgcgacaccccccacgcgcctcccctaccccgtcccttcccgaggcggagacccgtgccgccttcgtcccttctctccggttgggtcgggtcgggttctcgacgccgccgcgaacgccccgctgctcggctcctgcccctctcgccggacggcggcgcggggaagctcgcaaccacgagatggaaagccataattcatcacatcatcagattgctgaagtgaaaatggatatctcaccatcagcttctggagcagcagggaacaaaatctgcagaggtgctgcctgtgatttctctgatgccagtaacacctcgaaagatgccaaggagagatttgcatccatgaggaagcttataattgctgtgatcctttgtatcatattcatgacagtggaagtggttggaggcattaaagcaaacagtcttgcaatcttaactgatgcagctcatcttctttctgatgtggcagcatttgccatatcgttattctctctctgggctgctggatgggaagcaacaccacagcagtcttacgggttcttccggattgagattcttggtgcattggtctccattcagctcatatggctgcttgctggcatactcgtatatgaagctattgtaaggctcattaatgagagcgacgaggtgcagggctccctcatgtttgctgtatcagcttttggattgtttgtcaacatcataatggctgtactgctagggcatgaccatggacatggccatggacacagccatggtcatggacattcgcatgaccatggccatggtgattcagatgaccattcacaccatgaagaacaagagcagggccatgtgcatcgccatgagcacagccatggaagttctattactgtcaccacccatcaccaccaccacccaagcactggacaacatcatgatgctgaggaaccattgcttaagcatgaagctggttgtgagggtacccaatctgctgccaaagctgctaagaagcctcgccgcaatatcaatgtacacagtgcttatcttcacgtgattggggattccatccagagcgtcggggtcatgatcggtggggctctcatctggtataagcctgagtggaagatcattgatctcatctgcaccctcatcttctctgtggttgtactgttcaccacaatcaggatgctgcgcaacattcttgaagtactgatggagagcactccccgtgagattgatgccaccaggctcgagagggggctctgtgagatggatggtgtggttgccgtccacgagcttcacatctgggccatcacagtggggaaggtgcttctagcatgccatgtaacaatcgcaagggaagctgatgctgatcagatccttgacaaggtgattgggtacatcaagacggagtacaacatcagccatgtcaccattcagatcgagcgcgagtagggttgtctttaggctgtcagggcataaatggtgtcgcgtcttcactggttatcttgttctgttgggtactagtttttgcaactgggaagacgttggacagtcacccaagccataatgtgttcacaagttcatcttgattctagctttgaatgctgggtagtatcgtctattactagtctattaggtgaaggaaatattcggggtggtgtagtcgtcagtcagtgcattcacatggatgaaattttcggacttgctgttaactccttgtgggttcatcgaatttgcacctgtagtttagtaccctgtttcatcacctttatgtaagatgatgtttctggcatggaagatatgaagttagtgcttggcctattaccgtttgtcttgaactctgctttgcttgttgcagttgaatggagggagccttaaacgcatttctttctgcttacttgtgaatactcggtggctgttaagactgtttgccttcgtgtgaacactttcgtatgatgggg

SEQ ID NO: 4108 - DNA, 1981 bp, Setaria italica
ctttggctcgtgttccgccgcctcctcggggcctcgccacaccgggccacgcgacgcgccaccagagatataaccgccgcactgccagccctgcgacaccccccacgcgcctcccctaccccgtcccttcccgaggcggagacccgtgccgccttcgtcccttctctccggttgggtcgggtcgggttctcgacgccgccgcgaacgccccgctgctcggctcctgcccctctcgccggacggcggcgcggggaagctcgcaaccacgagatggaaagccataattcatcacatcatcagattgctgaagtgaaaatggatatctcaccatcagcttctggagcagcagggaacaaaatctgcagaggtgctgcctgtgatttctctgatgccagtaacacctcgaaagatgccaaggagagatttgcatccatgaggaagcttataattgctgtgatcctttgtatcatattcatgacagtggaagtggttggaggcattaaagcaaacagtcttgcaatcttaactgatgcagctcatcttctttctgatgtggcagcatttgccatatcgttattctctctctgggctgctggatgggaagcaacaccacagcagtcttacgggttcttccggattgagattcttggtgcattggtctccattcagctcatatggctgcttgctggcatactcgtatatgaagctattgtaaggctcattaatgagagcgacgaggtgcagggctccctcatgtttgctgtatcagcttttggattgtttgtcaacatcataatggctgtactgctagggcatgaccatggacatggccatggacacagccatggtcatggacattcgcatgaccatggccatggtgattcagatgaccattcacaccatgaagaacaagagcagggccatgtgcatcgccatgagcacagccatggaagttctattactgtcaccacccatcaccaccaccacccaagcactggacaacatcatgatgctgaggaaccattgcttaagcatgaagctggttgtgagggtacccaatctgctgccaaagctgctaagaagcctcgccgcaatatcaatgtacacagtgcttatcttcacgtgattggggattccatccagagcgtcggggtcatgatcggtggggctctcatctggtataagcctgagtggaagatcattgatctcatctgcaccctcatcttctctgtggttgtactgttcaccacaatcaggatgctgcgcaacattcttgaagtactgatggagagcactccccgtgagattgatgccaccaggctcgagagggggctctgtgagatggatggtgtggttgccgtccacgagcttcacatctgggccatcacagtggggaaggtgcttctagcatgccatgtaacaatcgcaagggaagctgatgctgatcagatccttgacaaggtgattgggtacatcaagacggagtacaacatcagccatgtcaccattcagatcgagcgcgagtagggttgtctttaggctgtcagggcataaatggtgtcgcgtcttcactggttatcttgttctgttgggtactagtttttgcaactgggaagacgttggacagtcacccaagccataatgtgttcacaagttcatcttgattctagctttgaatgctgggtagtatcgtctattactagtctattaggtgaaggaaatattcggggtggtgtagtcgtcagtcagtgcattcacatggatgaaattttcggacttgctgttaactccttgtgggttcatcgaatttgcacctgtagtttagtaccctgtttcatcacctttatgtaagatgatgtttctggcatggaagatatgaagttagtgcttggcctattaccgtttgtcttgaactctgctttgcttgttgcagttgaatggagggagccttaaacgcatttctttctgcttacttgtgaat

SEQ ID NO: 4109 - DNA, 1789 bp, Pennisetum glaucum
cagcgaacgcccgccgctcggctcccgcccctctcgccggacggcaccgccgccggggaccccgccaaccacgagatggaaagccacaattcatcacaccatcagattgctgaagtgaaaatggacatctcatcatcagcttctggagcagcagggaacaaaatctgcagaggtgctgcctgtgatttctctgatgccagtaacacctcaaaagatgcaaaggagagattagcatccatgaggaagcttataattgctgtgatcctttgtatcatattcatgacagtggaagtggttggaggcattaaagcaaacagtcttgcaatcttaactgatgcagctcatcttctttctgatgtggcagcatttgccatatcattattttctctttgggctgctggatgggaagcaacaccacagcagtcttacgggttcttccggatcgagattcttggtgcattggtctccattcagctcatatggctgcttgctggcatactcgtatatgaggctattgtacggctcattaatgagagtggggaggtgcagggctccctcatgtttgctgtatcagcgtttggattgtttgttaacatcataatggctgtactgctaggccatgaccatggacatggtcatggacacagccatggtcatggccacggacattcacatgaccatggcgatggtgattcagatgatgaccattcacaccatgaagaacaagagcagggccatgtgcatcgccacgagcacagccatgggacttctattactgtcaccacccatcaccaccaccacccaagcaccggacaacatcatgatgttgaggaaccattgcttaaggatgaagctggttgtgagggtacccaatctgctgccaaaactgccaagaagtctcggcgcaacatcaatgtacacagtgcttatcttcacgtgattggggattccatccagagcgttggcgtcatggttggtggggctctcatctggtacaagcctgagtggaagattattgatctcatctgcaccctcatcttctccgtgattgtactgttcaccacaatcaagatgctgcgcaacattcttgaagtactaatggagagcactccccgtgagattgatgccaccaggctcgagaggggcttgtgcgagatggatggtgtggttgccgtccacgagcttcatatctgggccatcactgtggggaaggtgcttctagcatgccatgtgacaatcgcaagagaagccgatgctgatcagatccttgacaaggtgattgggtacatcaagacggagtacaacatcagccacgttaccattcagatcgagcgtgagtagggttgtccttaggctgttgggggcataaatggtgtcgcgtctcttcactggttatcctgttctcttgggtactaattttttttgcacctgcgaagacgttagacggtgatccaggccataatgtgtttacaatctcatcttgattctagctttcatgctgggtagtatcgtctactagtaagtctgttaggtgaaggaaatattcagggtggtgaagtcggcaggcactgcattcacatggatgaaattttcggacgtgctgttaactccttgtgggttcatcgaatttgcacccgtagtttagtaccctgtgtcatcacctttatgtaagatgatgtttctggcatggaagatgtagtgcttggcctatgaccgtgtgtttgaacgctttgcttgttgcagtttaatgagggagctttagaacgcatctctctgctgacttgtgaat

SEQ ID NO: 4110 - DNA, 2108 bp, Panicum virgatum
ccccgcgacacccccacgcctccctccctgtccgtcccttcccgaggcggagacccgtgccgcgcctcgcctcgcctcgcctcgcctctgttccaccccgtgagccagcgccaggcgccctcctccggttgggtccggccgggtttcgggtctcgacgccgccgcagacgaccccccctgcccatctcggcgggcggcgaccacgagatggaaagccatagttcatcacatcctcagattgctgaagtgaaaatggacatctcaccgtcagcttctggagcagcagggaacaaaatctgcagaggtgctgcctgtgatttctctgattccagtaacagctcgaaagatgccaaggagagatccgcatccatgaggaagcttataattgccgtgatcctttgtatcatattcatgacagtggaagttgttggaggcatcaaagcaaacagtcttgcaatcttaactgatgcagctcatcttctttctgatgtggcagcttttgccatatcactattctctctttgggctgctggatgggaagcaacaccacaacagtcttacgggttctttcgtattgagattcttggtgcattggtctccattcagctcatatggctgcttgctggcatactcgtatatgaggctattgtaaggctcattaatgagagcggcgaggtgcagggctccctcatgtttgctgtatcagcttttggattatttgtcaacatcataatggctgtacttctggggcatgaccatggacacggccatggccacagccatggtcatggccatggacattcacatgatcatagccatggtgattcagatgatgaccatgaagaacaagagcagggccatgtgcatcgccacgagcacagccatggaagttctattactgtcacaacccatcaccaccaccacccaagcactggacaacatcgtgatgctgaggaaccattgcttaagcatgagggtacccagtctgctgccaaatctgctaagaaacaacgccgaaatatcaatgtacacagtgcttatcttcacgtgcttggagattcgatccagagcgtcggggtaatgattggtggggctatcatctggtacaagcctgagtggaagatcattgatctcatctgcaccctcatcttctctgtgattgtactgttcaccacaatcaggatgctgcgcaacatacttgaagtactgatggagagcactccccgtgagattgatgccaccaggctcgagatggggctctgcgagatggatggtgtggttgctgtccacgagcttcatatctgggccatcacagtagggaaggtgctcctagcatgccatgtgacaatagcaagggaagccgacgctgatcagatccttgacaaggtgatcggatacatcaagacagagtacaacatcagccacgtgaccattcagatcgagcgcgagtagggatatctttaggctgccagggcataaatggtgtctttgccggttatcttgttcatgtcggctaatactgctttttgcaccggggaaggcatcagacagtcaatcgagccacaatgcgctcacagctttgatgctgggtactatcatctattactagtctattaggtgaaggaattattcgggtggtgtagttgtcagtctgtgcattcacatggatgaatttttcggacatgttgttaacgccttgtgggttcatcgaactgcatctgtagtgagaaatagtttagcaccctgtgtcgtcacctttgtgtaagataatgtttctagcatgaaaggtatgaagttagtgagtggactatggccgtttgttttgagctctgttttgctttgttgcaattgaatggagcgagccggaaaggcacgctctcatctgaccactgaattctcggtggctgttacactttctttgcctatgatgggtctgtgcacctttgttcctctattgccatgtagtatatctgttttccaatgtacatctgctgggacaagcagatgcgaagttttttttcctctctcgagtgaaattactgttactcacacgtacaatatctaatgtcttaaaatactgaggaaagtggtgggaaacggttatgttc

SEQ ID NO: 4111 - DNA, 1879 bp, Zea mays
ggctccagctttgcgtctgtggccaaccaggcgcctccctcccaccacccggctctccacgccgccgccgccgccgccacaagcgaccgcgcatccgctcttctccctcccttcgctctcggcggccggcgatgggggagaccgtacgggcgggcgacgttgcaatcacgactcacgagatggagagccacaacccatcgcactctcagatcgccgaagtgacgatggacatcgcagcgtcagcttctggagcggcagggagcaagttctgcaagggcgcagcctgcgacttctccgacgccagcaactcctcgaaggacgccagggagaggtcggcgtcgatgaggaagctgatagtcgcggtggtcctctgcgtcgtattcatggcggtggaggtggtggggggcatcaaggcgaacagcctggccatcctgaccgacgcggcgcacctcctgtcggacgtggcggcgttcgccatctcgctgttctcgctctgggccgccgggtgggaggcgacgccgcggcagtcgtacgggttcttccgggtggagatcctcggcgccctcgtctccatccagctcatctggctgctcgccggcatactggtgtacgaggccgtcgtgaggctcgtcggcgagagcggcgacgtgcgggggtcgctcatgttcgccgtgtcggcgttcgggctggtcgtcaacgttctcatggccgtgttgctgggccatgaccacggccatggacatggacattcgcatgaccatggccacgttcatggggattcggacgatggccattcccaccacgacgacgaggagcaagaacagggccgtgtccatcaccacgagcacggccatggaggcgctatcactgtcacaacccaccaccaccaccatcatcacgatcacgatgttgaggaggcgctgatcaagcatgagggtacccagtctgctggcagagctggtaagaagcctcggcggaacatcaacgtgcacagcgcatacctccacgtgctcggggactccgtccagagcgtcggggtcatggtgggcggggcgatcatctggtacaagccggagtggaaggtcatcgacctcatctgcacgctcgtcttctcggtggtggtgctgttcaccacgatccggatgctgcgcagcatcctcgaagtgttgatggagagcacgccccgcgagatcgacgccaccaggctggagagcgggctctgcgggatggagggcgtggtggccgtccacgagctgcacatctgggccatcacggtgggcaaggtgctgctggcgtgccatgtgaccatcgccagggatgcggacgctgatgagatccttgacaaggtgatcgggtacatcaagacggagtacaacatcagccatgtgaccatccaggtcgagcgcgagtagggagctctgtctttggctgctgtcttgggcataaatggctggcgccattcgagctctggtgtgctcggtggtgttgtctattgctagtctattaggcaggccgggggaattttttgcgtggtggtggtggcggtggtggtcgtcagtcagtcagtcggtgcataaacaaggatgaaattttcggtaatgctattgacagcatcgtggttcatcgaactgcatattctagtacgctgtgccgtcacatcttgtgtaaggtcacgtttctgtgctgcggtatggaagatgtgaagttcgtggttggcatgttgctatttgttctgagcatgccttgtcgtttcagtcgaatggacttgtgggaaaaaaaactcggccagatggtggcgtggaggtacgcctgtggatgggttatatctatatttattacttttattattaagggcctgtttggttggagtgtgagtgtg

SEQ ID NO: 4112 - DNA, 1820 bp, Oryza sativa
gcatcctaccccccgttctctcctccccatctccaacgcacgcacgcgccatcaccaccacctcgacgccggcggcgacgaccacggcgacggcaacggcggcggcggcagagaagccctcctcatccccaagatggacagccataactcagcacctccccagattgctgaagtgagaatggacatctcatcatctacttctgtagcagctgggaacaaagtttgcagaggtgctgcttgtgacttttctgattccagtaatagctcaaaagatgcaagggagagaatggcgtcaatgaggaagctcattattgctgtgatcctttgcatcatattcatggcggtcgaagtggttggaggtatcaaagcaaacagtttggcaatcttgactgatgcagcccatctcctttcggatgttgcggcctttgccatatctttgttctctctttgggcagctggatgggaagctacaccacagcagtcatatgggtttttccgtatagaaattcttggtgccctggtttctattcagctcatatggctccttgctggtattcttgtctatgaagctattgtaaggctcattaatgaaagtggtgaggtccagggctccctcatgtttgctgtctcagcattcggcttatttgttaacatcataatggctgtcttgcttggtcatgaccatggacatggacacggacatggtcatgggcatggacattcccatgaccatgatcatggtggttctgaccatgaccatcaccaccatgaagatcaagagcatggccatgtacatcaccacgaagatggccatggtaattcaattaccgtcaatctccatcaccatccaggcactggacaccaccaccatgatgctgaggaaccattgctcaagagtgatgctggttgtgacagcacccaatctggtgccaaggatgccaagaaggctcgtcgtaatatcaatgtacacagtgcttatctgcatgtgcttggggattcaatccagagcatcggtgtgatgattggaggggctatcatctggtacaagcccgagtggaagattattgatctcatctgcaccctcatcttctccgtgatcgtactcttcaccacaatcaagatgctgcgcaacatccttgaggtcctgatggagagcacgccccgcgagatcgatgccaccagccttgagaatggcctccgcgacatggacggtgtggttgcagtacatgagctgcacatctgggccataacggtggggaaggttctcctggcgtgccatgtgacaatcactcaggacgcagacgctgatcaaatgctggacaaggtgattgggtacatcaagtctgagtacaacatcagccatgtgaccattcagattgagcgcgagtaggcttgaccgcttgagacaggtaggtagtgttgatgatagaacggatcatcttcatctcatctcatgggaccaacttatcaggaacctgtttcactggttttatgcagttactgttagctctgcagtgcaaatcagatcagcagagtccaacaattcctgcaggttcatctgaatgttagcttctgatgctgtttattactataagtacgtgttattagtactatcttagtcaattaggtgagttgatgttaatcagtttcgtagtcggttgtattcacatgggtgcagttttcagacaagttttcaggcacctgtgagtacgtcaacctgccttctgcgtctgtagtctagcgcccagccgtactagtttttatgtaaatctgcactggcatgggaaataataaccaagtttcgtttggccttataatga

SEQ ID NO: 4113 - DNA, 1855 bp, Secale cereale
cgaaccgcctccctccctcccgtcgcgtctcaccaaaccccgtggcggcggcggcggcggcggcgctgctcctgccgaggctccgtccatccagatggacagccataattctgcaccgccccatgttcctgaagtaaccatggacatctcatccgcttctggagcagctgggaacaaagtttgcagaggtgctgcttgcgacttttctgacgccagtaacacctcgaaagattcaaaggagaggtctgcatccatgaagaagctcctaattgctgtgatcctttgtgttatattcatggcggttgaagtggttggaggcatcaaagcaaacagtcttgcaatcttgactgatgctgcccatctcctttcggatgttgcagcctttgccatatctttgttctccctatgggcagctggttgggaagcgacacctcagcagtcatatggatttttccgtatagagattcttggggcattggtttccattcagcttatatggctccttgctggcatacttgtctatgaagctattatgaggctgattaatgaaagtggcgaggtacagggctccctcatgtttgccgtatcagcttttggtttgtttgttaacatcataatggcagtgttgcttggtcatgaccatgggcacggtggacatgggcacagccatggtcatggccatggacattcacatgaccatgatcatggtaactcagaggatgaccattcccatcatggagatcatgagcagggccatgtacatcaccatgagcacagccatggtacttctattaccgtcacaactaatcatcactctcattcgagcactggacaacatcaggatgttgagcaaccattgcttaaacatgatggtggttgtgagagtgcccagcctggagccaagcctgctaagaagcctcgccgcaatatcaatgttcacagtgcctatctgcatgtaattggagactccatccagagcatcggcgtaatgattggaggggctctcatctggtacaagcctgaatggaagattattgatctcatatgcaccctcatcttctctgtgattgtactgttcaccacaatcaggatgattcggaacatacttgaagttcttatggagagcacgccccgtgagatcgatgccaccaggcttgagagtggactccgtgagatggaaggcgtgattgcggtccatgagctgcacatctgggctatcacagtggggaaggtgctcttggcatgccatgtgacgatcacgcaggatgcggatgctgataaaatgcttgacaaggtcattgggtacatcaaggcagagtacaacatcagtcatgtgaccattcagattgagcgagagtaaggcacatgtcaggtagttgaggataaaggtgtgcctgttagcggtttatcatcttaatgcggttaatgttagatttgcacttgcaaaggcgttgcaggttcatctagctgttgcctctggtgctggagaaatattatatgtacgtgtttccattagcccattagttaaatgaactattaatcgggtggtgtagtcgtttatattcacatggatgcaattttcagacagtttttgagccttgtgagtttatcaacctgcacgtgtagtttcagcggcaccctttcttatcagtttatataaagatctgctatggtacggatgttatcaagtttctgttagctgtgataagctttgcttccagcactcgaatggaggaaggtggaagtagtactccctgtttatatgtttgaatttgcacttttgtgccactgtgtggtttctggtagggaatgtaggtcatcatggtgacacaaatgaaactcactgttgtagttt

SEQ ID NO: 4114 - DNA, 2088 bp, Triticum aestivum
agcggcgtgccgtggcggattaatcaatcactccgcttcgctttgttggtctccttcgcgtcgagtacttatccatcccagctgcccctactagcctagcctcccgtggtgccaaactccaatttgtgttcgcttttttccgtcattccgcgcagcatcttgtgacccgaataatgtccgtttctgaattagctgtgtctactaccagattggtgaatatttgggtagaagaggcatcttttttctctgcgactgaatgccgggtatctgattgatctccggtaatttgatggacagccataattctacgtcgccccatgttcctgaagtaaccatggacatctcatccgcttctggagcagctgggaacaaagcttgcagaggtgctgcttgcgacttttctgacgccagtaacacctcgaaagattcaaaggagaggtctgcatccatgaagaagctcctaattgctgtgatcctttgtgttatattcatggcggttgaagtggttggaggcatcaaagcaaacagtcttgcaatcttgactgatgctgcccatctcctttcggatgttgcagcctttgccatatctttgttctccctatgggcagctggttgggaagcgacacctcagcagtcatatggatttttccgtatagagattcttggggcattggtttccattcagcttatatggctcctcgctggcatacttgtctacgaagctattatgaggctcattaatgaaagcggcgaggtacagggctccctcatgtttgctgtatcagcttttggtttgtttgttaacatcataatggcagtgttgcttggtcatgaccatgggcacggtggacatgggcacagccatggtcatggccatggacattcacatgaccacgatcatggtaactcagaggatgaccattcccatcatggagatcatgagcagggccatgtacatcaccatgagcacagccatggtacttctattaccgttacaactaatcatcactctcattcgagcactggacaacatcaggatgttgagcaaccattgcttaaacatgatggtgattgtgagagtgcccagcctggagccaagcctgctaagaagcctcgccgcaacatcaatgttcacagtgcctatctgcatgtaattggggactccatccagagcatcggcgtaatgattggaggggctctcatctggtacaagcccgaatggaagattattgatctcatatgcaccctcatcttctctgtgattgtactgttcaccacaatcaagatgattcggaacatacttgaggtccttatggagagcacgccccgcgagatcgatgccaccaggcttgagagtggtctccgtgagatggaaggtgtgattgctgtccatgagctgcacatctgggctatcacagtggggaaggtgctcttggcatgccatgtgacgatcacgcaggatgcggatgctgataaaatgcttgacaaggtcattgggtacatcaaggcagagtacaacatcagtcatgtgaccattcagattgagcgagagtaaggcacatgtcaggtagttggggataaaggtgtgtgcctgttaacggtctatcatcttaatgccggttaatgttagacttgcacttgcaaaggcgttgcaggttcatctagctgttgcctttggtgctggagaaatattatatgtacgcgttttcgttagcccattagttgaatgaactattaatcgggtggtgcagttgtttgtattcacatggatgcaatttccagacaatttttgagccccttgtgagtttatcaacctgcatgtgtagtttcagtgacaccctttcttagcactctatgtaaagatctgctacggtatggacagtactgggtatggatgtttattcagtttctgttagctttactaagcttgcttccagcagtttttatgtgcgaatttgcaccttgtgccattgtgtgctttctgtcagggatgtaggtcatctggtgcctaaaatgaagtgcactgctgccagttttaatgcatccattccactattgcacatagaaaggagcaaagtgaattctttc

SEQ ID NO: 4115 - DNA, 1627 bp, Avena sativa
agatggatagccataatcactcaccgtcccatgtccctgaagtaacaatggacatttcatccgcttctggagcagctgggagcaaagcttgcagaggtgccgcttgcgacttctcacacaccagtaacacctcgaaagatgcaaaggagagatctgcgtccatgaggaagctcctgattgctgtgatcctttgcgttatattcatggcagttgaagtggttgggggcatcaaggcaaacagtcttgcaatcttgactgatgcagcccatctcctttcagatgttgcagcatttgccatatctttgttctctctatgggcagctggttgggaagcgacacctcagcagtcatatggatttttccgtatagagattcttggggccttgctttccattcagcttatttggctccttgctggcatacttgtctatgaagctatcaataggctcctcactgaaagcggcgaggtacagggctccctcatgtttgctgtatcagcttttggcttgtttgttaacatcataatggcagtgttgcttggtcacgaccatgggcacggagggcatgggcacagccatggtcatgaccatggacattcacatgatcatgatcacggtcactcggaggatgaccattcccatcatgaagatcatgagcagggccatgttcgccatgagcacagccacggtacttctataaccgtcacaactcatcagcactctcattcaagcagtggaatacatcatgatgctgaggaaccgttgcttaagcatgatggtgattgtgagagtgcccagcctggtgccaaggcagctaagaagccgagccgtaatatcaatgtacacagtgcttatctgcatgtcatcggggattccatccagagcattggcgtaatgattggagggggtctcatctggtacaagcctgagtggaagattattgatctcatatgcaccctcatcttttctgtgattgtcctgtttaccacagtcaagatgattcggaacattcttgaagttctgatggagagcacgccccgcgagatcgatgccaccaggcttgagagtggtctccgtgagatggaaggtgtggttgctgtccatgagctgcacatctgggctatcacggtggggaaggtgctcttggcgtgccatgtgaccatcactcaggatgcggatgctgatcaaatgcttgacaaggtcattgggtacatcaaggcagagtacaacatcagtcatgttaccattcagatcgagcgtgagtaataaagatcacgtcaggtagttggggataaaaagcgcgcctgttcatggtttatcttctcaaatgaggttattattagttttgcacttgcaaaggcgttgcaggttcatctagctgttatctttggcgctggagaaatattatatgtatgagttatcgttagtttgttagatgaatgaactattatctcggtgtagtccttgtgttctcatggatgcaattttcagacaatttttgagcccctttgtgagttcatcgacctgcatgtgtagttctgcagcatccttttttattttatgtaaagatcggctatggcatggatgttatcaagttcttttagccgttttgagctttttcttcctgc

SEQ ID NO: 4116 - DNA, 1488 bp, Avena sativa
agatggacagccataatcactcaccgtcccatgtccctgaagtaacaatggacatttcatccgcttctggagcagctgggagcaaagcttgcagaggtgccgcttgcgacttctcacacaccagtaacacctcgaaagatgcaaaggagagatctgcgtccatgaggaagctcctgattgctgtgatcctttgtgtcatattcatggcagttgaagtggttgggggcatcaaagcaaacagtcttgcaatcttgactgatgcagcccatctcctttcagatgttgcagcatttgccatatctttgttctctctatgggcagctggttgggaagcgacacctcagcagtcatatggatttttccgaattgagattcttggggccttgctttccattcagcttatatggctccttgctggcatacttgtctacgaagctatcaataggctcctcactgaaagcggcgaggtacagggctccctcatgtttgctgtatcagcttttggcttgtttgttaacattataatggcagtgttgcttggtcacgaccatgggcacggagggcatgggcacagccatggtcatgaccatggacattcacatgatcatgatcacggtcactcggaggatgaccattcccatcatgaagatcatgagcagggccatgttcgccatgagcacagccacggtacttctattacagtcacaactcatcagcactctcattcaagcagtggaatacataatgatgctgaagaaccattgcttaagcatgatggtgattgtgagagtgcccagcctggtgccaaggcagctaagaagcctagccgtaatatcaatgtacacagtgcttatctgcatgtcatcggggattccatccagagcattggcgtaatgattggagggggtctcatctggtacaagcctgagtggaagattattgatctcatatgcaccctcatcttttctgtgattgtcctgtttaccacagtcaagatgattcggaacatacttgaagttctgatggagagcacgccccgcgagatcgatgccacaaggcttgagagtggtctccgtgagatggaaggtgtggttgctgtccatgagctgcacatctgggctatcacggtggggaaggtgctcttggcgtgccatgtgaccatcactcaggatgcggatgctgatcaaatgcttgacaaggtcattgggtacatcaaggcagagtacaacatcagtcatgttaccattcagatcgagcgcgagtaataagaaacacgtcaggtagttggggataaaaagcgcacctgttcatggtttatcttctcgaatgcggttattgttagttttgcacttgcaaaggcattgcaggtccatctagctgttatctttggcgctggagaaatattatatgtatgagttatcgttagtttgttagatgaatgaactattatctgggtgtagtccttgtgttctcatggatgcaattttc

SEQ ID NO: 4117 - DNA, 1696 bp, Avena sativa
ggtccctccaaaactctgcggcggcggcaggtgacggagccgctgctgtttttgccgagtctcactccagatggacagccataatcactcaccgctccatgtccctgaagtaacaatggacatttcatctgcttctggagcagctgggaacaaagcttgcagaggtgccgcttgcgacttttctgacaccagtaacacctcgaaagatgcaaaggagagatctgcgtccatgaggaagctcctgattgctgtgatcctttgtgttatattcatggcagttgaagtggttggaggcatcaaagcaaacagtcttgcaatcttgactgatgcagcccatctcctttcagatgttgcagcatttgccatatctttgttctctctatgggcagctggttgggaagcgacacctcagcagtcatatggatttttccgtatagaaattcttggggcattgctttccattcagcttatatggctccttgctggcatacttgtctacgaagccatcaataggctcctcactgaaagcggcgaggtacagggctccctcatgtttgctgtatcagcttttggcttgtttgttaacatcataatggcggtgttgcttggtcacgaccatggacacggcgggcatgggcacagccatggtcatgaccatggacattcacatgaccatgatcatggtcactcagaggatgaccattcccatcatgaagatcatgagcagggccatgttcgccatgagcacagccatggtacatctataaccgtcacaactcatcagcactctcattcaagcagtggaatacataatgatgctgaagaaccattgcttaagcatgatggtgattgtgagagtgcccagcctggtgccaaggcagctaagaagcctagccgtaatatcaatgtacacagtgcttatctgcatgtcatcggggagttccatccagagcattggcgtaatgattggagggggtctcatctggtacaagcctgagtggaagattattgatctcatatgcaccctcatcttttctgtgattgtcctgtttaccacagtcaagatgattcggaacatacttgaagttctgatggagagcacgccccgcgagatcgatgccacaaggcttgagagtggtctccgtgagatggaaggtgtggttgctgtccatgagctgcacatctgggctatcacggtggggaaggtgctcttggcgtgccatgtgaccatcactcaggatgcggatgctgatcaaatgcttgacaaggtcattgggtacatcaaggcagagtacaacatcagtcatgttaccattcagatcgagcgtgagtaataaggatcacgtcaggtagttggggataaaaagcgcgcctgttcatggtttatcttctcgaatgcggttattgttagttttgcacttgcaaaggcgttgcaggttcatctagctgttatctttggcgctggagaaatattatatgtatgagttatcgttagtttgttagatgaatgaactattatctgggtgtagtccttgttctcatggatgcaattttcagacaaattttgagcccctttgtgagttcatcgacctgcatgtgtagctctgcagcatcctttcttatcacttatgtaaagatctgctatggcgtggatgttatcaagttcttttagccgttttgagctttttcttcctgc

SEQ ID NO: 4118 - DNA, 1769 bp, Avena sativa
gcctccgtccaggaccgtttgagcgcgcacggaggcgaagactgattgggatcctggacggacgacctcgcgtcttcgcccgccgctcccctggagagtggagctcactcgccggtgagctggccgccggaccaagatggacagccataatcactcaccgtcccatgtccctgaagtaacaatggacatttcatccgcttctggagcagcagctgggaacaaagcttgcagaggtgcagcttgcgacttctctgacaccagtaacacctcgaaagatgcaaaggagagatctgcgtccatgaggaagctcctgattgctgtgatcctttgcgttatattcatggcagttgaagtggttgggggcatcaaggcaaacagtcttgcaatcttgactgatgcagcccatctcctttcagatgttgcagcatttgccatatctttgttctctctatgggcagctggttgggaagcgacacctcagcagtcatatggatttttccgtatagagattcttggggccttgctttccattcagcttatttggctccttgctggcatacttgtctatgaagctatcaataggctcctcactgaaagcggcgaggtacagggctccctcatgtttgctgtatcagcttttggcttgtttgttaacattataatggcagtgttgcttggtcacgaccatgggcatggagggcatgggcacagccatggtcatgaccatggacattcacatgatcatgatcacggtcactcggaggatgaccattcccatcatgaagatcatgagcagggccatgttcgccatgagcacagccacggtacttctataaccgtcacaactcatcagcactctcattcaaacagtggaatacataatgatgctgaagaaccattgcttaagcatgatggtgattgtgagagtgcccagactgatgccaaggcagctaagaagccacgccgtaatatcaatgtgcacagtgcttatctgcatgtgattggggattccatccagagcattggcgtaatgattggagggggtctcatctggtacaagcctgagtggaagattattgatctcatatgcaccctcatcttctctgtgattgtcctgtttaccacagtcaagatgattcggaacatacttgaagttctgatggagagcacgccccgcgagatcgatgccaccaggcttgagagtggtctccgtgagatggaaggtgtggttgctgtccatgagctgcacatctgggctatcacggtggggaaggtgctcttggcgtgccatgtgaccatcactcaggatgcggatgctgatcaaatgcttgacaaggtcattgggtacatcaaggcagagtacaacatcagtcatgttaccattcagatcgagcgtgagtaataataatcacgtcaggtagttggggataaaaagcgcacctgttcatggtttatcttctcgaatgcggttattgttagttttgcacttgcaaaggcattgcaggttcatctagctgttatctttggcgctggagaaatattatatgtatgagttatcgttagtttgttagatgaatgaactattatctcggtgtagtccttgtgttctcatggatgcaattttcagacaattttttagcccctttgtgagttcatcgacctgcatgtgtagttctgcagcatcctttcttatcacttatgtaaagatcggctatggcatggatgttatcaagttcttttagccgttttgagctttttcttcctgcagt

SEQ ID NO: 4119 - DNA, 1579 bp, Brachypodium distachyon
cctcctctcctctcctctgcggcggcgaccccggctgcggcttcccctcctcctcctcctcctcggcgggagcccttctcctcgcagatggacagccataattcaccaccgccccatattcctgaagtaacaatggacatctcatctgcttctggagcagcagggaacaaaatgtgcagaggtggagcctgcgacttttctgactctagtaacacctcgaaagatgcaaaggacagatctacctccatcaggaagctcctaattgctgtgatcctttgcgttatattcatggctgttgaagtggttggaggcatcaaagcaaacagtctttcaatcttgactgatgcagcccatctcctctctgatgttgcagcctttgccatatctttgttctctctatgggcagctggttgggaagcgacgccccagcagtcatatgggtttttccgtatagaaattcttggcgcaatggtttccattcagcttatatggctccttgccggcatacttgtctatgaagctattatgaggctccttaatgaaagtggcgaggtacagggctccctcatgtttgctgtatcagcttttggcttgtttgttaacatcataatggcagtcttgcttggtcacgaccatgggcatggcggacacgggcacagccatggtcatagccatggacatgataactctgaggttgaccacctttcccatcatggagatcatgaggagggccatgtacaccaccatgagcacagccatggtacttctataaccgttacaacccggcagcactctcattccagcactggacaacatcaggatgccgaggaaccattgcttaagcatgacggtgattgtgagagcgcacatcctggtgccaagaagcctcgtcgcaatatcaatgtacacagtgcctatctgcatgtaattggggactccatccagagcgtcggcgtaatgattggaggggctctcatctggtacaagcccgaatggaagattattgatctcatatgcacactcatcttctccgtgatcgtactgtttaccacaatcaggatgatccggaacatacttgaagtcctgatggagagcactcctcgcgagatcgacgccacgaggctcgagaatggtctacgaggaatggaaggcgtgatcgccgtccatgagctgcacatctgggcaatcacagtggggaaggtgctcttggcgtgccatgtgacgatcacgcaggaagcgaatgccgatcaaatgcttgacaaggtcattgggtacatcaaggcagagtacaacatcagtcatgtgaccattcagatcgagcgcgagtgaagcatgtcaggcagttgggcataaaagcacgcttgtaaacagtttatcttatgtacttatgtggatttattgtttttgagcctccttgtgagttcatcaagctgcatgtgtagttcagcagcacccttttcttatcacttatgtaagatctgctatggcatggatgctgtcaagttcctgtttagcaaatactctccttttttttgcgggtgaaaaactatatgcatgatttccacagacacttgggtat

SEQ ID NO: 4120 - DNA, 1592 bp, Brachypodium distachyon
caaatgtcgtcctcttcctcctctcctctcctctgcggcggcgaccccggctgcggcttcccctcctcctcctcctcctcggcgggagcccttctcctcgcagatggacagccataattcaccaccgccccatattcctgaagtaacaatggacatctcatctgcttctggagcagcagggaacaaaatgtgcagaggtggagcctgcgacttttctgactctagtaacacctcgaaagatgcaaaggacagatctacctccatcaggaagctcctaattgctgtgatcctttgcgttatattcatggctgttgaagtggttggaggcatcaaagcaaacagtctttcaatcttgactgatgcagcccatctcctctctgatgttgcagcctttgccatatctttgttctctctatgggcagctggttgggaagcgacgccccagcagtcatatgggtttttccgtatagaaattcttggcgcaatggtttccattcagcttatatggctccttgccggcatacttgtctatgaagctattatgaggctccttaatgaaagtggcgaggtacagggctccctcatgtttgctgtatcagcttttggcttgtttgttaacatcataatggcagtcttgcttggtcacgaccatgggcatggcggacacgggcacagccatggtcatagccatggacatgataactctgaggttgaccacctttcccatcatggagatcatgaggagggccatgtacaccaccatgagcacagccatggtacttctataaccgttacaacccggcagcactctcattccagcactggacaacatcaggatgccgaggaaccattgcttaagcatgacggtgattgtgagagcgcacatcctggtgccaagaagcctcgtcgcaatatcaatgtacacagtgcctatctgcatgtaattggggactccatccagagcgtcggcgtaatgattggaggggctctcatctggtacaagcccgaatggaagattattgatctcatatgcacactcatcttctccgtgatcgtactgtttaccacaatcaggatgatccggaacatacttgaagtcctgatggagagcactcctcgcgagatcgacgccacgaggctcgagaatggtctacgaggaatggaaggcgtgatcgccgtccatgagctgcacatctgggcaatcacagtggggaaggtgctcttggcgtgccatgtgacgatcacgcaggaagcgaatgccgatcaaatgcttgacaaggtcattgggtacatcaaggcagagtacaacatcagtcatgtgaccattcagatcgagcgcgagtgaagcatgtcaggcagttgggcataaaagcacgcttgtaaacagtttatcttatgtacttatgtggatttattgtttttgagcctccttgtgagttcatcaagctgcatgtgtagttcagcagcacccttttcttatcacttatgtaagatctgctatggcatggatgctgtcaagttcctgtttagcaaatactctccttttttttgcgggtgaaaaactatatgcatgatttccacagacacttggg

SEQ ID NO: 4121 - DNA, 1456 bp, Avena sativa
acctcgcgtcttcgcccgccgctcccctggagagtggagctcactcgccggtgagctggccgccggaccaagatggacagccataatcactcaccgtcccatgtccctgaagtaataatggacatttcatccgcttctggagcagcagctgggaacaaagcttgcagaggtgcagcttgcgacttctctgacaccagtaacacctcgaaagatgcaaaggagagatctgcgtccatgaggaagctcctgattgctgtgatcctttgcgttatattcatggcagttgaagtggttgggggcatcaaggcaaacagtcttgcaatcttgactgatgcagcccatctcctttcagatgttgcagcatttgccatatctttgttctctctatgggcagctggttgggaagcgacacctcagcagtcatatggatttttccgtatagagattcttggggccttgctttccattcagcttatatggctccttgctggcatacttgtctatgaagctatcaataggctcctcactgaaagcggcgaggtacagggctccctcatgtttgctgtatcagcttttggcttgtttgttaacatcataatggcggtgttgcttggtcacgaccatgggcacggagggcatgggcacagccatggtcatgaccatggacattcacatgatcatgatcacggtcactcggaggatgaccattcccatcatgaagatcatgagcagggccatgttcgccatgagcacagccacggtacttctataaccgtcacaactcatcagcactctcattcaagcagtggaatacatcatgatgctgaggaaccgttgcttaagcatgatggtgattgtgagagtgcccagcctggtgccaaggcagctaagaagccgagccgtaatatcaatgtacacagtgcttatctgcatgtcatcggggattccatccagagcattggcgtaatgattggagggggtctcatctggtacaagcctgaatggaagattattgatctcatatgcaccctcatcttctctgtgattgtcctgtttaccacagtcaagatgattcggaacattcttgaagttctgatggagagcacgccccgcgagatcgatgccaccaggcttgagagtggtcttcgtgagatggaaggtgtgattgctgtccatgagctgcacatctgggctatcacggtggggaaggtgctcttggcgtgccatgtgaccatcactcaggatgcggatgctgatcaaatgcttgacaaggtcattgggtacatcaaggcagagtacaacatcagtcacgttaccattcagatcgagcgcgagtaataaggagcatgtcaggtagttggggataaaaagcgcacctgttcatggtttatcttctcgaatgcggctattgttagttttgcacttgcaaaggcattgcaggttcatctagctgtta

SEQ ID NO: 4122 - DNA, 1828 bp, Avena sativa
gaggaccgtttgagcgcgcacggaggcgaagactgattgggatcgtggacggacgacctcgcgtcgcccgccgctcccctggagggctggagctcactcgccggtgagttggccgcaggaccaagatggacagccataatcactcaccgtcccatgtccctgaagtaataatggacatttcatccgcttctggagcagcagctgggaacaaagcttgcagaggtgcagcttgcgacttctctgacaccagtaacacctcgaaagatgcaaaggagagatctgcgtccatgaggaagctcctgattgctgtgatcctttgtgtcatattcatggcagttgaagtggttgggggcatcaaggcaaacagtcttgcaatcttgactgatgcagcccatctcctttcagatgttgcagcatttgccatatctttgttctctctatgggcagctggttgggaagcgacacctcagcagtcatatggatttttccgaatagagattcttggggccctgctttccattcagcttatatggctccttgctggcatacttgtctacgaagctatcaataggctcctcactgaaagcggcgaggtacagggctccctcatgtttgctgtatcagcttttggcttgtttgttaacatcataatggcagtgttgcttggtcacgaccatgggcacggagggcatgggcacagccatggtcatgaccatggacattcacatgatcatgatcacggtcactcggaggatgaccattcccatcatgaagatcatgagcagggccatgttcgccatgagcacagccacggtacttctataaccgtcacaactcatcagcactctcattcaagcagtggaatacataatgatgctgaagaaccattgcttaagcatgatggtgattgtgagagtgcccagcctggtgccaaggcagctaagaagcctagccgtaatatcaatgtacacagtgcttatctgcatgtcatcggggattccatccagagcattggcgtaatgattggagggggtctcatctggtacaagcctgaatggaagattattgatctcatatgcaccctcatcttctctgtgattgtcctgtttaccacagtcaagatgattcggaacattcttgaagttctgatggagagcacgccccgcgagatcgatgccaccaggcttgagagtggtcttcgtgagatggaaggtgtgattgctgtccatgagctgcacatctgggctatcacggtggggaaggtgctcttagcgtgccatgtgaccatcacgcaggatgcagacgctgatcagatgcttgacaaggtcattgggtacatcaaggcagagtacaacatcagtcacgttaccattcagatcgagcgcgagtaataaggagcatgtcaggtagttggggataaaaagcgcgcctgttcacgggtttagcttctcaaaatgcggctattgttagttttgcacctgcaaaggcgttgcaggttcatctagctgttatctttggcgctggagaaatattatatgtactcgttatcattagtctgttagatgaatgaactattatctgggagtagtccttctattctcatggatgcaagtttcagacaatttttgagccccttgtgagttcatcaacctgcatgtgtagttcagcagcacccattcttatcacttgtctaaagatctgctatggcagggatgttatcaagttcttttagccgttctgtgcttttcatcctgcagttgaatgaagggaagtgcagcactcgttttcctatgcttaaattgcagtccagtgttccttgtgtcgttct

SEQ ID NO: 4123 - DNA, 1615 bp, Avena sativa
gtcctggacccttgagtgcacggaggcgaagactgatcgggatcctgaacggacgacctcgcgtcttcgcccgccgctcccctggagggatggagctcactcgccggtgagccggccgccggaccaagatggacagccataatcactcaccgtcccatgtccctgaagtaacaatggacatttcatccgcttctggagcagcagctgggaacaaagcttgcagaggtgccgcttgcgacttctcacacaccagtaacacctcgaaagatgcaaaggagagatctgcgtccatgaggaagctcctgattgctgtgatcctttgtgtcatattcatggcagttgaagtggttgggggcatcaaagcaaacagtcttgcaatcttgactgatgcagcccatctcctttcagatgttgcagcatttgccatatctttgttctctctatgggcagctggttgggaagcgacacctcagcagtcatatggatttttccgaatagagattcttggggccttgctttccattcagcttatatggctccttgctggcatacttgtctacgaagctatcaataggctcctcactgaaagcggcgaggtacagggctccctcatgtttgctgtatcagcttttggcttgtttgttaacattataatggcagtgttgcttggtcacgaccatgggcacggagggcatgggcacagccatggtcatgaccatggacattcacatgatcatgatcacggtcactcggaggatgaccattcccatcatgaagatcatgagcagggccatgttcgccatgagcacagccacggtacttctattaccgtcacaacacatcagcactctcattcaagcagtggaatacacaatgatgctgaagaaccattgcttaagcatgatggtgattgtgagagtgcccagcctggtgccaaggcagctaagaagcctagccgtaatatcaatgtacatagtgcttatctgcatgtcatcggggattccatccagagcattggcgtaatgattggagggggtctcatctggtacaagcctgagtggaagattattgatctcatatgcaccctcatcttttctgtgattgtcctgtttaccacagtcaagatgattcggaacatacttgaagttctgatggagagcacgccccgcgagatcgatgccactaggcttgagagtggtcttcgtgagatggaaggtgtggttgctgtccatgagctgcacatctgggctatcacggtggggaaggtgctcttggcgtgccatgtgaccatcactcaggatgcggatgctgatcaaatgcttgacaaggtcattgggtacatcaaggcagagtacaacatcagtcatgttaccattcagattgagcgcgaataaggaacccgtcaggtagttggagataaaaaagcgcacttgttcatggtttatcttctcgaatgcggttattgttagttttgcacttgcaaaggcattgcaggtccatctagctgttatctttggcgctggagaaatattatatgtatgagttatcgttagtttgttagatgaatgaactattatctgggtgtagtccttgtgttctcatggatgcaattttc

SEQ ID NO: 4124 - DNA, 1952 bp, Brachypodium distachyon
acacgcctctcctctttcctctttcctcctgactcctcgtcatcatcatcaccaaaaccgcctctccctctctgttccatcgcgtctccagactccgcggcggcggcggcggcggcggcgggtacggctgccgagcccccctccctccctccctcaagatggacggccatgattcagcggtgccccatatccctgaagtaacattggacatcacacctgcttctggagcagctgggaacaaaatgtgtagaggtgcggcttgtgacttttctgactccaataacacctcaaaagatgcacaggagagatctgcgtccatgaggaagctcctaattgcggtgatcctttgtgttatattcatggccgtggaagtggttggaggcatcaaagcaaacagtcttgcaatcttgactgatgcagcacatcttctttcagatgttgcagcctttgcaatatctttgttctctctctgggcagctggttgggaagcgacacctcagcagtcatatggatttttccgtatagaaattcttggggcattggtttccattcagcttatatggctccttgctggcatacttgtgtatgaagctattatgaggctcattactgaaagtggcgaggtacagggctccctcatgtttgctgtatcagcttttggtttgtttgttaacatcataatggcagtcttgcttggtcatgaccatgggcatggcggacatgggcacagccatggtcatagccatggacattcacatgaccatgatcatgataactcaggcgaccaccatacccatcatggagatcatgaggagggccatgtgcaccaccatgagcacagccatggtagttctataaccatcacaacccgtcagcactctcattccagcactggacaacatcagggtgctgaggaaccgttgcttaagcatgatggtgattgtgagagtgcccagcctggtggtaaggctgccaagaagcgtaatatcaatgtacacagtgcctatctgcatgtaattggggactccatccagagcgtcggtgtaatgattggaggggctctcatctggtacaagcctgaatggaagattatcgatctcatatgcacactcatcttctccgtgattgtactgtttaccacaatcaagatgatccgaaacatacttgaagtcctgatggagagcactcctcgtgagatcgatgctacaaggcttgagaatggtctacgtgaaatggaaggtgtgattgctgttcatgagctgcacatctgggctatcacagtggggaaggtgctcttggcgtgccatgtgacgatcacgcaggaggcgaatgctgatcaaatgcttgacaaggtcattgggtacatcaaggcagagtacaacatcagtcatgtgaccatccagatcgagcgcgagtaagtcatgtcaggtagtggggatgaaaagcgtgcttggaaacggtttatcttatgcgctcaaatgtttagctttggacttgcaaaggcggtgcaggtttatctagatgtggtatctgctggagaaatattgtatgtcgtgttaccattagcccattaggtgaatgaactattatcatgttggtctagtcgttgtattggcatggatgcaattttcaaacaattttcgatcctgctgtgagttcatcaacctacatgtgtagttcagcggcactctgttccatctcttatgtgaaagatctgctgtggcacatatgttgtcatgtttctgtttagcctgttgtggtttgttctgagcttgcgtcctaaagttgaatgaggaaggtgcaagtactccctatttttgtgtgtgtgtgaatgtgcagtttgtattatctgtgccattgtcttaaaactgtgcgtaggtgtatgaaacgtaggaagataaagattggcaggtcaccatggtgcctgaagcgaaatgcactgccacaactgt

SEQ ID NO: 4125 - DNA, 1603 bp, Avena sativa
cacaaaaaccggctccctccatctcttccgtcgcgtccctccaaaactctgcggcggcggcggtgacggagccgctgctgtttttgccgagtctcactccagatggacagccataatcactcaccgctccatgtccctgaagtaacaatggacatttcatctgcttctggagcagctgggaacaaagcttgcagaggtgccgcttgcgacttttctgacaccagtaacacctcgaaagatgcaaaggagagatctgcgtccatgaggaagctcctgattgctgtgatcctttgtgttatattcatggcagttgaagtggttggaggcatcaaagcaaacagtcttgcaatcttgactgatgcagcccatctcctttcagatgttgcagcatttgccatatctttgttctctctatgggcagctggttgggaagcgacacctcagcagtcatatggatttttccgtatagaaattcttggggcattgctttccattcagcttatatggctccttgctggcatacttgtctacgaagccatcaataggctcctcactgaaagcggcgaggtacagggctccctcatgtttgctgtatcagcttttggcttgtttgttaacatcataatggcggtgttgcttggtcacgaccatggacacggcgggcatgggcacagccatggtcatgaccatggacattcacatgaccatgatcatggtcactcagaggatgaccattcccatcatgaagatcatgagcagggccatgttcgccatgagcacagccatggtacatctataaccgtcacaactcatcagcactctcattcaagcagtggactacataatgatgctgaagaaccattgcttaagcatgatggtgattgtgagagtgcccagactgatgccaaggcagctaagaagccacgccgtaatatcaatgtgcacagtgcttatctgcatgtgattggggattccatccagagcattggcgtaatgattggagggggtctcatctggtacaagcctgagtggaagattattgatctcatatgcaccctcatcttctctgtgattgtcctgtttaccacagtcaagatgattcggaacatacttgaagttctgatggagagcacgccccgtagagatcgatgccaccaggctcgagagtgtctccgtgagatggaaggtgtgattgctgtccatgagctgcacatctgggctatcacagtggggaaggtgctcttggcatgccatgtgacgatcacgcaggatgcggatgctgatcaaatgcttgacaaggtcattgggtacatcaaggcagagtacaacatcagtcatgtgaccattcagatcgagcgcgagtaaggtgcatgtcaggtagttggggataaagagcgatttttcagagtttatcttcttaaaatgcgtttattgttagctttgcacttgcaaaggcgtcgcatgttcgtctagctgttaatctttggcactggaggaatattatatgtatgtgttatcattagctcgttaggtgaatgaactattatctgggtggtgtagtcccctgtttcacatggatgcagttttcagactttttcgagcc

SEQ ID NO: 4126 - DNA, 2373 bp, Brachypodium distachyon
acggctacgataatgctaaattgttaagttgttctacagctccggcaggaccaagttgtcaccatcaacaatatgccccggctcggcggctacaagtcaagagataaagatctggccgaagtaccaaagatgcaaacattaatacatattcggacagagggagtggtagaaaaaagatgaaagccgagaaagcaacgttcgaatgcgatccgaggcacattccaaaaaagatcctaggggtaggagcctaggaggcccggacccagggggggctccacgtcagcacgggggagcagttgtcatccgtcccggcacgcaaagttaccagactgcccctcccatctcggtccaatcacgacacgagaccttcccctttttctgtcggacgcaaatttatcaggctatcacacgcctctcctctttcctctttcctcctgactcctcgtcatcatcatcaccaaaaccgcctctccctctctgttccatcgcgtctccagactccgcggcggcggcggcggcggcggcgggtacggctgccgagcccccctccctccctccctcaagatggacggccatgattcagcggtgccccatatccctgaagtaacattggacatcacacctgcttctggagcagctgggaacaaaatgtgtagaggtgcggcttgtgacttttctgactccaataacacctcaaaagatgcacaggagagatctgcgtccatgaggaagctcctaattgcggtgatcctttgtgttatattcatggccgtggaagtggttggaggcatcaaagcaaacagtcttgcaatcttgactgatgcagcacatcttctttcagatgttgcagcctttgcaatatctttgttctctctctgggcagctggttgggaagcgacacctcagcagtcatatggatttttccgtatagaaattcttggggcattggtttccattcagcttatatggctccttgctggcatacttgtgtatgaagctattatgaggctcattactgaaagtggcgaggtacagggctccctcatgtttgctgtatcagcttttggtttgtttgttaacatcataatggcagtcttgcttggtcatgaccatgggcatggcggacatgggcacagccatggtcatagccatggacattcacatgaccatgatcatgataactcaggcgaccaccatacccatcatggagatcatgaggagggccatgtgcaccaccatgagcacagccatggtagttctataaccatcacaacccgtcagcactctcattccagcactggacaacatcagggtgctgaggaaccgttgcttaagcatgatggtgattgtgagagtgcccagcctggtggtaaggctgccaagaagcgtaatatcaatgtacacagtgcctatctgcatgtaattggggactccatccagagcgtcggtgtaatgattggaggggctctcatctggtacaagcctgaatggaagattatcgatctcatatgcacactcatcttctccgtgattgtactgtttaccacaatcaagatgatccgaaacatacttgaagtcctgatggagagcactcctcgtgagatcgatgctacaaggcttgagaatggtctacgtgaaatggaaggtgtgattgctgttcatgagctgcacatctgggctatcacagtggggaaggtgctcttggcgtgccatgtgacgatcacgcaggaggcgaatgctgatcaaatgcttgacaaggtcattgggtacatcaaggcagagtacaacatcagtcatgtgaccatccagatcgagcgcgagtaagtcatgtcaggtagtggggatgaaaagcgtgcttggaaacggtttatcttatgcgctcaaatgtttagctttggacttgcaaaggcggtgcaggtttatctagatgtggtatctgctggagaaatattgtatgtcgtgttaccattagcccattaggtgaatgaactattatcatgttggtctagtcgttgtattggcatggatgcaattttcaaacaattttcgatcctgctgtgagttcatcaacctacatgtgtagttcagcggcactctgttccatctcttatgtgaaagatctgctgtggcacatatgttgtcatgtttctgtttagcctgttgtggtttgttctgagcttgcgtcctaaagttgaatgaggaaggtgcaagtactccctatttttgtgtgtgtgtgaatgtgcagtttgtattatctgtgccattgtcttaaaactgtgcgtaggtgtatgaaacgtaggaagataaagattggcaggtcaccatggtgcctgaagcgaaatgcactgccacaactgtagagttcgtcttgca

SEQ ID NO: 4127 - DNA, 1890 bp, Secale cereale
tagggagtcgagaaagtagaatcacgaactggctgagagagagaagctgttcttctcctccagaaccctattcccttccatctctcaaattatcccttctcctcccctcgtagcgccgccatctctagatcggtccataacaaccatccatcctcctcctccgcttccaaacgccgagcgagcagagcagtgttccaggtcgtctagatgccgacgtcttagttatatacagtcgtttacttgtcgctgtaaacgtcctcgctgccctcgccctccccttgcccctctccgcctcaatctccggcggcgcgctcgatcccctcctctccagggaccccagatggacagccacacttcatccccgcaccatgaagtaacaatggacatctcatctgcatctgcgagcaaaatgtgcagaggtgcttcttgcgacttcgccgactcggccaacacctccaaagatgcaaaggagaggtctgcgtccatgaggaagctcctgatcgccgttatcctctgtgttatattcatggcggttgaagtggttggaggcatcaaggcaacagccttgcgatcttgactgatgcagcccatctcctctcggatgttgccgccttcgccatatctctcttctccctgtgggcagctggttgggaagcgacgcctcggcagtcgtacgggtttttccgtatagagattcttggggcactggtctccatccagctcatatggctcctcgccggcatacttgtctacgaagctatcatgaggcttgtcaatggaagcgggggcgaggtacagggctccctcatgtttgccgtatcagcttttggtctgtttgtcaacatcgtaatggcagtgctgcttggccatgaccatgggcacggtggccatggacatggacattcacatgaccatggtcatgatcatggtaactcggaggacgaccatgggcagcatgatcatgagcaaggccacgcacatcaccatgagcacagccatggcagttccataaccgtcaccactcatcatcaccctcattcaaccactggacaacaccagggtgatgctgaggaatcgttgcttaagcatgatgatggtgccaaggaagctaaggagcctcgccgccgcaacatcaatgtacacagcgcttacctgcatgtgatcggggactccatccagagcatcggcgtgatgatcggaggggctctcatctggtacaagcccgaatggaagataatcgacctcatatgcaccctcatcttctccgtgatcgtgctattcaccacgatcaagatggttcggaacttgctcgaggttctgatggagagcacgccgcgcgaggtcgacgccaccaggctcgagggcggcctccttcagatggaaggtgtggttgccgtccatgagctgcacatctgggctatcacggtggggaaggtgctcctggcgtgccatgtgacgatcgagcaggatgcggacgctgatcaaatgcttgacaaggtcattgggtacatcaaggcagaatacaacatcggccatgtcaccattcagatcgagcgcgagtaaggccattgtgcttcctgcacttgaatgagttttcttggttttttgctgtgctttattgtgtgaatgggtctggattggcagtcatcatggttcctgatgcactgctggtggttcgtccttgcagtagtccattgggcaaggtttccatggcgctgaatgcgcaaggttttcatggctcaatggggtttgatttaagtaattatattcagatgacattggttttgtatgtttttggtggcatctaatctgtagcctcttcatctagtgctatagcttcgagccaaattcggccccatttcaatgcaaactaggctccctatcaaagtc

SEQ ID NO: 4128 - DNA, 1796 bp, Setaria italica
cggccacggccagccgtcgccactcgccgccaccaactccgagtccaaacccaccactccaccagccaccacaatccacggccccgtctcatcgccatgggaaccaagaatctttcacggaaacatcccgcttccatggcgacggcatccgccactctgctcctttccctcgccctcctcgcctccgccgccgcctcctcgccgtcgtcggacgcggatgcgatctcccggttccaggagtacctccgcatcgatacggcgcagccggcgccggactacgccgcggccgtggccttcctccggggccaggcttccgaggccgggctcgaggcgcgcacgctggagctcgtcgccgggaagcccctgctgctactgcggtggcccgggcggcggtcgtcgctcccctcgatactcctcaactcccacaccgacgtcgtgccgtcggagccgcacaagtgggaccacccgcccttctccgccgccctcgacgaggcatccggtcgcatctacgcccgaggctcccaggacatgaagtgcgtagggatgcagtaccttgaagccatccgacgtttgcgttctgcaggttttgttccggatcgaaacatctatataatatttgttcctgatgaggagattggtgggcatgagggtgttgagctgtttgtttcatctaaggagttcaaagaaatgaatgtggggttggtccttgatgaggggcttgcatctcctggggaagagtatcgtgtgttctatgcagagcgtagcccttggtggcttactataaaagcaaagggtgcaccagggcatggtgcaaaattatatgatggtagtgcaatggagaatttgatgaagagtgtggaggttattaggagattcaggacatcgcagtttgatttagtgaagtctggagagaaggctgaaggagatgtcgtgtcggtgaattttgcatacctgaaggctggcacacctacaccgacgggtttcgtcatgaatctccaaccatctgaagcagaggtaggtcttgacatccgaatcccacctagtgcccatgtggaagcactggagaggcgccttgttgaagaatgggcaccatcttcacgcaacttgacctttgagtttaaacagaagatgtctgtcctggacaactttggtaagccagccatcacacctgctgacagcacaaacccctggtggttgttgcttgaagaagctgtgaagagtgctggtggcaaacttggtaagccagagatattcccagcctctactgatgcccgctacttccgacagattgggttaccagcattcggtttttcacctatggcgaacacaccaatattgcttcatgaccataatgagtttttgcgcaaagatgagtacctcaaaggaattgggatatacgagtccatcatcagggcactggccacccacaaagatggcggtaaagacaatgacagggcagagctatgaggaaaaccttgaccttgcctcatcttgtcgcgattcttgctgcccaactggagcactgaaatcatgaatccagcacactaaaaagcagctgcttatgtttctgctcctgcggcgaaatgatagaactgcaaacaccatccttgtatatttgcaataagcgtacttagaataattggcatgacattgcagctcctctgcgcaattcagggctgaccctattgctacttgatgcttcagtcttaactgttgtatcagacttacattcattgcatcagtaatgcagtacatgctgccacgtgcttcattgctatgtgcctttgtgcatttca

SEQ ID NO: 4129 - DNA, 1741 bp, Setaria italica
ctccgagtccaaacccaccactccaccagccaccacaatccacggccccgtctcatcgccatgggaaccaagaatctttcacggaaacatcccgcttccatggcgacggcatccgccactctgctcctttccctcgccctcctcgcctccgccgccgcctcctcgccgtcgtcggacgcggatgcgatctcccggttccaggagtacctccgcatcgatacggcgcagccggcgccggactacgccgcggccgtggccttcctccggggccaggcttccgaggccgggctcgaggcgcgcacgctggagctcgtcgccgggaagcccctgctgctactgcggtggcccgggcggcggtcgtcgctcccctcgatactcctcaactcccacaccgacgtcgtgccgtcggagccgcacaagtgggaccacccgcccttctccgccgccctcgacgaggcatccggtcgcatctacgcccgaggctcccaggacatgaagtgcgtagggatgcagtaccttgaagccatccgacgtttgcgttctgcaggttttgttccggatcgaaacatctatataatatttgttcctgatgaggagattggtgggcatgagggtgttgagctgtttgtttcatctaaggagttcaaagaaatgaatgtggggttggtccttgatgaggggcttgcatctcctggggaagagtatcgtgtgttctatgcagagcgtagcccttggtggcttactataaaagcaaagggtgcaccagggcatggtgcaaaattatatgatggtagtgcaatggagaatttgatgaagagtgtggaggttattaggagattcaggacatcgcagtttgatttagtgaagtctggagagaaggctgaaggagatgtcgtgtcggtgaattttgcatacctgaaggctggcacacctacaccgacgggtttcgtcatgaatctccaaccatctgaagcagaggtaggtcttgacatccgaatcccacctagtgcccatgtggaagcactggagaggcgccttgttgaagaatgggcaccatcttcacgcaacttgacctttgagtttaaacagaagatgtctgtcctggacaactttggtaagccagccatcacacctgctgacagcacaaacccctggtggttgttgcttgaagaagctgtgaagagtgctggtggcaaacttggtaagccagagatattcccagcctctactgatgcccgctacttccgacagattgggttaccagcattcggtttttcacctatggcgaacacaccaatattgcttcatgaccataatgagtttttgcgcaaagatgagtacctcaaaggaattgggatatacgagtccatcatcagggcactggccacccacaaagatggcggtaaagacaatgacagggcagagctatgaggaaaaccttgaccttgcctcatcttgtcgcgattcttgctgcccaactggagcactgaaatcatgaatccagcacactaaaaagcagctgcttatgtttctgctcctgcggcgaaatgatagaactgcaaacaccatccttgtatatttgcaataagcgtacttagaataattggcatgacattgcagctcctctgcgcaattcagggctgaccctattgctacttgatgcttcagtcttaactgttgtatcagacttacattcattgcatcagtaatgcagtacatgctgccacgtgcttcattgcta

SEQ ID NO: 4130 - DNA, 1726 bp, Pennisetum glaucum
ggggccgttcccagccgtcgccactcgccgccaccgagtccaaacccaccactccaggcaccagccaccacaatccacggccccgtctcatcgccatgggaaccaagaatctttcacggaaacatcccgcttccatggcgacggcatccaccacgctgctcctctgcctcgccttcctcgcctccgccgcggcggcctccccgtcgtcggacgccgatgcgatctcccggttccaggagtacctccgcatcgacacggcgcagccggcgccggactacgccgcggccgtggccttcctccgggaccaggcctccgaggccgggctcggggcgcgcacgctggagctcgtcgctgggaagcccctgctgctgctgctgtggcccgggcggcggccatcgctcccctcgatactcctcaactcccacaccgacgtcgtgccgtcggagccgcacaagtgggatcatccgcccttctccgctgctgtcgacgaggcgtccggtcgcatctacgcccgcggctcgcaggacatgaaatgcgtggggatgcagtaccttgaagccatccgccgtctccgtgctgggggatttgttccagaccgaaacatctatataacatttgttcctgatgaggagattggtgggcatgacggtgttgaggcttttgttgcatcaaaggaattcaaagacttgaatgttgggttggttcttgatgagggacttccatctcctggagaggggtaccgggtgttctatgctgagcgtagcccttggtggcttacgataaaagcaacaggtgcaccaggacatggtgcaaagttgtatgatggcagtgcaatggagaatttgatgaagagtgtggaggctattagaaggttcaggacatcacaatttgatttagtgaagtccggagagaaggctgaaggagatgtcgtgtcagtgaactttgcatacctgaaggctggcacacagacaccaacgggttttgtcatgaacctccaaccatctgaagcggaggtaggccttgatatccgaatgcctccagatgttcatactgaagcactggagaggcgccttgttgaagaatgggcaccttcctcacgcaacatgacctttgagttcaaacagaagggttctgtcctcgacgactttgggaagccagccttcacgcctgctgacaactcaaacccatggtggcgagtgtttgaagaagccgtgaagaaagcgggtggcaaacttggtaagccagaggtatttccagcctctaccgatgctcgttacttccggaagattggtttaccggcattcggtttctctcctatggaaaacacacctgtattgctccacgatcataatgagtttctgaccaaagatgagtacctcaaaggaattgggatatatgagtctgtcatcagggagctggccactcacaaacaagacgccagagacgatgaatcaagggctgagttatgagatgaccttaccctgccttggtcaaattcttgcagttcaattggagctttgaaatcacgttaggcaaagcttcttatgtatctgctaccacggcaaaattgtaaccacaaacattgtaaccacaaacaccattcttgtacatttcaataaaatccgaccctcgaataattggtttctggatctgcgattccttttgcatgtttcaggaatcaggattcaggttatcgctacatgatgggtcactaatgtataaacct

SEQ ID NO: 4131 - DNA, 1713 bp, Zea mays
cactcgccgccgctaacccagccccgtctcatcgccatttgaaccaggaatcttacgcggaaccgccccgcttccatggcgacggcatccactacgctgctcctctcccttgccttcctcgccttcgcctgggcggcgtcgccgtcgccgtcgccggatgcggaggcgatctcccggttccaggagtacctccgcatcgacacggcgcagccggcgccagactacgccgcggccgtggccttcctccggaaacaggccgccgatgctggactcgaggcgcgcacgcttgagctcgtcgccgggaagcccctgctgctgctgcggtggcccggtcggcggccgtcgctcccctccatactcctcaactcccacactgacgtggtgccgtcggagccgaacaagtgggaccacccgcccttttccgccgccctcgatgagccatccggtcgcatctacgcgcgaggctcccaggacatgaagtgtgtggggatgcagtaccttgaagccattcgccgtctccgttctgcaggatttgttccagatcgaaatatctatataacatttgttcctgacgaggagattggtgggcatggcggtgttgaaccatttgtttcatccaaggagttcaaagatatgaacgtggcattagtccttgatgaagggcttgcctctccaggggaggagtaccgtgtgttctatgcagagcgtagcccttggtggcttactataaaagcaacgggcgcaccagggcacggtgcgaagttgtatgatggtagtgcaatggagaatttgatgaagagcgtggaggctattaggagattcaggacatcacagtttgatctagtgaaatctggagagaaggctgaaggagatgttgtatcggtgaattttgcgtacctgaaggctggcacacctacaccaacgggttttgtcatgaatcttcaaccatctgaagcagaggtaggtcttgacatccggatccctcctagtgcccatgtggaagcactggagaggcgccttgttgaagaatgggcaccaccttcacgcaacctgaccttcgagtttaaacagaagatgtctgtcctggacaactttgggaagccagccatgacagcggcagacagcacaaacccatggtggacgttgctcgaagaagctgtgaagagcgctgacggcaaactcggcaaggcggagatattcccagcctctactgacgctcgctacttccggaaaatcggattaccagcatttggcttttcacctatggcgaacaccccgatactgctccatgaccataacgagtttctgagcaaagacgagtacctcaagggaatcgggatatacgagtccatcatcagggcactggccactcatgaagatggcggcaaagatgacgaatccagggcagagctgtgagcctgtgactgaggagaaccttgaaccttacctcgcttttgccgcagaccaaatggagcactggaagtcatgtttcggcattatgcagctgcttgtgcttctgctgcggcgtcggagcgatagaaccacaaacatcatctttgtacattctcgcaagagggcttatgcgcttaataattgatgaaattgagatatgtagttcgtctgcgcagttcagggctcacccagttcctacttgatgctgctttggtattggttgttgtatcaaaacttatattcacgtcgcttcgtgcttca

SEQ ID NO: 4132 - DNA, 1919 bp, Panicum virgatum
ctactcccagccgtcgccactcgccgccgccccaccagtctgcgagtccaaacccaccacgaatcagaacccacacgagcccctttcatcgccacgggaaccaagaatctgacacggaaacctcccgcttccatggcgacggcatccgccacgctgctcctctccctcgccctcctcgcctccgccgcggccgcctcgccgtcgtcgggcgcgggtgcgatctcccgtttccaggagtacctccgcatcgacacggcgcagccggcgccggactacgccgcggccgtggccttcctccggggccaggcctccgaggccggcctcgaggcgcgcacgctggagctcgccgctgggaagccccttctgctgctgcgatggcccgggcggcggccgtcgctgccctcgatactcctcaactcccacaccgacgtcgtgccgtcggagcggcagaagtgggaccacccgcccttctccgccgccctcgacgaggcatccggtcgcatctacgcccgaggctcccaggacatgaagtgtgtggggatgcaataccttgaagccatccgccgtctccgttctgcaggatttgttccagatcgaaacatctatataacatttgttcctgatgaggagattggtgggcatgggggtgttgagctgtttgtttcatcaaaggaattcaaagaaatgaacgtgggtttggtccttgatgaggggcttgcatctcctggggacgagtatcgtgtgttctatgcagagcgtagcccttggtggcttactataaaagcaaagggtgcaccagggcatggtgcaaagttgtatgacggtagtgcaatggagaatctgatgaagagcgtggaagctattaggagattcaggacatcacagtttgatttagtgaagtccggagagaaggctgaaggagatgttgtgtcggtgaatttcgcatacctgaaggctggcacacctacaccgacgggttttgtcatgaatctccaaccatctgaagcagaggtaggtcttgacatccggatccctcctagtgctcatgtggaagcactggagaggcgccttgttgaagaatgggcgccatcttcacgcaacttgacctttgagtttaaacagaagatgtctgtcctggacaactttgggaagccagccatgacacctgctgacagcacaaacccatggtggctgttgcttgaagaagctgtgaagagtgctggtggcaaacttggtaagccggagatattcccagcctctactgatgcccgttatttccggcagattgggttgccagcatttggcttttcacctatggcgaacacaccgatattgcttcatgaccataatgagtttctgcacaaagacgagtacctcaaaggaatcgggatatacgagtacatcatcaaggcactggccacccacaaagatagcgttaaagacgatgaatccagggcagaactatgagggcctcgatcttacctagccatgttgccattcttgccgcccaactggagcacagaaatcatgtgtaggcaaagcagctgcttacatttctgctcctgcggcgaaatgatagaactgcaaacaccatccctgtacattcaataagcgtgcttatgcgctgaacaattggcgtgattccctctatgcaattcatggttcagcctattgcaacttgatgcatcagttgtgacttgtgactgttgtatcaaacctacattggttgtatcagtatcctgttcggctgttcctacctgcatattgctacgttcttcactatcctgttcctttgttgcctttcgttggataacgttctaatacacaaatcttccaaaagtctgtagctgatgtgcaagcccacggctgacatgtatggaacataaattccgcaagaattcatagactcacttgaggtt

SEQ ID NO: 4133 - DNA, 1924 bp, Panicum virgatum
gccacgtcacttcacgatcgcccctgctactcccagccgtcgccaccaactgcgagtccgagcccaccacaaaccagaacccgcacgagcccctttcatcgccatgggaaccaagaatccgacccggaaacctcccgcttccatggcgacggcacccaccgcgctgctcctctccctcaccctcctcgcctccgccgcggccgcttcgccgtcgtcggacgcggatgcgatctcccggttccaggagtacctccgcatcgacacggcgcagccggcgccggactacgccgcggccgtggccttcctccggggccaggcctccgaggccggcctcgaggcgcgcacgctggagctcgccgctgggaagccgcttctgctgctgcggtggcccgggcggcggccgtcgctgccctcgatactcctcaactcccacaccgacgtcgtgccgtcggagccgcagaagtgggaccacccgcccttctccgccgccctcgacgaggcatccggtcgcatctacgcccggggctcccaggacatgaagtgtgtggggatgcaataccttgaagctatccgctgtctccgttctgcaggatttgttccagatcgaaacatctatataacttttgttcctgatgaggagattggtgggcatgagggtgttgagctgtttgtttcatctaaggaattcaaagaaatgaacgtggggttggtccttgatgaggggcttgcatctcctggggaggagtatcgcgtgttctatgctgagcgtagcccttggtggcttactataaaagcaaagggtgcaccagggcatggtgcaaagttgtatgatggtagtgcaatggagaatttgattaagagcatggaagctattagaagattcaggacatcacagtttaatttagtgaagtccggagagaaggctgaaggagatgttgtgtcggtgaattttgcatacctgaaggctggcacacctacaccgacgggttttgtcatgaatctccaaccatctgaagcagaagtaggtcttgacatccggatccctcctagtgcccatgtggaagcactggagagacgccttgttgaagaatgggcgccatcttcacgcaacttgacctgtgagtttaaacagaagatgtctgtcctggacaactttgggaagcccgccatgacacctgctgacagcacaaacccatggtggctgttgcttgaagaagctgtaaagagtgctggtggcaaacttggtaagccggagatattcccagcctctactgatgcccgctacttccggcagattggattgccagcatttggcttttcacctatggcaaacacaccaatattgcttcacgaccataatgagtttctgcacaaagatgagtacctcaagggaatcgggatatacgagtctatcatcagggcgctggccacccacaaagatggcgctaaagatgatgaatctagagcagagctatgaggaaaacttgacttctcatcgtcttgtcgcgattcttactgccaactggagcactgaaatcatgaatccagagcactgaagtgcagctgcttatattgctgctcatgcggggaaatggtagaactgcaaacaccatccttgtacattttcaataagcgttcttatgcgctgaatatttggcgtggcatctgcagttcctctgcgcaattcatagtttcagcctattgcaacttggtgcctcagccgtgactgttgtatcaaacctgcattggctgtatcagtattcagtactgcacggcatgttactttgttgcctttcgttggatggcataacagtcgctgatgcacaaatcttccaaatgtttgtagctgatgtatgacacacaaatttcgtaagaactaagaattcatcggcacacttgcggttgagttattgataattcacag

SEQ ID NO: 4134 - DNA, 1548 bp, Echinochloa colona
cccatggcgatggcatctaccacgctgctcctctccctcgccctcctcgcgtccgccgcgtccgcctcgtcatcatctgacgcggatgcgatctcccggttccaggagtacctccgtatcgacacggcgcagccgtcgccggactatgccgcggccgtggccttcctccgggaccaggccgccgccgcggggctcgaggcgcgcacgctggagctcgtcgctgggaagcccctgctgatactgcggtggcccgggcggcggccgtcgctcccctcgatactcctcaactcccacactgacgtcgtgccgtcggagccgcacaagtgggaccacccgccgttctccgccgcccttgatgaggcatccggtcgcatctatgccagaggctcccaggacatgaagtgcgtggggatgcagtaccttgaagctatcctccgtctccgttctgcaggatttgttccagatagaaatatctatctaacatttgttccggatgaggagattggtgggcatgagggtgttgagctgtttgtttcatctaaggagttcaaagaaatgaatgtggggttggtccttgatgaggggcttgcctctcctggggaggagtaccgtgtgttctatgcagagcgtagcccttggtggcttactataaaagcaaagggggcaccagggcatggtgcaaagttgtatgatggtagtgcaatggagaatttgatgaagagcgtggaggctattaggagattcaggacatcgcagtttgatttagtgaagtctggagagaaggctgaaggagatgttgtgtcagtgaattttgcatacctgaaggctggcacgcctacacctacgggttttgtcatgaatctccaaccatctgaagcagaggtaggtcttgacatccggatccctcctagtgcccatgtggaagcactggagaggcgccttgttgaagaatgggcaccatcttcacgcaacctgacctttgagtttaaacagaagatgtctgtcctggacaactttgggaagccagccatgacacctgttgacagcacaaacccatggtggttgttgcttgaagaagccatcaagagtgctggtggcaaacttggtaaaccagagatattcccagcctccacggatgcccgctacttccggcagattggattaccagcattcggtttttcacctatggcgaacacaccaatattgctccatgatcacaatgagtttctgaggaaagatgagtacctcaaaggaataggggtatatgagtccatcatcagagtactgaccactcaaaaagacggcgctaaagacgagctatgaggaaaagtggaaaacctcgacattacctctcccaagtggagcaccgagatcatgtttcagcaactcagccgtttatattctgctcctgtggcaaaatgatagaactgcgaaaaccatccttgtacattttcaataagcgcgcctacgcactgaaaaattgttatgacatatctgcagtctctctgcacaattgaggtctcaacctattgctacttgatgcgtcag

SEQ ID NO: 4135 - DNA, 1731 bp, Oryza sativa
aaaaaaagaaaaacaattgtatgggcatcggcctctcgggccccgccacgagctgcaaagcccctccctccgcggccgccgccacgagcccacggctctcgcttctcatctcacctgctcgcaatggcgagcaagaagagctcgacgcaggcgtctcccatggccgccgccgccgccagccttctcctcggtctcctcctcgtcctccccgtgccagccgtctcgtcgtcggacgcggaggaggcggtggtctcccggttccgggagtacctccgcatcgacacggcgcagccggcgccggactacgccgcggcggtggcgttcctccgggggcaggccggcgccgcggggctcgaggcgcgcacgctcgagctcgtcgccggcaagcccctgctgctgctccggtggcccgggcggcgcccgtcgctcccttcgctgctcctcaactcccacaccgacgtcgtgccgtcggagccgcacaagtgggaccacccgcccttctccgccgccctcgacgaggcatccggccgcatctacgcgcgtggctcccaggacatgaagtgcgtggggatgcagtaccttgaagccatccgccgtcttcgtagtgcaggctttatcccagatcggaatatctatcttacatttgttccagatgaagaaattggtgggcatgagggtatagaagcatttgttgcatcaaaggagttcaaagacatgaatgtaggtttggttctcgatgaagggcttgcatcacctggggaggagtaccgcgtgttctatggggagcgtagtccttggtggcttactattaaagctaaaggagccccagggcatggtgcaaagctgtatgatggtagcgcaatggagaatttgatgaagagtgtggaagcaattaggaggttcagaacatcacagtttgatttggtcaagtccggagcaaaggctgaaggggatgttgtatcagtgaattttgcatacttgaaggctggcacaccgacaccaacgggttttgtcatgaatctacaaccatctgaagcagagataggtctagacatccgactccctcctagtgttcatactgaggctctagagaagcgtcttgctgaagaatgggcaccttcttcacgcaacttgacatttgagttcaaacaaaagacctctgtacttgacaactttggcaagccagccgtcacccctgctgatagctcaaatgtatggtgggctctatttgaagaggctgtgaagagagccggtggcaaacttggtaagccggaaatattcccggcctctactgatgctcgttactttcgggtgcttgggataccagcatttggtttttctccaatgacaaacacaccgatattgctccatgatcacaatgagtttctgagcaaagatgagtacctcaaagggattgggatatacgagtctatcatcaggacattggccactcttaaggacagcaatgtcgactacgaatccagggcagagctatgaagaaaatgtttaggcaaaacctgatactgccataattcttgcaatcagatggagcacagaaacatgtttcggcaaatcaactgtgttttcttactgctcctagggtggaatcgaaacttcgaacacgatcgttgtaaattttcattgaaacctgtttagattttagaataaattgatcctgcatttgcagttaacctgtatgcttttcgcaactgctggtgctgcttgatgcat

SEQ ID NO: 4136 - DNA, 1777 bp, Hordeum vulgare
gaatgacgattaccgtctcagcaccggtgcctcctggccgccaccaccaacaactccagagtccgctctccctactcatcgccacgacctcccaccctttctcgtcagggggagcgagggctcgatgcggattcctcccatggctggactcaccaagatttttctcccactcctcctcctcctctccgtcgccgcggccgcttcgccgtcgtcggacgcggaggctgtatcccggttccaggagtacctccgcatcgacacagcgcagccgacgccggactacgccgcggcggtggccttcctccgggaccaggcggcgcctgccgggcttgaggcgcggacgctggagttcgccgccggcaagcccttgctgctgctccggtggcccgggcggcggccgtcgcttccttctatacttctcaactcccacaccgacgtcgtcccgtcggagcccaagaagtgggagcacgcgcctctctctgccactctcgacgaggcatccggtcgcatctacgcgcgcggctcccaggacatgaagtgtgtggggatgcagtatcttgaagccattcggcgtcttcgtaatgcgggctttgtcccagatcggaacatatatataatatttgttcctgatgaggagattggtggacatgagggtgttgagctatttgtcgcatcgaaggaattcaaggagctgaatgtgggattggttcttgatgaagggcttgcatcccctggggaggagtaccgggtgttctatgcagagcgtagtccttggtggcttactattaaagcaaagggagcgccagggcatggtgcaaagttgtatgatggtagcgcaatggagaatttaatgaaaagtgtggaggctcttcggaggttcaggacagctcagtttgatttggttaagtctggagagaaagctgaaggggacgttgtatcggtgaattttgcgtacttgaaggctggaacaccaacacccacgggttttgtgatgaatctacaaccatctgaagcagaggtaggaattgacattcgaatccctcctagtgttcatactgaagcactagagaagcgtcttgctgaagaatgggcaccttgttcacgcaacttgacctttgagttcaagcagaagggctctgtccttgacaagtttgggaaaccagccatgacaattgctgacagctcaaacccatggtggcctgtgtttgaagaatctgtgaagagagctggtggcaaacttggcaagccggagatatttccggcttccactgatgctcgttatttccgggaaattgggataccagctttcggcttttcccctatggcgaacacaccagtactgcttcatgatcataacgagttcctgagcaaagatgagtacctcaaaggaattgggatatatgagtccattataaaggcactggccacacacaaagatgacggcatcgacgaggagtctagggcagagctgtgaggaaagatgatcttatcttgctacggcgggtatcttgcctgttgacgttttcggcaaatacatgttctgtttctgctccggcagccaaagcaaaaccacagatacggttcttgtgcatctctaataattggaccttgaaataataaatcataccgtatatgtagttcctcagcatattacaccgagtaatggcatcttcttctgtacttgaataagttataatggcatttcattggtccttcgccggtcatctttttgggtgtggtggttcatcgctacttttgcgtcagtgaaacatggtcc

SEQ ID NO: 4137 - DNA, 1828 bp, Triticum aestivum
gtctcagcaccagtggctccccgccgtcaccaccaacaactccagagtccaactcccgtctccgccgctctccctactcatcgccacgacctcccaccctttctcgtcagggggagcgagggctcgatgcggattcctctcatggctggactcaccaagattctcctcccactcctcctcctcctctccgtcgccgcggccgcttcgccgtcgtcggacgcggaggctgtatcccggttccaggagtacctccgcatcgacacggcgcagccgacgccggactacgccgcggcggtggccttcctccgggaccaggcggcggctgttgggcttgaggcgcggacgctggagtttgccgccggcaagcccttgctgctgctccggtggcccgggcggcggccgtcgcttccttctatacttctcaactcccacaccgacgtcgtgccgtcggagcccaagaagtgggagcacgcgcctctctctgccactcttgacgaggcatccggtcgcatctacgcgcgcggctcccaggacatgaagtgtgtggggatgcagtatcttgaagccattcggcgtctccgtaatgcgggctttgtcccagatcggaacatatatattatatttgttcccgatgaggagattggtggacatgagggtgttgagctatttgttgcatcgaaggaattcaaggagctgaatgtgggattggttcttgatgaggggcttgcatcccctagggaggagtaccgggtgttctatgcagaacgtagtccttggtggcttactattaaagcaaagggagcgccagggcatggtgcaaaattgtatgatggtagtgcaatggagaatttaatgaaaagtgtggaggctcttcggaggttcaggacagctcagtttgatttggttaagtccggagagaaagctgaaggggacgttgtatcggtgaattttgcgtacttgaaggctgggacacctacacccacgggttttgtgatgaatctacaaccatctgaagcagaggtaggaattgacattcgaatccctcctagtgttcatactgaagcactagagaagcgtcttgctgaagaatgggcaccttcttcacgcaacttgactttcgagttcaaacagaagggctctgtccttgacaagttagggaagccagccatgacaattgctgacagctcgaacccatggtggcctgtgtttgaagaatctgtgaagagagctggtggcaaacttggcaagccggagatatttccggcttctactgatgctcgttatttccgggaaattgggataccagctttcggcttttcccctatggcgaacacaccagtactgctccatgatcataacgagttcctgagcaaagatgagtacctcaaaggaattgggatatacgagtccattataaaggcgctggccacacacaaagatgacggcatcgacgaggagtctagggcagagctgtgaggaaagatgatcttatcttgccacgccggatatcttgcctctcgacgtgcagtcgtaacgcagaagaaggttttggcaaatacatgttctgtttctgctccggcggccaaagcaaaaccacagatacggtccttgtacatctctaataatttgacctgaaataattcatgatactgcatctgtagttcctccacatattgtacgagtaatgacatctctgtataattaaataagtgatggcatttcatccgtcgttcatcggttctttttctgggtgcgacggttcctcgctactttgatctgtcagtgagatactgtgctgaagctgggaaggatcttgagacttggatcc

SEQ ID NO: 4138 - DNA, 1889 bp, Brachypodium distachyon
gtggctcaccgcaacaactccgaagtccaaacccgtctccgccgctctcccagcacatcgtcgcgaacctcccaccccgcagctctctcatcgcgctcgcctcgccagtaggccggagcaaaagcctcgacgcgggcgcgtccctcatggcgggattcaccgggactctcctcccgctcctcctcctcctctccgccgccgcggccgcggccgcctcgccggcgccgtcggacgcggtgtcccggttccaggagtacctccgcatcgacacggcgcagccagcgccggactacgccgcggcggtggccttcctccgcgaccaggcggcagccgcggggctcgaggcgcggacgctcgagcccgccgccggcaagcccctgctggtgctccggtggctcggccggcggccctctctcccttcgatacttctcaattcccacaccgacgttgtgccttcggagccgaagaagtgggagcacgccccattctccgccgctctcgacgaggcatctggccgcatctacgcccgcggctcccaggacatgaagtgtgtggggatgcaataccttgaagccatccgacgtctccgtgatgcgggatttgtccctgatcggaatatctacataacatttgtccctgatgaggagattggtggacatgagggtgttgaactatttgtcacatcaaaggaattcaaagagatgaatgtaggattggttcttgatgagggacttgcatcccctggggaggagtatcgggtgttctatgcagagcgtagcccttggtggctcattattaaagcaaagggtgcaccagggcatggtgcaaagctgtatgatggtagtgcaatggaaaatttgatgaagagcgtggaggctatccggaggttcaggacatctcaatttgatttagttaagtccggagagaaatctgaaggggatgttgtatcagtgaattttgcatacttgaaggctggtacgccgactccgacgggttttgtcatgaatctacaaccatctgaagcagagataggtattgacatcagaatgcctcctaatgttcatattgaagcactggagaggcgtcttgctgaagaatgggcaccttcttcacgcaacttgaccttcgagtttaaacagaagggcactgtctttgacaactttgggaagccagccatgacacttgctgacagttcaaacccatggtggcctgtgtttgaagaagctgtaaagagagctggtggcaaacttagtaagccggagatatttccggcgtctactgatgctcgttacttccgccaaattggaataccagcattcggtttttctcctatggcaaacacaccaatactgctccatgatcataacgagttcctgagcaaagatgagtacctcaaaggaattgagatatacaagtccatcatcaaggcactggctacccacaaaggtgacgaagtcgatgaggagtccagggcagagctgtgagaaaagatgaccctttcctgccatggtggtgtacctctcggctcttgctgtggagttcagaagcatgatccgtcaaaacgaatgcttcgtttctgctcctgggacgggagcaacacggcaaacacgatccatgtacatttctaataatctgacctaaaataattgatgatactgcatctgtatagttcctcagcatatcatacttccgtaagtgatggtattgcatctctagtctcggcgtaattgacgttacttctgctgcctcatgcgtcactgctgtataaacctttgtggcaatgtctctgtttttacctgctgtatgtgctgtgatatgtcttgaagcttggatcttattagctaatgtttatctgaaactagctgaagtttccggcctaatctgaaaca

SEQ ID NO: 4139 - DNA, 1915 bp, Brachypodium distachyon
ccaccaccagtggctcaccgcaacaactccgaagtccaaacccgtctccgccgctctcccagcacatcgtcgcgaacctcccaccccgcagctctctcatcgcgctcgcctcgccagtaggccggagcaaaagcctcgacgcgggcgcgtccctcatggcgggattcaccgggactctcctcccgctcctcctcctcctctccgccgccgcggccgcggccgcctcgccggcgccgtcggacgcggtgtcccggttccaggagtacctccgcatcgacacggcgcagccagcgccggactacgccgcggcggtggccttcctccgcgaccaggcggcagccgcggggctcgaggcgcggacgctcgagcccgccgccggcaagcccctgctggtgctccggtggctcggccggcggccctctctcccttcgatacttctcaattcccacaccgacgttgtgccttcggagccgaagaagtgggagcacgccccattctccgccgctctcgacgaggcatctggccgcatctacgcccgcggctcccaggacatgaagtgtgtggggatgcaataccttgaagccatccgacgtctccgtgatgcgggatttgtccctgatcggaatatctacataacatttgtccctgatgaggagattggtggacatgagggtgttgaactatttgtcacatcaaaggaattcaaagagatgaatgtaggattggttcttgatgagggacttgcatcccctggggaggagtatcgggtgttctatgcagagcgtagcccttggtggctcattattaaagcaaagggtgcaccagggcatggtgcaaagctgtatgatggtagtgcaatggaaaatttgatgaagagcgtggaggctatccggaggttcaggacatctcaatttgatttagttaagtccggagagaaatctgaaggggatgttgtatcagtgaattttgcatacttgaaggctggtacgccgactccgacgggttttgtcatgaatctacaaccatctgaagcagagataggtattgacatcagaatgcctcctaatgttcatattgaagcactggagaggcgtcttgctgaagaatgggcaccttcttcacgcaacttgaccttcgagtttaaacagaagggcactgtctttgacaactttgggaagccagccatgacacttgctgacagttcaaacccatggtggcctgtgtttgaagaagctgtaaagagagctggtggcaaacttagtaagccggagatatttccggcgtctactgatgctcgttacttccgccaaattggaataccagcattcggtttttctcctatggcaaacacaccaatactgctccatgatcataacgagttcctgagcaaagatgagtacctcaaaggaattgagatatacaagtccatcatcaaggcactggctacccacaaaggtgacgaagtcgatgaggagtccagggcagagctgtgagaaaagatgaccctttcctgccatggtggtgtacctctcggctcttgctgtggagttcagaagcatgatccgtcaaaacgaatgcttcgtttctgctcctgggacgggagcaacacggcaaacacgatccatgtacatttctaataatctgacctaaaataattgatgatactgcatctgtatagttcctcagcatatcatacttccgtaagtgatggtattgcatctctagtctcggcgtaattgacgttacttctgctgcctcatgcgtcactgctgtataaacctttgtggcaatgtctctgtttttacctgctgtatgtgctgtgatatgtcttgaagcttggatcttattagctaatgtttatctgaaactagctgaagtttccggcctaatctgaaacatgaatttcagaggagaa

SEQ ID NO: 4140 - DNA, 1737 bp, Lolium multiflorum
ctcttctccgccgccgccgcctcgccgtcgtcggacgcggaggcggtctcccggttccaggagtacctccgcatcgacaccgcgcagccggctccggactacgcagcggcggtagccttcctccgggaccaggcggcggccgccgggctcgaggcgcggactctggagcccgccgccggcaagcccctgctgctgctccggtggcccgggcggcggccggcgctcccttccatacttctcaactcccacaccgacgtcgtcccgtcggagcccaagaagtgggagcacgggcctttctcggccgctctcgacgaggcatccggccgcatctacgcgcgtggctcccaggacatgaagtgtgtggggatgcagtatcttgaagccatccgccgtctccgtgatgcgggctttgtcccagaccggaacatctatataacatttgtccccgacgaggagattggtggacacgagggtgttgagccatttgttgcatcaaaggaattcaaagagctaaatgtgggtctggttcttgatgagggacttgcatcccctggggaggagtaccgggtcttttatgcagagcgtagcccttggtggcttactattaaagcaaagggagcaccagggcatggtgcgaagctgtatgatggtagcgcgatggagaatttaatgaagagtgtggaggctattcgaaggttcaggacagctcagtttgatttggttaagtccggagagaaagctgaaggggatgttgtatctgtgaattttgcgtacttgaaggctgggacaccaacacccacgggttttgtgatgaatctacaaccatctgaagcagaggtaggtattgacatcagaatccctcctagtgttcatactgaagcactagagaggcgtcttgtcgaagaatgggcacctgcttcacgcaacttgagctttgagtttaaacagaagggctctgtccttgacaactttgggaagccagccatgacaactgctgacagctcaaacccatggtggcctgtgtttgaagaagctgtgaagagagctggtggcaaacttggtaagccagagatatttccggcgtctactgatgctcgttatttccgggaacttggcattccagcgtttgggttctctcctatggcgaacaccccaatactgctccatgatcataatgagttcctgagcaaagatgagtacctcaaaggaattgggatatatgagtacattattaaggcactggccacacacaaagatgacaccatcgacagtgaatccagggcagagctatgaggaaagatgatcttatctcgcaacggtggaattctcgctgcatgattgtagtgcagaagcaggttttgacaaacacatgctctgattctgccccgtggccaaagctaaaccacaaatacggtccttgtacatctctaataattagatctaaaataattggtgatacgcatcagtaattcttcagcatatagtacttaaataagtgatggtattttattctcggcataattcatgttactgctgctacttgatgcctcagtgctgtataaacatgtgtggctgtgtctcttctgaagtagtcattggtatgaacctccaaaataaatattctttaccttctgtgaatgtgttgaagctttggaggaaactttccgaagcatgtgaaaactcgcatgttaaagctacacttttccgaaactagctggagttttgacctaatgtgaa

SEQ ID NO: 4141 - DNA, 1652 bp, Secale cereale
gactctcatcgccacgacctcgtcagggggagccagggctcgatgcggatccctcccatggctggactcaccaagatttttcctccctctcctcctcctcctctccgtcgccgcggccgcttcgccgtcgtcggacgtggaggctgtatcccggttccaggagtacctccgcatcgacacggcgcagccgacgccggactacgccgcggcggtgtccttcctccgggaccaggcggcggctgtcgggcttgaggcgcggacgctggagttggccgccggcaagcccttgctgctgctccggtggcccgggcggcggccgtcgcttccttctatacttctcaactcccacaccgacgtcgtgccgtcggagcccaagaagtgggagcacgcgcctctctctgccactcttgacgaggcatccggtcgcatctatgcgcgcggttcccaggacatgaagtgtgtggggatgcagtatcttgaagccatccggcatctccgtaatgcgggctttgtcccagatcggaacatatatattatatttgttcccgatgaggagattggtggacatgagggtgttgagctatttgttgcatcgaaggaattcaaggagctaaatgtgggattggttcttgatgaggggcttgcatcccctggggaggagtaccgggtgttctatgcagagcgtagcccttggtggcttactattaaggcaaagggagcgccggggcatggtgcaaagttgtatgatggtagcgcaatggagaatttaatgaaaagtgtggaggctcttcggaggttcaggacagctcagtttgatttggttaagtccggagagaaagctgaaggggacgttgtatcggtgaattttgcgtacttgaaggctgggacaccaacacccacgggttttgtgatgaatctacaaccatctgaagcagaggtaggaattgacattcgaatccctcctagtgttcatactgaagcactagagaagcgtcttgctgaagaatgggcaccttcttcacgcaacttgaccttcgagttcaaacagaagggctctgtccttgacaagttagggaagccagccatgacaattgctgacagctcaaacccatggtggcctgtgtttgaagaatctgtgaagagagctggtggcaaacttggcaagccggagatatttccagcttctactgatgctcgttatttccgggaaattgggataccagcttttggcttttcccctatggcgaacacacaagtactgctccatgatcataacgagttcctgagcaaagatgagtacctcaaaggaattgggatatacgagtccattataaaggcgctggccacacacaaagacgacggcatcgacgaggagtccagggcagagctgtgaggaaagatgatcttatcttgccacggcgggatatcttgcctctcgacgtgcagttagcgcaggagaaggtttcagcaaatacatgttctgtttctgctccggcagccaaagcaaaaccacagatacggtccttgtacatctctaataatttgacctgaagtaattcatgatactgcatactgtatttagttcctccgcatattgtacgagtaatgacatctgtgcttcaataagtgatggcatttcatccgtcgttcaa

SEQ ID NO: 4142 - DNA, 1155 bp, Saccharum officinarum
tccaagaacaccacaccaacaccacaccccaccccaagtagaaatttcgtcttgcagagccaccaatggcttgttccactgcatctttagcggcgacgctgctggcgttcgcgctgatgttccgggcctgcctcgcggggaggaggctcaccgcgctcgtgcaggagccggccatcaccatgaagtaccacaagggcgcgctcctgtcgggccccatcgccgtcaacttcatctggtacggcgacttctcggcgccgcagcgcgcggtgatcaccgacttcgtctcgtcgctgtccgcggccccggcggcggcgcagccggagccgtccgtggccacgtggttcaagacggcccgcaagtactacgccagctccaaggtgcggttcccggcgctgcgcctgggctcccacgtcatcgaccagaactgctccctcggcaagcggctcacggagagggacctcctcaggctcgccgccaaggggagcccgagccgcgccatcaacctggtgctcacggccgccgacgtggccgtggacgggttctgcatgtcccggtgcggcacgcacggcgcgtccccgcggtcccgctccggccggttcgcgtacgtgtgggtgggcaacccggcgtcgcagtgccccggacagtgcgcgtggccgttccaccagcccgtgtacggcccgcagtcggcgccgctcaccccgcccaacggcgacgtcggggtcgacggcatggtcatctcgctggcgtccatgatcgtcggcacggtcaccaacccgttcggcaacgggttctaccaggagggctcggccgacgcgccgctggaggccgccacggcgtgcgccggcgtgtacggcaagggcgcgtaccccggctacgcggggtctctgctggtggaccaggccagcggggccagcttcaatgccaacggggcccacgggaggaagtacctggtcccggcgctcgtggacccggacacgtcgtcgtgcgccaccttggggtagattcgcgggtcgtaattagcgtttgtgattgtgatgaccgatgaggcggtggtggtgctgtggagagtgttccacgcggctaaaatttgtactttgtagtagtgaccatggtggattctttcatttgttcaatgaaaaagaaatattttcacgc

SEQ ID NO: 4143 - DNA, 1465 bp, Zea mays
ccggtcctccacactccactgtctctcacactcacacagtctcacaaaggctcgtgggctcgtggcctggcctctataaacccccgcccagccggtcacccccaccccatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcaacttcatctggtacggcgacttctcggcgccgcagcgggcggcgatcaccgacttcgtctcgtcgctgacggcggcggccccggccgcggcgcagccggagccgtccgtggccacgtggttcaagacggcgcgcaagtactacgccagctccaaggtgccgttcccggcgctgcgcctcggctcccacgccgtcgaccggaactgctccctcggcaggcgcctgacggagagggacctgctcaggctcgccgccaggggagccccgagccgcgccatcaacctggtgctcacggccgccgacgtggccgtggacgggttctgcgagtcccggtgcggcacgcacggcgcgtccccgcggtcccgctccggccggttcgcgtacgtgtgggtcggcaacccggcgtcgcagtgccccgggcagtgcgcgtggccgttccaccagcccgtgtacggcccgcaggcggcgccgctcaccccgcccaacggcgacgttggggtcgacggcatggtcatctcgctggcgtccatgctcgtcggcacggtcaccaacccgttcggcaacgggttctactaccaggagggctcggccgacgcgccgctggaggccgccacggcgtgcgccggcgtgtacggcaagggcgcgtaccccggctacgcgggctcgctgctggtagaccaggccagcggggccagcttcaatgccaacggggcccacgggaggaagtacctggtcccggcgctcgtcgacctggacacgtcgtcgtgcgccaccttggtttagatttcgctggtcgtaatcagtgttttgtgatggcgggtgctgtgcgtggagagtgttccacgcggctgacgattctagtagtgtagtgacctgtgaccatggtggattctttcatctgttcaatgaaaaaaaagaaatattttcacgcacacacgccggtcgattttgccaacaatatactctgttcccccaaagattttgccaggtttgagcatgagcaagatgcatgaatctgtacgacatgaaatcatgtgctatcccgcgcagatggtaaatgttcgttgtaccaagggaagaaaga

SEQ ID NO: 4144 - DNA, 1108 bp, Echinochloa colona
ccaatggcttgttccacagcatctctagcggcgacgctgcttgcgctcgcgctgatgttccaggcctgcctcgccgggcggcggctcaccgcgctcgtgcaggagcctgccatcaccatgcggtaccacaagggcgcgctcctctcgggccgcatcgccgtcaacttcatctggtacggcaacttctccgccccgcagcgcgcggtgatcaccgacttcgtctcgtccctctccgcgtccccggcggcggcggcgcaggcgcagccggagccgtcggtcgccacctggttcaagacggcgcgcaagtactacgccaactccaaggcgcggttcccggcgctgcgcctcggctcccacgtcctcgactcctcctactccctcggcaagcgcctcacggacggtgacctcctcaagctcgccgccaaggggtccccgagccgcgccatcaacgtggtgctcaccgccgacgacgtcgccgtggacgggttctgcatgtcccggtgcggcacccacggcgcgtccccgcggtcccgctccggccggttcgcgtacgtgtgggtgggcaacccggcgtcgcagtgccccggccagtgcgcgtggccgttccaccagccgacgtacggcccgcaggcggcgccgctcacggcccccaacggcgacgtgggcgtcgacggcatggtgatctcgctggcgtccatgatcgtgggcacggtgaccaacccgttcggcaacgggttctaccaggagggctccgccgacgcgccgctggaggccgccacggcgtgcgccggggtgtacggcaagggcgcgtacccgggctacgcggggtcgctgctggtggaccaggccagcggagccagcttcaatgccaacggggcccacgggaggaagtacctggtcccggcgctcgtggacccggacacgtcgtcgtgcgccacattggggtagatttcgtggggggtgatgatggctagtgtttgcgagggtgtgtgttactgtggagagtgttccatgcggctaaagtctgtactttgtagtagtgacggtggattctttcatttgttcaatgaaaaagaaatatttttagcgtggtgtggtcggcgtctct

SEQ ID NO: 4145 - DNA, 1372 bp, Setaria italica
cctcgagcaccaagcaagaagaaccctctgaaagcaccaacccaagaacaccccccacctccagtagaagaagtttcgttcttggattggagccaccacatcaccaatggcttgttccaccgcatctctagcagcgacgctgctggcgttcgcgctgttgttccaggcctgcctcgccgggaggcggctcaccgcgctcgtgcaggagccagccattaccatgaagtaccacaggggcgcgctcctgtcgggccgcatcgccgtcaacttcatctggtacggcaacttctccgcgccgcagcgcgcggtgatcaccgacttcgtctcgtcgctgtccgcgcccccggcggcggcggggcagccggagccgtcggtcgccacctggttcaagacggcgcgcaagtactacgccaactccaaggcgcggttcccggcgctgtacgtcggcacccacgtcctcgactcgtcctactccctcggcaagcgcctcacggacggggacctcctcaagctcgccgccaagggcgccccaagccgcgccatcaacgtggtgctcaccgccgacgacgtcgccgtcgacgggttctgcatgtcccggtgcggcacgcacggcgcgtccccgcggtcccgctccggccggttcgcgtacgtgtgggtgggcaacccggcgtcgcagtgccccggccagtgcgcgtggccgttccaccagcccgtgtacggcccgcaggcggcgccgctcacgccccccaacggcgacgtcggggccgacgggatggtgatctcgctggcgtccatgatcgtcggcacggtgaccaacccgttcggcaacgggttctaccaggagggctccgccgacgcgccgctggaggccgccacggcgtgcgccggcgtgtacggcaagggcgcgtaccccggctacgcgggctcgctgctggtggaccaggccagcggtgccagcttcaatgccaacggggcccacgggaggaggtacctggtcccggcgctcgtggacccggacacgtcgtcgtgcgccaccttggggtagatttcgtggcggggctagtggttttgtgagggtggtgtgttgcttgtggagagtgttccacacggctaaagtctctgtaccttgtagtagtggatggaggattctttcatttgttcgatgaaaaagaaatatttttcaagaacatcctgtccgtatgcttcttcgattttgcaaaattggcggagcatacgagagaaatcatgtgctgctctgcacctgctcgtgcagatggtaagtgttcattgtaccaggaacaggggaagaaagatagcataaacaataagacttggtcagaaaaataatgttttcggggccatgggaagtggg

SEQ ID NO: 4146 - DNA, 1586 bp, Setaria italica
catcgcaaatcctcgagcaccaagcaagaagaaccctctgaaagcaccaacccaagaacaccccccacctccagtagaagaagtttcgttcttggattggagccaccacatcaccaatggcttgttccaccgcatctctagcagcgacgctgctggcgttcgcgctgttgttccaggcctgcctcgccgggaggcggctcaccgcgctcgtgcaggagccagccattaccatgaagtaccacaggggcgcgctcctgtcgggccgcatcgccgtcaacttcatctggtacggcaacttctccgcgccgcagcgcgcggtgatcaccgacttcgtctcgtcgctgtccgcgcccccggcggcggcggggcagccggagccgtcggtcgccacctggttcaagacggcgcgcaagtactacgccaactccaaggcgcggttcccggcgctgtacgtcggcacccacgtcctcgactcgtcctactccctcggcaagcgcctcacggacggggacctcctcaagctcgccgccaagggcgccccaagccgcgccatcaacgtggtgctcaccgccgacgacgtcgccgtcgacgggttctgcatgtcccggtgcggcacgcacggcgcgtccccgcggtcccgctccggccggttcgcgtacgtgtgggtgggcaacccggcgtcgcagtgccccggccagtgcgcgtggccgttccaccagcccgtgtacggcccgcaggcggcgccgctcacgccccccaacggcgacgtcggggccgacgggatggtgatctcgctggcgtccatgatcgtcggcacggtgaccaacccgttcggcaacgggttctaccaggagggctccgccgacgcgccgctggaggccgccacggcgtgcgccggcgtgtacggcaagggcgcgtaccccggctacgcgggctcgctgctggtggaccaggccagcggtgccagcttcaatgccaacggggcccacgggaggaggtacctggtcccggcgctcgtggacccggacacgtcgtcgtgcgccaccttggggtagatttcgtggcggggctagtggttttgtgagggtggtgtgttgcttgtggagagtgttccacacggctaaagtctctgtaccttgtagtagtggatggaggattctttcatttgttcgatgaaaaagaaatatttttcaagaacatcctgtccgtatgcttcttcgattttgcaaaattggcggagcatacgagagaaatcatgtgctgctctgcacctgctcgtgcagatggtaagtgttcattgtaccaggaacaggggaagaaagatagcataaacaataagacttggtcagaaaaataatgttttcggggccatgggaagtgggaaatccgcgagcatgttccctcatgtcatgtgcgagcaaatttgctgataccttcttcgatgttactgttagatagcaccagtggcggacccaggatttcagagtagggtatgcccatggccaagaaaatacttagataaacgataagatcttacataaaagatacatatatagttcaaactaaatgtctttgataacaaagag

SEQ ID NO: 4147 - DNA, 4019 bp, Panicum virgatum
tgaatagtgaagtttggaaagagaaattttggaactaaacacagcaatagatttcgagtgcgagctgcggtgtcccgaacaccggcttaaattgctgctagactgtgcctgactgtaaaatgacagtacgtcgtcagtagtcatggctgttaaagggtaaagcagtactcctgcatagctacggcttgattcaaaatcatcacgaatcaataagtactccccgtaacctctttgatactattagctctgctccctgctcaggattagctgcattccctgcactacataagttttttttttcaactttattcagagacagacgagcttgccggctgcggaattaccttacctgtacgggccgtgcggccttacagtattaattgggctaaatttacggatctactgcggtgtgttcggatgcttctacgtgggccgcgggctcccctggttagacatctgaagattttacagggagcaggtagaccgtcctcagcccggatcacaaacaaatgaatcgccaattcgccataaacgcctgcttaaccgttgaactttttttaaaagtttttaaccgttgaactaacagctgccgcacatcaattcagcaaaagttactcgtgccagaacacgcaacgaaccgacgatcgacggctaatccaaaaggctttccaaggtgaagcaccattttccgaactgcattcacattccgtattcggcttggaacaagtcgtctgctagctggctctcgcaagaaacgggccaagaaagtgtcgcagcaggacacgccaaaaaagagacgaggggatcggtactggcgtgatggcttcacttcacatttatgcacgcatcaaaagctcatgcatgaatggatggccggagctagctcgccggtcgccacattcaagaacgcggcgaccctcttcggcccttcgacatcgtcgcatcaccatccaacggtcgccagccacgccgtcgcggataaggccagccgccagccgccggcctctgtgtggagtgtggactcatcgccccgtcggcgtccgccgcgtaccgtgtgggtgtacgcgtgtccacgcccgaccggccggctggcggccgcggccgctagctagcagctggtgggcacgcgagcaatgagcgaacgagccccgttcacgagcgcgtcgtgagggcgctaggcgcccccggggccgcagcgcgccagcgcctggccgcttcaccaccagctggccgccggccgtacgcggatcttcaggcgagcccacaccggcgggtccgcggagcaggaaagcgccgggcgcgggcccgctggtggcccgctgatgacatgtgggggctgctgtacctcgggctcgcttcgccgccgtacgccgatgggcctcgtcggagatcccatcgacatcgacccatccgatccgatcgcgcgagtgccgtcgcgtcgtgccgtcgtctcctcccccgattggcaaatcagctgccgagctccactaaccccacagtgaccatctgcccggtcgcagcattgtgcatgtgtggatccatggtcagttacgtacggttcggagaacgatgcagttggtgctcgccttagagccggggctgctgggatcacggctgtaatggcaaggacgatcccaacccgacggaccacctcgctccagcattggccatggagatctcggatcgaccgggtcccgtcccaccgtttgccgtgtcgatgggaacatggaatggtaggatcgatcagcttctcacacccactcccttgccatctccgtggtcagcttcttcttccgtcctctcgccacccatgcaggccgaggccagcagcagcctggctggcaagttacgcggcgaggcgatggatcggactgagcgcgagcagtgcgcaccaactgttcgagtaccgggggatactctgctgactgctgccccccacagctcttgaagccggggagcggggcccatgaaccagtgacctccaacgttcggaacccgccgggcccggcccagcactgaccacccctccccaacgttcatatcccccgctgcctaaaatttcaagcgcatcgagaagcccacctgcttttacccactcccggagtccccactttgccagtccccccccgcaatgcccaacttgccactgctttcaagccggcgcgcgcgggcatccgaggcggcgactgcctgggcaaaacggtaaagcggccgccccgctacagctgggatccagcagcgccacgcaaagccagctgtcagtgaccgttcggagcagccccgccaagccaaggacgccccccctctttactttgggtctttggcccagaaagtgctctccccctcctcatacggcacgcgcagtgccagccgagcccctccacctccacgctccactgtctcgcccttcgccagcgcgtggcctctataaaccccccgctcgctccacaccaaacccatcgctcaagctccaagcaagaagagccagcagaaatcactcggttaagaacacacccacaccaatctccattagaaattttagtattggattggagccaccaccaccaccaccaatggcttgttccaccgcatctctagcggcgacgctgctggcgttcgcgctgctgttccaggcctgcctcgccgggaggcggctcaccgcgctcgtgcaggagccggccatcaccatgaagtaccacaagggcgcgctcctgtcgggccgcatcgccgtcaacttcatctggtacggcaacttctccgcgccgcagcgcgcggtcatcaccgacttcgtctcgtcgctgtccgcggccccggcggcggggcagccggagccgtccgtcgccacctggttcgggacggcgcgcaagtactacgccagctccaaggcgcggttcccggcgctgcgcgtcggctcccacgtcctcgacgcgtcctactccctcggcaagcggctcacggacggcgacctcctcaagctcgccgccaggggtgccccgagccgcgccatcaacgtggtgctcaccgccgacgacgtcgccgtggacgggttctgcatgtcccggtgcggcacgcacggcgcgtccccgcggtcgcgctccggccggttcgcgtacgtgtgggtgggcaacccggcgacgcagtgccccggccagtgcgcgtggccgttccaccagcccgtgtacggcccgcaggcggcgccgctcacgccccccaacggcgacgtcggggccgacgggatggtgatctcgctggcgtccatgatcgtcggcacggtgaccaacccgttcgggaacggcttctaccaggagggctccgccgacgctccgctggaggccgccacggcgtgcgccggcgtgtacggcaagggcgcgtaccccgggtacacggggtcgctgctggtggaccaggccagcggggccagcttcaatgccaacggggcccacgggaggaggtacctggtccccgcgctcgtggacccggacacgtcgtcgtgtgccaccttggggtaggttttggtggcgtgactagtgtttttgtgaaggcctgaagggtggtgttacggtggagagtgttccacacggccgtgtctgtagtttgtagtagtgatgacggtggattctttcatttgttcaatgaaaaaaaagaaaatattttcgcgcatatcctgtccgcatgcttgctcgattttataaatttgtcagagcatacgagtggaaatcatgtgctgttctcatgttctgcacctgttcgtgcagatggtaagtgttcattgtaccgaggggagaaaaaagatacaagcataaacaataagacgtgcagatggtaagtgttcattgtaccaagagaagaaagaataaacataagacttgttcagaaaaataaagtttccggggcaaaggaaagtgggaaatccgcgagcatgttccctcatgtcatgtgcgaccaaattgttgataccttcttcgatgtgcctcgagttgtgcagtaaaaccacaatacaacacgcagggtttaagaac

SEQ ID NO: 4148 - DNA, 1288 bp, Zea mays
gccggctataaataaagtacccccgctcatccccatccatagcaaatcctcgacaccgagcaagaagccaggaaccagctcaaagttattcgtccaagaaccccaccccactccccgaatagaaatttcgtcttggagagccaccaatggcttgttccactgcatctttagcggcgacgctgctggcgttcgcgctgatgttccaggcctgcgtcgcggggaggcggaggctcaccgcgctcgtgcaggagccggccatcaccatgaagtaccacaaggccgcgctcctgtcgggccccatcgccgtcaacttcatctggtacggcgacttcacggcgccacagcgggcggtgatcaccgacttcgtctcgtcgctgtccgcggccccgcgggcggcggcgcagtcgcagccggagccgtccgtgtccacgtggttcaagacggcgcgcaagtactacgacacctccaaggcgcgtttcccggcgctgcgcctcggctcccacgccgtcgaccggaactgctccctcggcaggcggctcacggagcgggacctcctcaggctcgccgccaggggggcaccgagccgcgccatcaacctggtgctcacggccgccgacgtggccgtggacgggttctgcgcgtcccgttgcggcacgcacggcgcgtccccgcggtcccgcgccggccggttcgcgtacgtgtgggtgggcaacccggcgtcgcagtgccccggacagtgcgcgtggccgttccaccagcccgtctacggcccgcaggcgccgccgctcacgccccccaacgccgacgtcggggtcgacggcatggtgatctcgctggcgtccatgatcgtcggcaccgtcaccaacccgttcggcaacgggttctaccaggagggctcggccgacgcgccgctcgaggccgccacggcgtgcgccggcgtgtacggcaagggcgcgtaccccggctacgcgggggcgctgctggtggacccggccagcggcgccagcttcaatgccaacggggcccacgggagaaagtacctggtcccggcgctcgtggatccggacacgtcgtcgtgtgccaccttggggtagatttcgcggatcgtaaattagtgtttgcgatgtggcggtggtagtgctgtggagagtgttccacgcggctaaaagtttgtgctaaagtagtactgaccaggttgcattatttcatttgttcaatgaaaatgaagtattttcacgcacatactactcttatgcatgtcgattctgcctgcaatttactcggtttc

SEQ ID NO: 4149 - DNA, 1276 bp, Oryza sativa
cggaaaattaaccatcccccatccacttctcacactccacttcactctcctcggccaactataaagcccgcacccagctcgatctgcttccccacccaacgtccccaagaactcatctggccaaaaacccaccaaaatcctctcgatccatcgccaatggcggcttcctccgcagcttttgcagcgtgcctgctcgcgtgcgcgcttctcttccagatgtgcgtagcgtcgaggaagctcaccgcgctggtgcaggaccagcccatcacaatgacgtaccacaagggcgcgctcctctccggccgcatcgccgtcaacctcatctggtacggcaacttctccgcgccgcagcgcgcggtgatcaccgacttcgtctcgtcgctgtccaccccgccgtcgccgcagccgcagccggagccgtccgtcgccagctggttcaagacggcgcagaagtactacgccaactcgaaggcgcgcttcccggcgctgtccctcggccagcacgtgctcgaccagtcgtactccctcggcaagcggctcggggagaaggacctcgtcaggctcgccgcccgaggctcgccgagccgcgccatcaacgtggtgctcacggccgacgacgtcgctgtcgacggcttctgcatgagccggtgcggcacccacggcgcgtcgccgcggtcccgcgccgggcggttcgcctacgtgtgggtgggcaacccggcgacccagtgccccggccagtgcgcgtggccgtaccaccagccggtgtacggcccgcaggcggcgcccctcacgccgcccaacggcgacgtcggcgtcgacggcatggtgatatccctcgcctcgatgatcgtcggcaccgtcaccaacccgttcggcaacggcttcttccagggcgacgccgacgcgccgctggaggccgccaccgcgtgcgccggagtgtacggcaagggggcgtacccgggttacgccgggtcgctgctggtggacccggccagcggggccagctacaacgcgaatggggcgcacgggaggaaatacctggtcccggcgctcgtagaccccgacacgtcggcctgctccaccgtcgggtagatttgttggaatggagtagaggactgttgttttgttaccacggtggagagtgttccacgcggctaaaatttgtacctgggggtagtggtgaaattctttcatttgttcaatgaaaaaaaatattagttaaagatagtactgttcgaaactgaatcaacatcctcacctcgagatcgatcatcgt

SEQ ID NO: 4150 - DNA, 1271 bp, Triticum aestivum
agagcatcctaggcaagaagaggagagacccaccacctgagagcagcggcaatggcgtccttcggttccatggcggtggcgctcgtggtgtgcgcaatgctgctgcagacctgcgcggccacgaggaggctccaggcgctggtgcaggagcagcccatcaccatgaagtaccacaagggcgcgctcctctccggccgcatcgccgtcaacctcgtctggtacggcaacttctccgcgccgcagcgcgccatcgtcaccgacttcgtctcgtcgctcgcctccgcgtccccggcgccggcgccgcagccggagccgtccgtggccacctggttcaagacggcgcagaagtactacgccagctccaaggcccgcttcccggcgctggccctcggctcccacgtcttcgaccggtcctactccctcggccggcggctccgggagcgggacctcgtcaggctcgccgcgcgcggcgggcccagccgcgccatcaacgtggtgctcacggccgacgacgtggccgtcgacggcttctgcatgagccgctgcggctcccacggcgcctccccgcggtcccgcgccgggcggttcgcgtacgtgtgggtgggcaacccggcgacgcagtgcgccgggcagtgcgcgtggccgttccaccagccgcagtacggcccgcagacggcgcccctcgcgccgcccaacggcgacgtcggcgtcgacggcatggtggtgtccctcgcgtccatgatcgtcggcaccgtcaccaaccccttcggcaacggcttcttccagggcccggccgaggcgccgctggaggccgccacggcgtgcgccggggtgtacggcaagggggcgtaccccggctacgccggctcgctgctcgtggacccggccaccggcgccagcttcaacgcgaatggagcccacggccggaagtacctggtcccggcgctcgtcgaccccgacacgtccgcctgctccaccttggggtaggctctacgtaggaccatgatggtgtgtagttatagttgcggtggcgttgttgctgtgtggagagtgttccaccttccacgcgcgtgctaatgttaatctgtgtgcctgtagaggcgttgagatgaaattctttcatttgttgaatgaagaaaagtttactattaatgtaagagaacattgttcggaaactaacatttcggtgctcgttgagagatttacagcagaaactcgagcatccatcaaaatgacatgcatagagtactgcttcattaaaataccgaggg

SEQ ID NO: 4151 - DNA, 1176 bp, Leymus cinereus x Leymus triticoides
cgagcccaaacagaggaggaccccccctaggcaagaagtgacccaccaccccagcagcaaagcaatggcttcctttagttccatggcggtggcgctcctggtgtgcgcaatgctgctccagacctgcctcgccacgaggaggctcacggcgctcgtgcaggaccagcccatcaccatcaagtaccacaagggcgcgctcctctccggccgcatcgccgtcaacctcgtctggtacggcaacttctccgcgccgcagcgcgccatcatcaccgacttcgtctcctcgctgtccgcgtccccggcgccgcagccgcagccggagccgtccgtggccacctggttcaagacggcgcacaagtactacgccagctccaaggcccgcttcccggccctggccctcggctcccacgtcttcgaccagtcctactccctcggcaggcggctccgggagaaggacctcgtcaggctcgccgcgcgcggcgggcccagccgcgccatcaacgtggtgctcacggccgacgacgtgactgtcgacgggttctgcatgagccgctgcggctcgcacggcgcctccgcgcggtcccgcgccggccggttcgcgtacgtgtgggtgggcaacccggcgacgcagtgccccggccagtgcgcgtggccgttccaccagccgcagtacggcccgcagacggcgcccctcgcgccgcccaacggcgacgtcggcgtcgacggcatggtggtgtccctcgcgtccatggtcgtcggcaccgtcaccaacccgttcggcaacggcttcttccagggcccggccgaggcgccgctggaggccgccacggcgtgcgccggcgtgtacggcaagggggcgtaccccggctacgcgggctcgctgctcgtcgacccggccaccggcgccagcttcaacgccaacggagcccacgggcggaagtacctggtcccggcgctcgtcgaccccgacacgtccgcctgctccaccttggggtaggtccgtaggaccataatggtgtagttatagttgcggtgacgttgttgctgtgtggagagtgttccaccttccacgcgcgtgctaatattaatctgtgtgcctgtagaggcgttgagatgaaattctttcatttgttgaatgaaaaaagttactttttaatgtaagagagcattgttgga

SEQ ID NO: 4152 - DNA, 1231 bp, Hordeum vulgare
atcaccggctcacgagctagagcagagcatcctagacaagaagaggagaggcaccaccaccccggcggacggcagcaatggcggcttcgttcagctcttctgtggcggtggcggtggcggtcatggtgtgcgcaatgctggtgcagacctgcgtcgccacgaggcggctcacggcgctggtgcaggacccgcccatcaccatgaagtaccacaagggcgcgctcctctccggccgcatcgccgtcaacctcgtctggtacggcaacttctccgcgccgcagcgcgccatcgtcaccgacttcgtctcctcgctctcctccgcgtcgccggccgcggccccgcagccggagccgtccgtggccacctggttcaagacggcgcagaagtactacgccagctccaaggcccgcttcccggccctggccctcggctcccacgtcctcgaccagtcctactccctcggcaagcgcctccgggagcgggacctcgtcaggctcgccgcccgcggcggggccagccgcgccatcaacgtggtgctcacggccgacgacgtggccgtcgacgggttctgcacgagccgctgcggctcgcacggtgcctccccgcggtcccgtgccggccggttcgcgtacgtgtgggtcggcaacccggcgtcgcagtgcgccgggcactgcgcgtggccgttccaccagccgcagtacgggccgcagacggcgcccctcgcgccgcccaatggcgacgtcggcgtcgacggcatggtggtgtcgcttgcgtccatgatcgtcggcaccgtcaccaaccccttcggcaacggcttcttccagggccccgccgaggcgccgctggaggccgccacggcgtgcgccggcgtgtacggcaagggggcgtaccccggctacgccggctcgctgctcgtcgacccggccaccggcgccagcttcaacgcgaacggagcccacggccggaagtacctggtcccggccctcgtcgaccccgacacgtccgcatgctccaccttggggtagggccatgaccatgataagtggtgcgtagttatagttgcggtggcgttgttactgtgtggagagtgttccaccttccacgcgcgtgctaatattaatccgtgtgcctgtagaggcgttgagatgaaattctttcatttgttgaatgaaaaaagtttactacgtattaatgtaagagagcattgtttggaaactaacattattatcat

SEQ ID NO: 4153 - DNA, 1118 bp, Pseudoroegneria spicata
gagacccaccaccccggcggcaatggcttcctttagctcttcggtggcggtggcgctcctggtgtgcgcaatgctgctgcagacctgcgtcgccacgaggaggctccaggcgctggtgcaggaccagcccatcaccatgaagtaccacaagggcgcgctcctctccggccacatcgccgtcaacctcgtctggtacggcaacttctccgcgccgcagcgcgccatcgtcaccgacttcgtgtcgtcgctgtcctccgcgtcccccgcgccgcagccggagccgtctgtggccacctggttcaagacggcgcagaagtactacgccagctccaaggcccgcttcccggccctggccctcggtcatcacgtctttgaccagtcctactccctcggcaagcggctccgggagagggacctcgtcaggctggccgcccgcggcgggcccagccgcgccatcaacgtggtgctcacggccgacgacgtggccgtcgacgggttctgcatgagccgctgcggctcgcacggcgcctccgcgcggtcccgcgccgggcggttcgcgtacgtgtgggtgggcaacccggcgacgcagtgcgccggccagtgcgcgtggccgttccaccagccgcagtacggcccgcagacggcgcccctcgcgccgcccaacggcgacgtcggcgtcgacggcatggtggtgtccctcgcgtccatgatcgtcggcaccgtcaccaacccgttcggcaacggcttcttccagggcccggccgaggcgccgctggaggccgccacggcgtgcgccggggtgtacggcaagggggcgtaccccggctacgcgggctcgctgctcgtggacccggccaccggcggcagcttcaacgcgaacggagcccacgggcggaagtacctggtcccggccctcgtcgaccctgacacgtccgcctgctccaccttggggtaggctcgtaggaccagtgtagctatagtagcggtggcgttgttgctgtgtggagagtgttccaccttccacgcgcgtgctaatattaatctgtgtgcctgtagaggcgttgagatgaaattctttcatttgttgaatgaaaaaaagtttactattattactagta

SEQ ID NO: 4154 - DNA, 1356 bp, Secale cereale
cgtcacgcggtgcccctccctcggtaccatgcccaccacctttgcggtgctccactgtctctgctcttctcgctcactccctctataaaaccccggctcgatcccctccagttcatccatcaccagcccacgagcccagacagaggatccaaggcaagaagagaagagaagagatcgaccagaccacagtagcaatggcgtccttgagttccatggcggtggcgctgctggtgtgcgcaatgctgctgcagacctgcgtcgccacgaggaggctcacggcgctggtgcaggagcagcccatcaccatgaagtaccacaagggcgcgctcctctccggccgcatcaccgtcaacctcgtctggtacggcaacttctccgcgccgcagcgcgccatcgtcaccgacttcgtctcgtcgctcacctccgccgcgtccccggcgcagccggagccgtccgtggccacctggttcaagacggcgcagaagtactacgccagctccaaggcccgcttcccggccctggccctcggctcccacgtcttggaccagtcctactccctcggcaggcggctccgggagaaggacctcgtcaggctggcggcccgcggcggcccgagccgcgccatcaacgtggtgctcacggccgacgacgtggccgtcgacggcttctgcatgagccgctgcggctcccacggcgcctccgcgcggtcccgcgccgggcggttcgcgtacgtgtgggtcggcaacccggcgacgcagtgcgccggccagtgcgcgtggccgttccaccagccgcagtacggcccgcagacggcgccgctcgcgccgcccaacggcgacgtcggcgtcgacggcatggtggtgtccctcgcgtccatgatcgtcggcaccgtcaccaaccccttcggcaacggcttcttccagggccccgccgaggcgccgctcgaggccgccacggcgtgcgccggcgtgtacggcaagggggcgtaccccggctacgcgggctcgctgctcgtggacccggccaccggcgccagcttcaacgcgaacggagcccacggccggaagtacctggtcccggcgctcgtcgaccccgacacgtccgcctgctccaccttggggtaggctctcggtaggaccattaatggtgtagttatagttgcggtgacgttgttgctgtgtggagagtgttccaccttccacgcgcgtgctaatattaatctgtgtgcctgtagaggcggtgaaatgaaattctttcatttgttgaatgaaaaaagttactattaatgtaagagagtactatcattactaaaaaaaaaaaaaaaaaaaaaaaaaaaaaaaaaaaaaaaaaaaaaaa

SEQ ID NO: 4155 - DNA, 1516 bp, Saccharum officinarum
tcaacacaccgttcaaacacaacaacacacacacagcaaagagaagccaagaacctcctgtttcctgctggaaccaagcttcactcgatcgatacatcagagacggccacacgaaactgatcaaggcattagcattatcggcaatgggcgagttgatccctgggttgccggaggaggtggcgagggagtgcctcgtccgagtgggcttcgaccagctgccggtggtccgccgcatctcgcgccagtggaagtccgaggtggagtcgccggactaccaccgacagcgccgggcggaggggctggcgcgcccggtgctcgcgctggtccaggcgcagccgacagcgccaccggctgacgacggcgctggtggtccggtggacaagcactcgacggcggcgggctcgggaggccccgcgaactcgtaccggatggtgttgctggacccggtggagggacggtgggcgccgctgccgcccttgccgtggccaagcgagagccttcccctcttctgccaggtggccgccgtggacggcggcggcgggcagggacaggggaggaagcggctggtggtggtcggcggctggcacccggagacgtgggcgccgacggacgcggtgttcgtctacgacttcctgacgggcgcgtggcggcgcggcgcgcccatgccgggcccgcgccggtccttcttcgcctgcgcggccgtcggcggcgccgtgtacgtggccggcgggcacgacgacgagaagaacgccctgcggtcggcgctggcctacgacccggaggccgacgcgtgggcgcagctcccggacatggcggaggagcgcgacgagccgcgcgggctctgcgccgccgccgggggaagcagcaggttcctcgtcgtcggcgggtacccgacgcaggcgcagggccggttcgttggctccgcggagtgcttcgacccggcgacgtccacctgggcgcccgtcgacctgatgatcgaggacggcgtgtgcccgagaacctgctgtgccgcgccagggccagggccgtctgagcgcatgtacatgctgagtcgcgatgggaacctcgtggcgcgcgacggcgccgcctcggcgtcggcgtggcgaccggtggcgcaggtgcccgaggacgcccgcaccgcggcgaccgtctccgccatcccggacggccgcgtcgtggtcattgggtccgggtgccacggcggggatcagaccgtgtacgtgctccgcgaggagcccgggaaaggcgcatcgtcctggacgcgcgcgcccgcgccgcccgagttctccgggcacgtgcaggcctcctgcttccttgaaatctgaagtgtacttgtacgtacgtacaggacagaactacgctacgtgcttctcgccactactactcacggttgtgctgtatattgcaaatcaagccgatgtttaagaacagtagtaggatatgtactgtactgtactagtataattactgtgggaaattagtgaagtatcaagctttgttatgccttcgttcgatc

SEQ ID NO: 4156 - DNA, 1585 bp, Panicum virgatum
tcccgctcctcgccttcgcctcacacaaacgcatcgagctcagactcagagaactgagaagccaaagaagaacctctccctctcgtttcctgcacgaatccggcttccatccatcgatcggaacaccacacactgccagccggacgcagccgatcaagggcaatgggcgagctgatccccgggttgccggaggaagtggcgcgggagtgcctcgtccgggtgggcttcgaccagctgcccgtggtgcgccgcatctcgcgccagtggaagtcggagttggagtcgccggactaccaccgcctgcgccgggccgaggggctggcgcgcccggtgctcgcgctggtccaggcgagccccgcgccgccggccgacggcgacgcgggcacggctgcggacaagcagcgctcctcggcggcgggccccgcgaactcgtaccggatggtgctgctggacccggaggagggccggtgggcgccgctgccggcgccgcccgggccggcggggagcctgcccctgttctgccaggtggccgccgtgggcggcggcgggcaggggcggaagcggctggtggtcgtcggcggctgggacccggagacgtgggcgccggtggacgcggtgctcgtgtacgacttcctgaccggcgcgtggcgccgcggcgcgccgatgccgggcccccgccggtccttcttcgcctgcgcggccgtcggcggggccgtgtacgtggccgggcggccacgacgaggagaagaacgcgctgcggtcggcgctggcgtacgacccggagcgcgacgcgtggtcgtggctccccgacatggcggaggagcgcgacgagccgcgcgggctctgcgtcggcggcaggttcctcgtcgtcggcgggtacccgacgcaggcgcagggccgcttcgtcggctccgcggaggccttcgacccggcggcgtcggcctgggcgcccgtcggggacggcctgctcgaggacggcgcgtgcccgaggacctgctgcgcggcgccggggccggcggggcgcctgtacatgctccgcgacgggcacctcgtggcgcgcgacgctgccgcgccgggcgcggcgtggcggccggtggcgcaggtgcccgaggacgcgcgcaccgcggcgaccgtctccgccatccccggcggccgcgtggtggtgatcggctccgggtgccacggcggcgacaagaacgtgtacgtgctccgcgaggaggccggcaagggcgcgtcctgggagcgcgcggcggcgccgcccgagttcgccgggcacgtgcaggcctcctgctgcctcgaaatctgatgaagtgtacatagtacgagtggaatgccgaccacagatgtccctgcaagtttgtacagtacatactctgcaactacgtctcgctgttgtgtatagaaagaacatcaagctaagcagagtaacgagggaaggggcaaaaaaatagtttaagaacaagtagcagaatatgtaatgcactaaaaatgtttgagaaatgagtgaagtatcaatggcagtttttgaggtctttgctgaatcaaattttgttccgttggaatttcttggcagcatgatcagttt

SEQ ID NO: 4157 - DNA, 2470 bp, Zea mays
tgtcagcagagcagatcacatggaccatgcagaggagcggactcaagcagtgcaacagaaggcacagacagagggagtcaaggaagacaatcagagcccgcgcagccgtcgtgtaccaaagccaaataccaagtacatcggtgcagagtggcgcgtataggtatacggagttatacgtattgatgagggcaggtgtgccggtataaataatattgtaatcgtttctaaactcagtctggaacatgttattgccgagtcggcaagaaaggaatagataccagagaaattcctggcgtgaaccacgggtgttgttcacatttggtaccagagccaatactggatcctccacacgggtactggacgagatcgcaatcgaagttgggcggcatggcgccagcgaagacggacgatcctttgtcccagcttctggcgaagatcgaggagggaaacaaggagactcaccgacgcatggaggcgattcagggggcggtgggaaatatggaggcggcggtcaaggcgatccagatccagatgggaaagatggagaagaagccgctcggtttcgggtcgagacaggaagaagaaggagaagacggatttctgaagccgccaccatctgattcttcgaatttggagtttcgtcgtgaagaagggcggacccaattctcgcatggagatatctttactgggttgcaggtgccggaggaagttctggagtccaggcttcttcgtaaagggggtaaggtgatttcgcagttgctcattaagtggtccaattggccggtgtcactgtcaacctgggaggatgaagaggccattaagcagaaatttccacaagcaccagcttggggtcaagctgtcgttaaagaagggggaaatgtcagcagagcagatcacatggaccatgcagaggagcggactcaagcagtgcaacagaaggcacagacagagggagtcaaggaagacaatcagagcccgcgcagccgtcgtgtaccaaagccaaataccaagtacatcggtgcagagtggcgcgtataggtatacggagttatacgtattgatgagggcaggtgtgccggtataaataatattgtaatcgtttctaaactcagtctggaacatgttattgccgagtcggcaagaaaggaatagataccagagaaattcctggcgtgaaccacgggtgttgttcacactcgctgtccctgcctgactcttaaaaagggcggcgtgtcaccgcctggttactcacagtcatagattcacgccgcggaacgcggattccaagaacccaagtgaatcgcggctcctcgagtccggcggtgccgtccggagaggtagagctagactgctagagcacagccccgccatggcggccgcggcgcgcgcgatcatctgcgagctggcgccgcagaaggtgtcgtcgacggcgtcggggcccgcggcgccgaagaagcgtgacgccgggacgaaggtggtgctgcagccccgcctctgcacgctccggtcgtacggcgccggcagcggcgtggtgacgcggaggattctggccggggaggaggacggcagcggggccgccgactcgggcggctccgcggcgttgccgttcttcgcctcgctcgctgactacatcgagagctcccgcaagagccaggacttcgagaccatctccggccgcctcgccatggtggcgttcgcggcggcggtggccgtggagacggcgacgggcagctccctgttcaagaagctggacaccatggagatcgaggaggcggcgggggtgtgcgtggcggtggtcgccagcgccgcggcgttcgcatgggcctccagcgcgcgcaataggatcgggcagatgttcacgctgggctgcaacgccttcgtcgactccctgatcgacaacatcgtcgaggcgctcttctccgagagcgagctgcaggactggtccgatgacatatgaacatgcacacgcatatatagagactaatagtagacagacagtaatacagtatacgtacatacatagagtcaactattaacagtaagacactaggtagatgaagttgttaagtgagttccatgcattttcgcaagcttcgtcatcgctgcacaacggcaaggctgaatatttcagagatggatcgttgatcagagctccgcattctgcgtaggaacacacaagcagggatgtctttcagaagtgaggcggctcttcaagccttcaaggttgtgaaatatgtagatctcttctcttgggagaaatagtggtatcctactatcctaggctctggaaagattggcccccagaattaactgtacctgctactagtactactagatataccgagtgtatttagagaatgaatcatgtaatcaaatccatgtactatatgccaagtgtagtcagagtcaaatctggagtattgactcttgacattataccacatggagtggaaatgagagcctatacacc

SEQ ID NO: 4158 - DNA, 912 bp, Zea mays
ttccaagaacccaactcgtcaagtccagcggtgccgtccagagagagagcctagagcacagctagccccgccagccatggcggccgcggcgcgcgcgatcatctgcgagctggcgccgcagaaggtgtcgtcgacggcgccgaagaaacgtgacgccgggacaaaggtggtgctccagccccgtctctgcacgctgcggtcgtacggcgccggcagcggcgttgtgacgcggaggattctgaccggggaggaggacgggagcggggccgccgactcgggcgggtcctcggcgtcaccgttcttcgcctcgctcgccaactacatcgagagctcccgcaagagccaggacttcgagaccatctccggccgcctcgccatggtggcgttcgcggcggcagtggccgtggagacgacgacgggcagctcgctgttcaagaagctggacacgatggagatcgaggaggccgcgggggtgtgtgtggcggtggtcgcctgcgccgcggcgttcgcgtgggcgtccagagcgcgcaacaggatcggccagatgttcacgctggggtgcaacgccttcgtcgactccctcatcgacaacatcgtcgaggcgctcttctccgagggcgagctgcaggactggtccgatgacatgtaaacaaatatgcacatatgtatacgcagatggagaataatagtattagtagatagactcatagtcatagacagcacgtatatagtgtcaagtatatatagtaagtagatgaagctgtcaagtatttatagtaactggttcaagctaaagagaaggaagctcatagaatcaatactagaaattacaagtaaccctttataagtgatcatctccatcaaagtgcagtgtcttttcagtattcaaatgatgtctatccgaacttttaa

SEQ ID NO: 4159 - DNA, 1305 bp, Setaria italica
cgctgtcccagacggacattcaaaaagggtggccagtcgccgattggtactcacagtcacagaatcgcgatcggattccaagaagccgagtgaatcgcagctcgttcaagtccgcggtgccgtccagagagagaacgcacacggacgaagcccgccatggcggccgcggcgcgcgcgatcgtctgcgagctggcgccgcagaaggtggcggcggcggcggcggtgcccgcgccgccgaagaagcgcgacgccgggaaggtggtgctccagccccggctctgcacgctgcggtcctacggcgccggcagcggcgtggtgacgcggaggatcctggccggggaggaagatgggagcggggccgcggactcggccggcggctccggcgccgcctccccgttcttcgcgtcgctggccgactacatcgagagctcccgcaagagccaggacttcgagaccatctccggccgcctcgccatggtggcgttcgcggcggcggtggcggtggagctgacgacgggcagctcgctgttcaagaagctggacgcgatggagattgaggaggcggcgggggtgtgcgtggccgtggtggcctgcgcggcggcgttcgcgtgggcctccagcgcgcgcaacaggatcggccagatgttcacgctggggtgcaacgccttcgtcgactccctcatcgacaacatcgtcgaggcgctcttctccgagggcgagccccaggactggtccgacgacatatgagtatgcacgtatatacgcataaagactaggtagagagtactgtatatacgtagagtatgagcaagtatttacagatagatcgagctgttgagatccgtatatttcgcaagcttcgtcgtcgctgcacaacggcaagcaagttgatctgaatttttgttcagattcagacatggatctgcatcccagattgccagacgtggatcatgttcctgttgttctgtgatcagaaatctgcagcctgcgtaggaacccaagcagagtgcctttctgcagtcaggcagtcctgcaaggttgtcaaatgtgtagatctcttcagagaaatagtataccggggaggatcagccccttaagttaactgtacctactattagacatactgatattgtaattagtgactgaagcatgtaagcaagaccatgtgttttcttcaggagtcaaatctggagtgttgactcttgagattatattacgatggagtggagataaatctatacgctgtgtttcttacgtgtccttcgctccattactgtgtgttatgtgcactgaatctgaagaaat

SEQ ID NO: 4160 - DNA, 1310 bp, Setaria italica
ggccagtcgccgattggtactcacagtcacagaatcgcgatcggattccaagaagccgagtgaatcgcagctcgttcaagtccgcggtgccgtccagagagagaacgcacacggacgaagcccgccatggcggccgcggcgcgcgcgatcgtctgcgagctggcgccgcagaaggtggcggcggcggcggcggtgcccgcgccgccgaagaagcgcgacgccgggaaggtggtgctccagccccggctctgcacgctgcggtcctacggcgccggcagcggcgtggtgacgcggaggatcctggccggggaggaagatgggagcggggccgcggactcggccggcggctccggcgccgcctccccgttcttcgcgtcgctggccgactacatcgagagctcccgcaagagccaggacttcgagaccatctccggccgcctcgccatggtggcgttcgcggcggcggtggcggtggagctgacgacgggcagctcgctgttcaagaagctggacgcgatggagattgaggaggcggcgggggtgtgcgtggccgtggtggcctgcgcggcggcgttcgcgtgggcctccagcgcgcgcaacaggatcggccagatgttcacgctggggtgcaacgccttcgtcgactccctcatcgacaacatcgtcgaggcgctcttctccgagggcgagccccaggactggtccgacgacatatgagtatgcacgtatatacgcataaagactaggtagagagtactgtatatacgtagagtatgagcaagtatttacagatagatcgagctgttgagatccgtatatttcgcaagcttcgtcgtcgctgcacaacggcaagcaagttgatctgaatttttgttcagattcagacatggatctgcatcccagattgccagacgtggatcatgttcctgttgttctgtgatcagaaatctgcagcctgcgtaggaacccaagcagagtgcctttctgcagtcaggcagtcctgcaaggttgtcaaatgtgtagatctcttcagagaaatagtataccggggaggatcagccccttaagttaactgtacctactattagacatactgatattgtaattagtgactgaagcatgtaagcaagaccatgtgttttcttcaggagtcaaatctggagtgttgactcttgagattatattacgatggagtggagataaatctatacgctgtgtttcttacgtgtccttcgctccattactgtgtgttatgtgcactgaatctgaagaaatatcgtctgtaattctgtatcgacagagctacaaat

SEQ ID NO: 4161 - DNA, 2157 bp, Panicum virgatum
gtttagagaccgagatgacacaacgacactgtactctagtcctaatccgcacctgatcaccaaacccgtgtgcccgatctcccagtactcgggaccaaaggtagaaaggtctacggcaagggagaaccgtcggatggggatcggacggcgcaagagtcctccatgatcctggagcgccgatagcaacggctgtgtccgagaacgccgccacgttcgtccgggccccacgccggcgtctcgggcgaagcaacggtggcatgggccgctggaacacacggggacgcgacaatcttacggccgcgggcgaggttgacgggtgaatccggggtggcggggtcccttcaccaccagccaagcgcacccgcgcgacgtgtcggcgtgcgggcgtctcgccgcgagtccccagcggcctcacgaggcggggctcgccttcaccgggcggtgaacggccgcgtcgcccgccactcgctgtccctgccagactttcaaaaagggcggcgagtcaccggttggttactcacagtcagagattcgcgatcggattcctggaagccgagtgaatcgcagctcgtcgagtccggagggagcgcacggacagagccccgccatggcggccgcggcgcgcgcgatcatctgcgagctggcgccggagaaggtggcgtcgtcggtgcccgcgccgccgaagaagcgcgacgccgggaaggcggtgctgcagcctcggctctgcacgctgcggtcgtacggcgccggcagcggcgtggtgacgcggaggattctgaccggggcggaggaggggagcggggccgcggactcgggcggctctgctgcctccccgttcttcgcgtcgctggccgactacatcgagagctcccgcaagagccaggacttcgagaccatctccggccgcctcgccatggtggctttcgcggcggccgtggcggtggagctgacgacgggcagctcgctgttcaagaagctggacacgatggagatcgaggaggcggcggggttgtgcgtggccgtggtcgcctgcgccgcggcgttcgcgtgggcatccagcgcgcgcaccaggatcggccagatgttcacgctggggtgcaacgccttcgtcgactccctcatcgacaacatcgtcgaggcgctcttctccgagagcgagctccaggactggtccgacgacatatagtatgcaaatatatacgcatagagactagatagacagtacagtatacatagagcaagtatttacagacagatcaagctgttgagatctgcgcatttcgcaagcttcgttcgttgcaacggcaaggaagttgttctgaatttttgttcagacattgatcctgaatccaagatgatcagacatggatcatacagggttccaaacaactgacagctgctgtacatggtcctgcaaggatgaactgtgatcacaaatctgcagcctgtgtaggaagacaaagcagatcagtatctttgtgagtcaggcagtccgtcaagcgtcaaggttgtgaaatatgtagatctcttcatcagagaaatagtgtaccgggggctgggagggtcagccccttaattcaactgtacctactagtatagtactagattgtaattagtgactgaagctagcatgggagcaaagcactgtctttcctctaggggtcaaatctggagtttggctcttgagattataatatatggagtggagacaaatctatacattgtgtttcttatgtctcccttgcttcattcctgtatactggctctgaagaaatacaaacactgtcgacagagttgggttgagattatctacacggaattatcaatgatcaaacaatgcactctcaaatctcaacccaactctgctcaactattcttctttatgactgaaacggggagaagataatatttcaggaagacattgcagcatatctacttatacataacacatgcaaaattaacccattgcaaatattaagttttatcttgcagaatgtacctttaattctgtgtgattaagcaacggataattcggacatcaagcttctaagcagacgagtgatgtgatggattgatacagcgtgaaaatattgcaagattgaagcaagaatggagaaaaaggttaaagcttagtcttctaaatttctttctttgttt

SEQ ID NO: 4162 - DNA, 1175 bp, Echinochloa colona
gacgtccggggagagggagagatcgactgccagccagccacaggtagccatggcggccgcggcgcgcgcgatcgtctgcgagctggtgccgcagaaggcggcggcggtgcccgcgccggcgaagaggcgcgacgctgggaaggtggtgctccagccccggctctgcacgctccggtcgtacggcgccggcagcggcgtggtgacgcggaggattctagccggggaggaggagggcagcggggttgcggactcgggcggatctgctgcctccccgttcttcgcgtcgctggcggactacatcgagagctcccgcaagagccaggacttcgagaccatctccggccgcctcgccatggtggcgttcgcggcggcggtggcggtggagttgacgacgggcagctcgctgttcaagaagctggacacgatggagatcgaggaggcggcgggggtgtgcgtggccgtggtcgccggcgccgcggcgttcgcgtgggcatccagcgcgcgcaacaggatcggccagatgttcacgctggggtgcaacgccttcgtcgactccctcatcgacaacatcgtcgaggcgctcttctccgagggcgagctccaggactggtccgacgacatataagtatctgcacatatatacgcatatatatagggactagatagaacagtatatacatagagcaagtactctacagtacaaatagatcaagctgttgagatccgcctatttcgcaagcttcttggtcgctgcacaaaggcaaggagttgttctggattttcgttcagacatggatcctgcatctcagatcgccggacgaggatcatacagagttccaaacatctgaaagttcttgcacacagttctgtaaagggcgccctgcgatcagaagtctgcagcctgcgtagggacacaagcagaatatcttctctgtagtcaggcagtcccgcaaaggttgtgaaatagtgtaccggggaggatatccccttaagttaactgtatctactagtattagatatactgagattgtaattagagactgaagcatgtaagcaaaatcatgtacgagtactgtattttccctaggagtcaaatctggagtgttgactcttgagattatacatggagtggagacaaatcgtactgtctcatttatgaatgaatgaaggtggat

SEQ ID NO: 4163 - DNA, 2226 bp, Pennisetum glaucum
ccccgcgaataaaaacttttccagcgtccctttgaatccatccaacccatcgctcatctccctcccgaattcgatgcctttgtagcgctgccgcgtcgccccgcgccgtccgcctgctgctgcgctgcgcctccccatggatgccggggccggggccggatccggcaatgcctccggcggcgcaggcgcgtccgcgtgctgctactacgccatgctcggcatccgcaagaacgcctccgccaccgacatccgcaccgcctaccggaggctcgcgatgaagtggcacccggaccggtgggcgagcgaccccggcgcggccggcgaggccaagcggcgcttccagcggatccaggaggcatattccgtcctgtcggacaaggggaagaaggccatgtacgacgccgggctcttcgatcccctcgacgacgacgaccaggatttctccgacttcatgcaggagatgctggtgatgatggataacgtgaaaaacgagaagccggacacgctggaggacctgcagaagatgctggaggacatcgtgaagggcgacgacggcagccgcggcggcggcggccgcgtgccaccggacggggcgaggcgggcgcgcgtcgcgccgtacccgcagcagcaggcgcagcgcaggtgaccggcgcgccggtgtacgagatgtgcacgcgagccgcgccgcgtagcacgtcgcctacgcttttggtgtgagagagaccagatggaaagaccagccagcgaagcaacgggaagctcggaaagggagaataaaaatggattgccaagtcgttgccatccgatgatgattgaccgtagccgattgtgtaggattgggcatggtgggtggatcgggcgccgctcgattccggccccgcgccgccgccgccgcaagaagttgccggcggacgcgtggccgggggctccgattgttatctcttccacatttcgtgccccgaattgtcactggaattgttaactctttttttcacagtatatctccactccattgtaatatagtctcaagagtccacactcgagatctgactcctgaagaaaatacatggtcttgcttacatgcttcagtcactaattgcaatctctgtatgtctaatagtaggtacagttaacttgtggggctgatcaccccggtatctatttctctgacgagatctgcatgtttcataaccttgcaggactgccatgactgcaaaaaggcactctgcttgtgttcctacgcaggctacaggttttcggatcacagaacagcaggaacatgatccacgtctggcaatctgggatgcagatccatgtctgaactctgaacaaaaattcagaagaacttgcttgccgttgtgcagcgatgacgaagcttgcgaaatgtgcagctctcaacagctcgatctacctgtatactttctctacgtatatacagtacagtactctatctagtctttatgcgtatatacatgcatactcatatgtcgtcagaccagtcctggagctcgccctcggagaagagcgcctcgacgatgttgtcgatgagggagtcgacgaaggcgttgcatcccagcgtgaacatctggccgattctgttgcgcgcgctggtggcccacgcgaacgccgccgcgcaggccaccacggccacgcacacccccgccgcctcctcgatctccatcgcgtccagcttcttgaacagcgagctgcccgtcgtcagctccaccgccaccgccgccgcgaacgccaccatggcgaggcgaccggagatggtctcgaagtcctggctcttgcgggagctctcgatgtagtcggccagcgacgcgaagaacggagagccgccgccggagtccgtggccccgttcccctcctcctccccggccaggatcctccgcgtcaccaccccgcttccggcgccgtaggaccgcagcgtgcagagccggggctggagcaccaccttcccggcgtcgcgcttcttcggcggcgcgggcaccgacgacgccgccgccaccttctgcggcgccagctcgcagacgatcgcgcgcgccgttgccgccatggcggggctgttccctgtccccgtgtgctttgctctctggacgacggacttgacgagctgcgattcactcggcttcttggaatccgatcgcgattctgtgactatgggtaaccaaccggcgactggccagccttttagaaactccggccgggacagcgagtggcggc

SEQ ID NO: 4164 - DNA, 1689 bp, Panicum virgatum
atgccggcgtctcggcggaagcaacggtggcgtgggccgctggaacacacgggaacgcgacaatcttacggccgcgggcaaggtcgacgggtgaatccggggcccggagtcccttcaacaccggccaagcgcacccgcgtgacgtgtcggcgtgcgggcgtctcgccgcgagtccccggcggcctcaccaggcggggctcgccttcaccgggcggtgaacggccgcgtcgcccgccgctcgctgtccctgccagactttcaaaaagggcggcgagtcaccggttggttactcacagtcacagattcgcgatcggattccaagaagccgagtgaatcgcacgcagctcgtcgagtcgagtccagagggagcgctgcgcacggacagagccccccgccatggcggccgcggcgcgcgcgatcatctgcgagctggcgccggagaaggtggcgtcggtgcccgcgccgccgaagaagcgcgacgccgggaaggcggtgctgcagccccggctctgcacgctgcggtcgtacggcgccggcagcggcgtggtgacgcggaggattctgaccggggcggaggacgggagcggggccgcggactcgggcggctctgctgcctccccgttcttcgcatcgctggccgactacatcgagagctccgcaagagccaggacttcgagaccatctccggccgcctcgccatggtggctttcttggcggccgtggcggtggagctgacgacgggcagctcgctgttcaagaagctggacacgatggagatcgaggaggcggcggggttgtgcgtggccgtggtcgcctgcgccgcagcgttcgcgtgggcatccagcgcgcgcaccaggatcggtcggatgttcacgctggggtgcaacgccttcgtcgactccctcatcgataacatcgtcgaggcgctcttctccgagagcgagctccaggactggtccgacgacgtataagtatgcaaatatatacgcatagagactagatatagacagtacagtatatacatagagaaagtatttacagatagatcgtcaagctgttgagatccgcggatttcgcaagcttcgtccgttgcaacggcaaggaagttgttctgaatttttgttcagacattgatcctgaatccaaggttatcagacatggatcatacagggttccaaacaactggcagctgttgtccacggccctgcaaggatgaactgtgatcacaaatctgcagcctgtgtaggaagacaagcagagtatctttgacctttgtgtagccaggcagtccgtcaaggttgtgaaatatgtagatctctacatttcatcagagaaatagtgtacaggggacggggaggatcagccccttaattcaactgcacctactagtatagtgagattgtaattagtgactgaagcatgggagcaaaacaccgtgttttctttaggggtcaaatccggagtttgactcttgagattataatacatggagtgcagacaaatctacacatatatgtctcccttgctccattcctgtatacgggctctgaagaaatacaaacactgctgtgtcgattgagctgcaaaattgactttcattgtatttgctttgaggttgtcatctatacgacattatcaatggtcaaacaatgcactctctcaaatctcaacccaactctgctaaaccat

SEQ ID NO: 4165 - DNA, 1728 bp, Zea mays
ggctgccatttacacctgggttgagcaggcatggcaccgggaatgctgaagggtcaccagccgttcgatgctaaatggattgcatcggctagagctgacgtcatccgcggcgcacgcctccgtccccgccccccagcccgtcgtcgtctctctccaactccatcgtcacccgcgccgcctacgcctgctgcgtcccggatagccccgcggcgccgtccgaccacgaatccggaatcccctcctcgctcgccctcctgcttgatcccgccgcggccgcctcagccgccactcctccctgtccctctagggctgccctgccgctccctcgtatcgcgcaatcggaggcctctccttccgccctccaattttatcgcagcaggcagatggcgccgcagtcccggttgctgccgccgctgttgcaggttcttcgccgctgccgcgcatcgcgctcccacttctctaccgccccctctcttgtctcgccaccatccaaggccgtggtctacgacgagcatggcctgcccgagcaggtgctgaggctggtggacgtaccaccggcggagatcggtgaccgcgacgtctgcgtcaggatgatggctgcccccatcaacccctcggacatcaaccgcatcgagggcgtctaccccgtcaggcccccgctccccgccgccgtcggaggctacgagggcgtgggccaggtccacgccctcggccctgctgtcaccgcccggctgtcaccgggcgactgggtcataccgtccccgccatcgttcgggacctggcagacgtacattaccaagcatgagaacgtctggcacaaggtccgcagcgatgtacccatggagtacgctgccactatcaccgtcaacccattgaccgcacttaggatgctccaagactttgtaaaactcaatcctggtgatgccatagtccagaatggcgctaccagcattgttggccagtgtgttattcagcttgccaaagtacatggaatccacaccatcaacattataagggacaggcctgggtcagaggaagcaaaaaacaaactcaaacaacttggtgcagatgaggtgttcacagaaactcagctagacatgaagaatgtcaagagcttgctgggtgctttgccagagcctgcattaggatttaactgtgttggaggaaatgctgcttctctaatactcaagcttttgaagcaaggaggcaccatggtgacatatggtggaatgtccaagagacctgtcactgtccctacttcatatttcatttttaaggatctatccctacgagggttctggctccagaagtggctgaactcagacaaaacagaagactgcagaagaatgattgactacctcttgggccttgtgcatgaaggcaaactcaaatacgagatggagtccatttctttcggcgagttcagcttggctctggagaaggccctgggcaaacatggaagccagccgaagcaagttatcaagttctgagaccagggcgggttagaggatctgagagcatgcgattgccatcgatctgtatgaatgatgaatccaacagttagctatgtcaagtgccagagttttaaatacaaataaagtaaaggcagcaatgtttaatggaattgtgaaatcagcagcttagctatatttgagcgctgtgttgattttgcaatgaaatcagcagcttagctatatgtcaagtaaagggtgcgtcaatttctattgc

SEQ ID NO: 4166 - DNA, 1723 bp, Panicum virgatum
cttttcttttttggaggggaggaaggaagagcacagaggagaggagaagcgacgcgaagccaagtgactccgagcgataatggcgccgccgtcccggttgcttccgccgatgttgcagattctccgccgccgctgcgcctcccgctgccacttctccaccgccccgtccctcgtctcgccgccgtccaaggccgtgctctacgacgagcacggtgcccccgaccaggtgctcagggtggtggatgtgccgcccgtccatcttggggaccgcgacgtctgcgtccggatgctggccgcccccatcaacccatccgacatcaaccgcatcgagggcgtctaccccgtcaggcccccgctccctggcgccgtcgcggggtatgagggggtgggccaggtccacgccctcggccccgccgtcaccgcccctctctcccccggcgattgggtcataccatcccctccctctttcgggacatggcagacctacatcgtcaagcacgagagtgtgtggcacaaggtccgcagcgatgtgcccatggaatacgccgccaccgtcaccgtgaaccccttgaccgcgctcagcatgctccaagactttgtgaaactcaatcctggtgatgccattgtccagaatggcgctaccagcattgttggccagtgcgtgattcagcttgccaaggtacatggaattcacacaatcaacattataagggacaggccgggctcagaggaagcaaaagataaactcaaactccttggtgcagatgaggtgttcatggaatctcagctaggcatgaagaatgtcaagagcttgctgggtgctttaccggaacctgcattgggatttaactgcgttggaggaaatgctgcttctctgctactcaagtttctgaggcaaggaggcaccatggtgacatatggtggaatgtccaagcgacctgtcactattcctacttcatatttcatttttaaggatatttccctgcgagggttctggctacagaggtggatgaactcagataaggcagaggattgcagaacaatgatagactacctcttgggcctggtgcatgaaggcaaactcaaatatgagatggaggctattccattcggtgagttcagcttggctctggagaaggccctgggcaaacatggaagccagccaaagcaagttatgaggttctgagatgaaagatgaggtgaggctacagggatcatcaaagtatccctcccattgatgggtgcattcctacagttggttatgtcaagtattaggaagagcgacttgggagttttgtaaagaaaaaggctgctctgtcttcggcaggttagctagattcctgtccgagcgagttcatcaatctttcattgcaatgaaggggccaagtgagtgaattaccacgagatgtagttgtacacatgggttgtgcgttaaagtatttttgtttttgaaatacgctatctgcagcatatgtttaggctgatggttaatatgaatttaacagagatttgtttgtaagagtatatcaatcgttttgttagtgataggaaccggagtggccattgttagtgctgtgtggagcttgcagcaaaatatcagcggagaacatacaaggatgtgcctatcctcaatcgatgcatgtatccatccttccaatcacataacatgacagaaacacctggacgtacagtggaaggtgactacgtgagcatcatatatata

SEQ ID NO: 4167 - DNA, 1650 bp, Setaria italica
ttgggctggaatgctggattgggctgggctttagaaggaagaagaggaaggaaggaagaagagaagtagaatagagtagagaagccaagccaagccaagggaaccgaaccgacgacatggcgccgccgtcccggttgcttccggcgaccttgcagattctccgccgccgctgcgcctcccgcttctccaccgcctcctcccttgtctccccgccgtccaaggctgtgctctacgacgagcacggcgcccccgaccaggtgctccgggtggcggatgtgccgcccgtccacctcggcgaccgcgacgtctgtgtccggatgctggccgcccccatcaacccctccgacatcaaccgcatcgagggcgtctaccccatcaggccgccgctcccaggcgccgtcgggggttgcgagggggtggggcaggtccacgccctcggccccgccgtcaccgccccgctctccccaggcgattgggtcattccatccccgtcctcattcgggacatggcagacgtacatcgtcaagaacgagagcgtgtggcacaaggtccgcagcgacgtgcccatggaatacgccgccaccgtcaccgtcaaccccttgaccgcgctcaggatgctccgagactttgtgcaactcaatcctggtgatgccattgtccagaatggcgctaccagcattgtcggccagtgcgtgattcagctcgccaaggtacatggaattcacaccatcaacattataagggacaggcctggctcagaggaagcaaaaggtaaactcaaacaacttggcgcagatgaggtgttcacggaatctcagctagacatgaagaatctcaagagcctgctgggtgcttttccagaacctgcattaggatttaactgtgtcggaggaaatgctgcttctctggtactcaagtttttgaggcaaggaggcaccatggtgacatatggcggaatgtccaagcgacctgtcactgttcctacttcatatttcatttttaaggatatttccatgcgagggttctggctacagaagtggatgaactcagataaggcagaggattgcagaacaatgatagactacctcttgggcctagtgcacgaaggcaaactcaaatacgagatggagtcgattccattcagtgagttcagcttggctctggagaaggccctgggcaaacatggaagccagccaaagcaagttgtgaggttctgagatgaaagatgggtgtcaagtgttaggcagagcgacttggagttgtactctggacacagcagcttagctagatttctgtgcgatcgagttcatcttgtaatgaaatagcagttgtacacaaccacgacgccgggccacgtctggaggtttcggcgaactatgagtgtggatgttggtggatgccatcgtggcgagcagagtggtgaggtcgcgttgagatcctaatccaaccggtagggtgtggcagttcttgagttgagtggctactcgtgttgatatcacaatccaaccgggtgagtttattttgtttttctttttgtgaaacaagtttatttatcattatcactacatataccataattagctagacatatgagaacgaagcgttgtatgtatggttaggagagctagctgttgtacacctgtgtgcatg

SEQ ID NO: 4168 - DNA, 1648 bp, Setaria italica
tgggctggaatgctggattgggctgggctttagaaggaagaagaggaaggaaggaagaagagaagtagaatagagtagagaagccaagccaagccaagggaaccgaaccgacgacatggcgccgccgtcccggttgcttccggcgaccttgcagattctccgccgccgctgcgcctcccgcttctccaccgcctcctcccttgtctccccgccgtccaaggctgtgctctacgacgagcacggcgcccccgaccaggtgctccgggtggcggatgtgccgcccgtccacctcggcgaccgcgacgtctgtgtccggatgctggccgcccccatcaacccctccgacatcaaccgcatcgagggcgtctaccccatcaggccgccgctcccaggcgccgtcgggggttgcgagggggtggggcaggtccacgccctcggccccgccgtcaccgccccgctctccccaggcgattgggtcattccatccccgtcctcattcgggacatggcagacgtacatcgtcaagaacgagagcgtgtggcacaaggtccgcagcgacgtgcccatggaatacgccgccaccgtcaccgtcaaccccttgaccgcgctcaggatgctccgagactttgtgcaactcaatcctggtgatgccattgtccagaatggcgctaccagcattgtcggccagtgcgtgattcagctcgccaaggtacatggaattcacaccatcaacattataagggacaggcctggctcagaggaagcaaaaggtaaactcaaacaacttggcgcagatgaggtgttcacggaatctcagctagacatgaagaatctcaagagcctgctgggtgcttttccagaacctgcattaggatttaactgtgtcggaggaaatgctgcttctctggtactcaagtttttgaggcaaggaggcaccatggtgacatatggcggaatgtccaagcgacctgtcactgttcctacttcatatttcatttttaaggatatttccatgcgagggttctggctacagaagtggatgaactcagataaggcagaggattgcagaacaatgatagactacctcttgggcctagtgcacgaaggcaaactcaaatacgagatggagtcgattccattcagtgaattcagcttggctctggagaaggccctgggcaaacatggaagccagccaaagcaagttgtgaggttctgagatgaaagatgggtgtcaagtgttaggcagagcgacttggagttgtactctggacacagcagcttagctagatttctgtgcgatcgagttcatcttgtaatgaaatagcagttgtacacaaccacgacgccgggccacgtctggaggtttcggcgaactatgagtgtggatgttggtggatgccatcgtggcgagcagagtggtgaggtcgcgttgagatcctaatccaaccggtagggtgtggcagttcttgagttgagtggctactcgtgttgatatcacaatccaaccgggtgagtttattttgtttttctttttgtgaaacaagtttatttatcattatcactacatataccataattagctagacatatgagaacgaagcgttgtatgtatggttaggagagctagctgttgtacacctgtgtgcat

SEQ ID NO: 4169 - DNA, 1333 bp, Pennisetum glaucum
ggaggcggtggagaagcggcgaagcgcctaccgaacccgtctcgccatggcgccgccgtcccggttgcttccggcgaccttgcagattctccgccgccgctgcgcctcccgcttctccaccgcctcctccctcgcctcgccgccgtccaaggccgtgctctacgacgagcacggcgcccccgaccaggtgctccgggtggcggatgtgccgcccgtccacctcggcgaccgcgacgtctgcgtccggatgctggcggcgcccatcaacccctccgacatcaaccgcatcgagggcgtctaccccatcaggccgccgctcccaggcgccgtcgggggttacgagggggtgggccaggtccacgccctcggccccgccgtcaccgccccgctctcccccggcgattgggtcataccatccccggcctcatttgggacatggcagacgtacatcgtcaagcacgagagcgtgtggcacaaggtccgcagcgacgtgcccatggaatacgccgccaccgtcaccgtcaaccccttgaccgcgctcaggatgctccaagactttgtgcaactcaatcctggtgatgccattgtccagaatggcgctaccagcattgtcggccagtgcgtgattcagctcgccaaggtacatggaattaacaccatcaacattataagggacaggcctggctcagaggaagcaaaatacaaactaaaacaacttggagcagatgaggtgttcacggaatctcagctagacatgaagaacctcaagagcctgctgggtgctttgccagaacctgcattaggatttaactgcgttggaggaaatgctgcttctctggtactcaagtttttgaggcaaggaggcaccatggtgacatatggcggaatgtccaagcgacctgtcactgctcccacttcatatttcatttttaaggatatttccctgcgagggttctggctacagaaatggatgaactcagataaggcagaggattgcagagcaatgatagactacctcttgggcctggtgcacgaaggcaaactcaaatacgagatggagtcgattccattcgatgagttcagtttggctctggagaaggccctgggcaagcatggaagccagccaaagcaagttgtgaggttctgagattgatgtgcgtgcattcctacaggcagagcgattcctatgtgcgatcgagttccatcttgcaatgaaaatagtacttgtataccataattagtttgacatatgagaaggaagcattgtatcatgtatggtcagctgttgtacaatctgtttgcgggaataagatgttcttcgtcagcatctcaa

SEQ ID NO: 4170 - DNA, 1449 bp, Setaria italica
gaagaagaagagtagagtagagaagccaagccaagccaagggtaccgaaccgacgacatggcgccgccgtcccggttgcttccggcgaccttgcagattctccgccgccgctgcgcctcccgcttctccaccgcctcctccattgtctccccgccgtccaaggccgttctctacgacgagcacggcgcccccgaccaggtgctccgggtggcggacgtgccgcccgtccacctcggcgaccgcgacgtctgcgtccggatgctggccgcccccatcaacccctccgacatcaaccgcatcgagggcgtctaccccatcaggccgccgctcccaggcgccgtcgggggttgcgagggggtggggcaggtccacgccctcggccccgccgtcaccgccccgctctccccaggcgattgggtcattccatccccgtcctcattcgggacatggcagacgtacatcgtcaagaacgagagcatgtggcacaaggtccgcagcgacgtgcccatggaatacgcggccaccgtcaccgtcaaccccttgaccgcgctcaggatgctccgagactttgtgcaactcaatcctggtgatgccattgtccagaatggcgctaccagcattgtcggccagtgcgtgattcagctcgccaaggtacatggaattcacaccatcaacattataagggacaggcctggctcagaggaagcaaaaggtaagctcaaacaacttggcgcagatgaggtgttcacggaatctcagctagacatgaagaatctcaagagcctgctgggtgctttgccggaacctgcattaggatttaactgtgtcggaggaaatgctgcttctctggtactcaagtttttgaggcaaggaggcaccatggtgacatatggcggaatgtccaagcgacctgtcactgctcctacatcatatttcatttttaaggatatttccatgcgagggttctggctacagaagtggatgaactcagataaggcggaggattgcagaacgatgatcgactacctcttgggcctggtgcacgaaggcaaactcaaatacgagatggagtcgattccattcagtgagttcagcttggctctggagaaggccctgggcaaacatggaagccagccaaagcaagttgtgaggttctgagatgaaagatgagtgttgtcaagtgttttaggcagagcgacttggagttgtatgtactctggacacagcagcttagctagatttctgtgcgatcgagttcatcttgcaatgaaataccagttgtacacccaggttgatgtcacaatctaaccggacgagtttgttttatttttctttccttttcattttcttgtatctttccagtctggaacgtatcttttttaatataatcggcaggagagaacttatcttttttaatataatcggcagctctcgttcgtttaaaaaaaa

SEQ ID NO: 4171 - DNA, 1711 bp, Setaria italica
atccactattagatgtattttagatttaaccggtaggtttatctatttgcaaaaatatttgtagaaaagatgaataatcaaataaatgaaaaaaatcaatggcattttaagaatgaattatttgaccacgatgaagtataggccggcacttttatatggaaccaactacccacccacctaccatcttgggctggaatgctggattgggctgggctttaaaaggaagaagaggaaggaaggaagaagaagagggaggaaggaagaagaagaagagtagagtagagaagccaagccaagccaagggtaccgaaccgacgacatggcgccgccgtcccggttgcttccggcgaccttgcagattctccgccgccgctgcgcctcccgcttctccaccgcctcctccattgtctccccgccgtccaaggccgttctctacgacgagcacggcgcccccgaccaggtgctccgggtggcggacgtgccgcccgtccacctcggcgaccgcgacgtctgcgtccggatgctggccgcccccatcaacccctccgacatcaaccgcatcgagggcgtctaccccatcaggccgccgctcccaggcgccgtcgggggttgcgagggggtggggcaggtccacgccctcggccccgccgtcaccgccccgctctccccaggcgattgggtcattccatccccgtcctcattcgggacatggcagacgtacatcgtcaagaacgagagcatgtggcacaaggtccgcagcgacgtgcccatggaatacgcggccaccgtcaccgtcaaccccttgaccgcgctcaggatgctccgagactttgtgcaactcaatcctggtgatgccattgtccagaatggcgctaccagcattgtcggccagtgcgtgattcagctcgccaaggtacatggaattcacaccatcaacattataagggacaggcctggctcagaggaagcaaaaggtaagctcaaacaacttggcgcagatgaggtgttcacggaatctcagctagacatgaagaatctcaagagcctgctgggtgctttgccggaacctgcattaggatttaactgtgtcggaggaaatgctgcttctctggtactcaagtttttgaggcaaggaggcaccatggtgacatatggcggaatgtccaagcgacctgtcactgctcctacatcatatttcatttttaaggatatttccatgcgagggttctggctacagaagtggatgaactcagataaggcggaggattgcagaacgatgatcgactacctcttgggcctggtgcacgaaggcaaactcaaatacgagatggagtcgattccattcagtgagttcagcttggctctggagaaggccctgggcaaacatggaagccagccaaagcaagttgtgaggttctgagatgaaagatgagtgttgtcaagtgttttaggcagagcgacttggagttgtatgtactctggacacagcagcttagctagatttctgtgcgatcgagttcatcttgcaatgaaataccagttgtacacccaggttgatgtcacaatctaaccggacgagtttgttttatttttctttccttttcattttcttgtatctttccagtctggaacgtatcttttttaatataatcggcaggagagaacttatcttttttaatataatcggcagctctcgttcgtttaaaaaaaa

SEQ ID NO: 4172 - DNA, 1512 bp, Panicum virgatum
ggaaggaagagagaagccacgcgaagccaagttcaagcgacgtccctccgagcgaggagataatggcgccgccgtcccggttgctgccgccgacgttgcagattctccggctccgctgccacttgtccactgttgtctcgccgccgtccaaggccgtgctctacgacgagcacggtgcccccgagcaggtgctgagggtggcggatgcgccgcccgtccatctcggggaccgcgacgtctgcgtccggatgctggccgcccccatcaacccctccgacatcaaccgcatcgagggcgtctaccccgtgaggcccccgctccccggcgccgtcggggggtacgagggggtgggccaggtccacgccctcggccccgccgtcaccgccccgctctcccccggcgattgggtcataccgtccccgccctctttcgggacatggcagacctacatcgtcaagcaccagagtgtctggcacaaggtccgcagcgatgtgcccatggaatacgccgccaccgccaccgtcaaccccttgaccgcgctcaggatgctccaagaatttgtaaaactcaatcctggtgatgccattgtccagaatggtgctaccagcattgtcggccagtgcgtgattcagctcgccaagctacatggaattcacacaatcaacattataagggacaggccgggctcagaggaagcaaaagataaactcaaacaacttggtgcggatgaggtgttcatggaatctcagctagacatgaagaatgtcaagagcttgctgggtgctttaccagaacctgcattgggatttaactgcgttggaggaaatgccgcttctctgctactcaagtttctgaggcaaggaggcaccatggtgacttatggtggaatgtccaagcgacctgtcactgttcctacttcatatttcatttttaaggatatttccctgcgagggttctggctacagaggtggatgaactcagataaggcagaggattgcagaacaatgatagactacctcttgggcctggtgcacgaaggcaaactcaaatatgagatggagctgattccgttcggtgagttcagcttggctctggagaaggccctgggaaaacatggaagccagccaaagcaagttatgaggttctgagatgaaagataagaggggctatagggattatcaaagtatccctcccattgatgtgtacattcttacagttggttatgtcaaatgtttggcagagcgacttgggagttttgtgaaggaaaaaaggccgcgcagtcttgatgctagattcctgtccgagcgagttcatcgatctttcattgcaatgaactaatgaaggggctaagtgagtgaattaccacgagatagcagttgtacacatgggttgtgcgttaagtatttttgtttctggaatacgctatctgcgtcattagtttgtttaggcggatggttaatacgaatttaatagagatttgtttctaatagtatatcaatcgtttttgtgaaa

SEQ ID NO: 4173 - DNA, 1431 bp, Triticum aestivum
atggttcttctgagttctgactgcattagagacctgagtctagagaaaccccggcaccccagtagcaatggcgtcggcactccgcctgctgccgtcgacggcgacgcgcctccgctttcgtccccgcctccctctctccaccgctgcgtcactcttctcaccgccctccaaggccgtcctctacgaccaacacggcccgcccgaccaagtcctcagggtggaggatgtgccgccggtggagctcggggagcgcggcgtctgcgtgaagatgctagccgcacccatcaacccctccgacatcaaccgcgtccagggcgtctaccccgtcaggcctcccctccccgccgccgtcgctgggtacgagggcgtcggccaggtccacgccgttggccccgccgtcacccgccccctctcccccggcgactgggtcatcccttccccgccctccttcggaacatggcagacctacattgtgaagccggaagatgtgtggcacaaggttcgtgacgatgttccggtggaatacgctgccactgtcacggtgaaccccttgacagcgctcaggatgctgcaggactttgtgaaactcaaacctggtgatgctattgtccagaacggctcgaccagcatcgttggtcagtgtgttattcagctcgccaaagtgcagggaattcgcaccatcaacatcataagggacaggcctgggtcagaagaagcaaaagagaaacttaaacagcttggtgcagatgaggtcttcaccgaaagtcagctagatgtaaagaatgtcaagagcttgctgggcgctttaccagaacctgcattaggatttaactgcgttggaggaaatgctgcatctttgatactgaagttattaaggcaaggaggcaccatggtgacatatggcggaatgtccaagaaacctgtgactgtttctacttcgtctttcatatttaaggatctttccctcagagggttctggctacagaagtggatgaattcggacaagtcagaggaatgtagaacaatgatagactacctcttgggccttgtgcatgaaggcaaacttaaatatgagatggagttgacccccttcagcgagttcaacatggctcttgataaggcccttggaaaacacggaagccagccaaagcaggttcttaggttctgataagatgatgatgaggtagctagtattgtgttggccctggtgcaaatatttgtatggtcgtatcacttgtgtgcatgcgtgtgtgtagttactagttagtggttgagagttttttggttagctatgaactatggttatcctgggcaataaaaatataaattctataccacaagatatatgattgtattcaagttcgaaagaagtaaacctggaccgaagaagttcagttccttctatgtgtgtgacccaagagtcaactttaa

SEQ ID NO: 4174 - DNA, 1295 bp, Pseudoroegneria spicata
cggcactccgcctgctgccgtcgacggcgacgcgcctccgctttcgtccccgcctccctttctccaccgctgcgtcactcttctcaccgccttccaaggccgtcctctacgaccaacacggcccgcccgaccaagtcctcagggtggaggatgtgccgccggtggagctcggggagcgcggcgtctgcgtgaagatgctagccgcacccatcaacccctccgacatcaaccgcgtccagggcgtctaccccgtcaggcctcccctccccgccgccgtcgctgggtacgagggcgtcgcccaggtccacgccgttggtcccgccgtcacccgccccctctcccccggcgactgggtcatcccttccccgccctccttcggaacctggcagacctacattgtgaagccggaagatgtgtggcacaaggttcgtgacgatgttccggtggaatacgctgccactgtcacggtcaaccccttgacagcgctcaggatgctgcaggactttgtgaaactcaaacctggtgatgctattgtccagaacggctcgaccagcatcgttggtcagtgtgttattcagctcgccaaagtgcagggaattcgcaccatcaacatcataagggacaggcctgggtcagaagaagcaaaagagaagcttaaacagcttggtgcagatgaggtcttcaccgaaagccagctagatgtaaagaatgtcaagagcttgctgggtgctttaccagaacctgcattaggatttaactgcgttggaggaaatgctgcatctttgatactgaagttattaaggcaaggaggcaccatggtgacatatggcggaatgtccaagaaacctgtgactgtttctacttcatctttcatatttaaggatctttccctcagagggttctggctacagaagtggatgaattcggacaagtcagaggaatgcagaacaatgatagactacctgcttggccttgtgcaggaaggcaaacttaaatatgagatggagttgacccccttcagcgagttcgacctggctcttgctaaggcccttggaaaacacggaagccaaccaaagcaggttcttaggttctgatgagatgatgatgatgatgaggtagctagtattgtgttggccctggtgcaaatatttgtatggtcgtttcacttgtgtgcatgcgtgtgtagttactagttagtggttgagagttttttggttagctatgaactatggttatcctgggcaataaaaatataattgtataccacaaggcaaaaaaaaaaggaaaaaatgcgt

SEQ ID NO: 4175 - DNA, 1401 bp, Secale cereale
gactatggttcttctgcattattgacctcgagagaaaccaagagcatcaccccagtaacaatggcgtcggcgctccgcctgctgccgtcgacggcgacgcgcctccgctttcgtccccgcctccctctctccaccgctgcgtcactcttctcaccgccctccaaggccgtcctctacgaccaacacggcccgcccgaccaagtcctcagggtggaggatgtgccgccggtggagctcggggagcgcggcgtctgcgtgaagatgctagccgcacccatcaacccctccgacatcaaccgcgtccagggagtctaccccgtcaggcctcccctccccgccgccgtcgctgggtacgagggcatcggccaggtccacgccgttggccccgccgtcacccgccccctctcccccggcgactgggtcatcccttccccaccctccttcggaacatggcagacctacattgtgaagccggaagatgtgtggcacaaggttcgtgacgatgttccggtggaatacgctgccactgtcacggtcaaccccttgacagcgctcaggatgctgcaggactttgtgaaactcaaacctggtgatgctattgtccagaatggctcgaccagcatcgttggtcagtgtgttattcagctcgccaaagtgcagggagttcgcaccatcaacatcataagggacaggcctggatcagaagaagcaaaagagaaacttaaacagcttggtgcagatgaggtcttcaccgaaagtcagctagatgtaaagaatgtcaagagcttgctgggtgctttaccagaacctgcattaggatttaactgcgttggaggaaatgctgcatctttgatactgaagttattaaggcaaggaggcaccatggtgacatatggcggaatgtccaaaaaacctgtgactgtttctacttcgtctttcatatttaaggatctttccctcagagggttctggctacagaagtggatgaattcggacaagtcagaggaatgcagaacaatgatagactacctgttgggccttgttcaggaaggcaaacttaaatatgagatggagttgactcccttcagcgagttcgacctagctcttgataaggctcttggaaaacacggaagccaaccaaagcaggttcttaggttctgatgaaacgaagatgatgatgaggtagctagtattgtgttggccctggtgcaaatatttgtatggtcgtatcacttgtgtgcatgcgtgtgtgtagttactagttggtggttgagagttttttggttagctatgaactatggttatcctgggcaatataaatataaattgtataccacaatgtatatgcttgttttcaagtttgaaagaagtaaacctggaccgaagaagttcagttctttc

SEQ ID NO: 4176 - DNA, 1765 bp, Hordeum vulgare
gatcgcattagagaccacgagagaaacccagagcatcaccccagtaacaatggcgtcggctctccgcctactgccgtcgacggcgacgcgcctccgctttcgtccccacctccctttctccaccgctgcatcgctcttctcaccgccctcgaaggccgtcctctacgaccaacacggcccgcccgaccaagtcctcagggtggaggatgtgccaccggtggagctgggggagcgcggcgtctgcgtgaagatgctagccgcacccatcaacccctccgacatcaaccgcgtccagggcgtgtaccccgtcaggcctcccctccccgccgccgtcgctgggtacgagggcgtcggccaggtccacgccgttggtcccgccgtcacccgccccctctcccccggcgactgggtcataccttccccgccctccttcggaacatggcaaacctacattgtgaagccggaagatgtgtggcacaaggcccgtgacgatgttccggtggaatacgctgccactgtcacggtcaaccccctgacagcgctcaggatgctgcaggactttgtgaaactcaaacctggtgatgctattgtccagaacggctcgaccagcattgttggtcagtgtgttattcagctagccaaagtgcagggaattcgcaccatcaacatcataagggacaggcctgagtcagaagaagcaaaagagaaacttaaacagcttggtgcagatgaggtcttcatcgaaagtcagctagatgtaaagaatgtcaagggcttgctgggtgctttaccagaacctgcattaggatttaactgcgttggaggaaatgcggcatctttgatactgaagttattgaggcaaggaggcaccatggtgacatatggcggaatgtccaagaaacctgtgactgtttctacttcgtcttttatatttaaggatctttccctcagagggttctggctacagaagtggatgaattcggacaagtcagaggaatgcagaacaatgatagactacctgttgggccttgtgcaggaaggaaacctcaaatatgagatggagttgactcccttcagcgagttcgacctggctcttgataaggcccttggaaaacacggaagccaaccaaagcaggttcttaggttctgatgagatgatgatggggtagctagtattgtgttggccctggtgcaaatatttgtatagctgtatcacttgtatgcatgcgtgtgtgtacttagtggttgagacttttttggttagctatgaactatggttatcctggctcctgggcaagcagcaggctagacgctgttaagtcagtttggcaaaagagcaggagatggggttgtagaaatgcaagatactcgctccgttcctaaatataagtctttctagagattctactacggactacatacggatatatataaacatactttagagtatagattcactcattttgctccgtatatagtccataatgaagacttatactccctctgtttctaaataagtctttttagggattttattagaagactacatatgaaataaaacaaaataaaacgagtgaatctatatactaaagtatgtctatatgcatccgtatgtagttccctagtgaaacatctaaaaagacttatatttaggaacggagggagtagaacattctatgagataagtatataaggtatgaggtgttttgtagtttctgttagccaaccaacgcctgaaatcattgatggcatttccttttaaaaa

SEQ ID NO: 4177 - DNA, 1293 bp, Brachypodium distachyon
agatacgaaaacagaataaatacgagacccatggcgccgccgacggcgaggctgctcctccgaacaccccgcctctccctctccaccgccgcagcatcgctcttctcgccgccctccaaggccgtcctctacgaccaacacggccctcccgaccaagtcctaagggtggcggacgtgccgccggtggagctcggggagcgcgacgtgtgcgtcaagatgctggcggcgcccatcaacccctccgacatcaaccgcgtccagggcgtctacccggtccggcctcccgtcccccccgccgccgtcgccggctacgagggcgtcgcccaggtccatgccctcggccccgccgtcacccggcccctctcccccggcgactgggtcatcccttccccgccctccttcggaacgtggcagacctacattgtcaagccggagcacgtgtggcacaaggtccgcgacgacgtgcccgtcgagtacgctgccactgtcaccgtcaaccccttgacggcgctccggatgctgcaggactttgtgaaactcagtcctggcgatgctgttgtccagaacggcgccaccagcatcgtcggccagtgcgttattcagctcgccaaagtgcaggggattcgcaccatcaacatcataagggacaggcctgggtcagaagaagcaaaagagaaactcaaacagcttggtgcagatgaggttttcacagaaggtcagctggatgttaagaatgtcaagagcttgctgggtgctctaccagaacctgcactaggatttaactgtgtaggaggaaatgctgcagctttgatactgaagttattaaggcaaggaggcaccatggtgacatatggcggaatgtccaagagacctgtgactgtttctacttcgtcgtttattttcaaggatctttctctgagaggattctggctacagaagtggatgagttcagacaaggcggacgattgcagaaggctgatagactacctgctgggactggtgcaggaagggaaacttaaatacgagatggagttgagtccctttgacgactttggactggctcttgacaaggccctgggcaaacatgggagccaaccgaagcaggtcctgaggttctgatggtgtgtagattgaacaagggtgtgaaatttttgtacgttagcgactcagtgttgaagttgtgtggctgtgtctgtgcggttagtggatgtgagagagtcttgtttccagtggttggttatgtggcaattatgtgtggtaagacgcaaaatgtggtgagtattctgaaggcgg

SEQ ID NO: 4178 - DNA, 1297 bp, Brachypodium distachyon
agatacgaaaacagaataaatacgagacccatggcgccgccgacggcgaggctgctcctccgaacaccccgcctctccctctccaccgccgcagcatcgctcttctcgccgccctccaaggccgtcctctacgaccaacacggccctcccgaccaagtcctaagggtggcggacgtgccgccggtggagctcggggagcgcgacgtgtgcgtcaagatgctggcggcgcccatcaacccctccgacatcaaccgcgtccagggcgtctacccggtccggcctcccgtcccccccgccgccgtcgccggctacgagggcgtcgcccaggtccatgccctcggccccgccgtcacccggcccctctcccccggcgactgggtcatcccttccccgccctccttcggaacgtggcagacctacattgtcaagccggagcacgtgtggcacaaggtccgcgacgacgtgcccgtcgagtacgctgccactgtcaccgtcaaccccttgacggcgctccggatgctgcaggactttgtgaaactcagtcctggcgatgctgttgtccagaacggcgccaccagcatcgtcggccagtgcgttattcagctcgccaaagtgcaggggattcgcaccatcaacatcataagggacaggcctgggtcagaagaagcaaaagagaaactcaaacagcttggtgcagatgaggttttcacagaaggtcagctggatgttaagaatgtcaagagcttgctgggtgctctaccagaacctgcactaggatttaactgtgtaggaggaaatgctgcagctttgatactgaagttattaaggcaaggaggcaccatggtgacatatggcggaatgtccaagagacctgtgactgtttctacttcgtcgtttattttcaaggatctttctctgagaggattctggctacagaagtggatgagttcagacaaggcggacgattgcagaaggctgatagactacctgctgggactggtgcaggaagggaaacttaaatacgagatggagttgagtccctttgacgactttggactggctcttgacaaggccctgggcaaacatgggagccaaccgaagcaggtcctgaggttctgatggtgtgtagattgaacaagggtgtgaaatttttgtacgttagcgactcagtgttgaagttgtgtggctgtgtctgtgcggttagtggatgtgagagagtcttgtttccagtggttggttatgtggcaattatgtgtggtaagacgcaaaatgtggtgagtattctgaaggcggttcc

SEQ ID NO: 4179 - DNA, 3099 bp, Zea mays
ttctcttatcttacgccgtcgtcgtcctgctccggcgacggccaggcagccgagcagataaaaagagccgaagcagcaccaccaccacgtgcctctcttctcagcttgcctgcctcactgcacccggccacaagggcaagatgcccgcctctgtcgctgtctacccggccaagatggcatgctgtctccagctccaccatcttcgccggccgtcccctgctccactccctgctcgggtcctcttcctcctctcgaccccgcgcctgcgccccgtcagagcgtctcccggcccgtccccgcccaactccttcgctggctggtcctccgactccgacagcgcggatgacggcgccgacaaatctactctagggttcggccgagcaggagggcttcttggacctggacttgctgcctttttcttcctcgccggcattacctttgctgccgtctctatcagaagcagtggcacccacgcagctggaaaattgcaaaacttgcctacagagactgctgccacggaatcttaccctgattatcactcccacaaagaggatggtgctaccagggaagcttccttaccaacggattgggacgaagaagactatgacaacctcgataaaaaagaagatacagatgaattcctgacgcctctacagtcaaacgaggttcctggggtgccagctgaaggtgaagtggggcacctgttgcagaacactgagcctgttactgatggtgaccatgttgtcggtgaagaagcgaatcagtttgacaatctcattgcatccgatggtaatcaagatccaccaccacctttgcccatactcgatgctgcaggcccctcggaggaaattcctgatgtagaagaaacatcagatcccaaaatggatttgccagaaaaccagcatttcgatgaaacattaacttcagatgcaatggtgctagattcagatgttgtgcccatccaggacatctctgaaggtgccattgctgctgcatttcacccagaagacaaaggtgtcgagcagaacccacaaactcttgacaaagatgaactttctccatccggattgcctgattatatggaacatgtaagcgccgatgggatgcatccacttggatcaaacgagttatccatggctacaaggaccagtgagacaggagatggggaggaaactatagtagaggatctgtataaaggagaaagtgaattagaaaaccaaaacaaacaattggagtccacaccacctgaccaatatttttcttctcctggaattcctgctccctctgtagtatccactgctttacaggtgcccgcagggccgattgtggttccagcttctgttgacccaacccaggaaaatgctatagctgcattgcagattctaaaggtgatcgaatccagtgctcaagctggtgaattgtgtacccggcgtgagtatgctcgatggttggtagctgcgagcaattgcctttcaaggaacactttctcaaaagtgtatccagcaatgtatattgataatgtcactgaacttgcatttgacgatgtcacacctgaagatcctgattttccattcatacaaggcctagcagaagctggattgatttctagcaagctttcaagatctgatatgaatatcccagaagatgttcatgacaatcatatcttgttttcccctgagagtcctttgtcacgtcaagaccttgtgagttggaaaatggccctggataagagacaactgcctgaagttgacagaaattgtttgttcaaactatctggctacatagacatcgataagataaacacagctgcctggccagctttggctgcagacttggatgctggagaccagagcattacagctcttgccttcggtttcacaagacttttccaaccgaacaaacctgtgacaaagggacaagctgccctagcattttcagctggtgattctggcgaagtggttctggaggaggttgcccgtatcgaggcagagaaaatagctgaagcagctgtaaatgcacatgctgcattggttgctcaggtcgagaaagatcttaatgcaagttttgaaagggagcttaaggaggaaagagaaagggtagagacccttgaaaaagtagctgaagaagctagggtggagctagataggttgagggcagaaagagaggaagagaagaatattctggtcaggggcagagctgctgttgagtctgaaatggaagttctgttgaagttgaggagtgaggtagaggaacagctgcagaacgtactgagcaagaaggtggaggtgtcgttcgagaagagtaggattgagaaactccaaaaggaaattgagagcgataactcggctgttgtgcaacttcagtatgagcttgaagtggagaggaaggcgttatctatggcaagggcttgggcagaggaggaagccaaaaaggcccgggagcatgcacgcgcccttgaggaggcccggaaccaatgggagcgtcaaggaatcagagttgttgtcgaaggagaactgaaggatgacgcctcagctggggtgacatgggctaacgctggcaaagaaaacgcagtcgacgagtctatcaaccaggcagaagctctgctggagaagctcaagacaatgtctggtgagatggaggtgaggtctcggggtgcggtggagagagtgatgcagcatgtgaggtccttcatcgcaatcctaaagcagcaagctgcagatgcaaggcagtggtgtaccgagtttggggcttgtgctgcttccagggcaaacgaggtatcagcacaagtgaagggaagcgtatctgcgtttggtgcaacccttggagacaagtcgaagagggcaatggaagagtgcaaggacggcctggagaggatttcacacagattcaagacagactagataccaattttgttgtttgcttgttttttggggatgatgttgttgcagagttgtttactatagcatgctggaacgaacagtaagtagttcccgaccgtggccttgtggaataagtaagtgcaacgaagcacttgtggccttctggaataagtgtaattaataccaacagtaattaataatagttcccgtttattatatt

SEQ ID NO: 4180 - DNA, 2438 bp, Setaria italica
gcaggggtgaactcgcgccgagatctggagggagacggcgagccgacgctggcgccgttcgcgggcgacgcttttaacgctccccgccgaggtggccgtagaatggaagggagatgctgacgggagcggccacgtgtccttgacaggtgggtctagtgacgcggtaatggagtcgtgtctccacggggtcgtggtcgtttcgttggggctgtgggtgtttccgtcctcctgctctgacttctccgtttcgcccgatcccctcccccacctgccagccccccgccggtcaccgctcgccgccgccgccgccgcccacggcagccatccagccgccggaacccatccttccgtttggtgctgggttcagttcctgtgtcgaaacgagtcgcgcagagccgcagactgggagctggggcgaggagacgagggagggatgcagcagctgcagccgaagcagatgcactgggttagggccgactcctccgacttcgggggcgaccgccccgccccccgcagcgggcacacggcggtgagcatcggcaagtccaaggtggtcgtcttcggcggattcgccgacaagcgcttcctctctgacgtctccgtctacgacgtcgagaataagctatggtacacacctgagtgcacaattaatggatccgatgggcaggcaggcccaagccctagggcatttcatgtagctgtcgtcattgactgcaatatgttcatctttggtggccgttctggaggcaagcgattaggtgatttctggatgctagacaccgacctatggcagtggtcggagatgactggctttggtgatttgccatcaccacgggagtttgctgctgcttcggccataggaaatagaaaaattgttatgtatggtggttgggatggaaaaaaatggctttcagatgtatacatcatggacacaatgtcactggagtggacagaattagcagttaccggatccgtgccgcctccaagatgtgggcattctgcaaccatgattgagaagagactgcttatatttggaggcagaggtggagcagggctgataatgggtgatttatgggctttaaagggtgttactgaagaagacaatgagacaccaggttggacacaattgaagcttccagggcaatctccctcaccacgatgcggccattcagtaacatctggtggaccttatctcttgctatttggaggacatggaactggcggttggctaagtagatatgatgtgtactacaatgaatgcattattttagacagggtctctgttcaatggaagcgcctaccaacaagcaatgaaccgcctcctcctcgggcttatcactccatgacttccatagggtctcaatttcttttatttggtggctttgatggaaagaacacgtttggcgatctgtggtggcttgttcctgaagatgatcctattgcgaaacgaggtttagctcctaacattgattcaaatagcagacctagcactacgactggtgatgcccagcaacccaacttaaaggagtcacaagctgtggtatctccaataatagaattggccaaacgactgggaattccgctttctgaggaagtttcaataagttctgttgatgaaatggatgataaagaacttgtggaattgtcctctaggcttgctggtcaatcgcttccagctagtgaccaggtggcatcaattcaggtacttcgtgatcattggaaaagttctccagcaagctcactacaactgcaggagctaggacctttgctgagggactatcagcgtctcatcctccggcgctattcgggaaatcaatcagcagcatttcatgaaatggaagctctccgtttcttccatttgaaaagtgcttcacagttgcgcatggatgacattcccatcttgttgcgcgagtatggaaggctgctttcaacatgagatgtcatcttacctttttgctttgttcgaactgaacatttgaaacttccgaagaaggcaatgtaaatcttgctgcatatgtgccatcttactcgacttttgggtagcatgatggctgaggtaccaattctcacccaatgataggtcaaagaacattcacagaactgtgcatcatggacatgtttgtaggacgtacgatttatgaatgacaaactgaagcagcaactcctgtgactgtgatcgacatgtttggccattctgctcctcatctgaccaaaagggcattccattgcatatttgcatctgcaccggagatcgaccgcacacaggccgctactgtttaagacttaaagtgtagccggtcccggtcgtacgttcaaacgcatgtgttgcttgccgttcgtccatgcgagtacagaaaaaggtggaaaacgcagcctggagctttccaacgatgccactaaacttcatagaagaacagctcaattcatgcaagggtccg

SEQ ID NO: 4181 - DNA, 2240 bp, Pennisetum glaucum
gagagcgggggtcgcggtcgtttcttttggggccttgggctgtgggtgtttccgcccgcccccgctctcgatcccctcccccacctgccacagcctccccgccggccggccaccgctcgccgccgctgccatcctgtcgccggaacccatcctcccgtgtgtcgcggtgccaggttcagctcctgtgtcgaaacgagtcgcgcagactgggaggagctgggggcgaggagacgaggggaagaggaggatgcagcagctgctgcagccgaagcagatgcactgggtgagggccgactcctccgacttcgggggcgaaccccccgccccccgcagcgggcacacggcggtgagcatcggcaagtccaaggtggtcgtcttcggcggattcgccgacaagcgcttcctctctgacgtctccgtctacgacgtcgagaataagctatggtacacacctgagtgcacgatcaatggatccgatgggcaggcaggcccgagccctagggcatttcatgtagctgtcgtgattgactgcaatatgttcatctttggtggccgttctggaggcaagcggttaggtgatttctggatgctagacaccgacctgtggcagtggtcggagatgactggctttggtgatttgccatcaccacgggagttttctgctgcttcggccataggaaatagaaaaattgttatgtatggtggttgggatggcaaaaaatggctttcagatgtatacatcatggacacaatgtcactggagtggacagaattagcagttaccggatccatgccgcctccaagatgtgggcattctgcaaccatgattgagaagagactgcttatatttggaggcagaggtggagcaggaccgataatgggtgatttgtgggcattaaagggtgttactgaagaagataatgagacgccaggttggacacaattgaagcttccagggcaaactccctcaccacgatgtggccattcagtaacatctggtggaccttatctcttgctatttggaggacatggaactggtggttggctaagtagatatgatgtgtactacaatgaatgcattattttagacagggtctctgttcaatggaagcgcctaccaacaagcaatgaaccgcctcctcctcgagcgtatcactccatgacttccatagggtctcgatttcttttatttggtggctttgatggaaagaatacatttggcgatctatggtggcttgtccctgaagatgatcctattgcgaaacgagatttagctcctatcattgattcaaacagcaaacctagcactatgactcgtgatgcccagcaatccaacttaaaggagtcacaagctgtggggtctccaataatagaattggccaaacgactgggaattccgctttctgaggaagtttcaacaagtttcgtcgacgaagttgatgataaagaacttgtggaattgtcctctaggcttgctggtcaatcgcttccagctagtgaccaagtcgcatcaattcaggtacttcgcgatcattggagaagttctccagcaagctcactacaattgcaggagctaggacctttgctgagggactatcaacgcctcatcctccagcgctattcgggggatccattggtagcatttcatgaaatggaagctctccgtttcttccatttgaaaagtgcttcacagttgcgcgtggatgacattcccatcttgttgagcgagtatggaaggctactttcaacgtgagatgagactttttgccttgtttttaactgaacatctgtaagtttcgaagaaggcaacggaaatcttgctgcactgcacatgtgccaccttaactcagacttttgaacagcacatgggggtcgtggcgcaattgagtccatgttgagcgagggtaccaaaccttctcgcttaaagatttgcgaatggcacgtttgggacgtgtgatttatatgaattggccaaactgaggcaacagctcctggggggtcgacacatggacagcaaggcacttcacgcgtgctctcaaatccttctaccccctgacttttggccccttgtagcacgcacgcgtgccgtttctcttcattctgaatcgttgtacctgtagtaattctgcatgctagctaccgccccggggcctgggatgtacactaaaaggcacacgactgtcaatgtgatcagtaaacctcatgcgcgtcgttgtttgtttgactgagagaagtacaat

SEQ ID NO: 4182 - DNA, 3920 bp, Setaria italica
ccgagatctggagggagacggcgagccgacgctggcgccgttcgcgggcgacgcttttaacgctccccgccgaggtggccgtagaatggaagggagatgctgacgggagcggccacgtgtccttgacaggtgggtctagtgacgcggtaatggagtcgtgtctccacggggtcgtggtcgtttcgttggggctgtgggtgtttccgtcctcctgctctgacttctccgtttcgcccgatcccctcccccacctgccagccccccgccggtcaccgctcgccgccgccgccgccgcccacggcagccatccagccgccggaacccatccttccgtttggtgctgggttcagttcctgtgtcgaaacgagtcgcgcagagccgcagactgggagctggggcgaggagacgagggagggatgcagcagctgcagccgaagcagatgcactgggttagggccgactcctccgacttcgggggcgaccgccccgccccccgcagcgggcacacggcggtgagcatcggcaagtccaaggtggtcgtcttcggcggattcgccgacaagcgcttcctctctgacgtctccgtctacgacgtcgagaataagctatggtacacacctgagtgcacaattaatggatccgatgggcaggcaggcccaagccctagggcatttcatgtagctgtcgtcattgactgcaatatgttcatctttggtggccgttctggaggcaagcgattaggtgatttctggatgctagacaccgacctatggcagtggtcggagatgactggctttggtgatttgccatcaccacgggagtttgctgctgcttcggccataggaaatagaaaaattgttatgtatggtggttgggatggaaaaaaatggctttcagatgtatacatcatggacacaatgtcactggagtggacagaattagcagttaccggatccgtgccgcctccaagatgtgggcattctgcaaccatgattgagaagagactgcttatatttggaggcagaggtggagcagggctgataatgggtgatttatgggctttaaagggtgttactgaagaagacaatgagacaccaggttggacacaattgaagcttccagggcaatctccctcaccacgatgcggccattcagtaacatctggtggaccttatctcttgctatttggaggacatggaactggcggttggctaagtagatatgatgtgtactacaatgaatgcattattttagacagggtctctgttcaatggaagcgcctaccaacaagcaatgaaccgcctcctcctcgggcttatcactccatgacttccatagggtctcaatttcttttatttggtggctttgatggaaagaacacgtttggcgatctgtggtggcttgttcctgaagatgatcctattgcgaaacgaggtttagctcctaacattgattcaaatagcagacctagcactacgactggtgatgcccagcaacccaacttaaaggagtcacaagctgtggtatctccaataatagaattggccaaacgactgggaattccgctttctgaggaagtttcaataagttctgttgatgaaatggatgataaagaacttgtggaattgtcctctaggcttgctggtcaatcgcttccagctagtgaccaggtggcatcaattcaggtacttcgtgatcattggaaaagttctccagcaagctcactacaactgcaggagctaggacctttgctgagggactatcagcgtctcatcctccggcgctattcgggaaatcaatcagcagcatttcatgaaatggaagctctccgtttcttccatttgaaaagtgcttcacagttgcgcatggatgacattcccatcttgttgcgcgagtatggaaggctgctttcaacatgagatgtcatcttacctttttgctttgttcgaactgaacatttgaaacttccgaagaaggcaatgtaaatcttgctgcatatgtgccatcttactcgacttttgggtagcatgatggctgaggtaccaattctcacccaatgataggtcaaagaacattcacagaactgtgcatcatggacatgtttgtaggacgtacgatttatgaatgacaaactgaagcagcaactcctgtgactgtgatcgacatgtttggccattctgctcctcatctgaccaaaagggcattccattgcatatttgcatctgcaccggagatcgaccgcacacaggccgctactgtttaagacttaaagtgtagccggtcccggtcgtacgttcaaacgcatgtgttgcttgccgttcgtccatgcgagtacagaaaaaggtggaaaacgcagcctggagctttccaacgatgccactaaacttcatagaagaacagctcaattcatgcaagggtccgtgaaacatttactgtggcacggttacttactgttgtcgagacggtagtgaaattcttgggttgaacttggctggccggaccacggcgggatggtctgccaggcccaagcaatccgagcccaggcccaaatggggtccgggcagttccagaagcttccacggatgggatcgtgagacgaaacaggaaaccaccaaccccacccggcagcggcgggcgcacccgggattcccattccaccgcgccgcagacccgcagtgcgcagcgcagcgcagccaccccgcgcccccagactctctcgatcgcttgacgcacaggattctaagggtgaacagccggcggtatgactcctggcccttggacgaagcaggactgcaggaggaacgagcagctgatggatttacccctcgtctcatccgaatatctgatacctcatcctctaccgtagcatatgacatggcaggacatttgttgctcccttttgcacatgaggacggcgaggtcgttggggatcgtggagtcgatgggcagcagatagaaaacttcctttctaaactgttgctttgatggcagctcaaattcatcatcgctacgttacagaattgcaggttttaaatcatccttacgtattctagataaacaaatacattgtacattattcaaagcatccaccattgacgattgatcttgtcaatacaaaatctctctgcatctacattctacaatttgatctctacaataatttcgtgttgcaatgacattcttgaccgaaactcattcagttctgaagttcattcagttctacaatggcattctagcctttccaagctcattaattctgaagctcgttcagttcaagttctgcaatggcattctaggttgtcgatgttagcaaggtgcttttatgcaacagcaagcaaggaacagttataatcggcatattcataagttttctttaatgcaaatatgacctgctcagtgctgaccataatgatattgccctgactagccattcccttctctaggtggtaaattacaacattcctgacgcgaacatctcattaatcattatcttgagaaagattagtgccacaaaacctgcaaaatttgaatgaatgaaacataaagcaaacgattgatacaaatacaacaagagtcatcttccttagattgcctgagctgcaatcgacgcgatgagccctcggcaaaaacttgagtgcctcctacgacgagtcgaggtgccagtaccatcagcaccccacgatgagagtgctgcaggcaacgacatcgatggggagccggagccctcagggttgcggccctagcggcagaggtttagggtcaggtgcctcctatcgggaggggagcgcttgacgaggtgcgcaggcccggcgcgcaatggcgacgggggctttggactggggacctgggaaaggaggagacaggcgaaggaagaggaacgaatagatgtgagtggctgcgccgagcaagcctgagccgac

SEQ ID NO: 4183 - DNA, 8737 bp, Brachypodium distachyon
atgctgctgcagcagcagctgccgcagccgacgcggatgcactgggcgagagccgacgcctccgacttcggaggcgaaatccccgccccccgcagtgggcacacggcggtcggcatcggcaagtccaaggttgtcgtcttcggcgggttcgccgacaagcgcttcctcgccgacatcgccgtctacgacgtcgagaacaggctgtggtacacgccggaatgcaccggcagtggctcggatgggcaggcgggcgtcggccccagcccgagggcgttccacatcgccgtggtcattgactgtaacatgttcatcttcggcggccgttccgggggcaagaggttaggcgatttctggatgcttgacactgacatatggcaatggtcagagatgactggctttggtgatttgccgtctccgcgtgagtttgctgctgcatcggccataggaaacagaaaaattgtcatgtatggtggttgggatggcaaaaagtggttgtctgatgtatatgtcatggacacaatgtcacttgagtggacagaactatcagttgctggatcagcgccacctccaagatgtggacattctgccaccatgattgagaagaggcttcttatatttggaggcagaggtggaactggaccgataatgggtgatttatgggctttaaagggtgttactgaagaagataatgagacaccaggttggacacaattaaagctgccaggacactctccatctgcacgatgtggtcattcagtgacttccggaggaccctatctcttgctatttggaggacatggaactggaggttggctaagtagatatgatgtgtactacaatgattgtattgttttagacagggtctctgtccaatggaagcgcttaccaacaagtaatgagccaccccctcctcgggcatatcattctatgacttgcatagggcctcggtttcttctatttggtggctttgatggaaagaatacctttggcgatttgtggtggcttgttcctgaagatgatcctattgccaagcgagacttggttcctaaggttggttcagacagcaaccatagcactgtgactggtgatgcccaacagtctgcactgaaggaaccacaatctggggaatcaccaacgttggacttggcaaaacgattggggattccactttctctagaaacttcagcaaattttgtcgatgaaatccacgataaagaactaatggaattatcatctaggtttatcggtgaatcacttcctactagtgatcagctcgcatgtattgaggcacttcgtgatcattggagaagttctccatcaagctcgatacagctccaggaactaggtcctctgctgagggactatcaacgtctaattatccgctgctatgtggaaaatccaaccccgacattccttgaaaaggaagatcgtcgccttttccatttgaaaaatgcttcgcagttgcgcatggatgacattcccatcttgttgagcgagtatagaactctgctgtccacctgagggcctttacaacccttttagcagcctgcaggcaatatcgcgagaaggtaaattcacatgaatttctttttgggaggtctctcatcagtgtgatgaatgagtggccaaccagagtttcgtctcgggcagcattggcacaaggatgacagacatctctctcccgggataggttcatcagaaacatgcacagaaccatgaacatgccccaggacctaaacttccttaacgacggaagacagggagccaatttctctgctcctcgaatccactttcatcatttgcgttatctttttttcttttcacttcaacttgactggactagaaagccggaagaatgggaatctgaacaagcgaggacagtttgaggtctcagtcagcggcatttatttgtacatttagccttggcacatgcttttacttcattccatggctttggaagctcatgagggacgcaggagggtgtatggcgccgttgcagatcgaaaagggggacattgcatgatgcgatggattgcaggaaagttagctttgtttgctgcagtggttgttttgtttgactgaaggaattgataagtttgttggctagtggaagaagccgtccagtcttccttattttttatgagaaaagaggaacgaaatccatccatctaggtggctccatgttgcttgctgtcgtttgagcagcactatgggtcttaagcgtaaaaagctttatggccttaggcccaaagcctctgctaattctgactcgttagatcgggcaatgaaattcatttttctgcacacgttttctggacaatggcattttcttgtgcataccatgaaaacataggcatactgaattttgaaacctcgatggcatgcagtagtaatcttcatgaacattttgttatttacggtcgaagataaaaaaaaatattgacttcggacaaacctaaaactatctatattatgggcggagagagtatatcaattaaccatattaatgtcttaaaataaattggaacaaaatattaaaaaagaattggatcacttactctcatcacggtcagtaagatatggttttagccaaggcatggttcccttgtaaatggaaccatcgcggtgtgtggtattcttgaagatatgttccggatatacatgatcagtaggatcactaagaatgacatgacacctttggttgccctctttgtgtgtaccctgtcaatcccttcgttgatggctaaatgcttgcgtggggcataactgaaggtgcagaaaaagcagttggcacaaggaaagcggaggtgcagatcggcttaccccacttcttggcacctcctaggccagttctccatgccatgttccacagttccaggattcatatgcaaatctgtcaccaaagagtaacacaagaatccagctttaataagatttatatggcataataatcgtagcaagattgagaaaaggagaggacgacgaacagaagctaaaccctagccaaacaaaactctaccacagttcgaaccaaaactcacgattccaaatctggagaacaaggattagaaacttaaaccctaacaaatccaaactctaccgcaattcgaatcaaacgctaaataatcgccgcccaaactcgccggatcagcctccagagcacgcagccgaagagaggcagcagcgaaacgaatagaatcagacggaacttctaatgggccgtgggccgcgaaaagaagaagaagcggggccgcgaaagaagaaacaggccccacgaaagaaaagcaggtgacgctctttaaaggcggtacgtaaagaaattaccccccgatgttacataaggcccagcccaatagcgatccgctcaagcgctaaagcccccgtaaaaccctaccgcattggcaagtcctctcggaccggaagccgacggcgccgaagacacctgctgctgctgctctctctcggccgtcgtcggctatacccttgccgcctttgctcggagctgcgccgaggacccctgctgctgctccccccctcgacaccgtcggcggcgaccggtctcccttctcctagccatggagcaagcgccatcagtggaagtggagtcgatcctcttcggcttctacagcgaggaggagattaagagggtcagcgtcacaaggatcaccaaggcggaccgcctcgatgccaagaactgccccgtgccaggcgggttgcttgacctagcgatgggacccatcaacgccactgacacctgcaatacttgcggtcagctttccggtctctgccccggccattttggccacattgagctgtcaaagccgctgtttaatccactgctatttgggacccttcgagatcttctccgctcgacgtgcttctcttgtcacagattccgcttgcacagcgaacaggttcgtaggtacactcgtgagcttgaactggtagcaaggggtgacgtcgcccgtgctaaaaatttgcaagattcaggtgtagcagaggaagatgttgaaatggacgaggacagttcagttgatcaatcatctccttctgacagagagaataaaacctggacatcgattcagttaaaagaggctcatgctattatcttcaagctattgaaaaagcaagtgaaaaagtgtgcaaactgtgacatgaggagtccaaaggtcacatgtcagatatttggttggctcaagattcaggatactaaaggttcttctgtaagaagaaaagctattaccgattttaatctggaaggagatagtcatagacatgactcaagtgaaaatggtgtttctggtctttccgatgatataattaaagggtcgagcaatcaaataacaggcctttctgatgatagaattaaagaaattcctctcttagctacagaggttgaatccattctcaaagacttgtgggaaaatgaagccaggttctgcatgttactttgtgactttcagcagaacttaagtgtatcagaaaagaggaggggctatgagatgtttttcttgaagagtctgcttgtgacaccaaacagattccgtccctcgactagctctagccttggaattatggaacatccacaaaatgtgctgttaggtaaagtgcaagaggccaatcttgcggtccagcatgacaaagcccatccgaatcacatggatatcattacaagatggagagatctgcaaacaagtgtaaatttattttacgatagtagtaaaggctttggaaatggcgatggggatggtaatggtataaggcaactgttggataagaaagggggtgttattcgacagaaaatgatggggaagagagttaatcattcctgccggactgttatatctccggatccatttttggctgttaatgaaattgggattcctcctcaagctgcgttaaaaatgacttatccggagaatgtgatgccctgtaatgccaaaaagctacaagaagctataaataatggctgtggaattcatcccggtgcaacacactacaaggttaacaaaaacatgtataaattacaggatgaccgttccaaacggcgtgccattgctaagatgttacctgcttctagaggatcaatttctcaacctgggaaagatcctaaatgtgaatttgaaagcaaagttgtatatcgacatcttcaagatggtgatattgtacttgtcaacagacagcctactcttcacaagcccagcatgatggcccattttgttcgtgtattgcctggagagaagacaattcgaatgcactatgccaattgcagcacatacaatgctgattttgatggtgatgaaatgaatgtgcacttcccgcaagatgagatatctcgtgctgaggccatgaacattgttgatgcaaataagcagtacattggtccaaggagtggggatgctgtcagaggtctcattcaggaccacattgttagtgctgtgcttctgactaaactggacacattcataagccgtgaggaatacagtcagcttgtatatgggtcttgtgtgtcctcaactcgtagcccttgtcaatctggtaaaagggtatctgttatgaaggatggtgacatattggaacttcttcctccagctattttgaagccaaaaccactatggactggaaaacaggtcataacaaccatcttgaaccatttaacaaaaggtcacccgccatttactgttgagaagaaagggaaaattccagtaaaatatttaatacctaaagaacgccatggtgataaagataacgctaaagattctgaacaagttctgtatattcatgataatgagcttataaagggcatgatagataaggaccagttcgggaactacgggatagttcacacggtttatgaactatatggtgcagagacagctggaagactgctatcaatattcagccgtctgtttacattattcttgcagttacatggatttacttgtggtatagatgatctgctactattccaagaatccgataagcagaggacagaaactctcatgacaagtgagaaatgcagtgaagaagtccacaggaaatttacatgcgctggagattatgacgaagatccattgaaattgcaaatggaggttgaaaaggttgtgcggaggattggagaatccgcgaccgacacgttggataaaatgatgttaagtgctctaaatgggttacaatctgaggtcaatcgacgcttgtttccctatgggctacaaaagccttttcctagaaattgtctgactcttatgactgcaactggagctaaaggtggcgaggttaacatgacacaaatcacgtcattgctaggcagccaagatttagaaggagcgcgtgttccacgaatgatatctgggaagtcattaccttgctttccaccttgggatacttcttcaagagctggtggttttgtcagtgacagatttttaactggtctgcgccctcaagagtactatttccactgtatggccggcagaaatgggttgattgacacagcagtcaagacatcgcgtagtggatatcttcagcgttgtcttgtcaaaagtcttgaatcattgtttgtggcttatgatcacactgtgcgtaatgttgatggatcaattgtacaattccgctacggagaagatggagttgatgtccataaaagtaactttctcgataagttccaggataaagacatgtttaaagaacttgctgataatagaaaagctgtccttgacaggcttggtagatacactggtgatcacatgtcattgcagtccaattacatcactgaactgcctgaagcactcactgaccgtgcaacgaaatttctctcaaaagataaggggcgctgccggcatgacatcaaggaggatgaactaatgaatttactaaaagccaagtacctggctagtcttgtagatcctggtgaagctgttggtgtgatccttgcccagtctttaggagaaccctcgacacagatgacgctcaacacttttcattttgctggaagaagtgacgtgaatgtcacacttgggatgcctcggatacaagaaattctaatgaaagcatcagcaaacattgctacgcctgttatgatgtgtcctctgcttgaagatgtgacttgggatgatgctgaacgtcttgccgcaaaattgaggggtgttcggttggttgatattgtggagggaatcgaagtatgcacagttcctttttacaacaataatgggtatgtttcgagtctctataagttgcagataaaactattcccaccagagcgttaccctcctcagtctgagcttacagtagatgagtgtcaaacagccttgagaacagtgtttgttgattcaatggaatttgcaatcgaaaaacacctaaaattgctatacagagttagtggaatccaggaaactagggtaaaagacactgagagctcactatcagaaggtcctgaagaatctgaaggccgacctatcgacggggaagaatctggtgcaagtgatggtgataatgaaaatgaggatgacttgggaactgatggagaaaagaggaaacgtcaagagaatgatgagatggagtatgatggtgaagatgatgttgaaaaggaagatggtatgaacagtgaccctgaagaagagacaaaatatgaacttgataatgatgatgatctagttgagtcaggcggagaatcagaagtgaatgacgaaggacatgtgtcagattccagtaacaaggtaggcaaattagaaggtaagcttgcagctggtaaactcaagaaggaagtaaataaaaccgtggaaaacttggaggagcagaagcaggcacaaaaaggagtgaaacgcaccaagttaagccgcactgtccatgttgaaagcacaggcttaaattttgaggttcactacctcttgttgcacaacgaaccccatattttgctatcccagattgcccagaagacattgcggtccctatttgtcaagggatcccataacaacaaaattgatcaatgtaaagttgtttggccagagaagaaaggtgatttccgaggactgaagacggcaggagtgaactttgatgtattctggggtctgcaggactacctcgacatctgtaaggttgcgtcgaatgacatacatgcaatcttgaggacatacggggtggaggctgccagggccaccatcatcaaggaagtgaaagctgtttttgaaccctttggtataaatgtaaacagaaggcacctgagcctggttgctgagttcatgacctccggaggtgattaccgagcaatgagcagcatggggatggcccagttctgtacgtcgccgtttggcaagatgacttttgagcaagccaccaggttcatcacggaggctgctttttacggcgaggcggacaacctcaatggcccttcggcgaccatatcgttggggaaaccggctaagacggggacaggttgctttggcttgctgcagaatttttgcttagaggagaccgcggtcatgtaactgtctcttgtctatacgtttggtctatagcatgcatgactggtcacttgattttgagtccaaggattaaacataccagtgggtgagagaggtggttgcttgatttgagtcccaaggattagttagtgatgtattcttgtattgagactttggatcttttttgtatgtcagttgcatattcttggaacacgtcaataggcaaaagcctgattaattccgtaacacgtcaatattcagatgattaagttgggatcaac

SEQ ID NO: 4184 - DNA, 1905 bp, Triticum aestivum
ggaggagggatgatgcagcagctgcagccgacgcggatgcactgggcgagggccgtcccctccgacttcggcggccaagcccccgcccctcgcagcgggcacacggcggtcgccatcggcgggtccaaggtcgtcgtcttcggcgggttcgccgacaagcgcttcctcgccgacatcgccgtctacgacgtcgagaacaggctatggtacacgccggagtgcagcggcagcggcccggacgggcagccaggccccagcccgagggccttccacgtcgccgtggtcatcgactgcaacatgtttatcttcggcggccgctccgggggcaagaggttaggtgacttctggatgctcgacactgacatttggcagtggtcggagatgaccggctttggcgatttgccgtctccccgcgagtttgctgccgcatcagccataggaaacagaaaaattgtcatgtatggtggttgggatggcaaaaagtggctgtctgatgtatatgtcatggacacaatgtcacttgagtggacagaactagcagttactggatcagcgccacctccaagatgcggacattctgccactatgattgagaagaggctgcttatatttggaggcagaggtggaactgggccgataatgggtgatctctgggctttaaagggtattactgaagaagataatgagacaccaggatggacgcaattaaagctgccaggacaatctccctctgcacgatgtggtcattcagtgacttctggtggaccttatctcttgctatttggtggacatggaactggtggttggctaagtagatatgatgtgtactacaacgaatgtgttattttagacagggtctctgttcaatggaagcgcttaccaacaagtaatgagccaccccctcctcgggcatatcattctatgacttgcatagggcctcggtttcttttatttggcggctttgatggaaagaatacatttggcgatttgtggtggcttgttcctgaagatgatcctattgccaagcgggacttggttcctgatgttggttcagacagcaaccatagcactgtgactggtgatgcccaacagtctgcattgaaggaatcagaatcacaatctggggaatctccgatgttggagttggccaaacaattggggattccactttctgtagaaccttcagcaagttttgttgacgaaatcaacgataaagaactagtggaattatcatccaggctcattggtgaatcacttcctaccaccgaccagcttgcatgtattcaggcacttcgtgatcattggagaagttctccatccagctcaatacagctccaggagctaggccctctgctgagggactatcaacgtctcattatccgccgctttgtggaaaacccatccccgacattccttgaaagggaagatcgccgcctcttccatttgaaaaatgcctcgcagttgcgcatggatgacatccccatcttgctcggcgagtatagaactctgctttccacctgagagagggccacacaactattttgcctggtaggtgcttctaccatcggttctctgcttctgtggtttccgatgtgcagggcgagaaggacgacggcccagccgcctaggccccaggcaagcaaacagatcattgatgagcaaaattgacgaggaaatgttgtatttgggaaatgcatagaaaagcaaaatgtcatgatctataatggttgtattttgatgtacaagctagaatcttcttgtattttgttggatgtacaaatgcaattttaaaaatttcagactaaagagctccatggagctacggagcaaattaattctcatccgccatcattttaacatatgcgatcacatgcttgtcacgttgttggacagagatacaacata

SEQ ID NO: 4185 - DNA, 2001 bp, Avena sativa
ctgtccagcttcccctttccggccaccgttccggcaacggccgccgatcatatcgccaggagtgggagcagggggaggagagggatcatgcagccgacgcggatgcactgggcgagagccgactcctccgatttcggaggccaagcccccgcccctcgcagcgggcacacggcggtcgggatcggaaagtcgaaggtggtcgtcttcggcgggttcgccgacaagcgcttcctcggcgacatcgccgtctacgacgtcgagaacaggctatggtacacgccggagtgcacgggcagcggtccagatgggcatgcgggccccagccccagggcgttccacgtcgccgtggtcatcgactgcaacatgttcatcttcggtggccgctccgggggcaagaggttaggcgatttctggatgcttgacaccgacatttggcagtggtcagagatgactggctttggtgatttgccgtctccacgggagtttgcggctgcatcagccataggaaacaggaagattgtcatgtatggtggctgggatggaaaaaagtggctgtctgatgtatatgtcatggacacaatgtcacttgaatggacagaactagcagttgctggatcggcgccgcctccaagatgcggacattctgtcactatgattgagaagagattgcttgtatttggaggcagaggtggaaccgggccgataatgggcgatctatgggctttaaagggtgttactgaagaagataatgaggcaccaggttggacacaattaaagctgccaggacaatccccctctgcacgatgtggtcattcagtgacttctggtggaccttatctcttgctatttggaggacatggaactggcggttggctaagtagatatgatgtgtactacaacgaatgtgttattttagacagggtctctgtacaatggaagcgcttaccaacaagtaatgagccacctcctcctcgggcatatcattctatgacttgcatagggcctcggtttcttttatttggtggctttgatggaaagaatacctttggcgatttgtggtggcttgttcctgaagatgatccaattgccaagcgagacttggttccaaatgttgattcagagagcaaccagagcactgtgactagtgatgcccaacagtccgcattgaaggactcgcaccaatctggggaatctccaatgttagacttggcaaaaagattggggattccactttctctagaacctccagcaagttttgttgacgaaatcaatgataaagaactaatggaactatcatctaggcttgtcggcgaatcacttcctactactgaccagcctgcatgtattcaggcacttcgagatcattggagaagttctccatcaagctcgatacagctccgggaacttggccctctgttgagggactatcaacgtctcattatccgtcgctatgtggaaaacccatccccagcattccttgaaagggaggatcgccgccttttccatttgaaaaatgcttcgcagttgcgcatggatgacgtccccatcttgctgagcgagtacagaaatctgctttccacctgagagggctccacttgctactcttttacctggcagaccacaggcaacacatatcgagaagtcaatacaaccgcacctgcatatttgtcaagttaaatggtctacatgaactcttgcctgaggtttctgaccagattgatgatttagtggctatacagagctctgtacgccaagctttgaatggcgtcatgacggtgcttcaaggacatacatctcaccccgagataggctgagtcagagaagaaaggtgcacagaattgtggtgcatagtggaccttagatgtaacctctaacggaagctaagtcgatggctcgcgatgttctgagaggagttgacaatacagtttcttttgctcctatgtcatgcttatagtcgagaaatggtcaatttttgtgttctaaattcatgtactggttccc

SEQ ID NO: 4186 - DNA, 1971 bp, Secale cereale
cgacgcgacggccgccgaccgcgtcaccgggagcggaggaggaggaggagagggatgatgcagcagctgcagccgacgcggatgcactgggcgagggccgtcccctccgacttcggcggccaggcccccgcccctcgcagcgggcacacggcggtcgccatcggcgggtccaaggtcgtcgtcttcggtgggttcgccgacaagcgcttcctcgccgacaccgccgtctacgacgtcgagaacaggctatggtacacgccggagtgcagcggcagcggcccggacgggcagccaggccccagcccgagggccttccacgtcgccgtggtcatcgactgcaacatgtttatcttcggcggccgctccgggggcaagaggttaggtgacttctggatgctcgacaccgacatttggcagtggtcggagatgactggctttggcgatttgccgtctccccgggagtttgccgccgcatcagccataggaaacagaaagattgtcatgcatggtggttgggatggcaaaaagtggttgtctgatgtatatgtcatggacacaatgtcacttgagtggacagaactagcagttactggatcagcgccacctccaagatgcggacattctgccactatgattgagaagaggctgcttatatttggaggcagaggtggaactgggccgataatgggtgatctctgggctttaaagggtattactgaagaagataatgagacaccaggatggacacaattaaagctgccaggacaatctccctctgcacgatgtggtcattcagtgacttctggtggaccttatctcttgctatttggtggacatggaactggcggttggctaagtagatatgatgtgtactacaacgaatgtgttattttagacagggtctctgttcaatggaaacgcttaccaacaagtaatgagccaccccctcctcgggcatatcattctatgacttgcatagggcctcggtttcttttatttggtggctttgatggaaagaatacctttggcgatttgtggtggcttgttcctgaagatgatcctattgccaagcgggacttggttcctgatgttggttcagacagcaaccatagcactgtgactggtgatgcccaacagtctgcattgaaggaatcagaatcacaatctgatgaatctccgatgttggagttggccaaacgattggggattccactttctgtagaaccttcagcaagttttgttgacgaaatcagcgatagagaactagtggaattatcatctaggctcattggtgaatcacttcctaccaccgaccagcttgcatgtattcaggcacttcgtgatcattggagaagttctccatccagctcaatacagctccaggagctaggccctctgctgagggactatcaacgtctcattatccgccgctttgtggaaaacccatccccgacattccttgaaagggaagatcgccgcctcttccatttgaaaaatgcctcgcagttgcgcatggatgacatccccgtcttgctgggcgagtatagaactctgctttccacctgagagagggccagggccacacaactattttgcctggtagatgcaactgggctaaaaccattgtgctacgaccatcggttctctgcatctgtggtttccgatgcgcagggcgagaaggacgacggcccagtcacctaggccccaggacaagcaaacagaccgttgatgagcaaaattgatggggaaatgttgtatttgcaaaatgccatgatctataatgttttatattttgatgtacaagctagaatcttcttttgttttgttggatgtacaaatgtaattttaaaattttcaaaataaatagctccatggagctacggagcaaatcaattctcagccgccatctttttaacatatgcggtcacatgtttgtcacgttgtacccattatataacttcacattgacca

SEQ ID NO: 4187 - DNA, 2707 bp, Oryza sativa
attatgcttaaccaaaccggctttactctttgaccaaaccggcccaccccctctcgctccacctgactgcgtgtgcgtgaggttgaggtatccccaaatttccttccgccgccgtgctgctggtcaccgccgtggcgaggcgaggcgatcaagagctgagctaccgtggaggcgtggattgagagtctgagagagagcaatgacgccgcagctgcagccgaagcagatgcactgggcgagggccgactcctccgacttcggaggccaaatccccgcccctcggagcgggcacacggcggtgagcatcggcaagtccaaggtggtcgtcttcggcggattcgccgacaagcgcttcctctccgacatcgccgtctacgacgttgagaataggatttggtacacacctgaatgcaatgggagtggctcggatggacaggcaggccccagtccaagggcctttcacgtagctatcgtcattgactgcaacatgttcatctttggcggccgatcaggcggcaagagattaggtgacttttggatgctcgatactgacatatggcaatggtcagagttaaccggctttggtgatctaccatcacctcgagagtttgctgctgcttcagccataggaaacagaaaaattgttatgtatggcggttgggatggcaaaaaatggttgtcggatgtatacatcatggacacaatgtcacttgagtggacagaattatcagttactggatcagtgccacctccaagatgcggacattctgccacaatgatcgagaagaggttgcttgtatttggtggcaggggtggagctgggcccataatgggtgatttatgggctttaaagggtgtcactgaagaagataacgagacaccaggttggacacaattgaagctcccaggacaatctccatctccacgatgtggtcactcagtaacatctggtggaccttatctcttgctgtttggaggacatggaactggtggttggctaagtaggtatgatgtgtactacaatgaatgtattattttagacagggtctctgttcaatggaagctcttagcaacaagtaatgagccaccccctcctcgagcatatcattctatgacttgcatagggtctcgatttcttttatttggtggctttgatgggaaaaatacattcggggatctatggtggcttgttcctgaaggtgatcctattgcgaaacgagacttggttcctaatgttgattcagacagcaaacctagtaatgtgactggtggtgctcaacattccgcatcacaggaatcacaagctggggaatctccaatgattgacttggcaaaacgattgggcatttcactttctttagaagcttcagcaagttttgttgacgagatcaatgataaagaactaattgaattatcatctatgctttttggtgaatcaccccctaccggtgaccagcatgcatgcattcaggcacttcgtgatcattggacaagtattccagccaactcaatacagctccaggagctaggccctttactgagggattatcaacgcctcattcttcgccgctatttggaaaattcattcacgtctttctatgagaaggaagttcaccgcttcttccatttgaaaaatgcttccgagttacggatggatgacatccccatcttgttgatggagtatggaaagctgctttccacctgaggctgggatagcatcttagttctgactctttacttgagaacattagaaggcaaggaagcatagctgcatacatggcatgctttcacgatcttcagagcttggtggcatcagagctttgctccctgctcaaaaacgttttcagcatgggcacgaacaaagttaccgcactttcgggtacaacgtcgatagaatttgtgaatcatgggcgtgttaagaacctacatgctgcattatcttaaagaaatcgaaagcgacaacacctggcggcttggtgccgagaagctggcaggaaggctcttcacatttgttcaccttgattgatgtagtattctttctttgctcactaacaaaaataattatacattcattagtggagtcaattctcatattgattctttttctttgattgatatggagtcgtggccatctcggcgacggcacatttgacatgcatgatgcatgcgttgtactggtgctgtactcgctccatccaaaaaaaaaaaagacaaaccctatgtttttgtggccaacgtttgactatccgtcttatatgaaatttttttataattagtattttcattgctgttagatgataaaacataattaatactttatgcgtgacttatctttttaaattttttcacaaatttttcaaataagacaggacggttaaacgatggacacggaaactaggtttttttttttttttgagacggagggagtatgtgcggtggtggttggtgggggcaacgacggaacggcaacttcacgtggtgcagactgtggagaaagtttggacttttggggggttccgcccgtcgtcgaacaaaattcccattaaacggggcttttgtttgaaaattgggacacacatggttttaccaagctcatcacatgttttcacgaacttcatttttctgtacttggttaatgtcgtgtttgtcaaggtcgtgtttttcataattcgactaaagaagcgactggctgaatcattattcataa

SEQ ID NO: 4188 - DNA, 1976 bp, Triticum aestivum
ggaacgaaggctccgttccggcgacgcgacggccgcgaccgcgtcaccgggagtggaggaggagggatgatgcagcagctgcagccgacgcggatgcactgggcgagggccgtcccctccgacttcggcggccaagcccccgcccctcgcagcgggcacacggcggtcgccatcggcggatccaaggtcgtcgtcttcggcgggttcgcggacaagcgcttcctcgccgacatcgccgtctacgacgtcgagaacaggctatggtacacgccggagtgcagcggcagcggcccggacgggcagccaggccccagcccgagggccttccacgtcgccgtggtcatcgactgtaacatgtttatcttcggcggccgctctgggggcaagaggttaggtgacttctggatgctcgacaccgacatttggcagtggtcggagatgactggctttggcgatttgccgtctccccgggagtttgctgccgcatcagccataggaaacagaaaaattgtcatgtatggtggttgggatggcaaaaagtggctgtctgatgtatatgtcatggacacaatgtcacttgagtggacagaactagcagttactggatcagcgccacctccaagatgcggacattctgccactatgattgagaagagactgcttatatttggaggcagaggtggaactgggccgataatgggtgatctctgggctttaaagggtattactgaagaagataatgagacaccaggatggacgcaattaaagctgccaggacaatctccctctgcacgatgtggtcattcagtgacttctggtggaccttatctcttgctatttggtggacatggaactgggggttggctaagtagatatgatgtgtactacaacgaatgtgttattttagacagggtctctgttcaatggaagcgcttgccaacaagtaatgagccaccccctcctcgggcatatcattctatgacttgcatagggcctcggtttcttttatttggtggctttgatggaaagaatacctttggcgatttgtggtggcttgttcctgaagatgatcctattgccaagcgggacttggttcctgatgttggttcagacagcaaccatagcactgtgactggtgatgcccaacagtctgcagtgaaggaatcagaatcacaatctgatgaatctccaatgttggagttggccaaacgattggggattccactttctatagaaccttcagcaagttttgttgacgaaatcaatgatagagaactagtggaattatcatctaggctcattggtgaatcacttcctaccaccgaccagcttgcatgtattcaggcacttcgtgatcattggagaagttctccatccagctcaatacagctccaggagctaggccctctgctgagggactatcaacgtatcattatccgtcgctttgtggaaaacccatccccgacattccttgaaagggaagatcaccgactcttccatttgaaaaatgcctcgcagttgcgcatggatgacatcccgatcttactgggcgagtatagaactctgctttccacctgagagaggtccacacaactattttgcttggtaagtgcatctgggctaaaaccattgtgctacgaccatcggttctctgcttctgtggtttccgatgcccagggcaagaaggacgacagcccagccacctaggccctagggcaagcaaacagaccattggtgagcaaaattgatgaggaaatgtttgtatttgcgaaatgcatagaaaaacaaaatgccatgatctataatgtttgtattttgatgtacaagctagaatcttcttttattttcttggatgtacaaatgtaattttaaaattttcgaaagaaagagctccatggagctacggagcaaattaattctcatccgccatcattttaacatatgcgatcacatgcttgtcacgttgttggacagag

SEQ ID NO: 4189 - DNA, 2581 bp, Brachypodium distachyon
cacaaccgcggttgcttccccgtttccggcagcgcagccggccaccgatcgccggactccgaatcgagaccggggcatcgcctgggagaggagagaaccgagagatgctgctgcagcagcagctgccgcagccgacgcggatgcactgggcgagagccgacgcctccgacttcggaggcgaaatccccgccccccgcagtgggcacacggcggtcggcatcggcaagtccaaggttgtcgtcttcggcgggttcgccgacaagcgcttcctcgccgacatcgccgtctacgacgtcgagaacaggctgtggtacacgccggaatgcaccggcagtggctcggatgggcaggcgggcgtcggccccagcccgagggcgttccacatcgccgtggtcattgactgtaacatgttcatcttcggcggccgttccgggggcaagaggttaggcgatttctggatgcttgacactgacatatggcaatggtcagagatgactggctttggtgatttgccgtctccgcgtgagtttgctgctgcatcggccataggaaacagaaaaattgtcatgtatggtggttgggatggcaaaaagtggttgtctgatgtatatgtcatggacacaatgtcacttgagtggacagaactatcagttgctggatcagcgccacctccaagatgtggacattctgccaccatgattgagaagaggcttcttatatttggaggcagaggtggaactggaccgataatgggtgatttatgggctttaaagggtgttactgaagaagataatgagacaccaggttggacacaattaaagctgccaggacactctccatctgcacgatgtggtcattcagtgacttccggaggaccctatctcttgctatttggaggacatggaactggaggttggctaagtagatatgatgtgtactacaatgattgtattgttttagacagggtctctgtccaatggaagcgcttaccaacaagtaatgagccaccccctcctcgggcatatcattctatgacttgcatagggcctcggtttcttctatttggtggctttgatggaaagaatacctttggcgatttgtggtggcttgttcctgaagatgatcctattgccaagcgagacttggttcctaaggttggttcagacagcaaccatagcactgtgactggtgatgcccaacagtctgcactgaaggaaccacaatctggggaatcaccaacgttggacttggcaaaacgattggggattccactttctctagaaacttcagcaaattttgtcgatgaaatccacgataaagaactaatggaattatcatctaggtttatcggtgaatcacttcctactagtgatcagctcgcatgtattgaggcacttcgtgatcattggagaagttctccatcaagctcgatacagctccaggaactaggtcctctgctgagggactatcaacgtctaattatccgctgctatgtggaaaatccaaccccgacattccttgaaaaggaagatcgtcgccttttccatttgaaaaatgcttcgcagttgcgcatggatgacattcccatcttgttgagcgagtatagaactctgctgtccacctgagggcctttacaacccttttagcagcctgcaggcaatatcgcgagaaggtaaattcacatgaatttctttttgggaggtctctcatcagtgtgatgaatgagtggccaaccagagtttcgtctcgggcagcattggcacaaggatgacagacatctctctcccgggataggttcatcagaaacatgcacagaaccatgaacatgccccaggacctaaacttccttaacgacggaagacagggagccaatttctctgctcctcgaatccactttcatcatttgcgttatctttttttcttttcacttcaacttgactggactagaaagccggaagaatgggaatctgaacaagcgaggacagtttgaggtctcagtcagcggcatttatttgtacatttagccttggcacatgcttttacttcattccatggctttggaagctcatgagggacgcaggagggtgtatggcgccgttgcagatcgaaaagggggacattgcatgatgcgatggattgcaggaaagttagctttgtttgctgcagtggttgttttgtttgactgaaggaattgataagtttgttggctagtggaagaagccgtccagtcttccttattttttatgagaaaagaggaacgaaatccatccatctaggtggctccatgttgcttgctgtcgtttgagcagcactatgggtcttaagcgtaaaaagctttatggccttaggcccaaagcctctgctaattctgactcgttagatcgggcaatgaaattcatttttctgcacacgttttctggacaatggcattttcttgtgcataccatgaaaacataggcatactgaattttgaaacctcgatggcatgcagtagtaatcttcatgaacattttgttatttacggtcgaagataaaaaaaaatattgacttcggacaaacctaaaactatctatattatggg

SEQ ID NO: 4190 - DNA, 1896 bp, Brachypodium distachyon
accaacttagaccctgtttgtttgagtttgagcttcagcttcagctttcggtgcttttaacaatctcaaaagcacttctcctgtttacacatgaagctaagaagcacctccggacgtccggaggtgcttctagctgagaagcacctcgtcatgtataacgaaaaaagtgcttttgagatttttagaaacaccaaaagctgaagcagaagcccaagcaggacgtcaggcccactgtcagacgtgtaaggaattagaattccccacaaccgcggttgcttccccgtttccggcagcgcagccggccaccgatcgccggactccgaatcgagaccggggcatcgcctgggagaggagagaaccgagagatgctgctgcagcagcagctgccgcagccgacgcggatgcactgggcgagagccgacgcctccgacttcggaggcgaaatccccgccccccgcagtgggcacacggcggtcggcatcggcaagtccaaggttgtcgtcttcggcgggttcgccgacaagcgcttcctcgccgacatcgccgtctacgacgtcgagaacaggctgtggtacacgccggaatgcaccggcagtggctcggatgggcaggcgggcgtcggccccagcccgagggcgttccacatcgccgtggtcattgactgtaacatgttcatcttcggcggccgttccgggggcaagaggttaggcgatttctggatgcttgacactgacatatggcaatggtcagagatgactggctttggtgatttgccgtctccgcgtgagtttgctgctgcatcggccataggaaacagaaaaattgtcatgtatggtggttgggatggcaaaaagtggttgtctgatgtatatgtcatggacacaatgtcacttgagtggacagaactatcagttgctggatcagcgccacctccaagatgtggacattctgccaccatgattgagaagaggcttcttatatttggaggcagaggtggaactggaccgataatgggtgatttatgggctttaaagggtgttactgaagaagataatgagacaccaggttggacacaattaaagctgccaggacactctccatctgcacgatgtggtcattcagtgacttccggaggaccctatctcttgctatttggaggacatggaactggaggttggctaagtagatatgatgtgtactacaatgattgtattgttttagacagggtctctgtccaatggaagcgcttaccaacaagtaatgagccaccccctcctcgggcatatcattctatgacttgcatagggcctcggtttcttctatttggtggctttgatggaaagaatacctttggcgatttgtggtggcttgttcctgaagatgatcctattgccaagcgagacttggttcctaaggttggttcagacagcaaccatagcactgtgactggtgatgcccaacagtctgcactgaaggaaccacaatctggggaatcaccaacgttggacttggcaaaacgattggggattccactttctctagaaacttcagcaaattttgtcgatgaaatccacgataaagaactaatggaattatcatctaggtttatcggtgaatcacttcctactagtgatcagctcgcatgtattgaggcacttcgtgatcattggagaagttctccatcaagctcgatacagctccaggaactaggtcctctgctgagggactatcaacgtctaattatccgctgctatgtggaaaatccaaccccgacattccttgaaaaggaagatcgtcgccttttccatttgaaaaatgcttcgcagttgcgcatggatgacattcccatcttgttgagcgagtatagaactctgctgtccacctgagggcctttac

SEQ ID NO: 4191 - DNA, 2020 bp, Lolium multiflorum
ccccgctccggcgacggccgccgatcacatcgccgggaggaggagggagatgatgcagccgacgcggatgcactgggcgagggccgacgcctccgacttcggaggccaaccccccgtccctcgcagcgggcacacggcggtcgggatcggcaactcgaaggtggtcgtcttcggcgggttcgccgacaagcgcttcctcggcgacatcgccgtctacgacgtcgagaacaggctgtggtacacgccggagtgcaccggcagcggcccggacgggcagccgggccccagcccgagggccttccacgtcgccgtcgtcatcgactgcaacatgttcgtcttcggcggacgctccgggggcaagaggttaggcgatttctggatgctcgacactgacatttggcagtggtccgagatgaccggctttggtgatttgccgtctccgcgggagtttgctgcagcatcagccataggaaacaggaaaattgtcatgtatggtggctgggatggcaaaaagtggctatctgatgtatatgtcatggacacaatgtcacttgaatggacagaactagcagttgctggatcagcgccgcctccaagatgcggacattctgccactatgattgagaagagactgcttgtatttggaggcagaggtggaactggaccgataatgggcgatctatgggctttgaagggtgttactgaagaagataatgaggcgccaggttggacacagttaaagctgccaggtcaatccccctctgcacgatgtggtcattcagtgacttcaggtggaccttatctcctgctatttggaggacatggaactggcggttggctaagtagatatgatgtgtactacaacgaatgtgttattttagacagggtctctgttcaatggaagcgcttaccaacaagtaacgagccacctcctcctcgggcatatcattctatgacttgcataggatcccggtttcttctatttggtggctttgatggaaagaatacctttggcgatttgtggtggcttgttcctgaagatgatcctattgccaagcgagatttggttcctaatgttgaatcagacagcaacctaagcactgtgactagtgatgcccaacaggcagtgaaggaatcacaatctggggaatctccaatggtggacttggcaaaaagattggggattccactttctatggaacctccagcaagctttgttgatgaaatcaatgataaagagctaatggaattatcaactaggcttattggcgaatcacttcctactactgaccagcttgcatgtattcaggcacttcgtgatcattggagaagttccccatcaagctccatacagctccaggagcttggccctctgctgagggactatcaacgtctcattatccgccgttacgtggaaaacccatccccaaggttcctcaaaagggaagatcaccgccttttccatttgaaaaatgcttcgcagttgcgcatggatgacatccctgtcctgctgagcgaatacagaactctgctttccacctgagggggctccacttgcagctcttttacctggcagcgtgcaggtaacatatcaaaagtcaagcgcaccgcacctgcatacatgtcaagttaattgatgatgaacgagttgctaaccagagcattgtgcgtgacgcttccccgaggatgaatgtgtcgtaaccatgctttgaggacttacatctctctccttagagagtcaaaagaaagtcgcacaaaattattgtggatagcagactgtaaatgtaacctctaattgtaactggagctgacggctcctgggtctatgggaggtgttgataggaaaacagtttccttgctcttttggtccatgattaattgacaagtggtccaacgtttgtttgctaaattcgtgtgcagttccatttttcatggcacgtgctttctaatttcctccatatgccttgaccaaactttgaggtcaagtccaacatagtgtgaagaaagatacaattctcaa

SEQ ID NO: 4192 - DNA, 1114 bp, Zea mays
tgcatgcatgaatgcatccacccacaaagagccaagaaatgcgtggcaggagccacgcaagccgtgcagagcgttacgcaggcaggaccgtaggggagccgcatgctgcaaccagaaccgaggccccatttctgagcggcagcacgcaggcaggcagcggcgtgcattgcatggtgtgcctgtctgtcctgctagctaacaacggctagaatccagcgggcgaattctgaaaaatccggcccgtgaaaaaagtcacaggactctactgtatgtcgcatggaacgattgcacagccctgcttagcagtaatctcgaaccgtcgaacgcgttgaggaatcagtttagttctcgctaatcagccacccgacccgggcattaaacatcagctaacccttgggctcaataccagcgctctatataaaccgtggctctggttcccatccattgcatccccctttctgctcctgtgctgcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgcatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgtaaggcggagggcgccacgcgcaagtgcttctgcaagaagatatgctagtagtagcctcggctttgctggcacaagcaggtcgtcggcacgcaacgcaattcaagcatcatatcggtcctcctcccgcgttgctgtctactcgaccccgttttctctttcgatcgatttcgttgtttcctgttgctctcttcttttcccgcgaataatatgctccatgggatctcactgttgtactttctgcatccgttggtagtcaggacgatccttcttcccgctgtcacgtgtgattcaaaatggatgtactaatgcaactgttcgttcttccaaa

SEQ ID NO: 4193 - DNA, 622 bp, Triticum aestivum
gcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgcatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgtaaggcggagggcgccacgcgcaagtgcttctgcaagaagatatgctagtagtagcctcggctttgctggcacaagcaggtcgtcggcacgcaacgcaattcaagcatcatatcggtcctcctcccgcgttgctgtctactcgaccccgttttctctttcgatcgatttcgttgtttcctgttgctctcttcttttcccgcgaataatatgctccatgggatctcactgttgtactttctgcatccgttggtagtcaggacgatccttcttcccgctgtcacgtgtgattcaaaatggatgtactaat

SEQ ID NO: 4194 - DNA, 574 bp, Saccharum officinarum
gtcgacccacgcgtccgcttgcttggctcctgtccaccaccctcgttagaacgtaagacagccgagcgagcgggcaggcgtggttcagcttcgggtcaaggggatggcgctgtctcgccgcatggccgctcccgtcctcgtccttgtgctcctcctcgtcgccacagagctggggacgacgacggtggcggaggcgaggtactgcctgtcgcagagccaccggttcaaaggcttgtgcatgagcagcagcaactgcgccaacgtgtgccagaccgagaacttccccggcggcgagtgcaaggcggacggcgccacgcgcaagtgcttctgcaagaagatatgctagcctccgtctgctggcggtggcgggacggcaggtcgtcggcttgttctcctgcgttgctgtttctgtttactaccgtttctctgctggatgcctgcgctattacgttgtagctagcgcgtcgctgtttcctgttgctttctttctgttcccgcgaataaactccgggccatgcatgcatgtcccggcatatgatgcctgcgcgtgcggaatgacatctacatcaattct

SEQ ID NO: 4195 - DNA, 692 bp, Echinochloa colona
tccagcctcctgcctcaccacctccaccttcctgtcccattccatcccatcccttgcctcctgcgcccatctaacaaagaaagccaagagccagtgtgggtgtggttcggcttctggtccagctcgtcgtcaccaagcagatggcactgtctcgccgcatggccgcgccggtcctcgtcttcctgctcctcctcgtcgccacagagatggggccgccggcggtggcggaggcgaggcactgcctgtcgcagagccaccacttcaagggcctgtgcgtgagcagcagcaactgcttcaacgtgtgccggaccgagaacttccccggcggcgagtgcaaggccgagggcgccacgcgcaagtgcttctgcaagaagatctgctagcctatcgatccgtccgccggcttgcaagccgatcgagcattggccctccatccctgccgtctgtccgtgtactcgatctccttctgttgttcgtcggttcttcacgcacgctgcgcggcggctatacatacatgctgctgcgggttgttttgtttcctcttgatctattctgttttcttggaataataaactcggggctgctggtgctgccgagattgtatgatgcctgtgcgtgtagaacattagtagggtgaagatgatgtaaaagcccctcctttcagaatcgatgtaatgcagtttcgtgccaaa

SEQ ID NO: 4196 - DNA, 630 bp, Echinochloa colona
ggttcggcttctggtcaagctcgtcgtcacccagcagatggcactgtctcgccgcatggccgcgccggtcctcgtcttcctgctcctcctcgtcgccacagagatggggccgccggcggtggcggaggcgaggcactgcctgtcgcagagccaccacttcaagggcctgtgcgtgagcaccagcaactgcgccaacgtgtgccggaccgagaacttccccggcggcgagtgcaagaccgagggcgccacgcgcaagtgcttctgcaagaagatctgctagcctatccgtgcattggccctccattatccctgccgtctgttcgtgtactcgatctcgttctgttgttcgtcggttcttcacgcacgctgcgcggcggctataaatgctgctgcggggtgttttgtttcctcttttgctctgttctgttttcttggaataaactcggtgctgctggtgctgccgagatatatgatgcctgtgcgtgtggaacatttcagtattgttctgcatccaatgcgtccgtaggtactctccgacccgaccactagtagagggacagggtaaagatgatgtaaaaggccctcctttcagaatttatgtaatgcagtttcgtgccaaatcagcttaat

SEQ ID NO: 4197 - DNA, 1264 bp, Panicum virgatum
taaaggcattctcaacgcgtcgagaaagtggcttagcttgcagttgggtcctgttctaggccgtgctaatcagctctcaccttaagcatcagctaaaacctctagctcgatgcggacgctctatataaaccctccctctctgctcccatccatcccattcccatcccttgctacctgcatccatcgaccttagcgagctcacagttcaatcaggtccggttcggcttcaggccgggctcgtcaccgaggagatggcgctctctcgccgcatggccgcgccggttctcgtcttcctgctcctcctcgtcgccacagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggccgcaatgcgagccgagcactggtcttggttctgttcgtcggttcttcgtcatgcacgctgcgccgtgatgctgcagcgggctgtgttcctgtcgtctcttgttctctttacctggaataaattaaactcggtgctggtgtctggtgatgcctgtgcgtgtggaacatctcactgttgttctgcacccatatgcactccattattagtgtagtaggcaagatgatgtaaggtcctcctttcaacattgatgtaataatgtgatgcagcttcgtgctagttcagcttaattaagtgcgaggttttctttaatcgttacttgtttggttggttgaccgacaagccagcagaagcacttctgaataaattatgaggcagacaaaatagacaaacgctaactagtctcttccaattcgagaaaattacacacccaatttattagcagctgttaaatttagtgttaggtcatgtttgtcagttctaagttaagcatttgactattctaagttccaataatgcagagctatatatatacatacatatatatatatatatacatatatatatacatacatatatatatacatacatatatatacacacacacatatatacacacacatatatatacacacatatatatacacacacacatatatatacatatacatacatatatatacatatacatatatgcatatatgtatatatatatatatatatatagagtgaggaatgttgagtactctatcctg

SEQ ID NO: 4198 - DNA, 526 bp, Echinochloa colona
aacctttagctcgacgcctacgctctatataaacccttcctctgctctccccatccatccatcccttgcctctcctgcgcccatctaacaaagaaagccaagagctagtgtgggtatagtgtggttcggcttctggccaagctcgtcgtcaccagcagatggcactgtctcgccgcatggccgcgtcggtcctcgtcttcatgctcctcctcgtcgccacagagatggggccggtgacggtggcggaggcgaggcactgcctgtcgcagagccaccacttcaagggcctgtgcgtgagcaccagcaactgcgccaacgtgtgccggaccgagaacttccccggcggcgagtgcaagaccgagggcgccacgcgcaagtgcttctgcaagaagatctgctagactatccgtccgccggcatgctgcaagccgatcgagcattggccctccatccctgcctgccgtgtgtcccgtgtactcgatcgatctcgttctgttgttcgtcggttcttcacgcacgctgcgcg

SEQ ID NO: 4199 - DNA, 1242 bp, Panicum virgatum
accctgcatgcaatgcagtgcagagcatgagcatcgcatcagctagagcccagcgtgtgaatccagcccgtgagaggctacggcgctccaccgcgctgtagcacatggaaacatcgcgcccccgtgtcctgttcctgcacagcctctgatcaccagtgacggcattctcaacgcgtcgagaaactagctaagctttgcagtgggatcctgttctaggccgtgctaataatcagctcgcgcgttaaacctctggctcggagcggacgctccatataaaccctccctctctgctcccagcctcccatccatctcatcccttgctacctgcatctatcgaccttgcgagctcacagttcaatcaggtccggttcagcttcaggccgagctcgtcgtcaccgaggagatggcgctctctcaccgcatggccgcgcccgtcctcgtcttcctgctgctcctcgtcgccacagagatggggccggcgacggtggcggaggcgaggcactgcctgtcgcagagccaccacttcaagggcctgtgcgtgagcagcagcaactgcgccaacgtctgcaagaccgagaacttccccggcggcgagtgcaagacggagggcgccacccgcaagtgcttctgcaagaggatctgctagccgccgccgcccccgccccggcactgcactggtcctcccgccgttgttcgtgtgttcttccttctgttcgtcggttcctcatgcgcgcacgctgcgccgtgaacgctgtagcgggctgtgttcctctcgatcgtcttgttctcttttcctggaataaatttgaactcggtggcggtgctggtgatgccgaggtgtgcgatgcctgtgcgtgtggatcatctcgctgttgttctgcatccgtatgcactccattattagtgtactcgtagtcgtaggcaaggtgatgtaaggtcctcctttcaacattgatgtaataatgcaatgcagtttcgtgctagacagcttaattaagtgccaggttttctttaatcgtctttatgtcgatttccttttcactcaacaactgaaccaacatggcactacccagcctcttccaattggagaaaattatacacccaacttattagcagctgttaattatagtgttaggtcatgtttgtcaattctaaattaagcatttcactattctaagatccaaggcagagctatttatatcatataaatatcctaaacatgttcagttccagtatatccat

SEQ ID NO: 4200 - DNA, 2740 bp, Setaria italica
aaacccaacccccaaaagccagatgcactagcaatgccatcaacaacaggttttcatctgaaacaaagcctggatttttaccgcataacacacttccaaatccagttctaacctagttgacagcacaagggagatgcctagactttgtcgtaaagaaacaattcggcaagtagccgccgaaggctcctactcctgtggtggttacaccagcaaataactccaagctgcaaacagtaggaagggggagagattgatcaaaaaagcttgttcgtattggtagtccaccggtgaagcgtctttgaggaatctcagtttggttgaacaaggcgagctgtaagtgaatggttttggtcttctgctgaaacttgattcatcagtcaatatccaagttggttctgcatacacatatctcttggagtaatcttgatcagtgagtagccaaaactgtatgatggctacttattactcaagcccaggtagtgaaagggactcacagaacatgtactcaagagacccgggcaatgcatcctatcctatgccatcagctctagggaacttgctttatctgaacaattctacttccggaccatacacggaattcagtggcattctgcatcctcagcagaattgcatggagatgcctgaccctggccatccttcagtgatgtcccaagactcatctgcaagggagtccgacatgcttggttcccaccaggggcagcgctcttttggtccagtcaaagatatgaaaaatgagatgttgatgcatatgatggatggatcacaaagcagcacagctgatctcatccatgatgatgcccacaatggtgcacagcttgattttggtgttctgaacaaccacagctcatcgaacattccctcagtgcaaggccaaggtttatctctgagcctcaacacacaaatcctggcaccttccttaccatactggtctgtcaaaccagacatgttgtcgccgcactcttaccatgacagtcttcgagttgatgacatgcgaatgaagagtatgcagtctgaggcgtcacgtgcaatccggaactccaggtatctgaaagcagcacaagaactgcttgatgaggttgtgaacgtttggaagaatattaagcagaaagctcagaaagaacaagtcgaagctggaaaaacagatggcaaagagaccgagggaggggcaaaaagtgagggctctaatccgcaggagtctgctgccaatgcagcacctgagctttctactgctgagaagcaagagcttcagaacaagatggcgaagctgatggctatgttggatgaggtggaccggaagtacaagcactactaccaccaaatgcaaagtgtggtttcatcttttgatgtggtagctgggcctggagctgccaagccttacactgcagttgccctccagacaatctcacgacacttccggtgcctgaaggatgctatcaatgatcagatcaatgtcatcaggaagaagcttggtgaggaggaaaattcatctggaaaggagggcaaattaactcgtctacggtacattgatcagcagctaaggcaacaacgagctttccaacagtatggcatgattccacaaaatgcttggaggccacagagagggcttcctgaaaactctgtaaccattcttcgtgcttggctctttgagcatttccttcacccgtaccctaaagactctgaaaaaatgatgctagcaaggcaaacaggcttgacaaggagtcagatttcaaattggttcatcaatgcccgtgtccgtctttggaaaccgatgattgaggacatgtacaaagacgagattggagatatcgagcaagactccaactcttcctctgacaatgcgccaagaagcaagggcaaaatggcatcttctgaagacaaggaggacctgaaaagctctacacctcgagtttgtgagagcagccagctgagcgagtcgagagccagcatagggactatgaacattggcggagcacctgttggattccagaacgagcccaaccctgacgacagcttcatgaacctgatgctgaaagaccaacgatcgaacgaagcagatggtggcctcctcctacacaacgccgtcgcacatcatcaagatgagaacgcccggttcatggcctaccacctggcagagcttgggagatatggaaacggcaacgtatcgctgacactgggcttgcagcactccagcagcagcctctcagttcctaatgcccagcagagctttcctggtgtcggagacgatgacatctacaacgctaccgctcctctcggtgtgagcgtcgcgtcttcagactatgaatcaatgaaccagatggatcaacggcaacggttcgagcaatcacctcttctgcatgattttgtggcctgaatgccatacctctgaacatttgtaacacctggcttggctgggtgaataacatatatgcctaaaaggagcattgggtcgtagcctgtagtttcaattcgacacagattggaggtatagcaggaaatgtaatatagtgtaggtggtgggggtgatagggtaaaaaaggatcttgtaaagatgaaacacactatactatacgtgtaaaagcttgtgatttaagcagcatattgtaaagtaatggttacttagggtccaggaattggtatatgattacctgctgctgctgctgttattctttgttttactcattattatcaagcactatattagaatatttggatgggagtt

SEQ ID NO: 4201 - DNA, 2719 bp, Setaria italica
gccagatgcactagcaatgccatcaacaacaggttttcatctgaaacaaagcctggatttttaccgcataacacacttccaaatccagttctaacctagttgacagcacaagggagatgcctagactttgtcgtaaagaaacaattcggcaagtagccgccgaaggctcctactcctgtggtggttacaccagcaaataactccaagctgcaaacagtaggaagggggagagattgatcaaaaaagcttgttcgtattggtagtccaccggtgaagcgtctttgaggaatctcagtttggttgaacaaggcgagctgtaagtgaatggttttggtcttctgctgaaacttgattcatcagtcaatatccaagttggttctgcatacacatatctcttggagtaatcttgatcagtgagtagccaaaactgtatgatggctacttattactcaagcccaggtagtgaaagggactcacagaacatgtactcaagagacccgggcaatgcatcctatcctatgccatcagctctagggaacttgctttatctgaacaattctacttccggaccatacacggaattcagtggcattctgcatcctcagcagaattgcatggagatgcctgaccctggccatccttcagtgatgtcccaagactcatctgcaagggagtccgacatgcttggttcccaccaggggcagcgctcttttggtccagtcaaagatatgaaaaatgagatgttgatgcatatgatggatggatcacaaagcagcacagctgatctcatccatgatgatgcccacaatggtgcacagcttgattttggtgttctgaacaaccacagctcatcgaacattccctcagtgcaaggccaaggtttatctctgagcctcaacacacaaatcctggcaccttccttaccatactggtctgtcaaaccagacatgttgtcgccgcactcttaccatgacagtcttcgagttgatgacatgcgaatgaagagtatgcagtctgaggcgtcacgtgcaatccggaactccaggtatctgaaagcagcacaagaactgcttgatgaggttgtgaacgtttggaagaatattaagcagaaagctcagaaagaacaagtcgaagctggaaaaacagatggcaaagagaccgagggaggggcaaaaagtgagggctctaatccgcaggagtctgctgccaatgcagcacctgagctttctactgctgagaagcaagagcttcagaacaagatggcgaagctgatggctatgttggatgaggtggaccggaagtacaagcactactaccaccaaatgcaaagtgtggtttcatcttttgatgtggtagctgggcctggagctgccaagccttacactgcagttgccctccagacaatctcacgacacttccggtgcctgaaggatgctatcaatgatcagatcaatgtcatcaggaagaagcttggtgaggaggaaaattcatctggaaaggagggcaaattaactcgtctacggtacattgatcagcagctaaggcaacaacgagctttccaacagtatggcatgattccacaaaatgcttggaggccacagagagggcttcctgaaaactctgtaaccattcttcgtgcttggctctttgagcatttccttcacccgtaccctaaagactctgaaaaaatgatgctagcaaggcaaacaggcttgacaaggagtcagatttcaaattggttcatcaatgcccgtgtccgtctttggaaaccgatgattgaggacatgtacaaagacgagattggagatatcgagcaagactccaactcttcctctgacaatgcgccaagaagcaagggcaaaatggcatcttctgaagacaaggaggacctgaaaagctctacacctcgagtttgtgagagcagccagctgagcgagtcgagagccagcatagggactatgaacattggcggagcacctgttggattccagaacgagcccaaccctgacgacagcttcatgaacctgatgctgaaagaccaacgatcgaacgaagcagatggtggcctcctcctacacaacgccgtcgcacatcatcaagatgagaacgcccggttcatggcctaccacctggcagagcttgggagatatggaaacggcaacgtatcgctgacactgggcttgcagcactccagcagcagcctctcagttcctaatgcccagcagagctttcctggtgtcggagacgatgacatctacaacgctaccgctcctctcggtgtgagcgtcgcgtcttcagactatgaatcaatgaaccagatggatcaacggcaacggttcgagcaatcacctcttctgcatgattttgtggcctgaatgccatacctctgaacatttgtaacacctggcttggctgggtgaataacatatatgcctaaaaggagcattgggtcgtagcctgtagtttcaattcgacacagattggaggtatagcaggaaatgtaatatagtgtaggtggtgggggtgatagggtaaaaaaggatcttgtaaagatgaaacacactatactatacgtgtaaaagcttgtgatttaagcagcatattgtaaagtaatggttacttagggtccaggaattggtatatgattacctgctgctgctgctgttattctttgttttactcattattatcaagcactatattagaatatttggatggg

SEQ ID NO: 4202 - DNA, 3186 bp, Oryza sativa
gtggtggttacaccagcaaataactccaagcagcagcatcagcagcagcagcaacagttgagaggaggaggaggaggaggttagctagctcgtcagtataatccttctcgacagcaactaataaaggaacaagcaaaactatttctttaggaggcaaacattattccatatttggtgctgctgttagtgggtggtctgagctttttttatttaggcaacaaggagcaagctagcacaactgctgcttgctagagagaggagagaagaaggaggagaagaagaggagagagaggagctctgagctctgtgctctctcttgctgctgctgctggctgctgctcacttttccttttgggattgttacttattttaatcctgggatctgattttgtccccatattgggaggatcgattatctttctcccctcctctcctctcctctcatcccctctcccctatctatctatcttgaagaagatcagctggctgctttggtgtcaatcgctgctgcagttcctgttgcctttgccctgcgccccatcaggagcacaccctcagattttgattggtagctgtgttcgtagcaataacagcctggcagagaatctttgagaagttgcagtctattagttcaacaagggaagttgaacgggatcaagtttagtctggataacaaaatattgatgtcctgctggaatcatcaatcaagtcaacgtcaaagctggttcttcatatacatatatgcttttgcagtaatctcgagcaataagtagttataattgcgagatggctacttactattcaagccctggtagcgaaagagactcgcagaccatgtactcaagagacccaggcagtgcatcctatcctatgtcatcagctctagggaacttgctctatctgaacaatccatcttctggaccttatacggagttcagcggcattctgcagcctcagcagaattgcatggagatgcctggccctgggcatgcgtcagcaatgtcacaagacccctcttcaagggagtccgacatgcttgcttcgcaccagggtcaacgctctttcagccatgtcaaagatatgaaaaatgagatgttgatgcatatgatggatggagcacagggtagtggctctgagctcatccatgatgatgcccacactggttcacagcttgagtttggtgttctgaataatcacaactcatcaagtgttccatcaatgcaaagccaagggctatctctgagcttgaacacacaaatcatggcgccttccttaccgtactggtctataaagccagacatgttaacgccgcagtcttaccatgacaaccttagaggggaagacatgcggatgaagaatttgcagtccgaagcttcacgcgcaatccggaactcaaggtatctcaaggcagcacaagaactgcttgatgaggtcgtgagtgtttggaagagcataaaacaaaaggctcagaaagagaaggttgaatcaggaaaagcagatggcaaagagactgatggagggccaaaaagtgagggtgtatcttctaatccacaagaatctggcgctaatgcagcacctgagctttccactgctgagaagcaagagcttcagaacaaaatggcaaaactgatggcaatgttggatgaggtggaccggaaatacaagcattattaccaccaaatgcaaaccgtggtttcatcgtttgatgtggtagctggaccaggatctgcgaagccttacacagcagttgctcttcagacaatctcacggcactttcggtgcctgaaggatgctatcaatgatcagatcaatgttatcaggaaaaagcttggcgaggaagagaactcatctggcaaggagggaaaattaacccgcctccggtacattgatcagcagctaaggcaacaacgtgctttccaacagtacggtatgattccacaaaacgcctggagaccacagaggggactgcctgaaaactctgttacaattcttcgcgcttggctgtttgaacacttcctccatccgtacccaaaagattccgagaagttaatgcttgctaggcagactggcctgactaggagtcagatttcgaattggttcataaatgcccgtgtccgcctttggaaaccaatgattgaagacatgtacaaagaagagattggtgatttagagcaagactccaactcttcctctgacaatgcaccaagaagtaaggataaaatggcatcttcagaagacaaggaggatctcaaaaactccagggcacggatttgcgaaacaagccaattgagcgagtcgagaaccagcattggagcaatgaatgttggtggagcgcctgttggcttccagaatgagcccaatcctgatgacagtttcatgaacctgatgctgaaggaccagcgatcgaacgaagtggatggcggcctccttctccacaacactgtcgcgcagcactcagacgagaacgcccggttcatggcctatcacttggcagagcttgggagatacggcaatggcaatgtgtcgctgacactgggcttgcagcactccagcagcaacctcgttcctaatgctcagccaggtttccctggtgttaatgaggatgacatctacaatgctactgctcctcttggtgtcaccgtcgcatcttcggactatgattcgatgaatcagatggatcaacggcaacggtttgagcattcacctcttctgcatgattttgtggcctgaagacagcagagaaataatcaggaccatggacattaagagagagaattggggggcagcatttgtaacacctagtgggagaataacatgcctgaaagggcatgggatttgtagctttgtagttgccatttaatacagaagaggaggtatagcaggaaatgtaatataaggttagatggtgggggtgatagggtaaagaatcatatgtaaagataaaatccatcattactatatatatatacgtgtaaaagcttgtgatttgagcaccatattgtaaagtaatggttacttagggctgtccaattatacactctcacactactattagagcttttctgtcattcttttacacgtgtaagtggagctgaaaacttgctgtgtccagcaagttatgcagatttgcgttaagttctgttgtttttgttgtggagcactacagctcagctgggtgaaaataaa

SEQ ID NO: 4203 - DNA, 2731 bp, Brachypodium distachyon
gcacagaagagaggtctgaactctaaactctctctccatagcttgccccctttttctttttgagcttgttattttaatcttgggatctgattttgtccccatattgggaggatcgattatctttctccccacctcccccctctcctcctctctctccatagcctggaggagatcagctttggatgcaaatcttcccttccctgccctgccccccatgaggagcacaccctcagattgactagcaagctgggttcgcgttgataacgtgctagtgaagcgtctttgaggagtcttatattggttcaacgaggttgtaagaggaagattttaatctggtctgtcttgatcttcagctgaaacttgatcccaaaagaaactcgatcgagtcaacatcatagctttgttctgcatatgatctatgctttggagtaaaatcttgatcagtaagtaatcagaggagtgagatggctacttactactcaagccctggtagtgaaagagagtcccaagacatgtactcgagagaccagggcagcgcttcctatccgatgtcatcggctctaggcaatttgctttatctgaacaatccgtcttctggaccatacacggagttcagcggcattctgcagtctcagcagaattgcatggagatgcctggccatggccatcattcagcaatgtcccaagactcgtccgtgagagagtctgacatgcttgcttcccaccatgggcaacgctccttcggccatgtgaaagacatgaagaatgagatgttgatgcatatcatggatggaggacaaagtggtggtgctgaactcatccacgatgactcccacaatggtgctcagtttgaatttggtgttctgaacaaccatggctcatcaaatgtcccatcagggcaaggccaaggccaagggctatctctgagcctcaacacacaaatcatggcaccttccttgccttactggtctatcaaaccagacatgttgactcccaactcttaccacgaaagccttagagtcgacgacatccggatgaaaactatgcagtctgaagcctcccgtgcgatccggcactcaaggtatctgaaggcagcacaagaagtgctagatgaggttgtcaacgtctggaagaatataaaacagaaagctcagaaggagcaggctgaaccagaaaaggcagatggcaaagagactgatggaggaccaaaaagtgagggcgtatcttctaacccacaagaatctggcgccaatgcagcaccagagctgtccacagctgagaagcaagagcttcagaacaagatggcaaagctgatggcaatgttggatgaggtggaccggaaatacaagcattactaccaccaaatgcaaaatgtggtttcatcttttgatgtggtggctgggcccggatctgccaagccttacaccgcagttgctcttcagacaatctcgcggcatttccgatgcttgaaggatgctatcaatgagcagatcaatgttatcaggaagaagcttggcgaggaagaaaattcatctggcaaggaaggaaaattaactcgtctccggtacatcgatcagcagctaaggcaacagcgagctttccaacagtacggtatgattccgcaaaatgcttggagaccacagaggggactacccgaaaactcagttacagttcttcgcgcttggctttttgaacacttccttcacccctacccaaaagattctgaaaagttaatgctagcaaggcagactggcttgacaaggagtcagatttcgaattggttcataaatgcccgtgtccgcctttggaaaccaatgattgaggacatgtacaaagaggagactggtgatttggagcaagactccaactcttcctccgacaatgtgccaagaagcaagaacaaagtggcatgttctgaagaaaacgaagatctgaagaatgctagggctcgggtgtgcgaaaccagccagctaagcgagtcgagagccagcattggggctatgaatgctggtggtgcacctgttggattccagcatgaggccaaccctgacgacagtttcatgaacctgatgatgaaggaccagcgatcgggtgaagcagatgggggacttctcctccacaacgccatggcacagcactcggacgagagcgccaggttcatggcctaccacttggcagagcttgggaggtatgggaatggtaatgtatcgctcacactgggtttgcagcactctggtagcagcctctcagttccgaatgctcaggcaaactttcccggcgtcaccgatgatgacatgtacaacacagctgctcctctcggcgtcagcatcgcatcttcggactacgagtccatgaaccagatggatcaacggcaacggttcgagcaatcaccacttctgcatgattttgtggcatgatgatgatacatcatgattgtttacacaagatttgtgggggatgacagcatttgtaaaactcctagtggcagaaaaaaaataacatgcctgaaagagcatggactgttgtagcttgtagttgccatttgatacaggagagggggtatagcaggaaatgtaatataagcttaggtggttgggggtgataggggtaaagaatcttttgtaaagataaaaatgcaattactatacctgtaaaagcttgtgatttgagcacagtattgtaaagtaatggcaactttaggaatgccctagtaatagtaataccttgctac

SEQ ID NO: 4204 - DNA, 2989 bp, Brachypodium distachyon
gaaaaacttgtggtggttgcaccagcaaatagctccaagcggcagcagcagcagcagttgggaggagactagagaaggttagttaaaaggaattaggaagagtattatcctgctcagtccataccaactaataaatcagggaaaatcaattttcttttggaggcgcacacattattccttatttggtgctgttgttagtgggtggtccgagagctttttttatttaggcagcaagaaggaggagcacagctgcacagaagagaggtctgaactctaaactctctctccatagcttgccccctttttctttttgagcttgttattttaatcttgggatctgattttgtccccatattgggaggatcgattatctttctccccacctcccccctctcctcctctctctccatagcctggaggagatcagctttggatgcaaatcttcccttccctgccctgccccccatgaggagcacaccctcagattgactagcaagctgggttcgcgttgataacgtgctagtgaagcgtctttgaggagtcttatattggttcaacgaggttgtaagaggaagattttaatctggtctgtcttgatcttcagctgaaacttgatcccaaaagaaactcgatcgagtcaacatcatagctttgttctgcatatgatctatgctttggagtaaaatcttgatcagtaagtaatcagaggagtgagatggctacttactactcaagccctggtagtgaaagagagtcccaagacatgtactcgagagaccagggcagcgcttcctatccgatgtcatcggctctaggcaatttgctttatctgaacaatccgtcttctggaccatacacggagttcagcggcattctgcagtctcagcagaattgcatggagatgcctggccatggccatcattcagcaatgtcccaagactcgtccgtgagagagtctgacatgcttgcttcccaccatgggcaacgctccttcggccatgtgaaagacatgaagaatgagatgttgatgcatatcatggatggaggacaaagtggtggtgctgaactcatccacgatgactcccacaatggtgctcagtttgaatttggtgttctgaacaaccatggctcatcaaatgtcccatcagggcaaggccaaggccaagggctatctctgagcctcaacacacaaatcatggcaccttccttgccttactggtctatcaaaccagacatgttgactcccaactcttaccacgaaagccttagagtcgacgacatccggatgaaaactatgcagtctgaagcctcccgtgcgatccggcactcaaggtatctgaaggcagcacaagaagtgctagatgaggttgtcaacgtctggaagaatataaaacagaaagctcagaaggagcaggctgaaccagaaaaggcagatggcaaagagactgatggaggaccaaaaagtgagggcgtatcttctaacccacaagaatctggcgccaatgcagcaccagagctgtccacagctgagaagcaagagcttcagaacaagatggcaaagctgatggcaatgttggatgaggtggaccggaaatacaagcattactaccaccaaatgcaaaatgtggtttcatcttttgatgtggtggctgggcccggatctgccaagccttacaccgcagttgctcttcagacaatctcgcggcatttccgatgcttgaaggatgctatcaatgagcagatcaatgttatcaggaagaagcttggcgaggaagaaaattcatctggcaaggaaggaaaattaactcgtctccggtacatcgatcagcagctaaggcaacagcgagctttccaacagtacggtatgattccgcaaaatgcttggagaccacagaggggactacccgaaaactcagttacagttcttcgcgcttggctttttgaacacttccttcacccctacccaaaagattctgaaaagttaatgctagcaaggcagactggcttgacaaggagtcagatttcgaattggttcataaatgcccgtgtccgcctttggaaaccaatgattgaggacatgtacaaagaggagactggtgatttggagcaagactccaactcttcctccgacaatgtgccaagaagcaagaacaaagtggcatgttctgaagaaaacgaagatctgaagaatgctagggctcgggtgtgcgaaaccagccagctaagcgagtcgagagccagcattggggctatgaatgctggtggtgcacctgttggattccagcatgaggccaaccctgacgacagtttcatgaacctgatgatgaaggaccagcgatcgggtgaagcagatgggggacttctcctccacaacgccatggcacagcactcggacgagagcgccaggttcatggcctaccacttggcagagcttgggaggtatgggaatggtaatgtatcgctcacactgggtttgcagcactctggtagcagcctctcagttccgaatgctcaggcaaactttcccggcgtcaccgatgatgacatgtacaacacagctgctcctctcggcgtcagcatcgcatcttcggactacgagtccatgaaccagatggatcaacggcaacggttcgagcaatcaccacttctgcatgattttgtggcatgatgatgatacatcatgattgtttacacaagatttgtgggggatgacagcatttgtaaaactcctagtggcagaaaaaaaataacatgcctgaaagagcatggactgttgtagcttgtagttgccatttgatacaggagagggggtatagcaggaaatgtaatataagcttaggtggttgggggtgataggggtaaagaatcttttgtaaagataaaaatgcaattactatacctgtaaaagcttgtgatttgagcacagtattgtaaagtaatggcaactttaggaatgccctagtaatagtaataccttgctacatgatga

SEQ ID NO: 4205 - DNA, 2702 bp, Triticum aestivum
tgctgcgacccacgcgtgccggtaaacggagcgagagagagagggagagagagaaagggaggagctttttctccctttgagctctggttttttgggtattttaatcctgggatctgattttgtccctctccctctctccctctatcttactctctccatagactggtggaggaggaggagatcagctttggatgcaatcttcttcttcttcttgtgcctgccccccacgaggagcacaccctcgcccccagattgatcaggaagccacagtcacatcggtaacgcggtagcggagcgtcttcgaggggtttcatgttggtttaacaaggaggttggattgatcttctactgaaacttgctactggttgttaataatatctatgcttcacggtgatcttggtcagtaaaagagagatggctacttactactcgagccctggcagcgaaagagagtcgcaagacatgtactcaagagacccgggcggtgcatcctatccgatgtcgtctgctctgggcaacttgctctatctcaacaatccatcttctgggccatacactgagttcagcggcattctgcagactcagcagaatttcatggagatgcctggccatggccatcattctgcaatgtcccaggactcatcggcaagggagtcgcaggacatgcttgcttcccaccatgggcaacgctcgtttggtcatgtgaaagatatgaagaatgagatgttgatgcatatgatggatggggcacagagtggtggtgctgaactcatccacgatgatccccacaatggtgcacagttcgagtttggtgtcctgaacaaccatgactcgtcggatgttccggtagggcaaggccaaggccaaggccaagggctgtctctgagcctcaacacacaaatcctcgcgccgtccttgccatactggtctatcaaaccagacatgttgacgccaaactcttaccaggaaagccttagaatagacgacatccggatgaagaacatgcagtctgaggcctctcgtgcgatccggcactcgaggtatctcaaggcagctcaagaagtgctagatgaagttgtgaatgtttggaagaacatcaaacagaaagctcagaaagagcaagctgaacctggtaaagcagatggcaaagagaccgatggagggccaaaaagcgagggcgcatcgcaagaatccggcgcaaatgcagcacctgagctgtccactgctgagaagcaagagcttcagaacaagatggccaaactgatggcaatgttggatgaggtggaccggaaatacaagcactattaccaccaaatgcaaaatgtggttgcatcttttgacatggtggctgggcccggatctgccaagccttacaccgcagttgctctgcagacaatctcacgacatttccggtgcttgaaggacgctatcaatgatcagatcaatgttatcaggaagaagctcggcgaggaagaaaattcgtctagcaaggaaggcaaattgacccgtcttcggtacattgatcagcagctaaggcaacagcgtgctttccaacagtacggtatgattcctcagaatgcctggagaccgcagaggggactgcctgaaaactcggttacagttcttcgtgcttggctcttcgaacacttccttcacccgtatccaaaagattctgaaaagttaatgcttgcaaggcagactggcttgacaaggagtcagatttcgaattggttcataaacgctcgtgtccgcctttggaaaccaatgattgaagacatgtacaaagaagagaccggtgatctggagcaagactccaactcttcctctgacaatgtgtcgagaagcaagaacaaagtggcatcttcagaagagaatgaagatctgaagaacgccagggctcgggtttgcgagaccagccagctaagcgagtcgagagccagcatgggaactatgaatgttggcggggcacctgttagcttccagaacgaggccaaccctgatgacagtttcatgaacctgatgatgaaggatcagcgatccggtgaggcggatggaggcctcctcctccacaacgccgtcgcgcagcactcggacgagaacgcgcggttcatggcttaccacttggcagaacttgggaggtacggaaacggcaacgtatcgctaacgctgggcctacagcattctggcagcggtctctcggttccgaatgcccaagcaaactttcccggtgtcagtgacgatgacatctacaatgccggtgctcctctcggtgttagcattgcatcttcggactacgaatctttgaaccagatggatcagcggcaacgcttcgagcaatcgcctcttttgcatgattttgtggcctgaatcatgatggtacatcagatcaggaccattgacacaaagattgggtggggggtgacagcatttgtaaaagaaactcctagtggcagaataataacatgcctgcaagagcatggggttgtagctttgtagttgccatttgatacaggagagggggtatagcaggaaatgtaatataaagcgtaggtggtgggggtgatagggggtaaagatggaaaatcttttgtaaagataaaatgcaatttactatacgtgtaaaagcttgtgctcagtattgtaaagtaatggccacttcagggtgatagtatacattgctaaatgatggctattcttcttct

SEQ ID NO: 4206 - DNA, 2603 bp, Triticum aestivum
tcagctttggatgcaatcttcttcttcttctgcctgccccccacgaggagcacaccctcgcccccagattgatcaggaagccacggtcgcatcggtaacgcgctagcggagcgtcttcgaggggtttcatgttggtttaacaaggaggttggatccccgcaaaataaataaattgcaggaggttggattgatcttctactgaaacttgctactggttgttaataatatctatgcttcacggtgatcttggtcagtaaaagagagatggctacttactactcgagccctggcagcgaaagagagtcgcaagacatgtactcgagagacccgggcggtgcatcctatccgatgtcgtctgctctgggcaacttgctctatctgaacaatccgtcttctgggccatacactgagttcagtggcattctgcagactcagcagaatttcatggagatgcctggccatggccatcattctgcaatgtcccaggactcatcggcaagggagtcgcaggacatgcttgcttcccaccatgggcagcgctcgttcggtcatgtgaaagatatgaagaatgagatgttgatgcatatgatggatggagcacagagtggtggtgctgaactcatccatgatgatccccacaatggtgcacagttcgagtttggtgtcctgaacaaccatgactcgtcggatgttccggtaggtcaaggtcaagggcaaggccaagggctgtctctgagcctcaacacacaaatcctcgcgccgtccttgccatactggtctatcaaaccagacatgttgacgccaaactcgtaccaggaaagccttagaatagacgacatccggatgaagaacatgcagtctgaggcctctcgtgcgatccggcactcaaggtatctcaaggcagctcaagaagtgctagatgaagttgtgaatgtttggaagaacatcaaacagaaagctcagaaagagcaagctgaacctggtaaagcagatggcaaagagaccgatggagggccaaaaagcgagggcgcatcgcaagaatccggcgcaaatgcagcacctgagctgtccactgctgagaagcaagagcttcagaacaagatggccaaactgatggcaatgttggatgaggtggaccggaaatacaagcactattaccaccaaatgcaaaatgtggttgcatcttttgacatggtggctgggcccggatctgccaagccttacaccgcagttgctctgcagacaatctcacgacatttccggtgcttgaaggacgctatcaatgatcagatcaatgttatcaggaagaagctcggcgaggaagaaaattcgtctagcaaggaaggcaaattgacccgtcttcggtacattgatcagcagttaaggcagcagcgtgctttccaacagtacggtatgattcctcagaatgcctggagaccgcagaggggactgcctgaaaactcggttacagttcttcgtgcttggctcttcgaacacttccttcacccgtatccaaaagattctgaaaagttaatgcttgcaaggcagactggcttgacaaggagtcagatttcgaattggttcataaacgctcgtgtccgcctttggaaaccaatgattgaagacatgtacaaagaagagaccggtgatctggagcaagactccaactcttcctctgacaatgtgtcgagaagcaagaacaaagtggcatcttcagaagagaatgaagatctgaagaacgccagggctcgggtttgcgagaccagccagctaagcgagtcgagagccagcatgggaactatgaatgttggcggggcacctgttagcttccagaacgaggccaaccctgatgacagtttcatgaacctgatgatgaaggatcagcgatccggtgaggcggatggaggcctcctcctccacaacgccgtcgcgcagcactcggacgagaacgcgcggttcatggcttaccacttggcagaacttgggaggtacggaaacggcaacgtatcgctaacgctgggcctacagcattctggcagcggtctctcggttccgaatgcccaagcaaactttcccggtgtcagtgacgatgacatctacaatgccggtgctcctctcggtgttagcattgcatcttcggactacgaatctttgaaccagatggatcagcggcaacgcttcgagcaatcgcctcttttgcatgattttgtggcctgaatcatgatggtacatcagatcaggaccattgacacaaagattggtggggggtgacagcatttgtaaaagaaactcctagtggcagaataataacatgcctgcaagagcatggggttgtagctttgtagttgccatttgatacaggagagggggtatagcaggaaatgtaatataaagcgtaggtggtgggggtgatagggggtaaagatggaaaatcttttgtaaagataaaatgcaatttactatacgtgtaaaagcttgtgctcagtattgtaaagtaatggccacttcagggtgatagtatacattgctaaatgatggctattcttcttcttttctaccctccatatcttgtgcccagtattgtaaagtatttgccgtttccg

SEQ ID NO: 4207 - DNA, 2554 bp, Triticum aestivum
ctctctcccctatcttactctctccatagactggtggaggaggaggagatcagctttggatgcaatcttcttcttcttcttgtgcctgccccccacgaggagcacaccctcgcccccagattgatcaggaagccacagtcacatcggtaacgcggtagcggagcatcttcgaggggtttcatgttggtttaacaaggaggttggattgatcttctactgaaacttgctactggttgttaataatatctatgcttcacggtgatcttggtcagtaaaagagagatggctacttactactcgagccctggcagcgaaagagagtcgcaagacatgtactcaagagacccgggtggtgcatcctatccgatgtcgtctgctctgggcaacttgctctatctcaacaatccatcttctgggccatacactgagttcagtggcattctgcagactcagcagaatttcatggagatgcctggccatggccatcattctgcaatgtcccaggactcatcggcaagggagtcgcaggacatgcttgcttcccaccatgggcagcgctcgttcggtcatgtgaaagatatgaagaatgagatgttgatgcatatgatggatggagcacagagtggtggtgctgaactcatccatgatgatccccacaatggtgcacagttcgagtttggtgtcctgaacaaccatgactcgtcggatgttccggtaggtcaaggtcaagggcaaggccaagggctgtctctgagcctcaacacacaaatcctcgcgccgtccttgccatactggtctatcaaaccagacatgttgacgccaaactcgtaccaggaaagccttagaatagacgacatccggatgaagaacatgcagtctgaggcctctcgtgcgatccggcactcaaggtatctcaaggcagctcaagaagtgctagatgaagttgtgaatgtttggaagaacatcaagcagaaagctcagaaagagcaagctgaaccaggtaaagcagatggcaaagagaccgatggagggccaaaaagtgagggcgcatcgcaagaatccggcgcaaatgcagcacctgagctgtccactgctgagaagcaagagcttcagaacaagatggccaaactgatggcaatgttggatgaggtggaccggaaatacaagcactattaccaccaaatgcaaaatgtggttgcatcttttgacatggtggctgggcccggatctgccaagccttacaccgcagttgctctgcagacaatctcgcgacatttccggtgcttgaaggacgctatcaatgatcagatcaatgttatcaggaagaagctcggcgaggaagaaaattcgtctagcaaggaaggcaaattgacccgtcttcggtacattgatcagcagctaaggcaacagcgtgctttccaacagtacggtatgattcctcagaatgcctggagaccacagaggggactacctgaaaactcggttacagttcttcgcgcttggctctttgaacacttccttcacccgtatccaaaagattctgaaaagttgatgcttgcaaggcagactggcttgacaaggagtcagatttcgaattggttcataaacgctcgtgtccgcctttggaaaccaatgattgaagacatgtacaaagaagagactggtgatctggagcaagactccaactcttcctccgacaatgtgtcgagaagcaagaacaaagtggcatcttcagaagagaatgaagatctgaagaacgccagggctcgggtttgcgaaaccagccagctaagcgattcgagagccagcatcggaactatgaatgttggcggggcacctgttagcttccagaacgaggccaaccctgatgacagtttcatgaacctgatgatgaaggatcagcgatccggtgaggcggatggaggcctcctcctccacaacgccgtcgcgcagcactcggacgagaacgcgcggttcatggcctaccacttggcagagcttgggaggtacgggaacggcaacgtatcactgacgctgggcctacagcactctggcagcggcctgtcggttccaaatgcccaagcaaacttccccggtgtcagtgacgatgacatctacaatgccggtgctcctctcggtgttagcattgcatcttcagactacgaatctttgaaccagatggatcagcggcaacgcttcgagcaatcgcctcttttgcatgattttgtggcctgaatgatgatgatacgtcagatcaggaccattgacacaaagattgggtggggggtgacagcatttgtaaaactcctagtggcagaataataacatgcctacaagagcatggggttgtagtttgtagttgccatttgatacaggagagggggtatagcaggaaatgtaatataaagcgtaggtggtgggggtgatagggggtaaagatggaaaatcttttgttgtaaagataaaatgcaatttactatacgtgtaaaagcttgttctcagtattgtaaagtaatggccacttcagggtgatagtatacattgctaaatgatg

SEQ ID NO: 4208 - DNA, 2395 bp, Avena sativa
gagatcagctttggatgcaaaatcttcttcctgctgcttgcccccacgaggagcacgcccgccctctcagattgattgatcaccaagttacatctcatctcgcatcgataacgcgctagttgaagcatctctgaggagtcttatactagtttaacaagggagttgttagtagaagattttaatctgatcaagactgaacttgcgctgaaacctgaccgagtttcgttgcaagaaagctggttctgcataccatctatgctcggcagcaatctcagtcggcgagtgatcagaacttgagatggctacttactactcgagccccggtaacgaaagagagtcgcacgacatgtactcgagagacccaggcagtggatcctacccgatgtcgtcggctctaggcaacttgctctatctgaacaacccgtctcctgggccatacacggagttcagcggcatcctgcagtctcagcagaactgcatggagatgcctggccatcatgggcaccattccggaatgtctcacgactcatcagtgagggagtccgacatgcttgcgcgctcgttcgggcatgtcaaggatatgaagaatgagatgctaatgcacatgatggatggagcacaacagagtggtactggtgctgaactgatccatgacgacgcgcacaacggcgggcagtttgagtttggtgttctgaacaaccatggctcaccgaatgttccgtcagggcaaggccaggggctgtctctgagcctcaacacgcagatcctggccccttccttgccttactggtccatcaagccagacatgttgacgccgagctcctaccacgacagtctcagagtcgacgacatccggatgaagaacatgcagtctgaagcctcgcgcgctatccggcactcgaggtatctgaaggcggcacaagaagtgctagatgaggttgtgaatgtttggaagaatataaaacagaaggctcagaaagagcaggctgaaccagggaaagcagatggcaaagagactgatggtgggccaaaaagcgaaggcccgcaagaatccggggcaaatgctgtacctgagctttccactgctgagaagcaagaacttcagaacaagatggccaaactgatggcaatgttggatgaggtggaccgcaaatacaagcactactaccaccaaatgcaaaatgtggtttcatcttttgacgtggtggctgggcccggatctgccaagccgtacaccgcggttgctcttcagacaatctcgcggcatttccggtgcttgaaggatgccatcaatgatcagatcaacgttatcaggaagaagctcggcgaggaagagaattcatctggcaaggaaggtaaattgacccgtctccggtacatcgatcagcagctgcggcagcagcgagctttccagcagtacggtatgatcccgcagaacgcttggagaccgcagaggggactgccagaaaactcggttacggttctccgcgcttggcttttcgaacacttccttcacccgtacccaaaagattcagaaaagctaatgttagcaaggcagactggattgacaaggagccagatttcgaattggttcatcaacgctcgtgtccggctttggaaaccgatgatcgaagacatgtacaaagaagagaccggtgatcttgagcaagactccaactcttcctccgacaacgtgccgagaagcaagaacaaagtggcaacttcagaagaaaacgaggatctgaagaacgccagggctcgggtctgcgaaaccagccagctaagcgactcgagggccagcatcggcgccatgaacgtcggcggggcgcctctcaggttccagaacgaggccaaccatgacgacagcttcatgaacctgatgatgaaggagcagcgatcaggcgaggcggacgggggcctcctcctccacaacgctgccgtcgcgcagcactcggacgagaacgcgcggttcatggcctaccacttggcagggtttggtggtaggtacgggaacggcaacgtgtcgctgacgctgggcttgcagcaccccggcagcggcctctcggttccgaacgcccaggcgaacttccccggtgtcggtgacgacgatgacatctacaccgccaccggtgtgcctctcggtgtcagcatagcatcttcggactatgaatctttgaaccagatggaccaacggcagcggttcgagcagtcgcctctgctgcatgattttgtggcctagatgatgatacatcaggaaaaggaccattgacacaagaattgtaaaactcctagtggcagaagaataacatgcctgaaagagcatgcatggggttgtagcttgtagacagttgccattggatacaggagaggtatagcaggggatgtaatataagca

SEQ ID NO: 4209 - DNA, 2463 bp, Zea mays
ctgagcaatccagcgatgggtgaggctgactagctgagcaggtcgggcggccggccctgaagagatgcccgtgccccggtcccggtctttccacttgcagctagctagcagcggcagcacctaccctaggtaccccacccggcccagtccatggcgcgcgggcggtcccctccgcctccgcggcaccacgccacacgccccgagaaccaatcacgtcgtccgcctgcctggctcctcacccccgcccggtcttttaagcccaccacgcccacttgcagcagcagcaccaccacgccaccccaccgtgttccccatatcgtccagttgccgtagttttacgcgagaacgcacgcgcgcatctgccaaaacaaacaaacccacgtcccggccaccgcgcgcgcgcgtgcctcgtcgtcgtcctagctagctagctcgatcgatcctccctcgctcagctgccgtcgacctctctctcgcggagagagagatagagagaggttggggtttgtcggcactcggcaatcgacatcatgaggcgcttcctgcctgctggaggcggcggcggcggcggggagccgtcgtcctcctcgtcgtcgggcgggcaccagcaccaccagcacggcgggctcgcatcgggcgagagggcggcggcgggcctgcggtaccgaggaggcgccgacatatcgctggggcacgggcacgacgatggtggacatggtcgtagcatcgacgcggcggacaggcggaacgacgggtccatggacatgctggcgcggcacagcagctcgccggtcggcttcttctccaacctcgtggtggacaacgggtatccacgctcaaataaagccggaggcggtggtggcgtcgaaggtcagcagcatgatccatcaacggccgccaatgccagtggcagcagtgcccggaagatgaagacgcccgagttcaacttcaccggtgcgcagcagggccagcagctgggcgcggccgcgggccacctctcgcggatctccgaggacggcgccttcccgggcggcatgatgggcgaccgcgcgggccgcggctctgctggcgagagcagcggtgccgccgcggcggcgcgctcgtactcggccggcgggttctccatcgttgggccgtgggaggagtccagggacatcattaccaccctcggcgcatacgaccctcagtttagcggcgccatggcgggtacggcgctagagatggcgggcatggacaggtacgtgcagctgcagcaggaccaggtgccgttcaaagtgcgcgccaagcgcgggtgcgccacgcaccccaggagcatcgccgagagggagaggaggacgaggatcagcgagaagctcaggaagctccaggacctcgtgcccaacatggacaagcaaacgagcaccgcggacatgttggaccttgcagttgagcacatcaggggcctgcagagcgagctgcaggctctgaaacacgaacaggagaagtgtacctgctgccgaaagcgatagcgattcacgacggccgggggatcggaccaagagagcagaaacacttacaacaacatgtcggagtacctactgctccaccttttccgaagaccgaagcaacgaagacccatgtgagcaactagctagccagtagccagtgcagtgcagtgctaaaatgggcggccctcctagtctgatccgatgatccttggatttcttctgttcctgcttgatgttcaactccaattttagatctcttttaggatctgaaaacagttttgctatttatttaaacaagctgcttaattttattttgatatttagtataattaatatttgttgactgacgtcagaagaagaggctccttttttttttcttttgtataaggtaaaagaaagggcttttaggcttttatacagatataaaggctttggtgatgtttttgtatatatttcttaaacttataattgtttcaataggcattataatagatctgtattatttcagaagagggtatttgcatatagactcagcacaatacttctttataagataggggaagttttgccgtgaaatttaataaactttttttttgaatgtgtcatgtgtttcattaaggatggctctaatgcacaggggttgtatctaataacgtcatatcactattgaccagccggtctgtatctaccactgtcaacatttatctaccagaacttttcagtgtgcagtctatactgtcagcctatagtcatatcaacgtcatgtcagcttttattttcagactcgatgcacaacgaaacatgggttttaattcaaatatcaaaaaacattaaaaacatatagctagttcaataaataatattgtataaatcaaacaaagttcattaaatctaaaaacaataaaaggacaacgttttcgttcagttcgatgatcatgattctattcaagaactagtttctattgtaccacttggt

SEQ ID NO: 4210 - DNA, 2423 bp, Zea mays
atcatatcacctcaccgccacacctcggcagggcaagtcgtttgccacccaggccaaccctctgccgccgctacgccaccgcacgtccatccctcgccgacacgtctcgcacgctgacgggccaacccactccaccccgagtccgggcataaaagcaagcaccctaacacacactctctacttccaccccggaccgacaaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacggggagcgccaacgacctctacgagtcggcgcagctctacctcagcgcgcgctgcctcgccaccgcgcccgccgtgcgcctgcacaagccgcgccagtcgccgcgccccgtggcgtcgctcccggactcgcacaccaccgacgacaccttccgcggggtccgcgtcaagtggacctccaccacgcgcaccgtcgaccgcagcggcagcggcggcggcggtaacccgtacaacatattcggccgcggcggcgaccagcgcggcctcgagctccagttcccgcgccagcaccgggacctcgtccaccaccactacatcccgcacctcatcgacgaggccacccggatgcggctcaagtcgcgggagcgccgcctctacaccaaccgcgccacggggccctgcgacgaccaccaccgcctctggacgtcgcacgccttcgcgcacccgtccacgttcgacacgctggcgctcgacccggcgctgcgcgacgaggtccgcgccgacctgctgcgcttcgccgcgcgccgggaccactacgcgcgcgtcggccgcgcctggaagcgggggtacctgctccacggcccgcccggcacgggcaagaccagcctcgtcgctgccatcgccaacctgctcgacttcgacgtctacgacctggagctcaccacggtgcccaccaactcccacctccgccgcctgctcgtctccaccacgcccaagtccgtcgtcgtcgtcgaggacatcgactgctccctcgacctctccgaccgcaacaagaagacaaagaagggtgctggcgtcggcgtcggcatcggcaccgccggcgacgaagacgccgcagcacagctcgccgtcatgtcggtgtcgccggtcgcggcggccgtgatggggcgcgagtccgtcagcctctccggggtgctcaacttcgtcgacgggctctggtcgtcctgcgtcggcgagcgcctgatggtgttcacgaccaaccacccggagcggctcgacccggcgctgctccgcccgggccgcatggaccgcaagatcgagctcggctactgcacgccgcccgcgctgcgtgtgctcgccaagaactacctcggcgtcggcgacgagggctgcgacgacgccgacgcggaccccgacacggtcaacgccctcatggcggaggccgagggcctgctcgccgccgccgaggtgcaaatcacacccgccgacatcgccgaggtgttcatgggctgcgacggcgcgggcgccgccgccgcgctgaggaagctcgtgggcgagctgcggcggaggcgggatgctgctgcccttgccacggccgtagcaccgccggaataaaaccagccagggatcctacgtagcgcgccaccatgcatagctgcctagtcagcttccattactttgatgctaggtggtttatttattgagtcgtgacggtgcaatgcgaagtgtcgtgtgtcaggtgtttcccttctcatttagtttgggttcgtgtttttgtgtcgtgctagtacgtacggatcccgtaggctaggcagccaataagccaataatggacgctgattacccaggcacaacaatactgttatatgacagagctcgcccattgcatgcaccagtggtttcattttcagcgcataggtgtaaagtgccgaaaggcaaggccggctggatcgtgactaaaggctgtgttttagttagattcttatctggcatggccaagaataccaaaattgatttccacaaagttttgactttatagcccttacattttgtgatattagatcactctagtgactaaagttgaccaaaaccttaatcaccaatttgacaaaccaaaacttattcatgtcaaaaaaaaaggttaggccaagtacattaagggcatgtatagtggagagacactaaaacggttctccaagcataagagacaactaaaagactctattatac

SEQ ID NO: 4211 - DNA, 2007 bp, Setaria italica
ctcccaccctgcttccatagagcaagtgagcaactgagcgagcaagaaagccggccgtcatggagatggtgctggactggcggtcgctggggtccctgctggcgacgctcatggtgttccgcacggcgatgcgggacttcctccctccggaggccgagatgtgcctgcgccgcctcctcgcgcgtgtcgccgccgcgttccgcccgcccagcggcaccatcctcatcgacgaggccgacggcgccagcggcggcgccaacgacctctacgactcggcgcagctctacctcggcgagcgctgcctcgccacggcccccgccgtgcgcctccacaagccccgccaggcgcaccgccccgtcgcctccctcccggactcccacaccacgcacgacacgtatcagggcgtccgcgtccgctggacctccaccgcgcgcaccgccgaacgcggtgcgggcggcggagggtacagcccctacggcgtgttcggccgcggcggccacggcgtgggcggcggcggcgatcaccgcaccctcgagctgcagttcccgcgccagcaccgggacctcatccacgaccactacatcccccacctcatcgccgaggccgctcggatgcggctcaagtcgcgggagcgacggctgtacaccaaccgcgccaccggccccggcgatgaccaccaccgcctctggacctcgcacgccttctcccacccgtccaacttcgacacgctcgccgtcgacccggcgctccgcgaggagatccgcgccgacctgctccgcttcgcggcgcgccgggaccactacgcccgcgtcggccgcgcgtggaagcgcgggtacctgctccacggcccgccgggcacgggcaagaccagcctcgtcgccgccatcgccaacctcctcgagttcgacgtctacgacctcgagctcaccacggtgcccaccaactcccacctccgccgcctgctcgtctccaccacgccaaagtccgtcgtcgtcgtcgaggacatcgactgctccctcgacctctctgaccgcaacaagaagaacaagaacggcaataacggcgccgacgacgagaccgcggcgcagctcgccgcgatttcgcccgccgccgcggcggccatggcggtggtggggcgggaatccataagcctctccggggtgctcaacttcgtcgacggcctctggtcgtcctgcgtcggcgagcgcctgatggtgttcacgaccaaccacccggagcgcctagacccggcgctgctccgccccggccgcatggaccgcaagatcgagctcggctactgcacgccccccgcgctgcgcgtgctcgccaagaactacctcggcgtcggcgacgagggctgcgaggacgccggcgacgacccagacacggtgagggacctcatggccgaggcggaggacctgctcgcacccgccgccggggtgcgcatcacgcccgccgacatcgccgaggtgttcatgggctgcgacggcacgggcgccgccgccgccctgaggaagctcgtgggcgagcttcggcggagacgtgacgattacgcggcggccgcagccgtagcgccgggcgaatcgggggaggatacgacggattgttgaagccagggaattgtcgtacgtggcggcgcggctatgacgcgtggctgcctggtcagctttccactagtttgatcgatgctgctgggctgacgatggagtatgacggggcacttcgtctgtacttgttggtgttgtgtagatagggtgtttgtttgcctctcgttttgtgttgggttgtctactggtttatgtcgtagcatgtaggcgatgatggacgctgatcaagcaggcacgacggcacaaacgaacatggcagagctcgttcatttcgtgcaacaatggtttatgttgctaaatttcgttttcagcctaggtgtaaataaagtactgaaaaaggcaggcagactgcaatactttatcatgactaaaggcaaaaaaaagttgagctccaccttca

SEQ ID NO: 4212 - DNA, 2480 bp, Setaria italica
ggtcaagtcgtcccgtccggcccgaaaaaagcacgcgcgcgcgatcacccagcagaaacgtgccgccccggcacacctcgccgacgcatccgcggacagccaaaccactccactccactccactccgtccccacccaacccgaggagccgacgcccgaatcgcctccgaatccgacgacgacgcgcgcatacccttccataaaacccccacctcaccctccactcccagtctcccaccctgcttccatagagcaagtgagcaactgagcgagcaagaaagccggccgtcatggagatggtgctggactggcggtcgctggggtccctgctggcgacgctcatggtgttccgcacggcgatgcgggacttcctccctccggaggccgagatgtgcctgcgccgcctcctcgcgcgtgtcgccgccgcgttccgcccgcccagcggcaccatcctcatcgacgaggccgacggcgccagcggcggcgccaacgacctctacgactcggcgcagctctacctcggcgagcgctgcctcgccacggcccccgccgtgcgcctccacaagccccgccaggcgcaccgccccgtcgcctccctcccggactcccacaccacgcacgacacgtatcagggcgtccgcgtccgctggacctccaccgcgcgcaccgccgaacgcggtgcgggcggcggagggtacagcccctacggcgtgttcggccgcggcggccacggcgtgggcggcggcggcgatcaccgcaccctcgagctgcagttcccgcgccagcaccgggacctcatccacgaccactacatcccccacctcatcgccgaggccgctcggatgcggctcaagtcgcgggagcgacggctgtacaccaaccgcgccaccggccccggcgatgaccaccaccgcctctggacctcgcacgccttctcccacccgtccaacttcgacacgctcgccgtcgacccggcgctccgcgaggagatccgcgccgacctgctccgcttcgcggcgcgccgggaccactacgcccgcgtcggccgcgcgtggaagcgcgggtacctgctccacggcccgccgggcacgggcaagaccagcctcgtcgccgccatcgccaacctcctcgagttcgacgtctacgacctcgagctcaccacggtgcccaccaactcccacctccgccgcctgctcgtctccaccacgccaaagtccgtcgtcgtcgtcgaggacatcgactgctccctcgacctctctgaccgcaacaagaagaacaagaacggcaataacggcgccgacgacgagaccgcggcgcagctcgccgcgatttcgcccgccgccgcggcggccatggcggtggtggggcgggaatccataagcctctccggggtgctcaacttcgtcgacggcctctggtcgtcctgcgtcggcgagcgcctgatggtgttcacgaccaaccacccggagcgcctagacccggcgctgctccgccccggccgcatggaccgcaagatcgagctcggctactgcacgccccccgcgctgcgcgtgctcgccaagaactacctcggcgtcggcgacgagggctgcgaggacgccggcgacgacccagacacggtgagggacctcatggccgaggcggaggacctgctcgcacccgccgccggggtgcgcatcacgcccgccgacatcgccgaggtgttcatgggctgcgacggcacgggcgccgccgccgccctgaggaagctcgtgggcgagcttcggcggagacgtgacgattacgcggcggccgcagccgtagcgccgggcgaatcgggggaggatacgacggattgttgaagccagggaattgtcgtacgtggcggcgcggctatgacgcgtggctgcctggtcagctttccactagtttgatcgatgctgctgggctgacgatggagtatgacggggcacttcgtctgtacttgttggtgttgtgtagatagggtgtttgtttgcctctcgttttgtgttgggttgtctactggtttatgtcgtagcatgtaggcgatgatggacgctgatcaagcaggcacgacggcacaaacgaacatggcagagctcgttcatttcgtgcaacaatggtttatgttgctaaatttcgttttcagcctaggtgtaaataaagtactgaaaaaggcaggcagactgcaatactttatcatgactaaaggcaaaaaaaagttgagctccaccttcagcaattggtcctttcaattcctcggtggacactgatttgtggtttggtcttggtttacaagaagacatgaactagccacgttaggcttgccgagtgcacatgcaccagaaaaaaagtaaaatttcagcgatcagctattactaacttttatcacttgtgaacaactccctaaacgccaacgtgtgcaccaccgtccgacccagcagcccacgcttgcactcgaaggacaaaagccaacaggtc

SEQ ID NO: 4213 - DNA, 2019 bp, Panicum virgatum
gcccgagaagccgacgcccgaatcggctccgatccggcgcgcgcataaaagcaaagccccgcctcactccactcccacttcgacagagcagcactctgatcacacacacacacacacggagttcgagtacgagccagcaagaagcttaggcgcgcggcgatggagattgtcctggactggcgcgcgctggggtccctgctcgcgacgttcatggtgttccgcaccgccgtgcgggacttcctgccgccggaggcggaggcgtgcctgcgccgcctcctcgcgcgggtcgccgccgcgctccgcccgcccaggggcaccgtcctcatcgacgaggccgacggcgccagcggcggcgccaacgacctctacgacgccgcgcagctctacctcggcgcgcgctgcctcgccacggcgcccgccgtgcgcctgcacaagccgcgccagtcgccccgccccgtcgcctcgctcccggacgcgcacgccacgcacgacgtcttccgcggcgtccgcgtcaagtggacctccaccgcgcgcgccgtcgagcgcgccggccacggcccctacggcggcgcgttcggccgcggcggcggcggcgaccagcgcaccctcgagctccagttcccgcgccagcaccgggacctcatccacgaccactacatcccccacctcatcgccgaggccaccaggctgcggctcaagtcgcgggagcgccggctctacaccaaccgcgccacggggcccggcgacgaccaccaccgcctctggacctcgcacgccttcgcgcacccgtccaccttcgacacgctcgccgtcgacccggcgctccgcgaggagatccgcgccgacctcctccgcttcgccgcgcgccgggaccactacgcgcgcgtcggccgcgcctggaagcgcgggtacctgctccacggccctccgggcacgggcaagaccagcctggtcgccgcgatcgccaacctgctcgagttcgacgtctacgacctggagctcaccacggtgcccaccaactcccacctccgccgcctgctcgtctccaccacgcccaagtccgtcgtcgtcgtcgaggacatcgactgctccctcgacctctccgaccgcaacaagaagaagaatggcggcgccgacgaggagaccgcggcgcagctcgccatggtgtcgccggccgccgcggcggccatggcggcggcggggcgcgaatccataagcctctccggggtgctcaacttcgtggacgggctctggtcgtcctgcgtcggcgagcggctgatggtgttcacgaccaaccacccggagcggctggacccggcgctgctccgcccgggccgcatggaccgcaagatcgagctcggttactgcacggcccccgcgctgagggtgctcgccaagaactacctcggcgtcggcgacgatggcagcgacgaggacgccgacgccgaccccgacgcggtgagcagcctcatggccgaggcggagggcctggtcgccgccgccggggtgcgcatcacgcccgccgacatcgccgaggtgttcatgggctgcgacggcgcgggcgccgccgcagccctgaggaagctcgtgggcgagctgcggcggaggcgcgacggtgcggccgccgcggcagccgtggtgccgggcgaatcggcggaggacacgacggagtgaagctgtacgcggcgacgcaacgatgatgcatggctgcctcgtcagcttttcacactagtttgatcgatgcagctgagctgacgcctgatggcggaggacacgactggagtatgacagggcagggcactgtgtctgtgcttgttggtgttgctgtgtagataggttgtttctttggccttgttccgtttttctggacttcgcttttctgagaatcaggattctgagataagccagctgtccggagaatcggctgtctgaataactgggtgtttggcaatcctgattattttgagccgttctctgagttgagtggtataaagtctgaaatacccttgaggctgatga

SEQ ID NO: 4214 - DNA, 1949 bp, Oryza sativa
gctcaatctagcatgttgtgtactaatcatgttcacttgactcgatcgatcgctccgatcgactacaccccgccgcgccgcgcgcacgcataaaacccccaccacctgaacctccacctccactccacctccacttccacactcgagtagcgagcgagaggtcgtcgtcgtcgtcgtctcgtcgccgccatggagatggtgctggactggcgctcggtgggctcgctcctcgccaccatcatggtgttccggaccgccatgcgcgacttcctcccgcccgaggccgagatcttcctccgccgcctcctcacccgcctcgccgccgccttccgtccccacgtcggcaccatcctcatcgacgaggccgacggcgccagcggcggcgccaacgacctctacgacgcctcccagctctacctcggcgcccgctgcctcgccaccgcccccaccgtccgcctccacaagccccgccaagctccccgccccgtcgcctccctccccgacgcccacaccacccacgacgtcttccgcggcgtcctcgtcaagtggaccgctcgccccgtcgagcgcggcgcctccgccggcggcggcggcggcggagtgttcaacccttacaacccttatggccgaggtggcggcggcggcgagccgcgcagactcgagctgcagttcccgcgccagcatcgggagctcatccacggccactacatccagcacgtcatcgacgaggccaccaagatgcggctcaggtcgagggagcggcggctctacaccaaccgcgccgccgcccccggcgacgaccaccaccgcctctggacgtcgcacgccttctcccacccttccacgttcgacacgctcgccgtcgacccggcgctgcgcgacgacatccgcgccgacctgctgcgcttcgcggcgcggcgcgagcactacgcgcgcgtcggccgcgcgtggaagcgcgggtacctgctccacggcccgcccggcaccggcaagaccagcctcgtcgccgccatcgccaacctcctcgagttcgacgtctacgacctggagctcaccaccgtgcccaccaactcccacctccgccgtctgctcgtctccaccacgcccaagtcggtcgtcgtcgtcgaggacatcgactgctccctcgacctctccgaccgcaagaacaaggcgagcgacgacgagaacgcggcgcagctgtcgatcatctccccggccgccgcggcggccatggcggcgatggggcgggaatccatcagcctctccggcgtgctcaacttcgtcgacggcctctggtcatcctgcgtcggcgagcgcctcatggtgttcaccaccaaccacccggagcggctcgacccggcgctgctccgccccggccgcatggaccgcaagatcgagctcggctactgctcgccgcccgcgctccgcgtgctcgccaagaactacctcggcgtcggcgtcggcgacgaaggatgcgaggacgccgccgacgatccggacacggtgagcggcctcatggccgacgccgagggcctcctcgccgccggggtgctcatcacgcccgccgacatcgccgaggtgttcatgggctgcgacggcgcgggcgccaccgccgcgctgaggaagctcgccgacgagctgcggcggaggagggacgcgccggcggtgcctgtcacagaggaggcggccatgacgacagagtaaaaagcagacgagccgccattgcagattgcttgaacttgaacagcatcatgatcaatatataattaataattttcatggtgatttggtttcgagttaggtattaattaggtcggttgtgatcgtgtcatggttgcgccatggatggaggatttgaggatttgctgcattttgcaatggtgtgtggctttctgaatttttcagcaattttctttgcgttttatgagaagttgcaccatgtcgtctcc

SEQ ID NO: 4215 - DNA, 1139 bp, Setaria italica
cacggccacacctgcccccgacgagcgacacgccgccacgccatcggcatgggcggaggcgcgcggttacccccacctcgtcctccccgacttcacttccacccgtcaacgccgattccctatctgcacgctaccgcgcctgtcgccgcctcctccaccctctttgtccatcgccccgctccaatcccgagcgcccgcgtctcccgcccgcgccgccgcgccgccatgtctgccaccaccgccgccgactcctcctccaccatcggagtatcggatgccacgggggtcgacgctcgctcgttggagagcgtcgggcaaaacgacctactgatcgtcggacctggcgtgcttggccggatcgtcgctgagatgtggaaacaggaacatccaggttccaatgtttatggccatactgcaaccacagatcatcactgtgaattaactgaacttggtatcattccctccttgaaggggtccataccaggtccaaaatttccatatgttattttctgtgctccgccatatcgttctgaggattatgctggggacctgagagtagcagcttcgaattggaatggagaaggctctttcctgttcacctcgagtactgccgtctatgactgcagtgataatggattgtgcagtgaggattctccatgcatacagattggtcaaagccctcgtacggatgtccttctaaaagctgaaaatgttgtccttgaggcaggaggctgtgttctcaggctagtaggactttacaaatcggatcgaggtcctcatgtttactggttgtcaaaaggaaccttggatgcacgtcctgaccatatactcaatctgatacattatgaagatgccgcctcccttgcaattgccatcatgaaaaggagattacgcggccgcatctttgtgggctgtgataatgagcctctatctaggcaagagattatggaccgtgtcaacagaagtggaaaatttgacactaaattccagggcttcactgggactgatggtccactggggaaaaggatggagaattccaaaacccgggctgagatcggatggcagcccaagtatccaagtttcacagagttccttggtctcagcaatctctaactttcatgcgatgttgctaaattctt

SEQ ID NO: 4216 - DNA, 1634 bp, Zea mays
gcgcgcagcaatcctgcctcgcttccctccaaattcccaaagctctcgcgcgcggtgccatggcggagcgcctcgccgcctccctcctccctgccgcctcgccgtccccgtccgcccgccgcgcaacggtcgcagccgcagccgccgcctctttcccctccccatgctccgcccgcgcggggctgcgcctacgctcccgcccgcccctcttctcgcagaaggcggccgggcgcgggtgtggcctgcgggtggtgcggtgcatggcagcgtcggacgcggtgcagctcaaggccgcgcgggaggacatcaaggagctccttaagagcacatactgccaccccatcatggtccgtctggggtggcatgattctggtacctatgacaagaatattaaggactggccacagcgaggtggagctaatggaagtttaaggttcgatgctgagctgagtcatggagccaatgcgggcctgattaatgcattgaagcttatccagcctatcaaggacaaatacccaggtatcacttatgcagatttgttccagttagcaagtgctacggcgattgaggaagctggtggtccaaaaattccaatgaaatatggacgtgttgatgtcacagcagctgaacagtgtccgcccgaggggaggcttcctgatgctggcccacgtgatcctgctgaacaccttagggaggtattttatagaatgggccttgatgacaaggaaattgttgcactatctggagcacacacacttggaagagcaaggcctgaccggagtggctggggaaagctagaaacaaaatatactaaggatgggcctggtgagcctggagggcaatcatggacagttgagtggttgaagtttgataatagttacttcaaggacatgaagtttttgagccagcttccctggaaagagcagaaggaacaggatcttctagttttgcctacagatgctgcattatttgaggacccatcgttcaaggtatacgcagaaaagtatgcagaggaccaggaagcgttctttaaagactatggtgaagctcatgctaagctgagcgatcttggtgcaaagtttgatcctcctgagggattctcactcgacgatgacacatgctcttcaccttccgacgagaagacggaagaacctacactggtagcggtaggagcggcagtagcaacagcgacagcggacgacaacaacggcgcagctccgcagccggagcccttcatcgctgccaattactcgtatggaaagagggagttgtcggatgcgatgaagcaaaagatcagggcggagtacgaggggtttggaggcagcccggacaagcccatgcagtccaactacttcctcaacatcatgatcctgattgcggggttggcgttcttgacgtctctgctcgggaactgagtgttatatcatcatatgatccgattcctgaagtctacgagtgtccatatctacgactagcattagagctacgtacgtgcaaacagtttttttcgcgaattttggagagaaacgagcaaaagaaatgtataacgagtgttggagaaatagcgacctgactatcaacactctacctgtatgatttatctactatgaagcagtggatgcatggatattcac

SEQ ID NO: 4217 - DNA, 1789 bp, Setaria italica
cagccacgcaccctcccatccccgaggcgcttccctccaaatttctaaaacgcacaacgcgcgcggcgccatggcggagcgcctcgccgcctccctcctccccgccgcctccccctccccgtccgcccgccgcgccacggtcgcggcctcggggtccgccgccgcgtccttcccttcctcgtgctccgcccgagcggggctgcgcctccgctcctcccgctcggggtcggcccgcttctccaaggcggctgggcgcggcgggggaggcggcgcgctgcgggtggtccggtgcatggcggcgtcggacgcggcgcagctcaagagcgcgcgggaggacatcagggagcttctcaagaccacgtactgccaccccatcatggtccgtctggggtggcatgattctggtacctatgacaagaatattgaggagtggccccagcgaggtggagctgatggaagcttgagatttgaacctgagttgaatcatggagccaacgctggtctgattaatgccttgaagcttatccaacctatgaaggacaaatacccaggtatcacttatgcagatttgttccagttggcgagtgctacagcaattgaggaagctggtggcccaaaaattccaatgaaatacggacgggtggatgtcacagaacctgagcaatgtccacctgaggggaggcttcctgatgctggcccacgtgatcctgctgaacaccttagggaggtattctatagaatgggtcttgatgacaaggaaatcgttgcactgtctggagcacatacacttggaagagcaaggcctgaccggagtggctggggaaagccagaaacaaaatatactaaggatggccctggtgaacccggagggcaatcatggacagttgaatggttgaaatttgataacagttacttcaaggacatgaagtttctgagccagcttccatcgaaagagcagaaggatcaggatcttctagttttgcccactgatgccgcattatttgaggatccatctttcaaggtgtacgcagaaaagtacgcagaggaccaggaagccttctttaaagactatgctgaggctcatgctaaactgagcgaccttggtgcaaagtttgatcctcctgagggattctcactggacgatgacacaagcgatgagccagcagctgaaaagaaggaagaagctgcaccaacaccggaaccggcagctgcagcagcacctccgccagagccagcagcagcaccggcactggaaccagtagcagcagcagtagcaacagcgacagcggacgacaacaatggcgtggcgccacagccggagcccttcgtcgctgccaaatattcttatggaaagacggagctgtcggattcgatgaagcagaagatccgggcggagtacgaggggttcggaggcagcccggacaagcctctgcagtccaactacttcctcaacatcatgctcctcatcgcggggctggcgttcctgacgtctctggtcggcaactgatgaggatgttacggtcctgaagtttgcgagtgtccatatagcaaattctgtgaacatatatggaacatatacacggcgtgccaccatgtgactagcatcagagctacgtacactgtaaacatttttttttgcgaaattcggaaagaagactagagaaaaggagatgtatagaaagtgttccaagaaccatcgacctaactatatatgatgtatttactatgaaactgtgaatggatggatgtgcacatctgtattttttttaaaaaaaattgaacattggag

SEQ ID NO: 4218 - DNA, 1708 bp, Setaria italica
atttctaaaacgcacaacgcgcgcggcgccatggcggagcgcctcgccgcctccctcctccccgccgcctccccctccccgtccgcccgccgcgccacggtcgcggcctcggggtccgccgccgcgtccttcccttcctcgtgctccgcccgagcggggctgcgcctccgctcctcccgctcggggtcggcccgcttctccaaggcggctgggcgcggcgggggaggcggcgcgctgcgggtggtccggtgcatggcggcgtcggacgcggcgcagctcaagagcgcgcgggaggacatcagggagcttctcaagaccacgtactgccaccccatcatggtccgtctggggtggcatgattctggtacctatgacaagaatattgaggagtggccccagcgaggtggagctgatggaagcttgagatttgaacctgagttgaatcatggagccaacgctggtctgattaatgccttgaagcttatccaacctatgaaggacaaatacccaggtatcacttatgcagatttgttccagttggcgagtgctacagcaattgaggaagctggtggcccaaaaattccaatgaaatacggacgggtggatgtcacagaacctgagcaatgtccacctgaggggaggcttcctgatgctggcccacgtgatcctgctgaacaccttagggaggtattctatagaatgggtcttgatgacaaggaaatcgttgcactgtctggagcacatacacttggaagagcaaggcctgaccggagtggctggggaaagccagaaacaaaatatactaaggatggccctggtgaacccggagggcaatcatggacagttgaatggttgaaatttgataacagttacttcaaggacatgaagtttctgagccagcttccatcgaaagagcagaaggatcaggatcttctagttttgcccactgatgccgcattatttgaggatccatctttcaaggtgtacgcagaaaagtacgcagaggaccaggaagccttctttaaagactatgctgaggctcatgctaaactgagcgaccttggtgcaaagtttgatcctcctgagggattctcactggacgatgacacaagcgatgagccagcagctgaaaagaaggaagaagctgcaccaacaccggaaccggcagctgcagcagcacctccgccagagccagcagcagcaccggcactggaaccagtagcagcagcagtagcaacagcgacagcggacgacaacaatggcgtggcgccacagccggagcccttcgtcgctgccaaatattcttatggaaagacggagctgtcggattcgatgaagcagaagatccgggcggagtacgaggggttcggaggcagcccggacaagcctctgcagtccaactacttcctcaacatcatgctcctcatcgcggggctggcgttcctgacgtctctggtcggcaactgatgaggatgttacggtcctgaagtttgcgagtgtccatatagcaaattctgtgaacatatatggaacatatacacggcgtgccaccatgtgactagcatcagagctacgtacactgtaaacatttttttttgcgaaattcggaaagaagactagagaaaaggagatgtatagaaagtgttccaagaaccatcgacctaactatatatgatgtatttactatgaaactgtgaatggatggatg

SEQ ID NO: 4219 - DNA, 1772 bp, Oryza sativa
gaaaaaactcactcgactcgagcgcgcgcgccatggcggagcgcatcgccgcctccctcctcccggctgcctcgccctcgcctgctccgtcccctccccccccgcgcccccgcgtctccgccgcggccgccgcctccttcccatgctgctccaccagcgccggcggcctccgcctccgctcccgcccgtctcgcttcccgcagaaggctgcgacgacgaggagcgggcgcgccggcgcgggggcgcgggcggtggtccggtgcatggcggcggcggcggtggcggcgtccgacgcggcgcagctcaagagcgcccgggaggacatcagggagatcctcaagaccacctactgccaccccatcatggtccgtcttgggtggcacgattctggcacgtacgacaagaacatcgaggagtggccgcagaggggcggagccgacgggagcttgagatttgacgccgaattgagccacggagccaatgctggtctgattaatgctttgaagcttatccaaccaatcaaggacaaatacccgggtataacttatgctgatttgttccagttggcaagtgctacagcaattgaggaagctggtgggccgaaaattccaatgaaatatggacgagttgatgtcacagcagctgagcagtgcccaccagaggggaggcttcctgatgccggtccacgtgtgcccgctgatcatcttagggaggtattctacaggatgggccttgatgacaaggaaattgttgcattatctggagcacacacacttggaagatcaagacctgacaggagtggctggggaaagccagaaacaaaatatactaaggatgggcctggtgaacctggagggcaatcatggacagttgaatggttgaagtttgataacagttacttcaaggacataaaagagcaaagggaccaggatcttctagtgctacccacagatgctgcattatttgaggatccgtccttcaaggtatatgccgaaaaatatgcagaggatcaggaggcattctttaaagactacgctgaagctcatgctaaactgagcgaccttggtgcaaagttcgatccacctgagggattttcactggacgatgaaccagccgtcgaagagaaggatcctgaaccagcaccagcgccagcagcagcagcaccacctccaccagtcgaggagaagaaggaagctgaaccaactccagttccagtaacggtaggagcagcagtggcatcatcgccagcggatgacaacaacggtgcagcaccgcaaccagagcccttcgtcgctgcgaaatactcctacggaaagaaggagctgtcggactcgatgaagcagaagatcagggcggagtacgagggattcggaggcagcccggacaagcctctgcagtccaactacttcctcaacatcatgctcttgatcggagggctggccttcttgacgtctctgctcgggagctgagagcgatggtctgatgacctcctctgatgagtgttttgagttgttctgcctgtgctaagatttgcgtgtttctctttccatgttttgagtcgttattccgtaaataaattgaggtaaaaggatgggcatgtgaatggattccagtactttctgaacttcttgagtaattcctctagagaaatatttgtcggagagaaatgtcacattatctagttgtcatggctcatgactacattctctatactgagggaaattatgacattctctaaactaaggagggaaataatgaggacaccccatata

SEQ ID NO: 4220 - DNA, 3859 bp, Setaria italica
caaagacatcgatatatgacaagaatccacaattttgatttttgaaacaggcatttaaaacccccgcggcaaggccttgaacacagtcttttctatacgcaaatgactttttttctttcgtgctgtacgccacgaactctctgttttttttcatcgggtacgcacacaagctcacgaagacaccaacattcaccaacacgcatctcgaggcaccggtcacccccttcctccctccatctccctcctctcgacgccttatcctccatctcgccacggctcctcagttaaaccccgtcttctccctccactcccaccccaccattcccacgcaaacaaatgctcctctccttctccccgcacccttcccctcttctcctctccctcccctccacctccgcctccaagccccgcgcccgcctccaacctgtcatcgcctccgcctccgcgtccccctcgccggagctcctcggcaagtccgcgctccgccgcatctctgacaagctccgcagcctcggctacctcgagaccggttccgaggcccccgctccggcgccggtcacgagcggggatgccccatcggccggtgagatcttcgtgcccaccccggcccagctcccgcgccaccgcgtcggctccaccctcgacccgagctgggccacggccgacggagaggccggctccgccacgcggcggcgggggagggggcgcgggagggatgcgccggggtcttcttcgatgccgccgtccgcggcggagctcgcgctgccgcgggacgagctccggcggctgcaggggatcgggatcagggtgaggaagaggctcaaggtgggaaaggcgggcatcacggaggggatcgtgaacgggatacacgagcggtggcggaacgctgaggtcgtgaagatcaggttcgaggatgtctgggctatgaacatgaggcgcacgcacgagattctcgagaggaaaactggaggtttagtcatttggagatctgggagcaccatcatattatatagaggaaccaactataagtatccttacttccattacagagaaaggatggatggttttcttgacgaagaatcatcagagcagagcagctctggggatgaggatgaggatcctggtgtagaatcagaggcgctgagtaacagtgcggaggaggatgagactagttttcatcatgatagcagtcatgagagtagcgagaatcctgttatagcttgtgcagaacagaggagtacaggagagggaaagaataataatataggatatttgaaacagagcttaagcagagagaaagatacagctcatccaatattatctaccaaacggcttgtttttgatacactcgggggcaatttggacttgagagctggagctccaaatcaacagcatgcaagattgcacgtaaaaactcatgctgatcatctcggtaaagttggtcctagagatcgatcatccttagtggctggtgttggttctccaaataagttccgattacagttgcctggggaggtcaaacttgcagaggaagcagatagattactggatgggttgggcccaaggttttctggttggtgggggtatgatccccttccagtggatgcagatttattaccagctattgtgccaggataccgaagaagcagtaaccttcaagggttggctgcatccatgatcaagctatgggaaagatgcgaggtagcaaagattgcaatcaagagagatgctcacaacactgatagtgagctcgtcactgaagaattgaagggattgacaggtggaaccctattatcaagggataaggagtccattgtattctacagagggaaagatttcctcccccctgctgtttctctggcaatagaaaagcgcagaaagtggggcagttctacaatctacaagaccaagcctaacgctgaagaaagcacgcttgctcaggatgcttctgtactgaaggtatcaagtgatgtctctgtacaaattcatgaagaggtaacttctgtctcagagaatagagcagaatctcttaatactgtggcccagaatgtggagactagattatctcaggccatagcagagaaagagaaggctgaaaaacttcttgaagaactagaaaatgcatctcagccttcaaaagctgacactagagaggtcatcacggaagatgagaggtacatgttgaggaaagttggattgaagatgaaaccatttctgctgctagggaggagaggagtttttgatggaactattgaaaacatgcatcttcattggaagtatcgagaacttgtcaagattatctgtaaagaacacagccttaaagatgttgaatatgctgctcgaactctagaggcagagagtggtggtattttggtggcagtggaaaaagtgagcaaagggcatgctattatagtatatcgaggaaagaactaccagaggccatcaactctcaggccaaaaactttgttgactaaaagggatgctttgaagcgttccatggaaaaccaacgttgtaagtccctgaagcttcatgtgcttaatctgtcaaagaatattgactacttgagggaccagatgaattctagctactattacaatgccattcatgatcctagtgtcaactccggtacactacagcagaaaaacgaagaagtgcctgaacttgctcccatgagttcagaaccagaggttgaggagtgcacttcagttgagatggatggtaccttaaatttaacaaagtctggagctccttttgatgacaatgatatgcagagcaaagtctgtctcaacaagcctggagatggtccctctgtgaccgtaagtccaccatgcctgactgggagatctagcactgtttcattcaatggtctgaacagacatcaaaaccagtatggctctactgtgacattcaatccagatagtcatagtgaaggagattcaaaagatgtggatgcatcaaaatttgatctggaatctgatcctctcttgcctctgagagcaacaccactcacaaatcaagaaaggcttatgctaaggaagcaagcgctcaaaatgaagaaaaaaccagtactttccatagggaggaataatgtcatcacgggggttgcaaaaacaataaaaacacacttcaagaagcaccctcttgctattgtgaatattaagaacagagctgatgggactccaatccagcaactgatatcagaactggaggaggcgacaggatcggttctagtgtcacgagaaacgaacaaagtgatcttgtacagaggttggggagcagaagtggcccagaaaagctcaatggaaaatagtgcaaatggagaagaaaaggaggtgatatcgcctcagctcctggaggccatcaggttagagtgtggattgcttcctggcgagtcaggatagctggatcccagataacctccccactgatcatgtgttacggaggaatcgtactgtttttgccggtggattagtggatcatacacatatagagcgcatgtatgcagcgaagaactgaagctgcgtaagagcaacgtgtggaagaactgcttgctgacgtagttgtgccatgctgtcgaagtgtcgatgcatttctttgtcgccgtcgcaattgttggcggctgcgcatctttcctttctcttcgttttcctgggccattacatccaattattatccattcgaggctcttccggttgtgcagataagaacgcagacatgggcatgttttagctgtagtgtcttatcttcttccctgtagatattagaacgacctgagtaaattttcctgcaacctgtaaacctaatgcctcagaaactcgttagctgttaacatccggcacaaggtagtgccgcccgtct

SEQ ID NO: 4221 - DNA, 2325 bp, Zea mays
acctcacccaccgaaaaacccaaaagcctcagccgcggccacttacaaaaaaaaaaacttccccccgcttgccgcttgccgtctccccgcgtccccaagccgagctctcggcctctcgctttcggtgttctcccctcgatcctcgcccctgcgttctccagggcgcccatgagctgaggccgccaccgatgggcccgcccttctcagcgcaggaccccgcgccgtcgccgtcgggcggctccggctccggatcatccaggcgccgcctccgccggctcgaccgccgcaacgcgtccaagaacatcagctacaacgccaccaactactgccagtacccgccgtccccgcaggtcgcctccgcgccggggtccgggcgggcctcgctcgccggctcccttgcctgctccatcgacgtcgtcaacagctttcgcatcggcggcaacggcgacgggggcagggaccttcgcttcctgtgcgaaagtctcggcctctccggacccgacgacttcgccatcccgctggccgactgggaggcgcacaaggccgttcgatcctccacctccgcttcgggctcccccaactccgcacgcaccaaccacgactcccctcagcgggactcgcctttctgtcaggtgggtgccgaggagcccgcccaggctgcggacgccgacccggagctactggccggaacgggaagggacggcccaatcgaagctccggagcggccggcacgcctggatccgccgcccgagtccacctttcccgatgtgaggagggcagttggggagggaggaatcaagggggtgcgcccgccgccggtgctcaagccgccgccttcgatggcgctaccagctgtctgcggcgtgggatccacgtgggatatcttgcggtccttcgcgccggatgagaaagaggacgctcccgcgagcagaactgtccgtcgttttggacaccgggctgcagaggagaaggatgacgacgaggatggggcggtattgttaatgttggacgatctcaggctggaggagtcgtccgagggctttactggcacttcttcactatcaacaaccaacgatgacgagacctcaagcaccaccactgaatccatgttctatatctcaccgaacgggaggtttaggaggaggatccggtcatggaaccgagggatgctcctgggtagtggctcgtttgggacagtctacgagggcatcagcgatgagggtgtcttctttgctgtcaaagaagtgaacttatttgataaagggagcaatgcgaagcagtgtatctttcagcttgagcaggaaattgcacttctgagccagtttgagcatgagaatatagtgcagtactatggaacagacaaagaagattcaaaactttacatcttccttgaattactgacccaaggatcccttgcattactgtatcagaggtatcgcctgcgagatactcatgtctctgcatatacaagacagatccttaatgggttgatttacctccatgaaaagaacattgttcatagagacattaaatgcgcaaatattctggtgcatgccaatggatctgtgaaacttgcagattttggactcgctaaggagatcaccaaattcaatgcagttaaatcatgcaaaggaactgtttattggatggcacctgaggttgtcaatccaaagaagacgtatggacctgcagctgacatatggagtcttggttgcactgtcctagagatgttgacgcgccaaataccctatcctggcctcgaatggacacaagctctatacaggattggtaagggggaatcgccagcaattccaagttctctttcgaaggatgctcgtgattttataagtcagtgcgtaaaacccaatccagaagacagaccatcagcaatcaaactgttggagcatccatttgtaaacaagccaataagatcagtatggtctttgaggacatcttcacgctcgaattcatctacacgtggcatcaattaatgggtcgttgatcatctattggacattggaagaatgatgttggtccgcgcaaatcatgcggacctggccgaaagggagggttgttttgcccggagctagtattgtcaacgctcagcagcattgtcgtcaacctcttagtgtttcattagttgattctttggcatacgttcgcgaggaagatgtcctcgttgagccgccggctaatattcatattcttctgcctggatagggaatagtgaacgtgcatttgagtgcatgagttgtagagtgagaacgggctgtgtaaaacagactgtcctgatgccaatgatatggaaaaaagaaagaaagaaag

SEQ ID NO: 4222 - DNA, 2281 bp, Zea mays
cccccttgccgtctccccgcccccgcgtccccaagccgagctctcgctttcggcgctctcctcaatcctcgtccccgcgtctttcagagcgcccatgagctgaggccgccgccgatgggcccgccccccggtgcgcaggacccggcgccgtcgccgtcgggcggctccggctcttccaggcgccgcttccgccgcctcgaccgccgcaacgcatccaagcacatcgcctacgacgccaccaacttctgccagtacccgccgtccccgcaggccgcatccgcgccggggtcagggcgggcttcgctcgccagctccgctgcctgctccatcgatctcgtcaacagcttccgcatcggcggcagcggagacgggggcggggacctccgcttcctgtgcgagaacctcggcctctccgggcctgacgacttcgccgtcccgcgggccgactgggaggcacacaaggccgcccgatcatctgcctccgcttcgagctcccccaactccgcacgccccaactacgactcccctcagcggaactcaccgctctctcaggtgggtgccgaggagcccgcccaggcttcggacgccgagacggagctaccggccgcaacgggaagggacggcccaatcgaagccccggagcggccggcacgcttggatctaccgctcgagtccacctgtccggatgccaggagggcgcctgggcagggaggaatcaagggcgtgcgcccgccaccggtgctcaagccgccgccttcgatggccctaccagctgtctgcggcgtgggatccacgtgggatatcttgcggtcgttggcgccggatgagaaagatgacgcccccgctagcagatctggccgtcgttttggacacctggatgcagtggagaaggatgacgacgagcgtgcggcggttctgttaatgttggatgatcttaggctggaggagtcgtccgagagctttactggtacttcttcgctatcaacgaccaacgatgacgacacctcaagcaccaccacagaatccatgttctatatttcaccgaacgggaggtttaggaggaggatcaagtcatggagccgaggggtgctcctgggtagtggctcgtttgggacagtctatgagggcatcagcgatgagggtgtcttctttgctgtcaaagaagtgaacttatttgataaagggagcaatgcgaagcagtgtatctttcagcttgagcaggaaattgcacttctgagccagtttgagcatgagaatatagtgcagtactatgggacagacaaagaagattcgaaactttacatcttccttgaattagtgacccaaggatcccttgcatcactatatcataagtatcgcctgcgtgatactcaagtctctgcatatacaagacagattcttaatggattgatttacctccatgaaagaaatattgttcacagagacattaaatgcgcaaatattctggtgcatgcaaatggatctgtgaagcttgcagattttggactcgctaaggagattaccaaattcaatgaacttaaatcatgcaaaggaactgtttattggatggcaccggaggttgttaatccgcagcagacatatggacctgcagctgatatatggagtcttggttgcactgtcctggagatgttgacacgccagataccctatcctgaccttgaatgggcacaagctctatacaggatcggtaagggggaatcaccagcaattccaaacactctttcgagggatgctcgcgattttataagccggtgtgtaaaaccgaatccggaagacagaccatcagcatccaaactgttggagcatccattcgtaaacaagtccataagatcagtacggtctatgaggacgacaccttcacgctcgaattcatctactcgtggcatcaattaattggccgtccgtcatcatctattgggcagcggcagaatgatattggtccgcgcaaatcatgcggagctggccgagagggagtttgttttgactggagctagtattgtcaacgctcaacagcattgtcgtcaacctcttattggtgtttcattagttgattctttggcatacgcccgcgaggaagatgtcctcgttgagccgccggctaatgtatgttcttctgcctggatagagaatagtgggtgtgcatttgagcgcatgggttgtagagtgagaacgggctgtgtaaatagcttgtcctgatgccaaggatatgttattagttgtcacgagaaaaaagaaagaaaggaaaaaaggttcaaagctt

SEQ ID NO: 4223 - DNA, 2348 bp, Panicum virgatum
ccccccgaaccagaaaaaatcgcccccgccccgcccccgcttgccgtgtctccgctcccgcatccccaagcggagctctcgctttcggcgagcgctcccgtccggcctccagggcgccccatgagctgaggccgccgccgatgggcccgcccccctccgcgcaggaccccgcgccgtcgccgtcgggcggcagcggctccggctcctccaggcgccgcctccgccggctcgaccgccgcaacgcgtccaagaacatcggctacgacgccaccaacttctgccagttcccgccgtccccgcagccggcctccgcgccggcgtcggggccggcctcgctcgccggctccgtggcctgctccctcgacctcgtcaacagcttccgcatcggcggcagcggcgacggcggcggggacgtccagctcctctgccagagcctcggcctctccggccccgacgacttcgccatctcgctcgccgactggcaggcgcacaaggccgtgcgctcctcggcctccgcctccgcctccccttcgtccgcgcggcacgaacccgaaccccccgcgcgggactccccgctccgccacgagggtgccgaggagcccacccggccagcggacgccgaccacgagctaccggcgaaggagccggccgcgaggaacgccccaatcgaagctctggagcggccggcacggctggatccgctcgagtccacccgcccggatgtgaagagggcagttggggagggaggaatcaagggcttgcgcccgccgccggtgctcaagccgccccccacgatggcgctgccggctgtctgcggggcgggatccacgtgggacatcctgcggtcgttcgcgccggatgagaaagagcacgcccctgcgagcagatctggccgaggttttgcacaccaggatgcggaggaggacgaggatgcggcggtagcgttgacgctggaggatctcaggcttggcgagtcgtccgagggcttcactggcacttcttcgctatccaccacgaacgatgacgagacttgcagcacgaccacagagtccatgttctacatctcaccgaacggccggttcaggaagaagattcggtcatggaaccgaggggtgctgctggggagtggctcgtttgggacggtgtatgaaggcatcagcgatgagggtggcttctttgccgttaaagaagtaagcttatatgatcaagggagcaacgcgaagcagtgtatctttcagcttgagcaggaaattgcacttctgagccagtttgagcatgagaatatagtgcagtactacggaacagacaaagaagattcgaaactttacatcttccttgaactagtgacccaaggatcccttgcatctttgtatcagaagtaccgcctgcgagatactcatgtctctgcatatacaagacagatccttaatgggttgacatacctccatgaaaggaacattgttcatagagacattaaatgtgcaaatattctggtgcatgccaatggatctgtgaagcttgcagactttggacttgctaaggagattaccaaattcagtgcgatcaaatcatgcaaaggaactgtttattggatggcaccggaggttgtcaatccaaagaagacatatggacctgctgctgacatatggagtcttggttgcaccgtcctggagatgttgacacagaaaattccctatcctgatctggaatggacacaagctttatacaggattggtaaaggggaagcgccagcaattcctagtggtctttcaaaggatgcccgtgattttataagccagtgtgtaaaacccaatcccgaagacagaccttcagcatcaaaactgttggagcatccattcgttaacaggtcaataaggtcggtacggtctatgaggacatcttcacgcccaaattcgtctacacgtggcatcaactgatgagcggggatcatttatagcagtggcagaatgatattagtcaccgcgaatcatgcggagctggctgaaagggagggtggtttgcctggagcttgtattgtaaacgctcaacagcatcctcgtcaaccttgttatttttccattagttgattctttgacatacgtttgagggaagaaagatgtcctcgtgattcagccgccggctaatattcttctgccgggaggagttagaacagtgaatgcgcatttgagcgcatgagttgtagtgggaacgggcgatgtaaatatgtcagcgtgtccatgtgggtatttgtcttgatatgttgctatgagaaaaaagaaaaataagaaggaaaaaagaaacaaaagctttggaactagtcaacacagttgttaggattggaaactgca

SEQ ID NO: 4224 - DNA, 2807 bp, Panicum virgatum
cctccacctcacccgccgaaaaccccaaaagcccccccgagccgcggctagcgaaccaaaaaaaaatcgcccccgccctgccgtgtctccgctcccgcttccccaagcggagctctcgctttcggcgcgcgctcccgtccggcccccgcatcctccagggcgccccatgagctgaggccgccgccgatgggcccgccccccgccgcgcaggaccccgcgccgtcgccgtcgggcggcagcggctcctccaggcgccgcctccgccggctcgaccgccgcaacgcgtccaagaacatcggctacgacgccaccaacttctgccagttcccgctgtccccgcagccggcctccgcgccggcgtcggggccggcctcgctcgccggctccgcggcctgctcgctcgacctcgtcaacagcttccgcatcggcggcagcggcgacggcggcggggacgtccagctcctctgccagagcctcggcctctccggccccgacgacttcgccatcccgctcgccgactgggaggcgcacaaggccgtgcgctcctcggcctccgcctccgcctcccctgcgtccgcgcggcacaaacccgaaccccccgcgcgggactccccgctccgccacgagggcgccgacgagcccacccggccagcggacgccgaccacgagctaccggcgaaggagccggccgcgagggacgccccaatcgaagctctggagcggccggcacggctggatccgctcgagtccacccgcccggatgtgaagagggcagttggggagggaggaatcaagggcttgcgcccgccgccggtgctcaagccgcccccctcgatggcgctgccgcctgtctgcggggcgggatccacgtgggatatcctgcggtcgttcgcgccggatgagaaagagcatgcccctgcgagcagatctggccgagatttttcacaccaggatgcggaggaggacgaggatgcggcggtagtgttgacgctggaggatctcaggcttggcgagtcgtccgagggcttcactggcacttcttcgctatccaccacgaacgacgacgagacttgcagcacgaccaccgagtccatgttctacatctcaccgaacggccggttcaggaagaagattcggtcatggaaccgaggggtgctcctggggagtggctcgtttgggacggtgtatgaaggcatcagcgatgagggtggcttctttgccgtcaaagaagtaagtttatatgatcaagggagcaacgcgaagcagtgtatctttcagcttgagcaggaaattgcacttctgagccagtttgagcatgagaatatagtgcagtactatggaacagacaaagaagattcgaaactttacatcttccttgaactagtgacccaaggatcccttgcatctttgtatcagaagtaccgcctgcgagatactcatgtctctgcatatacaagacagatccttaatgggttgacctacctccatgaaaggaacattgttcatagagacattaaatgtgcaaatattctggtgcatgccaatggatctgtgaagcttgcagactttggacttgctaaggagattaccaaattcagtgcaataaaatcatgcaaaggaactgtttattggatggcacctgaggttgtcaatccaaagaagacatatggacctgctgctgacatatggagtcttggttgcaccgtcctggagatgttgacacagaaaattccctatcctgatctggaatggacacaagctttatacagaattggtaaaggggaagcaccagcaattcctagtggtctttcaaaggatgcccgtgattttataagccagtgtgtaaaacccaatcccgaagacagaccttcagcatcgaaattgttggagcatccattcgttaacaggtcaataaggtcggtacggtctatgaggacatcttcacgctcaaattcatctacacgtggcatcaactgatgagcggggatcatttgtagcacagtaccagtctagcagaatgatattagtcaccgctaatcatgcggagctggctgaaagggagggtggcttgcctggagctagtattgtaaacgctcaacagcatcctcgtcaaccttgttattttccattagttgattctttgacgtacgtttgagggaagaaagatgtcctcgtgtttcagccgccggctaatattcttctgcccggaggagttagaacagtgaatgcgcattgtagcgcatgagttgtagagtggaaacgggcgatgtaaatatgtcagcgtgtccacgtggggatttgtcttgatgccatgatatgttgctatgagaaaaagaaaaaatatagaaggaagaaaaatcgaagctttggaattgtcaacaacagttgttagattggaacggcatatgcatatcttgctgtcaaatgcaggaacgtacggcgatgttttattcgctttttcaatgcacggaactcccaagaaaattcttggattggctgccgcatccagccggttgtccatttggcatgccatgccatatcgctgtcagcctgccgctgggggattccttcctcacgcgttgtttgttgactcgcccgtccgcctacgtcgcccgagcaaagccaaacatgaacgtttacgattcaacccagaaaaactgtatttcgctacttggccatttgtcgtgccaaagaaaataaaaaggtcaaaaggacgacaaagaaccgacgaagaagggttgattcaagataagtcgtgatggtctgtaaagcttaaggtgacggacacagacaaagcagctgtccgg

SEQ ID NO: 4225 - DNA, 2331 bp, Setaria italica
atcccccacccgcttgctctctttgccgtgtccccccgcaccgcatcccccaagcgcagcgcagctagctctcgctttcggcgcgcgctccctctccccaccgcgtcctccagggcgccccatgagctgaggccgccgccgatgggcccgccccccgccgcgcaggaccccgcgccgtcgccgtcgggcggctccggctcctccaggcgccgcctccgcaggctcgaccgccgcaacgcgtccaagaacatcccctacgacgccaacaacttctgcccgttcccgccgtccccgcagcccgcctccgcgccggcgtcggggccggcctcgctcgccgcctccgcggcctgctccctcgacctcgtcaacagcttccgcatcggcggcagcggcgacggcggcggggacgtcctgttcctctgccagagcctcggcctcgccggccccgaggacttcgccatcccgatcgccgactgggaggcgcacaaggccgtgcggtcctcgccttcatccgcgcggcacaaacccgaaaccccagcgcgggactccccgctccgccgcgagggtgtagaggaggagcctatccggccagcggacgccgaacccgagctaccggcgaaggaacaggcggcaagggacgtcccaatcgaagcactggagcggccggcatggctggatccgctcgagtccacccgtccggatgtgaagaaggcagctggggagggaggaatcaagggcttgcgcccgccgcctgtgctcaagccgccgccctcgatggcgctgccggctgtctgcggggcgggatccacgtgggatatcctgcggtcgttcgcgccggatgagaaagagcacgccccggcgagcagatctggccgaggttttaggcaccaggatgcggtggaggtggaggacgacgaggatacggcggtagtgttgacgttggatgatctcaggcttggggagtcgtccgagggcttcactggcacttcttccctgtcgaccacgaacgacgacgagacttcgagcacgaccaccgagtccatgttctacatctcaccgaacgggcggttcagaaggaagatccggtcatggaaccgaggggtgctcctggggagtggctcgtttgggacggtctatgagggcatcagcgatgagggtgtcttctttgccgtcaaagaagtaagtttatttgatcaagggagcaacgcgaagcagtgtatctttcagcttgagcaggaaattgcacttctgagccagtttgaacatgagaatatagtacagtactatggaacagacaaagaagattcgaaactttacatcttccttgaactagtgacccaaggatcccttgcatctttgtatcagaagtaccgcctgcgagatactcatgtctctgcatatacaaggcagatcctcaatggattgacttacctccatgaaaagaacattgttcatagagacattaaatgtgcaaatattctggtgcatgtcaatggatctgtgaaacttgcagactttggacttgctaaggagattaccaaattcagtgcggttaaatcatgcaaaggaactgtttattggatggcacctgaggttatcaatccaaaacagacgtatggacctgctgctgacatatggagtcttggttgcaccgtcctagagatgttgacacgccaaattccctatcctgatctggaatggacacaagctttatacagaattggtaaaggggaaggaccaacagttcctagtggtctttcaaaggatgcccgtgattttataagccagtgtgtaaaacccaatccagaagacagaccttcagcatccaaactgttggagcatccattcgttaacaggtcaataagatcagtacggtccatgaggacatcttcacgctcaaattcaactacacgtggcatcaattgataagcgggggatgatttgtagcacggtggcagaatgatattagtcgccgcttatcatgcggagctggctgaaagggagggtggtttgcctggagagctagtattgtaaacgctcaatggcatccttgtcaaccttttagtgttctttccattagttgattctttgacatatgttagagggaagaaagatgtcgtggttgagccgccggctaatattcttctgcccggaggccggaggaggtaggaacagtgaatgtgcatttgagcgcatgagttgtatgtagagtgggaacgggcgatgtaaatatgtctgcatgggatttgtattggtgccatgatatgcttctatgagagagaaaaaaatagaaagaaaaaaatcaatgctttggaactgtcaacgacagtt

SEQ ID NO: 4226 - DNA, 2855 bp, Setaria italica
cgcggcgagagcgagaccattccagcgcaacccgatcaccggcgcggggccgagctcatctggccgcggttgccgtgtcgcgtcgctgacccgaccaccgggccggagcggcgaaaagatgcgagtcaatgcggacaacgctatccccgctcgctcgccccccctcctccacctcacccgccgaaaaacccaaccaaaagcccgaggccgcggctaacgaacgaaccagaaaaaatcccccacccgcttgctctctttgccgtgtccccccgcaccgcatcccccaagcgcagcgcagctagctctcgctttcggcgcgcgctccctctccccaccgcgtcctccagggcgccccatgagctgaggccgccgccgatgggcccgccccccgccgcgcaggaccccgcgccgtcgccgtcgggcggctccggctcctccaggcgccgcctccgcaggctcgaccgccgcaacgcgtccaagaacatcccctacgacgccaacaacttctgcccgttcccgccgtccccgcagcccgcctccgcgccggcgtcggggccggcctcgctcgccgcctccgcggcctgctccctcgacctcgtcaacagcttccgcatcggcggcagcggcgacggcggcggggacgtcctgttcctctgccagagcctcggcctcgccggccccgaggacttcgccatcccgatcgccgactgggaggcgcacaaggccgtgcggtcctcgccttcatccgcgcggcacaaacccgaaaccccagcgcgggactccccgctccgccgcgagggtgtagaggaggagcctatccggccagcggacgccgaacccgagctaccggcgaaggaacaggcggcaagggacgtcccaatcgaagcactggagcggccggcatggctggatccgctcgagtccacccgtccggatgtgaagaaggcagctggggagggaggaatcaagggcttgcgcccgccgcctgtgctcaagccgccgccctcgatggcgctgccggctgtctgcggggcgggatccacgtgggatatcctgcggtcgttcgcgccggatgagaaagagcacgccccggcgagcagatctggccgaggttttaggcaccaggatgcggtggaggtggaggacgacgaggatacggcggtagtgttgacgttggatgatctcaggcttggggagtcgtccgagggcttcactggcacttcttccctgtcgaccacgaacgacgacgagacttcgagcacgaccaccgagtccatgttctacatctcaccgaacgggcggttcagaaggaagatccggtcatggaaccgaggggtgctcctggggagtggctcgtttgggacggtctatgagggcatcagcgatgagggtgtcttctttgccgtcaaagaagtaagtttatttgatcaagggagcaacgcgaagcagtgtatctttcagcttgagcaggaaattgcacttctgagccagtttgaacatgagaatatagtacagtactatggaacagacaaagaagattcgaaactttacatcttccttgaactagtgacccaaggatcccttgcatctttgtatcagaagtaccgcctgcgagatactcatgtctctgcatatacaaggcagatcctcaatggattgacttacctccatgaaaagaacattgttcatagagacattaaatgtgcaaatattctggtgcatgtcaatggatctgtgaaacttgcagactttggacttgctaaggagattaccaaattcagtgcggttaaatcatgcaaaggaactgtttattggatggcacctgaggttatcaatccaaaacagacgtatggacctgctgctgacatatggagtcttggttgcaccgtcctagagatgttgacacgccaaattccctatcctgatctggaatggacacaagctttatacagaattggtaaaggggaaggaccaacagttcctagtggtctttcaaaggatgcccgtgattttataagccagtgtgtaaaacccaatccagaagacagaccttcagcatccaaactgttggagcatccattcgttaacaggtcaataagatcagtacggtccatgaggacatcttcacgctcaaattcaactacacgtggcatcaattgataagcgggggatgatttgtagcacggtggcagaatgatattagtcgccgcttatcatgcggagctggctgaaagggagggtggtttgcctggagagctagtattgtaaacgctcaatggcatccttgtcaaccttttagtgttctttccattagttgattctttgacatatgttagagggaagaaagatgtcgtggttgagccgccggctaatattcttctgcccggaggccggaggaggtaggaacagtgaatgtgcatttgagcgcatgagttgtatgtagagtgggaacgggcgatgtaaatatgtctgcatgggatttgtattggtgccatgatatgcttctatgagagagaaaaaaatagaaagaaaaaaatcaatgctttggaactgtcaacgacagttgttagattgacaccgcatgtcttgctgtcatttttttgctacggcaggaaccgtacggcgatgctttcctctcttttccaatgcacggaacttcccaagaaaattcttcgattggcctgccgggttcagcctgtctccatttggcgtaccgtaccatatcattctcggcctagcgcagcgggattcctttctcacgcggtgtttgttgacttgcccgcccgccaacgcctgtgtgtgtgcctacgtacacggaaaatttgtgttccacttcttggaaatttgtcctgcca

SEQ ID NO: 4227 - DNA, 1875 bp, Zea mays
cccgttcggcgcattcgcgttccgccgcacccgcgtggaggccgggccggagcagccagccatgggcgtggatgaggcggggcgcgccgccggcaggaatctcacgctggcaagcatcggcttcgcggacgtccgcgtgggcgctgccgtgcccgggggcgccgggtacaaggacggcctgctcgtcgtggggctgcccgtgcccaaggacgacggcctcgacgccgccgcccgggtcgtccgggacctcgccaccaggctgcccgacgtaggcgccgccgctaggacttttctgaggaatagagaagttgcagaattcgtgagtggagcattggctggtgcaatgactaaggctgttcttgctcccttagaaactatcaggacaagaatggttgtaggggtaggatcaaaacatatttttggtagctttgtggagattgttgaacataatggctggcaaggactctgggcaggtaatacaataaatatgctccggattatcccaactcaagcaattgagctcgggacatttgaatgtgtcaaaaggagtatggcctcggcacaagagaaatggaaagaggaaggatgcccaaagatacaactcggcgatttgaaaattgagttgccatttcacttactatcgccgattgcgattggaggtgcggcagctggaatagctagcactttggtgtgtcatcctcttgaggttcttaaggatcgcatgactgtcaaccgtgaggcttatcctagtattgccattgccttcagcaagatctaccgaactgatggcattggtggtctttatgctggcctctgcccaacgttggttggcatgcttccatatagcacatgctactatttcatgtacgagaccatcaagactaactactgccgtgcgcacaaaaagaaatctttgagccgtcctgagctgctggttatcggggctctttcaggtctaactgcaagcacgatcagcttccctcttgaagtggcaaggaagcgccttatggtaggatccctgcaagggaagtgcccaccccacatgatcgcggcgttagccgaggtgatccaagaggagggtgccaaggggcttttccgaggatgggcggcgagctccctgaaggtcatgccaacgtccggtgtcacctggatgttttacgaggcatggaaggaccttcttttgagttcacggctccatgcgtagcaggagcttgaagaagtcgggctcttgcattgtcacagaataaatttgttgcgctgtgtcggattttcaacatttttttcttcttaaaaagtcgcacacatgccaaccatttaggagagaagaaggccatcttgtgctggttgcacccttgattagcagcactagccaattggccttcgctgacctgggattatctaactactagcaactctgagcagactcaacctggactgggtatgcattggccccaggcatcgttgttgcgaaatttgtctactaatgaaaaacaaggactattcatgaaccttttgtcactgaatgttgcatgttttgtatgtgtggggcatttatccggttcttaatgagtctcaatgttacacaatattatacatctactggtccaaaaacgagtgttgttgtgggaaatgtgcaaatagactttgttctaatttctcatacgagaactatattagcatttgtgtatgctacaccctcagtgttccaattatagttcagttatgttttgtactaagtcaaacttatcaagagttagtcaagttttagaaaaatatgtgccagcatctacaagtttgaaaagatgcactagcaggacatatttcatggagtggttaacaaaaaaggtattgtagacgttgaagcatttcatggag

SEQ ID NO: 4228 - DNA, 1628 bp, Setaria italica
ccgtagacgtctcgggctctcagcgcagagctttgccaagattccctctctccggcgccaccaccctttttctttctcctccttccctcccttcccctacaaaagccgcgagaagcggcggagacgaggactaggaggaggactacccttttgcgcctgggcccctcccgctctgccgcattcgcgtccccgacccgctcgagtaggagccatgggcctggaggaggcggggcgcgccgccgccgccaccggcaagaagctcgcgctggcgagcatcagcttcgcggacgtccgcgtgggcgccgccgggggcgccggatacaaggacgacctgctcgtcgtggggctgcccgtgcccaaggatgacggcctcgacgtcgtcggggacctggccgtcaggctgccggatgtaggcgccgccgtcaggacttttctgaggaatagagaagttgcggaattcgtcagtggagcaatggctggggcaatgactaaggctgttctagctcctctagaaacaatcaggacaagaatggttgttggggtaggatcaaaacatatttttggtagttttgtggagatcattgaacagaatggctggcaagggctctgggcaggcaatactataaatatgctccggatcatcccaactcaagcaattgagcttggaacatttgagtgtgtcaaaaggagtatggcatctgcacaagagaaatggaaagaggatgggtgcccaaagatacaacttggcaatttgaaaatcgagctgccatttcacttattatcaccgattgccattggaggtgcagttgctggaatagctagcagtttagcgtgccatcctcttgaggttcttaaggatcgtatgactgtcaatcgcgaggcttatcctagtattgttattgccttcaacaagatttaccgcgctgacggcattggtggtctttatgctggcctctgcccaacattagttggcatgcttccatatagtacatgctactatttcatgtacgagacaatcaagacttcttactgccgtgcacagaaaaagaaatctttgagccgtcctgagctactggttattggggctgtttcaggcctaactgcaagcacaatcagcttccctctggaagtggcaaggaagcggcttatggtgggagccatacgagggaagtgcccaccccacatgattgcggcattagctgaggtggtccaagaagagggcttcaaggggcttttccgaggatgggcagcgagctccctgaaggtcatgccgacgtctggtgtcacttggatgttctatgaggcatggaaggagatcctattggctccccagctccatgcctagcaagagcacgcagctcaacaagggcattggcactgagacagaataagtttgttctgctgtgtgggatttccaatctttttctcttttcaaatcccacatgtgccaagtatctaggcaaaaaaggccatcttgtgcggtttggccgatgattagaagcattagtttgattatcctatgctaacctggattgtctaattactagcaactgttaacagaaagggtatgcatcggccccaatcattgttgtgaacactaataaataaataagttacctcttctggga

SEQ ID NO: 4229 - DNA, 1977 bp, Setaria italica
gtaaattctctgcgcgttctcgaaaaaagaatacacgtacaatattgtgaatttgcagataataaaaacagggaaatacgggataaatacgccaccgcgctaccccctacgcgccgtgattccgtgaagccgtagacgtctcgggctctcagcgcagagctttgccaagattccctctctccggcgccaccaccctttttctttctcctccttccctcccttcccctacaaaagccgcgagaagcggcggagacgaggactaggaggaggactacccttttgcgcctgggcccctcccgctctgccgcattcgcgtccccgacccgctcgagtaggagccatgggcctggaggaggcggggcgcgccgccgccgccaccggcaagaagctcgcgctggcgagcatcagcttcgcggacgtccgcgtgggcgccgccgggggcgccggatacaaggacgacctgctcgtcgtggggctgcccgtgcccaaggatgacggcctcgacgtcgtcggggacctggccgtcaggctgccggatgtaggcgccgccgtcaggacttttctgaggaatagagaagttgcggaattcgtcagtggagcaatggctggggcaatgactaaggctgttctagctcctctagaaacaatcaggacaagaatggttgttggggtaggatcaaaacatatttttggtagttttgtggagatcattgaacagaatggctggcaagggctctgggcaggcaatactataaatatgctccggatcatcccaactcaagcaattgagcttggaacatttgagtgtgtcaaaaggagtatggcatctgcacaagagaaatggaaagaggatgggtgcccaaagatacaacttggcaatttgaaaatcgagctgccatttcacttattatcaccgattgccattggaggtgcagttgctggaatagctagcagtttagcgtgccatcctcttgaggttcttaaggatcgtatgactgtcaatcgcgaggcttatcctagtattgttattgccttcaacaagatttaccgcgctgacggcattggtggtctttatgctggcctctgcccaacattagttggcatgcttccatatagtacatgctactatttcatgtacgagacaatcaagacttcttactgccgtgcacagaaaaagaaatctttgagccgtcctgagctactggttattggggctgtttcaggcctaactgcaagcacaatcagcttccctctggaagtggcaaggaagcggcttatggtgggagccatacgagggaagtgcccaccccacatgattgcggcattagctgaggtggtccaagaagagggcttcaaggggcttttccgaggatgggcagcgagctccctgaaggtcatgccgacgtctggtgtcacttggatgttctatgaggcatggaaggagatcctattggctccccagctccatgcctagcaagagcacgcagctcaacaagggcattggcactgagacagaataagtttgttctgctgtgtgggatttccaatctttttctcttttcaaatcccacatgtgccaagtatctaggcaaaaaaggccatcttgtgcggtttggccgatgattagaagcattagtttgattatcctatgctaacctggattgtctaattactagcaactgttaacagaaagggtatgcatcggccccaatcattgttgtgaacactaataaataaataagttacctcttctgggatgtgccttgggatgtgccttgcaagttattgagttgcatgcaccaaccagttcaacctaaaagtttaaattgatagggaaagttcaacctaaaagtttaaactgacagggaaaggtgagcaattcacttatacttcaacacttcccctcacgtgtaggctctcttaagccgcatacgtggaaattggagtgtgctgcaattattttatttaattgtgccg

SEQ ID NO: 4230 - DNA, 1734 bp, Panicum virgatum
caccctttttctttctcctcctccctccctcgcttcgcttccatacaaaagccgcgagaagcggcggagacgaggaggaggaccacccttttgcgccccggacgcctcccgttccggcattcgcgacctccacccgctcgaggaggagccatgggcgtggaggaggcggggcgcgcccgcggcggcggcaagaagctggcgctggcgagcatcggcttcgcggacgtccgcgtgggcgccgccgggggtgccggctacagggaggacctgctcgaggtggggctgcccctgcccgggcccaaggacgacgggggcctggccgtcaggctgccggacgttggcgccgccgtcaggacttttctgaggaatagagaagttgcagaattcgtcagtggagcaatggccggtgcaatgaccaaggctgttctagctcctctagaaactatcaggacaagaatggttgttggggtaggatcaaaacatatttttggtagttttgtggagatcattgaacaaaatggctggcaaggactctgggcaggtaatactataaatatgctccggattatcccaactcaagcaattgagctcgggacatttgagtgtgtcaaaaggagtatggcatctgcacaagagaaatggaaagaggatggatgccccaagatacaacttggcaatttgaaaatcgagcttccatttcacttattatcaccgattgccattggaggtgcagctgctggaatagctagcactttagcatgccatcctcttgaggttcttaaggaccgtatgactgtcaatcgtgaggcttatcctagtattgccattgccttcaacaagatctaccgtgctgatggcattggtggcctttatgctggcctctgcccaacattagttggcatgcttccttatagcacatgctactatttcatgtacgagacaatcaagacttcttactgccgtgcacagaaaaagaaatctttaagccgtcctgagctactggctattggggctctttcaggcctgactgcaagcacaatcagcttccctctggaagtcgcaagaaagcggcttatggtgggagccatacaagggaagtgcccaccccacatgattgcggctttagccgaggtggttcaagaggagggcttcaaggggcttttccgtggatgggcagcaagctccctgaaggtcatgccaacgtccggtgtcacctggatgttttatgaggcgtggaaggatatccttttggctccacggctccatgtctagcaagatcacgcaactcaacaagggcattagcactgctgcaaaataaatttgtcctgctgtgtggccgtgtgtgtgtgtgtgggatttccaatctttttttctcttttcaaatcccacatgtgccaacgatgtaggcaaaagaaggccatcttgtattcttgtgcggtttggccgatgatcagaagcattagctgtttgtcctctgctaacctggattgtctaattagtagcaactgttaacagacagtctctgggctgggaatgcattggccccaaccattgttattgtgaaactttcactaatgaataaataagttacctcttctcagatgtgcctcgcgattgtcgcagaaatgatccagtgcttcgtgagtcgatgctatactacactgctgcatctagtcctctactctaaaatgaatgtgcttcctataaaaaaagaaaaggaaattgctagcgagg

SEQ ID NO: 4231 - DNA, 1804 bp, Panicum virgatum
gtaaattctcccagtgttgaccccaaaaaaaaaacaattttttgaatttcagataatgaaaataggaagaatacgagataaatacaccaccatgcttgatgctgctataccctctatacgcatgtacgctatgcccgtgaaaccgtagacgtctcagcctctcgggtctcggcgcttttgctcagagattccctcttcggcgccaccacccttttctttctcctcctcccctctccctccttcgcttccctacaaaagccgcgagaagcggcggagacgaggaggaggaccaccccacccttttgcgccagggcccctcccgttccgcgcattcgcgtcccccacccgctcgaggaggagccatgggcgtggaggaggcggggcgcgcccgcggcggcggcggcaagaagctggcgctggcgagcatcggcttcgcggacgtccgcgtgggcgccgccgggggtgccggctacagggaaggcctgctcgaggtggggctgcccctgcccgggcccaaggacgacgggggcctcgccgtcaggctgccggacgttggcgccgccgtcaggacttttctgaggaatagagaagttgcagaattcgtcagtggagcaatggccggtgcaatgaccaaggctgttctagctcctctagaaactatcaggacaagaatggttgttggggtaggatcaaaacatatttttggtagttttgtggagatcattgaacaaaatggctggcaaggactctgggcaggtaatactataaatatgctccggattatcccaactcaagcaattgagcttgggacatttgagtgtgtcaaaaggagtatggcatctgcacaagagaaatggaaagaggatgggtgccccaagatacaacttggcaatttgaaaatcgagctgccatttcacttattatcaccgattgccattggaggtgcagctgctggaatagctagcactttagcatgccatcctcttgaggttcttaaggaccgtatgactgtcaatcgtgcggcttatcctagtattgccattgccttcaacaagatctaccgaactgatggcattggtggtctttatgctggtctctgcccaacattagttggcatgcttccttatagtacatgttactatttcatgtacgagacaatcaagacttcttactgccgcgcacagaaaaagaaatctttaagccgtcctgagctactggttattggggctgtttcaggcctaactgcaagcacaatcagcttccctctggaagtcgcaagaaagcggcttatggtgggagccatacaagggaagtgcccaccccacatgattgcggcattagccgaggtggttcgtgaggagggcttcaaggggcttttccgaggatgggcagcaagctccctgaaggtcatgccaacgtccggcgtcacctggatgttttatgaggcgtggaaggatatccttttggctccacggctccatgtctagcaagagcacgcaactcaacaagggtattagcactgctgcaaaataaatttgttctgctgtgtggccgtgtgggatttccaaatcttttctcttttcaaatcccacatgtgccaatgatggaggcaaaagaaggccatcttgtgcggtttggccgatgatctgaagcattagttgtttgtcctctgctaacctggattgtctaattagtagcaactgttaacagacagtctctgggctgggaatgcattgcccccaaccattgttattgtgaaactctcactaatgaataaataagttgcctcttctcagatgtgcct

SEQ ID NO: 4232 - DNA, 1706 bp, Oryza sativa
aaaaattcttgcgcttcgccacgtcagcatcctcctccttccttccttcctctcctctccaccctttcctccaaaagcggcgacgagcggcggcgaggagaggagccaccaccattttgcggtttgccccctgcggtttcgcgcatttgcgttcctctcgagtagccatgggcatggaggaggagggggtggcgcgcggcggcggcggcaagaagctcgcgctcgccagcatcggcttcgcggacgtccgtgtcggcgccgtggctggcggcggcggcgccggcgccggcggcgggtacaaggaggacttgttagtcgtgggcctgcccaaggacgacgacttcgatgtcgccaaggtcgtcggggacgtggccgtcgggctcccggacgtcggcgccgccgtcaggaatttcctgaggaatagagaagttggagaattcgtgagtggggcattagctggtgctatgactaaagctgttcttgctcctctagaaactatcaggacaagaatggttgttggggtaggatcaaaacacatttttggtagttttgtggagatcgtcgaacaaaatggctggcaaggactctgggcaggtaatacaataaatatgcttcggattattccaactcaagcacttgagcttggcacatttgagtgtgtcaaaaggagcatgacagaagcacaagagaaatggaaggaagatgggtgcccaaatatacaaattggcaatttgaaaattgagctaccacttcacttgctctctccaattgctgttggtggtgcggctgctggaatagttagcaccttagtgtgccatcctcttgaggttcttaaggaccgcctgactgtcaaccgtgaggcttatccaagtatcggccttgccttcaacaagatataccaaactgatggtattggtggtctctatgctggcctctgcccaacactagttggcatgcttccttatagcacctgctactatttcatgtatgagacgatcaagacttcttattgccgtgcacataaaaagaagtccttgagccgtcctgagctactcattattggagctctttcaggtctaactgcaagtacaataagcttccctctggaagtggcgaggaagcggcttatggttggaaccctgcaagggaaatgcccgccccacatgatcgcggccttagctgaggtgttccaagaggagggcatcaagggactttaccgcggatgggccgcaagctccctgaaggtgatgccgacctccggcattacctggatgttctatgaggcatggaaggacattcttttggctccagagctgcacacctagcactagcagtctagcatgcctggaattgttcaacatggcaggcattgctacagaataaatttcttgtgctgtgaggcagtgtgggatttccttcttttttttttcttctttgaaatcccacacatgccagtcatctagctaagaggccattttgtgccaatgattagaagcattagttaattggctttattcaacctggattgtttaagccagtaattgttgacaaggggggcagacattccatgccatgtggcttgagttatgcattgcccccaaaattctgtgaaattccccaagtaatgaagaaaagggggttaattcccagagtagcctttgtacgaatgtgtgattcagaaatgctatctgccattctttttctgc

SEQ ID NO: 4233 - DNA, 1562 bp, Brachypodium distachyon
gggctcgagaagagccgaagagcgccgccatttcgcgcccgggtccccattcggcgaattttcggggccggagccatgggcgtggaggtggcggcggctcgcggcaggaataagctcgcgtttgccagcatcgggtttgccgaggtccgcgtgggcggtggcggcggcgggttgaaggatgatggcctgctgggggctgggctgcccaaggacgccgagtacctgtttggggacgtgtccgtccggatgccggacgtcggcgccgccgtcaggacattcctgaggcgtagagaagtcggagaattctttagcggagcactggctggtgctatgactaaagctgttcttgctcctctagaaactatcaggacaagaatgattgttggggtaggatcaaaacatatttttggtagttttgtggagatcatggaacacaatggctggcaaggactttgggccggtaatgctattaacatgattcgtatagttcctacacaagcaattgagcttggcacattcgagtgcgtcaaacggagtatgacatcagcacaagagagatggaaagaggatggtggcccaaagatacaacttggtggtttgacgattgagctgcctcttcatctgttatctccagttgccattggtggtgcagctgctgggatagttagcactttagtgtgccatcctcttgaggttcttaaggatcgcatgactataaaccgtgaggcctatcctagcatcgcccttgccttcaacaagatctaccgaactgacggcctagctggcctatacgctggtctctgcccaactctagttggcatgcttccttacagcacatgctactatttcatgtacgagacaatcaagacttcctactgccgcacacataaaaagaaatctttgagccgccctgaactactgatcataggagccctttcaggtttgactgcgagtacgatcagcttccctctcgaagtggcgaggaagcggctgatggtgggagccctgcaagggaaatgcccaccccacatggtcgcggccttgggcgaggtgatcagggaggagggcttaagggggctgtaccgtgggtgggctgcgagctccctgaaggtcatgccgacgtccggcatgacctgggtgttctacgaagcatggaaggacatccttctggctcctcacctccacatctagcttccctgaggttgttcagcaggggcactgccacggaataaacttgtgatgtgtggccattagaagcctctgtttgttaatttacattttgctaacctggctgttcaacagactggatcaatggctgatttttcattatgcattggccatcgggaccgttggccatttggccctaagcactgttactgtgaaataccctcagtaatatgaaaaaaaaagggagatttcgttcccagattacctttcgtgtgaatttcagccacttcttgctgctccctccgatcctaaattgttgtcgaaatattacatgtatttagacattttttaagaattgttacatccatatttgggtaaatttgagacaagaattt

SEQ ID NO: 4234 - DNA, 1636 bp, Brachypodium distachyon
tttccggcgccacgtcatcgcccttcttcttccgcttctttcttcttcgaacaaaaaggcgcaacagagcgcgggctcgagaagagccgaagagcgccgccatttcgcgcccgggtccccattcggcgaattttcggggccggagccatgggcgtggaggtggcggcggctcgcggcaggaataagctcgcgtttgccagcatcgggtttgccgaggtccgcgtgggcggtggcggcggcgggttgaaggatgatggcctgctgggggctgggctgcccaaggacgccgagtacctgtttggggacgtgtccgtccggatgccggacgtcggcgccgccgtcaggacattcctgaggcgtagagaagtcggagaattctttagcggagcactggctggtgctatgactaaagctgttcttgctcctctagaaactatcaggacaagaatgattgttggggtaggatcaaaacatatttttggtagttttgtggagatcatggaacacaatggctggcaaggactttgggccggtaatgctattaacatgattcgtatagttcctacacaagcaattgagcttggcacattcgagtgcgtcaaacggagtatgacatcagcacaagagagatggaaagaggatggtggcccaaagatacaacttggtggtttgacgattgagctgcctcttcatctgttatctccagttgccattggtggtgcagctgctgggatagttagcactttagtgtgccatcctcttgaggttcttaaggatcgcatgactataaaccgtgaggcctatcctagcatcgcccttgccttcaacaagatctaccgaactgacggcctagctggcctatacgctggtctctgcccaactctagttggcatgcttccttacagcacatgctactatttcatgtacgagacaatcaagacttcctactgccgcacacataaaaagaaatctttgagccgccctgaactactgatcataggagccctttcaggtttgactgcgagtacgatcagcttccctctcgaagtggcgaggaagcggctgatggtgggagccctgcaagggaaatgcccaccccacatggtcgcggccttgggcgaggtgatcagggaggagggcttaagggggctgtaccgtgggtgggctgcgagctccctgaaggtcatgccgacgtccggcatgacctgggtgttctacgaagcatggaaggacatccttctggctcctcacctccacatctagcttccctgaggttgttcagcaggggcactgccacggaataaacttgtgatgtgtggccattagaagcctctgtttgttaatttacattttgctaacctggctgttcaacagactggatcaatggctgatttttcattatgcattggccatcgggaccgttggccatttggccctaagcactgttactgtgaaataccctcagtaatatgaaaaaaaaagggagatttcgttcccagattacctttcgtgtgaatttcagccacttcttgctgctccctccgatcctaaattgttgtcgaaatattacatgtatttagacattttttaagaattgttacatccatatttgggtaaatttgagacaagaatttag

SEQ ID NO: 4235 - DNA, 923 bp, Saccharum officinarum
cacccacatccgagtacagtcacgtagcggctagctagctagctagctcatcgatctgttgcgcgacgacatggcggccaccagaagcagcaagtcgtcgtcgtcctcgagctcgccgcggcagctggtggctgccgcgctgctcgtggccgtcctggtggcggcgtccgtgctggtggcggcggaggcggtgtgcgacatgagcaacgagcagttcatgtcgtgccagcccgcggcggccaagacgacggacccgccggcggcgccgtcgcaggcgtgctgcgacgcgctggcgggcgcggacctcaagtgtctctgcggctacaagaactcgccctggatgagcgtctacaacatcgacccccagcgcgccatggagctcccggccaagtgcggcctcgccacgccacccaactgctagccaagctaagggctggcattgttgtacgtgtgtgtgtgcatcgatctgcagcaggctgcagggcccgtacgtgtctcatcatgtcacgtactaaaatgttcttgtcgagtgtgtgctccatgctggcgtgcgtgtctattttatgtgcgtcgtcgtgtcgttggtacatatagatgcccgtggttggcatggcttggactgtttgtgcgtacgcgcacatgtgggatgtgtcactaactagcttgtcatgtactccgtcgtgtgtgtgcctgccgggcaagttgcatcttgtgccctcgctcgctctctctttctatctataaagagtgtttttcatcctaaataaacattaattagtacttcgttgtcttccatctcaggtcattttttgtgtgcaagaactacttcatatctgcatgtacgaggcactactatattgtttaaggtcattacattaacatgttacttcgagatgaagtgactagggatgattattctagtt

SEQ ID NO: 4236 - DNA, 799 bp, Saccharum officinarum
cacccacatccgagtacagtcacgtagcggctagctagctagctcatcgatctgttgcgcgacgacatggcggccaccagaagcagcaagtcgtcgtcgtcctcgagctcgccgcggcagctggtggctgccgcgctgctcgtggccgccctggtggcggcgtccgtgctggtggcggcggaggcggtgtgcgacatgagcaacgagcagttcatgtcgtgccagcccgcggcggccaagacgacggacccgccggcggcgccgtcgcaggcgtgctgcgacgcgctggcgggcgcggacctcaagtgtctctgcggctacaagaactcgccgtggatgagcgtctacaacatcgacccccagcgcgccatggagctccccgccaagtgcggcctcgccacgccacccaactgctagccaagctaagggctggcattgttgtacgtgttgttgcgttgctgtacgtgtgtgtgtgcatctgcagcaggctagctagctgcagggcccgtacgtgtcacatcttgtcacgcactaaaatgttcttgtcgtgtgtgcgctccatgctggcgtgcgtgtctattttatgtgcgtcgtgtcgttggtacatatagatgcccgtggttggcatggtttgggctgtttgtgcgtacgcgcacatgtgtgatgtgtcactaactagcttgtcatgtactcggtcgtgtgtgtgcctgccgggcaagttgcatcttgtgccctcgctcgtcgctctctctttctatctataaagagtgtttttcatcctaaataaacattaattagt

SEQ ID NO: 4237 - DNA, 825 bp, Saccharum officinarum
cacccacatccgagtacagtcacgtagcggctagctagctagctagctcatcgatctgttgcgcgacgacatggcggccaccagaagcagcaagtcgccgtcgtcctcgagctcgccgcggcagctggtggctgccgcgctgctcgtggccgtcctggtggcagcgtccgtgctggtggcggcggaggcggtgtgcgacatgagcaacgagcagttcatgtcgtgccagcccgcggcggccaagacgacggacccgccggcggcgccgtcgcaggcgtgctgcgacgcgctggcgggcgcggacctcaagtgcctgtgcggctacaagaactcgccgtggatgaccgtctacaacatcgacccccagcgcgccatggagctcccggccaagtgcggcctcgccacgccacccaactgctagccaagctaagggctggcattgttgtacgtgttgttgcattgctgtactacgtgtgtgtgtgcatctgcagcaggctagctagctgcagggcccgtacgtgtcacatcttgtcacgcactaaaatgttcttgtcgtgtgtgtgctccatgctggcgtgcgtgtctattttgtttgcgtcgtgtcgttggtacatatagatgcccctggttggcatggtttggactgtttgtgcgtacgcgcacatgtgggatgtgtcactaactagcttgtcatgtactcggtcgtgtgtgtgcctgccgggcaagttgcatcttgtgccctcgctcgctcgctctctctctctttctatctataaagagtgtttttcatcctaaataaacattaattagtacttcgttgtcttc

SEQ ID NO: 4238 - DNA, 636 bp, Saccharum officinarum
cacccacatccgagtacagtcacgtagcggctagctagctagcaagctcatctgtcgcgacgacatggcggccaccagcagcagcaggaagtcttcgtcctcgagctcgccgcagctgctggctgccgcgctgcttgtggcggtgtccgtgctggtggcggcggaggcggtgtgcgacatgagcaacgagcagttcatgtcgtgccagcccgcggcggccaagacgacggacccgccggcggcgccgtcgcaggcgtgctgcgacgcgctggcgggcgcggacctcaagtgcctgtgcggctacaagaactcgccctggatgagcgtctacaacatcgacccccagcgcgccatggagctcccggccaagtgcggcctcgccacgccacccaactgctagccaagctaagggctggcattgttgtacgtgttgttgcattattgctgtacgtgtgtgtgtgcatctgcagcaggctagctagctgcagggcccgtacgtgtcacatcttgtcacgcactaaaatgttcttgtcgtgtgtgtgctccatgctggcgagcgtgtctattttgtgcgcgtcgtgtagttggtacatatagacccccgaggtttgcatggtttggactgttcgtgcgtac

SEQ ID NO: 4239 - DNA, 985 bp, Zea mays
ccggaacacccgacaacccaggaccagaacagccgcgtcgaggcggccctcgagacccccggccccgacccatcccaccaccacccccacccccacctcgcctcccggatccgcacccgatgggcagcctcggcggcgacgcggagccgcagggcgcgaggcggcggccgcggttcctgtgcctgcacgggttccgcaccagcggcgagatcatgcgcaagcaggtgctcgggaagtggcccgccgacgtcacggcgcgcctcgacctcgtcttcgccgacgcgccgttccccgccgagggcaagtccgacgtcgacggcatcttcgacccgccctactacgagtggttccagttcgacaagagttttatggagtacaggaatttcgacaagtgcctggcctacatcgaagagctgatgataaaagacggccccttcgacggactgatgggtttctcccagggttccattctgtcggcggcgcttccggggctccaagaacaagggctggccctgactagagtcccgaaggtcaagtacctcatcatcatcggtggcgctaagttccagtcacccacggtggccggcaaggcgtacgccaacaagatcgcatgcccctcgcttcacttcatcggtgaaaacgacttcctgaaagtccatggtgaaaagctgatagaatcatgcgtggacccattcgtaatccgtcacccaaagggccacacagttccgaggctcgatgacgagagtttagtggtcatgcaccgtttccttgagaagattgagggggaggtacttgagtattcgtccaaagatgtcaacgaaaccgaagtgggcatgtgataaagactttagaccattagtacttgatgttggcgaaaaggctatacttgtactatttatttacagaatgaacatgtgatgtaacctcgattttcatgaggcatgattatgaaaaatacagaataattgttttatattctatatta

SEQ ID NO: 4240 - DNA, 1029 bp, Setaria italica
ccgcctcgagccctcgacccccctcgacacaccaccggcgatcgaggagcccccgaccaggcgcgcccgcacacacccctcgtctcctctcctgatccacgggctcgctcggcgcccggccggacccgcggacgatgggcagcctcggcggcgaggatcggcggcagccggaggcgcggggtaggcggccgcggttcctgtgcctgcacgggttccgcaccagcgccgagatcatgcgcaagcaggtggtgggcaagtggcccgccgacgtcacggcgcgcctcgacctcgtcttcgccgacgcgcccttccccgccgagggcaagtccgacgtcgacggcatcttcgacccgccctactacgagtggttccagttcgacaaggagtttacagagtacaagaatttcgacaagtgcctcgcctacatcgaggagctcatgatcaaggatggccccttcgacggattgatgggtttctcccagggtgccattctttccgcggcgcttcccgggctccaagaacaagggctggccctgactagagttcccaagatcaagtacctgatcatcatcggcggcgccaagttcctgtcgccgactgtggccgagaaggcgtacgccaacaagatcgcgtgcacctcgcttcacttcatcggtgacaacgacttcctgaaaacccatggtgagaagctcatagaatcatgcgtcgacccgttcgtcatccgtcacccaaagggccacacagttccaaggctcgatgacaagagccttcaagtcatgctccgtttccttgagaagattgagaaggagacatctgagcatgcgtccaccgatgttgacgaaaaagaagtgtgcttgtgataggacgtaggttattagcatctgaatactcatgatactagtattgtagaaataaacatacaactgtagcctcgttattttgaggcacgactattctgtacctaaatgaagaataatcattttgtatcttctattcacttcaatttgctgaatactccctccgtttcga

SEQ ID NO: 4241 - DNA, 4426 bp, Setaria italica
ggcaacagcagcggacgtggggcgcacgcggcccacgccccacctgcacgcccaaaacgggcggtcgcccgcccggccccaccacgccgcgggatcgaaccatcatatataccccgccccacgccgcggcctgccggccacagccagccggccgcctcgagccctcgacccccctcgacacaccaccggcgatcgaggagcccccgaccaggcgcgcccgcacacacccctcgtctcctctcctgatccacgggctcgctcggcgcccggccggacccgcggacgatgggcagcctcggcggcgaggatcggcggcagccggaggcgcggggtaggcggccgcggttcctgtgcctgcacgggttccgcaccagcgccgagatcatgcgcaagcaggtggtgggcaagtggcccgccgacgtcacggcgcgcctcgacctcgtcttcgccgacgcgcccttccccgccgagggcaagtccgacgtcgacggcatcttcgacccgccctactacgagtggttccagttcgacaaggagtttacagagtacaagaatttcgacaagtgcctcgcctacatcgaggagctcatgatcaaggatggccccttcgacggattgatgggtttctcccagggtgccattctttccgcggcgcttcccgggctccaagaacaagggctggccctgactagagttcccaagatcaagtacctgatcatcatcggcggcgccaagttcctgtcgccgactgtggccgagaaggcgtacgccaacaagatcgcgtgcacctcgcttcacttcatcggtgacaacgacttcctgaaaacccatggtgagaagctcatagaatcatgcgtcgacccgttcgtcatccgtcacccaaagggccacacagttccaaggctcgatgacaagagccttcaagtcatgctccgtttccttgagaagattgagaaggagacatctgagcatgcgtccaccgatgttgacgaaaaagaagtgtgcttgtgataggacgtaggttattagcatctgaatactcatgatactagtattgtagaaataaacatacaactgtagcctcgttattttgaggcacgactattctgtacctaaatgaagaataatcattttgtatcttctattcacttcaatttgctgaatactccctccgtttcgaactgcaggctgttttatctttttttagatttataggtattattatacatctatatatagactagatatgcacagtggaatggaggtgcacagtggaatggaggggtaatatctgatccacaggttcatgacacggagctagcgcatatcacacattgaaatgctacatcgctgtagtttgctcaggcctgtacaaagtttaggccaatttgactaacttggcttccgtgcatatggacagaaaaatatatagttcgcagacatatagagtgtgctatcccaaacaaaaactactccaataatcctatttgctggatttttaatagagcaactgtgcactggccagccagagatgcatgcagtggaatttaaaatccctcggtcctgtttgagacgaatgcaattgggttggtggggggaatgcgttcgttttcatgtccaaataaaaaagaaattagttcgacatggggaattaagtaacacacacgattgaaaattagaagtgacaggaaaaaattatctcagtgtttaggtactggagaaaagaatatcacttcaagcaaaaacagaaaggtccatctaggcctttgaatctaaaacaaacgtctttgattaacaaccccataaccttggagaagaaaaaggagaagctgactggtgttctgaaaaaaaaaaccccgcgtgccggaacggtgagaaatgtccggggtgcattttagcagccctaaaacacaatgacgcccgagcaactccaagagtactctaaaaaattcttccccaaaactatgtattgggggttctttaaaaaaaaatttcccctaaaaacatatcaatccacaacagatcgctaataaatagcccccaatattttaaaacaggccacgtcatcgtattgggcccatcggaagggacgcgcgagtgtgcgggaatcaggattggaggaggaatgccaacgctaaaatatacgcggtggtaggctgttttttagcgttgctaaaaaattggggaaggtttgggtggactgttggagttcgttttttctcctttttccctaaaaaaaatattgggggtaagattagcggcctcttggagttgctcacaattgaaacgagggttaagctcacgttaaagttcatcaaaaactgtggagcgcagagtataccactcccacgaattatttgaggccattcaaacgaaccagctacttgcatagaaataaaacctgtacaacaactcatctgcaaattcttcttcttcttccttttttgtgaagaaagctcagacagccctgctgaatctgtgcggggcatggttgatcaacttgcagataaactgcaacagccacgtcagtacgctagatcagtcattttccctctgtataagattggttcattggttggatccgtgctccacaatcgttaatctcggcaggcggcacttgtctcctcgccggctggccagcttaaaacaagacgcgacagaagtcacgaaggcatccgcaccccaatcatggctatggttggctgatcctcccgtgatcttcagaacaaaacagtggcacgccccccggagtcccacgcccccctttctgtccttgctccccatggatttgatccgtactcctccagcgagatgcccgcggctgcggccgcggcagctcgcaccctccgccgcggcgccaccagcttccgtttcttgggcagcgctcccctgccacctaccagcctacgccgccgcgccctccccccaccagcgcgatcgccggccgcgccgcggcctgcggcttcggaacgccggcagcgagggggaggcggcgctagcggggcggcggcggccgcggttcctgtgcttgcacgggttccggaccagcgccgagatcttgcgcaagcaggtggtggggagatggcccgccgacgtcacggcgcgcctcgacctcgtcttcgccgacgcgcccttccccgccgagggcaagtccgacgtcgatggcatcttcgacccgccctactacgagtggttccagttcgccggcgagatctcggggggacaggatcccatcaagtgcaggaacttggacaggtgcttctcctacgtcgaggagctgatgatcagacaagggccgttcgacgggctgctaggattctcccagggcgccgtcgtatctgcagtgcttgcagggctccaggaacagactcgtctctgcgttttccggcaggggttggccttcactggggttgctaaggtgaagtgcgtgatagttatatccggggggaagatccaggctccggtggccgccgcaagggcgttcaacagcaagatcatgtgcccgtcgcttcacttcattggtgacgatgactttgtgaaggttcacagtgaagagcttgtagaagcatttgcggatccacttgttatacgtcatccctgcggccatactatacctaatcttgatgagaagggcctccaaactatgctcaccttcctagacaagattgagaggggaatatgggaacattcatcgaccgatactaagatcatggtctcaaattcggaggctcaaatatctgaagtttagaaaatgcacagaattgacatgttctaaagaaattcaaatccagagagtttggtaagacgttgagtgtcatatctaggaactttcccttacctaactccttcatatcaagaaccatccatcctgtttcattgatcatctaaaatggaccaaaatcattgccactttggcaaaatacccatatatttacacaagcgcgcgcacaagaacgagtgtgttcatcggtgttgaaaacgtgtgctgcacatgttacatgacttgctagatgtgatgagcacgtgtcatgtgtgcctagtaggtgtgatgttgcgagtgtgatgtgtacctggtggtgcttgtgtaaccgagaaaaaagaaagaaaacaatgccactgctaaaacctcttgcaaaagccgccgatttgggtattggacatggactcaatgaatggttgcataatcgagaggggtgtgctatagagtcaactgatttcaatcgatagatgcgtgtgttgattggtgtctggatcggaccctacttgattagggacccttatcattttttcttggtatgtggattattggtaaatatacaattgaaaagtaaagcactaagattttgaaagaagaggatcgctctaggaaattttagaattcagttaaaatttgtactaattaaatcctaagattttggatcctaaa

SEQ ID NO: 4242 - DNA, 1194 bp, Pennisetum glaucum
atagcacagccagagacagccggccggccgcaccagactccaccaccggcgacccgacgagccccatcgaccaggcgcgctcctctccgacccacgcgcgctcgctcgctcgctaggactaccggatccacgcgcgcgatgggcagcctcggcggcgaggaggcgccggcgccgccgggtagtaggcggccacggttcctgtgcctgcacgggttccgcaccagcgccgagatcatgcgcaagcaggtgctcggcaagtggcccgccgacgtcaccgcgcgcctcgacctcgtcttcgccgacgcgcccttccccgccgagggcaagtccgacgtcgagggcatcttcgacccgccctactacgagtggttccagttcgacaaggggtttacggagtacaggaatttcgacgagtgcctcgcgtacatcgaggagctcatgatcaaggatggccccttcgacggattgatgggtttctcacagggtgccattctatctgcggcgcttcccgggctccaagaacaaggtctggccctgactagagtcccgaagatcaagtacctgatcatcatcggcggcgccaagttcttcgcaccgacggtggcagagaaggcttacgccaacaagatcgcatgcccatcgcttcacttcatcggtgacaacgacttcctgaaaacacatggcgagaagctcatagaatcatgcgtcgacccgttcgtcatccgtcacccaaagggccacacagttccaaggctcgatgacaagagcctccaagtcatgctccgtttccttgggaagattgaggaggagacgtctgagcaggcatccaccgatgttgacgaaaaagaagtgtgcttgtgattgtgatagatattagcatctgggcactcatgatactagcattatattgtagaataaacatacaattgtagtggcctctcgttactttgaggcacgactattctgtacctaataattaggaagtgtctgcacatcaaacgtttgatttttagcaatccctccatcacttttttttagccgtggatgcttgatccgatggctagaggggagtcagctattcctttttttactgggattgattgagatttagttttctttcaatcacttttccaatacaatatataatacaggtttttttaaaaggaaaaaaaaaaaaaaggaaaaacaaaaaaa

SEQ ID NO: 4243 - DNA, 2797 bp, Saccharum officinarum
ctcctcctcgcctttccttgcttctttctcgtgagcagagcaggtggtgaggcagccacagccagcacgcgcggccacgcccacagagacgcggcacgccgccactcctcctccgactccgaggcgagcgagcacgccgcacgctccgcctcgcagtcgcagcccccgtctcctctcgcgcgtgctctctttctacctcttctccgtcctgcttgtcgccgcttcgctcgaaggcctcgatctggtagctctggcggggaacaaccacaagaattgaagacttgacactagcacagtctgctcatcaaagagccttggcagaatgcggtggctcggtctttcggttgatgtgttccgcagggggatctcattgaacctttactgccgtgtgattctgtaaatcgtctccgtggctaccggagaccgaccttccttggcacgcctcctgatttataggcttgtgaaggcactttacatcttccccacccagtcgttggcgtcgctgttaggccgttgtggttgtttggccaaaccgttgaggagaacggagtggagtactaatggtgtggaaagcagctgctcagacgagattccgcttgtttaagcatgagaacggaatcacagtgagagttattgcttgcttccagctgctgcaaaattgccaggccgagtacttccgccatctcctcaagcccgtgacgtagcttctctctctgctctccatctgctgctgaataaacttactgttttcggtttttctccatcacaattcaagtgggagaacttcctgttcatctgaactttctgctggtagttctgtccggtgatttgatttgttcatgggggacaaggttaatccctggtgccattggcataatcctccatggaaattcaacactgaaacttctgccggcaatctccgcccacctgatgttggccttgttaacgccaattcggtggcattgcctgcatatctgagcacagttgctgcacctgtgccttttttcacagcatcaattgctgagagacctctttcaacagctccgagatatgccacaacattggcaccaagtttggagttgcctgctctgtatccctcacgtaagagacctctagttttctaccagaaggaaaatcatgctcctatcgcagctcctttgctgagcaaggggccactggatcctgtgccagagctccaaggtagcaacgagaccaatgtaactgatgttggagcagaagaaactgagggtattcatgagaacacagatgagatcaatgcgctcctggactctgactcagatgaagggtatgaaaaactgcttgaactcgacagagtcaggcggcaatctcctgccgagaatgacaccctgagtgttgagtcagtagccagtgctggtgctgccacagattctgcaccgccagccaagaagagaaaactcagctcctgtactgacaagtctgttgtcgacactgccagttcagcaaggcctgatcattccatcgaacagaagcttcttgtgaatgactgtgatgcgcagtcatgctgcgtcggtgaagtggaaagcgaccacaagttttctctgggggaggtagaagcagcagaaggcgacagccctgatgatcagaagcgaagaagagagaggatccaagagactgttgctgccctcaggaatattgtccctgggggcatcgccaaagacgccaccgctgttcttgatgaagcaatctgctacttgcagtatctgaagctgaaggtcaagacgctgggagctgtctccctctagctgtgatctggttctctgaagccactggcttctgctgctctacatatatgaagtactagcattggtaataaggtgaagatgccaaagatatctcagattggtggtgcttcaggacgtgccagaggtgaataacggaagaagaaaaggtccaatggtgctttcttggcttccctgatggttctaatgatatcgtgggcaaatgactggcacgcagcattgcagtagcacttcaactgaagcaaggcgtgcgtgttttccttccattgtggcggagagcgctcctggccacctatgctgccctccagtgagctagcctaccaccatctttctgtctgagagcttgagtcttgtcataccagctgtgagtccctgtcggtgccccgcagtacctgcctgtatcacccaccttcctcaaaaggccctcgtgggtcggagcaacatacgtatgttatgcaaagctagaaacatcttttgctgagcgtgatccaaagcagagtgggggaaaggaaaggaggtccattccatgcaaagcgcgctgctgttgtgtttcgtcagccatggcttttgacccaactaacaaaggcgaagggggagatgagatggctcgaggttgggttgtgtggtgtatagttccttgctgcgggtccagccggtccaacaaagtgttgtgtgcctgatgtggagctcaacttcagcacaccgttgcgcttgcgctgcgcctttcatcatctgctgctgctgctgctgctgctttactttctctcatcaactaccattatatgtatgtattgtttgtggaatggctttgccacgcctttatacgcgttgtaatgatatacactcctgctttggctgggacctgctcagccagaataatgttgctttggtagtaaaaaaaaaaaaaagatcaaatataaaaaataaaactcaaaaaaaaaaaaaaaccccagggcggccgctgtagaggatgatagatgacgaaggacgcgtgcatgtgatatctagtagtcggc

SEQ ID NO: 4244 - DNA, 1376 bp, Echinochloa colona
tgtttaagcatgagaacggaatttctgtaagagttattgcttgcttccagccgctgcagaattgccaggccgagtacttccgccatctcctcaagcccgtgacgtagcttcgccctcctctccgtttgctgctgaagaaactttctgctttaggtttttctccatcacaattcaagtgggagaatttccagttcaactgaactttctgctggtaacttttttggtggtggtttcgtcatgggggacaaggttaatccttggtgccagtggcctaatcctccatggaaattcaacactgaaagctctgtgggcaatctctgcccacctgatgttgggcttgttgacaccaattcagtggcattgcctacatatctgaacacagttgctgcacccgtgccattcttcacagcatcagttgctgacagtcctcttccgatggctccaagatttgtcacaacattggcgcccagtttggaattgtctgcactgtatccctcacataagagatctctggttttctaccaggagaaccatcctattgcagctcctttggctagcaaggggacattggatcccgtgccagagctccaaggtagcaatgagactaatgtaactgatgttggcgcagaagaaactgagggtattcatgagaacacagatgagatcaatgcactcctggattctgactcggatgaagggtatgaaaaggtgcaagaactcaacagagttaagaggccatctcctgctgaggatgacaccttgagcgtggaatcggtggccagtgctggtgcgagcacaggttcagcgcgaccagccaagaagagaaggctcagttctggcactgacaagtccgttgtggacacagccagttcggccaggcttgatcattccatcgaacagaagcttcttgccaatgactgcgatgcacaatcctgttgcattggtgaagtggagagtaaccacaagttcactctgggtcttggggaaggtgaggcagcagaaggtgacagccccgatgatcaggagcgaagaagagagaggatccaagagactgttgctgcactcaggaagattgtccctgggggcatcgccaaagacgccactgctgttctcgatgaagcaatctgctacctgcagtatctgaaactgaaggtcaagacgcttggagctgtctccctctagctcctggacagttcagtgatttggtaatcgaagccactagcttctacagatatgaagtgctagtattagtaataaggtgaagatgccaaatagagctcaattttgtgctcgagggtgcactggagtgaaatgaaagaagagggtgatccagtggtgcttgcttcacctggcctgtacccagaaggcactgatga

SEQ ID NO: 4245 - DNA, 2183 bp, Pennisetum glaucum
ttgcttggcaaagcttttgaggagaacggagtggagtactaatggtgtggaaagcagctgctcagacaagattccgcgtgtttaagcatgagaacgggatcactgtgagagttatagcttgcttccagccgctgcagaattgccaggccgagtatttccgccatcttctcaagcccgtgacgtagcttctctctgctctttgtttgctgctgaagaaatttttctgctttaggtctttctccatcacaattcaagtgggagaatttcccattcatctgaactttctgctggtaatttttttggcggttgtctcttcatggcggacaaggttaatccttggtgccattggcctaaccctccatggaaattcaacaccgaaagctccgcaggcaatacctgcccacctgatattggacttgatgtcaattcggtggcattgcctacatatctgaacacagttgctgcacccgtgccatttttctcagcatcagttgctgacagacctctcccaatggctccaagatttgtcacaacattggcacccagtttgaaattgtctgcactgtatccctcacacaagagatctctggtattctaccaggagaatcatactcctattgcagctcctttggtaagcaaggggacactggatcctgtgccagagctccaaggtagcaatgagactaatgtaactgatgttggagcagaagaaactgagggtgttcacgagaacacagatgagatcaatgcactcctggattctgactcagatgaagggtatgaaaaggtgcaagaactcaacagagctaggaagccgtctcctgttgagaatgacaccttgagtgtggaatcagtggccagtgctggtgctagcgcaggttctgcgcgaccagccaagaagagaaggctcagctctggcactgacaagtctgttgtggacacggccagctcggcaaggcttgaccattccatcgaacagaagcttcttgtcaatgactgtgatgcacagtcttgctgcattggtgaagtggagagcgaccacaagttttctcttggggaaggtgaaggtgaagcaggagaaggtgacaacccagatgatcaaaagcggagaagagagaggatccaagagactgttgctgcgctcaggaagatcgtccctgggggcatcgccaaagatgccacagccgttctcgatgaagcaatatgctacctgcagtatctgaaactgaaggtcaagacgctgggagctgtctccctctagcccctgggcagtggtgattctttgttgaaacaactagcttctacatatatgaagtgccactgtgccagtattagtaataaggtgaaggtgccaaaggtaacacagtttggtgctttgagaggagcatgcactggaggaaaaggatccggtggtgtggtgcttgagaggggatgcacttgaggaaaaggatgcagtggtgtgtggtgcttgagagaggatgcactggacgaaaggaagggtggtgcttgcttggcttggcctgtacccataacagagagaaggctttgatgattgagtggacaatgagcatgcagcatcgcaacgctagttaaactgaatcaagccatgaaatgccttcttccattgcggtggactggagtgctatccatctttctgccacagggcttcgggtgaactttctcggtcacatactcactcactccctgtcggtggtgtgcctcagtgcctgcttcatcaccaccttcctcaaaagcccctcatggcgttgataggagcaatatgttatgcaaagctacaaagatctttcgccggcctgagcgtgatccaaagcaagcaaaggggagggaagggagcccattccatgcaaagggcactgctgttgtgctgtttgcggccatggctttttgaccccaactaaccaccaaaggcaaagggggtaaggaggaggagatagctcaaggttaggttgtgtggggagttcccctggggggtccaagcaaagtgttgtgtgcctccccagcggctttcttctttctccatcctcacgacgtactagtactacgcccactaccatatgttatgtgctctcgtctctgtaaactcgctttgccacgacggctttatacgccttgtaattgtaatgatactgccctggctgggacccaaagcaaagcaaacgaac

SEQ ID NO: 4246 - DNA, 2917 bp, Setaria italica
aaggcccgcccataagactccactccacgcgcctgccctgccctgcctcccctccccgcagcctcctccagtcctcctcctcctcctccctgcctttctcgtgagccacccacagcctcgcccacagagacgcccgcacgcctcgcctccgactccgaggcgcgcacgctcctcctcgcaatcgcagtcccgtctcctctcgcgcgcgtgctcccctcgactcgccccatcggtggcgcctcccgtccgctccatccggcttcttcttcccacgcgcgctcgatctggtaatttctggtgcagaataagcagaagaaccggagacttgacactctagcgcaggggccctgaaagcatgcgatggctgggtctttcggttgacgtgttccgctgggggatctccttgaacctttactgccgtgtgattctgtaaatcacctctgtggatactggagacattcctgattcataagcttgtgaaggcatttcaaaacttccccatccagtctctggtgttgctgttaaggtgctgtggttgcttggccaaagcttttgaggagaacggagtggagtactaatggtgtggaaagcagctgctcagacaagattccgcgtgtttaagcatgagaacggaatcgctgtgagagttatagcttgcttccagccgctgcagaattgccaggccgagtactttcgccatctcctcaagcctgtgacgtagcttcgctctgctctccatttgctgctgaagaaaaatttctgatttagatttttctccatcacaattcaagtgggagaattccccgttcatctgaactttctgctggtaatttttttggtggttgtctcttcatggcggacaaggttaatccttggtgccattggcctaatcctccatggaaattcaacactgaaagctctgcgggcaatatctacccacctgacattggacttgttgattccaattcggtggcattgcctacatatctgaacactgttgctgcacctgtgccatttttcacagcatcagttgctgacagacctcttccaatggctccaagatttgtcacaaaattggcaccgagttttgaattttctgcactgtatccctcgcataagagatctctggttttctaccaggagaatcatactcctattgcagctcctttgataagcaagcagacactggatcctgtgccagagctccaaggtagcaatgagactaatgtaactgatgttggagcagaagaaactgagggtattcatgagaacacagatgagatcaatgcactcctcgattctgactcagatgaagggtatgaaaaggttcaagaactcaacagagttaggaagccatctcctgctgagaatgacaccttgagtgtggaatcagtggccagtgctggtgctagtgcaggttctgtgcgaccggccaagaagagaaaactcagctctggcactgacaagtctgttgtggacacggccagttcagcaaggcttgatcattccatcgaacagaagcttcttgttaatgactctgatgcacagtcctgttgcattggtgaagtggagagtgatcacaagttctttctgggggaaggtgaagcagctgagggtgacaaccccgacgatcagaatcgaagaagagagaggatccaagagactgttgctgcactcaggaagattgttcctgggggcatcgccaaagatgccacagctgttctcgatgaagcaatatgctacctgcagtatctgaaactgaaggtcaagacgctgggagctgtctccctctagctcctgggcagttgtgatttggttaatgaagccactagcttgtgcatatatgaagtgccagtattagtaataaggtgaagatgccaaagaacaatttggtgcttgagaggatgcactggaagaaaaggatccagtggtgtggcgcttgcttggcatggcccgtaccaataacaggaggctttgatgattgagtggacaatgaacatgcagcattgcaaccccacttaaactgaatcaaggcatggaatgctttcttgcattgcggtggagtgctagtcctggaggccacaagttccaactagctcgccataccactctccggtgagctagttagtctaccaccatctttctgccacagggcttcggtgatcttctccgtcccagactccctgtcggtggtgcctcggtgcctttgcatcaccaccctcctcaaaagtccctcatggcgttgataggagcaatatgttatgcaaagctacaaagatctttcgccgagcctgagcgggatccaaagcaagcaaaggggcctaaaggagcccattccatgcaaagggcactgttgtgctgtttgcgcccatggctttttgacccaactaccggggggggggggggggggggggggggatagctcaaggttaggttgtgtggggagttcctggggtccaaccggtcctgcattcagcaaagtgttgtgtggagctcaacctcgtcaccgcctttcatcaaccccctgctttcttctttctccctcctcgctacgtacgcccactaccatatatgtgtgcccgtctctgtactcgctttgccacggctttatacgccttggctgggacccaaagcaaaacgctttggtacctttggtgtacgtattattgcagtagtttcctgtcgtagtgacatgtatgcggttggaaaatggcgcgctggttcgcgtgcacgtgcagcagcgagggggtagtagtatcctcaaaggattcccctgttggagccttgttcattgagtgtgcatcgctctcatgattgctttggaagagagaggctgcatcatgagttgagtcctctcctcccctcgtccactgcccttggagggtgcggcgccaggttgggaggctctgccggtgcc

SEQ ID NO: 4247 - DNA, 3514 bp, Panicum virgatum
tctttatctttaagaattgggaaaaatgatggctagcccatcgtgcaccagctttattaattaatccacggccatcttgtatcaatgtgtatggtattcgtatagcagacgacacatacacgttgctgccaaacaactagaaatcgaattaaaattgggaatggaaaataacaccgtataagctaggaaattaagttccggggcgataacaacggcgtctacagcgtaccatttgcagctaagcagataagcagagaaaatttctcgcgatgctaatcttcgagtggccgcggagctggaggaaatgatggccgccgcgtggcgggcgccccctccggaaagcggaaagccaccaccgccggggcctctgctgtcgtgggctcgtggcacggctcgggcagccggacagtgcacgcgcgcaaataccagcacgccgcggggtatttccgtccaggctcgcccaataaagactccgctccacgcgcctgcccctgctccgcgcagccgccgcctcctcctcctctgcctttctcgtgagccggcacgcgtggccacgcacagcctcgtcgtctccccacagccccccaacggaggcctcgcctccgactccgaggcgcgcacgctgcgaggtcctcgcagcccccgcctcctctcacgcgcgcgctttgctcgactcccacccccactcggccgcctcccctccgccccgtccggcctgtcgccttacctcgccgcgctcgatctggtaatttctggtgaaaaacaatcagatcggctggagacttgacactagtgcatagccctggcagtggcagcatgcggtggtttggtctttcggttgacgtcttccgcagggggatctccttgagcctctactgccgtgtgattctttaaatcacctccgtggatatcggagaccttccttcggcttgcgaaggcagctcaaaacctctccatcctggcgttgctgttaaggtgctgtggttgtttggccaaagcttttgaggagaacggagtggggtactaatggtgtggaaagcagctgctcagacgagattccgcgtgtttaagcatgagaacggaatcgctgtgagagttattgcttgcttccagccgctgcagaattgccaggccgagtacttccgccatctcctcaagcccgtgacgtagctttgctctgctctccgtttgctgctgaagaaattttctgctttaggtttttctccatcacaatttaagttggagaatttcccgttcttctgaactttctgctggtactttttttggtggttgtttcttcatgggggacaaggataatccttggtgccattggcctaattctccatggaaattcaacactgaaagctctgcaggcaatatctgcccacctgatgttgggcttgttgacactaatttggtggcattgcctacatgtctgaacacagttgctgcacctgtgccatttttcacagcatccattgctgaaagacctcttccaatgactccgagatttgtcaccactttggtgcccagtttggaattgtcttcactatatccctcgcacaagagacctctggttttctaccaggagaatcatactcctattacagctcctctggtgaggaaggggacgctggatcctgtgccagaactccaaggtagcaatgagactaatctaactgatgttggagcagaagaaaccgagggtattcatgagaacacagatgagattaatgcactcctgtattctgactcggatgaagggtatgaaaaggtgcaagaactcaacagaattaggaggccatctcctgctgagaatgacaccttgagtgtggaatcagtagccagtgctggtgctagcgcatcaggttctgcgcgaccggccaagaagagaaggctctgctctggcactgacaagtctgttgtggacacggccagttcagcaaggcccgatcattccatcgaacagaagcttcttgtcaatgactgtgatgcacagtcctgttgcattggtgaagttgagagcgatcacaagtttgctcggggggaaggtgaagctgtagaaggcgacagccccgacgaccagaagcgaagaagagagaggatccaagagactgttgctgcgctcaggaagattgtccctggtggcatcgccaaagatgccacggctattcttgatgaagctatctgctacctgcagtacctcaaactgaaggtcaagacgctgggagctgcctcgctctagctcctgctggacagttgtgggtgggttactgaagccactagtttctaaatacataaagtgctagtgttagtaataaggtgaagaagccaaagggagctcaattcggtgcttgatgaagacgcactggattgaaatgaaaaaaaagaagaagaagaaaaggacccggtgatgcttgcttggcttcccttgtacccagaagaaagctacttcaactgaaccgaggctgcaatgctttctttcattgtggtggagtgctagtcctggaggccacaagacccacatagctcgccatgccactccggtgagctagccaagcagactaccaccatctttctgcgacagagcttggaccttcttctccgtcccagagagagcccctgtcaggtggctcagtgcctgctgcatcaccttcctcaaaaggccctcatggcgttgataggagcaaacaaagtatgtttatgcaaagctacaggcatcttccgccgggcgtgatccaaagcagcaaagggcgctgttgtgttgtttgcttccatggcctttttgacctaactaccaaagccaaaggccaaagcggagatgggtcgaggttaggtttgccacttgtgtgttgagctcctggggtccagtccaactccaaaccaaccggtccagcactctagcaaagtgttctctgtgcacctgcctgagatgcggagctcagcctcagcaccgtcatccatccaacccgctcctttgttctccgctgcatagtatgccactaccatatttgtaagcaagtgttctcgctttgccttggacgggacgacccaaagcaatgctatgcatgcacctttggtgtgcgtatgctgctgttgctgtactgtacgccggtattattactgttgcagtctcctcttgtcgtagcgaaatgtatgctagtaagactgggaatgcggcgctgttttgcgtgcacgcccagcagcaaccagatggtacgtagtatcctcgaggattcccctgttggagccccttgttcatcaagtagtgtgcgcgcgtcgggctcatgattgcttggagaggctgcatcatgagctttgccattggctttgagtcttcccttgggagtgtgcgtggttgtgtgccagtgccaggttgggaggcgcctgcttgcctgcctggctctgccggccggggaacgggacgggacggggggatcggattccgagtgggcggcacgcgtgggtggggggacggggcgtgcggcgagcctcgcgacgggcatgagtgccg

SEQ ID NO: 4248 - DNA, 2071 bp, Panicum virgatum
cacgcgcctgcccctgcccctgccctgcctcccgcagcctcctgctcttcctttctcgtgagccagccagcacgcgcacaggccacagcctcgtcgtctccccacggaggcctcgcctccgactccgaggcgcgcacgccgcgaggtcctcgcagcccccgcttcctctcgcgcgcgtgctgtcttcgactcccacccccactcggccgcctcccctccgccccatccggcctgtcggctgtcgccgccgcttcgtacctcgccgcgctccatcgatctggtggtttctggtgaaaaacaagcacaagggctggagacctgacactagcgcataaccctggcagtggcagcatgcggtggtttggtctttcggttgacgtgttccgcagggggatctctttgaacctctactgccgtgtgattctgtaaatcacctccgtggatatcggagaccttccttcggcttgcgaaggcagttcaaaacttccccatcctgtctctggcgttgctgttaaggtgctgtggttgcttggccaaagcttctgaggagaacggagtggagtactaatggtgtggaaagcagctgctcagacgagattcaacgtgtttaagcatgagaatggaatcgctgtgagagttattgcttgcttccagccgccgcagaattgccaggccgagtacttccgccatctcctcaagcccgtgacgtagcttcgctctgctctccgtttgctgctgaagaaactttctgctttaggttttttctccatcacaattcgagtgggagaatttcccgttcatctgaactttctgctggtattttttggtgtttgtttcttcatgggggacaaggataattcttggtgccattggcctaattctccatggaaattcaacactgaaagctctgcaggcaatatctgcccacctgatgttggccttgttgacgctaatttggtggcattgcctacatgtctgaacatggttgctgcacctgtgccatttttcacagcatccattgctgaaagacctcttccaatgactccaagatttgtcaccacaatggtgcccagtttggaattgtctgcaatgtatccctcacacaagagacctctagttttctaccaggagaatcatactcctattgcagctcctttggtgaggaaggggaccctcctggatcctgttccagagctccaaggtagcaatgagactaatctaactgatgttggagcagaagaaaccgagggtattcatgagaacacagatgagattaatgcactcctggattctgactcggatgaagggtgtgaaaaggtgcaagaactcaacagagttaggaggccatctcctgctgagaatgacaccttgagtgtggaatcagtagccagtgctggtgctagcgcagcaggttctgcgcgaccggccaagaagagaaggctctgctctggcactgacaagtctgttgtggacacggccagttcagcaaggctcgatcattccatcgaacagaagcttcttgtcaacgactgtgatgcacagtcctgttgcattggtgaagttgagagcgaccacaagtttgctctgggggaaggtgaagctgtagaaggtgacaatcccgacgaccagaagcgaagaagagagaggatccaagagacggttgctgtgctcaggaagattgtccctgggggcatcgccaaagatgccacggctgttcttgatgaagctatctgctacctgcagtacctgaaactgaaggtcaagacgctgggagctgtctcgctctagctcctgctggacagttgtgattgggttatcgaagccaccggcttctaaatacataaagtgctagtgttagtaataaggtgaagatgccaaagggagctcaattcggtgcttggtgaagacgctctggattgaaatgaaaaaaaagaaagaaagggatcccgtggtgcttgcttggcttccccttgaacccagaagaaagctttcaagatgaagtggacaacgaacatgcagcatggcaatgctacttcaactgaaccgaggctacaatgctttcattcattgt

SEQ ID NO: 4249 - DNA, 3757 bp, Zea mays
aaaaaggtgaacgtaggaatgcacgtcctgaaatcggagtttggcgtaggaggctagcgcatctagcgaatgagaaatgtgcatctcggctgagtctcgggagggctacgacgtttggcgtaggaggctggcttgcctggctgaggcagagcttcttcgtgcggtcagcttagccgtggcatgactcggacagcccgacagtgcacgcgcggaaataacagcacgccgcaggggcatttccgtcaagggccgcccataagagtccacacgcttgcgctgccctgccccgccctcccccgcagccgccccgcccttggcctcgcctttccttgcttccttctcgagcagagcaacagagcaggtgaggcagtcagcacgctcagccacacccacagagacgcggcacgcctccactcctcctccgactccgaggccagcacgccgcacgctccgcctcgcagtcgcagcccctagcctctcgcgcgtgcttcttcttcctcctcgctccgggggctcgatctggtaactctggtgggggacaatcaagaactgaacactcgacactggcacagagctctggcagcatgcggtggctcggtctatctgtcgatgtgttccgcagggggatctccttgaacctttactgccgtgtgattctgtaaatcgtctccgtggctaccggcttttccttcgcacgcctcctgattcatgagaggcttgtgaaggcactttacatcttccccacccagtcattaattggcgtcgctgttaggctgttgtggttgtttggccaaggcttttgaggagaacgggctggagtactgatggtgtggaaagcagccgctcagacgagattccgcgtgtttaagcatgagaacggaatcacagtgagggctattgcttgcttccagccgctgcaaaattgccaggccgagtacttccgccatctcctcaagcccgtgacgtagctcccctctgctctccacctgctgctgaataaacttacagccttagttttttctccatagcaactgaagtgggagaacatcccagtcgttcatcgggactttctgctggtagttctgtccggtggttgttttaatttattcatcatgggggacaaggtgaatccctggtgccattggcctaatcctcaatggaaattcaacactgagagttctgccggcaatctgcacccacctgatgtcgggcttgctaatgccgattcggtggcattgcctgcataccaccttaacgcagcacctatgccatttttcgcagcatcgtcgattgctgagagacctcttccaatgggcccgagacacgtcacgacattggcaccaagtttcgaatcgcctgcaccgtgtccctcgcgtaagagaccttcagtcctctaccagaaggaaactcatggtcccaccgcagctcctttgcggaggagcaaggggccactggatcctgtgccggagctccaaggtagcaacgagaccaacgtaaccgacgttggagcagaagaaaccgagggtgttcacgagaacacagacgagatcgatgccctcctggactcctccgactcggacgaagggccgcacgaactcgacagggccaggaggcagcctgctgcagagaacgagacctcgagcgtcgagtcggtggccagtgccgcaggttctgcgccgccggccaagaagaggaggctcagctcttgcacggacaggtccgtcgtcgacaccgccagttcggcgaggccggaccattccgtcgagcagaagcctctcgcgagcgactgcgacgcgcagtcgtgctgcgtcggcgaggtggtggaaagcggccgccttaggttctctccgggggagggggaggcagcagaaggcgacagccccgacgatcagcggcggaggagagagaggatccaagagaccgtggctgcgctgagaaacatcgtcccggggggcaccgccaaggacgccacggccgttctcgacgaagccatctgctacctgcagtatctgaagctgaaggtcaagacgctgggagctgcctccctctagcctcctggacagggagtcatctggctttctgctgttctacataagtatggagtgcaggcaggcattgggtaataaggtgaaagatgccggagaccatatcagaatttggcggtgcttcaggacacgcaccacaccaggggtgaaaacaacggggagaagggggaaaaaaaggtccaatggtgcttgctttgctgcttccccgcccgtgtaccacccccaccacaaggctctcgaacgatgctgtgggcaacgactggcgtgcagcattgcgaagagcgtcttcaaccgaagcgaggcgggtatgttttccgtcgtccatttgtggcggagcaacatggaggccaaaagatccatccaccagtcaccaccacctaatatgctgctctccagtgacagtgagctgctagtgtaagcaccatctttctgtctgggagcatggatcttccaccctaagagctgtcggtgcctgcctgtatcactcgccgtcctcaaaaaggccctcacggcacgggttggtgcaacgtatgcgctatgcaaagctagaagacatcttttgctgaccgtgatccaaagcaaagagcggcactgaccaccaaaggcaaggaaagggggggagatgggctggagcctggagtccaacaaagtgctgtgtgcctgacgtggatgagctcaaactctgagccacaccaattgcgcgggcgggcgcctttcatcatctcacgctgctttgctttctctcaaatcccgctgcatgtgccaccacactagcgtacatacgtatgtatgcttgtgtaatcgctttgacacgcctttgtacgcggtgtaatcatgtatagtcctagctttagtcctgttcgtcaagtgtgcgtgcgtgcgtgcgtctatagtcctgttctgttggcaatgattgtttggaggctgcatcgtcgtcgtcccgttgttgcccctcgactagaaggggattaaatcctcttctggattggtataaccgaagccgaagagtgctgctgcggcgctgtcactgccggattgggaaccgctttggtccctgtagggaacggatggcgggagggattccgagtgggggcacgcgtggggagcggagcgtgcagcgaccgtcgcggcggaatgagtggcgaggcagatggagtggagccgtcgaggccgcctgctttccttcggttcgttgcgccgaggtgaggtggggccggccccaatgccaaagcggaagatggagaggactgcactgcacaggcatcatcgcactcgcatgcgcatgcgacggaacggagtgcgggccgtagtatccgccccccctcaactccctgtagcaaagcctttatagacgtgcaaaccaggtcacctggcggtggtcatacattgaaggagtcttcgaaaccattgctttacttctgtaacaccctgttttaaaggaacaaagctgggtgcatctcatacatgcgccaagaagacaacatatataataacagagtatatagagttaaatgtcacaaaacatcagagtatttattacatagcggaagtcttattacaaaataaagataaatataaaacgaactaaggatcgtcggcgccaatgtcgactgagaaacaccacctagatcaagtcgaatgcctcagtgttaggcagctcctctccgaccacctgttcttctcctgtgggggggggtgtgagacagcaagag

SEQ ID NO: 4250 - DNA, 1864 bp, Zea mays
gacaaacacagaagcccagtgcctgcaacacagttcatttccagcccactacacctgtcgaaggtcgaccacgcttccgtcttccagatctcggcaatctccatccccgctacgccatggctgctgcctcctccccaaccttcccgccgccggcgaccgacgtcgccgctccaggcgtccccgatctctcgatcccctacgacctggccacccgcgggcagtggcaggcgctcttctcccacctctcccatccggcccacacgccccatccgcaccaccgcctcctcctctccgctctctccgccctctgcctggccaagctccgacgcttccccgacgccgctgcgcttctagcttccctccacccggatccggcctgcccgccgccacccttcctcatccgcctcctccatgctctcctcccactcttcctccccgaccgccccctcgcgctcgaccgcctctacacgctcctctcctccgtccgcgcacgccccaacgccgggcaccccgagtggcgccgccgcgacgcgctcgtcgcgtccgtcctcgccgccgaccacctcgcccaccgcgagttcgacgtcgcactcgcgctcctcgccgacatcgccggccgctacccgggcgacccggtgctcctctcgcgcctcgcctacgcgcacctccagatcggcaacctcggcgcggcctcggctgccttccgccacgtggagtccgtggccgccgcgtccgaggacccgacgcggcatgccaacctcctggcccgcaaccgcgcgctggagtgcatcgtgggcaaggactacgcggcggcggtgcgggagtacgagcgctgcatcgaggcggaccccgcggacgccgtggccctcaacaacaaggcgctgtgcctcatgtactcgcgggacctcggcgacgccatcaaggtgctggagggtgccctcgagagggtccccacggcggcgctcaacgagacggtggtggtcaacctgtgcagcatgtacgagctcgccttcgtcaaccacggcgaggtcaagaggagccttgctgagtggatcgccagggttgcgcccgacgacttcgacacctcctgcacgcgcatgtaggaggtactctgcctttttgcaattcagcattgtagccagccatgtgtatggctgttatgtcaacatgctgaaatgtgattatctctgtttagatagcattccaattcaaccaatttctgtttatgtgcatggaaattgtgacatgattggtatacatgattgaaaacaagagtgaattggagacagacatgctgttgtgatcatacatgcgaagaatgatgaatcccagtttttctcctcttgtcataactcacaatgatttataaccacacccaccttagtacttgttcggttttttcaatccatataaattgaagaggattgatatggatgagaagaaattttgactctaggattgaaacccactcaatccatatggattggggtagaaccgaacaaagatcctttaaacatgatctttaaacatgtagagctgcgaatccccatacgcgaagagcgcttgtttgcgcgtcgccgtttggcgcggctccctctccccagtgcagtccgctgccactctggttgtctgattcgagtgacactgaaactcatgattacaccgaaataaaattgaactcaacataatgaaacagtactgaaaggtgacatctcttgattcttttgtcgcgagaaaaaagcgatgtctgttttcacgggattcataggcaacaagtactgcaaaacgcaccttttacgcatgtccgtcatctagtagcgcctatgtctacgttaatccagttttaaactgctgtcatgaacaa

SEQ ID NO: 4251 - DNA, 3780 bp, Setaria italica
cagccgctcgtcattgcctccaacctcctgtgaagctgtctcctgtgaagcgagttgaggatcggcacggaaccaatccggccctagagccgccgccgttgctctggctcaccactctagccatccttcaggcatgcctgtgcttgtgggcatggcggcactgggccatgcgccggaggcctgtgaagctgatgtgcccgcgccggaggcttgtgaagctgatggccccgcgctggggacgccgggccacgcgccggcggccaggcccgccgcggctgggatgcctggttgctgcgccggcggctggaccgccgcggttgctgcgcctgcaggccatgtgcccgccaccatgccgggaggcactcccgcggcggccaggagggcacccaagggacccgtcggcgggcctcccggccacacgaacgaggcaccgccagcccctccgccggacacatacggcgcgccgctggcccctccgctagccgcatcctggagcccaccaccggatctgcccctttcggctgccggatcccagtttcccgccaccggagccgcatcccgctcatccatgccgcccgccgccaccagaccgagaccggcggctgccagacctagaccgtgagaagggagaggaaaagaacggttcgcgagagagggaggaaaaggacgcggtggcaatttgctgttatttcaacgaagttcaaggatagtttggtaacatggggggcgcggatggaggggaagccgcggggagctggtttttccggcttctcctccccagtacaaattggaaaacggcttcacgggtacttcgcaagagaagccgttttttggaagggcatttggtacggcttctccagaagccgctcgagaagccgtccaataagccctaccaaacaggcccatagtattgaactggatttcgccaacatactcaattcgatggaattgtttgaaggatcaaaaccagtcaaaattccatagccttattgaaggcccaagtccaacgtaagtacacgaacgcagaagcccaggaccctcacgcagttcatttccagcccactccaccccctgtcgagagagggtccaccacacgggccacaccagtcaccactcaccagagactccttccttcgtccccgagatctcgatctcgatcccaccgcgccatggccgccgcctcctcacccacctccccgcccccgccgccggagaccgacgccgccgcgccaggactccccgatctctcgataccctacgacctggccacgcgcgggcagtggcaggcgcttttctcccacctctcccacccggcccacgtcccgcacccgcaccaccgcctcctcctctccgcgctctccgcgctctccctcgccaagctccgacgcttccccgacgccgccgcgctgctcgcctccctccacccggacccggcctgcccgccgccgcccttcctcatccgcctcctccacgcgctcctcccgctcttcctccccgaccgccccctcgcgctcgaccgcctctacaccctcctctcctccgtccgcgcccgccccgacgccgggcaccccgagtggcgccgccgcgacgccctcgtcgcgtccctcctcgccgccgaccacctcgcccaccgcgagttcgacgtcgccctagccctcctctccgacatcgccgcgcgcgacccgggcgacccggtgctcctctcccgcctcgcctacgcgcacctccagatcggcaacctcgccgcggcctccgccgccttccgccacgtggagtccgtggtcgccgcggccgaggaccccgcgcggcacgccaacctcctcgcccgcaaccgcgctctggagtgcatcgtggccaaggacttcgcggcggcggtgcgggagtacgagcgctgcatcgaggcggaccccgcagacgccgtggcgctcaacaacaaggcgctctgcctcatgtactcgcgggacctaggcgacgccatcaaggtgctcgagggcgcgctcgagaggattccaacggcggccctcaacgagacggtggtggtcaacctgtgcagcatgtacgagctcgcctttgtcaaccatggcgaggtcaagaggagccttgccgaatggatcgccagggttgcgcccgacgattttgacacctcctgcacgcggatgtaggaggtaacccctattgcaattcagctttgggccatgtatggctgttctgtggtgcatactgaaatttgactgtccatgttcaatcgatttctttggtagcaattgaagttgtgaggtgattgcctgattggttatacatacatggttgaaaagaaatgagtacattgtaaaagacaaacatgttgctgtgattacacctgtgcagaatcccagtttttctttactagtgtcaaccgcaattgtcacaactgagggctgcttggtttctgcttggggctcggctcagctcgcctcgcctcttcttgctggcacgagccacgatgcgcttgccagcccaggcgaacgaatctggctatctcacgctggcaagccccgagagaattttgcttcagttccaaaagtcttgccttgctcactctactggcaaggcaacacaatagctatcaagaaaaaccaagcacgccctgacatgatttacactctttcccagcttaaaaaaaaaatcctacccatctgggcaattcaggcaattaggctagcctagtttcatactgaacttggtgactagatatccattacacatttccctgagatagtatttgtttcaaaatagagaggtgtcataccatgtacaatctcttggtgtctaggcaagaaacacatcaagatacacaagcttagcgagagaggcaggctcccatggcattgcaaaaataaaaatgaacatagttgagatgttaatatgagagaaataagaatatcttgtgcaatcctggttaatgtttactagtatactcgagtgacatgaggtcggagcccaggaactgaaagaactatgctaagaagccgcactgggtcctatattgtgactgcattatgcaagaaaagtatctgaaggtttgagcacttagcaccacttaacttgtaacgcggggtaatatagccatcaacttataaactgcagttttgggtcctcctttttttttagtggttcatttgtctccatacctctccacctaagctcctcatgctgatgtggcatgacagctaggtggctgctcctctcagtttgcctaccaggattggccgccggcaaatgtggaacctaactgttgtggaggccagaacactctccctgcgcggccagttggtcttctcaagcctttgggaggagacagccgcaccgcccctgctcctctttggagccatccccgtcagccgttgacactacatcactgcagaagtgcagatggttcctccgcgcatttcatgaaataaactagagtgagatttggggataatttgctcaaagatttgaggaaagggaaagcaatagtgccaatgtgtacggatttggctttgttcaccacttctaagcaggaagaaggctgttggaattctcaattctgttgcctgtctgcggccgcggcggcgagctccccctgtttcactgctatccaaaccaaatccattggagttgctgtcgtgtggatgaagtttctgtttgccatatggtttgctcaaaagtgcagtaggtacccgtttcttatttgttggttcacggctttgttcatcccgattgctccctccgtgcatcaatttgctcgctgctaggaag

SEQ ID NO: 4252 - DNA, 1456 bp, Setaria italica
atcaaaaccagtcaaaattccatagccttattgaaggcccaagtccaacgtaagtacacgaacgcagaagcccaggaccctcacgcagttcatttccagcccactccaccccctgtcgagagagggtccaccacacgggccacaccagtcaccactcaccagagactccttccttcgtccccgagatctcgatctcgatcccaccgcgccatggccgccgcctcctcacccacctccccgcccccgccgccggagaccgacgccgccgcgccaggactccccgatctctcgataccctacgacctggccacgcgcgggcagtggcaggcgcttttctcccacctctcccacccggcccacgtcccgcacccgcaccaccgcctcctcctctccgcgctctccgcgctctccctcgccaagctccgacgcttccccgacgccgccgcgctgctcgcctccctccacccggacccggcctgcccgccgccgcccttcctcatccgcctcctccacgcgctcctcccgctcttcctccccgaccgccccctcgcgctcgaccgcctctacaccctcctctcctccgtccgcgcccgccccgacgccgggcaccccgagtggcgccgccgcgacgccctcgtcgcgtccctcctcgccgccgaccacctcgcccaccgcgagttcgacgtcgccctagccctcctctccgacatcgccgcgcgcgacccgggcgacccggtgctcctctcccgcctcgcctacgcgcacctccagatcggcaacctcgccgcggcctccgccgccttccgccacgtggagtccgtggtcgccgcggccgaggaccccgcgcggcacgccaacctcctcgcccgcaaccgcgctctggagtgcatcgtggccaaggacttcgcggcggcggtgcgggagtacgagcgctgcatcgaggcggaccccgcagacgccgtggcgctcaacaacaaggcgctctgcctcatgtactcgcgggacctaggcgacgccatcaaggtgctcgagggcgcgctcgagaggattccaacggcggccctcaacgagacggtggtggtcaacctgtgcagcatgtacgagctcgcctttgtcaaccatggcgaggtcaagaggagccttgccgaatggatcgccagggttgcgcccgacgattttgacacctcctgcacgcggatgtaggaggtaacccctattgcaattcagctttgggccatgtatggctgttctgtggtgcatactgaaatttgactgtccatgttcaatcgatttctttggtagcaattgaagttgtgaggtgattgcctgattggttatacatacatggttgaaaagaaatgagtacattgtaaaagacaaacatgttgctgtgattacacctgtgcagaatcccagtttttctttactagtgtcaaccgcaattgtcacaactgag

SEQ ID NO: 4253 - DNA, 3090 bp, Brachypodium distachyon
aaaaaatccgtccaagtccagttttcccgaaagaaaattccgctgccgtcccctcctcctccgcctccgctcgagatctcgatcccgccatgtctgccgcttcctccccggaccctcctcggtctccggcgacctccgccgccgccgccgctttgcccgacctctccatcccccacgacctagccacgcgcggacagtggcaagcgctgctcgcgcacctcgcccacccctcccgcacccaccacccgcaccaccgcctcctcctatccgcgctctcggcgctctccctcgccaagctccgccgcttccccgacgccgccgcgctcctcgcatcactccatcctgaccccgcctgcccgccgccgcccttcctcctccgcctccttcacgctctcctcccgcttttcttccccgaccgccccctcgcgctcgaccgcctctacaccctcctctcctccgtccgcgcccgccccgacgcccagcatcccgagtggcgccgtcgtgacgccctcgtcacgtccctcctcgcctccgatcacctcgcccaccgcgagttcgatgttgccctcgccctcatcgccgacctcgccgcccgcgagccagacaacccggtcctgctctcccgcctcgcctatgcccaccttcagatcggcaacctcgccgccgcttctgccgtcttccgacacgtggaatccgtcgcggccaacgacccctcgcacgccaacctcctcgctcgcaaccgcgccctcgagtgcatcgtggccaaggactatgcggcggcagtgcgggagtacgagcgctgcctggaggtggaccctgcggatgccatcgccttgaacaacaaggcgctgtgcctcatgtactcgcgggacctcggtgacgccatcaaggtgcttgagggcgcgctggagagggtgcccacggcggcgctcaatgagacggtggtggtcaacctgtgtagcatgtacgagcttgcctttgtcaaccacagcgaggtcaagcgaaccctggccgactggatcacaagggtggcgcctgacgactttgataagtcctgcacacgaatgtaggaggtactgctggttactacaattcatcattgaattatttcaccatactggtaggatgtgctctatggcagagagacagtattctatagttgtcacattgtaattcgattgttcatgtttctgtggcatttaaagattttcttagtgaaaattgtgtggttgtaccgttttatgacttgctccacttgaatgtacaatgtgggtaacaaatgtggagtgatcgttcgtgtttggaatacacatgcatactttataatgctttaatatgtgctagaggatttaagcttgaaatacaataatcctatgttttcgtgtttgatgatgagtttgttcctattgttatgcatattggaagcaattcgacattgtaatgttaggttctacctctgcatcgtgataaaattatgtcattgtgatcattgcaaaattgaagaaaatcttaattaaatcctgtaaggtggcacatatgcaataatatattttgtcgtcaaaagaatatcgccggttggtgaaatatagaatattttccagtagtctaacaattcaccctaccaccctcacaccgggtggtctgacttttagctattatcaacacgttggtatgcttttcaatttgcagtttgatccagtatggtcatacacatactataatgacaactatggctgattttcctatgagaaaatgacctatttgtacttgaactgtgtaagtattatcaataaaacttcagctttgcagcacgccccctttgaagaaaagaagcacataaacactataacacataaattggaatagttaagcactaaaaagagtaagtaaactcttatggttgcactagcatctttcaaaaggtggtgagcacctcaaatcttccgttcccaaatgatcatttgaacttaatcgctgatacccacagtgatgccactaagttccatacttcatggatgccaaaataaatcggtatgaggtgtcaacggcattgttgagctcggtgttgtaactgtcagtccaactactgtcaatgtgaaacttgttccgagacatagtgccatgaaggtgatgtcaccagctgactatcttggtgttaagatccttgcaagttgtcctcaaactgacattcttttcacttcacgcaaggggactcatgcttacagttctgtccagatattggttggcaccttgaagaaggcctgtaagcttggaaattctgcaccatctatgcaagtgatcagaacgtctcttgcttctatggtcccttcctctagctaatcagattcaaacatgttccagatcaaagtacatcttccgaagtgcatgtatcctttggttgcaaatacttttctgcaggcctgtttaatggggtacaaagatgtggattcagaagggtagtgatgtgatagatgatcttgtctagcgggtggcctaatgtcacaatcttctgaacctggaaaccacaaagcgggatgacaaggctggtggactggtgcatgggaggggagtggagattcagacacttgatgttacttgagcatctgcgatgggaggttcttggcgaagatgacagtgatgcttcatttctcgagggcatcgcagatgcgggcatcatcatcaggaacatgccgctagtgcagaggaagcagaagtgcctgtgtgtatggatggaaggtatgtggttgcgctcaaggaaaggaagggagtatgtggttgcgctcaaggaaaggaggctggaagtgccagatctttgcttcggtatatcttctctgagctgaagggactgttcaggcttggtccaaacgtgcgaacgattagaagacttaaacaaagtaacccatgaattagctcagttagctaggaagaataattctgctgtttggcagcctgtctcccctcctgcagcataaatgtgcttctgcatattgattgtaatcatcttatttctcgatcaataaagctcacgtgatatttcgaagagcgactcatcctcgagacttggtagttgtcgaagggtaaacaacaaat

SEQ ID NO: 4254 - DNA, 1529 bp, Hordeum vulgare
aaatccttcgttcttttaggaagaaagaaagaattgaggaaatccttggcgtcttcctcctgcgcttccctcccgagatctcgatcccaccatgtctgccactcccgccctggcctcacctccggcgacctctgccgctgccgccgcgttgcccgatctctccgttccctatgatctagccacacgtggacagtggcaagcgctgctcgcgcacctcgcccacccctcccacgcccatcacccgcaccaccgcctcctcttatctgcgctctcggcgctctccctcgccaagctccgccgcttccccgaaggcgcggccctacttgcctcacttcacccagatcccggctgcccgccgccgccttttcttctccgcctcctgcacgctctcctcccgctcttcttccccgaccgccccctcgctctcgaccgcctctacacgctcctctcatcggtccgggcccgcccggacgcccagcatcccgagtggcgccgtcgtgacgcccttgtcgcgtccatcctcgcatccgatcacctcgcccaccgcgagttcgacgttgcccttgccctcgtcgctgaactcgtcgcccgtgagccggacaacccggtcctgctctcccgcctcgcctatgcccacctccagatcggcaacctcgctgccgcctcggcggtcttccaacacgttgaatccgttgtggccggcgactcctctcacgacaatctcctgtctcgcaaccgcgcgctcgagtgcatcgtggctaaggactatgccgcagcggtgcgggagtacgagcgctgcattgaggctgacccttctgacgccatcgccttgaacaacaaggcgctatgcctcatgtactcgcgggacctcggcgatgccatcaaggtgctcgagggcgccctggagacgatgcccacggcggccctcaacgagacagtggtggtcaacttgtgtagcatgtacgagcttgccttcgtcaaccatggtgaggtcaagcgaacccttgccgattggatcaccagggtggcaccagatgacttcgacaagtcctgcacacgcatgtaggaggtactggatttcagcattgaattatttcacctgctgctaggatgtgctctagcagagagattgtgtatttgtgttgctatagttgctccacacactaagatttgattgctcatgtttccatggcatttatcatttaatgttaactgaaagttatgtggttgcagtgacttgctcaactggaaggtactatgtggttaacaaacatggggaatttctagcattttgtttctagcatttatcatccatcgataagtttgttcctgctgttatccttactgaaagcaattcaacattgtacttatgaaatgttttaccgctgcaccatgataattccttctctgattaatgcaaaaggtaaagaatgtcttaattaaagcctgtataatggcagctatgtgatacaaatgttgtggccaagatgcatattctccctaattctggagctagcgatttcaccctc

SEQ ID NO: 4255 - DNA, 1474 bp, Triticum aestivum
ggctgggtgcatctgtcgctcggtgcagcgatgcacttctcgtagttccgctttgcaaaaatcctccttttttgaggtcaagaaaacgaaggaaatcattggcgtcttcctcctgcgctcccctcaccagatctcgatcccaccatgtctgccacttccgccctggggtctccggcgacctccgccgccgcggcccctctgcccgacctctccatcccctatgatctagccacgcgtggacagtggcaagcgctgctcgcgaacctcgctcacccctcccacgcccatcacccgcaccaccgcctcctcttatctgcgctctcggcgctctccctcgccaagctccgccgctaccccgacggcgccgccctactggcctcacttcacccagatcccggctgcccgccgccgccctttcttctccgcctcctgcacgctctcctcccgctcttcttccccgaccgccccctcgctctcgaccgcctctacacgctcctctcatcggtccgcgcccgccctgacgcccagcatccggagtggcgccgtcgtgacgccctcgtctcgtcaatcctcgcctccgatcacctcgcccaccgcgagttcgacgtcgcccttgccctcgtcgctgaactcgtcgcccgcgagccggacaacccggtcctgctctcccgcctcgcctatgcccacctccagatcggcaacctcgctgccgcctccgcggtcttccaacacgttgaatccgtcgcggccggcgactcctctcacgacagcctcctgtctcgcaaccgcgcgctcgagtgcatcgtggctaaggactatgccgcagcggtgcgggagtacgagcgctgtattgaagctgacccggctgacgccatcgccgtgaacaacaaggcgctgtgcctaatgtactcgcgggacctcggcgatgccatcaaggtgcttgagggcgcgctggagacgatgcccacggcggcgctcaacgagacagtggtggtcaatttgtgtagcatgtacgagcttgccttcgtcaaccatggtgaggtcaagcgaacccttgccgattggatcacgagggtggcaccagacgacttcgacaagtcctgcacacgcatgtaggaggtactggaattcagcattgaattattcacctgctgctaggatgtgctctagcagagagattgtgtatttgtgttgctatagttgctccacacactggagtttgattgttcatgtttccatgacatttatcatttaatgataactgaaagttatgtggttgcagtgacttggtcaactggaaggtactatgtggttaacaaacaatggggaatttctagcattatgttgtgctgtttgaaatgcagtgatcatatgtgtttgtaatacttttgcatacttagaatgactaaatatgcgctggaaggctaaaagttaggtaatagcaatagatacatatgtattgtgtttaggaaag

SEQ ID NO: 4256 - DNA, 1221 bp, Pennisetum glaucum
gccgacgcgccaggactccccgatctctcgatcccctacgacctggccacgcgcgggcggggcagttggtgaggaggagggtccaccactcgggccgcaccagagacccagaccttccttcttcgtccccgagatctctcgatctcgatcccaccgagccatggccgcctcctcctcaccaacttccccgcccccgccgccggcgaccgaggccgccgacgcgccaggactccccgatctctcgatcccctacgacctggccacgcgcgggcagtgggaagcgctcctctcccatctctcccacccggcccacgtcccgcacccgcaccaccgcctcctcctctccgctctctccgccctctccctcgccaagctccgccgcttccccgatgccgccgcgctgctcgcctccctccacccggacccggcctgtccgccgccgcccttcctcatccgcctcctccacgcgctcctcccgctcttcctccccgaccgccccctcgcgctcgaccgcctctacaccctcctctcctccgtccgcgcccgccccgacgccgggcaccccgagtggcgccgccgcgacgccctcgtcgcgtccctcctcgccgctgaccacctcgcccacagggagttcgacgtcgccctagccctcctcgccaacatcgccgcgcgcgacccgggcaacccggtgctcctctcccgcctcgcctacgcgcacctccagatcggcaacctcgccgcggcctccgccgccttccgccacgtggagtccgtggccgccgcggccgaggaccccgcgcggcacgccaacctcctcgcccgtaaccgcgcactggagtgcatcgtggccaaggacttcgcggccgcggtgcgggagtacgagcgctgcatcgaggccgaccccgcggacgccgtggcgctcaacaacaaggcgctctgcctcatgtactcgcgggacctcggcgacgccatcaaggtgctcgagggcgcgctcgagaggattcccacagcggccctcaacgagacggtggtggtcaacctctgcagcatgtacgagctcgcctttgtcaaccatggcgaggtcaagaggacccttgccgaatggatcgccagggttgctcccgacgattttgacacctcctgcacacggatgtaggaggtaatgcctattgcaattcagctttgggccattgcacaccatgctgcatgactgttctgttg

SEQ ID NO: 4257 - DNA, 1155 bp, Secale cereale
ggggtctccggcgacctccgccaccgcggcccctctgcccgacctctccaccccctatgatctagccacgcgtggacagtggcaagcgctgctcgcgcacctcgcccacccctcccacgcccatcacccgcaccaccgcctcctcttatctgcgctctcggcactctccctagccaagctccgccgcttctccgacggcgccgccctactggcctcacttcacccagatcccggctgcccgccgccgccctttcttctccgcctcctgcacgctctcctcccgctcttcttccccgaccgccccctcgctctcgaccgcctctacacgctcctctcatcggtccgcgcccgcccggacgcccagcatcccgagtggcgccgtcgtgacgccctcgtctcgtcaatcctcgcgtccgatcacctcgcccaccgcgagttcgacgtcgcccttgccctcgtcgctgaactcgtcgcccgcgagccggacaaccctgtcctgctctcccgcctcgcctatgcccacctccagatcggcaacctcgctgccgcctccgcggtcttccaacacgttgaatccgtcgcggccggcgactcctctcacgacaacctcctgtctcgcaaccgcgcgctcgaatgcatcgtggctaaggactatgccgcagcggttcgggagtacgagcgctgcattgaggctgaccccactgatgccatcgctgtgaacaacaaggcgctatgcctcatgtactctcgggacctcggtgatgccatcaaggtgcttgagggtgcgctggagacgatgcccacggcggcgctcaatgagacggtggtggtcaacttgtgtagcatgtacgagcttgccttcgtcaaccatggtgaggtcaagcgaacccttgccgattggatcacgagggtggcaccagacgacttcgacaagtcatgcacacgcatgtaggaggtactggaatttagcactgaattgtttcacctgctgctaggatgtgctgtagcagagaaattgtgtatttgtgttgctatagttgctccacacactgtaatttgattgttcatgtttccatggcatttatcatttaatgataactgaaagttatgtggttgcagtaacttgctcaactggaaggtactatgtggttaaca

SEQ ID NO: 4258 - DNA, 1779 bp, Oryza sativa
gtgatgattagcgaacagagttgagacagcccaaaagcccaataataccttacctgtgtacaaagtgtacaacccaagcccacttcgtcgaccagcctctgtcttcttcttcttcttcttctgatcctccgattccaacctccgagatcccgatccagccatggcggaggccgccgccgccgcgtccaactccacccccgcctcgcctcctcctccgcccgccgccgccgccgcgctcggcctccccgacctctccgtgccctacgatctggcgacgcgcgggcagtggaagtcgctgctctccaacctcgacgacgcgtcgcacccgcggcaccgcctcctcctctccgcgctctccgccctctcgctcgccaagctccgccgctacgcggacgccgcggcgctcatcgcctcgctccgcccggacccgggctgcccgccgccgcccttcctcctccgcctcctccacgccctgctcccgctcttcctccccgccgaccgccccctcgccctcgaccgcctctacaccctcctctcctccgtccgcgcccgccccgacgcctcccacccggagtggcgccgccgcgagtccctcgtcgcgtccctcctcgccgccgaccacctcgcccaccgcgagttcgacgtcgccctcgcgctcctcgcgtccgtcgcggcgctggacccgggcaacccggcggtcctctcccgcctcggctacgcccacctccagatcggcaacctcgccgctgccgcggccgcgttccgccacgtggagtcggtggccggcggcgacccggcccacgccagcctcctcgcccgcaaccgcgcgctggagtgcgtggtggccaaggactacgcggcggcggtgcgggagtacgagcggtgcatcgaggcggacgccgcggacgcggtggccgtgaacaacaaggcgctgtgcctcatgtactcgcgcgacctcggcgacgcgatcaaggtgctcgaggcggcgctggagggccacccgacggcggcgttgaacgagacggtggtggtgaacctgtgcagcatgtacgagctcgccttcgtcaaccacgccgacgtcaagcgcagcctcaccgactggatcgccagggtcgcccccgacgacttcgacccctcctgcactcgcatgtaggggaaattgttggaattctgttcttcaaattcgcttgaatttgtgtgaaagatttgctgaaattgggatgtacaatttgggggttagcaaacaatgggtttcagttgattgtcctacctgggatcaatagctttctgttgttgctcaattaatatcgatatattactcttgtgaatttcattacttaatgaaattatctattatctaaaaatgatggaaaattatcgaaagcaagtcgtcgatttccttagaattgttctttttacacatgaacataataatagacgatgcacatattcagataatttgaagtgcagagaagataataaaccaagccttgaaactagtagcaaaattcaatgaaattgtttctgggttggaacttggaagtggaagtaaaacaatatccataagctattctcttcacattaagaaaaaaaatgtgaggggttgataactgacaagtggcacaattagatatcaggacagatgctgggatgaaaccctccagagataaatgccatgaaaatcagaaaacattctatctgccgcacggattcagattggatgacatagtataggcatgccacagtgtgacatagcgtagatctcagagcaggtttagt

SEQ ID NO: 4259 - DNA, 1054 bp, Zea mays
ccctcagcttcctgctcccccctctgtcatggccaagacgaagcaagggaagcgggatgtcgacgcctataccatcaagggcaccaacaaggtggtccgagtgggggactgcgtgctgatgcggccagcggacacggacaacccgccgtacgtggcgcgggtggagcggatggagtcggacgggcgcggcagcgtgagggtgcgggtgcgctggtactaccgccccgaggaggccaagggcggccgacgcccgttccacggtgccaaggagctcttcctctccgaccacttcgacacgcagagcgcccacaccattgagggcaagtgcatcgttcactccttcaagagctacaccaagctcgacaacgttggtccggaggacttctactgccgatttgactacaaggccgccaccggtgcattcacccccgaccgtgtcgccgtatattgcaagtgtgagatgccgtacaacccggatgacctcatggtgcagtgtgaaggatgcaaggactggttccatccgtcttgtatgggaatgaccattgagcaagcaaaaaagatagatcattacatgtgctcggattgtgctaaagaaaatggtgcaaagagaccctcaaattcatactcagtttcaccaaactcagattctaagattgaatcaaagaggcgcaagagataaatgctgcggcagaagcacccctggcaaaggagatgcggtatttatggtgtcagctcctcattactggtgcatatttgagatgttgatgtgtacactgcgagagaagagccaagccaattgtagggcaaaacctatttgacttatcattcttctgtgtattctgcctagacattagtgtgatgagtaggtgagttccccgttgcggcgtgtgcatgatcagctgctggaggcgggatgtcgggaaatgctagaattatgctgactcttgtcgatgtaagtgtatcgtgtgtgtgtgttaacatatgcactggctggaaacgttcccatgtgtgaatggaggatgctgatgatagcttgactgttgtttcatattca

SEQ ID NO: 4260 - DNA, 1290 bp, Setaria italica
caacctcctgctccgtcggaacgggcagccgctgcattcggcattccccctcccgcactccctccaccgtcgcggctagggtttgctcccaatccaccgcctccgccatggccaagacgaagcaggggaagcgggacgtcgacgcctacaccatcaagggcaccaacaaggtggtccgagtgggggactgcgtgctgatgcgtccggcggacacggataagccgccgtacgtggcgcgggtggagcggatggagtcggacggccgcggcggcgtgcgggtgcggtgccgctggtactaccgccccgaggaggccaagggcggccgccgcccgttccacggcgccaaggagctcttcctctccgaccacttcgacacgcagagcgcgcacaccatcgagggcaagtgcgtcgtccactccttcaagaactacaccaagctcgacaacgtcggccctgaggatttctactgccgatttgactacaaggcgggcagcggcgcgttcacccccgaccgtgtcgccgtgtactgcaagtgcgagatgccatacaacccggatgaccttatggtgcagtgtgagggatgcaaggactggtttcatccatcctgtatgggaatgaccattgagcaggccaaaaagattgatcattacatgtgctcagactgtgctaaagaaaatggtgcgaagagaccctcgaattcatacccagttgcaccaaactctgattctaagattgaatcaaagaggcgcaagagataaatgctgtaacagaaaacatccctggcaaggagatgcgctgttcatggcacgcaccagctcttcattgctggtgcagatttaagctgtggagatgtacactgcgagagaagagccagggcatttgtaggacaaaagcgtgtttgacttattggtctgctgtgtatcatggggacgtttcctgcggtttagaacattagtttgatgagtaggttaatttccccacagccgcgcgatgcgtgatcagctgcttgaggtggggaaagaagttgagagaaaaaaatgtagaatgctgctgactctgtcgatgtagccgtatcagtgcgtgttaacatattcccctgctggaaacgttcccttgtgtgaatgatgtcgatgatagctttgactgttgtttcataatttaattagatgtcgtggagagtttacaaaccggttatctgtggctgcggctgctgctgctgcatgaaatgttatcgagcttgatcttggaagttttcatgtgtggaaccgtttggtgacgagggaataatgc

SEQ ID NO: 4261 - DNA, 1195 bp, Setaria italica
attccccctcccgcactccctccaccgtcgcggctagggtttgctcccaatccaccgcctccgccatggccaagacgaagcaggggaagcgggacgtcgacgcctacaccatcaagggcaccaacaaggtggtccgagtgggggactgcgtgctgatgcgtccggcggacacggataagccgccgtacgtggcgcgggtggagcggatggagtcggacggccgcggcggcgtgcgggtgcggtgccgctggtactaccgccccgaggaggccaagggcggccgccgcccgttccacggcgccaaggagctcttcctctccgaccacttcgacacgcagagcgcgcacaccatcgagggcaagtgcgtcgtccactccttcaagaactacaccaagctcgacaacgtcggccctgaggatttctactgccgatttgactacaaggcgggcagcggcgcgttcacccccgaccgtgtcgccgtgtactgcaagtgcgagatgccatacaacccggatgaccttatggtgcagtgtgagggatgcaaggactggtttcatccatcctgtatgggaatgaccattgagcaggccaaaaagattgatcattacatgtgctcagactgtgctaaagaaaatggtgcgaagagaccctcgaattcatacccagttgcaccaaactctgattctaagattgaatcaaagaggcgcaagagataaatgctgtaacagaaaacatccctggcaaggagatgcgctgttcatggcacgcaccagctcttcattgctggtgcagatttaagctgtggagatgtacactgcgagagaagagccagggcatttgtaggacaaaagcgtgtttgacttattggtctgctgtgtatcatggggacgtttcctgcggtttagaacattagtttgatgagtaggttaatttccccacagccgcgcgatgcgtgatcagctgcttgaggtggggaaagaagttgagagaaaaaaatgtagaatgctgctgactctgtcgatgtagccgtatcagtgcgtgttaacatattcccctgctggaaacgttcccttgtgtgaatgatgtcgatgatagctttgactgttgtttcataatttaattagatgtcgtggagagtttacaaaccggttatctgtggctgcggctgctgctgctgcatgaaatgttatcgagc

SEQ ID NO: 4262 - DNA, 1094 bp, Pennisetum glaucum
cccactccccctccaccctcgcggctagggtttgttcccaatccgccacctcgccatggccaagacgaagcaggggaagcgggacgtcgacgcctacaccatcaagggcacgaacaaggtggtccgagtgggggactgcgtgttgatgcgtccggcggacacggacaagccgccgtacgtggcgcgggtggaggggatggagtcggacggccgcggcggcgtgcgggtgcggtgccgctggtactaccgccccgaggaggccaagggcggtcgccgcccgttccacggcgccaaggagctcttcctctccgaccacttcgacacgcagagcgcgcacaccatcgagggcaagtgcgtcgtccactccttcaagaactacaccaagctcgacgacgtcggccctgaggatttctactgccgatttgactacaaggcgggcagcggcgcgttcacccccgaccgtgtcgccgtgtactgcaagtgcgagatgccgtacaacccggatgaccttatggtgcagtgtgaggcatgcaaggactggttccatccatcttgtatgggaatgaccattgagcaggccaaaaagattgatcattacatgtgctcagactgtgctaaagaaaatggtgtgaagagaccctcgaattcatatccagttgcaccaaattctgattctaagattgaatcaaagaggcgcaagagataaatgctgtaatagaaaacatccctggcggggagatacacttttcatggcaccagctcttcattgctggtgtagatttaagctgtggagatgtacactgcgagagaagagccagggcatttctaggacaaaagcgtgtttgacttattggtctgctgtgtatcctggggacattcctgcaatttagaacattagtttgatgagtaggttaatttccccgcagccgcgtgatgcgtgatcagcttgaggtggggaaagaagttgagagaaaaaaaaatgtagaatgctgctgactctgtcagatgtagccgtatcagtgtgtgttgacatattcccctgctggaaacgttcccttgtgtgaatgatgtggatgatagctttgactgttgtt

SEQ ID NO: 4263 - DNA, 758 bp, Panicum virgatum
ccgctccttctccctcagcctctagctccgtcggaacgggcagccgctgcattccccctccctcacctccaccctcgcagctagggtttgctcccaatccaacgcctccgccatggccaagacgaagcaggggaagcgggacgtcgaagcctactccatcaagggcaccaacaaggtggtccgagtgggggactgcgtgctgatgcggccggcggacacggacaacccgccgtacgtggcgcgggtggagcggatggagtcggatgggcgcggcggcgtgcgggtgcgggtgcgctggtactaccgccccgaggaggccaagggcggccgccgcccgttccatggcgccaaggagctcttcctctccgaccacttcgacacgcagagcgcgcacaccatcgagggcaagtgcgtcgtccactccttcaagaactacaccaagctcgacaacgtcgggcctgaggatttctactgccgatttgactacaaggcgagcagcggcgcattcacccccgaccgtgtcgccgtgtattgcaagtgtgagatgccatataacccggatgacctcatggtgcaatgtgagggatgcaaggactggttccatccatcctgtatgggaatgaccattgagcaggccaaaaagatagatcactacatgtgttcggactgtgctaaagaaaatggtgcaaagagaacatcaaattcatacctagttccaccaaactctgattctaaggtcattcttttcttttctcttt

SEQ ID NO: 4264 - DNA, 1294 bp, Triticum aestivum
attttcagtttttcactgctcccccacgaaatcccgagactacccctcccctccccggtctctcctcctccctgggcggaacggagctgtggccaaccacacccctccccccttcccgtccttcccccagctcagcttcctagggtttcctcccgatccaaccccgacctccatggccaagaccaagcagggcaagagggacatcgactcctacaccatcaggggcaccaccaaggtcgtccgagtcggggactgcgtgctgatgcggccgtcggacacggacaacgcgccctacgtggcccgggtggagagcctggagtcggacggtcgggggagcgtgcgggtgcgggtccgctggtactaccggccggaggagtccaagggcggccgccggcagttccacggggccaaagagctcttcctctccgaccacttcgacacgcagagcgcacacaccatcgagggcaagtgcatcgttcactccttcaagaactacaccaagctcgacaacgtcggcccggaagacttcttctgccgattcgagtacaaggcggccaccggagcgttcacccccgaccgtgtcgccgtgtactgtaagtgcgagatgccgtacaacccagatgacctcatggtgcaatgcgagggatgcaaagactggttccatccaacctgtatgggaatgaccattgagcaggccaaaaagttagatactttcctgtgcgcggattgtgctaaagaaaatggtgcaaagagaccttcaaattcatacccgagttcaccaagttctgattctaaggttgagccgaaaaggcggaagaggtaatcgcttcaacaaaaaccatccccggtgaggagatgcactgtttatggcgtcagccctccattgctggtgcagaaaaaaacgtggcgttgtacagtgcatgagatgagctaggctatttaactgtaggattgaaattatgtttgctgctgtatctcgggagcgtttcctgcaatctaggtatcggcgagaaggaaatcgggaattgtactgtcatttgctcttgtcaaagtagcccttgtgtgtgaattaacttgttccctgcaggaaacggaaacgtttcctgtgtgaatgatgatgatgagcttgactgttgtagtttcataatttagatgtgtcagagtcttatgaactggtgaccatgacgacatgtttatgttgtttcaataattctgcaataatccgtgctacatacttttgtagggattgtttattcccaagttgcctgaaattatattaaattttaatagcctt

SEQ ID NO: 4265 - DNA, 1050 bp, Secale cereale
tccttccccagttcagcttcctagggtttcctccggatccaaccgcgacctccatggccaagaccaagcagggcaagagggacatcgactcctacaccatcaggggcaccaccaaggtcgtccgagtcggggactgcgtgctgatgcggccgtcggacacggacaacgcgccgtacgtggcccgggtggagagcctggagtcggacggccgggggagcgtgcgggtgcgggtgcgctggtactaccggccggaggagtccaagggcggccggcggcagttccacggcgccaaagagctcttcctctccgaccacttcgacacgcagagcgcacacaccatcgagggcaaatgcatcgttcactccttcaagaactacaccaagctcgacaacgtcggcccggaagatttcttctgccgattcgagtacaaggcagccaccggagcgttcaccccggaccgtgtcgccgtgtactgtaagtgcgagatgccgtacaacccagatgacctcatggtgcaatgcgaaggatgcaaagactggttccatccaacctgtatgggaatgaccattgagcaggccaaaaagttagatactttcctgtgcgcggattgtgctaaagaaaatggtgtgaagagacctacaaattcatacccgagttcaccaagttctgattctaaggttgagccgaaaaggcgtaagaggtaatcgcttcaacaaaaaccatccccggtgaggagatgcactgtttatggcgtcagccctccattgctggtgcagaaaaaacatggcgttgtacagtgcatgagatgagctaggctatttaactttaggatttaaattatgtttgctgctgtatctcggggcatttcctgcaatctaggtatcggcgagaaggaaatcgaaatcgggaattgtactgtcatttgctcttgtcaaagtagcccttgtgtgtgaattaacttgttccctgcaggaaacggttccctgtgtgaatgatgatgatgagcttgactgttgtagtttcataatttagatgtgtcagagtcttatg

SEQ ID NO: 4266 - DNA, 1261 bp, Brachypodium distachyon
ccccttccccttccctagggtttcctcccgatccaccgcccacctccatggccaagaccaagcagggcaagagggacgtcgactcctacaccatcaagggcaccactaaggtcgtccgagtcggggactgcgtgctgatgcgctcgtcggacaaggacaatcccccctacgtcgcccgggttgagagcctggagtctgacgggcgggggagcttgcgtgtgcgggtgcggtggtactaccggccggaggagtccaagggcggccggcggcagttccacggggccaaggagctcttcctctccgaccacttcgacacgcagagcgcgcacaccatcgaggggcagtgcatcgtccaccccttcaagacatacaccaagctagataacgtcggcccggaggacttcttctgccgattcgagtacaaggccgccactggcgccttcacccctgaccgtgtcgcagtgtactgcaagtgcgagatgccctacaaccctgatgatctcatggtgcagtgtgagggatgcaaagactggttccacccatcctgtatgggaatgaccattgaacagaccaaaaagttagattatttcatgtgctcggattgtgctaaagaaaatggaacaaagagaccttcatattcagaccccgcttcgccaagttctgattctaaggttcagccaaaaaggcggaagaggtaattgcggcaagatgtaccattcccggtgaggagatgcactgtttatggcgccagctcctcattgctggtgcaaactaaaacgcgacgatgtacagtgcgagagaagagctagcaggctatttaactttaggactggaaccatgttgctgctgtatccttggagcgtttcgtgcagtctagttatcagtgaggctcggttaactccccgccaccgctggagcagccatgacctactggaggtgttggggaaggaagtcgggaacggtggcgtgttttagactcttgtcaaagtagccccggtgtgttgtactgccatgtcagcttgtgttaaccttgcttgaaagcgttccctgtgtccgtgcgagtgatgatgatagcttggctgttagcctgttacagtctcgtagtttagatgtatcaagagttgtacgaacaggttatctgcaataatgatgaatgatgatgatatccactggttgatttctccactggagcaccagtaggctgcagagtacataagattttctactaactttgttccaaaatataagatgtttatgtttt

SEQ ID NO: 4267 - DNA, 1264 bp, Brachypodium distachyon
tccccccttccccttccctagggtttcctcccgatccaccgcccacctccatggccaagaccaagcagggcaagagggacgtcgactcctacaccatcaagggcaccactaaggtcgtccgagtcggggactgcgtgctgatgcgctcgtcggacaaggacaatcccccctacgtcgcccgggttgagagcctggagtctgacgggcgggggagcttgcgtgtgcgggtgcggtggtactaccggccggaggagtccaagggcggccggcggcagttccacggggccaaggagctcttcctctccgaccacttcgacacgcagagcgcgcacaccatcgaggggcagtgcatcgtccaccccttcaagacatacaccaagctagataacgtcggcccggaggacttcttctgccgattcgagtacaaggccgccactggcgccttcacccctgaccgtgtcgcagtgtactgcaagtgcgagatgccctacaaccctgatgatctcatggtgcagtgtgagggatgcaaagactggttccacccatcctgtatgggaatgaccattgaacagaccaaaaagttagattatttcatgtgctcggattgtgctaaagaaaatggaacaaagagaccttcatattcagaccccgcttcgccaagttctgattctaaggttcagccaaaaaggcggaagaggtaattgcggcaagatgtaccattcccggtgaggagatgcactgtttatggcgccagctcctcattgctggtgcaaactaaaacgcgacgatgtacagtgcgagagaagagctagcaggctatttaactttaggactggaaccatgttgctgctgtatccttggagcgtttcgtgcagtctagttatcagtgaggctcggttaactccccgccaccgctggagcagccatgacctactggaggtgttggggaaggaagtcgggaacggtggcgtgttttagactcttgtcaaagtagccccggtgtgttgtactgccatgtcagcttgtgttaaccttgcttgaaagcgttccctgtgtccgtgcgagtgatgatgatagcttggctgttagcctgttacagtctcgtagtttagatgtatcaagagttgtacgaacaggttatctgcaataatgatgaatgatgatgatatccactggttgatttctccactggagcaccagtaggctgcagagtacataagattttctactaactttgttccaaaatataagatgtttatgtttt

SEQ ID NO: 4268 - DNA, 1143 bp, Oryza sativa
ctcctccttcccttgtctgaacggggggagctgtggccacacctctccccccacctcctcctcctctagggtttcctcccaatcccctccatggccaagaccaagcagggcaagaaggacgtcgaatcctacaccatcaagggcaccaccaagatcgtccgagtgggggattgcgtgctgatgcgggcgtcggacacggagaaggcgccgtacgtggggagggtggagaggctggagacggacgggagggggagcgtgcgggtgcgggtgcggtggtactaccggccggaggagtccaagggcgggaggaggcagttccatggcgccaaggagctgttcctctccgaccacttcgacacccagagcgcccacaccatcgagggcaagtgcgtcgtccactccttcaagaactacaccaagctcgacaacgtcggccccgaggacttcttctgccgcttcgagtacaaggccgccaccggcgccttcacccccgaccgcgtcgccgtgtactgcaagtgcgagatgccgtataacccggatgatctaatggtgcagtgcgagggatgcaaggactggttccatccatcttgtatgggaatgaccattgagcaggccaaaaaattagatcatttcctgtgcgcggattgtgtcaaagaaaatggcacgaagagaccttcaaattcatatccagcatcatcaaattctgattctaaggttgagccaaaaaagcggaagaggtaattgctgtgacacgagccatccgtggtgaggagatgcactgtttatggcgtcagctcttcattgctggtgcaaagtcaaaacgtggagggtgtacagtgcagatgaagagctaggctaggtccaagatcgcgttaacttatcatttgcccgaatttgggaacgtttccatcagtctaggcaaaagaacgaacttcattgatgctgttggctcgttcagttgtagccagtgtggactggatgagtgtcagcgtgttttagctttttgcctggtacaggaaaacgttcccagcgtggatgatgttgatgatagcttaactgtagtttcataatttgggtgtccctgagttctgtgacctgtttattgataagtgaatgccgcatgatgatgctgttgctgcaaaa

SEQ ID NO: 4269 - DNA, 768 bp, Hordeum vulgare
ccggcctcctcctccctggtcggaacggagccgtggcaaccacacccctcccctcccttcccctcctcccccccgctcagcttcctagggtttcctcccgatccaaccccgacctccatggccaagaccaagcagggcaagagggacatcgactcctacaccatcaggggcaccaccaaggtcgtccgagtcggggactgcgtgctgatgcggccgtcggacacggacaacgcgccctacgtggcccgggtggagagcctggagtcggacggtcgggggagcgtgcgggtccgggtgcgttggtactaccggccggaggagtccaagggcggccgccggcagttccacggggccaaagagcttttcctctccgaccacttcgacacgcagagcgcacacactatcgagggcaagtgcatcgtccactccttcaagaactacaccaagctcgacaacgtcggccccgaggacttcttctgccgattcgagtacaaggcggccaccggggcattcacccccgaccgtgtcgccgtgtactgcaagtgcgagatgccgtacaacccagatgacctcatggtgcagtgtgagggatgcaaagactggttccatccaacctgtatgggaatgaccattgagcaggccaaaaagttagatactttcctgtgcgcagactgtgctaaagaaaatggtgcaaagagaccttcaaattcatacccgagttcaccaagttctgattctaaggtcagtgatgttttgttcccttttctt

SEQ ID NO: 4270 - DNA, 1288 bp, Setaria italica
gaaacgggcaagtggaaatcgaggcttgcgagcttcgttttaatttttttcttcttgaaagatcgagcttcgagccttggagctttcggtaaagttcatagtctccctaaactgcccttctcctcgtttctccagcagcgaacactccccctgtccgcttcccctccgctccccatttctcctctgctagggtttctccccctccaaatccacgctccacggccatggcgaagacgaagcaaggcaagaaggacgtggattcgtacactatccgcggcaccaacaaggtcgtccgagttggcgattgcgtgctgatgcggccgtcggactcggacaaccagccgtacgtggcgcgggtggagaagatggaggccgacggccgcggcagcgtgcgggtgcgggtgcgctggtactaccgccccgaggagtccaagggcggccgccggcagttccacggcgccaaggagctgttcctctccgaccacttcgacctgcagagcgcccacaccatcgagggcaagtgtgttgtacactctttcaagaactacaccaagctcgacaatgtcgggcccgaggacttcttctgccgattcgagtataaggcggcgaccggctcatttacccctgatcgtgtcgcagtgtattgcaagtgtgagatgccgtacaacccagatgatctcatggtacagtgcgacgcctgcaaagactggttccatccatcgtgcatgggcatgaccattgaacaggccaaaaagctagatcactttgtttgctcagactgtgtgaaggaaaatggatcaaagagactttcaaatgcatatgctacttccccaaattctgagcctaaggctgaatcgaaaaggcagaggaggtaacacaactccgagtgccagcatccatcgctgaggagacgcgctgccttccgtggcgtaccagcagcccttggcgtcactagagcggaggtgtacagtgcagtgcagtagaacaagtgtttgcggaacctttggctccgtcgttgtgagccgtcaggcattatgccgtgttatcggtggtacggttttgctggtttcagtcggtgtggcatgctgttgtaccgaacaggaaaacagccgcggtcgtgttggcttgtcggattagcagctgcttgtgcattgtgttgactgaactgaactgctgccggacagttccctctgtggctgataattcgagtcatgtgggtatctcctctgggctctgttgctgcagagcccaaacttttaacaatgttgccgtcctgttgttcctcgct

SEQ ID NO: 4271 - DNA, 1415 bp, Panicum virgatum
gcccttctccctgttcttcccactccgtcctccagcagcgaacactccccctgcccacttcgcttccactccccatttctcctctgctagggtttcctccccctccaaatcctcgccgcacggccatggcgaagacgaagcagggcaagaaggacgtggattcgtacaccatccgcggcaccaacaaggtcgtcagagttggcaactgcgtgcttatgcggccgtcggactcggacaatcagccgtacgtggcgcgggtggagaagatggaggccgacgggcgcggcagcgtgcgggtgcgggtgcgctggtactaccgccccgaggagtccaagggcggccgccggcagttccacggcgccaaggagctattcctctccgaccatttcgacctgcagagcgcccacaccatcgagggcaagtgtgttgtccattctttcaagaactacaccaagctcgacaatgtggggcccgaggacttcttctgccgatttgagtacaaggcggccaccggctcattcacccctgatcgcgtcgcagtgtactgcaagtgtgagatgccgtacaaccccgacgatctcatggtacaatgtgacgcgtgcaaggactggttccatccatcttgcatgggcatgaccattgaacaggcgaaaaagctagaccactttgtttgttcagactgtgtgaaggaaaatggaccaaagagactttcaaacggatatgctacgtccccaaattcggagcctaaggctgaatccaaaaggcagaggcggtaacagctcggagcgctagcatccatcgctgaggagatgcgctgcttctgcagcgaaccagcccgtcgcggttcacgagcgcggaggtctacagtgcagtatagctagtgtttgcggagcctccttaggctccgttgtctcttgggctgccaggcattatgtcctgttatcgggggaacggttttgttcgtttcagtcggtgtggcatgccgtacattgtacggcccggcgtgttgttcttgtgaggtaaacagggggtacagccttgccatgttatctagtcgtccgactaattgcgattagttgcgattagtcgggcttatcggtccggtgaccccgataagggacaccgagtaggtctgggcgactagttttctagtcgttcgactagtcgtcgactagtcgcgattagtcgcacgatcaggttggaaaacgatcagacttgagattgttttgtgggctgtttgagttgtgagcctcggccagcgatgggctggcaagctggcccattaggtttttggtatatagaggctgagagacaggaatagggactatgggacaggaatacagagttctggacagttcacaaatcatctctcacaaataagtgaaaaattgaccattattgttgccttcatactt

SEQ ID NO: 4272 - DNA, 2020 bp, Panicum virgatum
tcacaatccacaaacagcgaacattctagccccttgtggcgtcaacggcaaagccagcccatcaaatcagccgtccaaaaacatcagacgcagaaccagccagcgtccatcggacggcggagagaggccggtcgccacctggattcaaacgtcccgtcactcccactcaccgaaggaaattaccaagctgcccctagcccgctccttctccctcagcctcctgctccgtcggaacgggcagccgctgcattccccccctccctcacctccaccctcgcagctagggtttgctcccaatccaacgcctccgccatggctaagacgaagcaggggaagcgggacgtcgacgcctacaccatcaagggcaccaacaaggtggtccgagtgggggactgcgtgctgatgcggccggcggacacggacaacccgccgtacgtggcgcgggtggagcggatggagtcggatgggcgcggcggcgtgcgggtgcgggtgcgctggtactaccgccccgaggaggccaagggcggccgccgcccattccacggcgccaaggagctcttcctctccgaccacttcgacacgcagagcgcgcacaccatcgagggcaagtgcgtcgtccattccttcaagaactacaccaagctcgacaacgtcgggcctgaggatttctactgccgatttgactacaaggcgagcagcggcgcattcacccccgaccgtgtcgccgtgtattgcaagtgtgagatgccatacaacccggatgacctcatggtgcagtgtgagggatgcaaggactggttccatccatcctgtatgggaatgaccattgagcaggccaaaaagatagatcactacatgtgctccgactgtgctaaagaaaatggtgcaaagagaacctcaaattcatacccaggtccaacaaactctgattctaaggtcattgccttttttttctgtctttatcagttatcacatgactgcatagattgtttgctacttttctgtttttcatgtagtttctctttctatttgagatgatttttaggctgaccctgtaagatctgtttttgcatgcaatgtgtttccagaactggtggttgttgcctgttttcctaaattaattgatcagtgctttttgctgagttgttgactacatagcgctcaattttggtgatgactgctgcaattaactcttgaaactatttgcatgcgttgtggttatttttcatgtgtcttgcattgagcaatactgcaatactgcttcatgattatttgatccagcatctgtattattcttcattctgtatggtttaatttgtgtaagctgccctactgtaactttgtatcttgttagctaatggatccttgcattctcagtaagattatttatgctgcctctgtagagcattagcagcattgccgtctagcatctcatgcatgctattcttggtcattaatctttgatttggaatgctagtcgttaaacttgacttccagtcttctcttccaatgactgaagcatgttctccttgatcgataataccacctagtacattctgagcacctaaaaacatctcatagagatatggagcttgctattcgaattataatgagattactgctaatctgtgacattctggaaaacataagctatgatcacatgacaaatcagctatgttgcccggatacgcggatacggataccggtacgcgatacaaggatattccgatatgccatttttccaaaaacaaggatacggggatttgccaatatatataaaaaataaaaataaataaaagtttcaggaactagaatgtgagaaaatagaagttccaaggactataatgcgtcataaactcatattttcatatgttctataattattagaaaagggaaggggcaaaggaaaaaagaaccaaccttatcttacctgttcgtctgttccacgaatggatgtcggtcgtcttcttccccaacctccggcactccctctctctctctctctctctctctctctctt

SEQ ID NO: 4273 - DNA, 1148 bp, Setaria italica
tcgtttctccagcagcgaacactccccctgtccgcttcccctccgctccccatttctcctctgctagggtttctccccctccaaatccacgctccacggccatggcgaagacgaagcaaggcaagaaggacgtggattcgtacactatccgcggcaccaacaaggtcgtccgagttggcgattgcgtgctgatgcggccgtcggactcggacaaccagccgtacgtggcgcgggtggagaagatggaggccgacggccgcggcagcgtgcgggtgcgggtgcgctggtactaccgccccgaggagtccaagagcggccgcctgcagttccacggcgccaaggagctgttcctctccgaccacttcgacctgcagagcgcccacaccatcgagggcaagtgtgttgtacactctttcaagaactacaccaagctcgacaatgtcgggcccgaggacttcttctgccgattcgagtataaggcggcgaccggctcatttacccctgatcgtgtcgcagtgtattgcaagtgtgagatgccgtacaacccagatgatctcatggtacagtgcgacgcctgcaaagactggttccatccatcgtgcatgggcatgaccattgaacaggccaaaaagctagatcactttgtttgctcagactgtgtgaaggaaaatggatcaaagagactttcaaatgcatatgctacttccccaaattctgagcctaaggctgaatcgaaaaggcagaggaggtaacacaactccgagtgccagcatccatcgctgaggagacgcgctgccttccgtggcgtaccagcagcccttggcgtcactagagcggaggtgtacagtgcagtgcagtagaacaagtgtttgcggaacctttggctccgtcgttgtgagccgtcaggcattatgccgtgttatcggtggtacggttttgctggtttcagtcggtgtggcatgctgttgtaccgaacaggaaaacagccgcggtcgtgttggcttgtcggattagcagctgcttgtgcattgtgttgactgaactgaactgctgccggacagttccctctgtggctgataattcgagtcatgtgggtatctcctctgggctctgttgctgcagagcccaaacttttaacaatgttgccg

SEQ ID NO: 4274 - DNA, 1338 bp, Oryza sativa
gcagatttccccttcctccggccggatcggaacgcggccacttctcccagctccccacccatctcatcgtcgtcgcctctagggtttctctccccacctcccccctcctccacctcccaaaacctcgccccctcgccatggccaagaccaagcagggcaagcgggacgtcgactcctacaccatctccggcaccaacaaggtcgtacgagtgggggactgcgtgctgatgcggccggtggactcggacaaccagccgtacgtggcgcgggtggagaagatggagctggacgggcgcgggagcgtgcgggtgcgggtgcggtggtactaccggcccgaggagtccaagggcgggaggaggcagttccatggcgccaaggagctcttcctctccgaccacttcgacatgcagagcgccaacaccatcgagggcaagtgcgtcgtccactccttcaagaactacaccaagctcgacaacgtcggccccgaggacttcttctgccgcttcgagtacaaggccgccaccggcgccttcacccccgaccgcgtcgccgtatactgcaagtgtgagatgccatacaacccggatgatctcatggtgcagtgcgatgactgcaaggactggtttcatccttcatgcatgagcatgacgattgagcaggccaaaaaactagatcactttgtgtgctcagattgtgtcaaggaaaacggtgcaaagagaccttcacatgcatatgcaggttcaacaaagtatgagcctaaggctgagtcaaaaaggcagaggaggtgaaaactcttgactgggtaacatctgctgctgagggataccttgtgcttttccgtggcgaaggttgaggtgtacagtgcaagagaaccaaggcgtctgcagaattcggccttcgccgcctcttagcctgttcaagaaaagaaaaaaaaaagaacattatgttgtgttgctgttaggaaaacggcttcggcgcagctcagccgtcgctacggccacggctttgctgcgccggtcgtttggttagaggtggggggagagagttgaacaccaacaacacctgtggtgattgatgacttggttagctctgcgtgcagtgtgtgtgtgttaacttaattcctgtcagcaacatttcctttgtgagatgtgagcccttgtgaggctctgtgactgatgatgatcgagaatttctcatgtactccagtagtgtactactagcttagcttatctccttcaggcttcagatgtgtgtgtattgcatgtagtcttgcagagccattgatgaggatgtatcgttgttgcctgtcggccgccattgctggctgcctcctcctgc

SEQ ID NO: 4275 - DNA, 1162 bp, Sorghum bicolor
ctcgccccactactcatccatcctctctctcttcggcgacatggccagcgaccagcgagcaccttcccgccgccctcctccccgtgcctgcacccgcgctcgcgccgcaccacctctcacacgcgcggctatggcagatgtggcaagggcggcgacaaatccgccagatccaacatcaaggtttctacccctccaaatccgtcctcgctccacggccatggcgaagacgaagcagggaaagaaggacgtggattcgtacaccatccgcggcaccaacaagctcgtccatgtgggtgactgcgtgctgatgcgggcgtcggactcggacaaccaaccgtatgtggcgcgggtggagaagatggaggccgatgggcgcggcagcgtgcgggtgcgtgtgcgctggtactaccgccctgaggagtccaagggcggccgcctgcagttccacggcgccaaggagctattcctctccgaccatttcgacctgcagagcgcacacaccattgaggggaagtgcgttgtccactctttcaagaactacaccaagcttgacaatgtcgggcctgaggacttcttctgccgatttgagtacaaggcggccactggttccttcacccctgaccgcgtggcagtgtattgcaaatgtgagatgccatacaaccctgatgacctcatggtgcagtgcgacgcttgcaaggactggttccatccatcttgcatgtctatgaccattgaacaggccaaaaagctagatcactttgtttgctcagactgtttgaaagaaaatggttcaaagagactttcaaatgcatatgccacttcaccaaattctgagcccaaggctgaatcaaaaaggcagaggaggtgacaactccgattggcaacaacatccatgggtaagggggagatgtgctgcttatgtggtatatcagcccttttgctgtggtcagagcagtgtacagttcactagaaccagttgtttgctgttttaggggaacggttttgttcgatgtagccagtgtggcatcatcgcatgcagttgttggtagaggggcaaagaacaatccttgtgttgacttggtcagcttagccgttgttaatgtactgtgttaactgttaacagctccctttgggattgataatgcaagtcttgcagttgttg

SEQ ID NO: 4276 - DNA, 1011 bp, Amorphophallus konjac
gagaggaggagcaagacccagatggcgaagacgaagcctgggaagaaggatctcgaatcctacaccatcaagggcaccaacaaggttgtcaaagtgggggactgtgtgctgatgcggccgtcggacttggacaagccaccgtatgtggcacgtgtggagaagattgaggcagaccatcgcaacaacgtaaaggtgagggtgcggtggtactatcggcccgaggagtcaattgggggccgtcgccagttccatggggccaaggagctattcctttcagatcactatgatgtgcagagtgcccacaccatagagggcaagtgcattgttcactccttcaagaactatactaagctcgagaatgttggcgctgaggattacttctgccgctttgaatacaaggctgccactggcagcttcacccctgaccgagttgctgtgtattgcaagtgcgagatgccctataacccagatgacctcatggtccagtgtgaaggctgcaaggattggtttcatccttcttgcatgggcatgactattgaacaggcaaagaagttggatcactttctgtgttctgattgtggcactgaggatgactccaaaagatctctgaattcattccctgtatcaccagtctctgagcccaaggtggaatcaaaacgccggaagagatgaccgccggagatggggaaagtgtgcacttccttgcatgttagtgcgtcattgttggctgtggaatttgtacagtgccgaaaaacaggccgtgcttgcacaaaacgggggaacacttgaaaaaaaaaggagagttacatgtctgatatgatgtgttctcatgagggtgcatgcagagtgtttgtgtccatgtcaatacgagtcttgtgcaagtttctcgttaggtccatgatgacttggtgggtggttgtactctagagataaaacgtctcccggagaagtgtggatttttcgtgtctggtgtagtcttaaatttttattcaaggccctttggtgcagaag

SEQ ID NO: 4277 - DNA, 1011 bp, Avena sativa
gtcccaccctattcttccttgcctagggtttcttccctcccaaaacctcgaccgcggccatggccaagatcaagcaggggaagaaggacgtggattcctacaccatccgcggcaccaacaaagtcgtccgagtgggcgacaccgtgctgatgcggccgtcggacacggacaaccagccgtacgtggcgcgggtggagagcatggagacggacgggcgcggcagcgtgcgggtcaaggtgcgctggtactaccgcccagaggaggctaaggggggcaggcgccagttccacggtgccaaggagctcttccgctccgaccacctggacatgcagagcgcccacaccatcgagggcaagtgcatcgtgcactccttcaaggactacaccaagctcaacaacgtcggggccgaggacttcttctgccgctttgactacaatgccgcctctggcgccttcagccccgaccgtgtggccgtctactgcaagtgcgagatgccgtacaacccagatgatctcatggtgcagtgtgatgcgtgcaaggactggtttcatccatcttgtgtggagatgaccattgagcaggccaaaaaaatagatcactttatgtgctcagactgtgctgaggaaaatggcgaaaagaaaccttcaaatggatatggaccaaatgctgagcctaagactgaacccaaaagacagaggaggtaatcaactctgaccgcaaacatctatcgttgaatctctgtcagccctggatgctgcgaaggtcgaggtgtacagtgcaagagaaaagtgtttgcagaactcgcttcgtcgttaacgtgtcagccgttatttgtgacagtatggaatgttttgctctgtttagtctttatggcatggtgctacaatcgtttggtagaggcaagaatacagctttagatcttgtgtcgtgtgttaaattgggtcttttccttgtgactgataattagttctcatgtaatcttcaagatttactaataaatatgcagagtca

SEQ ID NO: 4278 - DNA, 1105 bp, Ananas comosus
cctctttctctcttcaccctagggtttctaacctcttacacctcactccctctctcactgccacaaacctcactacctcccccacccatcattcctacaaaccctacatagtcggagctgagctgagaaggcgatcgtgagagctaggcgatggcgaagaccaagcctgggaaaagagacctcgattcctacaccatcaagggaaccaacaagatcgtcaaagtgggggattgtgtcctgatgcgcccatccgactcggagaagcccccgtacgttgcgcgggtggagaagatcgaggcggatcaccggaacaatgtgcgggtgcgcgtgcgctggtattatcgccccgaggagtcgatcgggggccggcggcagttccacggcgccaaggagctcttcttgtcggaccactacgacgtgcagagcgcgcacaccatcgagggcaagtgcacggtccactccttcaagaactacaccaagctcgagaacgtcggggccgaggactacttctgccgcttcgagtacaaggccgccaccggcggattcactcctgatcgggtcgcggtactgtaagtgtgagatgccctataatccggatgacctcatggtgcagtgtgagggatgcaaggactggtttcatccatcttgtatgggcatgactattgaagaggccaaaaaattggatcacttcctgtgctcagattgtacttcggaagatgatgctaagaagccttcaaatgcatttcctgtttcaccaaattccgagcctaaggttgagtcgaaaagacggaagagatagttatgatacaaacagggcgtgcgaggagatacactatttatgccaaggtagctcttcaatgctgtctagatgagactgtacagtgtagaaaacagacttttgagaaatcaaatttggttttaacttaaatgagtatcatttgtatggcgaagtaaaactcaaatgttcgggtcttttgtatggtgtgtcttgctttgcattgattcctagttcagttgggctggcgaaagtgctcattgttcatgttatgtgcttggtgtcgctagaaacattgtgtgaaggtttaggtgttaagaattcttgcga

SEQ ID NO: 4279 - DNA, 2336 bp, Setaria italica
ccgagacgtacgcaacccgacgccccactcgcagaggcaccgggtctgcctcacgcacgcagcagcaggcgcggaaagcgacgcgcctccaccgccgctgcttgccgcctccctcccataagcccataccgcctcctgcgtcctgcccgggacgacgcggccaagcagcagcagagcgcccaaaccaccataagcgtctggcggcgcctgcgccaccttgaagcaagcaccgcccgtgcgattggcggattgaagaagctagcattcgaagcggcggccgggaggggtggagcggagatggtggcggcggcgctggacgcaatggcggggacgcggtgggggcggtggctggggcttgtgacggcggtgtgggtgcagtgcatctccggcaacaactacaccttctccaactactcgcacgcgctcaagacgctcatgggcctgacgcagctgcagctcaacgggctctccgtcgccaaggacgtcggcaaggcgttcggcctcctcgcgggtctcgcctccgaccgcgtcccgacctggctcctcctcgccatcggctccctcgagggcctcctcggctacggcgcgcagtggatggtcgtgtccggggccgtcgcgccgctcccctactggcagatgtgcgtcttcctctgcctcggcgggaacagcaccacgtggatgaacaccgccgtgctcgtcacgtgcatccgcaacttccgccgcagcaggggccccgtctccggcctgctcaaggggtacgtcggcctcagcaccgccatcttcaccgacgtctgctccgcgctcttcgccgacgaccccgcgtcgttcctcgtcatgctcgccgtcgtgcccgccgcggtctgcgcgctcgccatggtcttcctccgcgagggccccaacggcggcgccgcgggcggggccaccgcggacgaggcggaggacggccgctgcttcgccgccatcaactcgctcgccgtcgccatcgcgctgtacctcctcgccgccgacctcaccggcatcggcgcccgcggcggggccgtatcggccgtcttcgtggccgtgctcctggtgctcctcgcgtcccccggcgccgtgccggcgctcctggcgtggaagtcgtgggtgaaggcccgcaaggccgcgaacgccgacctcgaggaggcggactccttggcggccgcggcggcgccgctcctcgtcgcggcgaagacggcggcggggaggagcgaggaggaggaggcgcgggcgcccggcgagcggccgcggctcggggaggagcacaccatcgcgcaggcgctgacgtcgctggacttctggctgatgttcgcgtcgttcctgatgggcgtgggcacggggctggccgtgatgaacaacctggggcagatgggcgtggccatgggctacgccgacgtctccatcttcgtctccatgaccagcatctggggattcttcggccgcatcgcatccggaaccatctccgagcacttcatcaagacacgggcgatcccacgcccgctgtggaacgcagcctcgcaggtcctgatggccgtgggctacatcgtgatggcgctggccatcccgggctccctcttcatcggctcggtggtcgtcggcgcctgctacggcgtgcggctggcggtcacggtgccgacggcgtccgagctgttcgggctcaagtactacggcctcatctacaacatcctcatcctcaacctgcccctgggctccttcctcttctcgggcatgctggcgggcctcctctacgacgcggaggccaccccggtgccgggcggcggcaacacatgcgtcggcgcgcactgctaccgcctcgtgttcctgatcatggccgtcgcctgcgccgtcgggttcggcatcgacgtcctgctctccgtcaggacgaagcgggtttacgccaagatccacgagagcaagagggcgagcaggtcggccgtggcgcagagggtgagctagcctcgatgcttctgtggagaggctcgatggaacgggaccgcgccattagcgttctggggttgcgccctgtcaatttttgtgtgaataataagggaaggggattcatagtcttgattctttggacaagatggatggatcgattcgattgcttggcactgccatatggaactgtggaactgttggctggtaaagagtgctgctagcgaagtgtagtgttactggagtactgacggagaaagctacaaaattttgttggttctccttcattttcgtggcgctgtgtattgtaaaaagtgtactgtaccctgatcgcaacggtgtaatataaattggtttgatcgtagcgcagaacctgtggtatactg

SEQ ID NO: 4280 - DNA, 2355 bp, Setaria italica
caaacccccaacgacaccgagacgtacgcaacccgacgccccactcgcagaggcaccgggtctgcctcacgcacgcagcagcaggcgcggaaagcgacgcgcctccaccgccgctgcttgccgcctccctcccataagcccataccgcctcctgcgtcctgcccgggacgacgcggccaagcagcagcagagcgcccaaaccaccataagcgtctggcggcgcctgcgccaccttgaagcaagcaccgcccgtgcgattggcggattgaagaagctagcattcgaagcggcggccgggaggggtggagcggagatggtggcggcggcgctggacgcaatggcggggacgcggtgggggcggtggctggggcttgtgacggcggtgtgggtgcagtgcatctccggcaacaactacaccttctccaactactcgcacgcgctcaagacgctcatgggcctgacgcagctgcagctcaacgggctctccgtcgccaaggacgtcggcaaggcgttcggcctcctcgcgggtctcgcctccgaccgcgtcccgacctggctcctcctcgccatcggctccctcgagggcctcctcggctacggcgcgcagtggatggtcgtgtccggggccgtcgcgccgctcccctactggcagatgtgcgtcttcctctgcctcggcgggaacagcaccacgtggatgaacaccgccgtgctcgtcacgtgcatccgcaacttccgccgcagcaggggccccgtctccggcctgctcaaggggtacgtcggcctcagcaccgccatcttcaccgacgtctgctccgcgctcttcgccgacgaccccgcgtcgttcctcgtcatgctcgccgtcgtgcccgccgcggtctgcgcgctcgccatggtcttcctccgcgagggccccaacggcggcgccgcgggcggggccaccgcggacgaggcggaggacggccgctgcttcgccgccatcaactcgctcgccgtcgccatcgcgctgtacctcctcgccgccgacctcaccggcatcggcgcccgcggcggggccgtatcggccgtcttcgtggccgtgctcctggtgctcctcgcgtcccccggcgccgtgccggcgctcctggcgtggaagtcgtgggtgaaggcccgcaaggccgcgaacgccgacctcgaggaggcggactccttggcggccgcggcggcgccgctcctcgtcgcggcgaagacggcggcggggaggagcgaggaggaggaggcgcgggcgcccggcgagcggccgcggctcggggaggagcacaccatcgcgcaggcgctgacgtcgctggacttctggctgatgttcgcgtcgttcctgatgggcgtgggcacggggctggccgtgatgaacaacctggggcagatgggcgtggccatgggctacgccgacgtctccatcttcgtctccatgaccagcatctggggattcttcggccgcatcgcatccggaaccatctccgagcacttcatcaagacacgggcgatcccacgcccgctgtggaacgcagcctcgcaggtcctgatggccgtgggctacatcgtgatggcgctggccatcccgggctccctcttcatcggctcggtggtcgtcggcgcctgctacggcgtgcggctggcggtcacggtgccgacggcgtccgagctgttcgggctcaagtactacggcctcatctacaacatcctcatcctcaacctgcccctgggctccttcctcttctcgggcatgctggcgggcctcctctacgacgcggaggccaccccggtgccgggcggcggcaacacatgcgtcggcgcgcactgctaccgcctcgtgttcctgatcatggccgtcgcctgcgccgtcgggttcggcatcgacgtcctgctctccgtcaggacgaagcgggtttacgccaagatccacgagagcaagagggcgagcaggtcggccgtggcgcagagggtgagctagcctcgatgcttctgtggagaggctcgatggaacgggaccgcgccattagcgttctggggttgcgccctgtcaatttttgtgtgaataataagggaaggggattcatagtcttgattctttggacaagatggatggatcgattcgattgcttggcactgccatatggaactgtggaactgttggctggtaaagagtgctgctagcgaagtgtagtgttactggagtactgacggagaaagctacaaaattttgttggttctccttcattttcgtggcgctgtgtattgtaaaaagtgtactgtaccctgatcgcaacggtgtaatataaattggtttgatcgtagcgcagaacctgtggtatactggac

SEQ ID NO: 4281 - DNA, 1960 bp, Zea mays
cctcgagtcccgcccgacgcaccggaaagcgacgcgcctccaccgccccttccgtacctcctcctcctcctcctcgggacacacggccaagcaccaagcgaccaaacgcgcgccaccttgattgaactcgaagcaagcaaggaaaggccctaatggcggggacgcgctgggggcggtggctggggctggtgacggcggtgtgggtgcagtgcatctccggcaacaactacaccttctccaactactcgcacgcgctcaagacgctcatgggcctcacgcagctgcagctcaacggcctctccgtcgccaaggacgtcggcaaggcgttcggcctcctcgcggggctggcgtccgaccgcgtccccacctggctcctcctcgccgtcggctccctcgagggcctcctcggctacggcgcgcagtggatggtcgtgtccggggccgtcgcgccgctcccgtactggcagatgtgcgtcttcctctgtctcggcgggaacagcaccacatggatgaacaccgccgtgctcgtcacctgcatccgcaacttccgccggagtaggggccccgtctccggcctgctcaagggctacgtcggcctcagcaccgccatcttcaccgacacctgctccgcgctcttcgccgacgacccggcctcgttcctcgtcatgctcgccgtcgtgccggccgccgtctgcgcgctcgccatggtgttcctccgcgagggcgccgccgctgcggacgaggacgacgacgggcgctgcttcgccgcgatcaactcgctcgccgtggcaatcgcgctgtacctcctcgccgcggacctcacggggctcggcggcgggggcggggtcgtcttcgtcgccgtgctcctggtgctcctcgcgtcccccgctgccgtgccggcgatcctggcgtggaaatcgtgggcggagacccgcaaggccgcgaacgccgacctcgaggaggcggactccttggccgcggccgcgccgctgcttctcgtcgcgaaggaggcgcgtgctcccggagagcggccgcgcctcggggaggagcacacgatcgcgcagacgctcacgtcgctggacttctggctgatgttcgcgtcgttcctgatgggcgtgggcacggggctggccgtgatgaacaacctggggcagatgggcgtggccatgggctacgtcgacgtctccctcttcgtctccatgaccagcatctggggattcttcggtcgcatcgcctccggcaccatctccgagcacttcatcaagacacgaggtattccccgcccgctgtggaacgcagcctcgcaggtcctgatggccgtcggatacatcgtgatggcgctggcgatgccaggctccctcttcatcggctcggtggtcgtcggcatctgctacggcgtgcggctggcggtcaccgtgcccacggcgtcggagctgttcggcctcaagtactacggtctcgtctacaacgtcctcatcctcaacctgccgctcggctccttcctcttctcgggcctgctggcgggcctcctctacgacgcggaagccaccgcggtgcccggcggcggcaacacctgcgtcggcgcacactgctaccgcctcgtcttcctgatcatggcgctcgcctgcgtcgtcgggttcggcctcgacgtcctgctctgcgtccggacgaagagggtgtacgccaagatccacgagagcaagcggttgagcaggtcagccgtggcggagagggtgggttagcttagcaacgcacgcggcgccggcggctctgtggaagcgttggaattcagaagcacctccgcaattttaagggccattcttgtctttattctatttctagggaaaagatgggatcaatttgattgatacagttgattgccactaagtactaattgagggggggctgcggcctgcagattttgctggttcgccagcacggtgtctactcttgaaacgta

SEQ ID NO: 4282 - DNA, 2319 bp, Oryza sativa
gctgcttacatgcaaaaaaactcccataaacccctcctcttcgagaaaatccctttttgttcaaccacgacgcgaattcccaagcaacccccccacacccagctgagtagctgacgcagcaccagcagtcgcggggaaagggacacgtctcgccgccccagcttcccgcctccttcccatcccgccgccgcggacgcgtccaagccacagcaacagcaacccctccgacgaacacctcgcctgcgcgatggtggcggcggcgctggacgcgatggcggggacgaggtgggggaggtggctggggctcgtgacggcggtgtgggtgcagtgcatctccggcaacaactacaccttctccaactactcccactccatcaagacgctcatgggcctcacccagctgcagctcaacggcctctccgtcgccaaggacgtcggcaaggcgttcggcctcctcgccggcctcgcctccgaccgcgtccccacctggcttctcctcgccgtcggctccctcgagggcctcctcggctacggcgcgcagtggctcgtcgtgtcccgggccgtcgcgccgctgccctactggcagatgtgcgtcttcctctgcctcggcgggaacagcacgacgtggatgaacaccgccgtgctcgtcacctgcatccgcaacttccgccggagcagggggccggtgtccgggttgctcaagggctatgtggggctcagcacggcgatcttcaccgacgtctgctccgcgctcttcgccgacgacccggcctcgttcctcgtcatgctcgccgtcgtgccggccgcggtgtgcgcggtcgccatggtgttcctccgcgagggggaggttggcggcggcggcgcggacgggcgggaggaggaggaggaggatgggtggtgcttcgccgcaatcaacacgctcgccgtcgccatcgcgctgtacctcctcgccgccgacctcaccggcgtcgggggaggcggcggggtcgtgtcggccgtcttcgtggccgtcctccttgtgctcctcgcgtcccccgccgcggtgccggcgcacgtggcgtggaagtcctggatgaagacgcggaagctcgcgaacgccgacgtcgaggaggcggaggagtgcgcgtccgccccgctcctcgtggcgaaggcgacggcggcggcggcggcggaggcgcgcggccccggcgagaagccggtgctcggggaggagcacacgatcgcgcaggcgctcatgtcgctggacttctggctcatgttcgcgtcgttcctgatgggcgtcggcacggggctcgccgtgatgaacaacctggggcagatgggcgtcgccatgggctactccgacgtctccctcttcgtctccatgaccagcatctggggattcttcggccgcatcgcctccgggaccatctccgagcacttcatcaagacaagagcaattccacgccccttgtggaatgcagcttcgcaaatcctgatggccgtgggctatgttgtgatggcagttggtatgccaggctccctcttcgtcggctccgttgtggttggcatctgctacggtgtccgcctggcggtcaccgtgccaacagcatctgaactgttcggtctcaagtactacggcctcatctacaacatcctcattctcaacttaccactcggctccttcctcttctctggccttcttgctggcctcctctacgacgcgcaggccaccaaggtacccggtggtggcaacacctgtgttggtgcgcactgctaccgcctcgtgttcgtggtcatggcgattgcctgcgtcgtcgggttcggtttggatgtcttgctgtgcttcaggaccaagagggtgtatgccaagatccatgagagcaagaggcagagcaggtcggcagttgtgcagagggtaagctagccaaaacctacagctatgagaaaaatggtacagattcgcgcaattgcatcaagattcaatgattcaacgagtgcaggttctgtaaattttgtgcaaataagaggatcccatgtcttgattctttggaattagatggatggatccattcaatcggtatagtttaactgccacggaggtttctaggggctgattcgagcaatgtttgccctgtgtgtgtaattcagtactagtactgactactactgactgagaggctgcagattgtggagttgtctgatccctcggtgtaatcagtttagtcagtgtatccttgaggaaatgtattctcggttttagcctgtacgatgaattgttgtgcaattagcctgttggcatataaattcagatcaattcaagccattctttttggaaca

SEQ ID NO: 4283 - DNA, 2595 bp, Brachypodium distachyon
tcaaccaatacaactcccaggtcgcccgcccgcccacacacgccgaccgactgaccgacgcgacacgctccgaaagcaacacgcctctaccgcccccgcttccgccctccctccctcccataccgcctcccgacgcagacgcagacgcagacgcaacgcaagaaccccaccgggcgacaggcgcaggaaacccatagtagcgcgcacgctcgtcgctcaggagtgcgaagcgtattggggacgatcgacgggatggtgtcgtcggcgctggacgcaatgtcggggacggcgtgggggcggtggctgggcctcgtggcggcggtgtgggtgcagtgcatctcggggaacaactacaccttctccaactactccgactccatcaagacgctcatgggcctcacgcagctgcagctcaacgggctctccgtggccaaggacgtgggcaaggcgttcgggctcgtggccgggctcgcctccgaccgcgtccccacctggctcctcctcgccatcggctccctcgagggcttcctcggctacggtgcgcagtggctcgtcgtctcccgcgccgtcgcgccgccgccctactggcagatgtgcgtctggctctgcctcggcggcaacagcaccacatggatgaacaccgccgtgctcgtcacctgcatccgcaacttcagggggagcaggggccccgtgtccggggtgctcaaggggtatgtcgggctgagcacggcgattttcaccgacgtgtgctccgcgctcttcgccgacgacccggcctcgttcctcgtcatgctcgccgtcgtgcccgccgccgtgtgcgccgtcgccatggtgttccttcgcgagggcccgcaggccgccgccgccgcgggcaggcaggaggaagatgacgcgaggggattcaccgcgataagcatgctcgccgtggccatcgcgctgtacctcctggcggccgacctcacgggcaccggcgggggcggcggggtcgtctcgaccatcttcgtcgccgtgctgctggtgctcctggcggcccccgtcgccgtgccggcgcacgtggcgttgaggtcgtggatgaaatctcggaaggcgccgaacgcggacgccgaggcggcggaggccgcggcggcggcggcggagtcgacgaccgcaccgcttctactcgcggcggcgccggcgaagggggaggagcggaatgggtcggaggcggaggcgcggggccccggcgagaggccgcggctcggtgaggagcacacgatagcgcaggcgcttgcgtcgatggacttctggctgctgttcacctccttcctgatgggcgtcggaaccgggctggccgtgatgaacaacctgggccagatgggctccgccatgggctactccgacgtctccatcttcgtctccatgaccagcatctggggattcttcggccgcctcgcctccggcaccatctccgagcacttcatcaagacaagagcaacgccgcggccggcatggaacgcggcgtcccaggtgctgatggcggcggggtacgtggtgatggcgctgggcatgccgggctcgctcttcgtgggctctgttgtcgtcggcatctgctacggcgtgcgcgtggcggtgaccgtgccgacggcgtcggagctgttcgggctcaagcactacggcctcatctacaacatcctcatcctcaacctgccgctgggctccttcctcttctccggcctcctcgctggcctgctctacgacgctgaggccaccgcggtgcccggcggcggcaacacctgcgccggcgcgcactgctaccgcctcgtgttcgtcgtcatggccgtcgcctgcgtcgccgggttcgccctcgacgtgctcctcagcctcaggaccaggagggtgtacgctaagatccaccaagcgaagagcaggtctgcctccgtgcagagggtcagctagccattcttctcccagaaatgcaacttgtcgcgcattagcattcagtggcattttcgaagaagaactgaagaacagtgtacggagtacatcggtaaggggattatcctctgaagattcatgcatgccttcattctttgggcaaatatggattccattggtatatgtagcgtgctgccagggaagttcatggcggctgatttgggtggagaaattgtttcgtcagctgtagcagtagtgtactactgaccgagaaggctgcactttgcgtatagctttccccccttcggtttattagtgcgtaccctgcagagaagcttttgtaaacttgtagtggttgcatttgtaccttacaggatatacgtgtgccctggggacaacggtgtagtggttgtacatttgagcttgtttgtcatacgagctcgcatcaattcaaaactacgattcttgaatattcttctgtgcgtttgaggaattcactacttgcaggattacatggctgttggctgattcgacggaagtgctgttaatgtaaactgcagtgctgaattgtaggtttgccaactgcatcctactctttccctttagtgtgtgacctgaacctgaggaggagtagaagatattgcagacttgcagttgctgtagcattagcttctgtagaac

SEQ ID NO: 4284 - DNA, 2399 bp, Brachypodium distachyon
caaccaatacaactcccaggtcgcccgcccgcccacacacgccgaccgactgaccgacgcgacacgctccgaaagcaacacgcctctaccgcccccgcttccgccctccctccctcccataccgcctcccgacgcagacgcagacgcagacgcaacgcaagaaccccaccgggcgacaggcgcaggaaacccatagtagcgcgcacgctcgtcgctcaggagtgcgaagcgtattggggacgatcgacgggatggtgtcgtcggcgctggacgcaatgtcggggacggcgtgggggcggtggctgggcctcgtggcggcggtgtgggtgcagtgcatctcggggaacaactacaccttctccaactactccgactccatcaagacgctcatgggcctcacgcagctgcagctcaacgggctctccgtggccaaggacgtgggcaaggcgttcgggctcgtggccgggctcgcctccgaccgcgtccccacctggctcctcctcgccatcggctccctcgagggcttcctcggctacggtgcgcagtggctcgtcgtctcccgcgccgtcgcgccgccgccctactggcagatgtgcgtctggctctgcctcggcggcaacagcaccacatggatgaacaccgccgtgctcgtcacctgcatccgcaacttcagggggagcaggggccccgtgtccggggtgctcaaggggtatgtcgggctgagcacggcgattttcaccgacgtgtgctccgcgctcttcgccgacgacccggcctcgttcctcgtcatgctcgccgtcgtgcccgccgccgtgtgcgccgtcgccatggtgttccttcgcgagggcccgcaggccgccgccgccgcgggcaggcaggaggaagatgacgcgaggggattcaccgcgataagcatgctcgccgtggccatcgcgctgtacctcctggcggccgacctcacgggcaccggcgggggcggcggggtcgtctcgaccatcttcgtcgccgtgctgctggtgctcctggcggcccccgtcgccgtgccggcgcacgtggcgttgaggtcgtggatgaaatctcggaaggcgccgaacgcggacgccgaggcggcggaggccgcggcggcggcggcggagtcgacgaccgcaccgcttctactcgcggcggcgccggcgaagggggaggagcggaatgggtcggaggcggaggcgcggggccccggcgagaggccgcggctcggtgaggagcacacgatagcgcaggcgcttgcgtcgatggacttctggctgctgttcacctccttcctgatgggcgtcggaaccgggctggccgtgatgaacaacctgggccagatgggctccgccatgggctactccgacgtctccatcttcgtctccatgaccagcatctggggattcttcggccgcctcgcctccggcaccatctccgagcacttcatcaagacaagagcaacgccgcggccggcatggaacgcggcgtcccaggtgctgatggcggcggggtacgtggtgatggcgctgggcatgccgggctcgctcttcgtgggctctgttgtcgtcggcatctgctacggcgtgcgcgtggcggtgaccgtgccgacggcgtcggagctgttcgggctcaagcactacggcctcatctacaacatcctcatcctcaacctgccgctgggctccttcctcttctccggcctcctcgctggcctgctctacgacgctgaggccaccgcggtgcccggcggcggcaacacctgcgccggcgcgcactgctaccgcctcgtgttcgtcgtcatggccgtcgcctgcgtcgccgggttcgccctcgacgtgctcctcagcctcaggaccaggagggtgtacgctaagatccaccaagcgaagagcaggtctgcctccgtgcagagggtcagctagccattcttctcccagaaatgcaacttgtcgcgcattagcattcagtggcattttcgaagaagaactgaagaacagtgtacggagtacatcggtaaggggattatcctctgaagattcatgcatgccttcattctttgggcaaatatggattccattggtatatgtagcgtgctgccagggaagttcatggcggctgatttgggtggagaaattgtttcgtcagctgtagcagtagtgtactactgaccgagaaggctgcactttgcgtatagctttccccccttcggtttattagtgcgtaccctgcagagaagcttttgtaaacttgtagtggttgcatttgtaccttacaggatatacgtgtgccctggggacaacggtgtagtggttgtacatttgagcttgtttgtcatacgagctcgcatcaattcaaaactacgattcttgaatattcttctgtgcgtt

SEQ ID NO: 4285 - DNA, 2331 bp, Hordeum vulgare
ccccccaggcgaaacgaaaacccccataccataccatacgcccgcacgcaccgtcccactgacccgcggaaagcaccgcccccgctcccgccctccctcccataccacctcccacacgcggccaaagccaaagcaagctgtgaagccgagccgtagtaggtagcgggttgtcgtcgtcggcggcgatggtgacgacggcgctggacgcgatggcggggacggcgtggggacggtggctggggctggtggcggcggtgtgggtgcagtgcatctcgggcaacaactacaccttctccaactactccgactccatcaagacgctcatgggcctcacccagctgcagctcaacggcctctccgtcgccaaggacgtcggcaaggcgttcggcctgctggccgggctcgcctccgaccgcgtccccacctggctcctcctcgccgtcggctccctcgagggcttcctcggctacggcgcgcagtggctcgtcgtctccagggccgtcgcgccgctgccctactggcagatgtgcgtctgcctctgcctcggcggcaactccaccacctggatgaacaccgccgtgctcgtcacctgcatccgcaacttccggggcagcaggggccccgtctcgggcgtcctcaaggggtacgtcggcctcagcaccgccatcttcaccgacgtctgctccgcgctcttcgccgacgacccggcctccttcctcgtcatgctcgccgtcgtgcccgccgccgtctgcgccgtcgccatggtcttcctccgcgagggccgcgtggccgactctgactgcaccggtgcggccggggacgaggccgacgcgcgcgggttcgcggccatcagcacgctcgcggtcgccatcgcgctctacctcctggcggccgacctgaccggcgtggggggcggcggcggggtcgtgtccaccgtcttcgtggccgtgctgatggtgctcctcgcggccccggtcgccgtgccggcgtacgtgggctggacgtcctggatgaagtcccgcaaggcggccaacgccgacgcggaggacgcggccgcacccctgctgctcgactcgaaggcggcggcggcggcgcagcagggcagcgaggcggaggaggcgcgcgggcccggggagcggccgcggctcggggaggagcacacgatagcggaggcgctggcgtcggtggacttctgggtgctcttctcgtcgttcctgatgggggtgggcacggggctggcggtgatgaacaacctggggcagatgggcgtggccatgggctacgccgacgtctccctcttcgtctccatgaccagcatctggggcttcttcggccgcatcgcctctggcaccatctccgagcacttcatcaagacgagggcgctgccgcggcccgtgtggaacgcggcgtcgcaggtgctcatgtgcgcagggtacgtgctgatggcgttcggcatgccgggatccctcttcgtcggctcggtggtggtcggcgtctgctacggcgtgcggctggcggtcaccgtgcccacggcgtcggagctgttcggcctcaagtactacggcctcatctacaacatcctcatcctcaacctgccgctcggatccttcctcttctcgggcctcctcgcgggactcctctacgacgcggaggccaccaaggtgcccggcggtggcaacacctgctccggcgctcactgctaccgcctcgtcttcgtcgtcatggccgctgcctgcgtcgtcggcttcggcctcgacgtgctcctcagcctcaggaccaggcgggtctacgccaagatccaccaggccaagcgggccaagaggttggccgccgccgcacagagggtgagctaacctcgctgccgctcttctcatgagaaactgcacagtttacagcctttcaggctgaagaacagtcctctaaattttgcgcatcagttaaggggatgccttgattaagtggatacatgccttgattctttgggcaaagatggatagtatagattcaattggtatactcatactcatacgtatggatggatggtatacactatggctatgtgcatcgatctatgcaaatgccaccattttctgaaaacagattgtgtactgccagggaagttcataggctgctagatggaactgttgtttttgttaggtgaagtagaatgctcctgcctgagaaggcgttggatcgtgtggctttccaacccctttcagtttcgcatgtatcttgctgagaaggttgtaaactagtacggagtactatgttgctgtttgtagccaattcggcattagatgtcgcaacaattcaagtgcatatcttttcatc

SEQ ID NO: 4286 - DNA, 2313 bp, Triticum aestivum
ggcgagacgaaaacccccacccgccccactgacgcggcgcgacacgcgcggaaagcaacgcgcctccaccgcccccgctcccgccctccctcccataccgcctcccgcccactccgaggcaggcagccaagcagacgcggccaaagcaaagggaaagaggagccgtggtaggtaacgttggccgccggcgatggtgtcgacggcgctggacgcgatggcggggacggcgtgggggcggtggctggggctggtggcggcggtgtgggtgcagtgcatctcgggcaacaactacaccttctccaactactccgactccatcaagacgctcatgggcctcacgcagctgcagctcaacggcctctccgtcgccaaggacgtcggcaaggccttcggcctgctcgcggggctcgcctccgaccgcctccccacctggctcctcctcgccatcggctccctcgagggcttcctcggctacggcgcgcagtggctcgtcgtctccaaaaccatatcgccgctgccctactggcagatgtgcgtctgcctctgcctcggcggcaactccaccacctggatgaacaccgccgtgctcgtcacctgcatccgcaacttccgcggcagcaggggccccgtctccggggtcctcaagggctacgtggggctcagcaccgccatcttcaccgacgtctgctccgcgctcttcgccgacgacccggcctccttcctcgtcatgctcgccgtcgtgcccgccgccgtctgcgccgtcgccatggtgttcctccgcgagggccgcgtcgccagcgccgactcgggcggggacgaggccgacgcgcgcggcttcgcggccatcagcacgctcgccgtcgccatcgcgctctacctcctggcggccgacctcacgggcgtgggcggcggcggggggctcgtctccaccgtcttcgtggccgtgctgatggtgctcctcgccgcccccgccgccgtgcccgcgtacgtgggctggacgtcctggatgaagtcccgcaaggcggccaacgccgacgccgaggacgcggccgcccccctgctgctcgactccaaggaggcgacgcagccgcagggcaacggggaggcggaggaggctcgcgggccgcggctgggggaggagcacacgatcgcggaggcgctgtcgtcggtggacttctgggtgctcttctcgtcgttcctgatgggcgtgggcacggggctggcggtgatgaacaacctggggcagatgggcgtggccatgggctacactgacgtgtccatcttcgtctccatgaccagcatatggggcttcttcggccgcctcgcctccggcaccatctccgagcacttcatcaagacgagggcgctgccgcggccggtgtggaacgcggcgtcgcaggtgctcatgtgcgcggggtacgtggtgatggccttcggcatgccggggtccctcttcgtcggctcggtggtggtgggcgtctgctacggtgtgcggctggcggtcaccgtgcccacggcgtcggagctgttcggcctcaagtactacggcctcatctacaacatcctcatcctcaacctgccgctcggctccttcctcttctcgggcctgctggcggggctcctctacgacgcggaggccaccaaggtgcccggcggcggcaacacctgctccggcgcgcactgctaccgcctcgtcttcgtcgtcatggccgccgcctgcgtcgtcggcttcggcctcgacgtgctcctcagcctcaggaccaggcgggtctacgccaagatccaccaggccaagcgggccaagaggtcggccgccgccgcgcagagggtgagctaagctggccggccggtagccgcctctcttctcagagaaactcagctggctgcacagctagcacctacgtactagcagtttttcagactgatgaagagcaacagcgtctgcactgtaaagttttgcgcagcaatgtacatgccttgattcttttgggcaaagatggatagtatatagattcaattggtatactggatgatatatactgtatgctactatggctgtgcaatagattgatgcagaggccggtggtagctccttcattctctgaaaacaaacagattgtgtactgccagggaagttcatagttcaaatttgaacaaaaaccacgccaagtatttccgagcggaggcagtagtagtatgtttgtgtttgtagcctgttcggcataagagctcgcatcaattcaagtgcatttcttttcctcgcctgtctgtctgtctgttattatctgtgctcggctcagtacatggaattaa

SEQ ID NO: 4287 - DNA, 5418 bp, Zea mays
ggaagctagggacacggttccacctgtggtctacagtgcagtagtagagaagagaacatggtgctccctttctataaaaaagaactaaaaaaagatagcttactttctttatgtcagacgttctattctgttttgatttttttttcaaattttctgtatggaaaccttttgttacaaacgaatgtcatgccaaatatcgaaagctctcgtacgccttcgtctaatcgtcttctctactgtccctgttttgttcctcctcgtcgcttggcgcttccagagaaaaacccgaaagacgtctcgtgtcgcctccactaggcacgtcctggaaccttgcggggccggtattggaaagcaggcaagcacaacagcgatcccacaaaccacagctcggctcctcttcgccgtcgcaaccgatttatatatggcgatggaggcgtcggcggcctccgacgaaaccctagccgccgtcttcgcccagctcaagctccacaccgtcgctctcctcgacctcctccgcactcgccgccccatctctagctccggctcctccctacgcgaaatggccgctttcctccgcgccgccccggccccggcgctgcagctctgcttcgattatacagtgtttccactgctcctgctcctggatgcggcggtgcagtgcaggaagcaaggcaatgcgccggggcaggttgcagggggcattgatataggtgatgccgtcgccgaagctggtctgacctgccttgaggtcctcctcaccaagtgccacctcacctcggtcaatcagatggtagcaatgctgaaaaagttgacttccggggctatgctttcaccttcagaggcttcagaggaattccgtggtgcaattattagatgcttcagggctttggttttgcagttacagccatgcttggaccatttttgttcttgcaaacacggaatagtgttacctacgatcccaaccagtacatgcttggaggttagaagtgtagtccgcccaaatcactctgcgcagccagaggagtgcttgcttgcatttcttcagtctcaaaatgcttcagctgccgtaggacattggctctcacttcttctacaagcatcagaacttgaggcatcaagggggcaccggggaagtgcagatgttaggaaggaatcattgcacacgctgcgcattcttattggcaaggtaggctctgctgatgcacttgcctttttccttcctggaattgtcagtcgccttgggaaggttctctacacagctaagactatgattagtggtgctgctgggagttctttgagcattgaacaagccattcttggattgaccgaggctttgatgatagtactaaatgacaaggaaaatcttagtgcacttggtaagcacaagaatgagaatcattctggtggcagtgagtcaactgagcatatattgcagatgcttcgccagttgccaaccaaaaatatatctgataagataagccatgatgagattacagatgattctgtctccaatgtcaataattcctttgctgatagaaaggcactgcatgtgaagcggaccaaaaaatggcttgaggaaacaactagtaatgttgataaattgctgtctgctacattcccacatcttgctattcattcatctgagaaggtaaggaaggcagtggttagtggtgtaaaagggcttttgtctagttgcagttctacattaaaaagaaccaagatgctacttttggaatgtttatgtgttctggcatgtgatgatgctgcagctgtgtctgaggctgcacaagatgctcttgatcatcttttcaaccaaggccacaatctcgtaacagaaaaggagatttctgatacctttactaggctggttgaaaggctaccacaagtggtacttggaagcgaggagacaaccgcactttcacatgctaggatgttgttggctctgaccttttatgctggtccccagtttctgataaatcatcttcaccgttctcctgtcattgctgctcgtttctttgattgtttgggtttatgcataggtcatagctcacagttttctggttccatggacaagctaattgtatcaaagccactatctattgggtatctttattcagttgctgagttgaagagtggcgcctattctaaagatacaactaacatatctctgcatgccacgtcaacatctgcagcctccaaaatatctgttatccatgataatgctttgccaaatgcattacttggtacagttgaatatgagttgccccatgtgcctccatggttttttcatgctggtagccagaagctttatggggttcttgctggaataattagacttgttggcctatcaacagtgtcaggggaaggaactgctgcaaccttgtctctctttgttgatattctgcttgatcagtttaggaggttgagcactgagctgagagacaaagatgtttacaacgatggtctgcagcggtggtacatgaaaggtgaagctggacaagcattgcgccaggctagttcagctgtctgcatgctcaatgagctcatgtatggtttgtcaggtcgatcccttggtatgtttttacaacttttcagcaacggatcagcacagatgccaaggacagtttgtcagaaaaatcaactgcttgcttgtgttaaacataatgcagttactaacaaaagagaagtgtggggttttagtgaacaaaagggcactaaagacaacattcttcattgcatcagcagtattctgcatgaatatgtatcaccagaagtgtgggatcttccaacagagaaggacactgagctacacctaatagagttgaacctgccattgcacttctaccgtgatacaactgcattgcacacagtagtgcttgaaggaattggagtcttgggtgttcttcttggtcaagattttgcacttagtgggtttatgcactcttccctttatcttctgctccgtgaacttatcagctcaagtgctcagataagaactgcatgtgatgctgtcttgagagcccttgctactgctggcggtcattgttcggttggccaatttgtcgttgcgaatgcagactacattattgactctctttgcaggcaattgcgtcacctggacctgaacccccatgtccctgatgttcttgcttccatgctatgttacatcggtgcttctcgtgatatcttgccattcttggaagaaccgatgcaatcaatttcttctgagcttgaggtacttggcaggcatgatcacccacgtctaactgttccatttctgaaggcagtttctgagatttccaaggcatgtagacatgaatccacttgtttgccagatgaggcacaatcattttatgagaaggtcagttctgagggtcaagaagtaaaaattatgattgagaagagaatggaatccagtgcaatatctgaaagaaagaatgttgatgctcgatcttactttatgaccttggaatactgggaagatttattttgtaagctaaatgagatgagaagatataggagaatagttgggtctcttgcgggctcttgtttatcagctgccatcccacttctctcttccaataaggaaacagcatgccttgtggcccttgacattgtggagagtgctgctatatctattgccaatgttgaggaggcttataagtgtgaatgtcaaagcaaaggagtcattgaggaggccatccagttttgttcatttgacgagcttcttgatggtacagatgccaccgaagatgttgatgaaaataggctactcccagcaatgaacaaactgtggccttacttggttatctgtctaaggaacaagatctcagtgccggttgttaggaagtgcaccgaaatgttgaggcgagcaatttgcatatctggcggcgatttttatgtacgcaggtttcataaggatggacctattgtttggaggttgctggctttatctccattccgacgtctgtcaaagatggatgaaaaagcaatcattttaccatatagggatacctcacttaactcagaggaacctatggctgagatctccagccaaaagattcagattgcagtcctggacatgatcgctgcaatatcttcgaacaagagaagtgctgttgcactagaaagcgtactaaagaaggtctgtggccttgtggtaggcattgcctacagtagtttgacagatgtgtactactcactaaaccaaagggaatctttacttcccaaccaagatctagccctggtatcagatcttttgccccctccagtgtcttcgagagaatacctctttgtacagtatggaggtgagggtgtcaggttcctgatactgtgtatttgtaatcttgctgagtttctttggtcatgctagcaccctatgtcacacattgaacataatatcacctgctacagagaatgcaaacatcaggactcatgatgacaatgaaggatgtgatgggtttgtatctgttagccatataaggttgcacgttaagcatgcccctgacttgccggacgagcagcaagacttcgggacctagattggctaaggcactaagaatagaatagcttatctaccgatatgtaaagtcttatttccacctttcgaattcttttcctcggtagctaagcttatttagttgcctaatggtcgatgtaatctttttattgtgtgattcattccactttcatggtatttccgctcttgttacctccctctaccgcttcttcatctacatctaacctcatgcctggcgacctctaataagtaactgttgatccggccacataattggaatgccttcgcgtgaggttgccggcctttgtgtcagtcactcaacatgctctcaacatgctgaggaaggtcgttgttgtgccgtagccgagcgacgcaacaagtggctgttcagaacacggacaaggtgatgttgaacgtgtagaaacaacggcagcgtgatgcggaacgtctgaaacaacgacagcgtgatgccgaatgcgtggatgtagagcgccttcaagtttgtaaggaaaatggactccgggcagtttggctaattgagttttgatgtttaatgaataacacaatctatgaactaataagttttttagtgtttgtgtttgtagttcacaggatgcaatatttacttgcactaaggaattgaggaaagcaacacctcaaaagaagacataaaatgatgcacagaagttcaagactcaagaacaaaagaagcccgaaaaaatcaacgaagaaaccttgaagagggctgtcagccagcgtctggtggcgcatcggacagtgaacagtacctgtccggtgcgcaccggactgtttggtgggacaaccggacagtctgcgcagagaggccacagacaggtgctctcgggctgtagcaccggactgtccggtatgcaccggac

SEQ ID NO: 4288 - DNA, 1405 bp, Setaria italica
tcgacaattcctgctgtccaagttttggtggggctgttcatgcgctcacgggcatggctgttggggtgcaaaactgaaaggtatatcatctgccggagcagccgccgccgccggccatagcccagggaagggaagcccgtttggaagaatggccaaaaagcctatccaatacgtcgtggtggacgccttcacggcggagccgttcaagggcaacccggcgtcggtgtgcgtcctcgacgacgccgagcgggccgccgacgcgcggtggatgcaggccgtcgccaccgagttcaacctgtcccagaccgccttcctcctccgggattccagctccgccgccgccgccgccccgcggttcgggctccgatggttcacccccaacaccgaggtcgcgctctgcgggcacgcaacgctggcctccgcccactacctcttcacctccgtcctcgcggagcacgaggcgctcatcgagttcgccaccaagtcggggatcctcaccgccaagaaggtcccggcgccggcgagcgcgggcgtctcgggtgaggggaagctgttcatcgagctggatctgcccgcgattgatttcgtggagtgcgatgaagccgagctgccgtccctccccgagaccctgaacggagttcccgtcgtcagcgttcataaatcgacgaccgtcagcgacttcattgtggaactttcctcaggaaaagaggttgccgatatcattcctaacatccatgaaatcaaaaggtgctccggcagaggagttatttttacagggccagcacctgatgaatctggttatgactttttcacacgtttcttctgcccaaaattcaacatagatgaggatcctgtttgtggtagtgcacactgtgttttagcaccctactgggctcgcaagctggggaaacaaaagctgacggcgtttcaagtatctccacggagcgggacattatacctggagttggaagctgcagcaaggagagtgcggattcagggagaggctgtcactgtgatgactggtaccctcctaacctagtggctcactccccatgtatgctccaaaatctgaagggcaagggaacctgtaggcaattccaattgctgggacatatatacgggcttgttcaaccgtattagcttatggaatcaaagttcctgaactttctatggagctttaaataaagttgcagtttgtaaaatcgtaccgacataaaagtaccagctccctttgggttatcatttctcaatgtaacatagctgggagttgtgaagtacagtacatacgacctttgttcaagtttcctgtcatgtttggaaacgcgaatgaaacagaatattcagatcctgcggtttaacaccataactatgtactccctgaaacaagagagaatttgaaccaccc

SEQ ID NO: 4289 - DNA, 1593 bp, Setaria italica
atggtaagatcaatgctgaggaagctagggctcaagtctttcggcgcggaggcgatcttcatcaaatctgaacttatggatgtacttgggggaaatttacctctgcacgaactctattcactctccatcacaaaactaggaattttcgcacgatgccaccaaatttctcgtgagaattgtcatcgctgtcgacaattcctgctgtccaagttttggtggggctgttcatgcgctcacgggcatggctgttggggtgcaaaactgaaaggtatatcatctgccggagcagccgccgccgccggccatagcccagggaagggaagcccgtttggaagaatggccaaaaagcctatccaatacgtcgtggtggacgccttcacggcggagccgttcaagggcaacccggcgtcggtgtgcgtcctcgacgacgccgagcgggccgccgacgcgcggtggatgcaggccgtcgccaccgagttcaacctgtcccagaccgccttcctcctccgggattccagctccgccgccgccgccgccccgcggttcgggctccgatggttcacccccaacaccgaggtcgcgctctgcgggcacgcaacgctggcctccgcccactacctcttcacctccgtcctcgcggagcacgaggcgctcatcgagttcgccaccaagtcggggatcctcaccgccaagaaggtcccggcgccggcgagcgcgggcgtctcgggtgaggggaagctgttcatcgagctggatctgcccgcgattgatttcgtggagtgcgatgaagccgagctgccgtccctccccgagaccctgaacggagttcccgtcgtcagcgttcataaatcgacgaccgtcagcgacttcattgtggaactttcctcaggaaaagaggttgccgatatcattcctaacatccatgaaatcaaaaggtgctccggcagaggagttatttttacagggccagcacctgatgaatctggttatgactttttcacacgtttcttctgcccaaaattcaacatagatgaggatcctgtttgtggtagtgcacactgtgttttagcaccctactgggctcgcaagctggggaaacaaaagctgacggcgtttcaagtatctccacggagcgggacattatacctggagttggaagctgcagcaaggagagtgcggattcagggagaggctgtcactgtgatgactggtaccctcctaacctagtggctcactccccatgtatgctccaaaatctgaagggcaagggaacctgtaggcaattccaattgctgggacatatatacgggcttgttcaaccgtattagcttatggaatcaaagttcctgaactttctatggagctttaaataaagttgcagtttgtaaaatcgtaccgacataaaagtaccagctccctttgggttatcatttctcaatgtaacatagctgggagttgtgaagtacagtacatacgacctttgttcaagtttcctgtcatgtttggaaacgcgaatgaaacagaatattcagatcctgcggtttaacaccataactatgtactccctgaaacaagagagaatttgaaccaccc

SEQ ID NO: 4290 - DNA, 1306 bp, Saccharum officinarum
tattaagggtcgacccacgcgtccgaaacgttttcagttctttgattcattctgtggcggcaaaagcggaggctggagaaatatcccccatggctatcctcgccgttgcctctccgctcaaaaccctaaaccttagcccggcggaccacagccgcatccgcctctcctcctccgtcctccaccttccgctccgggtgccacgatggcgtcgcctccggtgctccgcgcagtacagtgaggcggcggcgccgcccacgtcgacaacgacgccgcggccggcggagataccctggagcaaggagctttgcaactcggtgcggctcattgggactgtgggcaccgacgtcgagctgcggcagctgcccagcggctccgctgtcgcgaggggccgcctcgccgtatggaagtcggccaccgagactacatgggtaactctacaattctgggatgatctggctattgtggcctctgagcatgttaagaagggtgaccggatatttgtttctggacggcttgtgtcagatactgttgatgaggggcctgagaagcggcatgtttactacaagcttgcagttcaacagttgaatttcatcgagtcccagccagttcgattatatgaaccagaggcaagccaggatgccccaggtggaaggcgtgctgattattttaactctacctctaattcaactgaggataagaatagggataatatgagctcttcccgatcaactgaagagctgtggcaagcggtctttgctaaccctcttgactggtgggataacaggacaaataagaagaacccaaggtatccagacttcaagcataagcacactggtgaagcactatgggttgatgggaggaacaaccccaactgggtcatatctcagctggcagttttggactcaagactgagttctctgcaagacaatgagagaaaaccagtctcttatatgtatgctgatgagttcatgacattggacggcaatcgatagtctttatgagggaggaagcttcgcagcgcccattatttgtgcagcttggttgcctgttatggcgagatggtgctgtcagactagctaactcatgcctgctgtctgagttttggtatacatgtctgatcggctctggacgctttagtgttacaagtttccgttatataatatgtactctggaccatggatggtacctataccccataccctacattattcatgttgggaaaagccaatgcttttacccgctcccacgaatcctatactaaaaaaggcggtcgtttttaaacctaaatcctactccctggccctcg

SEQ ID NO: 4291 - DNA, 1262 bp, Zea mays
gcacacgcacggccacgccccgatatcgccatggctatcctcgccgttgcctctccactcaaaaccctaaaccctagccccggggaccacagccgctgccgcctctcctcttccctcctccaccttccgctaccagtgccacgatggcgccgcctccggtgctccgctcagtacagtgaggcggcggcgcagcccacgtcgacaacgacggcgcgtccagcggacataccctggagcaaggagctctgcaactcggtgcggctcattgggactgtaggcaccgacgtagagctgcggcagctgcccagcggctccgccgttgcgaggggtcgcctcgccgtatggaagtcagccaccgagactacatgggtaactctacaattctgggacgatcttgctattgtggcctctgagcatgttaagaagggtgaccggatatttgtttctggacggcttgtgtcagatactgttgatgaggggcctgagaagcggcatgtttactacaagcttgcagttcaacagttgaatttcatcgagtcccagccagttcgattatatgaaccagaggcaagccaggatgccctaggtggaaggcgtgctgattattttaactctatctctaattcaactgaggataagaatagggataatatgagctcatctcgatcaaccgaagagctgtggcaagtgttctttgccaatcctcttgactggtgggataacaggacaaataagaagaacccaaggtatccagacttcaagcataagcagactggcgaagcactatgggttgacgggaggaacaaccccaactgggttatatctcagctggcggttttggactcgagaatgagttcgctgcaagacaatgagaggaaaccagtctcctatatgtatgctgacgagttcatgacattggacggcaaccgatagtcgttatggaggagggaagcttcgctcgtgccgattggctggctgttatggcgagcgagatcatgctgtcgacctgtcttagtagctagctcatgcttgctgtctcagttttgttgagcggctctggagggttgcgtgttatgagcgtcgtccgtagtatggtttgtgacataaggtagctatgatgagcctagaacaaacataaacaaagtgcgggggaaacccttgcttttagtgactccattagtagtgctatgtggtttgtgacatggtttttaactatgatgttacgccgaatggtaatatattgaagaacgtgccgtggccct

SEQ ID NO: 4292 - DNA, 1313 bp, Setaria italica
ctccggcagagaaaggcgaaagcccaaaaatatcaccatggctatcctcgccgtcgcctccccgctcaaaaccctaaaccctagccccgcggacccccgccgcaggcgcctctcatattccctgctccgcctcccgccgccggtgccacgagggcgccgcctctggtgctccgcgcagtacggcgagaccgcggcaccgcccacgacgacgccgcggccggcggagataccctggagcagggagctctgcaactcggtgcggctcatcgggacggtgggcaccgaagtcgagctgcggcagctgcccagcggctccgccgtcgcgcgggggcgcctcgccgtctggaagtcggccaccgagactacatgggtgactctacagttttgggatgatctcgcccttgtggcctctgagcatgtgaagaagggtgaccggatatttgtttctggacggcttgtgtcagatactgttgatgaggggcctgagaagcggcatgtttactacaaggttgcagttcaacagttgaatttcatcgagtccatgcagccagttcggttgtatgaaccagaggcaagcgatgataacccaggtggaagccgtggtggttattttgattctacctctagttcatctgaggataagaatagggataatatcagttcgtcctctcgatcaactgaagagctgtggcaagccttctttgctaatccacttgactggtgggataacaggacaaataagaagaacccaaggtatccagacttcaagcataagcacactggagaagcactgtgggttgatgggaggaacaaccccaactgggttatatctcagctggcagttctggactcaagaatgggttctctgcaagacaatgagagaaaaccagtctcctatatgtacgctgacgacttcatgacactggatggcagccgatagtctccatggaggaggaagcctcgcacactccattctacagttcggctaactgttatgtcgaaagcgtgttatcggggtagtccatgagtgctgtcacagttttgtacttttgatgtacatatctgggctctggaaggtttatcacggatgtggacgtgcggtggtccgtagtattttgtagtagcctctagtgtagttatggcaaacatataaacagaagtcgtttggcacatcgtaaaacgtaggttggttgagtgtgatcttgtttgtgacatgatcttttacctccgacggtgaaactatactgttgcactgagttgacttgtgagttgtgaccactcgtgaagaagtaaactgggggcacttatatttt

SEQ ID NO: 4293 - DNA, 1559 bp, Setaria italica
tgtgacatgtgagctgaacactggaggtctggaacagcaatcctgaagaaagggcaatgtggggccagcatgacagccacgtcggtagcttgtgggggtccacgcgtcggtcaccgccgccgcaggttctgggaccacttgcagtgattgaaaagacacccacgccacgctgaaataagctcacgagctcccccatctccggcagagaaaggcgaaagcccaaaaatatcaccatggctatcctcgccgtcgcctccccgctcaaaaccctaaaccctagccccgcggacccccgccgcaggcgcctctcatattccctgctccgcctcccgccgccggtgccacgagggcgccgcctctggtgctccgcgcagtacggcgagaccgcggcaccgcccacgacgacgccgcggccggcggagataccctggagcagggagctctgcaactcggtgcggctcatcgggacggtgggcaccgaagtcgagctgcggcagctgcccagcggctccgccgtcgcgcgggggcgcctcgccgtctggaagtcggccaccgagactacatgggtgactctacagttttgggatgatctcgcccttgtggcctctgagcatgtgaagaagggtgaccggatatttgtttctggacggcttgtgtcagatactgttgatgaggggcctgagaagcggcatgtttactacaaggttgcagttcaacagttgaatttcatcgagtccatgcagccagttcggttgtatgaaccagaggcaagcgatgataacccaggtggaagccgtggtggttattttgattctacctctagttcatctgaggataagaatagggataatatcagttcgtcctctcgatcaactgaagagctgtggcaagccttctttgctaatccacttgactggtgggataacaggacaaataagaagaacccaaggtatccagacttcaagcataagcacactggagaagcactgtgggttgatgggaggaacaaccccaactgggttatatctcagctggcagttctggactcaagaatgggttctctgcaagacaatgagagaaaaccagtctcctatatgtacgctgacgacttcatgacactggatggcagccgatagtctccatggaggaggaagcctcgcacactccattctacagttcggctaactgttatgtcgaaagcgtgttatcggggtagtccatgagtgctgtcacagttttgtacttttgatgtacatatctgggctctggaaggtttatcacggatgtggacgtgcggtggtccgtagtattttgtagtagcctctagtgtagttatggcaaacatataaacagaagtcgtttggcacatcgtaaaacgtaggttggttgagtgtgatcttgtttgtgacatgatcttttacctccgacggtgaaactatactgttgcactgagttgacttgtgagttgtgaccactcgtgaagaagtaaactgggggcacttatattttaccacccatgtttgtctgtgaggcagaggcaggtatcctaactacagcgg

SEQ ID NO: 4294 - DNA, 1541 bp, Panicum virgatum
gtcaagcagcgtggcggtgtcgctgtgacctgtgagctgaacactggaacaagccttgcaatagcaagatcgcagcctggagaaagtgcaatgtggggcctgcttggcagccacagtggtagctcgtggggtccacgcgtcagtcacccccgccgcaggttctgggaccactagcagtgagagaaaaggaacccacgccaccgcataagcccacgaggcccatctccggcagagaaaggcgaaagccggaaaatatcgccatggcgctcgccgtcgcctccctgctcaaaaccctaaaccctagccccgcgggccaccgccgccggcgcctctcctcttccctactccgcctcccgccgccggtgccacgagggcgccgccccaggtgctccgcgcagtacggtgagcccgtggcgccgcccacgacgacgacgccgcggcccgcggagataccttggagcagggagctctgcaactctgtgcggctcatcggaacggtgggcaccgaggtcgaactgcgtcagctgcccagcggctccgccgtcgcgaggggtcgtctcgccgtctggaagtcggccaccgagactacatgggtgactctacaattttgggatgacctggctcatgtggcctctgagcatgtgaagaagggtgaccggatatatgtttctggacggtttgtgtcagatactgttgatgaggggcctgagaagcggcatgtttactacaaggttgcagttcaagagttaaatttcatcgagtccatgcagccagttcgattatatgaaccagaggcaagccaggataccccaagtggaaggcgtggtgattattttgattctacctctagttcaactgaggacaagaatagggatactatcagttcttctcgatcaactgaagagctgtggcaggccttctttgctaatccacttgagtggtgggataacaggacaaataagaagaacccaaggtatccagatttcaagcataagcacaccggtgaagccctgtggattgatgggaggaacaaccccaactgggttgtatctcagctggcagttttgcactcaagaatgggttctctgcaagacaatgagagaaaaccagtctcctatatgtatgcggacgagttcatgacattggacggcaatcaatagtcaatagaggaagccccacagtccccatttgcatgctgttgtgtggaaagcgatcaatctggctagttcatggatgctgtctcagttttgttgtacatatctgggcgcttgatggtttaccagggaggtggaggtgcggccgtcggtagtattatgtagtacttctgtagtttagctgtgacaaacatacgtagagtagttggagaaggccttgttatttacttgtttgacatcataaatctgttgggatgttgggtgtcatccttttttttttgaggtactgttgagtgtcatctggtattcaggttttgtgagacttattatatgccatgtgatggacgatgggcccaattatgcatatgcgtgattaagaaaaaaaaa

SEQ ID NO: 4295 - DNA, 979 bp, Echinochloa colona
cccccgccgcaggcacctctcctcctcccttctatgcttcccacagccggtgccatgcgggcgccgcctccgctactccgcgcagtacggcgaggccgcggcgccacccacgacgaccacgacgccgcggccggcggagatacccctggagcaggagctctgcaactcggtgaggctcatcggaacggtgggcaccgaggtcgagctgcggcagctgcccagcggctccgccgtcgcgaggggccgcctcgccgtctggaagtcggccaccgagactacatgggtgacactacagttttgggatgacctggctcttgtggcctctgagcatgtgaagaagggtgaccggatatatgtttctggacggcttgtgtcagatactgttgatgaggggcccgagaagcgacacgtttactacaaggttgcagttcaagagttgaatttcatcgaatccatgcagccagttcgattatatgaaccagaggcaagccaggataccccaggtggaagacgcggtgattattttgattatacctccagttcaactgattacaagagcagggataatatcagttcttctcgatcaactgaagagctgtggcaggccttctttgctaatccactcgactggtgggataacaggacaaataagaagaacccaagatacccagactttaagaataagagcactggtgaagcactgtgggttgatgggaggaacaaccccaactgggttatatctcagctggcagttctggactcaagaatgggttctctgcaagacaatgagagaaaaccagtctcctatatgtacgctgacgagttcatgacgttggatggcagtcgatagtctcgatggaggaagcctcacagtccccatctgtgcagctcggctagcggtatgtcgggtagttcgtgcatgctgtcacggtttgttgtacatatctgggccctcagaaggtttatcaggaaggtggat

SEQ ID NO: 4296 - DNA, 2355 bp, Sorghum bicolor
gtcaaagcctttggagatgctctaacagaacctcgccacatcaaacaaagaaactaagtccctatccttatcaggatttaacgcatgaaaaacctgatacattgccgcattggcccctcaacactccacactccacagcctttaggagcagcagttatgtcatatcattgccgcgccctcgtccagggtccatttctccacccgcccttctcccccggagctgctggtgctcctgctccctcgctcggagttagtgtagggttgccctcgagagctctgcggttgccgcggccagcaagggcgtccgtggagaagcgagagcagcaggcgacgatggaggagaaagccggccaggcggcgttcggatgggcggccagggacgccaccggcgtcctctccccctacaacttctccagaagggttcctaaagacgacgatgtcacgatcaaggtgctctactgcgggatctgccataccgatctccacatcatcaagaacgactggggaaacgccatgtaccctgtcgtccccgggcacgagatcgtcggcgtggtgaccggcgtcggcggcggcgtcacgcggttcaaggccggcgacacggtcggcgtgggctacttcgtcggctcctgccgctcctgcgacagctgcggcaaggggaacgagaactactgcgccggggtggtgcagacctccaacggcgtcgactacgcccacggtggcgtgcccaccaaggggggattctccgatgtcatcgtcgtgaacgagcactacgtggtccgcgtcccggacggcctggcgctggaccgcaccgcgccgctgctctgcgccggcgtcaccgtgtacagccccatgatgcgccacggcctcaacgagcccggcaagcatctgggcgtcgtcgggctcggcggcctcggccacgtcgccgtcaagttcggcaaggcgttcgggatgaaggtcaccgtcatcagcacgtccgcgagcaagcgtcaggaggcgatcgagagcctcggcgcggacgagttcttgatcagccgggacccggaggagatgaaggcggcgacgggcaccatggacggcatcatcgacacggtatcggcgtggcacccgatcacgccactgcttgcgctgctgaagccgttggggcagatggtggtcgtgggagggccgagcaagccgctagagctgccggcgtacgccatcgtgccgggcgggaagggcgtggctgggaacagcgtcggcagcgtcggggactgccaggccatgcttgagttcgcggggaagcacggcatcggcgccgaggtggaagtcatcaagatggactacgtcaacacggcgatcgagcggctcgagaagaacgacgttcgctaccgcttcggggacgccgacgtgacgatcaaggtgctcttctgtggcatctgccacacggacctccacgtcatcaagaacgagtggggcaacgcaatgtaccccgtcgtcccagggcacgaggtcgtcggcgtcgtcacggacgtcggccatggcgtcaccaagttcaaggctggggacacggtgggcgtgggctacttcgtcgactcctgccggacctgcgagagctgcagcacggggcacgagaactactgccctgacctcgtcctcacctccaacggcgtggaccaccaccaccacggcgccaccaccaagggaggcttctccgacgtgctcgtcgtcagccaggacttcgtcgtccgcgtcccggagagcctccctctcgacggcgccgcgccgctgctctgcgccggggtcaccgtgtacagccccatggcgcagtacgcgctcaacgagcccggcaagcacctcggcgtcgtcggtctcggtggcctaggccacatggccgtcaagttcgccaaggcgttcggcatgacggtcaccgtcatcagctcgtcgcccggcaagcgcgacgaggcgctcggacgccttggcgccgacgcgttcttggtcagccacgacgccgcgcaaatgaaggcagcagcggccacgttggacggcatcatcgacacggtgtcagcggggcaccagatcgtgccgctgctggcgctactgaagcccatggggcagatggtggtcgtcggcgcgccaagcacgccgctggagctgccggcgtacgccatcatcaccggcgggaagcgggtggccgggaacggcgtggggagtgtcgccgactgccaggcgatgctggacttcgcaggagagcatggcgtcaccgctgacattgaggtggtgcagatggactacgtcaacacagcgatcgagcggctcgagaagaacgatgtgaggtatcgcttcgtcattgacgtcgcgggcagcaagatggaggag

SEQ ID NO: 4297 - DNA, 1357 bp, Zea mays
cacccagagcttcattcttctgaacggagaagccaagtaaggtagatcaagctaggtgtccatggagcaaggcggcaagatggcccatgggtgggctgccagggatgcctccggcctcctctccccttacagcttctcaagaagggttcagggggacgacgacgtgacgatcaaggtgctcttctgcggcatctgccacaccgacctccacatcatcaagaacgagtggggcaacgccatgtaccctgtcgtccccgggcacgaggtcgtcggcgtcgtcacggacgtcggccatggcgtcagcaagttcaaggccggggacacggtgggcgtgggctacttcgtcgactcgtgccgcgcctgcgagagctgcagcacggggcacgagaactactgccccgacctcgtgctctcctccaacggcgtggaccaccaccaccacgacggcggcgcgagcgcgagcgcgaccaccaaggggggcttctccgacgtgctggtcgtcagccaggacttcgtggtccgggtgccagagagcctgcctccggacggcgccgcgccgctgctctgcgccggagtcacggtgtacagcccgatggtgcagtacgcgctcaacgggccgggcaagcacctcggcgtcgtcggcctcgggggcctaggccatctggccgtcaagtttgggaaggcgttcggcatgacggtcaccgtcatcagctcgtcgcctgccaagcgcgaggaggcgctcggacgccttggcgccgacgcgttcttggtgagccacgacgcctcgcaaatgaaggctgcagccgccacgatggacggcatcatcgacacggtctcggcggggcaccagatcgtgccgctgctggcgctgctgaagcccatggggcagatggtggtggtcggcgcgccgagcacgccgctggagctgccggcgtacgccatcatcacgggcgggaagcgggtggccgggaacggcgtcgggagtgtcgcggactgccaggcgatgctggacttcgcggcggagcacggcgtcaccgctgacaccgaggtcgtgccgatggactacgtcaacaccgccatcgagcggctggagaagaacgatgtcaggtaccgcttcgtcgtcgacgtcgcgggcagccagatggataccgttgcttagaagcctggatgtgtggttcgatcgagtcatgtagcagccgtcgttgtgcgtggtgtgaaattgtttgctcgtgccgtctatttgttggtgggtgtgggtcaataaactaggcagaacaattgggccgtatgcatggtctgcacttcctgccattggttgaatccttatgtacctttgaattttaaatttgactgagaa

SEQ ID NO: 4298 - DNA, 1446 bp, Setaria italica
ttaccaacggcgtaccacccagcagagcctcatttttcctgaacgtagaagctgagcaaggttgaagaagcaggttagggctctcaaggagtttccatggagcaagggggcaagccggtgcttgggtgggcagcgagagacgcctccggccacctctccccgtacaggttctcaagaagggtgcagagagacggcgacgtgacgatcaaggtgctcttctgtgggatctgccacacggacctccacgtcatcaagaacgagtggggcaacgccatgtaccccgtcgtccccgggcacgaggtcgtcggcgtcgtcacggacgtcggcaccggcgtcaccaagttcaaggccggggacacggtgggcgtgggctacttcgtcgactcctgcggcgcctgcgagagctgcggcacggggcacgagaactactgccccaatctcgtgctcgcctccaacggcgtggacagcgacggcgccaccaccaagggaggcttctccgacgtcgtcgtggtcagcaaggactacgtcgtccgggtcccggagagcctgcctccggacggcgccgcgccgctgctctgcgccggcgtcacggtgtacagcccgatgatgcagtacggcctcaacgagccgggaaagcacctcggcgtcgtcggcctcggtggccttggccacatggccgtcaagttcgggaaggcgttcgggatgacggtcaccgtcatcagctcgtcgccgggcaagcgcgaggaggcgctgggccgcctcggcgccgacgcattcttggtcagccatgacgccgctcaaatgaaggccgcggcgggctccatggacggcatcatcgacacggtgtcggcagggcaccagatcgtgccgctgctggagctgctgaagccgatggggcagatggtggtcgtcggcgcgccgagcaaaccgctggagctgccggcgtacgccatcatcgccggcgggaagcgagtggctggcaacggcgtggggagcatcgcagactgccaggcgatgctggacttcgcgggggagcacggcatcgccgcggacgtcgaggtcgttgggatggactacgtcaacacggcgatccagcggctcgagaggaacgacgtgaggtaccgcttcgtcgttgacgtcgccggcagccagctggacgccacagcttaattaggcgcctgctggagccaaggattagtggttcgtataatacagcagcaagcatgtgaagttgtttgcattgcacctgtcttttggcgggtgtgtgcatgcggtaggcgaataaattggagcataacactttggtagcgaatggttatatatatgtgtgacgtgtttaagatttgagaaagggtatactaaaataaacatactatgttgtttctttagccttcccttggacttccgatctacttttttgtatggtgcaaataattaatttgctct

SEQ ID NO: 4299 - DNA, 5238 bp, Setaria italica
ccatgatggcggctcgcggctttcctatttaggccgagctcagtggttaccaaaggcgtgcccacctaactgcaacccgagaaggcaagtgagcttgaggaagcagatcaagatcaaggagttttttcaatggcggaaggcatggaggcgcatggctgggctgccagggatgcctccggccacctctcccctttcaacttctcaaggagggtacagagagatggcgacgtcaccatcaaggtgctcttctgcgggctttgccacacggacctccacgtcatcaagaacgaatggggcaacgccatgtaccccctcgttcctgggcacgaggtcgtcggcgtggtgacggatgtcgcctccggcgtcaccaagttcaaggccggcgacacggtgggcgtgggctactttgtcgactcctgccgcacctgcgagagctgcagcaagggatacgaaagctactgcccccagctcgtgcaaacgtccaacggcatcgacttactcgacggctccaccacccaaggtggcttctccgatgtccttatcgttagccagggctacgtggtccgggtcccggagaccctgtccctcgacggggcggcgccgctgctgtgcgccggcatcacggtgttcagccccatggtgcagtacggcctcaacgcgccgggaaagcacctgggcgtcgtcggcctcgggggcctcgggcacatgggcgtcaagttcggcaaggcgttcgggatgacggtcaccgtcatcagcacgtcgccggacaagcgcgaggaggcgctcgaccgcctcggcgccgacgcgttcctggtcagccgcgaccccgagcagatgaaggcggcggcgagcaccatggacggcatcatcgacacggtgtcggcggagcacccggtcgaggcgctgctggagctgctgaagccgatggggcagatggtgatcgtcggcttgccggccaagcctctcgaggtgcccgccttcagcctcgtcgccggagggaaacgagtcgccgggagcggcggcggcggcatcgcggagtgccaggcgatgctggactttgcgggcgagcacggcatcaccgcagatgtcgaggtcgtcgggatggactacgttaacacggcgatccagcgccttgagaggaatgatgtgaggtaccgcttcgttgtcgacgtcgccggcagcaacctgggcgtttctgattaggcgccaaggattgttccttgttcggccgatatgtttggagttccttgttgctcgaccgtgtctcgtggttttggtgagtgtacacccgtgaataagcaagggtagaatttggtgttttgttgcatccatggataatttatgatatatgcagcttatatatgtaagacatttaagcgccgatcctatatgtgaaataatagaacattattttcatatgtacgcaaaaattttcaaattctcaacgacgatattgataccaaatggttttagattcttgcaaattttaatttggtgcattattactttttttcattttcattaccgggagtccggaccggcaactaaagttttttttgttgtgaattgagtgtagctcaattgacaaggttttttgtgtgtggaacctgtccatcagtggttcgagtcctcgacacagtattggtgttcacattttcctaaatttttattcttatatttaatgagaactattctttcaatggtatgtaggggtggtaaagggctctttaatttagcctagcgaatttaaggctcgagctcaataagggtcatgccataatattatatgattttgaactaaatatagatagggatgagttcagttgtgaagaaagcatgagggtcatgatccattaccacccctagtggtatgcgacatacccgtcgatagcgaggtgccaatggtaacttcatcgatctcaagaatctatcggttcggtctttcggaggtactcatagtggtagagttccgtacgtgtactcatagggttgagtgtgggtacatttatgtgagcgcctgcgtctgaactgtgtttcgcaaaaaaaaaattgcaacttaaagcaaattctaaccggaaatactttattacccaaatcactggtatttattgaaaagattagcaccatgattttaaattctgtttggcaggtagtattatattctcacacgattctatacgaaagtcgttaatagaggaaggaaaaattacaatatgacatttgcaatttatctcttgacagattttaagaaaaaatctgccgaaaattttcatgttgcacatttttgttgcaaacattattatgcgatatttcaaaatattttataattttagggaaggaaatataaagggttttttaatgttggagatggcattttactatgtttcaaacattgtgtcacatgctgcatagtacttcattttctagcaatatgaaacatgagagcctgcaatattgcagaacttcgtccgcaacactataaaatttgacaaatttacctctaaaaatctatggacggataatagacaactccatataggtaccaaccagttccctcctaataaaaggagtatcatcagtatggagcgtttatatatatagccaattcatgagcccaacgatgtggtggcatccccataaacaagctcagcctgctgcggtgctgccgccacacggaatttcagcctactagcgtccaagcgcaacagccattcagcccatctccctggtgtccatgtttttagtaatttctgttgttatactttaatttgtataatctcaactgaactatcttttattcatatacggagtaccttattatttggcctacctttgtcctattgggggtctttcaagcctctttcctccgccgttacccttcccattcgcaaactgtttgacgaactccttacataattaacttcccccacttgctcttacaaagacagtgattaggagtaatttagtcgatagctcaggctgtagtgttaagcacatgcgtcaccagggctctgcggtatacgcgtcactgcatatgcgaccgcgcaattttgaccttgaccggaattaatgaaccaagagttcgacaaacccaggatgtaattcattgttgctaaatgcgcgtggagggatatatatcttctccatatgaaatataaggatccttattttttctaagtcaaactattatttatactcatttagtatcgcaaatatcatttttagtctctataaattttgtcaaattcagtatatatagtttgccataaacttaaaatcttatatattttaggagggatagaataaaacaggtcagatccccttttccattttttccacacgatcaagagatgtgtcaaaatcaaatagaatattttttactgttctaatagccattttttccactctattatactgtttgacggtaacgtttgaatggagtgtaactccataattcaaatagaataatttttactagtcattttaacttttttagatgcatagatattattatgcatctagatatagggtatatctaagtgcataacaaagtctatgaatctaaaaaagtcaaaacgaaatctataatttgagggagtaccttcgtaaaaaaaaactattagacgtctctccgacgcattattctattttaagttgtaaaatagtaaactgtaaaaaaaacggggcgcagtcctgcgtgagcgctgagaggggatacgtagtacgtgtgatctgacgtcgccgcggtggctgctggctcctagtttgcctatttaagagaagcttcaaagtttaccaacggcgtaccacccagcagagcctcatttttcctgaacgtagaagctgagcaaggttgaagaagcaggttagggctctcaaggagtttccatggagcaagggggcaagccggtgcttgggtgggcagcgagagacgcctccggccacctctccccgtacaggttctcaagaagggtgcagagagacggcgacgtgacgatcaaggtgctcttctgtgggatctgccacacggacctccacgtcatcaagaacgagtggggcaacgccatgtaccccgtcgtccccgggcacgaggtcgtcggcgtcgtcacggacgtcggcaccggcgtcaccaagttcaaggccggggacacggtgggcgtgggctacttcgtcgactcctgcggcgcctgcgagagctgcggcacggggcacgagaactactgccccaatctcgtgctcgcctccaacggcgtggacagcgacggcgccaccaccaagggaggcttctccgacgtcgtcgtggtcagcaaggactacgtcgtccgggtcccggagagcctgcctccggacggcgccgcgccgctgctctgcgccggcgtcacggtgtacagcccgatgatgcagtacggcctcaacgagccgggaaagcacctcggcgtcgtcggcctcggtggccttggccacatggccgtcaagttcgggaaggcgttcgggatgacggtcaccgtcatcagctcgtcgccgggcaagcgcgaggaggcgctgggccgcctcggcgccgacgcattcttggtcagccatgacgccgctcaaatgaaggccgcggcgggctccatggacggcatcatcgacacggtgtcggcagggcaccagatcgtgccgctgctggagctgctgaagccgatggggcagatggtggtcgtcggcgcgccgagcaaaccgctggagctgccggcgtacgccatcatcgccggcgggaagcgagtggctggcaacggcgtggggagcatcgcagactgccaggcgatgctggacttcgcgggggagcacggcatcgccgcggacgtcgaggtcgttgggatggactacgtcaacacggcgatccagcggctcgagaggaacgacgtgaggtaccgcttcgtcgttgacgtcgccggcagccagctggacgccacagcttaattaggcgcctgctggagccaaggattagtggttcgtataatacagcagcaagcatgtgaagttgtttgcattgcacctgtcttttggcgggtgtgtgcatgcggtaggcgaataaattggagcataacactttggtagcgaatggttatatatatgtgtgacgtgtttaagatttgagaaagggtatactaaaataaacatactatgttgtttctttagccttcccttggacttccgatctacttttttgtatggtgcaaataattaatttgctct

SEQ ID NO: 4300 - DNA, 1671 bp, Brachypodium distachyon
gatctgacaccgagtaagcaatgacgacgtccaccagccaagggacccgggggagcacgtacgtagagtctgacgttgatcatgttttgtgatgcccactagcctgcctatttattcccatctcggggctcgacagcaccatctcacccggattcctggactggaaagcagagtggataggattgaggaagcagagcattacactagagcgaaggagacaatggagcaaggcaaggccgcgctcgggtgggccgcgagagacgcctccggccacctctccccgtacaacttctcaagaagagttcagaaggacgacgatgtgacgatcaaggtgctcttctgtgggatctgccacacggacctccacatcatcaagaacgagtggggcaacgccctgtaccccatcgttcccgggcatgaggtcgtcggcgtcgtgaccgacgtcggccccggcgtgaagaacttcaaggcgggcgagacggtgggcgtgggctactttctcgactcgtgccgcacctgcgacagctgcagcaaagggcacgagaactactgccccacgctggtgctcacctccaacggcgtggactacgacggcgcgaccacgcagggcgggttctccgacgtggtcgtcgtcaaccaggactacgtcgtgcgcgtcccggacacgctgcccccggacggcgccgcgccgctgctctgcgccggcgtcacggtgtacagccccatgatgcagtacggcctcaacgcgcccgggaagcacctcggcgtcgtgggcctcggcgggctcggccacatggccgtcaagttcggcaaggcgttcgggatgaaagtcaccgtgatcagctcgtcgctgaggaagcgcgaggaggcgctggaccgcctgggcgccgacgacttcttggtcagcagcgacgcggagcagatgaaggccgcggcgggcgccatggacggcatcatcgacacggtgtcggcggggcacccgatcgtgccgctgctggagctgctgaggcccatggggcagatggtggtgtgcggggcgccgagcgagccgctgcagctgccggcgtacgccgtcatcacgggcgggaagcgcatcgccgggaacggcgtgggcagcgtccgcgactgccaggccatgctggacttcgccggggagcacggcatcactgctgacgtcgaggtcgtcaagatggactatgttaacacggcggtcgaacggctcgagaggaacgatgtgaggtaccgcttcgtcatcgatgtcgccggcagcctgcagcagggcggcgccgcttaattagtgaatgcggaaagttatcggctttcatattgccacgtgaaaatcatgagtgtgtgtcggtgtgtgcaattccacgtgaaataaagtatgcttctttttcctcgccgatcatgtattgtatgccctctcgctgtccacaccgctgctccactctcaagcacgggcgcctctttagtcccgattcacggctcgtcgtcccccctgcacaaccggatctgcaagcgtgccaccagagacgaatgccataccaacggtgggattgggtcagaccagaccggtccatttgcaacggaggtaacagtgtgacaattagtctgaattgttcacgtggccgcaacatggtgacccatcgggtctatggaaatttcgcaaag

SEQ ID NO: 4301 - DNA, 1679 bp, Brachypodium distachyon
gatctgacaccgagtaagcaatgacgacgtccaccagccaagggacccgggggagcacgtacgtagagtctgacgttgatcatgttttgtgatgcccactagcctgcctatttattcccatctcggggctcgacagcaccatctcacccggattcctggactggaaagcagagtggataggattgaggaagcagagcattacactagagcgaaggagacaatggagcaaggcaaggccgcgctcgggtgggccgcgagagacgcctccggccacctctccccgtacaacttctcaagaagagttcagaaggacgacgatgtgacgatcaaggtgctcttctgtgggatctgccacacggacctccacatcatcaagaacgagtggggcaacgccctgtaccccatcgttcccgggcatgaggtcgtcggcgtcgtgaccgacgtcggccccggcgtgaagaacttcaaggcgggcgagacggtgggcgtgggctactttctcgactcgtgccgcacctgcgacagctgcagcaaagggcacgagaactactgccccacgctggtgctcacctccaacggcgtggactacgacggcgcgaccacgcagggcgggttctccgacgtggtcgtcgtcaaccaggactacgtcgtgcgcgtcccggacacgctgcccccggacggcgccgcgccgctgctctgcgccggcgtcacggtgtacagccccatgatgcagtacggcctcaacgcgcccgggaagcacctcggcgtcgtgggcctcggcgggctcggccacatggccgtcaagttcggcaaggcgttcgggatgaaagtcaccgtgatcagctcgtcgctgaggaagcgcgaggaggcgctggaccgcctgggcgccgacgacttcttggtcagcagcgacgcggagcagatgaaggccgcggcgggcgccatggacggcatcatcgacacggtgtcggcggggcacccgatcgtgccgctgctggagctgctgaggcccatggggcagatggtggtgtgcggggcgccgagcgagccgctgcagctgccggcgtacgccgtcatcacgggcgggaagcgcatcgccgggaacggcgtgggcagcgtccgcgactgccaggccatgctggacttcgccggggagcacggcatcactgctgacgtcgaggtcgtcaagatggactatgttaacacggcggtcgaacggctcgagaggaacgatgtgaggtaccgcttcgtcatcgatgtcgccggcagcctgcagcagggcggcgccgcttaattagtgaatgcggaaagttatcggctttcatattgccacgtgaaaatcatgagtgtgtgtcggtgtgtgcaattccacgtgaaataaagtatgcttctttttcctcgccgatcatgtattgtatgccctctcgctgtccacaccgctgctccactctcaagcacgggcgcctctttagtcccgattcacggctcgtcgtcccccctgcacaaccggatctgcaagcgtgccaccagagacgaatgccataccaacggtgggattgggtcagaccagaccggtccatttgcaacggaggtaacagtgtgacaattagtctgaattgttcacgtggccgcaacatggtgacccatcgggtctatggaaatttcgcaaagaggtcctc

SEQ ID NO: 4302 - DNA, 1616 bp, Sorghum bicolor
cgaaatcagcacaggtcgttcgctcgtctaccattaaaaacatagtaccgttaaattccataataaatctagaaaaagttacgaacactaatgccaagtcgaagacttagaccccgggtggtaggttctaccacaaggatccaaccatgggtgccaactaaagaaaccattgaagtgggcctgcttgagcactgacagtctatttactcttacttaaccactgcttagcaccggcaaatcatcctggtccctgaacgacgaagcagagtgacaacaagctaaggttgcagggcggaatcaaggagttcctatggagcaagtaagcaaggcggcgctcgggtgggctgcgagggacgcctccggacacctctccccttacagcttctcgagggttctgagagacggcgacgtgacgatcaaggtgctcttctgcggggtctgccacaccgacctccacatcatcaagaacgagtggggcaacgcactgtaccccgtcgttcccgggcacgaggtcgtcggcgtcgtcacggacgtcggcgccggcgtgaccaagttcaaggccggcgacacggtgggcgtgggctacttcatcgactcgtgccgcacctgcgagagctgcagcacggggcacgagaactactgccccgacctcgtcctcacctccaacggcgtagcccgcgacggcggcgtgacgacgacgacgaccacgcagggtggcttctccgacgtggtggtggtggaccagcactacgtcgtcagggtccccgcgagcctgcctccggacggggccgcgccgctgctctgcgccggcgtcacggtgtacagccccatggtggagtacggcctcaacgtgcccgggaagcgcctcggcgtcgtgggactcggtggcctcggccacatcgccgtcaagttcggcaaggcgttcgggatggcggtcacggtgatcagctcgtcccctgccaagcgtggagaggccatcgagcgccttggcgccgacgagttcttggtcagccgcgacaccgagcagatgaaggcggcggcaggcacgatggacggcatcatcgacacggtgtcagcggggcacccgatcgtgccgctgctggcgctactgaagcccatggggcagatggtgatcgtcggcgcgccaagcacgccgctggagctgccggcgtacgccatcatcacgggcgggaagcgggtggccgggaacggagtggggagtatcgccgactgccaggcgatgctggacttcgcggggcagcacggcatcaccgcggacatcgagctcgttaggatggactacgtcaacacggccatggagcggctggagaggaacgacgtcaggtaccggttcgtcgttgatgtcgctggcagtctgggcgccgctgcttaattaggcgcgcggcagaatacggtgcctgcttcttgtgtaccagtcgggtgcaataataaaattatagagtgcactgccgtgtgatgtattgtaacactgccagacaaagttcctaatgcacgagatctgaatctgatgatgctcttgttattctgaactttatgtcctcacaagtcacgacactttcattcttttttatatatcttctccatccaagttttgc

SEQ ID NO: 4303 - DNA, 1509 bp, Setaria italica
ccatgagtgtgccaactaaattaagaaaccactgaagtgggcctgtctgagcactgacactgtctatttagtctgatttgatcactgctcaccggcatatcaccctgatccctgaacaacgaagcagtagtgagtagtgacaaggttgaagaagcggatcaacaggtcaaggagtttctatggagcaaggcggcaaggcggtgctcgggtgggcagcgagggacgcctccggccacctctccccgtacagcttctcaagaagggtgctgagagacggcgacgtgacgatcaaggtgctcttctgcgggatctgccacacggacctccacgtcatcaagaacgagtggggcaacgccatgtaccccgtcgtccccgggcacgaggtcgtcggcgtcgtcacggacgtcggcccgggtgtcaccaagttcgaggccggcgacacggtgggcgtgggctacttcgtcgactcctgccgctcctgcgagagctgcagcacggggcacgagaactactgccccgacgtcgtgctcgcctctaacggcgtcgacggcgacggcgcaaccacccagggcggcttctccgacgtcgtggtcgtcgaccaggactacgtcgtcagggtcccgcggagcctgccaccggacggcgccgcgccgctgctctgcgccggcgtcaccgtgtacagccccatggtgcagtacggcctcaacgcgccgggcaagcgcctgggcgtggtcggcctcggggggctcggccacattgccgtcaagttcggcaaggcgttcggcatgactgtcacggtgatcagctcgtccccgggcaagcgtgaggaggcgatcgagcgccttggggccgacgagttcttggtcagcagcgatcccgagcagatgaaggcggaagcgggcacgatggacggcatcatcgacacggtgtcggcgtggcacccgctggcggcgctgctcgagctcctgaagccgatggggcagatggtgctcgtgggggtgcccagcaagccgctggagctgccggccttcgctgtctgcccgagcgggaagcgcgtggccgggaacggcgtgggcagcgtcggcgactgccaggcgatgctggacttcgccggggagcacgggattaccgcggacgtcgaggtcgtcgggatggactacgtcaacaaagctatcgagcggctcgagaggaacgacgtgaggtatcgcttcgtcgtcgacgtcgccggcagcctgggcgccgatgcttaattaggccagaatatgttgctcgcttgtgcacagcgcttgtctgtaccacttttcgtggtggtatcttcaccgtgaataactagtgcagggcatcgcaacacgccaaagaaagtgttatacgctagccacattttcattccttttaaattcttttatacaaaggcacgtatacacgcacacgctcactgctatggatacattctactcttattagcacctgcgaaaaactatacccatatactttgagattgatgaagcc

SEQ ID NO: 4304 - DNA, 1464 bp, Setaria italica
ctgacactgtctatttagtctgatttgatcactgctcaccggcatatcaccctgatccctgaacaacgaagcagtagtgagtagtgacaaggttgaagaagcggatcaacaggtcaaggagtttctatggagcaaggcggcaaggcggtgctcgggtgggcagcgagggacgcctccggccacctctccccgtacagcttctcaagaagggtgctgagagacggcgacgtgacgatcaaggtgctcttctgcgggatctgccacacggacctccacgtcatcaagaacgagtggggcaacgccatgtaccccgtcgtccccgggcacgaggtcgtcggcgtcgtcacggacgtcggcccgggtgtcaccaagttcgaggccggcgacacggtgggcgtgggctacttcgtcgactcctgccgctcctgcgagagctgcagcacggggcacgagaactactgccccgacgtcgtgctcgcctctaacggcgtcgacggcgacggcgcaaccacccagggcggcttctccgacgtcgtggtcgtcgaccaggactacgtcgtcagggtcccgcggagcctgccaccggacggcgccgcgccgctgctctgcgccggcgtcaccgtgtacagccccatggtgcagtacggcctcaacgcgccgggcaagcgcctgggcgtggtcggcctcggggggctcggccacattgccgtcaagttcggcaaggcgttcggcatgactgtcacggtgatcagctcgtccccgggcaagcgtgaggaggcgatcgagcgccttggggccgacgagttcttggtcagcagcgatcccgagcagatgaaggcggaagcgggcacgatggacggcatcatcgacacggtgtcggcgtggcacccgctggcggcgctgctcgagctcctgaagccgatggggcagatggtgctcgtgggggtgcccagcaagccgctggagctgccggccttcgctgtctgcccgagcgggaagcgcgtggccgggaacggcgtgggcagcgtcggcgactgccaggcgatgctggacttcgccggggagcacgggattaccgcggacgtcgaggtcgtcgggatggactacgtcaacaaagctatcgagcggctcgagaggaacgacgtgaggtatcgcttcgtcgtcgacgtcgccggcagcctgggcgccgatgcttaattaggccagaatatgttgctcgcttgtgcacagcgcttgtctgtaccacttttcgtggtggtatcttcaccgtgaataactagtgcagggcatcgcaacacgccaaagaaagtgttatacgctagccacattttcattccttttaaattcttttatacaaaggcacgtatacacgcacacgctcactgctatggatacattctactcttattagcacctgcgaaaaactatacccatatactttgagattgatgaagccaaaaaaaa

SEQ ID NO: 4305 - DNA, 1408 bp, Triticum aestivum
aggaaatcgaagtagtccagctcggagcataggcgaataagcagagcaagcaatcatcaatggagaaaggcacgcctgcgataggttgggccgcgagggacgactcgggtctcctctccccttacagcttctcgcgaagggttccgaaggacgacgatgtgacgatcaaggtgctcttctgcgggatctgccacaccgacctccacatcgccaagaacgagtggggcaacgccctctaccccatcgttccagggcatgagatcgttggcatcgtcaccgacgtcggccctggcgtcaagagcttcaaggccggggacacggtgggcgtgggctacttcctcgactcctgccgctcctgcgacacctgcagcaaggggtacgagaactactgccccacactcgtgctcacctccaacggcgtggactacgacggcgccaccacccagggggggttctccgacgtgctcgtcgtcaaccaggattacgtcctccgtgtcccggagagcctgtctctcgccggggcggcgccgctgctctgcgccggcgtcacggtgtacagcccgatgatgcagtacggcctcaacgccccggggaagcacctcggcgtcgtcggcctcgggggcctcggccacatggccgtcaagttcggcaaggcgttcgggatgaccgtcaccgtgatcagctcgtcgccgaggaagcgcgaggaggcgctcgagcggctcggcgccgacgcgttcttggtcagccgggatgccgagcaaatgaaggcggcggcgggcacgatggacggcatcatcgacacggtgtcggcggggcacccgctggtgccactgctggagctgctgaagccgatggggcagatggtggtggtcggcgcgccgagcgagccgctggcgctgccggcctacgccatcatcggaggcggcaagcgcgtggccgggaacggcgtgggcagcgtcagcagctgccaggcgatgctggacttcgcggggaagcacggcatcaccgcggacgtcgaggtcgtcaagatggactacgtcaacacggcggtggagcggctggagaagaacgacgtgaggtaccgcttcgtcatcgacgttgccggcagccagctggacgccgccgcttagtgctccgacacgtagactctcggcggtcagcggccacgtgaggtcgtgatttgtggtgttgttatttccatgggttgatgtgtgcatttccagattttcaggtgaaataattgcttcgtgtgttgtttgttctggccatgttccgttctcgaatattacctataactgtagaacatccatgtgttgccacgggccttataatcttttcctaattattgtataaaactcgatgaatttgcagcctctttcaatgcagatttgctatttcacatctagat

SEQ ID NO: 4306 - DNA, 1477 bp, Hordeum vulgare
agtagtagtaggtgaagggtggagatacgtagtgtctgacgttgccatgccgtcgacacgtagtgtctgacgtccagtccggctcgtcggcatgcctatttattctcatctccgggcttggcagtcaccaacaccctgatttcagtgatttgtgagcaggaaatcgaagtatactccagctaggagcctaggcgaagaagcagagcgagcaatcatcaatggagaaaggcacgcccgcgctcggttgggccgcgagagacgagtccggtctcctctccccctacagcttctcgagaagggcccggaaggacgaggatgtgacgatcaaggtgctcttctgcgggatctgccacaccgacctccacatcgccaagaacgagtggggcaacgccctctaccccatcgttcccgggcatgagattgtgggcgtcgtcaccgacgtcggccctggcgtcaagagcttcaaggtcggggacacggtgggcgtgggctacttcgttgactcctgccgctcgtgcggcacctgcagcaaggggtacgagaactactgctccaccctcgtgctcacctccaacggcgtggactacgacggcgccaccacccaggggggtttctcagacgtgctcgtcgtcaaccaggactacgtcctccgcgtcccggagagcctgtctctcgccggggcggcgccgttgctctgcgccggcgtcacggtgtacagcccgatgatgcagtacggcctcaacgcgccggggaagcacctcggagtcgtcggcctcgggggtctcggccacatggccgtcaagttcggcaaggcgttcgggatgaccgtcaccgtgatcagctcgtcgccgaggaagcgcgaggaggcgctcgagcgcctcggcgccgacgcgttcttggtcagccaggacgccgagcaaatgaaggctgcggcggggacgatggacggcatcatcgacacggtgtcggcggggcacccgctcgtgccactgctggagctgatgaagccgatggggcagatggtggtggtcggcgcgccgagcgagcccctggcgctgccagcctacgccatcatcggaggcggcaagcgcttggccgggaacggcgtgggcagcgtgcgcgactgccaggcgatgctggacttcgcggggaagcacggcatcaccgcggacgtcgaggtcgtcaagatggactacgtcaacacggcggtcgagcggctggagaagaacgacgtgaggtaccgcttcgtcatcgacgtcgccggcagccagctgggcgccgccgcttagtgctccgagacgtagacacgcagcggtcaccggccacgtggggtcgtgatacgtggtcttgttatttccatgggtcggtgtgtgtgtatttccagaattttctggtgaaataattgcttcgcatgttgtgtgttctggccatgttccactctagaatggccctgtttggatctatgagctagagttag

SEQ ID NO: 4307 - DNA, 1539 bp, Panicum virgatum
ggaggaaagggaaagcattgttaagcgcagccgccggcggctttttcatgggtgtgggcctgcctgagcaccgacactgtctatttattcagattggataactgcttaccactggcaaatcatcaccctgatccctgaagaacgaaaagcagtagtgacactgtgacagcaagtgaggttgaagaagtggatcaaccagccgagaggagttcccatggagcagggcggcaaggcggcgctcgggtgggctgcgagggacgcctccggccacctctccccgtacagcttctcgagaagggtcccgagagacggcgacgtgacgatcaaggtgctcttctgcgggctctgccacaccgacctccacatcatcaagaacgagtggggcaacgccatgtaccccgtcgtccccgggcacgaggtcgtcggcgtcgtcacggacgtcggccccggcgtgaccaagttcgtggccggcgacaccgtgggcgtgggctacttcgtcgactggtgccgctcctgcgagagctgcggcgccgggcacgagaactactgccccggcgtcgtgctcgcctccaacggcgtcgacggcgacggcgcgaccacccaggggggcttctccgacgtcgtggtcgtcgaccagggctacgtcgtcagggtgccgaggagccttcctccggacggcgccgcgccgctgctctgcgccggcgtcacggtgtacagccccatggtggagtacggcctcaacgcgccgggcaagcgcctgggcgtcgtcggcctcgggggcctcggccacatggccgtcaagttcgccaaggcgttcggcatggcggtcacggtgatcagctcgtccccgggcaagcgtgaggaggcgatcgggcgccttggcgccgacgagttcctggtcagccgcgatcccgagcagatgaaggccgcggcgggcaccatggacggcatcatcgacacggtgtcggcgtggcacccgctggcgccgctgctcgagcttctgaagccgatggggcagatggtgctcgtgggagtgcccagcaagccgctggagctgccggccttcgccgtctgcccgagcgggaagcgcgtggccgggaacggcgtgggcagcgtcggcgactgccaggcgatgctggacttcgccggggagcacggaatcactgcggacgtcgaggtcgtcgggatggactacgtcaacacggctatcgagcggctcgagaggaacgacgtgaggtatcgcttcgtcgtcgacgtcgccggcagcctgttgggagccgctgcttagccggccgccgccgctttaggccagtatacgttgcttgcttgtgcacgccggccattaaatatatatacaccgttgatgatccttcgagatccgtgcaagggggtggtgaacacaacggtgggtttatatatggtttactttgtgagatggtgtcttcgcctgaataactagtgcagggcattgcagtgatgtatcgcaacacgcaaagttcttgtgcatgagcctgttattctcccctacgttggggtaat

SEQ ID NO: 4308 - DNA, 1351 bp, Triticum aestivum
atcctgatttgtgagcaggaaatcgaagtactccagctcgaagtctaggcgaagaagcagagcaagcaatcatcaatggagaagggcacgcctgcgctcggttgggccgcgagagacgagtccggtctcctctccccttacagcttctcgcgaagggtccagaaggacgacgatgtgacgatcaaggtgctcttctgcgggatctgccacactgacctccacatcgccaagaacgagtggggcaacgccctctaccccatcgttccagggcatgagatcgttggcgtcgtcaccgacgtcggccctggcgtcgagagcttcaaggccggggacacggtgggcgtgggctacttcatcgactcctgccgctcgtgcgacacctgcagcaaggggtacgagaactactgctccaccctcgtgctcacctccaacggcgtggactacgacggcgctaccacccaggggggtttctccgacgtgctcgtcgtcaatcaggactacgtcctccgcgtcccggagagcctgtctctcgccggggcggcgccgctgctctgcgccggcgtcacggtgtacagcccgatgatgcagtacggcctcaacgcgccggggaagcacctcggcgtcgtcggcctcgggggcctcggccacatggccgtcaagttcggcaaggcgttcaggatgaccgtcaccgtaatcagctcgtcgccgaggaagcgcgaggaggcgctcgagcgcctcggcgccgacgcgttcttggtcagccaggacgccgagcaaatgaaggctgcggcgggcacgatggacggaatcatcgacacggtgtcggcggggcacccgctcgtgccactgctggagctgctgaagccgatggggcagatggtggtggtcggcgcgccgagcgagccgctggcgctgccggcctacgccatcatcggaggcggcaagcgcgtagccgggaacggtgtgggcagcgtcagcagctgccaggcgatgctggacttcgcggggaagcacggcatcaccgcggacgtcgaggtcgtcaagatggactacgtcaacacggcggtggagcggctggagaggaacgacgtgaggtaccgcttcgtcatcgacgttgccggcagccagctggacgccgccgcttagtgctcgacacgtaggctctcggtggtcaccagccacgcgaggtcgtgatttgtggtgttgttatttccatgcgtcggtgtgtgcatttccagattttcaggtgaaataattgcttcgcgtgttgtttgttctggccatgttccgttctcgaatgttacctataaaaagcaaatgaatattaaaacatgccgagacttgactcttc

SEQ ID NO: 4309 - DNA, 1247 bp, Brachypodium distachyon
actccgaaaccctagaaccctctcgtcacgatgaggtcgcttcgcgcggcgcacacccttgcgtcccgctcgctcctcctctccgcgcgcgcgctccacggcacggcctgccccggcgcggccgcggccgcgggcggccgctggggcgccccgcctccggcgccatcctcgcgggtggtgcccgccgggatcgccggcgcggtgtccttctccctgacattcgcgacggtggcggcggctgaggtgcaggcgaaggagcgattgcccgtggatctgctcccgcagaacgtggtgctgtatcagtatcaagcatgccccttctgcaacaaggtccgagcttttctagactatcatgatataccctacaaagttgtggaagttaatccactgagtaaaaaggaaatcaagtggtctgaatacaagaaggtcccaatattgactgtagatggtgaacacctggttgattcatcagatataatcaatatattacagcggaagatcagccctgatgatgacgtcatgagtgaagaggaagcaaagtggcgcaggtgggttgatgagcaccttgtgcatatattatcgccaaatatatacaggacgacttcagaggctctagaatcttttgattatattgcaaagcatggcaactttagtactgttgagcggtttgctgcaaagtatgctggtgctgcagcaatgtacatggtgtccaagaagcttatgaagaaatacaatattaccgatgcgcgtgcttcattgtatgaagcttgtaacacatggacggaagccctgaacggaagaaattttcttgggggctccaagcctaacttggcagatcttgcagtctttggtgttctgagacctatccgatacttgagatctggaaaagatatggttgaacatactcaaattggtgaatggtaccaacggatggaagatgcagttggagaaccatcaaggatccaggacgagtaaaagaaaacaaccagcaatagattctctttcattactgaagtccgcagttaggatgggtggaatggaatacatgtcttccataagcactagaaatattcaaatttttgccaaattttagtagtatccaataatgttgtgacatatacaaagtaaacgcacgcacagttggacataaaacatagtacttcacagtcgacatactgtgccgagtgattgatttgatgaagggaatgggaaactcagcagtttattttgtctcaattccctagttt

SEQ ID NO: 4310 - DNA, 1271 bp, Brachypodium distachyon
cgaggcggctactccgaaaccctagaaccctctcgtcacgatgaggtcgcttcgcgcggcgcacacccttgcgtcccgctcgctcctcctctccgcgcgcgcgctccacggcacggcctgccccggcgcggccgcggccgcgggcggccgctggggcgccccgcctccggcgccatcctcgcgggtggtgcccgccgggatcgccggcgcggtgtccttctccctgacattcgcgacggtggcggcggctgaggtgcaggcgaaggagcgattgcccgtggatctgctcccgcagaacgtggtgctgtatcagtatcaagcatgccccttctgcaacaaggtccgagcttttctagactatcatgatataccctacaaagttgtggaagttaatccactgagtaaaaaggaaatcaagtggtctgaatacaagaaggtcccaatattgactgtagatggtgaacacctggttgattcatcagatataatcaatatattacagcggaagatcagccctgatgatgacgtcatgagtgaagaggaagcaaagtggcgcaggtgggttgatgagcaccttgtgcatatattatcgccaaatatatacaggacgacttcagaggctctagaatcttttgattatattgcaaagcatggcaactttagtactgttgagcggtttgctgcaaagtatgctggtgctgcagcaatgtacatggtgtccaagaagcttatgaagaaatacaatattaccgatgcgcgtgcttcattgtatgaagcttgtaacacatggacggaagccctgaacggaagaaattttcttgggggctccaagcctaacttggcagatcttgcagtctttggtgttctgagacctatccgatacttgagatctggaaaagatatggttgaacatactcaaattggtgaatggtaccaacggatggaagatgcagttggagaaccatcaaggatccaggacgagtaaaagaaaacaaccagcaatagattctctttcattactgaagtccgcagttaggatgggtggaatggaatacatgtcttccataagcactagaaatattcaaatttttgccaaattttagtagtatccaataatgttgtgacatatacaaagtaaacgcacgcacagttggacataaaacatagtacttcacagtcgacatactgtgccgagtgattgatttgatgaagggaatgggaaactcagcagtttattttgtctcaattccctagtttcaaatgtttagggg

SEQ ID NO: 4311 - DNA, 1423 bp, Triticum aestivum
cccccgccgacgccgacgaggcggccgctcctccggcgaaaccctagggccacgatgaggtcgctccgcgcggcgcggaccctgctcgcctcccgctcgttcctcctctcctcgcgcgcgctccatgccgccgcggcctcccccgcggccggccgctggggcaacgcgccgccgccgccgcccacgccctgcccggggccgtcgtcccgggccgggatcgcgggcgcggtctccttctccctgacgttcgccacggtggcggtggccgaggtgcaggccaaggagcggctgcccacggatctgctgccccggaacgtcgtgctctaccagtaccaggcgtgccccttctgcaacaaggtcagagctttcctagactatcatgatataccctacaaagttgtggaagttaatccactgagcaaaaaggaaatcaagtggtctgagtacaagaaggtcccgatattgacggtagatggtgaacatctggttgattctacagacataatcaatatattacagcacaggatcagccctgatgatgaagttactaacgaagaggaaacaaaatggcgcaagtgggttgatgagcaccttgtgcatgtattgtcaccaaatatataccggacgacttcggaggctctagaatcttttgactacattgcaaagcatggtaacttcagttacaccgagcggtttgctgtgaagtatgctggtgctgcagcaatgtacttcgtggccaagaagcttaagaagaaatacaacattactgatgagcgcgcctcgttgtatgatgctgccaacacgtggacggaagcactgaatggaagaaattttcttggtggctccaagcctaacttggcagatcttgcagcatttggtgttctgagacctatcagatacctgcaatctggaaaagacatggttgagcatacccaaatcggcgagtggtaccagcggatggaagatgcggtcggagaaccatcaagaatcccggagggccagtaccaggagtagaagaaaaccaccactaatagaattttttgctcgttgaagccctcatttcaaatggatgaaatcgaatggaatgcgtgtctttcattaggcaatcaggttattcaaattttgccaaaggttttagtagtatgcaataatgctgccgcacatatgaagttaaatacacggtttgacatgaaaacatgcttcacactgctgcttgagtgtacggagtgattgattttggagtaggagaaatgagaattcccgcttctatccatctttcgcccagtgcctgcctttgaatgttgggtgagctattgaaattcctggttttatctctgtttgttccttaaaatgagacgcaaaaggatgtgatagtgatgatcaccatgaacgaggaaaggcatgggataaatattggctagca

SEQ ID NO: 4312 - DNA, 895 bp, Saccharum officinarum
aagacaccgcatcaggcaccagcagcaccaccacctttaattcctgcctacagccaccacctccctagccccaggactccaccccgcaagtttgccagcaccatcgtctcaccatcccggaggagcgacgagaaatccagcgaccgagccgcaagctacaagtcgagggcgcggccctgggttcgatccggccgatcgatcgcatgcggcacctactgatgctccacgcatccgtcccctgagatctcggttgctccatggggagtggaaaggcgtcgtccccgccaggcgccgccgctgccggcgggagcggctcgccgccgggcggcgccgtcgtctgctgcatgtgcggcgaccgcggcctcctgcctgagctcttccgctgctccgcctgctccgtccgctcccagcacacatactgcacggatcggtacccgaaggtggagtcgtacggcacctgcaactggtgcctcagggcggatgggggcgtggcttctacttctaactcgccgagatccaccggcaaagcggctgcccggtcggctcctcacggcggtgacacgaccggcagcggcagcggaagatcgccgaaggttgccgctcgcggcgactttgcgtcgtccaacctgagcaagcctatcaagaagcagcagccgcagcagcagcatgcgcagcggctcttgctgcggcggtcggcgtcggaccttggcagccgcgttcgtaccgaccacaacgcgccgccggcgtcgcccggcgtcgcgcgtggcaggccgagggtccggaggtacaagctcctggaagaggtgatcactagctagctaactagccggccatgccccgccgtgtggtatcgatgtcgtcgtggatgacaagatcgagtgcgtgtgcgtgtatt

SEQ ID NO: 4313 - DNA, 1160 bp, Zea mays
tccgcaagatctacctacgccttgcgatgtgtgaggactggagaagaccccgcatcagtcaggcaccaccaccaccacctttttagttgctgcctccagcgtccagccaccctccccaggacatccaccccgcaagtttggcaccaccaccttctcatcacctatccaggaccaggatcgacgacgaggaatcaagcagccagcagcgaccgatcgagacgcagccctgtggctgtgccgctgtgggttggatccggccgattcgacagcacgcggcacctacggatgccccacgcacccgtctcctgagagaactcgatcgattgcttcatggggagcggcaaggcgtcgtctccgccaggccccactgccggcgggcgcggctcgccgccaggtgccgccgtctgctgcatgtgcggcgaccgcggcctcctgcccgagctcttccgctgctccgcctgctccgtccgctcccagcacacatactgcacggatcggtacccgaaggtggagtcatacggcgtctgcaactggtgcctcagggcggacgggggcgtggcttctacttctaactcgccgagatccgccggcaaagcggttgtccagcgcccggctcctcacggcggtgacaaaatcggcagcggaacatcacccaaggctgccgctcgtggcgacttcgcgtcttccaacctgagcaagcctatcaagaagcagccgcagcagcatgcgcagaggctgttgctgcggcggtcggcgtcggacctcggcagtcgcgtcgttcgtaccgaccacgacgcgccgccttcgcccggcgttactacgcgtggcaggccgagggtccggaggtacaagctcctggaagaggtgatcactagctagctaactagccgtacccggggcgtgtgtgttgtgtattaggtgtaaaattaaatatacgtgcgtttaatttgtgtatatatatctacttagctacatctaggggtagacacggcatctcttgcggtgctgccatgcatgcatggagatcgagcagtgtgtacgtatgtactacgtgctgatcatctcaggcgttaattcatcaccatgcatcagggtgctcgcgtcgtgttgtacttgtacatgaggaataatgtagtgcttgctaccgcgcagttcgatca

SEQ ID NO: 4314 - DNA, 1189 bp, Zea mays
ggccatgcaggaagaggaggacaaaagagggcagcttcggcaagatcttgagatgtgtgaagactgcagaagacaccgcatcaggcaccaccgtccaccacaccaccaccttcatcaattcctgcaacgtccagccacgccctccccacaggacatccacccccagtctcatcacccaggaggagcgacgaggaatcaagcagccagctaaacaaccaaccccatcgtcggtagatagccacgctgctgggctcgatccggccgatcgatcgcatgcggcacctacggatgccccacgcatccgtcttctgagatctcggttgctccatggggagcggcaaggcatcgtccccgccaggcgccgctgccggcgggagcgccccgccgccgggcggcgccgtcgtctgctgcatgtgcggcgaccgcggcgtcctgtccgagctcttccgctgctccgcctgctccgtccgctcccagcacacatactgcacggataggtacccgaaggcggagtcgtacggcacctgcaactggtgcctcagggcggatgggcgcgtggcttctacttctaactcgccgagatccgctggcaaagcggctgcccggccgccatctcacggtggtgacacgatcggcagcggaagatcgcccaaggttgccgctcgtggcgactttgcgtcttccaacctgagcaagcctgtcaagaagcagcatgcgcagcggatcctgctgcggcggtcggcgtcggaccttggcagccgcgttcctaccgaccacaacgcgccgccgtcgcccggcgtcgcgcgtggcaggccgaaggtccggaggtacaagctcctggaagaggtgatcagtagctaataatagtctaactagcgatacccggtgcggtgtcgatgtcgtggaaaacattatcgagtgcgtgtgcgtattagatgtataatacgtacgtgcatgtgtatctagctaatatataggggtagacacggcatcttgcggtgctgccatgcatgcatggaaatactacgtgctgatcgatctcaagcattactcagggtgctcgcgtcgtgttgtatttgtatatgaggtattgtataaagcatcggttcccacggtttctaacatcgtcgtgggagttatgcataaatgagcacactacctcactggtattcttttacaagtgtctcaa

SEQ ID NO: 4315 - DNA, 1370 bp, Setaria italica
ttattttactggacaaaaattctcatgcttcaaacaaacaaatcctacaaataaaaccaccaaacttgaaggtctagactgcaaagctgaaccagtgaataaaatattacagaaaatctttaccggccatggcaggaagaggaggacaaaagagggcagcttctgcaagatcttgggatgtgtgaagactgcacaagacgcatcagccgccaccaccacctttaattcctgcctccagccagcctccccgaaacatccaccccacaagtttgccaactccaccgtctcatcatcgttctccgggaggagcgacgagaaatcaagcagccgccgacgaacccagctgctgcagctatcaacggcagttgttcggcaccagcagaccagctagcgttgggtttgatcccgtcggatcgatcgcatgcggcgccggctcgacccgtgcatctgagatcgccgggaggcatcgatccatggggagcggcaaggcatcctcaccaggcgccgttgccggcgcgagcggtggcccgccgcagcagccgccgggcgccgccgtctgctgcatgtgcggcgaccgcggcctcctgcccgagctcttccgctgctccgcctgctccgtccgctcccagcacacatactgcacggatcggtacccgaaggtggagtcgtacggcacctgcaactggtgtctgagggtggacgggggcgtggctgcttcgacttcttcctcgccgaggtccgccggcaaggcggccgcccggtcgccggctggtcacagcgaccccacgagcggcggcggcaggtcgcccaaggtcgccgctcgtggcgacttcgcgtcgtcgaacccgagcaagcctataaagaagcagcagccgcagcaccagcggctcctgctgcggcggtcggcgtcggacctcggaagccgcgccgtccgcgacgcgccgcccccgtcgcccggcgtcgcgcgcggcaggccgagggtccggaggtacaagctcttggaagaggtgatcactagctagtagccacagatgccagtgtgccgtcgtggatgacacgtgtatgtattaggtgttgtacgtgcatcttgtgtgccgccatgcatgcatgcatggacggaggaggtctagcggtgtcctgtgtgcgtgcgcttatcagctgctaatcagactgtgcgacgtgctgtacatgaggaataatacttgctaacgtggagttcgatattcgcttgatcgatcctctcggttatagttaaccggctagctgtttatagagtgttctctgcgtacaaataaacttctttcctgcgatgtacaaactctaatctcgagagcttaatcaaggtaattaaagagagaaggcttctgtta

SEQ ID NO: 4316 - DNA, 1373 bp, Setaria italica
ccagttattttactggacaaaaattctcatgcttcaaacaaacaaatcctacaaataaaaccaccaaacttgaaggtctagactgcaaagctgaaccagtgaataaaatattacagaaaatctttaccggccatggcaggaagaggaggacaaaagagggcagcttctgcaagatcttgggatgtgtgaagactgcacaagacgcatcagccgccaccaccacctttaattcctgcctccagccagcctccccgaaacatccaccccacaagtttgccaactccaccgtctcatcatcgttctccgggaggagcgacgagaaatcaagcagccgccgacgaacccagctgctgcagctatcaacggcagttgttcggcaccagcagaccagctagcgttgggtttgatcccgtcggatcgatcgcatgcggcgccggctcgacccgtgcatctgagatcgccgggaggcatcgatccatggggagcggcaaggcatcctcaccaggcgccgttgccggcgcgagcggtggcccgccgcagcagccgccgggcgccgccgtctgctgcatgtgcggcgaccgcggcctcctgcccgagctcttccgctgctccgcctgctccgtccgctcccagcacacatactgcacggatcggtacccgaaggtggagtcgtacggcacctgcaactggtgtctgagggtggacgggggcgtggctgcttcgacttcttcctcgccgaggtccgccggcaaggcggccgcccggtcgccggctggtcacagcgaccccacgagcggcggcggcaggtcgcccaaggtcgccgctcgtggcgacttcgcgtcgtcgaacccgagcaagcctataaagaagcagcagccgcagcaccagcggctcctgctgcggcggtcggcgtcggacctcggaagccgcgccgtccgcgacgcgccgcccccgtcgcccggcgtcgcgcgcggcaggccgagggtccggaggtacaagctcttggaagaggtgatcactagctagtagccacagatgccagtgtgccgtcgtggatgacacgtgtatgtattaggtgttgtacgtgcatcttgtgtgccgccatgcatgcatgcatggacggaggaggtctagcggtgtcctgtgtgcgtgcgcttatcagctgctaatcagactgtgcgacgtgctgtacatgaggaataatacttgctaacgtggagttcgatattcgcttgatcgatcctctcggttatagttaaccggctagctgtttatagagtgttctctgcgtacaaataaacttctttcctgcgatgtacaaactctaatctcgagagcttaatcaaggtaattaaagagagaaggcttctgtt

SEQ ID NO: 4317 - DNA, 4165 bp, Setaria italica
ccagcagagagcggcagccatggagcttctttgttcacctcctcaagcaagctcccttcttgtagcagcttggaccagttgttgcactcacagaatcaaagccaacaaccgaggcttccagctgaactgaacaagctgcctttacacactacacacatatagaaaacgctgtaccccgtacgcgcgctactactccgactaagagcttggcggcgctagagcagctagcagatcgagagcaaatcgaacggtccagccgtccagctggtgatcttcctcctcctgatcagagctcctgcgacgccaccgccgcggccgagcagctagctaagctaaccgatcagatcggggaggggtgcggtgtcatctctcctgaggaagcggcgcggcaatggccggggggcagcagcccgaggcgtcgcccgggcgctaccagcgccgccgcgacgagatcgacgacgactgcgcggacgtgctcggcgtcgacgtgcggggcccggacgccgaccccttcgacatccccgccaagcgcgccccggtcgagcggctgcggcgctggaggcaagctgcacttgtcctcaatgcttctcgacgattcagatatacgcttgacctaaaaaaggaggaggagaaagaacaaataaggaggaagattagggcccatgctcaagtcatacgggctgcgttacttttcaaagaggctggtgaaaagcagaatggtgacagggaattaccagaaattctcccacgggggtttggaatcagagaggagcagctgacagtgatgactagagatcacaattattctgctctgcaagaatatggaggggttaaagggcttacaaatttactgaaaaccaactcagagaagggaattcatggcgatgaggcagatttgtcatgcagggcaaatgcttttggggctaacagatatcctcgcaagaaaggaagaagcttttgggtttttctttgggaggcctgccaggatatgacgctagttattcttatcatagctgcaataatttctctagtattgggcattgcaacagagggtatcaaagaaggatggtatgatggcacaagtattgcatttgcggtgtttcttgtgatagttgttacagctgtcagtgactacaagcagtccctgcagttccaacacctcaacgaggagaagcaaaacatacaagtggaggttattaggggcggcagaaggattcaagtgtcaatatttgatattgtggttggtgatgtagtggctttaaaaattggtgatcaggtcccagctgatggtgttgtaatcagtagtcattctcttgccattgatgagtccagtatgacaggggaaagcaagattgttatgaaggatcagaagactccttttttaatggctggatgcaaagttgctgatggttatggtaccatgttggtaaccgcagttggccttaacactgaatggggtttattaatggccagcatttcagaagataacaatgaagaaactcctttgcaggtacggttgaatggagtagcaacattcataggtatcgtagggctttctgttgctgctatggtcctcatagtcctctttgcaagatatttttcaggacataccacaaattcagatggctctgttcagtttgttaaggggcgcacaagtgcgaaatctgcaatatttgggtcaataaagatactaactgttgcggtgaccattgttgttgtcgctgtacctgagggcttaccactggctgtcacactaactctggcttattccatgcggaaaatgatggctgacaaagcactggtgcggaggctttctgcctgtgaaacaatgggttcggctactactatttgcagtgacaagactggtacattaacgttaaaccagatgaccgttgtgcaatcgattgttggcggagtgaagctgcaagctcctgctaatgttgataacctgtcacctactgtagtctcacttttacttgaaggaattgcacagaatacttcaggcagtgtgtttgaggctcaggatggtagcgtcgagataactggctcaccaacggaaaaggccatccttgcttggggtcttgaacttcggatgaaatttgcggaggagagatcacgatctgctataattcatgtctctccattcaactctgaaaaaaagcgtgctggggttgcagtggctgtgagagattcagatattcatgtacactggaaaggagctgctgaaattgttcttgacttatgcaaaagttggattgatgtggatggctcaaatcatgaaatgacacctgataaggctaatcaactcaagaaatttatagaagatatggcagaacaaagtcttcgatgtattgcttttgcttatcgaaatcttgatctggaggatgttccaagtgaggaacaacgaatcagctggcaactgccagatgatgacctgactcttattggaatcgcagggatgaaggatccttgccgccctgaagtaagagaagctgttgaattgtgcaaaaaggctggtgtaaaggtacggatggtaactggagataatctaaagacagctagagcgatagcacttgagtgtggaatactcgaggactctgatgcatctgcgcaagctataatagagggaagagttttccgtgcttacaatgatactgaaagggaggatgttgccgataagatttctgtgatggcgcgatcttctcctaatgacaaacttctcctagttaaggctcttaagaaaagaggccatgtcgttgctgttactggtgatggaacaaatgatgctcctgcattgcatgaggcagatattggtcttgctatgggcatccaaggaacagaagtagctaaagagagctcagacataattattctggatgataatttttctactgttgtgaaggtagttcgctggggtcgctctgtttatgcaaatatccaaaagtttattcagttccagctcactgtaaatgttgcggctcttgtcataaatgttgttgctgctgtttcctcaggaaatgttcctctaaatgctgttcagcttctctgggttaatctcatcatggacacacttggtgctcttgcattggctactgaaccaccaacagatcaacttatgaggcggtcacctgttggacggagagaacctcttgtgactaatatcatgtggaggaacttgtttattcaggctgtctttcaagttgctgttcttcttactctcaactttaggggccggaatcttttgcatttgactcaggacacactagattactccagtaaagtgaaaaatacagttatattcaatacatttgtcttgtgtcaggtgtttaatgagttcaattctcgtaaaccagaagaactgaacatctttagtggagtttcaagaaatcatctttttttgggagtagtgactataaccgttgtattgcaggtgataattattgagttccttgggaaatttacatcaactgtgagactgaattggaagctttggcttgtttctgtagttattgcttttgtaagttggcccttggcttttgttggaaaattcatcccagttccaaagactgaattgaaggatatcattctaaggtgttggccccaacgtaatgagagagcagaacaacagggacaggatgagagacgggcagaatcacaggtgtgaagctgcttgggcaagtgttcaaaattatcggatgctgaaatatagtgttggtgcacatagatggtgttggttaattttgggtgctgatttcttctaaccatgctaccttgatccctggctataaattctgaggctggtcagcgatgcaagagataatacatcctcgctggctcatgatctagagttgaagtcattgtaaacaaaatatttcatccttagcctaacgaagttcaggacctccagtagttaattgcacacaagttgtgccggcggtcttagattggtttgatctggggaagtcgcaaaaaacaatgaagtgtagctcgttttccctatattcttttggttttagttgctctctagaacattttgtctaaccggacactggtgctcggtgtaaagtctgatatgtgaatgctacttgggtgcgattgaaggatttgactttcgcaatgtacatttgctgacttgctattggttgcgcacacttcttaagtcgtg

SEQ ID NO: 4318 - DNA, 4078 bp, Setaria italica
cgaactaccatcaagcagtatagcaacctaaaggcgacgacgccagcagagagcggcagccatggagcttctttgttcacctcctcaagcaagctcccttcttgtagcagcttggaccagttgttgcactcacagaatcaaagccaacaaccgaggcttccagctgaactgaacaagctgcctttacacactacacacatatagaaaacgctgtaccccgtacgcgcgctactactccgactaagagcttggcggcgctagagcagctagcagatcgagagcaaatcgaacggtccagccgtccagctggtgatcttcctcctcctgatcagagctcctgcgacgccaccgccgcggccgagcagctagctaagctaaccgatcagatcggggaggggtgcggtgtcatctctcctgaggaagcggcgcggcaatggccggggggcagcagcccgaggcgtcgcccgggcgctaccagcgccgccgcgacgagatcgacgacgactgcgcggacgtgctcggcgtcgacgtgcggggcccggacgccgaccccttcgacatccccgccaagcgcgccccggtcgagcggctgcggcgctggaggcaagctgcacttgtcctcaatgcttctcgacgattcagatatacgcttgacctaaaaaaggaggaggagaaagaacaaataaggaggaagattagggcccatgctcaagtcatacgggctgcgttacttttcaaagaggctggtgaaaagcagaatggtgacagggaattaccagaaattctcccacgggggtttggaatcagagaggagcagctgacagtgatgactagagatcacaattattctgctctgcaagaatatggaggggttaaagggcttacaaatttactgaaaaccaactcagagaagggaattcatggcgatgaggcagatttgtcatgcagggcaaatgcttttggggctaacagatatcctcgcaagaaaggaagaagcttttgggtttttctttgggaggcctgccaggatatgacgctagttattcttatcatagctgcaataatttctctagtattgggcattgcaacagagggtatcaaagaaggatggtatgatggcacaagtattgcatttgcggtgtttcttgtgatagttgttacagctgtcagtgactacaagcagtccctgcagttccaacacctcaacgaggagaagcaaaacatacaagtggaggttattaggggcggcagaaggattcaagtgtcaatatttgatattgtggttggtgatgtagtggctttaaaaattggtgatcaggtaaccgcagttggccttaacactgaatggggtttattaatggccagcatttcagaagataacaatgaagaaactcctttgcaggtacggttgaatggagtagcaacattcataggtatcgtagggctttctgttgctgctatggtcctcatagtcctctttgcaagatatttttcaggacataccacaaattcagatggctctgttcagtttgttaaggggcgcacaagtgcgaaatctgcaatatttgggtcaataaagatactaactgttgcggtgaccattgttgttgtcgctgtacctgagggcttaccactggctgtcacactaactctggcttattccatgcggaaaatgatggctgacaaagcactggtgcggaggctttctgcctgtgaaacaatgggttcggctactactatttgcagtgacaagactggtacattaacgttaaaccagatgaccgttgtgcaatcgattgttggcggagtgaagctgcaagctcctgctaatgttgataacctgtcacctactgtagtctcacttttacttgaaggaattgcacagaatacttcaggcagtgtgtttgaggctcaggatggtagcgtcgagataactggctcaccaacggaaaaggccatccttgcttggggtcttgaacttcggatgaaatttgcggaggagagatcacgatctgctataattcatgtctctccattcaactctgaaaaaaagcgtgctggggttgcagtggctgtgagagattcagatattcatgtacactggaaaggagctgctgaaattgttcttgacttatgcaaaagttggattgatgtggatggctcaaatcatgaaatgacacctgataaggctaatcaactcaagaaatttatagaagatatggcagaacaaagtcttcgatgtattgcttttgcttatcgaaatcttgatctggaggatgttccaagtgaggaacaacgaatcagctggcaactgccagatgatgacctgactcttattggaatcgcagggatgaaggatccttgccgccctgaagtaagagaagctgttgaattgtgcaaaaaggctggtgtaaaggtacggatggtaactggagataatctaaagacagctagagcgatagcacttgagtgtggaatactcgaggactctgatgcatctgcgcaagctataatagagggaagagttttccgtgcttacaatgatactgaaagggaggatgttgccgataagatttctgtgatggcgcgatcttctcctaatgacaaacttctcctagttaaggctcttaagaaaagaggccatgtcgttgctgttactggtgatggaacaaatgatgctcctgcattgcatgaggcagatattggtcttgctatgggcatccaaggaacagaagtagctaaagagagctcagacataattattctggatgataatttttctactgttgtgaaggtagttcgctggggtcgctctgtttatgcaaatatccaaaagtttattcagttccagctcactgtaaatgttgcggctcttgtcataaatgttgttgctgctgtttcctcaggaaatgttcctctaaatgctgttcagcttctctgggttaatctcatcatggacacacttggtgctcttgcattggctactgaaccaccaacagatcaacttatgaggcggtcacctgttggacggagagaacctcttgtgactaatatcatgtggaggaacttgtttattcaggctgtctttcaagttgctgttcttcttactctcaactttaggggccggaatcttttgcatttgactcaggacacactagattactccagtaaagtgaaaaatacagttatattcaatacatttgtcttgtgtcaggtgtttaatgagttcaattctcgtaaaccagaagaactgaacatctttagtggagtttcaagaaatcatctttttttgggagtagtgactataaccgttgtattgcaggtgataattattgagttccttgggaaatttacatcaactgtgagactgaattggaagctttggcttgtttctgtagttattgcttttgtaagttggcccttggcttttgttggaaaattcatcccagttccaaagactgaattgaaggatatcattctaaggtgttggccccaacgtaatgagagagcagaacaacagggacaggatgagagacgggcagaatcacaggtgtgaagctgcttgggcaagtgttcaaaattatcggatgctgaaatatagtgttggtgcacatagatggtgttggttaattttgggtgctgatttcttctaaccatgctaccttgatccctggctataaattctgaggctggtcagcgatgcaagagataatacatcctcgctggctcatgatctagagttgaagtcattgtaaacaaaatatttcatccttagcctaacgaagttcaggacctccagtagttaattgcacacaagttgtgccggcggtcttagattggtttgatctggggaagtcgcaaaaaacaatgaagtgtagctcgttttccctatattcttttggttttagttgctctctagaacattttgtctaaccggacactggtgctcggtgtaaagtctgatatgtgaatgctacttgggtgcgattgaaggatttgactttcgcaatgtacatttgctgacttgctattggttgcgcacacttcttaagtcgtgaattgcagtgtctatgttctg

SEQ ID NO: 4319 - DNA, 4074 bp, Brachypodium distachyon
aagcgggaaaaggggcaaggaagcaacgcggaaggagacaaaagcccagccaagccaagcgcctcaattcgccgcacacgctcgcttcgtttcctccgccgcgcggctcctcccctaccactgctagccccgccgccgtctccggctaggtttcgctctcacctgcgcgcgcgcggcgcggcggcggcgcccgcctcgagattcgggggcgcggcggccgcgtttggtgtcatctctcctgaacagcggcggccgcgatgcccacgggcgtgcaggcgcccgaggcgtcgcccgggcggtaccagcggcaccgcgacgaggtgcccgacgacgtggggtgcgaagacgtgctcggcatcgacttggaaccggtggccgaccccttcgacatccctgccaagcgcgcgcccgtcgagcggctacggcggtggaggcaagctgcacttgtgctcaatgcttctcggcgattcagatatacacttgacctgaaaaaggaggaagaaaaggaacaaataaggaggaagatcagggctcatgctcaagtcatacgggctgcattacttttcaaggaagcgggagaaaagcagaatggtgagatggaattatcagaaatgccctcccagggatttagaattagagcggatcaacttacagccatgacaagggatcataattattctgccctgcaagaatatggaggggttaacgggctcacaaaattactgaaaacaaacccagagaagggagtccatggagatgaagcagatttgtcatgcaggttgggtgcttttggggctaacagatatcctcgcaagaaaggaagaagcttttgggtttttctctgggaggcctgtcaggatttgacactggctatccttatcgtagctgctgtcatttctcttgtattgggtatcgcaacagagggcatcaaggaaggatggtatgatggtgcaagtattgcatttgctgtctttctcgtgatacttgttactgctgtcagtgattacaaacagtccctgcagttccaacacctcaatgaggagaaacagaatatccaagtggaggttattaggggcggtagaaggattcaagtgtcaatctttgatatcgtggttggtgatgttgttgctctaaaaattggtgatcaggttccagctgatggtgttttaattagtggccattctcttgccattgatgaatccagtatgactggggaaagcaaaattgtctttaaggatcagaagtcgccttttctgatgggaggatgcaaggtagctgatggttatggtaccatgttggtaactgcagttggtctaaacactgaatggggcttactaatggcaagcatttcagaagaaaataatgaagagactccattacaggtgcggttgaatggagtagcaacattcataggcattgtgggtcttgttgttgctgcaatggtccttgtagtcctttttgcaaggtattttacaggacatactacaaacccagacggttctgttcagtttgttaaggggcgcacaggtgtgaaatctataatattcggagtgataaagatactaactgttgcggtgaccattattgtcgtcgctgtacctgagggactaccgctggccgtaacactgaccctggcttattcaatgcggaaaatgatggcagacaaagcactggtgaggaggctttcggcttgtgaaacgatgggttctgctacaacaatttgtagtgacaagaccggtacattaacgctcaaccagatgacggtggtgcggtcaatagttgcgggaatagagttgcaacctgtggctgctgttgagaagttgtcacctacagttacctctgttgtacttgaaggaattgcacaaaatacttcaggcagtgtgtttgagccagaggatgataatactgttgaggtaacaggctcaccaactgaaaaggcgatcctttcttggggtcttgagcttcatatgaaattcgcggaggagagatcaaaatctgctatcattcatgtttctccattcaactcagaaaaaaagcgtggcggagttgcagtgattacgagagattcagatgttcatgtgcactggaaaggagcagctgaaatagttcttgccttgtgtacaaattggcttaatgtagatggctcaacccataaaatgacacctgataaggctaatcaattcaagaaatacatagaagatatggccgagcaaagtcttcgttgtgttgcttttgcttatagaaatctggatctgaaggatgttccaagtgaggagcaaagaactaactggcaggtgccagataatgacctgactctcattgcaattgtggggatgaaggatccttgtcgccctggagttagagatgctgttgagctgtgcaccaattctggtgttaaggtacgcatggtaactggagataatctgcagacagctagagcaatagcactggagtgtggaatactcactgacccgcatgcttctgcaccagttataatagagggaagagtttttcgagagtatggcgacgctgacagggaggcaattgccgacaaaatttctgtgatgggaagatcctctccgaatgataagcttctccttgtaaaagcactgaagaagaatggccatgttgttgctgttactggtgatgggacaaatgatgctcctgcattgcacgaggcagatattggtctttctatgggcatccaaggaacagaagtagctaaagagagctcggacataattattctggatgacaattttgcttcggtcgtgaaggtggtccgctggggtcgatcggtttatgccaatatccaaaagtttattcaattccagcttactgtaaatgttgcggctcttataatcaatgtggttgctgctatttcctcgggcaatgttcctctaaatgctgttcagcttctctgggttaatctcataatggacacacttggtgcacttgctttggctactgaaccaccaacggaccagcttatgaagcggacgcctgttggacggagagaacctcttgtgaccaatattatgtggagaaacttgttcattcaggctgcctatcaagttgctgttcttctgaccctcaactttaggggccgaaatcttttgcacttgactcaagatacccttgaacactccagtaaagtgaaaaattcatttatattcaacacatttgtcctgtgccaggtgtttaacgagttcaattctcgtaaaccagaagaactgaatatatttgaaggagtttcaagaaaccatctttttttggccgttgtgagcataaccattgtgatgcaggtggtcattattgagttcctaggaaaatttacatcaacagtgaaacttacttgggagctttggcttgtttctctagctattgcttttgttagctggccgttggcttttgttggcaagttcattccagttcccaagactccattgaagaatttgatcctaaagtgttggcctaaatggaagaagcaaggtgaaggaccggctccaccagtgtgaaactccaagcgggtcaaagattatcaactatctcgaattatagtcctgccgtcctggtgcacatagatgcctgtataaattggactgctgacttctcctaacgatgctactagcttttagcctgactaaatattcttgaggttgcagtcaatgcaagtgaggttcttcatccttaccgctcttgatccgaggttaatttgaagccgatgtgaacaaaatgcggtattcactagcctaacaaaggtcagctatacaaccagtttggaagctcgctagtgaacagttctgttggacatgagtgaagtgtatattctaggtttcttttcttatgttgaggtcctctagaattttgtcctagctacaatatttgaaacagagggagtagattcttgtgaagagttggtttgggctttcttttgggtgctaatgagttgtggttgtagcatgaacctgcgtcagattttattgtttgctgactggggtgagatcactcgcttgtttacgtgctaatttaaacggaactggccagtgacgtaccaagatgacacatcgaggc

SEQ ID NO: 4320 - DNA, 4279 bp, Brachypodium distachyon
gatatccaaacttttgtttgttacaagagacgcgtttaggagatgtcaaaaggagagagacgcgtctaggaaatcagaggaagacgcaccttgaaacggcagatgccctggaagctacgcaacagaacggaaaaaaggaagcagacgaaatcaagggcgtgaagcgggaaaaggggcaaggaagcaacgcggaaggagacaaaagcccagccaagccaagcgcctcaattcgccgcacacgctcgcttcgtttcctccgccgcgcggctcctcccctaccactgctagccccgccgccgtctccggctaggtttcgctctcacctgcgcgcgcgcggcgcggcggcggcgcccgcctcgagattcgggggcgcggcggccgcgtttggtgtcatctctcctgaacagcggcggccgcgatgcccacgggcgtgcaggcgcccgaggcgtcgcccgggcggtaccagcggcaccgcgacgaggtgcccgacgacgtggggtgcgaagacgtgctcggcatcgacttggaaccggtggccgaccccttcgacatccctgccaagcgcgcgcccgtcgagcggctacggcggtggaggcaagctgcacttgtgctcaatgcttctcggcgattcagatatacacttgacctgaaaaaggaggaagaaaaggaacaaataaggaggaagatcagggctcatgctcaagtcatacgggctgcattacttttcaaggaagcgggagaaaagcagaatggtgagatggaattatcagaaatgccctcccagggatttagaattagagcggatcaacttacagccatgacaagggatcataattattctgccctgcaagaatatggaggggttaacgggctcacaaaattactgaaaacaaacccagagaagggagtccatggagatgaagcagatttgtcatgcaggttgggtgcttttggggctaacagatatcctcgcaagaaaggaagaagcttttgggtttttctctgggaggcctgtcaggatttgacactggctatccttatcgtagctgctgtcatttctcttgtattgggtatcgcaacagagggcatcaaggaaggatggtatgatggtgcaagtattgcatttgctgtctttctcgtgatacttgttactgctgtcagtgattacaaacagtccctgcagttccaacacctcaatgaggagaaacagaatatccaagtggaggttattaggggcggtagaaggattcaagtgtcaatctttgatatcgtggttggtgatgttgttgctctaaaaattggtgatcaggttccagctgatggtgttttaattagtggccattctcttgccattgatgaatccagtatgactggggaaagcaaaattgtctttaaggatcagaagtcgccttttctgatgggaggatgcaaggtagctgatggttatggtaccatgttggtaactgcagttggtctaaacactgaatggggcttactaatggcaagcatttcagaagaaaataatgaagagactccattacaggtgcggttgaatggagtagcaacattcataggcattgtgggtcttgttgttgctgcaatggtccttgtagtcctttttgcaaggtattttacaggacatactacaaacccagacggttctgttcagtttgttaaggggcgcacaggtgtgaaatctataatattcggagtgataaagatactaactgttgcggtgaccattattgtcgtcgctgtacctgagggactaccgctggccgtaacactgaccctggcttattcaatgcggaaaatgatggcagacaaagcactggtgaggaggctttcggcttgtgaaacgatgggttctgctacaacaatttgtagtgacaagaccggtacattaacgctcaaccagatgacggtggtgcggtcaatagttgcgggaatagagttgcaacctgtggctgctgttgagaagttgtcacctacagttacctctgttgtacttgaaggaattgcacaaaatacttcaggcagtgtgtttgagccagaggtgacgtcacaggatgataatactgttgaggtaacaggctcaccaactgaaaaggcgatcctttcttggggtcttgagcttcatatgaaattcgcggaggagagatcaaaatctgctatcattcatgtttctccattcaactcagaaaaaaagcgtggcggagttgcagtgattacgagagattcagatgttcatgtgcactggaaaggagcagctgaaatagttcttgccttgtgtacaaattggcttaatgtagatggctcaacccataaaatgacacctgataaggctaatcaattcaagaaatacatagaagatatggccgagcaaagtcttcgttgtgttgcttttgcttatagaaatctggatctgaaggatgttccaagtgaggagcaaagaactaactggcaggtgccagataatgacctgactctcattgcaattgtggggatgaaggatccttgtcgccctggagttagagatgctgttgagctgtgcaccaattctggtgttaaggtacgcatggtaactggagataatctgcagacagctagagcaatagcactggagtgtggaatactcactgacccgcatgcttctgcaccagttataatagagggaagagtttttcgagagtatggcgacgctgacagggaggcaattgccgacaaaatttctgtgatgggaagatcctctccgaatgataagcttctccttgtaaaagcactgaagaagaatggccatgttgttgctgttactggtgatgggacaaatgatgctcctgcattgcacgaggcagatattggtctttctatgggcatccaaggaacagaagtagctaaagagagctcggacataattattctggatgacaattttgcttcggtcgtgaaggtggtccgctggggtcgatcggtttatgccaatatccaaaagtttattcaattccagcttactgtaaatgttgcggctcttataatcaatgtggttgctgctatttcctcgggcaatgttcctctaaatgctgttcagcttctctgggttaatctcataatggacacacttggtgcacttgctttggctactgaaccaccaacggaccagcttatgaagcggacgcctgttggacggagagaacctcttgtgaccaatattatgtggagaaacttgttcattcaggctgcctatcaagttgctgttcttctgaccctcaactttaggggccgaaatcttttgcacttgactcaagatacccttgaacactccagtaaagtgaaaaattcatttatattcaacacatttgtcctgtgccaggtgtttaacgagttcaattctcgtaaaccagaagaactgaatatatttgaaggagtttcaagaaaccatctttttttggccgttgtgagcataaccattgtgatgcaggtggtcattattgagttcctaggaaaatttacatcaacagtgaaacttacttgggagctttggcttgtttctctagctattgcttttgttagctggccgttggcttttgttggcaagttcattccagttcccaagactccattgaagaatttgatcctaaagtgttggcctaaatggaagaagcaaggtgaaggaccggctccaccagtgtgaaactccaagcgggtcaaagattatcaactatctcgaattatagtcctgccgtcctggtgcacatagatgcctgtataaattggactgctgacttctcctaacgatgctactagcttttagcctgactaaatattcttgaggttgcagtcaatgcaagtgaggttcttcatccttaccgctcttgatccgaggttaatttgaagccgatgtgaacaaaatgcggtattcactagcctaacaaaggtcagctatacaaccagtttggaagctcgctagtgaacagttctgttggacatgagtgaagtgtatattctaggtttcttttcttatgttgaggtcctctagaattttgtcctagctacaatatttgaaacagagggagtagattcttgtgaagagttggtttgggctttcttttgggtgctaatgagttgtggttgtagcatgaacctgcgtcagattttattgtttgctgactggggtgagatcactcgcttgtttacgtgctaatttaaacggaactggccagtgacgtaccaagatgacacatcgaggccatcgttcagacactgataacgtcattgcgtt

SEQ ID NO: 4321 - DNA, 3675 bp, Triticum aestivum
gctgcacttgtgctcaatgcatctcggcgattcagatatacactcgacttgaaaaaggaggaagaaaaagaacaaataaggaggaagattagggctcatgctcaagtcatacgggctgcactactgttcaaggaagcaggagaaaagcagaatggtgatacggaattaccagaaattctcccacgggggtttggaattggagaggatcaacttacatcgatgacaagggatcataactattccgctctgcaagaatatggaggggttaaagggctcacaaatttactgaaaacaaacccagagaaggggatccatggtgatgaagcagatttgtcatgtagggcgaatgcttttggggctaacagatatcctcgcaagaaaggaaaaagcttctgggtttttctctgggaggcctgcaaggacttgacattggttatccttattgtagctgcagccatttctcttgtattgggcatcgcaacagagggcatcaaggaaggatggtatgatggtgcaagtatagcatttgctgtctttcttgtgatacttgttactgctgtcagtgattacaaacagtcccttcagttccaacacctcaatgaggagaaacaaaatattcaagtcgaggttattaggggtggtagaaggattcaagtgtcgatctttgatattgttgttggtgatgtagtagctttaaaaattggtgatcaggttccagcagatggcattttaattagtggccattctcttgccattgatgaatccagtatgaccggggaaagcaaaattgttttgaaggatcagaattcaccttttctaatgggaggatgcaaagtagctgatggttatggtaccatgttggtaactgcggttggtctaaacactgaatggggtctattaatggccagcatttcagaagataataatgaagagacaccgttgcaggtgcggttgaatggagtagcaacattcataggcattgtggggcttgttgttgcagcaatggtccttgtagtcctctttgcaagatattttacaggacatactacaaacccagatggtactgttcagtttgttaaggggcgcacaggtgtgaaatctacaatatttggagtaataaagatactaactgtcgcggtgactattgttgtcgttgctgtacctgagggactaccgctggctgtaacactaaccctggcttattcaatgcggaaaatgatggcagataaagctctggtgaggaggctttcagcttgtgaaacgatgggttctgctacaacaatttgtagtgacaagaccggtacattaacgctcaatcagatgactgtggtgcgatcaatagttggggcgatagagctgcaacctcaggctactattgacaagttgtcacatacagttacctctcttgtacttgaagcaattgcacagaatacttcaggcagtgtgtttgagccagaggatggtagcaccgtcgaggtaacaggctcaccaactgaaaaggcaatcctttcttggggtcttgagcttcatatgaaatttgccgtggagagatcaaaatctgctatcattcatgtctctccattcaactcagaaaaaaaacgcggaggcgttgcagtgattgggagagattcagatgttcatgtgcattggaaaggagctgcggaaatagttctcgcgttatgtacaaattggcttgatgtagacggctcaactcatgaaatgacacctgataaggctaatcacttcaggaaatacatagaagatatggcggagcaaagtcttcgttgtgttgcttttgcttatagaaatcttgatccgaaggacattccaagtgaggaacaaagaattaattgggagttgcctgataatgacctgactcttattggaattgtggggatgaaggatccttgccgtcctggagtgagagatgctgttgagctgtgcaccaattctggtgttaaggtacggatggtaactggagataatctgcagacagctagagcaatagcacttgagtgtggaatacttactgacccccaggcttctgcaccagttataatagagggaaaagttttccgtgcatacagtgacgccgaaagagaggcggttgccgacaagatatctgtgatgggaagatcctctccgaatgataagcttcttcttgtaaaagcactgaagaagaatggccatgttgtggctgttactggagatgggacaaacgatgcccctgcattgcatgaggcagatattggtctttctatgggcattcaaggaacagaagtagctaaagagagctcagacataattattctggatgataattttgcttcagtcgtgaaggtggtccgctggggtcgttctgtttatgcaaatatccaaaagttcattcaattccagcttactgtaaatgttgcggctcttataatcaatgtggttgctgctatttcctcgggcaatgttcctctaaatgctgttcagcttctctgggttaatctcataatggacacactcggcgcacttgcattggctactgaaccaccaacggaccagcttatgaaaaggacacctgttggacggagagaacctcttgtgactaatattatgtggagaaacttgttcattcaggctgtctatcaagtggctgttcttttgacgcttaactttaggggccgagatcttctgcatttgactcaagataccctcgaacactccagtaaagtgaaaaattcatttatattcaacacatttgtcctgtgtcaggtgtttaacgagttcaatgcacgtaaaccagaagagctgaacatatttgaaggagtttcaagaaaccacctctttttggccgttgtgagcgtaaccgtcgtgctgcaggtgataattattgagttccttgggaaatttacatcaacagtgagactcagttggcagctttggcttgtttctcttgctattgcttttatcagctggccgttggctcttgttggaaagttcattccagttccccagaccccattgaagaatttgatcctgaagtgttggccaaaaaagaagaagcaaggtgatgaaggagcagctccaccggtgtgacactgaacgtctctcccaagtggcagaaatcatcagctgccgaattccagttctggtgcatatagatgcttgcataaatttgaatgctgatttcctctaaccacgctagctagcttttatctgactaaatactcgggaggttgaagccaacacgagtgagacgcttcgtcctcgctgactcgtaagctgggtctgaagccgacctgaactaaagaccattttaggagcctaacaaaggtcaggaactccgtcggctacacacctgtacaaatggtgcagcatgtctagaatgttctcgcagtttggaagatcgctagtaaacaaatttccttttggatacgattgatgtgtatatcgtttcgtctagtttccctcttttcctctaggattttgttctagcgaactagtgagtcctgtggagagaaccctgggctttctttcgagtggtaatgtttgtgtggtcgaaccatgaatttgcataatgtgcattaaattggtactgacttcagtaagctaccttctgtatgccaaaccttgtgaacgtttatgtttacctaaaaatggtacaaagcgcacgtgcctgattctggc

SEQ ID NO: 4322 - DNA, 3265 bp, Zea mays
acagagccgccagcagatccaccttcatgcatggttttctgtgcttcagacatgcttgttctgaaatttccaataattacttcaactagtgctgctgtacatgcagtcataactgtttttatctgttcactaatttttacgcgttcttattgtgtttttttgctttggcagcaagctgcacttgtcctgaatgcttctcgacgattcagatacacccttgacctaaaaaaggaggaggagaaggaacaaataagaaggaagataagggcccatgcccaagtcatacgggccgctttacttttcaaagaggctggggaaaagcagactcatgaaacagagttaccagaaattctcccacgagattttggaattggagaggagcagctgacagtgatgactagggatcataattattctgctctgcaagaatatggaggggtcatagggctcgcaaatttactgaaaaccaacctagagaagggaattcatggcgatgaggcagatttgtcatgcagggcaaatgcttttgggcctaacagatatcctcgcaagaaaggaaggagcttttgggtttttctttgggaggcctgccaggatatgacgctagttatccttatcatagctgcagtaatttctttagtactgggcattgcaactgagggcacaaaagaaggctggtatgatggcactagtattgcatttgcagtctttcttgtgatagtcgttactgctgttagtgactacaagcagtcgctgcagttccaacacctcaatgaggagaagcaaaacatacaagtggaggttattaggggtggtagaaggatacaagtatcaatatttgatattgtagtcggtgatatcgtggctttaaaaattggtgatcaggtctcagctgatggtgttgtaatcagtggtcattctcttgccattgatgagtctagtatgactggggaaagcaagattgttatgaaagatcagaagtcaccctttttaatggctggatcaaaagttgctgatggttatggcaccatgttggtaacggctgttggccttaacaccgaatggggtttattaatggccagcatttcagaagacaacaatgaagaaactcctctgcaggtgcggttgaatggagtagcaacattcataggtattgcaggcctttctgttgctgctatggtcctcgtagtcctctttgcaagatattttacaggacatactacagattcagatggctctgttcaatttgttaagaggcacactagtgtgaaatctgcaatatttggttcaataaagatactaactgttgcggtaactattgttgtcgtcgctgtacctgagggcttaccactggctgtcacactaactctggcttattccatgcgaaaaatgatggccgacaaagcactggttcggaggctttctgcctgtgaaacaatgggttcagcgacaactatttgtagtgacaagactggtacattaacattaaaccagatgactgttatgcaatcgattgtcggtgaagtaaagctgcaacctcctgctaatgttgataaactgtcatctactgtagcctcacttctacttgaaggaattgcacagaatacttcaggcagtgtgtttgaggcacaggatggtagcgtcgaggtaactggttcaccaacagaaaaggctatcctatcttggggtcttgatagagattcaaatgttcatgtacactggaaaggagctgctgaaattgttcttgccttgtgcacaagttggctcaatgtggatggctcaacacatgaaatgacacctgataaggatccttgtcgccctgaagtaagagacgctgtcgaactgtgcaaaaaggctggtgttaaggtacgaatggtaactggagataatctgaagacagctaaagcaatagctcttgagtgtggaatactcgatgactcagaggcatctgcacaagctataatagagggaagagttttccgtgcttacgatgatactgaaagggagaatgttgctgacaagatttctgtgatggcacgatcctctcctaatgacaaacttctcctagtaaaagctcttaagaaaataggccatgttgtagctgttactggtgatggaacgaatgatgctcctgcattgcatgaggcagatattggtctttctatgggcatccaaggaacagaagtagccaaagagagctcagacataataattctggatgacaatttttcttctgttgtgaaggtggttcgctggggtcgctctgtttatgcaaatatccaaaagtttattcagttccagcttaccgtaaatgttgcagctcttgtcatcaatgttgttgctgctgtttcctcaggaaatgttcctctaaatgctgttcagcttctctgggttaatctcatcatggacacactcggtgctcttgctttggctactgaaccaccaacagatcaacttatgaggcggccaccagttggacggagagaacctcttgtgactaatatcatgtggagaaacttgtttattcaggctgtctttcaagttgctgttcttctgactctcaactttaggggtcgggatcttttgcatttgactcatgacacactaggacactctagtaaagtgaaaaatacacttatattcaacacatttgtattgtgccaggtgtttaatgaggtcaattctcgtaaaccagaagaactgaacatcttttccggagtttcaagaaatcatcttttcttggcagtagtgagcataactgttgtgatgcaggtgataattattgagttcctcgggaaatttacatcaacagtgagactcaactggaagctttggcttgtttctgtagttattgcttttctaagttggcccttggcttttgttggaaaattcattccagttccgaggactgaattgaaggatctcattgtaaggtgttggcctaaacgtggcgagagtgcagcacaacagactcaggatgacagaatggaagtaccagtgtgaagctgttcttgagcaacttctcgaaattatcagtcagcaatcggggagtggtttattgcacaagttgtgcagtcggtcccagaatcatttggggaaggcgctataaacagtttttcttggcaggagtggagtgtagctccttttcgctaatatcatttttacttttagatgcaatcaagaacattttgtcaaacactctaatagtaattggctgattttgttagagttgcctttgctatgccataattgtatttcagaaatt

SEQ ID NO: 4323 - DNA, 4815 bp, Oryza sativa
aaaaaaaaaagaaaaacccgacacaacgctttagttgacaggttttcaagaaatttacgcccccctattcttatagaactagaatgtaaatatgatagagacaaaaagacaaagtaaaaaaaaaaagaaacggaaaacacccacagtcccagccacagcacatttttggtagcttgtcttttggctagttggcctggctctggccgatcgagaggatcaggaaaacaatcggacttgaaaacaaaaaccagcgacagccgacagggtcgtcgctccgttccaccgttggttcgcaaccgaaccaacgcgtgcccgcacgacgccgtgcgccccagatacaaagtcgccaacgcgcaatttatttagcccagcccagccaagaccgtcgcgcgtgccacgcacccagcacgtacgcgtgacggagacaccgagccaatcgcgccggttcgatcgagcagttgggctcgttaggtcaggtcaggtcacccccgcgtcgtccgaccgcgacaccattcatcacacaagtcacggtctcgaactcgactcggccgcgacgtcgacgacgagttcaccactagcccaccaccacgacgactacactctcccggctccgagacccgccggaaaatcccccggcgaactgcggcgcgattcctctccgagttaaagcaaaaaaaagcggaagccgaagcgcccccgcctccgcgtcgtctgcgtgaagcactccccctcttcaagcgggaaaagcgggggagggaagcaacgcggaaattaaagagcagagcagagcagagccctgagccctcgattcgcttcgtttcctccgccgcacgcctcctcctcccccaccccctccccccactccgactccgccgccgccgccgccgccgccgcctccggctccggctacagctcgccgccccccaggttgctctggatttttgcgcgtgtcgctgttggttttggggggcgaggggtcgggggatgggttgggatttgtgcttgttttttttttttgtgcgtgtgtttatgctgttgctgatgagggtggtgtgggaatgtgcgtgcagatcgggggcggccgccgcctggtggtgtccgtgtcatctctcctgaggaaccatgccggtgggagtgcaggcgcccgaggcgtcgccggggaggtaccatcggcggcgggacgacgacgatggcaacggcagcgactgcagcgacgtgctcggcgtcgacgtgctggacgagggggccgaccccttcgacatccccgccaagcgcgcctccgtcgagcggcttcgccggtggaggcaagctgctcttgtgctcaatgcctctcggcgattcagatatactcttgatctgaagaaagaggaggaaaaggaacaaataaggaggaaaattagggctcatgctcaagtcatccgggttaaaggactcgcaaatttactgaaaacaaacacggagaagggagtccatggagatgaggtagatttggcatgcagggcaaatgcttttggggctaacagataccctcgcaagaaggggagaagttttttggttttcctctgggaagcttgccaagacttgacactagttatccttatcatagcggctgtaatttctctggtattgggcattgcaacagagggcatcaaagaaggatggtacgacggtgcaagcattgcatttgcggtctttcttgtcatacttgttactgctgtgagtgactacaaacagtcccttcagttccagcaccttaatgaagagaagcaaaatatacaagtggaggttattagaggtggtagaaggattgaagtgtcaatatttgatattgtagttggtgatgtagtggctctaaaaattggtgaccaggtcccggctgatggtgttttggttagtggtcattctcttgccattgatgaatccagtatgactggggaaagcaagatagttgtcaaggaccataaatcacctttcttaatgggaggatgcaaagtagctgatggttatggtaccatgttggtaactgcagtcggtctaaacactgagtggggcttattgatggccagcatctcagaagacaacaatgaagaaactccactacaggtacggttgaatggagtggcaactttcataggtattgtggggctttctgttgctgcaatggttctcatagtccttgttgcaagatattttacagggcatactacaaatccagatggctctattcaatttgttaaggggcaaacaagtgtgaaatctacaatttttgggacaataaagatactaactatcgcggtgactattgttgtcgttgctgtacctgagggactaccacttgccgtaactctaacgctggcctattcgatgcaaaaaatgatggcagacaaagctctggtgcggaggctttcagcttgtgaaacaatgggttcagctacaaccatttgtagtgacaagactggtacactaacactcaatcagatgaccgttgtccgatctgttgttggggggataaagctgaaatctccagctgatattgagaatttgtcgcctgttgtttcctctcttatacttgaaggaatcgcacagaattcttcaggcagcgtttttgagccagaggatggtagtcctattgagataacaggctcaccaactgaaaaggctattctttcttggggtgttgagtttcatatgaaatttgcggaggagaaatcaaaatcttctattattcatgtctccccattcaactcagaaaagaaacgtgccggtgttgcagtgattgtggatgattcagatattcatgtgcactggaaaggggctgctgaaattgttcttgccttatgtacaaattggcttgatgtaaatggcattagtcatgaaatgacacctgataaggctaatcagttcaagaaatacatagaggagatggccgaggaaagtcttcgatgtgttgcttttgcttatagaactcttgatctgaattatgttccaaatgaggaagaaagaatcaactgggaattaccagataatgaactggctctcattggaatcgtagggatgaaggacccctgtcgccctggggtaagaaatgctgtagatctgtgcaaaaatgctggtgtaaaggtacgaatggtaactggagataacctacaaacggccagagcaatagcacttgagtgtggaatactcacggactcccaggcatctcaaccagttataatagagggaaaagttttccgggcatacagtgacgctgaaagggaggcagttgctgatcagattagtgtcatgggaagatcttctccaagtgacaaacttctcctagtaaaagcactgaaaaagaaaggcaatgttgttgctgttactggagatggaacgaatgatgctcctgcattgcatgaggcagacattggtcttgctatgggtatccaaggaacagaagtagctaaagaaagctcagatataattattctggatgacaattttgcttcagttgtaaaggtggtccgctggggtcgttcggtttatgcaaatatccaaaagtttattcaattccagcttactgtaaatgttgcggctcttataatcaatgtggttgctgctatttcttcaggaaatgttcctctaaacgccgttcagcttctttgggtcaatctcattatggacacacttggtgcacttgcattggctactgaaccaccaacagaccaacttatgaagcggccacctgttggacggaaagaaccacttgtgactaacattatgtggagaaacttgttcattcaggctgtctttcaagttactgttcttctgacactcaactttagaggccgggatcttctgcatttgactcaagatactcttgatcatgccaataaagtgtttaacgaattcaattctcgtaaaccatatgaactgaatatatttgatggggtttcaagaaaccatctttttttggctgtagtgagcataactgtcgtgctgcaggtaataatcattgagtttcttgggaaatttacatcaacagtgagactcagttggaagctttggcttgtttctgttggtattggatttgtgagttggcccctggctttttctggaaagttcataccggttccccaaactgaattgaaaacttacatctcaaggtgtttaccgggaaagaaagataacgaaggatcaactccacctccacctccacctccacctgtgtgattgtgcatgtccaagtgaccaaaattatcagctctgaaattagtggtggtgcacatagatgcttgtataattttgaaggttgacttctaaccatgctacctcttaggctgactgtatactgaggttgaagccaatccgacagatgtttcaacctctcttactcatgaattgggcctgacgccgatgtaaacaaagattaggaacttagacatacacttcactagttggctagggatgagtgtgggctgacccgtggatactcctttacccacactagttcaactaaatgaactaaatttcacttttagaatcacaaaaaatgaaatgtagttcgtttatttggactagagtgggtcaattagtacctatgggttggcctgtggccagtcttggccacattcatgcatcatagtacgctactgagcacatcttctttcaaagtattacacggagatgtctaaaaatttgagctaaatgactgggaggtttattagtgttactgcttttgatttttgagagctgctcatatttttcaggatcaacatacattttgtacttgaatgctgtacttttatttaggtatgttccggcgcaaattatata

SEQ ID NO: 4324 - DNA, 476 bp, Saccharum officinarum
cacaaagtcgcaaagcgtttggcgattccgtgaagcgagcaaggcgatgagcttgaggtacatgagccgggtgggcgcgcgggcggcgcaggcggtgcgggagagcacggggaggtcggtcaaggacaaggcgcagtcgtcgtcggcgtcgatggcgaggagcaacggcggcaggccggcgccggccgccgggtcggtggagtcgggaagggcgagcgccgcggcggcggccaggaggaaggcggaggaggagaagcggcggcgcgccgagcaggcgctgcgcaccgtcatgttcctctccgtctgggggcccaacacctagtaggatgtaggaaggagtatagcatcgatcttgtgtagtttgtgagcacactgctacgtcaagatggtttaggtagtgttgagcgcctttgtttgtttgaggttggaaacaagatgtaaatttgctaatatataatatttgaagacaatcgacc

SEQ ID NO: 4325 - DNA, 1960 bp, Panicum virgatum
catgttttttttcttcgtccgggaaatccacggcaaaggctgataccgtgttcggtcagaaatatcgtttgctcgtaatctatccgagccacggcaggcagaacgcgttgcggccgacgtcacatgtgacgcgagcgaggatggagataggataagaaacgccaaacgccggcttctggagtggtctgttcccgcagcggacgcccgccgtttcagacaaaccacgctccgcgcgcgcccaccagaaacacaagagacacagaggcagactggcagagagagcccagcggcgccgccttcttccccaacactgcttccttccacggcagtataaagcacccgcgcctcttcacgttccaggtcaatccacaaaaccaaccaagaagaagaggacaagaagcgttcggtgatttcgtttcgtgtgggaggagaagagcaaggcgatgagcttgaggtacgtgagccgggtgggcgcgcgggcggcgcaggcggtgcgggagagcaccggcaggtccgtcaaggacaaggcgcagtcggcctcgtcgtcggcgtcgatggcgcggagcagcagggcgcctgccgccgggtcggtggactcgggcagggcgagcgccgccgcggcggcgaggaggaaggcggaggaggagaggcggcggcgggccgagcaggcgctgcgcaccgtcatgttcctctccgtctgggggcccaacacctaaaagtaggagagcatctctctgtgtgtgatggtttcagggtgttacaatgcctagcgttgtgcgcgtttctgttttgagttgaagaaaaaagaaaatgtaaatttataaatatgatctaatatatggacaccgataatttgattccgattagcttttcgtcctcccctccgacgatccgcccggcctctgcacgcttgtgccgcatgaggtgctcgtcttgctggacctccggagcggtcagttctgggttgagtgttttctgcagctcagcctgctgaggagctgtcgttcccgtcgtcgcagcgccaccgcacacaccagctgcctcaaactcacggccggcggcggtagattgtgtcgtgtctctgaatggaagacaaggctgcgtgttctctcttgttccagctgaatcaccatgccgatcaacgcaacgaagcttgcagctatgcacgctgtttcatgtgaaaatctaataagcttcttcgtggattacgtgatctaagttaagcggttcaatggaaacaaatcttgcgagctagcgtgcggatctaccaactacaagaacgtaaaacttcccaaaatggtcaacatgttgtgtcagctctgaaattgcaggttgccaaaagaaaattactgaagcaggtgaggtgacccatgcatcatgcaacatagtgcaattagaaagttcggcgctactgtgacaattttacatcagtgaacacatgcagatcatatacagacacgtacgtctccatgactctgctagaattcgaggtgaccgacgagaaactggacagcaatcagcaagaacgcagcctagttgggtccccagcacacaaggtgcatcacgttctcagccttctgcgccttcctcctcctcagcttctccaccgcgactgccttctcgacgggcacgctgctccggccgccgccgccgccaactccctgcggccgctgcgccgctggtgccgtccccggcttcacaccgccagccatcggcctaggcgccgccgggtgcctggcccgcacggcctgcgccgctcgcagcaccaccctgctcgcgtacctcaggctcatcgacgctggctggcggctgctggaactctgcgttctgaatccagtggatttttactgtgctggtgatggaagacggcgcacgccgactgtatataagcggcgcgaggggggacacagcgccggtcagttcagttccgaaaccgtcaggattgatcgagcggcggccg

SEQ ID NO: 4326 - DNA, 552 bp, Pennisetum glaucum
cgtcaatccaatccccaaagccagccaagaaagaagaagagagcaaagagcaaagcgatgagcttgaggtacatgagtcgggtgggcgcgcgggcggcgcaggcggtgcgggagagcaccggcaggtccgtcaaggacaaggcgcagtcggcctcgtcgtcggcgtcgatggcgaggagcggcagggcggccgggtcggtggactcgggcagggtcagcgccgcggcggcggcgaggaggaaggcggaggaggagaagcggcggcgcgccgagcaggcgctgcgcaccgtcatgttcctctccgtctgggggcccaacacctagaagtatagaactagcataaatatctggtctgtgtgttactttgctgctagctagcttacaactcttgcgcgcatttctgttcgagatgaaggaattgtaaatgatctggtatatgaacaaaaatcgatgctgttcattcttggaacaaggttctgtctctgtacctagaatctcaagatgtctccactgtgtttgcgtacccattcgttctctttcgaatctgttttc

SEQ ID NO: 4327 - DNA, 1619 bp, Panicum virgatum
cggtaattccacggcaaaggctaccgtgttcggtcagaaattcgtttgctcgtacctccgaaagcaatagagagttcgtaatctatccgagacacggtcacacggcaggcagaacgcgttgcggccgacgtcacatatgacgcgagcgacgatggagattaggataagcggtggcaaacgccggcttcgggagtgctctgttcccgcggcgagcgcccactgtttcagttaaaccacgctccgcgcgcgcccaccagaaacacacgagacacaagaggcagatagggcccagcggcgccgccttcttccccaacactgcttccttccacggcagtataaagcacccgcgcctcctcacgttccaggtcaatccacaaatccaaccaagaagtagaagacaagaagcgctcggtgacttcgtttcgtgtgggaggaggaggagaagagcaaggcgatgagcttgaggtacatgagccgtgtgggcgcgcgggcggcgcaggcggtgcgggagagcaccggcaggtccgtcaaggacaaggcgcagtcggcctcgtcgtcgtcggcgtcgatggcgcggagcagcagggcggccgggtcgtcggtggactcgggtagcgtgagcgccgcggcggcggcgaggaggaaggcggaggaggagaagcggcgccgggccgagcaggcgctgcgcaccgtcatgttcctctccgtctgggggcccaacacctagaattagcagagcgtctctctctgcgtgtgatactagtttctctgcgtctctctgcgcgtgcacacctagcgttgtgcacgtttgtgtttgagttgaaggaaaaaattgtaaatgatctaatatatggacacatcgatactttgattcttggaaaagcctctggtttgttgttgatttcaagctgtattcattccatgctgattcgtacccgttctctttcgaatctgcttgcgcacatcccattccaattctagcactgcgcgcgtctgccggttccctcgacgacctgctgtcagttgtgcttgggcttcagccttctgttcatggctaaattcctgtataactactcttgcagatggccacccttgaggttgcgtgcaatcctctgccaacaggaaccacttttgcaaatggccaaattcaggacatcagctctgaactctgaatttgcaatttgcagactgaaaatttttctgaagcatgctctccactttcagattatagtgaggcagttcacagttcatgtaccgtcacttgagcagcagggatctgtttttttcggcgatggcatctgttgttggacgccagcttgagtagcaacaagaggaacaccccgaattgcaagaacgcgcagggagcaaaactgcagaacaaggcggcatggatcagaatcaggtggggaggggcacagcagcgccgccatggtacttgttgcttcgtaattctcgtccatggtggcgtcaagggctcaaggccagatggctggctccggagtcgattagacagcagcgcccgtgaggcctacggtgtcggttccggcgcggctgacgggcacgttatctcaagaactagcgagctagcgtgtggatctaccaactacgagaacggtaaa

SEQ ID NO: 4328 - DNA, 537 bp, Pennisetum glaucum
ggctcatgtaccccaatccaatccacaaaccgagccaagaaagaagaagagggcaacgagcaaagcgatgagcttgaggtacatgagccgtgttggcgcgcgggcggcgcaggcggtgcgggagagcaccggcaggtccgtcaaggacaaggcgcagtcggcctcgtcgtcggcgtcgatggcgaggagcggcagggcggccgggtcggtggactcgggcagggtcagcgccgcggcggcggcggcggcgaggaggaaggcggaggaggagaagcggcggcgcgccgagcaggcgctgcgcaccgtcatgttcctctccgtctgggggcccaacacctagaagtatagaactagcataaatatctggtctgtgtgttactttgctgctagctagcttacaactctcgtgcgcatttctgttcgagatgaaggaattgtaaatcatctggtatatgaacaaaaatcgatgatgttcattcttggaacaaggctctgtctctgtacctagaatctcaagatgtctccactgtgtttgcg

SEQ ID NO: 4329 - DNA, 480 bp, Setaria italica
caaagccaagatcacagagttcggtgatttcgtgtgggaggaggagaagagcgaagcgatgagcttgaggtacatgagccgggtgggcgcgcgggcggcgcaggcggtgcgagagagcaccggcaggtccgtcaaggacaaggcgcagtcggcctcttcgtcggcctcgatggcgaggagcggcagggcggtcgggtgggtggactcgggcaggatcagcgccgccgcggcggcgaggaggaaggcggaggaggagaagcggcggcgcgccgagcaggcgctgcgcaccgtcatgttcctctccgtctggggtcccaacacctagaatttgcagaccatctgcgtgtaattgctgctagcctactactgttgtgcttgcgcatgtttctgttcgagatgaaggaattgtaaatgacctgatatatggacacaaatcgatctgttgattcttcgaacaaggctctggctctgttgctgatc

SEQ ID NO: 4330 - DNA, 572 bp, Setaria italica
aagcagcccaacggcggcgccgtcctcccctctccttccttccacgcaccagtataaaaggacccgcgcctcttcgcactccacgtcaatccacaaagccaagatcacagagttcggtgatttcgtgtgggaggaggagaagagcgaagcgatgagcttgaggtacatgagccgggtgggcgcgcgggcggcgcaggcggtgcgagagagcaccggcaggtccgtcaaggacaaggcgcagtcggcctcttcgtcggcctcgatggcgaggagcggcagggcggtcgggtgggtggactcgggcaggatcagcgccgccgcggcggcgaggaggaaggcggaggaggagaagcggcggcgcgccgagcaggcgctgcgcaccgtcatgttcctctccgtctggggtcccaacacctagaatttgcagaccatctgcgtgtaattgctgctagcctactactgttgtgcttgcgcatgtttctgttcgagatgaaggaattgtaaatgacctgatatatggacacaaatcgatctgttgattcttcgaacaaggctctggctctgttgctgat

SEQ ID NO: 4331 - DNA, 967 bp, Zea mays
actttgttctaatccacctcgatctagtcagctccggtcgccccacccaccacacgacacatccccagagcccaattcgctacaccctgtgtgcgtgaaacctgtcgcggtttgctgttcagcacgtctgcctcccgcaagttgtgtgcaggcaccaccgcaaccaaccgccatttggtttcgctcaacttcggcacttcgtgagctctggagtcacagcatcgatgagcctgagtgcctcctgcctcctgcctcctggaagttgtagctcaggctggcgttcaacgccgtcgtggaaagtggaagccccctcggtaactttgtttcgccaaagaatcaacgtagggatgtgatgtcttcaaagattataccactgtaagtaatatacactttgttttctgaacctcaaacaaacaaacaaacaaacaaacaaacgtgcacagaacgctacacatgatgatgctaacactccttgattcctactaggcctaggtgttggggccccagacggagaggaacatgacggtgcgcagcgcctgctcggcgcgccgccgcttctcctcctccgccttcctcctggccgccgccgccgccgccacggcgctcgctctccccgactccaccgacccggcggccggcgccctgctgccgccgctcctcgccatggacgccgcctgcgcctgcgccttgaccgacctgcccgtgctctcccgcaccacccgcgcgcccacacggctcatgtacctcaagctcatcgccttgcaattgctcaccgcaactttgtgtcctggattggattgacgtggagtgcggagaggcgcgcgggggccttttatgctgccgcctctgctttctggtgggcgcgtggggaacgcggtttggcctggaaccgggtgcgggtgcgggagtactcctatcaaacagcggcgggcggacggacggacgcagcgaactccagaagccgagc

SEQ ID NO: 4332 - DNA, 1046 bp, Zea mays
cgcgttccccacgcgcccaccagaaagcagaggcggcagcataaaaggcccccgcgcgcctctccgcactccacgtcaatccaatccaggacacaaagttgcggtgagcaattgcaaggcgatgagcttgaggtacatgagccgtgtgggagcgcgggtggtgcgggagagcacgggcaggtcggtcaaggcgcaggcgcaggcggcgtccatggcgaggagcggcggcagcagggcgccggccgccgggtcggtggagtcggggagagcgagcgccgtggcggcggcggcggcggccaggaggaaggcggaggaggagaagcggcggcgcgccgagcaggcgctgcgcaccgtcatgttcctctccgtctggggccccaacacctaggcctagtaggaatcaaggagtgttagcatcatcatgtgtagcgttctgtgcacgtttgtttgtttgtttgtttgtttgtttgaggttcagaaaacaaagtgtatattacttacagtggtataatctttgaagacatcacatccctacgttgattctttggcgaaacaaagttaccgagggggcttccactttccacgacggcgttgaacgccagcctgagctacaacttccaggaggcaggaggcaggaggcactcaggctcatcgatgctgtgactccagagctcacgaagtgccgaagttgagcgaaaccaaatggcggttggttgcggtggtgcctgcacacaacttgcgggaggcagacgtgctgaacagcaaaccgcgacaggtttcacgcacacagggtgtagcgaattgggctctggggatgtgtcgtgtggtgggtggggcgaccggagctgactagatcgaggtggattagaacaaagtggtacactgccgtcactgtatgggttgggtccatacagacgtacccttttttggcaggatatattataaccggaagaaactttttttttaaaaaaaatgtgatcatggagacttgcaaatgtaatagagaagctagcaaatcggtgctcggaactttaaaaaatctcgga

SEQ ID NO: 4333 - DNA, 1843 bp, Zea mays
caacaatatgttaaataaataagaaaacttagattacataaaattaatagcccatacttttattcctctaaaatctagaggacggcccaaaggaggccaaaccccgcccgcttcgagaaccggattgcagttgcccgttgtaatagaagcgccacgtgcgagctgcgactttgcttcaacacggaactgaaacgggttgacccacatcacaattcacaacaccagttgccaaccccacgcacgctctgcgacgcgcgagttccccttccccactcccagcttccgtttcctcggaccccaccaccgcgcccccattcctcagagctcagatgcagccgcagcccgccgagatggaccccgccgtcgacgcctccgcctccaccgcgcaggccgactccaacgtcagcgccgccgtccccgcacccgatccctccccgcccctgccggcgccggaggctgagacggtcgatccgccgcccccgccgcccgcaccagcgcccaagacggtcacctggagcgagaagctcacgtccgagtcgccgacgcacgtgcacgccgccgctgcggcggagtccagccagtacgtgtcccgcgggcccgcgtcctcctcgtctaaaggcgccgtggaggcgatgagggagacgctgtcgaggtgggggaagtcgtggggggagaccaccaagctggtcgagagcctcagccgcgacacgtggcaacacttcaagactggacctagttttactgaagctgctatgggacgcctagcacaagggactaaagttttagcagaaggaggctatgaaaaaatatttaagcagaccttcgaggttcttccagacgaggagctgaaaatatgctatgcgtgctatctctcaacatcagcaggtcctgtcatgggagtcttgtatatttctacagcaaagattgctttctgcagtgacaatcctctgtcatacaaagctggaaataaaactgaatggagttactacaaggtggtcattcctcttcaccagctaagagcagctaatccttcagtaagcaaattaagtcccgcggagaagtacattcaggtcgtatccattgaaggccacgagttctggttcatgggttttctaatgtacgacaaggctgcaaccagtcttcaagaagccttggctagcgcacgtgagttgcaaccgtgaagacaccggggtaaatggtgtttcttccggttacatcagtttccacatcttgagttcaggctgggtcgcaaggattccttagcttctgagtgtctcctgtttcagatccttttagctgaagcctttgacacggtacactcactagcttgcatacgcgtcagaaatgtctgttgttcctgtcaatgttgtaatcatgagatgtatgtggagaaagaatgcatgtcaaacatttaaatgtggcagaactaatgtgggaacttgattatcaagggcctagaaaagttagggggaccagaaggtcgaggagaaacaagcggttggtgatgcgttatatttttgtcgattgacaaagggagccaggatttttaaatgtttctctgcattcacaccattatatttatatgggagctttggtggcgatgaggcgtaagccgcttgtagccatgactggttgccgtgtactaaccttagagcatctctaagagactagctaaatggcttagcaagtcaaattttagctatttaacaacaaaataactctccaacagactagctatttgactcgccaagctatccgactctccaaattggctcccttactagccaaatttggctagccacctgactagtcaaactagatagataatctgttagaacgaaga

SEQ ID NO: 4334 - DNA, 1809 bp, Oryza sativa
ccaacaaagacaaaaggtttgaccccgaccaccaccaccactccagcccatcgccacgcctccactccgctccgacccgaaacacgcgacccattttctcctcggtttcctcgcgcggagtcggggagaggaggaggcggcccagatgcagacgcccgccgagattccgccggccgccgccgccgccgccgaggcgcccgcggtgcccagatccgacgacccccccgccgcctccgacccctcctcccctccgccgccgccgccccccgtcgccgtggccgccgccaccgccgatccgcctccccccgcgcagccgcaggggcagaagaccgtcacgtggagcgagaagctgacgtcggagtcgcccacctatgtggcggccgccaccgccgaggccgccgagtccagccagtacgtctcccgcggccccgcctcctcgtcctccaagggcgcggtggaggccatgaaggagacgctgtccaggtgggggaagtcggtgggggagacgaccaagatggtcgagagcctcagccgggacacgtggcagcacttcaagacaggacctagttttactgaagctgctatgggacggcttgctcaaggaactaaagtcttagcagaaggtggctatgaaaaaatattcaggcaaacttttgaggttcttcctgaggagcagctgaaaatatcttatgcatgctatctatcaacatctgctggtcctgtcatgggagtcatgtacatttctacagctaaaattgcattctgcagcgacaatcctctctcttacaaagctggaaataaaactgaatggagttactacaaggtggtcattcctctgcaccagctaagagcggctaatccttcagtgagcaaagtaaaccctgctgaaaagtatattcaggttgtttcagttgaaggccacgagttctggttcatgggttttctgatgtatgacaaagccgtgtgtagcctccaagaagccatgaatagtgcccgcgagatgcaaccgtagataccaaagcagaagtttcagtcgagagtcatcctgatcctgtgtagcaatcctgggggggcatctctatttccgcgatcgattccttcgcttctgagtgtctcctgtttcagatccttcgcggctgtgtgcttcggagccatttgagacgatacactcactagcttctatacgtgttcgaaatgtgttctttttgttgtggccttccgcgtgttgtaatgatgggatgtatgggaaaacactggagctgtccattttgaatgcttttattatcaacacttgaaaatgtggcagtatcggatggatgtttatgggaacgaatctctccaaaaaaaaaaagaactatacatgtatatacagccaaagttatccgtgatacggatggtgatgtggtggctgcttaccgggggagagtgaataatctgatgcatcctctccatggtgagcttattgcatgcttacagggagtccaggcagcagtggagatgggaatagggcgggggatgattgagacagacgcgacggctgtgatccaagcggtctacacaaacgatttcgagctgagcgacgtgtcgttcctggtggcagagcttcaatccttactgcgcctgaatttcatttcctggagtgttagtcatgtacctcggctatataacagagtagctcatgaactggcagctatgggtagtgtctgcgatccggcggaggcccctgttttggctcctactccggcacaaatcatgtacctggttgctgatgatttagcagtgtcatagtaatggaaatcctgatttccc

SEQ ID NO: 4335 - DNA, 1372 bp, Brachypodium distachyon
ccccaccactactgcccaacctcctccaacctcgcacaccccaaacgcgcaacgcatttcctcttcctctttcttcctcctcgcttggagccccagagcagagccaccccccgaagaaccctccagatgcagccggccgccgagatgcagccgcctgccggctcccccaccgcctcccaatccgacaccccgcagccgcctcccccttccgatccctccccgcccccatcgcctgctccagcgccggcaccggctcccgaggcggccgatccgcccgcacccgcgcctgctctagcgccggtccagttgcaggcgcagcagaagagcgtcacgtggagcgagaagctcacgtcggagtcgccgacgcacgtgccggccgccgccgccgcggaagccagccagtacgtctcccgcgggcccgcttcctcctcctccaagggcgcggtggaggcgatgaaagatacgctgtccaggtgggggaagtcgatgggggagacgaccaagatggtagagagcctcagccgcgacacgtggcagcacttcaagacaggacctagttttaccgaagctgctatgggccggcttgctcaaggaactaaagttttagcggaaggtggctatgacaaaatatttaaacagacttttgaggttcttccggacgagcagctgaaaatatcttacgcgtgctatctatcaacatctgctgggcctgtcatgggagttatgtacatctctacagctaaaatcgcattctgcagtgacaatcctctttcttacaaagctggcaataaaactgaatggagttactacaaggtggtcattcctctgcatcagttaagaagtgctaatccttcagtgagcaaagtaaattctgcagaaaagtatatacaggttgtctcagttgaaggtcatgagttctggtttatgggttttctgatgtatgacaaagccgtagccactcttcaagaagctctggattgttctcgtgagttgcaaccataggtatcagatggaagtttcagttgcgtcaacctgtaaaacatcctcaggggtatcgcaagttttccactcaatatcttcacttctgagtgtcttgattaagacagatccttccggcagtgctccttggagcttttgatttggcaccctcgctagcttgtatacgggttcagaatgtttgttcttgttctttgacatccctgtgttgtaatgatgatagcatatatggggaaaatactggagctgtccatttttaatgcttctgtcatcgacatttaaatgtgatagtgttaggtgtttactggtagacacccagggcctggcatcgctcggtcgaactgcaggttgagatggcaattcttaacaaaataga

SEQ ID NO: 4336 - DNA, 1395 bp, Brachypodium distachyon
ccaccactactgcccaacctcctccaacctcgcacaccccaaacgcgcaacgcatttcctcttcctctttcttcctcctcgcttggagccccagagcagagccaccccccgaagaaccctccagatgcagccggccgccgagatgcagccgcctgccggctcccccaccgcctcccaatccgacaccccgcagccgcctcccccttccgatccctccccgcccccatcgcctgctccagcgccggcaccggctcccgaggcggccgatccgcccgcacccgcgcctgctctagcgccggtccagttgcaggcgcagcagaagagcgtcacgtggagcgagaagctcacgtcggagtcgccgacgcacgtgccggccgccgccgccgcggaagccagccagtacgtctcccgcgggcccgcttcctcctcctccaagggcgcggtggaggcgatgaaagatacgctgtccaggtgggggaagtcgatgggggagacgaccaagatggtagagagcctcagccgcgacacgtggcagcacttcaagacaggacctagttttaccgaagctgctatgggccggcttgctcaaggaactaaagttttagcggaaggtggctatgacaaaatatttaaacagacttttgaggttcttccggacgagcagctgaaaatatcttacgcgtgctatctatcaacatctgctgggcctgtcatgggagttatgtacatctctacagctaaaatcgcattctgcagtgacaatcctctttcttacaaagctggcaataaaactgaatggagttactacaaggtggtcattcctctgcatcagttaagaagtgctaatccttcagtgagcaaagtaaattctgcagaaaagtatatacaggttgtctcagttgaaggtcatgagttctggtttatgggttttctgatgtatgacaaagccgtagccactcttcaagaagctctggattgttctcgtgagttgcaaccataggtatcagatggaagtttcagttgcgtcaacctgtaaaacatcctcaggggtatcgcaagttttccactcaatatcttcacttctgagtgtcttgattaagacagatccttccggcagtgctccttggagcttttgatttggcaccctcgctagcttgtatacgggttcagaatgtttgttcttgttctttgacatccctgtgttgtaatgatgatagcatatatggggaaaatactggagctgtccatttttaatgcttctgtcatcgacatttaaatgtgatagtgttaggtgtttactggtagacacccagggcctggcatcgctcggtcgaactgcaggttgagatggcaattcttaacaaaatagaagaaatgttgcacaaaccaggatgg

SEQ ID NO: 4337 - DNA, 1558 bp, Zea mays
aggacttgcgtgttgatggcatagctgagtttgcaagatcagtggtgaacacaccacagcgaaagctccactagccctcacagcaacagatgcggacatgtacctccttgatttgttcacaaacaatgtggagtcggaggacgaggcggaggcggcgtgcgcggtcgtgctgacgccgccgctgtcgctggagggcggccttgcggcggagctccgcccggccaatctcgcccagcgggtgctcagcctcttcctcaacgtccgcccgggctctgacctctcccacttccagctgccggcgacgttcaacctgcccaagtcgcagctgcagctgtacggcgagggcgtgtactgcgccggcgaggacctgctggggcggtgcgcgcgggggcgcgacagcctggagcgcctggcgtgcgtggtggcgtggagcatctccacgacgcggccccccatcttcggcttcgcgccctacaacccggtgctaggggagacgcaccacgtctccaccacctccggctgcggcggcggcctcaacgtgctcctggagcaggtctcgcaccggccgcccgtgacagcgctgcacgccacggacgcccgcggggaggtgcggctggtgtggtgccagagccccgcgccgcggttccacggcgccagcgtggaggccgcggtgcgcggcgcgcgggagctccgcctgctccggcacgccgagacgtacgttatcgggtgccccggcctgctgatccgcctcttcccgtcgcccgcctgcgagtggtccggcgacgtccgcgtcgtctgcgccgagtccgggctcgaggcccagctcagctactgccggacccgccgctccttcctcggcttcggcggcggcgacgcccgctgcgtcaggggcaggatcttccgctcggctgagcccggagacaccctgtgcgagatcgacgggttctgggaccgccaggtcacgcgcagggacctcgccaccggcgaggtctccgtgctctacgacgcgcagcgcgccatcggtgacctcgccacgcccgtggtgcaagaccgaaagggcgtgtcggcctcggagtcggccgtggtctggggcgaggtgagcaacgcgatcctgaagaaggactgggagacagcccagcaggcgaagcggcgggtggaggacacggcgaggaggttcgccaaggagaggaacgacagaggggaggtgtggacgcccaagcacttctcgctgtcgcagaacaagagcggcgactgggagtgctggccgctggaggactccgtgccgccggctcctattgtcgtcccctcctcctcctcatcatcatgaaagatctatgaatccatagtacacacatacggtacagaagtgagagaaacaatgttcatggaacaaacgatgaacagcctgttttggtcgtcgtaatctatacgtaaacggatccagtctgtatctgtattctgtacatgtttccgtccccactgggcatgatggatggttttactaccgctgctacgcatggggactataccgtcaatgagtgaaccttacagtacaaga

SEQ ID NO: 4338 - DNA, 1697 bp, Zea mays
gggccaacaccaccaaacaccaacagcaacaccaacaacggcggagctgccaaagaaagcaaaccagaggagagaagagaggaggggttggctggctggccctggccgtcgtccgccggtagctcgtggtcgctcgctcgctccatcattcctccctctccgccggcgtgcccgcccgcccacatgacggagtcagagggcgaggcggaggcggcgcgcgcggccgtgctgacgccgccgctgtcgctgggggccggcgggctcgcgggggagctccgcccggccaacctcggccagcgggtgctcagcctgttccgcaacgtccgcccgggctccgacctctcccacttccagctgccggcgacgttcaacctgcccaagtcgcagctgcagctgtacggcgaggccgtgtactgcggcggcgaggacatgctggcgcggtgcgcgcgcggcgccgacagcctgcagcgcatgtgcgccgtggtggcgtggagcatctccaccacgcggccccccatcttcggcttcgcgccctacaacccggtgctcggggagacgcaccacgtctccacgtccgccggcctcaacgtgctcctggagcaggtctcgcaccggccgcccgtgacggcgctgcacgcgacgcacgcgcgtggggaggtggagctggtgtggtgccagagccccgcgccgcggttccacggcgccagcgtggaggccgcggtgcggggcgcgcgggagctgcggctgccgcgccacgccgagacgtacgccgtcgggtgcccgggcctcgtgatccgcctgctgccgtcgccgggctgcgagtgggccggcgacgtccgcgtctcctgcgccgagtccgggctcgaggccacgctcagctaccgccgcagccgccgctccttcctcggcctcggcggcggcgacgcgcgctgcgtcaggggcagggtcttccgctccgccgcgcccgacgacacgctgtgcgaggtggacgggttctgggaccgccaggtctcgctcagggacgtcgccaccggcgaggtctccgtgctctacgacgcacggcaaaccatcgctgacctggccacgcccgtcgtgcaagacagaaagggcgtgtccgcctcggagtccgccgtggtctgggccgaggtcagcgccgcgatcctgaacaaggactgggaggcggccaggcaggcgaagcggcgggtggaggagacggcgaggcggctcgccaaggagaggaacgagcggggggaggtgtggactcccagccacttctcgctgtggcagaacaagcacggcgactgggagtgctggccgctggaggactccgtgccgccggctcctattgtcgtcccctctcctttgtgactccaagtccactagcagcagatctttgttcactgataacatacgacgaacgaacgtgaacgtcgaatacatctttcttctagcttcgtcgccttgagaatgctgttatgcatgcatattagccacggtttctgatgacagatcggcggcaaatgagcactcagtgaaggaaacaaagtgggctctcagaccaagagaaaaacaaaaacaatactgtatgaatccacggtccacacaaaaaagcgacgaaacaacgcacaacattttcttttcatggaacaaacggtggacagcaagaatcatataaacgagggcaaatctgcaagggc

SEQ ID NO: 4339 - DNA, 1564 bp, Setaria italica
aaagaaaggcggaggggatcggcggagaggaggagctcagtattcttttttctttgcgtcgacgacgaacaaccgccgagctagatcgagcccgggaagagggggagaagaagcttattcttagctagcccggccggcaggagtagagaggatcggaagaagagagggatccaacaagggggattgattggtcgtcggccggcggtagcttcgttgccttcggatcagattcttctctcccgcgcgccccaaatggtggagtcggagggcgaggcggcggcgtgcgcggcggcggtgctgacgccgccgctgtcgctggagggcggcctcgcggcggagctccgcccggccaacctcgtccggcgggtgctcagccttttccgcaacgtcagcccgggatccgacctctcccacttccagctgccggcgacgttcaacctgcccaagtcgcagctccagatgtacggcgagggcctgtactgcgccggcgaggacctcctcggccgttgcgcccgtggcaaggacagcctggagcgcctcacgtcggtggtggcctggagtatctccaccacccgccccccgatcttcggcttcgcgccctacaaccccgtcctcggcgagacgcaccacgtctccgcgggctccggcggcctcaacgtcctcctcgagcaggtctcccaccggccccccgtctcggcgctgcacgccacgaacgccgccggcgacgtgcggctcgtctggtgccagagccccgtccccaagttccacggcgccagcatcgaggccgcggtgcggggccggcgggagctgcgcctgccccgccacggtgagcgctacgaggtcgactgccccaacctgctcatccggctgctgcccgcgccgtccgtcgagtggtccggcgacgtcagggtggtgtgcgcggagtccgggctcgaggcgcagctcagctactgccggagccgctccttcctgggattcggcggcgacgccaggtgcgtcagggggagggtcttccggtcggcgtcgagggacgagacgatctacgagatcgatgggttctgggacaggaccgtctcgctcaaggacgtcagcaccggcgaggtctccgtgctctacgacgcccagcgcgccattagcaaactcaccacgccggtggtccaagaccacaagggcttggcgccttcggaatccgccgtggtgtggggcgaggtcagcgacgcgctcctgaagaaggactgggagaaagctcggcaggcgaagcggcgggtggaggacgaagcgaggaagcttgccaaggagaggaatgagaagggggaggtctggacgcccaagcacttctccctgtcgcagaacaagaacggcgagtgggagtgctggccgttggaggagtcggtgccgccggctcccattgttgtcccctcatgacagtagatcacatgacatgtaacaaacactatacgatgaaactgaatttcatgtaaatttgtcactagttgattacgctgattcttcttcgtctgcctgagaattgtgatggtggctacggttttttaagaaaaaactg

SEQ ID NO: 4340 - DNA, 1827 bp, Setaria italica
aaagaaaggcggaggggatcggcggagaggaggagctcagtattcttttttctttgcgtcgacgacgaacaaccgccgagctagatcgagcccgggaagagggggagaagaagcttattcttagctagcccggccggcaggagtagagaggatcggaagaagagagggatccaacaagggggattgattggtcgtcggccggcggtagcttcgttgccttcggatcagattcttctctcccgcgcgccccaaatggtggagtcggagggcgaggcggcggcgtgcgcggcggcggtgctgacgccgccgctgtcgctggagggcggcctcgcggcggagctccgcccggccaacctcgtccggcgggtgctcagccttttccgcaacgtcagcccgggatccgacctctcccacttccagctgccggcgacgttcaacctgcccaagtcgcagctccagatgtacggcgagggcctgtactgcgccggcgaggacctcctcggccgttgcgcccgtggcaaggacagcctggagcgcctcacgtcggtggtggcctggagtatctccaccacccgccccccgatcttcggcttcgcgccctacaaccccgtcctcggcgagacgcaccacgtctccgcgggctccggcggcctcaacgtcctcctcgagcaggtctcccaccggccccccgtctcggcgctgcacgccacgaacgccgccggcgacgtgcggctcgtctggtgccagagccccgtccccaagttccacggcgccagcatcgaggccgcggtgcggggccggcgggagctgcgcctgccccgccacggtgagcgctacgaggtcgactgccccaacctgctcatccggctgctgcccgcgccgtccgtcgagtggtccggcgacgtcagggtggtgtgcgcggagtccgggctcgaggcgcagctcagctactgccggagccgctccttcctgggattcggcggcgacgccaggtgcgtcagggggagggtcttccggtcggcgtcgagggacgagacgatctacgagatcgatgggttctgggacaggaccgtctcgctcaaggacgtcagcaccggcgaggtctccgtgctctacgacgcccagcgcgccattagcaaactcaccacgccggtggtccaagaccacaagggcttggcgccttcggaatccgccgtggtgtggggcgaggtcagcgacgcgctcctgaagaaggactgggagaaagctcggcaggcgaagcggcgggtggaggacgaagcgaggaagcttgccaaggagaggaatgagaagggggaggtctggacgcccaagcacttctccctgtcgcagaacaagaacggcgagtgggagtgctggccgttggaggagtcggtgccgccggctcccattgttgtcccctcatgacagtagatcacatgacatgtaacaaacactatacgatgaaactgaatttcatgtaaatttgtcactagttgattacgctgattcttcttcgtctgcctgagaattgtgatggtggctacggttttttaagaaaaaactgcaggtgaactaaaaaaactgaacattcagtgaagctcacagttgggctctgaaaacctgaacatcaacctgaaacaaagtaactgaattcatggaataactgaacgtcgtctttattttctataatccgaataaacgaaatcaatctgtacatgtttccttctcaattgggcctgatggattttactactgctactgtacatgagtccagggagctactgtcagtgaatcctacaagagctgtgcctgacaagtgacaacgtt

SEQ ID NO: 4341 - DNA, 1400 bp, Zea mays
aaggccacaagggtatcaaaaggcttaaggttgggcaagagggcgtttgagtttgtcaacaggaaacactccaacacaagttcagcctttgggaacagagaaaagagtggaaaacacaggccagaaagatgtatcaccaacatcagggcctgagtgagctcttcaccacgaggacatcctttccaatggagcagcatctgtttttgcgtggaggaaatgcccaaggagattctgggctggttctctcaactgatgctaaaccaaggctcaaatggacacctgagttacatcagcgatttgtagatgcagtcaatcagttaggtggagcagagaaagctactccaaaaacagtcatgaggctcatgggaatcccaggactcaccttgtaccatttgaaaagccatctccagaaatacaggctgagcaagaacctccaagctcaagcaaatgtcagtacatcaaagaatgccataggatgtacatccattgctgataggattcctggaacaagcgctgcaacaatgagcagtacaaatgtcgttccgcaggcagagaagactattcaaattggtgaagcacttcagatgcaaattgaggttcagagacagttaaatgaacaacttgaggtgcaaaggcatctacaactacgaattgaagcacaagggaaatacctacaagcagttttggagcaggcacaagaaacacttggaaaacagaatttgggtcctgcgaacctggaagatgcaaaaataaaaatatcacagttagtttcacaagtatcaactgaatgcttcagtaatgcaattacagatgtaaaaggaagttcaagtgtgcataggttagagcccagacaaatccagtttgttgaaagttcaacaaatagttatttgtctgtggccgaaggattcatcaaggagcagagactacagcaccaacagcaccatggagtactaaaagcacatgatggtagttcattattttgcagaaaaagaccgcatgaacatgagacccagtttgcccttaacagaagcctaagtgagcgtaggatggcacatttgcagaatgatgaacaatacagtaaagcagagtttgggtatgaaagtgacacagagatagtgcatgagtatactgcaccccaaaatggtggaggtagcaccaccagttcggcatcaggaagcaaagtagatgcggagaagctatatctagaagagcaaaagtgtgcaagacaggtcgctgaataccccagagaaagcaagctaatagattttgagaattcgtgttcagggaagaaacttgatctgaacacccataatgtagatgacactgatcaagcttacagacattttgacttgaatgatttcagctggagctgataatatgtaagatgatagaagcaaaga

SEQ ID NO: 4342 - DNA, 1502 bp, Zea mays
tcaacctgagaaggccaaaagggtatcaaaagacttaaggtcagacaagagggtgtttgagtttgtcaacaggaagcattccaacacaagttcaggctttgggaacagagtaaagaggccactggaaaacacaggccacaaagatgtatcaccaacatcagggtccgagtgagctcttcaccacgaggacatcctttccaatggagcagcatccgtttttgcgtggaggaaatgcccaaggagattctgggctggttctctcaactgacgctaaaccaaggctgaaatggacacctgagttacatcagcgatttgtagatgcagtcaatcaattaggtggagaagagaaagctactccaaaaacagtcatgaggctcatgggaattccaggactcaccttgtaccatttgaaaagccatctccagaaatacaggctcagcaagaacctccaagctcaagcaaatgccagtacatcgaagaatggatgtacgcccgttgctgataggattcccggaacaaccgcagcaacaatgagcagtacaaatgttcttcctcaggcagagaagactattcaaattggtgaagcactgcagatgcaaatccaggttcaaagacagttaaatgaacaacttgaggtgcaaaggcatctacaactacgaattgaagcccaagggaaatatcttcaggcagttttggagcaggcacaagagacacttggaaaacagaatttgggccctgcaaacctggaagatgcaaaaataaaaatatcagagttagtttcacaagtatcaaatgaatgcttcagtaatgcaattacagatgtaaaagaaagttcaagtgtgcatagattagagcccatacaaattgagtttgttgaaagttcaacaaatagttatttgtctgttgctgaaggattcatcaaggagcacaaactacagcaccatggagtactaaaagcatatgatgatagttcattattttgcagaaaaagatctcatgaacatgagacacagtttgccctcaacagaagcctaagcgaacataggatggctcatttgcagaatgaggaaggataccataaagcagagtttgggtatgaaagtgacacagagatggcgcatgagtatactgcacctcaaaagaatggtagatgtagtaccaccagttcggcatccggaagcaaagtagatgcagagaagctatatctggaagaacaaaagtgtgcaagacaggcagttgaataccccagagaaagcaagctagtagattttgagcatccgtgttcagtgaacaaacttgatctgaacacccacaatgtcgatgacacaaatcaagcttacagacattttgacctgaatggcttcagctggggctgataatatgtaagatgatagaagtgaagaaatgaagttacaaataatttcttccaacattgatttcaccattgaagtatggatacatgatcaaatggatacacaacgtcgatggggagagtaacgtcc

SEQ ID NO: 4343 - DNA, 1511 bp, Setaria italica
atcaacctgagaaggccaaaagggtatcaacaagcttaaggcaggacaagagtgtgtttgagctagtcaacaggaacaacttcaacgtctgagaacagagaaaagaggccactggaaaacagaggcaagaaagcagatgtatcaccaacatcaaggcccgagtgagctcttcactacaaggacatcctttccaatggagcagcatctgtttttgcgtgggggaaatgcccaaggagattctgggctggttctctcaactgacgctaaaccaaggctgaaatggacacctgagttacatcagcgatttgtagatgcagtcaatcaattaggtggagctgagaaagctacaccaaaaacagtcatgaggctcatgggcattccaggactcaccttgtaccatctgaaaagtcatctccagaaatacagacttagcaagaacctccaagctcaagcgaatgtcagtacatcaaagaatgccataggatgtacaaacattgctgataggatgcctggaacaagtgcaccaacaatgagcagtacaaatgccattccacaagcagagaagactattcaaattggtgaagcacttcagatgcaaatcgaggttcagaggcagctaaatgaacagcttgaggtgcaaaggcatctacaactacgaatagaagcccaagggaagtacctacaggcagttttagagcaggcacaagagacacttggaaaacagaatttgggtcctgcaaaccttgaagatgcaaaaataaaaatatcagagctggtatcacaagtatcaaatgagtgcttcagcaatgcaattacagatataaaagaaagttcaagtgtgcatagattagagcccaaacaaatccagtttgttgaaagctcaacaaataattatttgactgcagctgaaggattcatcaaggagcacagactacaccatcatggagtactaaaagcacatgatgatagttcattattttgcagaaaaggatctcatgaacatgagaccccgttggcccttaacagaagcttaagtgaacgtaggatggctcatttgcagattgagaacgggtacagtaaagcagagttagggtatgaaaatgatacagagatggcacctgagtatattggacctccaaagaatggtggaggtagcaccagcagttcggcgtcaggaagcaaaggagacgcagagaagccatatctcgaagaaccaaactgcacgagacaggcggttgaatatcccagagaaagcaagctactagactttgggcactcatgtccggggaagaaacttgacctgaacacccacaatgtcgacgacactgatcaagcttacagacattttgatttgaatggcttcagctggagctgataatatgtaagatgatcaaagtgaagaaatggaattacaaataatttcttccagcattgatgagaccattgatacatgatcaaacaacatatataaagtggtgtcaaggcatcattcatatctttgagtttttagg

SEQ ID NO: 4344 - DNA, 1469 bp, Setaria italica
caacctgagaaggccaaaagggtatcaacaagcttaaggcaggacaagagtgtgtttgagctagtcaacaggaacaacttcaacgtctgagaacagagaaaagaggccactggaaaacagagatgtatcaccaacatcaaggcccgagtgagctcttcactacaaggacatcctttccaatggagcagcatctgtttttgcgtgggggaaatgcccaaggagattctgggctggttctctcaactgacgctaaaccaaggctgaaatggacacctgagttacatcagcgatttgtagatgcagtcaatcaattaggtggagctgagaaagctacaccaaaaacagtcatgaggctcatgggcattccaggactcaccttgtaccatctgaaaagtcatctccagaaatacagacttagcaagaacctccaagctcaagcgaatgtcagtacatcaaagaatgccataggatgtacaaacattgctgataggatgcctggaacaagtgcaccaacaatgagcagtacaaatgccattccacaagcagagaagactattcaaattggtgaagcacttcagatgcaaatcgaggttcagaggcagctaaatgaacagcttgaggtgcaaaggcatctacaactacgaatagaagcccaagggaagtacctacaggcagttttagagcaggcacaagagacacttggaaaacagaatttgggtcctgcaaaccttgaagatgcaaaaataaaaatatcagagctggtatcacaagtatcaaatgagtgcttcagcaatgcaattacagatataaaagaaagttcaagtgtgcatagattagagcccaaacaaatccagtttgttgaaagctcaacaaataattatttgactgcagctgaaggattcatcaaggagcacagactacaccatcatggagtactaaaagcacatgatgatagttcattattttgcagaaaaggatctcatgaacatgagaccccgttggcccttaacagaagcttaagtgaacgtaggatggctcatttgcagattgagaacgggtacagtaaagcagagttagggtatgaaaatgatacagagatggcacctgagtatattggacctccaaagaatggtggaggtagcaccagcagttcggcgtcaggaagcaaaggagacgcagagaagccatatctcgaagaaccaaactgcacgagacaggcggttgaatatcccagagaaagcaagctactagactttgggcactcatgtccggggaagaaacttgacctgaacacccacaatgtcgacgacactgatcaagcttacagacattttgatttgaatggcttcagctggagctgataatatgtaagatgatcaaagtgaagaaatggaattacaaataatttcttccagcattgatgagaccattgatacatgatcaaacaacatatataaagtggtgtcaag

SEQ ID NO: 4345 - DNA, 1425 bp, Panicum virgatum
atcaacctgagaaggccaaaagggtatcaacaggcttaaggtaggacaagagtgtgtttgagctagtcaacaggaacaaattcaacgtttgagaacagagaaaagaggccactggaaaacacagcagatgtatcaccaacatcagggcccgagtgagctcttcactacaaggacatcctttcctatggagcagcatctgtttttgcgtggaggaaatgcccaaggagattctgggctggttctctcaactgatgctaaaccaaggctgaaatggacacctgagttacatcagagatttgtagatgcagtcaatcaattaggtggagctgagaaagctacaccaaaaacagtcatgagactcatgggcattccaggactcaccttgtaccatctgaaaagccatctccagaaatacaggcttagcaagaacctccaagctcaagcaaatgtcagcacatcaaagaatgccataggatgtgcaaccattgctgataggatgcctggaacaagtgcgccaacaatgagcagtacaaatgtcattccacaggcagagaagactattcaaattggcgaagcacttcagatgcaaattgaggttcagaggcagttgaatgaacagcttgaggtgcaaaggcatctacaactacgaatagaagcccaagggaagtacctacaggcagttttagagcaggcacaagagacacttggaaaacagaatttgggtcctgcaaaccttgaagatgcaaaaataaaaatatcagagctggtatcacaagtatcaaatgaacgcttcagcaatgcaattacagatataaaagaaagttcaagtgtgcatagattagagcccaaacaaatccagtttgttgacagttgttggaaaagtaattatttgactgcagctgaaggattcatcaaggagcacagactacaacatcatggagtactaagagcatatgatgatagttcattattttgcagaaaaggatctcatgaacatgaaaaccagattgcccttaatagaagcctaagtgagcgtaggatggctcatttgcagaatgagaaagggtacaataaagcagaatttgggtatgaaagtgatacagagatggcacctgagtatattacacctcaaaagaatggtggaggtagcaccaccagttcggcatcaggaagcaaaggggacacagggaagacatacctcgaagaaccaaactgcacgagacagtcagttgaatatcccagcgaaagcaagctactagactttgagcactcatgtccggggaagaaactcgacctgaacacccacaatgttgatgatgccgatcaagcttacagacatttcgacttgaatgggttcagctggagttgataatatgtaagatgatcaaagtgaagaaatgaaattacaaataatttcttccaaca

SEQ ID NO: 4346 - DNA, 1297 bp, Echinochloa colona
gagaaggccaaaagggtatcaacaggcttaaggtaggacaagagtgtgtttcagctaacaagaacaacttcaacgtttgagaacagagaagagatacacagatgtatcaccaacatcagggaccgagtgagctcttcactacgaggacatcctttccaatggagcagcatctgtttttgcgtggaggaaatgcccaaggagattctggtcttgttctctcaactgacgctaaaccaaggctgaaatggacacctgagttacatcagagatttgtagatgcagtcaatcaattaggtggagctgagaaagctactccaaaaacagtcatgaggctcatgggcattccaggactcaccttataccatctgaaaagtcaatctccagaaagtaccaggcttagcaagaatcttcaagctcaagcgaatgtcagttcatcaaagaatgccataggatgtacgaccattgttgataggatgcccggaacaagtgcaccagcaatgagcagttcaaatgtcattccacaggcagagaagactattcaaattggtgaagcacttcaaatgcaaattgaggttcagaggcagctaaatgaacagcttgaggtgcaaaggcatctacaactacgaatagaagcccaaggaaagtacctacaggcggttttagagcaggcacaagagacacttggaaaacagaatttgggtcctgcaaaccttgaagatgcaaaaataaaaatatcagagctggtatcacaagtatcaaatgaatgcttcggcaatacaattacagatataaaagaaagttcaggtgtgcatagactagagcccaaacaaatccagtttgttgaaagttcagcgaataattatttgactgcagctgaaggatttatcaaagagcacagactacagcatcatggagtactaaaagcatatgatgatagttcattaatttgcagaaaaggatctcatgaacatgagacccagtttgcccttaatagaagcctaagtgagcgtaggatgactcatttgcagaatgagaaagggtacagtaaagaagagtttgggtacgaaagtgacacagagatggcacctgagtatgttacacctcaaaagaatggtggaggtagcactaccagttcggcgtcgggaagcaaaggagatgcagagaagccatatctcgaggaaccaaactgcacgagacaggcagttgaataccccagagaaagcaagctactagactttgagcactcgtgtccagggaagaaacttgacctgaacacccacaatgtcgatgacactga

SEQ ID NO: 4347 - DNA, 1712 bp, Panicum virgatum
aacctgagaaggccaaaagggtatcaacaggcttaaggtaggacaagagtgtgtttgagctagtcaacaggaacaaactgaacatttgcgaacagagaaaagagaccactggaaaacacaggtacagcagatgtatcaccaacatcagggcccgagtgacctcttcactacaaggacatcctttcctatggagcagcatctgtttctgcgtggaggaaatgcccaaggagattctgggctggttctctcaactgatgctaaaccaaggctgaaatggacacctgagttacatcagagatttgtagatgcagtcaatcaattaggtggagctgagaaagctactccaaaaacagtcatgagactcatgggcattccaggactcaccttgtaccatctgaaaagccatctccaggtacttgagaatccaaaatcctcctggtaaagatgatatatgtaactgtgggaggaaaaactatttttcggatgttacagaaatacaggcttagcaagaaccttcaagctcaagcaaatgtcagtacatcaaagaatgccataggatgtgcaaccattgctgataggatgcctggaacaagtgcaccaacaatgagcagtacaaatgtcattccacaggcagagaagactattcaaattggtgaagcacttcagatgcaaattgaggttcagaggcagctaaatgaacaacttgaggtgcaaaggcatctacaactacgaatagaagcccaaggcaagtacctacaggcagttttagagcaggcacaagagacacttgggaaacagaatttgggtcctgcaaaccttgaagatgcaaaaataaaaatatcagagctggtatcacaagtatcaaatgaatgcttcagcaatgcaattacagatataaaagaaagttcaagtgtgcatagattagagcccaaacaaatccagtttgttgaaagttcaacaagtaattatttgactgcagctgaaggattcatcaaggaacacagactacaacatcatggagtactaaaagcatatgatgaaagttcattattttgcagaaaaggatctcatgaacatgaaaaccagattgcccttaacagaagcctaagtgagcgtaggatggttcatttgcagaacgagaaagggtacaatagagcagaatttgggtatgaaagtgatacagagatggcacctgagtatattacacctcaaaagaatggcggaggtagcaccaccagttcggcatcaggaagcaaaggggacgcagagaagacatacctcgaagaaccaaactgcacaagacagtcagttgaatatcccagagaaagcaagctaatagactttgagcactcatgtccggggaagaaactcgacctgaacacccacaatgttgatgatgccgatcaagcttacagacattttgacttgaatgggttcagctggagctgataataatatgtaagatgatcaaagtgaagaaatgaagttacaaataatctcttccaacatggatgtcacgattgacacatgattaaacatcatatgtaagaggtgtcacttatatatttgggcttttaggataggttacagcaatagtattcgctttgggccatcagcagtttaatcaaaagtgaaataacaatacgtgaacagtctatgtaagaaaccagacaataaaattaatgaaattagactcctaaggatacagaata

SEQ ID NO: 4348 - DNA, 1657 bp, Oryza sativa
gaccaaaagagtatcaatagacctaggcttggagaagagtgctggctttggcactgccaaaagagaagcactcataacagtttcgacgtgtgatagcaaagagaagaaacagactggataacacaagtaagaaaggatagtgtaaatgcttgcctctttatgtttccattcttctaaaagtgtgtattaattttgcagtagatgtatcaccaacatcagggtcggagtgacctcttcactactaggacatcctttccaatggagcggcatctgtttctgcatggaggaaatacacaaggagattctgggctggttctctcaactgacgctaaacctaggttgaaatggacacctgagttgcatcagcgatttgtagatgcagttaatcaattaggtggagcagagaaagctactccaaaaacagtcatgaggctcatgggcattccaggactcaccttataccatctgaaaagccatctccagaaatacaggctcagtaagaatctccaaggtcaagctaatgttgggacaacaaagaatgcccttggatgtacaggtgttgctgataggattcctggaacaagtgcattagcgatggccagtgcaagcgccattccacaggcagagaaaactattcaaatcggtgaagcactacagatgcaaattgaggtgcagaggcagctaaatgaacaacttgaggtacaacggcatctacagctgcggatagaagcccaagggaagtatctgcaggcagttcttgagcaagctcaagagacccttgggaagcagaacttgggccctgcaagcctggaagatgcaaaaataaaaatatcagaactggtctcacaagtttcaaatgaatgtctcagcaacgcagttacagaaataagagaaagttcaagtatacacagactagagccaaggcaaatccagtttgttgaaagttcagccaataactgtttgactgcagctgaaggattcaaggagcataggctacaaaaccacggggtactcaaagcatatgatgatagtacattattttgccgaaaacagtcccaagatcaagaatctcaatattcccttaacagaagcttaagtgagcgtagaatgggtcatctgtatagtggtaaacagtatcacaaatcagagggaagtgacagtgatacagaggttctacatgagtatatcacgcctcaaaagaatggcggaggcagcacaaccagttcaacatcaggaagcaaagaaataaatgtagagaagctatatcttgatgaaccaagctgcaaaagacaaacagttgactatcaaagagaaagcaagctactagattttgatcaacaaagttcagggaagaatcttgatctaaatactcacaatatagatgataacgatcaaggttatagacattttgacttgaacggcttcagctggagttgattagctgacaatatgtaatacaatcaaggagaagaaatgagcttacaaataatttcttccaaagttataactactttaattctgtaaatacattatgtaggccgggaaagattgtagctatctagagttgtaccataggttataaataattcaatgatgtatgaacaagctattgcaaatgttgagttgtaccacaggataactaacggaagacagcata

SEQ ID NO: 4349 - DNA, 3179 bp, Triticum aestivum
agatgctagattctatgtttccccatataaggagcccctcacagggcattgcttaccaacctgagaagaccaaaagggtatcaacaggcttaagctcacacggagaacaggactggtattcatcttgtcagtagggaaatactcaatacacagtttcaacgtgcaacagcaaagaggaaggaagcgactgcagaacaacagaagatgtatcaccaacatcagggccctagtgagctcttcactactaggacgacctttcccatggagaggcatctgtttctgcacggaggaagtacgcaaggagattccgggctagttctctcaaccgatgcaaaaccaaggctgaaatggacacccgagttacatcagcgatttgtagatgcggtcaatcaattgggcggagcagaaaaagctactccaaaaacagtcatgaggcttatgggcattccaggactcaccttgtatcatctgaaaagccaccttcagaaatacaggctcagtaagaacctccaagctcaagttaacgttgggacaaacaagaacaccataggatgtgcaattgtagctgatggcatgcccggaacaagtgtgccagcgatgatcaatacaaatgtcattccacagccagagaaaactatgcaaattggtgaagccctacagatgcaaatcgaggtgcagagacaattaaacgaacaactcgaggtacaacggcatctgcaactacggatagaagcccaagggaagtatctgcaggcagttctagagcaggcacaagagagccttggaaaacagaatttgggtcctgcaaacctggaagatgcaaagatgaaaatatcagaactagtctcacaagtatcaaacgaatgtttcagcaatgcagttacagagataaaagaaagttcaagtatgcacagactagagccaaggcaaatccagttcatggaaagttcaaccaacaactgtttgactgcagccggaggattcattaatgagcatagactacacagccatggaatgctcaaagcatatgatgatagttcaatattttgcagaaagcactctcctgaccgtgagtaccagttttcccttaatagaagcctaagcgagcgtaagatgggtcatttgcacaatgtgaatgagtaccacaaagcagagtttggaagtgaaagtgacatggagattcaacaggaatatactacacctcaaaagaatggcagaggcagcaccaccagttcagcctcaggaagcaaagaagagatgcggacagactatatcttgaagaaccaaactgcaagagacaagcggttgaacattcaggttttgagcatccaagttctgggaagaaacttgatctgaacactcaaaacactgatgatggtgatcacgggtataggcattttgatttaaatggcttcagctggagctgaattgttaatgatatgcaatatgattgaagcgaagaaatgagcatacaaataatttttcctggcattttcaacaccattatttggtgattaaactgcgcaggtcaagaaaaaatactagtacaccagagttcaaccattgagtatagaaactgagatgttatggctcagcagtttaaatctccatttcgagaggtgtaatacatatgaataggatatcaagtccgtaataataaaaagggaatagggatgcaatataggaacagaatgcagaaggcaaagatagctagagaaccaccaaccgagtaagcgtcacacttaatacaggtaaaccatggtgagaaatactcatccatgtaatagtataatttctcggaatttaagtagtaagaatagcagggactaccagaaccttaccctcccaaataacatggttaaatcaatttagtaacagaagctatcccgactttcagctcaacacagcttaaaagttaaaacaaaaccgaacagttcatcaattgatgcacacttcacgaacacaactatatctcagagaagcgtgtgtagaataaagatggaagtaattcgtccgcagtcatctgtgcacatcattcaaccagcatataaagtgatgtatctgttcgtccacacaacataaacgagttttgaagtaaagtacatcgcagcacttatttgtataccatcagcatcaggcaaggcaagagtcacttattgcataattcaattaaaaactgcaaatgaaagagcaaagctatgtataatcttggggtgtgatgtgcatcacaagtgatataagaagacatgtatctattcctttgttcctctccttattctcaactatacttgccacaagagcaagagcactgtattatagagtactatatgtgataactagaaaactactgtagtttattatggagagcagtaagcgctggtgtcatccactcatgctgctactactacttcttgatccggcgcaccttcttggcgccccagacctccatcctgcccttggcgcagccgcagggggagcggaagatgagcacggagcggccgttggggggcgccatcttcctgagctccgcctcgagctcccggtgctcctcgccgagctcgacgaggcgcgcggcggagccgccggccgcgaggagcgtcttggcgtggccgccgggcggcagcagcctgccgctcccgcgcacgcactcctccgtctcgagctggatgtcgaactcgacggccttgcgcaggccgcggcagcggggcctgccgcacttgcgcgcgtggtggcccgccgcctcccacgcgagcagccccgccacggcggcgaccgcggcgccggcgccggcggcgaaggccacgtacgagtaaggctcctccgggtactgccgcaccaggtccgcggcctcgcgggccagcagcctggcgtagggcgcggccaggaaggccagcgcgccgagcacggccaggagggcgagcgcgtccagggcggcggtcgggggcgggttgtcgcagagcgaggtgaatagctttccccgcgacgatggcgatgaggaggaggaggaggctgcgcggcgggggcgggcacacggcgagggggagccgccggccgccgcggaggcgcggcggcggtgctcgaaggcgcggaggaactcgatgaggctgcggcagtccgccatggcggaggcgggggcgaggtcgaggtatcgggaatggaatttgggcggatcgggatct

SEQ ID NO: 4350 - DNA, 1664 bp, Brachypodium distachyon
ctccagttttaggtatttatcctatacacatacttctactgatctaatgagtaaaccatgcagatgaagttcccataaaaaaggcagagaaacctgacattttgattttcgctattgtttccagaataactgaggacggcatcttctgtcagttgcattaaagattgttccttccttgtttgttccaagatgctagattctatgtttcaccatataaggagtccctcacgaggcattccttatcaacctgaaagaccaaaagggtatcaacaggcttaagcttgctcggacaatagtgcaggtatttgtcttgtcagtagggaaacactcataaacatttcaacgtccaagggcaaagagaaaggacacggctggagaacacaacagaagatgtatcaccaacatcaaggtccaagtgagctcttcagtactaggacgacctttccaatggaacgacatctgtttctgcatggaggaagtacacaagattctgggctagttctttcaactgatgctaaacctagactgaaatggacacccgagttacatcagagatttgtagatgcggtcaatcaattaggtggagcagagaaagctacaccaaaaacagtcatgaggcttatgggcatcccaggactcaccctgtatcatctcaaaagccacctccagaaatacaggctcagtaagaacctccaagctcaagttaacgttgggacaacaaagaacgctataggatgtgcagttgtagctgatagcatgcctgcaacaagtacaccagcaatgaccaacacaaatgtcattccacaggcagagaaaactattcaaattggtgaagccctacagatgcaaatcgaggtgcagaggcagctaaacgagcaactcgaggtacaacggcatctacaactacggatagaagcccaagggaagtatctgcagtcagttctagagcaggcacaagagagccttggaaaacagaatttgggtcctgcaaacctggaggatgcaaaaataaaaatatcagaactagtctcacaagtatcaaatgaatgtttcagcaatgcagttacagatataaaagaaagttcaaggatgcacagactagagccaaggcaaatccagtttgttgaaagttcaacaaataactgtttgactgcagctgaaggatacatcaatgagcatagactacacagccatggagtgctcaaagcatatgatgatagttcaatattatacagaaaacaatctcatggccatgagtatcaatttccgcttaatagaagcttaagcgagcgtaggatgggtcatttgcacaatgtaaaagagtaccataaagcagagttgggaagtgaaagtgacacggagattcaacaggagtatattacacctcaaaagaatgttggaggcagcaccaccagttcggcttcaggaaccaaagaaggcgatataaagaaattgtatcttgaagaaccaagctgcaagagacgagctatggactatccaagttttgaacgcccgaattctgggaagaaacttgatctgaacacccacaacactgatgatagtgatcaaggttttaggcattttgatttaaatggcttcagctggagctgaattgataaatgataatgatatgcatatgatcaaagagaagaaatgagcataca

SEQ ID NO: 4351 - DNA, 1781 bp, Brachypodium distachyon
ccagatagcagaataatatgccagaaagcaacattcagaaaggaaatcactccagttttaggtatttatcctatacacatacttctactgatctaatgagtaaaccatgcagatgaagttcccataaaaaaggcagagaaacctgacattttgattttcgctattgtttccagaataactgaggacggcatcttctgtcagttgcattaaagattgttccttccttgtttgttccaagatgctagattctatgtttcaccatataaggagtccctcacgaggcattccttatcaacctgaaagaccaaaagggtatcaacaggcttaagcttgctcggacaatagtgcaggtatttgtcttgtcagtagggaaacactcataaacatttcaacgtccaagggcaaagagaaaggacacggctggagaacacaacagaagatgtatcaccaacatcaaggtccaagtgagctcttcagtactaggacgacctttccaatggaacgacatctgtttctgcatggaggaagtacacaagattctgggctagttctttcaactgatgctaaacctagactgaaatggacacccgagttacatcagagatttgtagatgcggtcaatcaattaggtggagcagagaaagctacaccaaaaacagtcatgaggcttatgggcatcccaggactcaccctgtatcatctcaaaagccacctccagaaatacaggctcagtaagaacctccaagctcaagttaacgttgggacaacaaagaacgctataggatgtgcagttgtagctgatagcatgcctgcaacaagtacaccagcaatgaccaacacaaatgtcattccacaggcagagaaaactattcaaattggtgaagccctacagatgcaaatcgaggtgcagaggcagctaaacgagcaactcgaggtacaacggcatctacaactacggatagaagcccaagggaagtatctgcagtcagttctagagcaggcacaagagagccttggaaaacagaatttgggtcctgcaaacctggaggatgcaaaaataaaaatatcagaactagtctcacaagtatcaaatgaatgtttcagcaatgcagttacagatataaaagaaagttcaaggatgcacagactagagccaaggcaaatccagtttgttgaaagttcaacaaataactgtttgactgcagctgaaggatacatcaatgagcatagactacacagccatggagtgctcaaagcatatgatgatagttcaatattatacagaaaacaatctcatggccatgagtatcaatttccgcttaatagaagcttaagcgagcgtaggatgggtcatttgcacaatgtaaaagagtaccataaagcagagttgggaagtgaaagtgacacggagattcaacaggagtatattacacctcaaaagaatgttggaggcagcaccaccagttcggcttcaggaaccaaagaaggcgatataaagaaattgtatcttgaagaaccaagctgcaagagacgagctatggactatccaagttttgaacgcccgaattctgggaagaaacttgatctgaacacccacaacactgatgatagtgatcaaggttttaggcattttgatttaaatggcttcagctggagctgaattgataaatgataatgatatgcatatgatcaaagagaagaaatgagcatacaaataatttctcccagcattctaccatcattattcagcgattaaactgtacgcttcaagacaaaaaata

SEQ ID NO: 4352 - DNA, 6418 bp, Setaria italica
cgctccccttccttccccacctcgcttcctcgccaccgccacttcctgcgccaccgcggccgcagcagcagcaaccagtcagcaccagcgcaagcaactccaccaccccgcgatcgcgcgtcgcgtcaccagcagcagggacgcgcgccgtcgggatcggcggcctcgccggggatggcgagcgccggcgccggcccgtcggggccggtgcggtcccagtcggggcggcagcggacgatgtcgcggttgcccacgcgcgccctcaccatgcgccctgagggcttctccggggaggacggcgtcgagatagtcgagctcgtgccctcgtcgctcgcgccaatcgtgcccatcctccgcgccgccaacgagattgaggaggagaacccgcgcgtcgcctacctgtgccgttttaccgcattcgagaaggttcacactatggatccaaactcaaatggacgcggagttcggcaattcaaaacatacctgttgcataagcttgaaaaggatgaacaagagacaaagcgcaggcttgcttcgactgatgcaagggagatacaaaagttctatgagtattactgtcaaaaatatctagaggaagatcatgaaaagaggaaacctgaggagatggctcgatactatcagatcgcgtccgtcctgtatgatgttctgaaaaccgtgacacctggcaaacatcatcccgagtatgataagtatgctgaaggagttgaaaaagagaaagcttctttttcacagtacaacattttaccccttaatatttctgttccaagacaaccaataatggaaattcctgagatcaaagcagcagttgggcttcttcgtcagatggatggtcttccaatgccaaaaccgcaaagctctgatggaaaaacagggcttgatggaatggacagacctgtccaggatttgcttgaatggctttggcaaacatttggatttcagaaaggtaatgttgagaatcaaaaggagcatttgattttgctgcttgcaaacattgacatgagacaacagggtcatgcccaccagagtgaaagacatgttcatatgatacgtaatagtacggtgatagacttgatggacaagatttttaagaactacaactcctggtgtcaatatttgcatttggagtcaaacattagaattccaagggatgcctccacacaacagccagagcttctttacatagggctgtatttactgatctggggtgaagcttctaatgtccgcttcatgcctgaatgtctttgctatatcttccaccatatggccagagatttacatgacataatatctgatagaagagatggatggtttgatccaccattccagcgagaggggagtgatgatgcatttctgcagctagtgattgaacccatctacagtgttatgcagaaggaagctgcaaggagcaaacgtggtacagtgagccactcaaagtggagaaactatgatgacttgaacgaatacttttggtcgaaaaaatgcttcaaaaaacttggatggccaatggatccaacagctgacttttttgcggtgcctaccagaaccaagaatgaaactgagcaacatgatcatgcaattcgcagacgaagggcgtcaaaaacaaattttgttgaagttcgtacatttttgcacctattcagaagttttgatcgtatgtgggccttctttatattgtctttccaggcaatggcaattattgcctggagcccctctggatcactttcttctatatttgaagcagatgttttcagaaatgtgttgacaatcttcataacggcagcattcctgaacttccttcaagccatgctagagataattctcaactggaaggcttggaagagcctggagtgctcacaaaggatgcgatgtatcctgaaatttgctgcagccattgcttggttgataattcttccaataacatactcaggctccattcaaaatcccacaggccttgtgaagttcttcagcaattggatcgggaatttgcagaatgaatcaatttataattttgctgttgccctttacatgctaccaaacatcctcagtgccctgtttttcatatttctaccaattcgaggggtcttagagcgctcaaattctcgtattattaggtttcttttgtggtggactcagccgaagttatatgttgcccgcggcatgtatgaagacactggctcacttcttaagtacacaaccttctggattctattgcttatatgcaagcttgccttcagtttttatgttgagattgctcctctagttgagcctaccaggataatcatgtcactggataggccgccttatgaatggcatgagttcttcccaaacttgcagcataatttaggagttgtgactactgtatgggctccaattgtcatggtatacttcatggacacgcaaatatggtatgccattttctccacaatatgtggtggcgtaaatggagccttcagccgcttgggtgagatccgaacccttgggatgttaagatcaagattccaggcaattccaagagcatttggcaaaaaacttgtacctaatcgtggtagtcattttaaacgagaagaggaggacagaaacccgccctatgataagtttgctgacatatggaatgcatttattacttctttgcgggaagaggacttactgaacaatagggagaaaaatctgttgattgttccatcctctggcggtgaaacaagtgtttttcagtggcctcctttccttcttgccagtaagattccaattgcacttgacatggcaaagaatgtcaagaaaaaggatgatgaactcatgaagaggataaaccaggatccttatactgagtatgctgtaatagaatgctatgagacattattggatatactttacagcattatagttgaacaaagtgataagaaagttatcgataagatagatgaaagcattaaaaatagcattgaatgtaaacaacttgtgaaagaattccgattggatgagcttcctcagctaagtgaaaagtttgataagctgctagatctactgaagttttatgatgagaatgatcctacaaagaacaatacacagattgccaatctgttgcaagatataatggaaattatcacgcaggatattatgaaaaatggacaaggtatcttgaaggatgagggacaaaaacaactatttgcaaatttaaatctggacccattgaagcatgttgcttggagggagaagtgtgttaggcttcaactgttgttgacaacaaaggaatctgctatatatgtaccaacgaacttggaagctcggcgtaggatcacctttttcgcaaactcactttttatgaagatgccaagggcaccacctgtccgtagcatgatgtccttcagtgttttaactccatacttcaaagaggaggtgctcttttctccgaaagatcttggtagaaaaaatgaggatggtatatcaatattgttctatctaaggaagatatttccagatgaatttaggaacttccttcagcggataaactgtaaaccaaaggatgaagaggaacttaaagaaaggatggaggagatctgtcattgggcatcttataggggccaaacactctccagaacagtgagaggaatgatgtactacaggaaggcacttgaaatccaatgccttcaagatacaaaagatcctgctaaatttggccgagacacatcaatagaatcctatcaagagttgcagtctgatagtgaaatggcacaagctattgctgatatcaaattcacctatgttgtctcatgtcaaatctatggcatgcagaagacgtccaagaaaaaagaggacaaaaaccgctatctgaatatcctcaatctcatgataacgaacccatcactacgtgttgcttacattgatgaggtagaagctccaactgggaatggaacaactgagaagacatattattctgttcttgtcaaaggtggtgaaaagtatgatgaggaaatttaccgcataaagcttcccggcagaccaacagatattggtgaggggaaacctgaaaaccaaaatcatgcaataatcttcactagaggagaagcactccaggccattgatatgaatcaggataattatattgaagaggccttcaaaatgagaaatgtgctggaggagtttgagagtagaaagtatgggaagagaaaacccactatattaggcctacgtgagcatatatttactggaagtgtttcgtcactggcttggtttatgtccaatcaagagaccagttttgttactattggacaaagagttctggcaaatcctctcaaggttcggttccattacggccacccagatatttttgacagactcttccatatcaccagaggaggcataagtaaagcttcaaagactataaacctgagtgaagatatcttttcaggttttaattcaactatgagaggaggaaatgttacacatcatgaatacatgcaagtcggtaaggggcgtgatgtgggaatgaatcagatttctagctttgaagctaaggtggccaacggcaatggtgaacaaacattgagccgtgacatctatcggcttggacgcagatttgacttctacagaatgctatctttctatttcactacagttgggttttatttcagtagcatggttactgtacttactgtctatgtatttttgtatgggaggctatatctagttatgagtggtctggaaaagtctattctgatggacccacgaaatcagcagaacgtgaaggctcttgaaaatgcactggcttcacagtctgttttccagctaggtttgctgcttgtcctccctatgatcatggaagttggcttggagaaagggttccgcacggcgttaggagagtttataatcatgcagcttcagttggcctctatgttcttcacattccagcttggaaccaaaacccactactatgggagaacaatactccatggtggtgcaatatacagacctacaggtcgtggatttgttgtgtaccacgcgaagtttactgaaaattaccgcttgtactcccgtagccactttgttaaaggactggaactgttgatacttctggtcgtatatctagtctatggaagttcctatcgcagctcaaacctatacatatttgtcacctgctcaatatggttcctggttgcttcatggctctttgcgccgtttatattcaatccatcgtgctttgagtggcagaagacagttgacgactggacagaatggaggaagtggatgggtaaccgagggggtatcggcatgtctgtggaaaaaagctgggaagcttggtggataagtgagcaggatcacctcaggaagactagcatccgagcccttctgttggaaatcatcatttcacttcgtttcttgatctaccagtatggcattgtctaccatctgaacatagcagtagcacgtcacaacaaaagcattatggtatatgcactgtcatgggtggttatgctccttgttctagtagtcctgaagatggtttcaatagggcggcagaaatttggaactgatctgcagcttatgttccgcattctcaaaggccttctcttccttggctttgtctccgtgatggcagtcctatttgttgtcttaaaccttactattgctgatgtcttcgctagcatccttgggttcttgcctactggatggtgtatacttctgattggacaagcgtgttcaccattgcttaggaggactgtgctgtgggactccatcatggagctcgggaggtcgtacgaaaacataatgggtctcatccttttcctgccaataggcttcctgtcatggtttccctttgtctctgagttccagacccggctgctgttcaaccaggccttcagcaggggcctccagatatcaagaatccttgcaggtcaggaggtggatatcggcgacgagtccgagtccgaatgaccagttccatccctcttacgaacaagcttggacagcaaagcaaggcaccagttccaagttatcttccatggatgtgcttgtagtgatcgattttgggcatctgtagtgtagtttcgtcaggtttactacattagaagtacatggagctaccgagctactactgatatcagaattatcagtatgtgtttttgcccctgtatagtgacatatagtggtaattagaattgaacatttatacacactaaggaggtcctgtttgtatacgtatttctgaaactcgcttacatacgtatttctgaaactcgcttacgtagtacaggcttatcagataagcttgctttctggagaatccgttgtctgaataagtagggtgtttgtcaatcctgattattttgtgttgattgtctatcctggttggtaaattgacatgaatgcccctgagactgataatagctcatttttgttg

SEQ ID NO: 4353 - DNA, 6156 bp, Oryza sativa
gatcctcaccaccaccaccgccgccaccgccgccaacgccgccgcggcgttggtctcgatcgttgtcgaatagggaggagggggtacgttggtcgtcgtcgtcgttgtcgtagtcgccgccgcggggcgggggaggcatggcgacggggggaggggggttgtcggggccgcagccgtcgctgcggcggggcttgtcgagggcgttcaccatgaggccggaggggtactccggggaggacggcggggagtacagcgaggagagcgagctggtgcctaactcgctcgcccccatcgtccccatcctccgcgccgccaacgagatcgaggaggagaaccagcgcgtcgcctacctctgtcggtttaccgcgttcgagaaggctcacaccatggatccaaactcaggtggacgaggagttcggcaattcaaaacatacctcttgcataggctggagaaggatgaacacgagacacagcgcagacttgcaggaacagatgcgaaagagattcagcggttttatgagcattattgtaaaaaaaatcttgtggacggtcttaagacaaaaaaaccggaggagatggctagacactatcagattgcgtccgtcctatatgatgtgctaaaaaccgtgacacctgaaaaatttcacgctgagtttgatatatatgctaaagaggttgaaaaggagaaagcttccttctcacactacaacattctaccccttaatatttctggtcagcgacaaccagtaatggaaattcctgagattaaagcagcagtggaccttcttcgcaagatagacggcctcccgatgccaaggcttgatccagtttctgctgaaaaagagacagatgtacctactgtccgtgatttgtttgattggctctggctgacatttggatttcagaaaggcaatgttgagaatcagaaggagcatttgattttgctgcttgcaaacattgatatgagaaaaggggctaatgcctaccaaagtgacagacacaatcatgtgtatggctcgcagatgcatagtgatacagttagatccttgatgaggaaaatctttgaaaactacatttcttggtgccgatatttacatttggagtcaaacataaaaattccaaacgatgcctccacacaacaacctgagattctttacatagggttgtatttgctgatctggggtgaagcttctaatgttcgctttatgcctgaatgtatttgttatatcttccatcatatggcaagggatttgtatgacatcatatctgatagaagacaagattttgatccaccctttcggcgagaggggagtgatgatgcctttctacagcttgttattcaacccatctacagtgttatgaagcaggaagctgcaatgaataaacgtggtaggacaagccactcaaagtggagaaactatgatgacctgaatgaatacttttggtcaaagagatgcttcaaacagcttaaatggccgatggattcagcagctgacttttttgcggttcctctgaaaattaaaactgaagagcatcatgatcgtgtgattaccagacggagaatacccaaaacaaattttgttgaagttcgtacatttttgcacctattcagaagttttgatcgaatgtgggctttctttatattagccttccaggcgatggtaattgttgcttggagcccttctggattaccgtctgctatttttgatcctactgttttcagaaatgttttgacaatattcataacggctgcatttctgaacttcctgcaagccacgcttgagataattcttaactggaaagcttggaggagtctggagtgctcgcagatgatacgatatatcctgaaatttgttgtagctgttgcttggttgataattcttcctacaacgtatatgagttctattcaaaattccacgggccttatcaagttcttcagcagctggattggaaatctgcagagtgaatcgatatataattttgccgttgctctttacatgttaccaaacatattcagtgctttgtttttcatatttctaccatttcgaagggtattggagcgttcaaattctcgcattattagattttttttgtggtggacacagccaaagctatatgttgcccgaggcatgtatgaggatacatgttcacttctaaagtatacattattctggatactattgctcatatgcaagctcgccttcagtttctatgttgagatttatcctctcgttggaccaacgaggacaattatgttcttgggacgagggcaatacgcatggcatgagttctttccatacttgcagcataatttaggtgttgtaattactgtatgggcaccaattgtcatggtatacttcatggacacacaaatatggtatgccattttttcaacaatatgtggtggagtgaatggtgccttcagccgcttgggtgagatccggacccttggaatgttaagatcacgattcgaggcaattccaatagcatttggcaaacatcttgtgccgggacatgatagtcaaccaaagagacacgagcatgaggaagacaaaattaacaagttctctgacatatggaatgcatttattcactctttgagagaagaagacttaataagcaatagggagagaaatttactgattgttccatcatctatgggtgatactactgtttttcagtggcctcctttccttctcgctagtaagattccaattgcacttgacatggctaatagtgtcaaaaaaagggatgaagaattgagaaagaggataaatcaggatccatatacctattatgctgtagtagaatgctaccagacattgtttagtattctagacagccttattgtggaacaaagtgataagaaagttgttgatagaatacatgataggattgaagatagcataagacgtcagtcacttgtaaaagagttccgattggatgaacttcctcagctaagtgctaagtttgataagctgctaaatctattgttgagaactgatgaagacattgaaccgataaagacacaaattgccaatttgttacaagatataatggaaatcatcacacaggatattatgaagaatggacaaggtattttgaaggatgaaaacagaaacaatcaattgtttgcaaatataaatctggattcagtaaaagataaaacttggaaggagaagtgtgttaggcttcaactattattgacaacgaaagaatctgcaatatatgtacctacaaacttggatgctcgtcgcaggatcactttctttgcaaactcacttttcatgaaaatgccaaaggctccacaggtccgcagtatgatgtcctttagtgttttaactccctacttcaaagaggaggtgctcttttcagcagaagacctttataaaaagaatgaggatggaatatccatactgttctatctacggaaaatatatccagatgaatggaagaattttcttgagaggatagaatttcaaccaacggatgaagaatcactgaaaacaaagatggatgaaatccggccctgggcatcttatagggggcaaacactcaccagaactgtaagaggaatgatgtactaccgcagagcacttgagattcagtgtattcaagacaaaactgatattgttaaactggaacatcgtagaacagttgagtcttctcaacaggggtgggccagtttcgatatggcacgggcaattgctgatatcaaatttacctatgttgtctcttgtcaagtctatggaatgcaaaagacatccaaggatcccaaagacaaagcttgctatttaaacatccttaatctcatgttaatgtacccatcgttacgtgttgcttatattgatgaagtagaagctccagctggtaatgggacaacagagaagacttattattctgttcttgtcaaaggaggtgaaaagtatgatgaggaaatttatcgcatcaagcttcctggcaaacctacagatattggagagggaaaacctgaaaatcaaaaccatgccattgttttcaccaggggagaggcactccaggccattgatatgaatcaggataattacctcgaagaggcatttaaaatgagaaatgtgctggaggagtttgagagtgaaaagtatggaaagagaaaacccactatattaggcctccgtgagcacatttttactgggagtgtttcatcacttgcttggtttatgtccaaccaagagaccagttttgttaccattgggcaacgagtcttggctaatcctctcaaggttcggttccattatggtcatcctgatattttcgatagactcttccatattactagaggtggcataagtaaagcctcaaagactataaatctaagtgaagatatattttcaggttttaattcaacaatgagagaagggaatgtcacacatcatgagtatatgcaagttggtaaggggcgtgatgtgggaatgaatcaaatttcaagctttgaagctaaggtggcaaatggcaatggtgaacaaacattgagtcgtgatatctatcggctggggcgcagattcgatttttatagaatgctatccttctactttactacagttgggttttactttagtagcatggttacagtacttacagtttatgtgtttctatatgggaggttatatctagttatgagtggtctggaaaggtctattttgctggatccacgtatcgagcagaacattaagcctcttgaaaacgcactggcctcgcagtcttttttccagctaggtttgctgcttgttctccctatggtaatggaagttggcttagaaaagggattccgcacagcattaggagagtttgttatcatgcagcttcaactggcatctgtgtttttcacattccagcttggcaccaaaacgcactactacggaagaacaatactgcatggcggggctaaatacagacctacaggtcgtggatttgttgtctaccatgcaaagtttgctgacaattaccgcatgtactcccgcagccactttgttaaaggacttgaactgttgatacttctggtggtttatttagtgtatggaagttcctaccgcagctcaagcatgtacctatttgtcaccttctccatatggttcctggttgcatcttggctcttcgcaccctttatcttcaatccgtcatgcttcgaatggcagaagacagttgatgactggacagattggaggaagtggatggggaaccgtgggggtatcggcatgtctgtggatcaaagctgggaggcttggtggataagtgagcaggagcaccttaggaagactagcattcgctctctcctcttggaaatcattctttcgctccgcttcttgatctatcagtacggtattgtgtaccatctgaacatagcacgccgcagcaaaagcattctggtatatggattgtcatggctggttatgctctcagtcctagtagttctaaagatggtttcgattgggcgacagaagtttggaacagatctgcagcttatgttccgcattctcaagggcctcctgttccttggttttgtctctgtgatggctgtattattcgtcgtttgtaacctcacaatttcggatgtttttgctagtattcttgggttcatgcctactggttggtgcattcttctgattgggcaggcatgttcgccgttggtgaagaaggcaatgctgtgggattccatcatggagctcgggaggtcgtacgagaacctgatgggactcgtcctcttcctccccatcggcctcttgtcatggttccccttcgtgtccgagttccagacacgactgctcttcaaccaggccttcagccgtggcctccagatctcaaggatcctcgccgggcaaaaggacattggagaggaatgaatgaatggatgaatggcccctcctggcctcgtctcctccggtgaactcgcttggacgaaaaaaccatcgattttgggcggctagttcgttgatagggccttttttaaatagttctgaacaaacaaatagtagccggtacatctgaactgtagtataaatgtttgttcctctttagaacaaggcatatatatgtagtaagcaattaacataaatgcagtacgttggtatatttccaagggtcggcatgtcaggatatattaattagttagtgactggc

SEQ ID NO: 4354 - DNA, 1538 bp, Glycine max
cgcttggtacgggtcgggtccatgtgtaagccgcaaggaaggtgtgttatgtataagcataggagaaaagtaaactagggttttagcagtggaagctttgttgagaaggaaggggttttagaatagaactccacatttttaagatttgatttgtttttctcttctcttctcatcatcaatggcgaccctcattcctccccctcctccccctcctcctcctcctgccgccgccgccgaccccaaggtcgattacttgaacctcccatgtccaattcccttcgaagagctccatcgcgaagctatgatgtctttgaagccagatctttttgagggcatgcgttttgatttcaccaagatgctcaatcagaagttctccctcaatcacagcgtgttgatgggacctactgaggttccttctcagtccacggagactattaagattccaactgctcactatgagtttggctcaaccttcattgatcaccctaggttgttgctctgggggagaattttgactgatgggaggctcaatgccagagtcaagtgtgatttgtccgaaaatctcacttttaaagccaatgctcagctcacaaatgagccgcatatgtctcatgcgatgatcaactttgattacaagggaaaagactatagaacccaatttcaacttggtaatggagccttgctaggagcaagttatattcagagtgtgacacagcatttatcattgggtggggaggtattttgggccggtcagcatcggaagtctggtattggttatgctgctcgctacaacactgataaatcggttgctaccgggcaagttgctagcactggaatggttcttctaagctatgttcagaaggtatctgagaaggtttctctagcatctgagtttatgtgcaactacttgtcaagagatgtcacagctagctttggttacgactacatccttagacagtgccgccttaggggaaagattgactccaatggctgtgttgctgcttttttggaggagcggttaaatatgggtctgaattttattctttctgcagagcttgaccacaggaaaaaagactacaaatttgggtttggtttgaccgttggagaatgaataagccggactagagctgtgttttcattgctgtagccagcttagcaagctttcttgcatccttttccttgttggagatttttcttaacgaaaaagaaaagaggaaatatcgtttgtgtcgggaaacacactatttacaatccacaagtagctgcagaattttcagtagtcatcaatttatttggaacttagccgaaaaaactttatttatttggatctattgccctgttttcccttgcgggggatgtagagtgatatcagtttaatgcatattgtgagattcaatttcaataatgtttctagtgctcgagtatctatccatgtcctatacttttaaatgacccatgcatgggaccatcgcagcaataatgccttggtgcgctattttttctggctgaattcaatgcataatttagcgatagattgg

SEQ ID NO: 4355 - DNA, 1899 bp, Cajanus cajan
agttgtataagcttagctgagtgagacagaaaaggaaaagagaattagggttttagcagtggtggaaggttgttgagagggttttagaacttctcactcttcagatttgcgttcctcttctctcgctcgttcatcaatggccaccaccgtgcctcctcctcccgctcccgctcccgctcccgccgtcgacgccaaggtcgattacttcaatctcccatgtccaattcccttcgaagagctccaccgcgaggccatgatgtctttgaagccggatcttttcgagggcatgcgttttgatttcaccaagatgctcaatcagaagttctctctcaatcacagcgtgttgatgggacctactgagattccttctcagtccactgagaccattaagattcccactgctcactatgagtttggctcaaccttcattgatcatcctaggttgttgctctgggggagaattttgactgatggaaggctgaatgccagagtcaagtgcgatttgtccgaaaatctcacttttaaagcaaatgctcagcttacgaatgagccacacatgtctcatgggatgatcaactttgattacaagggaaatgactataggacacagtttcaacttgggaatggggccttactaggagcaagttatattcagagtgtgacacagcatttatcattgggtggggaggtattttgggctggtcagcatcggaagtctggtgttggttatgctgctcgctacaacactgataaaatggttgctacagggcaagttgctagcactggaatggttcttttaagctatgttcagaaggtatctgagaaggtttctctagcatcagagttaatgtgtaactacttgtcaagagatgtcacagctagctttggttatgactacatccttagacagtgccgccttaggggaaagattgattccaacggctgtgttgctgcttttttggaggagcggttaaatatgggtctgaattttattctttctgcagagcttgaccacaggaaaaaagactacaaatttgggtttggtttgaccgttggagaatgaataagcaggactagaactgcttccattgctgtagccagcttagcgaggtttcttgcatctttttccttgtcggagatttttctttccaaaaaagaaaagaggaagtatcggttgtgtcgggaaacactatttacaatcaacaagtagctgcagaaattccagtagtcatcaatttatttggaacttgggccgaagaaacttaatttatttggaactattgccctgttttcccttgagggggatgtagagtgatatcagattaatgcatattgtgagattcaatttcaataatttttctggtgttcgtgtatctatccatgtcatatacttctcatgtttaaataacccaggggaccatcgcatcaagaatgccttggtgtgccgttttttcatgttgaagtcaaagcataatttagtggtagattaacgcttaaatctctcttttacaagcaaaaattaagagtcttattttagagattatttggagagattccatttttacacaatggtaaatcaacaatacgtaaaagtggtttccttcttcaattcgttggcctacccaaacacagactaaggggggccaccgtatcctgtttaaatttgttggcctaccaaaaccaatagattgagaagtgaagtgctataaaatagtttattataatggtttttatttcaattctttttgtctgcaaattaagtgttgaatcccatcttattgtaaggaacatgaaatgatattgctgaagaaaagcataatattttaaacaacttgagatacattatgatgagttgcatgatatgttggtatatgaataaatatttttctttatgatcat

SEQ ID NO: 4356 - DNA, 1331 bp, Vitis vinifera
cgacacactgaggctctctgtaaaaccagaggctctctctctctagggttctccataaaccctagatttgctgacaaaatctgacgccaacaatggccggattcgttcctccgccaccacctccggctcctcctgccccacctaagcccgatgagaaagtcgactacctcgatcttccttgccccatcccctacgaagaaatccaccgcgaagctctcatgtctttaaagccagagctttttgaggggatgcggtttgactttaccaaggggctcaatcagaaattctcactcagtcacagcgtgttcatggggcccactgaaattccttctcaatcctctgaaactattaaaatcccaactgctcattatgagtttggcgctaactttatagacccaaagttgatgctttttgggagaatattgaccgacgggaggctgaatgcaagagtgaagtgtgatttgactgaaaatctcactctgaaggctaatgctcagcttacaagtgagccacatatgtcacatggcatggttaattttgattacaagggtggtgattacaggactcaacttcaacttggaaatggtgctttatttggagctagttacatccagagtgtgaccccttatttgtctttgggtggtgaagttttttgggctggtcagcatagaaagtcaggaattggttatgctgctcgttacaataccgataagatggttgcaacaggacaagttgctagcactggcatggttgctctgagctatgttcagaaagtatcagagaaggtttctttagcatcagatttcatgtacaattatatgtcaagagatgtcactgcaagttttggttatgattacatccttcgacagtgccgtcttaggggaaagatcgactccaatgggtgcacagctgcttttcttgaagagcgattgaatatgggtcttaatttcattctttctgcagagatagatcaccggaagaaagactacaaatttgggtttgggctgacagtaggagaatagaatagattagaaggcaatttgtgctgtttttttctcagttttatcacacattgttgccagcaactcagcaagttattctgggttggtttttccttggttggaaaggttcacagatcggttttgtgcttctctctcggcaaacattatttgtggggcagcgtcagctgcttcaacagttttagcaatcgtaatttttggcatttcagagatgtaggaatcataatttatcaaaattgagatatgattttaatggtgtgtttgcatgatgaaataaacatgcagctagatgttggacattgatgatatgta

SEQ ID NO: 4357 - DNA, 1974 bp, Cichorium intybus
gccgactttttatagcaaagcagctccaagggttttgtaaagttgtagaaggggggcgctctcatcgtactccttcattcgctgaatacacacattactcttgcaacatcaatggccgcaatcaccatataaagcaggagaaaagattttacgaaccattgactgctcgttagtactcaaatctaatcgaaatccatccaaaatcaacgttgataccaatggcagctcttgttcctcctcccgcaacagcttcaccggcggcggaggctatcaagccagagaaagttgattacatggacctaccatgccctattccttacgaagaaatccaccgcgaggctatgatgtcattaaagccggaacattttgagggtatgcgtgtcgactttaccaagggtctcaatcagagattctcactaagtcacagtattgtaatggggcctacagaagttccttctcaatctgcagacacaatcaaaatccctactgcaaactatgaatttggtgctaactttatagacccaaggttgatgctttttggaaggatcttgaccgatggacggctaagtgcccgagtgaagtgtgacttgtctgaaaatcttaccatgaaagccaatgcacagcttacaaacgagcctcacatgtcacatggaatgttcaactttgactataagggtactgattacaggactcaattccaactaggaaatggtggtctacttggagctagttatatccagagtgtgacacctcacctgtctttaggtggggaagtattctgggctggtcaacatcgcaagtctggtcttggttatgctgcacgatacaacacggataaaatggttgcttctggacaaattgccagcactggaatggttgctcttagttatgttcaaaaagtgtccgaaaaggtttccctagcatcagatttgatgtacaattacatgtcaagagatgtcactgccagttttggctatgattatatactccgtcagtgtcgccttagagggaagattgactcgaatggatgtacatctgcttttcttgaagaaaggttgaatatgggtctaaatttcattctatcagccgagattgaccataggaagaaagactacaagtttgggtttgggttgactgttggagaatagatttaaaagaaaaacatgagcccaggtgggaaacctaggatttaaatttattttggagtgagaaaagttgtcatatcaggtatgatttttttttttatcgcgatgaagaacgatcaaagagtcagttttgtacttgtttttgagcagcattatttgtggctgcgattacagctgcatagacagtttattagagcataattagtagttgtcaaaatgtgcagcttggatatgtaattcaatcgagttcctatttgaagctgtggatgcattatgatgcaatttgacaaatacattccctttgtttttatgtttgattgtggttctaaatattttcaagtcctctttgtttaggacatctttaaaatccatttatcggttgggtttgactggtattgaattggttttctttttcatatctaaaaaacgttattttggtgattatttaaattcaaacagttacaaatgcgactatttaaaatgcaaacaattataaatatgtatcggatttagggttccatttaggatgcagatttattctgtagaccaaaacaaaatgggctttgattggttttgtctcattatttattgttttcttgttttggtttggttcaataatttgatacactgcaccgggaactaattaattacttgaacgaattattcctttcatgtgaagcatgaccaagaacaattttaaaatcgtttcatcgtgacagtgatttgacttttgaaaaagacgtgtacgttgaaattatatatttcagttgttattacgaatcatcgagtggtgtgtcaacttgggtgatttcgtgtttgcactaaaata

SEQ ID NO: 4358 - DNA, 1546 bp, Lactuca sativa
gccagcaagccgaactttttatagcaaaccttggtattcatcagggttttgtaaagttgtagaaggggggcggtatcatcgtactccttccattcactgaaaacacacatactctcttgcaacatcaatggccgcaatcaccttatagagcagaaaaaatagcttctacgaaccactctactgctcatcagtactcaaatctaatcgaaatccattcaaaatcaacgttgataccaatggcagcttttattcctcagccacccgcaacagcttcaccggccgaagctattaagccagagaaagttgattacatggacctgccgtgccctattccttacgaagaaattcaccgcgaggctatgatgtcattaaagcctgaactttttgagggtatgcgtgttgactttaccaagggtctgaatcagagattctcactaagtcacagtattgttatggggcctacagaacttccttctcaatctgctgatataattaaaatccctactgcaaactatgagtttggtgctaactttatcgatccaaagttgatgctctttggaaggatcttgactgatgggcgactaagtgcccgagtgaagtgtgacttgtctgaaaatcttactatgaaagccaatgctcagcttacaaatgagcctcacatgtcacatggaatgttcaactttgactataagggtagtgattacaggacacagttccaactaggaaatggtggccttcttggagctagttatatccagagtgtgacccctcacctgtctttaggtggggaggtgttctgggctggtcagcatcggaaatctggtcttggctatgctgcaagatacaacacggacaaaatggttgcctctggacaaatagccagcactggaatggttgctcttagctatgttcagaaagtgtctgaaaaggtttctctagcaactgatatgatgtacaattacatgtcaagagatgtcactgccagctttggctatgactatatacttcgtcagtgtcgtcttagaggaaagatcgactcaaatgggtgtgcgtctgcttttcttgaagaaaggttgaatatgggtctgaatttcattctatcagccgagctagaccacaggaagaaagactacaagtttgggtttgggctgacagttggagaatagacgaggaggccaggtgggaaaaagtaaaccaaggaggattttaaacttatttttgagtgagaaacaaaaacttgtcatacatggttatggtatgatttttttttttaaaaaaaaaacacgatcaaagagtcaagttttgtacttggtttttgagcaagcattatttactatgcaattgcagcagctgcatagacagttttttttagagcataatccatacttgtcaaaatttgcagcttttaatatataattcattcgacttcctatttgaagctgtagtagaatgcatcatgatatgctaattggcaatatatatccgattgttgccacacctttaggctttaggatatgcttttagacgagaccaacaaatatgtcgg

SEQ ID NO: 4359 - DNA, 1472 bp, Ambrosia trifida
tgtgtagtcttgctgcacaagcacaagaggcgcctcacctcaccatactccatcccttccattccatcctctcaaaacacacacaaaacccttattttttacatcatcttcatcaatgctctgaatcactaccacaacataaccacaacacaaccattaacatacatatacaaaaccccatctcaacccacccacaatcaacaatggctacacatattcctccacctgcaccggcggctgaacccaccaagcctgagaaagttgtactactttgaccttccttgccctattccctatgaggagatccatcgtgaagccatgatgtcgttgaagccagagcactttgagggtatgcgttttgattttaccaagggtctaaatcagaagttctctctaagtcacagtgttgtcatgggacccactgaagttccttctcaatctgctgaaacgattaagattcctactgcaaactatgagtttggtgctaactttatagacccgaagttgatgctttttggaaggatcttgaccgatggacggctaagtgctcgcgtgaaatgtgacttgtctgagaatcttactttgaaggccaatgctcagcttacaaatgagcctcacatgtcacatggaatgttcaacttcgactataagggttcggactacaggactcagttacaactaggaaacggtggcctgattggagcaagttatattcagagtgtgacacctcacctatctttaggtggggaagtcttttgggctggtcagcataggaagtctggtcttggttatgctgcacgctacaacactgataaaatggttgcctcgggacaaattgctagcactggaatggtggttcttggttatgtccagaaagtgtctgaaaaggtttccctggcaacagatatgatgtacaattacatgtcaagggatgttactgctagctttggctatgattatatactccgtcagtgtcgccttagagggaagatcgactcaaatggttgtacatctgcatttcttgaagaaaggttgaatatgggtctaaatttcattctgtcagctgagatagaccacaagaaaaaagactacaagtttgggttcgggatgactgttggagaatagatcaaaaagcatgagaacggatgcaaatttaggatttaaattaatttttgtagggacaatttgtcataccaagtgtgattcttgttattttatgatgatggacagagtcagttttgtacttgttttgaagcagcagcattatctgtggcggctattcaagctgcgctgcagacggtttagagcacaacataatccttcgttgtcaagttttgcagctcggatatgtaattcctacttgaagctgtagaatgcaatttgacaatacatttattttggcacaagtttttcattgttgaggtatgttaatgttggcgggtgttagcccgttagatgtttttaaaaaagaa

SEQ ID NO: 4360 - DNA, 1458 bp, Cichorium intybus
gcgggggtagaggggggcgctctcatcgtactccttcattcgctgaatacacacattactcttgcaacatcaatggccgcaatcaccatataaagcagaagaaaagtttttacgaaccattgactgctcattatcactcaaatctaatcgaaatctatccaaaatcaacgttgataccaatggcagctcttgttcctcctccacccgcaacagcttcaccggcggcggaggctatcaaaccagagaaaattgattacatggacctaccatgccctattccttacgaagaaatccaccgcgaggctatgatgtcattaaagccggaacattttgagggtatgcgtgttgactttaccaagggtctcaatcagagattctcactaagtcacagtattgtaatggggcctacagaagttccttctcaatctgctgacacaatcaaaatccctactgcaaactatgagtttggtgccaactttatagacccaaagttgatgctttttggaaggatcttgactgatggacggctaagtgcccgagtgaagtgtgacttgtctgaaaatcttaccatgaaagccaatgcacagcttacaaacgagcctcacatgtcacatggaatgttcaactttgactataagggtactgattacaggactcaattccaactaggaaatggtggtctacttggagctagttatatccagagtgtgacacctcacctgtctttaggtggggaagtattctgggctggtcaacatcgcaagtctggtcttggttatgctgcacgatacaacacggataaaatggttgcttctggacaaattgccagcactggaatggttgctcttagttatgttcaaaaagtgtccgaaaaggtttccctagcatcagatttgatgtacaattacatgtcaagagatgtcactgccagttttggctatgattatatactccgtcagtgtcgccttagagggaagattgactcgaatggatgtacatctgcttttcttgaagaaaggttgaatatgggtctaaatttcattctatcagccgagattgaccataggaagaaagactacaagtttgggtttgggttgactgttggagaatagatttaaaagaaaaacatgagcccaggtgggaaacctaggatttaaatttattttggagtgagaaaagttgtcatatcaggtatgattttttttttttatcgcgatgaagaacgatcgaagagtcagatttgcacttgttttagaccaacaatatttggggctgctattacacctgcatagacggattattacatcataatctacgagttgtcacaatgtgcatcttggatatgtaattcaatccagttcctatctgaagctgtggatgcattatgatgcaatttgccaaatgcgaaaaaaacaagaaaaaaaaggccctctcgccccattcgactctagactcgag

SEQ ID NO: 4361 - DNA, 1314 bp, Amsonia hubrichtii
aagagaaggcaaatccaacctcttcttctactatcactacagcgcctttcatttccacttggtcgaatcagagcgaaacgaattgggaaccgacgaagcaatggccaccctcgtacctcctcctgcaactactgctcctactcaatccgccgcttcgcagccgacagtgatcgaaccggagaaagtcgactacctgaaccttccttgtcctattccctatgaagaaatccaccgcgaagctttcatgtcattgaagccagaactttttgaggggatgcgatttgattttaccaaaggacttaatcagagattttcactcagccacagtgtgttcatgggaccgacagaaattccttctcagtcttctgaaaccattaaaatccctacagctcattatgagtttggcgcaaattttttagacccgaagttaatgctctttgggagggtattgacagatgggagactaactgccagattgaagtgtgatttagctgagaatcttaccctcaagggttctgctcaacttacaaatgaaccacacatgtcaaatggcatgtttaattttgattacaagggcaaagactataggactcagtttcaactcggtactggtgccttacttggtgccagttatattcagagtgtgacaaaaaatttgtctttaggtggtgaagtgttttgggctggtcagcacaggaagtctggcattggttatgcagctcggtacaacactgacaagatggttgccactgggcaagttgcaagcaccggaatggttcttctgagctatgtccagaaaatatctgaaaaggtctcgctagcttctgacttcatgtacaactacatgtctaatgatgtcacagcaagctttggttacgattacatccttcgccagtgtcgtcttcgagggaagatcgattcaaatggctgtgttgctgggttcttggaggagagattgaatatgggtcttaattttattctttctgcagagcttgatcatcggaagaaggattacaagttcgggttcgggttgacagttggagaatagataacatttttcgctgttattcttagcttagtttaaagtttttgcaagcaactccactgggtgattgttcgtcctttggataagattcaaagaatcaattttgtacttgtgttgagcatacattatttgatggtcacagctctggctgctccgacaaattagcatcaccagtagcattagttgttttccaagtttggtgatacctattcagatatggtttcaaagctgtagaataatgcgaaagaaagtaccaagccaaattttat

SEQ ID NO: 4362 - DNA, 1575 bp, Citrullus lanatus
aagccggaacttggtcctagggttttagagcgtttgcattctctccggggtttagagggagataaccctactctctctctcgctctctgatcgctacacctaactcaaatcaatctcattcgcattgccttttcgatcgtcccatcgccatttctacacttgtttcttgcttgtttttcttccattcctttacctgattctacacaatggcgggccttgctcctccgaccgccgccgcggctgcggctactgctcttcccgtcccaccgaagaagatagaggatgagaaggtcgattacttgaacctcccttgcccgatcccctacgaggagattcaccgtgaagctttcatgtccttaaagccggaactatttgaagggatgcgatttgatttcaccaaaggactcaatcaaaagttttccctcagccacagtgtgtttatgggacctattgagattcctaaccaatccaccgaaaccgtcaaaatccctactgccacttatgagtttggtgccaactatatagacccgaagttgatgctctttgggaggatacttaccgatggtaggctgaatgcgagagtgaagtgcgatttatctgacaatctcactttaaaggccaatgcacagctgacaaatgagccacatatgtcgcatggcatggtcaacttcgattataagggcagagacttcagaacccagtttcaattaggcaatggtgccttatttggagcaagttacattcagagtgtatcacctcatctatcattgggtggtgaagtattttgggctggtcagcacagaaagtctggtattggttatgctgcaagatacaacacagataagatggttgccactggacaagttgccagcacaggtatggtagctctgagctacgttcagaaagtgtctgagaaggtttcattggcatctgatttcacgtataactacatgtcaagagatgtaatatcgagtcttggctacgactacattcttcgacagtgccgtcttagagggaagattgattccaatggttgtgtagctgctttccttgaagagcggctaaatatgggtgttaatttcatcctttccgcagagattgatcacaggaagaaagactacaaatttggatttggtttgacagtaggagagtagattgggaggactaggaggctggggtggtggttaatcttgtcctcaatgctctggtagaaacatagtggagttctttccttgcatgatttttccttgttttgaattctcagtttctttagttaattattcagcacattattttgagcagaatctaactgctgttgcagtttttagaggccatatctctgttcccataccaaaatttttcttaattaataatttatttttcacctgagggctggacaacgagatgacgaatataatgccaatttcaaaattttaagcatctgttgatatgtttattaatcgatttttggttgatatatttatacagctatacatcaatagaatttgtttcttatcaaatatatatgtttagacagctatgtttaactcatttcctttgctggttttgatcatt

SEQ ID NO: 4363 - DNA, 1175 bp, Ipomoea nil
gtctctcacaccctctcctttttccttactagtcgcagctgaatccgaagccagaccagaatcaaatcagcaatggctgcctttgtccctccccctgccgccgcagctccacctgcggattcaaagccggcggcaccggaaaaagtcgattatatgaacctgccttgccctattccatatgaggaaatccaccgcgaagcttttatgtccttgaagccagaactttttgaaggcatgcggtttgactttacaaaagcacttaatcagagattttcacttagtcatagtgtgttcatgggacccacagaaattccttctcagtcgacagaaacaataaaaattccaacctctcattatgagtttggtgcaaacttcatagatccaaagttgatgcttcttgggaggttgatgacagatgggaggcttaatgctagggtgaagtgtgatttgtctgaaaatctttctttgaaggccaatgctcaactctcaaatgagccacatatgtcccaagggatggtcaattttgactacaagggaaaagactataggtctcaatttcaactagggaatggtggattgcttggagccaattacattcagagtgtgactccacatttatctctgggtggtgaagtattctgggctggacagcatcgcaaatcaggcattggttatgctgctcggtacaacacagataagatggttgccacaggacaagttgctagcactggacttgttgcattaaactatgttcaaaaagtttcagagaaggtttctctagcaacagatttcatgtacaactacatttctggagatgtcacagcaagtgttggttatgattatattcttcggcagtgtcgtctgagggggaagattgattccaccggctgtgttgctgctttcttggaagagcgattgaacatgggtgtgaattttatcctctctgcagaggttgatcataaaaagaaagattacaagtttggttttgggcttacagtaggagaatagaaatgtgaggcttttagatgtttcatcattcatcacccaaatacttgagctgaatggtgggagcgagagtcttttgattggtgattctttattccgtttttcattagaatcaaagcgacaagttttgtacttttctattgattggccccctgttaaagtaaaaggcc

SEQ ID NO: 4364 - DNA, 1306 bp, Olea europaea
tggggttttcgataattgaggcaaagggtttctctccttcctgctacgcagccgctcaagaagaagaagaaaatcactcttcttcttcttactctttcatttttctacaacactgtcaaattttgaactgaaaatggctacacttaccactccgcctactgctgtaacagatccaccggcagcaggttctagtccttcagtggctgaaccgcagaaagtcgattacatgaaccttccttgccctattccctacgaggagattcaccgcgaagctctcatgtctttgaagccagaactttttgaagggatgcgttttgattttactaaaggactcaatcagaaattttcactgagtcacagtgtgatgatgggccctacagaaattccttctcagtcatctgaaacaattaaaattcccaccgctcactacgagtttggcgctaacttcattgacccaaagttgatgctttttgggagggtattgactgatggcagactgaatgcaagattgaagtgtgatttgaccgagaatcttactttgaagggcaatgctcaacttacacacgagccacatatgtcgcatggcatgttcaattttgattataagggattggattataggactcaacttcaattaggaaatggagccttattaggtgcaagttacatccagagcgtgagccctcatttgtcattgggtggtgaggtcttctgggctggtcaacatcgaaagtctggcattggatatgctgcccgctataacacagacaagatggtggcaactggacaagttgctagcactggtatggttgctctaagctatgttcaaaaagtatctgataaggtttctctggcttcagacttcatgtacaactatatgtctagagatgttacagccagctttggttatgattacatccttcggcagtgtcgtctaagaggaaagattgattctaatggttgtgtggctgctcttctggaagagagattaaacatgggtcttaattttattctttctgcagagatggatcatcggaagaaagattacaaatttgggttcggtctgacagtgggagaataaaataggacgcctagccattccatattttcaatataagcttattgttggaagagcatcattacgaggaaatttgtcttcacttgtgattagtaatagagaatcggtttttgtactttttcgaggacagcacatctctgctacaacgtgcttagaatagccttagttgattttgcaacttggaaatatttgttagtatctcctgcagaactgtagattttattgtat

SEQ ID NO: 4365 - DNA, 1249 bp, Cirsium arvense
aatcacaaaataaacaacaacaagaagaaagttttccaaaccatttcatctcctcactagtactcgaatccaactgaaatccatccaaaaactaccttgataacaatggcaactcttgttcctccacctacaactcctccaccgccgccgccggccgaagctatcaagccagagaaagttgactacatggatttaccatgccctattccttacgaagaaatccaccgagaggctatgatgtccttgaaacctgatcattttgagggtatgcgtgttgattttaccaagggtctcaatcagaagttctcattaagtcacagtattgttatgggacctacggaagttccttctcaatctgctgaaacgattaaaattcctactgcaaactatgagtttggtgctaactttatagacccaaagctgatgctttttggaagggtttatactgatgggcggctaagtgctcgagtgaagtgcgacttggctgagaatcttaccatgaaggccaatgctcagcttacaaacgagcctcacatgtctcatggaatgttcaactttgactataagggtacggattacaggactcagttccaactaggaaatggtaacctgcttggagctagttatatccagagtgtaacacctcacctctctttgggtggggaagtattctgggctggtcagcatcggaagtctggtattggctatgctgcacgatacaacacagagaaaatggttgcctcgggacaaattgctagcactggaatggtggctcttagctatgttcagaaagtgtccgaaaaagtttctttggcatcggatcttatgtacaattacatgtcaagagatgtcactgccagctttggatatgattatatactccgccagtgtcgacttagagggaagattgactcaaatggctgtacatctgcttttcttgaagaaaggttgaatatgggtctaaatttccttctatcggctgagatagaccacaaaaagaaagactacaagtttggattcgggttgacagttggagaatagatccaaaccctaggatttacgctcgtatttttgagtgacatcacttattatacccccgaggtatgattgtttttaaaaatcatgatgatggacaaatatcaaagagttggttttgtactttttttcgcgcagcattatttgtggcggaaattccagctgcattagacagtttttttaagagcataatacatagatgtcgaaatttgca

SEQ ID NO: 4366 - DNA, 1384 bp, Arnica chamissonis
atcgtactccttccattcactgaacacacaaaactcttacatcatcaatggccgcaatcagcagatagaacgaaagagtgaaaaggttttactaagcattatactgctcactagcattcaaatcggatcaaaatccatccaaaatcgacgttcataacaatggcaacccaagttcctccacctacaacagcttcaccggcggcggaagctatcaagccggaaaaagttgattacatggaccttccgtgtcctattccgtacgaggaaatccaccgcgaggctatgatgtccttgaaggcagaacattttgagggtatgcgtgttgattttaccaagggtctcaatcaaaggttctctctaagtcacagtattgtcatgggacctactgaagttccttctcaatctgccgaaacaattaaaattcctactgcaaactatgaatttggtgctaactttatagacccaaagttgatgctttttggaaggatattgaccgatggacggctaagtgctcgagtaaaatgtgacctgtctgagaatcttacactgaaggccaatgctcagcttacaaatgagcctcacatgtcacatggaatgttcaactttgactataagggttcggattacaggactcagttacaactaggaaatggtggcctgattggagctagttatattcagagtgtgacacctcatctgtctttaggtggggaagtattttgggctggtcagcataggaagtctggtcttgggtatgctgcacgatacaacactgataaaatggttgcctcggggcaaattgctagcactggaatggtggttcttggttatgttcagaaagtgtctgaaaaggtttctctggcaacagatatgatgtacaattacatgtcaagagatgtcactgccagctttggctatgattatatactccgtcagtgtcgtcttagagggaagatcgactcaaatgggtgtacatctgcattccttgaagaaaggttgaatatgggtctaaatttcatcctgtcagctgagatagaccacaagaagaaagactacaagtttgggttcgggttgacagttggagaatagatcaaaaaactcgagcccggatgcgaacttttaggatttaaatttatttttgagcgacagtttgtcataccaagtgtgatcttttttaatattatattattttatggacagagtcggttttgtactcgttttgaagcagaattatttctggcggcgagtccagctgcttggacggttttagagcatgacataatccttagttgtcaaaatttgcagcttggatatgtaattcggttgaattcctacttgaggctgtagaatgcatcataatgcaatttgacaatacatttatttc

SEQ ID NO: 4367 - DNA, 1288 bp, Cichorium intybus
cgcgggggagaacagtgtcaaagcctttttttttcgcttccatttttgaagcagccgaaaccaatcttggtaacaatggcgaccctcgtccctcctccaccttcaccggcggcggcggaagcgatcaagccggagaaagtcgattacatggacctaccgtgccctattccttacgaagaaatccaccgggaagccctcatgtccttaaaggccgattattttgaggggatgcgtgttgattttaccaagggactcaatcagaagttctcactaagtcacagtatttccatgggacccacagagatcccttctcaatctgctgaaacaattaaaattcctactgcaaactatgagtttggtgcaaactacatagatccaaagttaatgcttattggaagggtgttgactgatgggcgggtcaccgccagagtcaaatgtgacttgtctgacaatctcagcatgaaggccaatgctcagcttacaagcgagccacacatgtctcatggaatggtcaattttgactacaagggtagtgactatagggcgcaattccaacttggaaatggtgccttacttggtgctagttatatccagagtgttacacctcacttgtcattaggtggtgaagtattctgggcaggtcagcatcgcaagtctggtcttggttatgctgcccgatacaatacagataaaatggttgcttcaggacagattgctagcactggaatggtggcacttagctatgttcagaaagtgtctgaaaaagtttctttggcatctgatttaatgtacaattacatgtcaagagatgtcactgcaagctttggctatgattatatacttcgccagtgtcggcttagaggcaagattgactcaaatggttgcacatctgcctttcttgaagaaaggttgaacatgggtcttaattttattatttctgctgagatagaccacaataagaaagactacaagtttgggttcgggttgacggttggagaatagatacaagcaacgatgcaaactttattgtttcaagtgagtcaaagtcaaactgattattttttcatcttacggacaaatattcgagatttgtttttactttttttgagcaatattgcttatccagctgtatcgacagtttagggcagcattcatagacattaaattttgcagtttggggatgtaatttaatctagttctttttcagccatttgtatggatcgtaggatgtactgcatttgacatgtaatggactgtcagtgggacaaaattgcaattttttgtccca

SEQ ID NO: 4368 - DNA, 1321 bp, Flaveria ramosissima
agaaggaggcgttatcatcgttctcctcaacaacacacacaaaaccctcacaaacatcaatgtcctcaaatcaccacataaaaaccataaacacataaacttcaactcaccattgtacactcaatcatcactcaaatccgatcaaaatccactctaaatcaccaccaacagcaatggcaacacgtgttcctccgcctgcaaccgtcccaccgccgccgcctccggcggaggctatcaagccggagaaagttgattacatggacctgccgtgtccgattccgtacgaggagatccaccgcgaggcgatgatgtcattgaagccggatcattttgagggtatgcgtgttgattttaccaagggtctcaatcaaaagttctctctaagtcacagtattgttatggggcctactgaagttccttctcaatctgccgaaacgattaaaattcctactgcaaactatgagtttggtgctaactttatagacccaaagttgatgcttttcgggaggatcttgactgatgggcggctaagtgctcgagtgaaatgtgacttgtctgagaatcttactatgaaggccaatgctcagcttacaaatgagcctcacatgtcacatggaatgttcaactttgactataagggttcggattacagaactcagttacaactaggaaatggtggcctgattggagctagttatattcagagtgtgacacctcacctgtctttaggtggggaagtgttttgggctggtcaacataggaagtctggtattggttatgccgcacgttacagcaccgataaaatggttgcttcaggacaaattgctagcactggaatggtggttcttggttatgttcagaaagtgtctgaaaaggtttctctggcaacagatatgatgtacaactacatgtcaagagatgccactgccagctttggctatgattatatactccgtcagtgtcgtcttagaggaaagattgactcaaatggatgtacatctgcatttcttgaagaaaggttgaatatgggtcttaatttcattctgtcagctgagatagaccacaagaagaaagactacaagtttggttttgggttgacggttggagaatagatccaaaaacgcgagctcagatgcaaacttttaggatttaaatttatttttgagtgacagtttgtcataccaagtgtgatccttttgtcttatattatggacagattcagtttttggtttgaaacagcattatttatggcggctgatcgactgcaagacggtttagagcataacataatccttagttgtcaaatttgcagcttggatat

SEQ ID NO: 4369 - DNA, 1112 bp, Acacia harpophylla
gctctttctctcggtccagagagatcttggggtcaactatctcctcttacatttcctgctaacacttgtttgatcttgtttgcaatggcgaccattgctcctctgattcctggtgcagcggctggcactagtgcccagaagaaggaggaggagaaagttgattacctgaaccctccctgtccgattccctatgaagaggtccaccgtgaagctctcatgtctttaaaaccagagctctttgaggggatgcgctttgattttaccaagggccttaatcaaaagttctctctcagccatagtctattcatggggcctaccgaggttccttctccatcctcagagaccattaaaatccctacttctcattatgagtttggtgcgaactttcttgatcctaagttgatgcttattgggagaataatgactgatggaaggctaaacgcaagagtcaagtgtgacttaacagaaagcctcactttaaaggccaatgctcagcttacaaatgaaccacatatgtctcatgggatagccaacttcgattataagggaacagactttaggacacagcttcaagttgggaatggagccttatttggagcaagttatattcagagtttgacgccttatttatcattgggtggagaagtattttggtctggtcagcatcggaagtctggtcttggttatgctgctcgctacaacactgacaaaatggttgctacagggcaagtagctagcaccggaatggttcttctaagctacgttcagagggtatctgagaaggtgtctctagcatcagagttcatgtataattacatgtcaagagatgtcacagctagctttggttatgattatattcttagacagtgccgcctgaggggaaagattgattccaatggcaccgtctctgcttttcttgaggaacggttaaatatgggcctcaacttcattatttcagccgagcttgatcactggaaaaaagactacaaatttgggtttggtttgacagttggagaatagattagcaggagtggaagcttttttaaacccctcattgtttgtgccagcctagtgggctttcttgccccttttcatttgactttttttttttt

SEQ ID NO: 4370 - DNA, 1247 bp, Manihot esculenta
ctcacaaactgcaatggcggggatggtacctccaggtacggcgatgctaggcgaggcatctgctgcagcgtcagccaagaagatcaatgaagttgggaagaaagtcgattacatgaacctcccttgtcccattccctatgaagaactccatcgtgaagctcttatgtctttaaagccagagctttttgaggggatgcgcttcgattttaccaaaggactcaatcagaaattctctcttagtcacagtgtgtttatgggacctatggaacttccttcacaatctgcagaaaccatcaaaatccctactgcccattatgagtttggtgctaactttatagaccctaagttaatgctttttgggagggtgttgacggatgggagactaaatgctagagtgaagtgtgatttgaccgatgatcttactctgaaggctaatgctcagcttacaaatgagccccatatgtcacatgccatgttcaactttgattataagggtaaagactacaggacccagcttcaactaggaaatggagccttatttggagccagttacattcagagtgtgacgccacatttgtctttgggtggtgaagttttttgggctggtcaacatagaaagtctggtcttggatatgctgctcgatatgagacagataaaatggtggcaacagggcaagttgctagcactggaatggttgctttgagctatgttcagaaggtttctgacaaggtttcactagctacagacttcatgtataactacatgtcaaaagatgtgactgcaagtgttggttatgattacatccttagacaagcacgtctaagaggaaagatagattccaatggctgtgcagcagctttcctagaagagcgcttaaatatgggtctcaattttattctttctgctgagttagatcataagaagaaagactacaaatttggattcggattgacagtagggtaattgaattgaagtcccaaaggtttatatcaaagctttacataaagtcggtgctagctagttagcaagttttctaggtaaactttgcatttgatgttgaaggtcaaggggttggttgtaatggtttgagcaaacattatttgtggggctgttgcagctgctgcaaacagttttttagcttcaatattcattctccggagatgtcactttatttccatgatagggatgtacaatttcaagatgaaacgtagggatggttcttataataaggttttcattgaataac

SEQ ID NO: 4371 - DNA, 1272 bp, Cucurbita pepo
aaaaactactctctctgtctctgaccgctacacgattctcacaaatccacgttccgacacttcatcccttcaacaaatctccatttgcagtgccttttccgatcgttccatcgccattccttcactagcttgttgcttggttctttcccatttcatttaggtgatcatatacaatggcgggccttgctcctccgaccactgcaactgctgcggctgcggctacggccttacccgttcctcccaagaagacagaggatgagaaagttgattacttggatctcccttgtcctatcccctacgaggagattcaccgtgaagctttcatgtcgttaaagccggaactatttgaagggatgcgatttgatttcaccaaaggactcaatcaaaagttttccctcagtcacagtgtgtccatgggaccaattgagattccttcccaatctacggaaaccatcaaaatccctactgccacttacgagtttggtgccaactatatagacccgaagttgatgctttttgggaggatactcactgatggaaggctgaatgcgagagtgaagtgcgatttatctgacaatctcactttaaaaggcaatgcacagctgacaaatgagccacatatgtcgcatggcatggtcaacttcgactataagggcagagacttcagatcccagtttcaattaggcaatggtgccttatttggagcaagttacattcagagtgtatcaccccatctatcattgggtggtgaagtattttgggctggtcagcatagaaaatctggtattggttatgctgctagatacaacacagataagatggttgccactggacaagttgccagcacgggtatggtagctctaagttacgttcaaaaagtgtctgagaaggtttctttggcaactgatttcacgtataactacatgtcaagagatgtaatatccagtcttggctacgactacattcttcgacagtgccgtcttagagggaagattgattccaatggttgtgtagctgctttccttgaagagcggctaaatatgggggttaatttcatcctttcagcagagattgatcacaggaagaaagactacaaatttggatttggtttgacagtaggagagtagattgggaaggagggagtagtagggtggttgtggtagaagaagaaacatagtggagttctttccttgtgttgaattctcagtttccttagttaattaattattcagcacattatttttagcacaatctgtgtcccccattcctaaa

SEQ ID NO: 4372 - DNA, 1209 bp, Cichorium intybus
cgcgggggagaacagtgtcaaagcctttttttttcgttccatttttgaagcagccgaaaccaatcttggtaacaatggcgaccctcgtccctcctccaccttcaccggcggcggcggaagcgatcaagccggagaaagtcgattacatggacctaccgtgccctattccttacgaagaaatccaccgggaagccctcatgtccttaaaggccgattattttgaggggatgcgtgttgattttaccaagggactcaatcagaagttctcactaagtcacagtatttccatgggacccacagagatcccttctcaatctgctgaaacaattaaaattcctactgcaaactatgagtttggtgcaaactacatagatccaaagttaatgcttattggaagggtgttgactgatgggcgggtcaccgccagagtcaaatgtgacttgtctgacaatctcagcatgaaggccaatgctcagcttacaagcgagccacacatgtctcatggaatggtcaattttgactacaagggtagtgactatagggcgcaattccaacttggaaatggtgccttacttggtgctagttatatccagagtgttacacctcacttgtcattaggtggtgaagtattctgggcaggtcagcatcgcaagtctggtcttggttatgctgcccgatacaatacagataaaatggttgcttcaggacagattgctagcactggaatggtggcacttagctatgttcagaaagtgtctgaaaaagtttctttggcatctgatttaatgtacaattacatgtcaagagatgtcactgcaagctttggctatgattatatacttcccagtgtcggcttagaggcaagattgactcaaatggttgcacatctgcctttcttgaagaaaggttgaacatgggtcttaattttattatttctgctgagatagaccacaataagaaagactacaagtttgggttcgggttgacggttggagaatagatacaagcaacgatgcaaactttattgtttcaagtgagtcaaagtcaaactgattatttttttcatcttacggacaaatattcgagatttgtttttactttttttgagcaatattgcttatccagctgtatcgacagtttagggcagcattcatagacattaaattttgcagtttggggatgtaatttaatctagttcttttttcagcc

SEQ ID NO: 4373 - DNA, 1238 bp, Flaveria ramosissima
cagaaggaggcgctatcatcgttctcctcaacaacactcacaaaaccctcacaaacatcaatgtcctcaatcaccacataaaaaccataaacacataaccttcaactcaccattgtacactcaatcatcactcaaatccgatcaaattccacccaaaatcaccaccaacagcaatggcaacacgtgttcctccgcctgcaaccgtcccaccgccgcagcctccggcggaagctatcaagccggagaaagttgattacatggacctgccgtgtccgattccgtacgaggagatccaccgcgaggcgatgatgtcattgaagccagatcattttgagggtatgcgtgttgattttaacaagggtctcaaccaaaagttctctctaagtcacagcattgttatgggacctactgaagttccttctcaatctgccgaaacaattaaaattcctaccgcaaactatgagtttggtgctaactttatagacccaaagttgatgcttttcggaaggatcttgactgatgggcggctaagtgctcgagtgaaatgtgacctgtcggagaatcttactatgaaggccaatgctcagcttacgaatgagcctcacatgtcacatggaatgttcaactttgactataagggttcggattacagaactcagttacaactaggaaatggtggcctgattggagctagttatattcagagtgtgacacctcacctgtctttgggtggggaagtgttttgggctggtcagcataggaagtctggtattggttatgccgcacgttacagcaccgataaaatggttgcttcaggacaaattgctagcactggaatggtggttcttggttatgttcagaaagtgtctgaaaaggtttctctggcaaccgatatgatgtacaactacatgtcaagagatgccactgccagctttggctatgattatatactccgtcagtgccgtcttagagggaagattgactcaaatggttgtacatctgcatttcttgaagaaaggttgaatatgggtcttaatttcattctgtcagctgagatagaccacaaaaagaaagactacaagtttggttttgggttgacggttggagaatagatcaaaaaacgcaagcgcagaggcaaacttctaggatttaaatttattttttgtaatgacaatttgtcataccaaagtgtgatcttttgttttattctatgatggacaaattcagtttttgttttc

SEQ ID NO: 4374 - DNA, 1144 bp, Cucumis sativus
ccggaacttagggttttagagcattctctctggggtttagagagagataaccctaaactccaccctttctctctcgtctctgatcgctacacttgaaactaaaatcaatcccattcccatttcctttccgatcgtcccctcgccattactacacttgattctctgctatctccttttgttgattatacacaatggcgggccttgctcctccgaccgccgccactgctacggctgcgccttatcccctacccatcccaccgaagaagacagaggatgagaaggtcgattacttgaacctcccttgtccgatcccctacgaggagattcaccgtgaagctttcatgtccttaagccggaactatttgaaggtatgcgatttgatttcactaaaggactcaatcaaaagttttccctcagccacagtgtgttatgggaccaactgagattcctaaccaatctgccgaaaccatcaaaatacctactgccacttacgagtttggtgccaattttatagatccgaagttgatgctttttgggaggatactcaccgatggtaggctgaatgcaagagtgaagtgtgatttatctgacaatctcactttgaaggccaatgcacagctgacaaatgagccacacatgtcacatggaatggtcaacttcgattataagggcagagacttcagaactcaatttcaattgggcaacggtgccttatttggagccagttacattcagagtgtatcccctcatctgtcattgggtggtgaagtattttgggctggtcagcatagaaagtctggtattggttatgctgcaagatacaacactgataagatggttgccactggacaagttgctagcacaggtatggtagcgctgagctacgttcaaaaggtgtctgagaaggtttcattggcaactgatttcacgtataattacatgtcaagagatgtaatatccagtcttggctacgactacattcttcgacagtctcgtcttagagggaagattgattccaatggttgtgtagctgctttccttgaagagcggctaaatatgggcgttaatttcatcctttccgcagagattgatcacaggaagaaagattacaaatttggatttggtttgacagtaggagagtaag

SEQ ID NO: 4375 - DNA, 1119 bp, Flaveria ramosissima
ggccgcaatcacaacataaagtagaaacaacaaaatttctactaacaatcatacttctcatcactaaaatcgcacagaatccttccaaaatcaccaccaacaacaatggcaacccacgttccaccgcctccaacagcttcaccggcgacggcggaagctatcaagcctgaaaaagtcgattacatggatctaccctgtcctattccctacgaagagattcatcgcgaggctatgatgtcgttgaaacctgagcattttgagggtatgcgtgttgattttacaaagggtctgaatcaaaggttctcgctaagtcatagtattgtcatggggcctacggaagttccttctcaatctgctgaaacaattaaaattcctactgcaaactatgagtttggtgctaactttatagacccaaaggtgatgcttttcggaagaatcttgactgatgggcggctaagtgctcgagtgaaatgtgacttttctgagaatcttactatgaaggccaatgctcagcttacaaacgagcctcacatgtcgcacggtatgttcaactttgactataagggaacagattacagggctcagcttcaactaggaaatggtggcctgcttggagctagttatatccagagtgtgacgcctcacctctctttaggtggggaagtattctgggctggtcagcataggaagtctggtattggctatgctgcacgatacaacactgataaaatggttgcctcaggacaaattgctagcactggaatgatggttcttggctatgttcagaaagtgtctgaaaaggtttctctggcaacagatatgatgtacaattacatgtcaagagatgtcactgccagcgttggctatgattatatactccgtcagtgtcgtcttagagggaagattgattcaaatggatgcacatctgcttttcttgaagaaaggttgaatatgggtctaaatttcattttgtcagccgagatcgaccacaagaagaaagactacaagtttgggttcgggttgacagttggagaatagatcaaacaacatgagctgtatgcaaattttagcatataaacttatttttgcagtgacgcaggttgtcataccaactttggt

SEQ ID NO: 4376 - DNA, 948 bp, Cyclamen graecum
ctctgagcagctagagacggagagaggcctcagcaatggcgactctggttcctccgccggccactctggttcctccgccggagacaccggccgtggcatcgccggagaaagttgactacttgaacctgcctttacctataccctatgaagaaattcaccgcgaagctctcatgtccttaaagccagaactttttgaggggatgcgatttgatttcaccaaaggacttaatcagaagttctcacttagtcacagtgtgttcatgggacccacggaaattccttctcagggttccgaagccattaagattcccactgctcactatgagtttggagctaactttatagacccaaagttgatgctttttgggagggtactgacagatgggagagttaatgctcgagtgaagtgtgatctatcagaaaatctgactttgaaggcgaacgctcagcttacaaatgaaccacatatgtcgcaaggcatggctaatttcgattacaagggtaaagacttcaggactcagtttcaactaggaaatggtgctttatttggagccagttacattcagagtgtgaccccacatttgtctcttggtggtgaagtattttggactggtcagcaccggaagtctggaattggttatgctgctcgatacaacaatgacaagatggttgctacagggcaagttgctagcacagggatggttgctcttagctatgtccagaaagtatctgagaaggtttctctggcatcagacttcatgtacaactatatgtcaagagatgtgacggcaagctttggctatgattacattctccgacagtgtcgtcttaggggaaagatagattctaatggctgcactgctgcatttttggaagagcgacttaatatgggtctgaatttcattctttctgctgagattgatcacaagaagaaagactacaaatttg

SEQ ID NO: 4377 - DNA, 1233 bp, Taraxacum officinale
cgcgggggaacaatattgataaaatggcgacccttgtccctcctccacctgcggcggcggcggcagaagcgatcaagccggagaaagtcgattacatggacctaccatgccctattccttacgaagaaatccaccgggaagccctcatgtccttaaaagccgattactttgaggggatgcgtattgatttcactaagggactcaatcagaggttctcattgagtcacagtatcgccatgggacccacagagttcccttctcaatctgctgacataatcaaagtcccaattgcaaactatgagtttggtgcaaacttcatagatccaaagatgatgcttattgggcgggtgttgaccgatgggcgggtcaacgcaagagtcaaatgtgacttgactgagaatcttagcatgaaggcggatgctcagcttacaaatgagccacacatgtctcatggaatggtcaactttgactacaagggtaccgactataggactcaattccaacttggaaatggtggattacttggtgctagttatattcagagtgttacccctcacttgtcattaggtggggaagtattctgggcaggtcagcatcgtaagtctggccttggttatgctgcccgatacaatacggataaaatggttgctacaggacagattgctagcactggaatggtggcacttggatatgttcagaaagtgtctgaaaaggtttcattggcatctgatttaatgtacaattacatgtcaagagacgtcactgccagctttggttatgattatatacttcgccagtgtcggcttcgaggcaagattgactcaaatggctgcacatctgcttttcttgaagaaaggttgaacatgggtcttaattttattatttctgctgagatagaccacatgaagaaagactacaggtttggattcggattaacagttggagaatagatacaaaatgcataaccttcttcattgttttttcagtgaaaactattatttttcaatcttacggaaactattcgatatttttattccatcttttttgagcaatattgcttgcgagcggcacttccagctgtatcaacagtttagagcagcattcctagacattaaattttgcagtttggagatgtaatttaatcaaagtgtagtctgttttcagccatttgtatggatcataataaggttcaacttcactttgttatgttagcatacactcagtgttcttgac

SEQ ID NO: 4378 - DNA, 1378 bp, Carica papaya
agccccgcctctcaaacggaaacccttgtttttgtctctcttccttcacttacatttctgctgattgtatcacaatcgaactccagaaaagctaaagagagaagcagcaatggcggggttcgtaccagctggtacaactacgatccataacgatgagaagagcaaaacagatgagaaagtggattacaccaaccttccttgccctataccgtatgaagaactccatcgcgaggctctcatgtctttgaagccagaactgtttgaggggttgcgctttgattttaccaagggactgaatccaaaattctctctgagtcatagtgtgcttatgggaccaacagaaattccttcccagtcttctgagactattaaaatccctactgctcactatgagtttggtgctaactttatagacccgaagctgatgcttatcgggagggtcttgacggatggtagactaaatgcaagggtgaagtgggatttgactgatactcttacgttgaaggctaatgctcagcttaccaatgagcctcatatgtcacatgggatggttaactttgattacaagggcaaagactatcgaagccagttacagctggggaacggtgccttattgggagccagttatatacagagtgtgacttcatacttgtctctgggtggtgagatattttgggctggtcagcaccgaaagtccggaattggttatggtgctcgatatgaaacggataagatggttggaacagcacaagttgctagcacaggaatggttgctcttagctatgttcagaaggtatctgagaaggtttctctagcatctgatttcatgtacaactatatgtcaagagatgtcacagctagtgttggttatgattacatcctaaggcagtgtcgtcttaggggaaagattgattctaatggttgcactgctgcttttcttgaagaacgactaaatatgggtcttaattttgttctttctgccgagctagatcataagaaaaaggattacaagtttgggtttgggttgacggtggggtaatagatttgaaggctggttaatgaaatttgacataagaggttcatcatcagcaactagactgagggagttgtgagccatctttgcttttgtttgaagaggaaaaagaatttgtttagtactgtctttctaataacaattgagcaattttagcagagctgctatactcattgttttggcagttgatactgtcaatttgggatatgactttagagttgtagtatttaaatcaatggaattggagatatttggttttgagtttgtttcctgtttgaattttaatcttgatattttttgttatatcaatttggagtacttttaagaagttgtattgaaattgat

SEQ ID NO: 4379 - DNA, 1345 bp, Tropaeolum majus
atcgcaaaaacttactcactctgtatcagaatcaaaggcagtagagcttagaaagaaaaagcagcatcaaaaatggcggggattatcccaccagttaccgcaattcaaaccgatgcgaacactaaagcggaagagaaagttgattacaccaaccttccttgccccattccatatgaggagatacatcgcgaggctctcatgtctttaaagccagagctatttgagggattgcgttttgactttacaaaaggactgaaccagaaattctctctcagtcacagtgtgctcatgggaccaacagaagttccttcccagtctgctgaaactattaaaattcctactgctaactacgagtttggtgctaactatatagatccagagttgatgcttattgggagggtcatgacggatggtagactaaatgcaagagtaaagtgggagatgacggatactctaactatgaaggctaatgctcagctcactggtgaacctcatatgtctcatgcgatggttaactttgattacaagggaagagactacaggacccaatttcaacttggaaatggtgccctattcggagccaattacatccagagtgtgacaccccacttatctttgggtggagaggtattttgggctggtcagcatcgaaagtccggtattggttatgctgcccgatatgagtcaaataagatggttgccacaggacaggttgctagcactggaatggtagctctgagctatgtccagaaggtttctgataaggcttcgctagcatcagatttgatgtacaattacatgtcaagggacgtcacagctagtgttggttacgattatatccttcgacagtcgcgtcttaggggaaagatcgactctaatggctgtgcagctgcttttcttgaagaacgactaaatatgggcttgaatttcattctttccgcggagttggatcataaaaaaaagactacaagttcggctttgggttgacagtagggtagaactggatggtgtgtattaccaaccattacataagcccattgctggtgagcagctcagctgaaatcccgattcgactaaacgtttgatttgaagatggaagacaaagtatcagttctgtatcgtcttttttgttggagtaaaccatgtgggcagcacgaacttgctgccaccagttttttagtagtcaagcacttgggattaatatcttggtagccatcatttttggttttatattagattggagtttaaagtggaatattgatcagagtgagatttaaatttgagattcattgaaaatactcgatgaaatcatttgacttttggataataagatgcgaagccattt

SEQ ID NO: 4380 - DNA, 1452 bp, Catharanthus roseus
aaaagcttttccactgttgaaacttctcactctcattctcttctagccgctttcaaggaagaagaagaacggaggagtgccgccatccaatttcttcttctactttcaccgctgcgttctttgatttgctgccgtcggaatcagtacgagacggattggagccgccgacgacgaagcaatggccacacttgtccctccttctgcaagtactcttcctcctcaacaacatcctgctggttccaagccgacggtgatcgaaccggagaaagtcgattacctcaaccttccttgtcctattccctatgaagaaatccaccgcgaagctttcatgtcattgaaggcagaactctttgagggaatgcgattcgattttaccaaaggacttaatcaaagattttcactcagccacagtgtgttcatgggtccaacagaaattccttctcagtcttccgaaaccattaaaatccctacagctcattatgagttcggtgcaaattttttagatccgaagttgatgctctttgggagggtactgacagatgggaggctgaatgccagattaaagtgtgatttatcagaaaatcttaccctcaagggttctgctcatctcaccaatgaaccacacatgtctaatggcatgtttaactttgattacaagggaaaagactataggtctcagtttcagatcggcactggtgccttgctgggtgccagctatattcagagtgtgacaaaaatttgtctttaggtggtgaagtattttgggctggtcagcacaggaaatctggcattggttatgcagctaggtacaacacagacaagatggtcgccacaggccaagttgcaagcactggaatggttgccctgagctatgtccagaaagtatctgaaaaggtctctctagcttctgacttcatgtacaactacatgtctaatgatgtcaccgcaagctttggttatgattacattcttcgccagtgccgcctaagagggaagattgattcaaatggcgttgtttctagtttcttggaggagaggttgaatatgggtcttaactttattctttctgcagagatcgatcatgcaaagaaggattacaagtttggtttcggattaacagttggagaatagaattagtcttttttcgggtattattcttagctttagctctctttggtttctgcaaaagcacaaactccacggggtgattcttttcgtcctttggataaaagattcaagaaaaacacagttttgtacttgtgttgagcatacattatttgatgaagagcggtggctgctcttgacaaattagcaccgctaccagacagtcgtagtagttttttttctctagtttggtgatatttattcagatttggttttcagtttgtagaataatgctaaaagaaaaatagtacaaaaaggccaaatttgttactagaggcgtggtggcgt

SEQ ID NO: 4381 - DNA, 1252 bp, Castanea mollissima
gagatcaaaataactcattgagttacaataatggcaactgctactgccactgcccctccaactagtagtaccactacgctgccacaaatgaagaaagaggacgaaaaagtcgattacttcaacctcccttgtcctattccctatgaggagatccaccgtgaagctttcatgtctttaaagccagaactatttgaagggatgcgctttgattttaccaaaggactcaatcagaggttctcactcagccacagcgtgttcatgggaccaatggagattccttcacaatcttctgaaaccattaaaatccctactgctcactatgaatttggtgccaactttatagacccaaagctgatgctttttgggagaataatgactgatgggaggctcaatgcaagagtgaagtgtgatttaaccgacaatctttctttcaagggtaatgctcagcttacaaatgagccgcatatgtcacatggaatggcctattttgattacaagggcaaagactacaggtcccagtttcagctgggaaatggtgccttacttggagcaaattatatacagagtgtgacccccaatttgtcttttggtggtgaagtgttttgggctggtcagcatcggaagtctggtattggttatgctgctcgatacaacacggataagatggttgccactgggcaagttgcaagtacaggattggttgctctgagctatgttcagaagatatctgagaaggtttctctagcttcagacttaatgtacaactacatgtcaaaagaagccacagccagtttcggttatgattacatccttagacagtgccgccttagagggaagattgattccaatggctgtgcatctgcttttctggaagagcgattgaatatgggtctaaattttattctttctgcagagctagatcacaggaagaaagactacaaatttggttttgggctgacagtcggagagtagattagcatgacttgatgctgttttatcctcattcttggtagcaaatttgcgagctattcttgctttatttttcctattggcacagagcaaagaaacagttttgtatttctacttttggcaacgttatttgtgagtagcatcgtgtgctgccacggttttagccgtcttatttattaattcggagttaacactcttattaccctttagggctgtagaatgagatcaaataatgcaaattaagatatttatcacttcaataacgttagttttagaattaact

SEQ ID NO: 4382 - DNA, 912 bp, Glycine max
ccgatgaacattaatcaattatcattattcagcaaaaaaatctccacttttttgtttttgttcaatctcgaataccacaaactcaaaatcccaaacccgtgtgtgccatccacagatttcgcgaaaaataaaaaatatcacgcgctggtaccacctttccccaaaccatcaattccaatcctcccaatttccacaatcttcaaccttcaaattctgcttcacctttcttcatttcacttcagagagagagaacaaaacagaatgggcgtcgtggtgatcgacggcagcaccgtgcgcgacttcgtgaacgacgaaaccgccttcaccaagagcgtggacgagcagttctcggcgctggacctcaacaacgacggcgtcctctcgcgctcggagctccgcacggccttcgagtccatgcgcctcatcgagacgcacttcggcatcgacgtttccacgccgccggagcagctcgcgaagctctacgactccatcttcgacaagttcgacggcgaccggagcggcgccgtcgaccgccgcgagttccgcgacgagatgaggaagatcatgctcgccatcgccgacggcctcggatcgttccccataaggatggtcctcgaggacgatcccaatagtcttcttcagaaagccgcggatcttgaagcctccaagacctgaaatccaaacggcgacgttttgagttcggttcggtaatagtaattgattgtgctttcgtgcgttcactttgtttttcttttcttaaataaaagggtttatgtagagaccgtgtttcgaaactgaggttccgttctgtgtataatgtaagggacactgttattaacttatcatgttgagtgttgagttaattatactttttttccctaatttaatttctaagtttaatttagtcttttt

SEQ ID NO: 4383 - DNA, 748 bp, Phaseolus vulgaris
tcgctgttggaaagaggagtaacaaacattgagtgagaaagtgagagaaatcagaatgggcgtggtgataatcgacggcaccaccgtgcgcgacttcgtcaacgacgccgccgcgttcacgaagagcgtggacgagcagttcacggcgctggacctcaacaaagacggcgtcctgtcgcggtcggagcttcgcacggcgttcgagtccatgcgactcatcgagacgcacttcggcatcgacgtggccactccgccggagaatctcgcgacgttctacgactccatcttcgacaagttcgacggcgaccggagcggtgccgtggaccgccacgagttccgagaggagatgaagaagatcatgctcgccatcgccgacggcctcggctccttccctatccgcatggtcctcgaagacgaccccaatagtctcctccagaaagccgcggatctcgaagcttccaagatctgaatggaaacggtgacgtttcgtagcttccaacacgtggacagagacggcaatggaaacggcggcgttttttagatttcgtaactgtatttgaccgtaggccttcgtgtgttgactttggttttcttttttaataaatggtttatgctgagaggtgtgagtgaataaaaaaggaatttagttttttttaatcaattcttgtgatgatataaaatcgttattaaatattaaatttaaagatatcaatattatatatcatatggatttaatttaaacaccgtt

SEQ ID NO: 4384 - DNA, 659 bp, Cajanus cajan
aatgggcgtggtcgtgatcgacggcaccaccgtgcgcgacttcgtgcgggacgaggcggcgttcgccaagagcgtggacgagcagttcgcggcgctcgacctcaacaacgacggcgtcctctcgcggtcggagctccgcacggcgttccagtccatgcgcctcatcgagtcgcacttcggcatcgacgtggccacgccgccggagcagctggccgcgctctacgactccatcttccagaagttcgacggcgaccggagcggcgccgtggaccgcggcgagttccgggaggagatgaagaagatcatgctggccatcgccgacggcttggggtccttccccatccagatggtcctcgaagacgacccccacagtctcttgcagaaggccgcggatctagaagcttccaagtcttgaaaacgctaaacgccgccgtttgaccttcggtacctcccctttaccggagtattcgatcggagctgtcgttcggcccccagaacacgagaagattactagtgtacccttcggcaggtacaatatatattagagagggtaaaacattttgtatatctatagttaaacaaatgattataattttttgtgtttaatagttatactgatggttgtaatattttttatacatgttttctttattttaacc

SEQ ID NO: 4385 - DNA, 697 bp, Cajanus cajan
tcaacgtgtcaatcgaaccaattcccattcccccaacccaatccccaaactccaactacaaaagccacttcccaaaacgacatccctctccagcgttccaccgcgacaatgggcgtggtcgtgatcgacggcaccaccgtgcgcgacttcgtgcgggacgaggcggcgttcgccaagagcgtggacgagcagttcgcggcgctcgacctcaacaacgacggcgtcctctcgcggtcggagctccgcacggcgttccagtccatgcgcctcatcgagtcgcacttcggcatcgacgtggccacgccgccggagcagctggccgcgctctacgactccatcttccagaagttcgacggcgaccggagcggcgccgtggaccgcggcgagttccgggaggagatgaagaagatcatgctggccatcgccgacggcttggggtccttccccatccagatggtcctcgaagacgacccccacagtctcttgcagaaggccgcggatctagaagcttccaagtcttgaaaacgctaaacgccgccgtttgaccttcggtaattctgcttttttttttttttgtatgcgtgtttgtatgtttgaagatggaaacacgggtttatgcaatgttatttcagttggtttttttttttttttttaaatatgtatcaaccttctaaatcatttcatgtttctaacagtg

SEQ ID NO: 4386 - DNA, 653 bp, Vigna unguiculata
ggaatctttagagggaaagtgagagagaacagaatgggagtggtaataatcgacggcaccaccgtgagcgacttcgtcaacgacaccgccgcgttcacgaagtgcgtggacgatcagttcacggcgctggacctcaacaacgacggcgtgctgtcgcggtcggagctccgcaaggcgttcgagtccatgcgcctcatcgaagcgcactttggcatcgacgtgaccactacgccggagaagctcgccacgctttacgactccatcttcgacaaattcgacgtcgaccggagcggtaccgtggaccgcgacgagttccgagaggagatgaagaagatcatgctcgccatcgccgacggcctcggctccttccctatccagatggtcctcgaagacgaccccaacagtctcctccagaaagccgcggatctcgaagcttccaagacctgaatgaaaacggtgacgtttctatgcttacgagacacgaatagagacggcggcgtttcaggattccgtgaactgaaacgacggcaattgaaacgccgccgttttagatttggtaactgtgtttgaccgtgtgccttcgtgtggtaactttgtttttttttctttttctcttaataaaggatttatgttgagattagtgtgcttgaata

SEQ ID NO: 4387 - DNA, 741 bp, Arachis hypogaea
gtggtatcaacgcagagtacgggggacttcaccgtagccataagattattataattaagatcccacaaagcacatcacagataagagagaagggatgggagtggtggttattgacggcacgaccgttagggatttcgttaacgacgacgcacacttcaacaagagcgttgatgaacaattcacggcgcttgataccaacaacgacggcgttttgtcacgctcggagctccgcaccgccttcgagtccatgaggctcatcgagacgcacttcggcatcgacgtcgctacttcgccggaggaactcaagaaactctacgattccatcttcgagaggttcgatggtgatggaagcggcgacgtcgacaagaacgagttcagatccgagatgaagaagatcatgctcgcaatcgctgacggtttgggatcttttccgatccagatggttctcgaagatgatgacaacagcttgctccagaaagctgcagatctcgaagcttctaagaccgccgctgcttgatttccgccgtcatcggcggtggcggtggcggtggctccgccttccttcttttgttgcttatcttggtatcacgttgtcgttttgtgttgttttcagttgtcgttttggttatgtggaaataatgagtggcgactggtacgggaattgactttgtctttgtatatcgttttttttgttttgttttattgggccttttttatatgtaagatgaataataaataagt

SEQ ID NO: 4388 - DNA, 910 bp, Arachis hypogaea
cttcaccgtagccataagattattataattaagatcccacaaagcacttcacagataagagagaagggatgggagtggtggttattgacggcacgaccgttagggatttcgttaacgacgatgcacacttcaacaagagcgttgatgaacaattcacggcgcttgataccaacaacgacggcgttttgtcacgctccgagctccgcaccgccttcgagtccatgaggctcatcgagacgcacttcggcatcgacgttgctacttcgccggaggaactcaagaaactatacgattccatcttcgagaggttcgatggtgatggaagcggcgacgtcgacaagaacgaattccgatccgagatgaagaagatcatgctcgcaatcgctgacggtttgggatcttttccgatccagatggttctcgaagatgatgacaacagcttgctccagaaagctgcagatctcgaagcttctaagaccgccactgcttgatttccgccgtcatcggcggtggcggtggcggtggcggtggctccgccttcgttcttttgttacttatggtggtatcacgttgtcgttttgtgttgttttcagttgtcgttttggttatgtggaaataatgactggcgactggtacgggaattgactttgtagtttgtatatgttttttttgttttgttttattgggccttttttatatgtaagatgaataataaataagcgggcctattaacatgaaaatgggcccaatgtgaatccaaagtagtgaataatgtagctacaaaaagtagaaagaaaaaacgcctacaaaaacttcacatgtagtgctcaatctgtggacaaaaacatagtcacttcattttagctttgggtttgaaactaggaaagtaccgaaattaacagttattgtg

SEQ ID NO: 4389 - DNA, 955 bp, Arachis hypogaea
tgggagtggtggttattgacggcacgaccgttagggatttcgttaacgacgatgcacacttcgacaagagcgttgatgaacaattcacggcgcttgataccaacaacgacggcgttttgtcacgctccgagctccgcaccgccttcgagtccatgaggctcatcgagacgcacttcggcatcgacgttgctacttcgccggaggaactcaagaaactatacgattccatcttcgagaggttcgatggtgatggaagcggcgacgtcgacaagaacgaattccgatccgagatgaagaagatcatgctcgcaatcgctgacggtttgggatcttttccgatccagatggttctcgaagatgatgacaacagcttgctccagaaagctgcagatctcgaagcttctaagaccgccactgcttgatttccgccgtcatcggcggtggcggtggcggtggcggtggctccgccttcgttcttttgttacttatggtggtatcacgttgtcgttttgtgttgttttcagttgtcgttttggttatgtggaaataatgactggcgactggtacgggaattgactttgtagtttgtatatgttttttttgtttgttttattgggcctttttatatgtaagatgaataataaataagcgggcctattaacatgaaaatgggcccaatgtgaatccaaagtagtgaataatgtagctacaaaaagtagaaagaaaaaacgcctacaaaaacttcacatgtagtgctcaatctgtggacaaaaacatagtcacttcattttagctttgggtttgaaactaggaaagtaccgaaattaacagttattgtgatttgcgtgattggtgatatgatcgtaaagcgaagtggtgtatttacactttcatttcaaaaaaaaagaaaaaaaacaaaagtactctgcgttgataccactgcttagacgtatca

SEQ ID NO: 4390 - DNA, 620 bp, Lotus japonicus
cttcatcgttatcttcccaatcgctaacatgggtgtggtgataatcgacggcacgacggtgagggatttcgtgaacgacgaagccagtttcaccaagagcgtggacgaacagttcgccgcgctggatctcaacaacgacggcgttttatcacgcgcggagctccgcaccgccttcgagtccatgaggctcatcgaggctcacttcggcatcgacgtcgcaaccccgccggagcagctcaccaagatctacgactctgtgtttgatacgtttgacggtgatggtagcggcaccgttgaccgcctcgagttcaggtccgagataaagaagatcatgctcgctgttgctgatggtctgggaactaacccgattcagatggctcttgaagatgactctaacaatcttcttcagaaagctgcggatctcgaagcttctaagatcggcgccgcctgaccgcgacggaacacggcggtgatgcgtttcgttgttttattttatattatatttgtgcaattaattactataagaggtaggatagctgtttgtgaattcgtgtgtgtgtgtgtggaatcttttttcctttcttaatttgtatggatttacactttaatgtgaatgtatg

SEQ ID NO: 4391 - DNA, 541 bp, Arachis hypogaea
gacggcacgaccgttagggatttcgttaacgacgatgcacacttcaacaagagcgttgatgaacaattcacggcgcttgataccaacaacgacggcgttttgtcacgctccgagctccgcaccgccttcgagtccatgaggctcatcgagacgcacttcggcatcgacgttgctacttcgccggaggaactcaagaaactctacgattccatcttcgagaggttcgatggtgatggaagcggcgacgtcgacaagaacgaattccgatccgagatgaagaagatcatgctcgcaatcgctgacggtttgggatcttttccgatccagatggttctcgaagatgatgacaacagcttgctccagaaagctgcagatctcgaagcttctaagaccgccactgcttgatttccgccgtcatcggcggtggcggtggcggtggctccgccttccttcttttgttacttatcttggtatcacgttgtcgttttgtgttgttttcagttgtcgttttggttatgtggaaataatgagtggcgactgg

SEQ ID NO: 4392 - DNA, 3687 bp, Cajanus cajan
aggggatctatgaccagctgatgatctacggtgaccgggtattcacctgaattcgtgatacccttttgattgagtatctgagcatgttgggtagaatttagttggggaattattattgtcctttgagtggaataagaatcttgattagggtctgttgatttcttggtagtcttgatttttgtcacttcaattctgccttaaaacacagtacattttgtaaagtctgcttcttgatattgggtttgttagtgttttcttgttagtggcctcctttttttcccaatggctaacccaacacaacctaatgttgggttcacccctgagagagagagtccaaaccctgagaagagtccaattccaccccctccaagttttgttgcggcgtcacctggttttcttccaccaaaattgcatttacagcaagatcaagcctcttctcgttcccttaaaaccccgagcgttttatcaccggccaatggggttaccactggcagtcctgttcctcacttgagcacccctcccggacccccggtttttacgtcgcctgtccgtccagctgccgttccctttcggacatcgcctgcatcgcctcagccggttgcattttcttcaggctctttgccaatgtcatcgtctccaccgcaatattcaaatggatcgtttgagttgcagcaccaagtttctgataatatagaagaccatgttcctgttggggagtcatcgtttgttcttttttctgctcataaggtattgaaacagaagaaacaaggtaatgtacccagtttgggttttggggcattggtctctcctgggagggaggtttcaatgggtcctcatgtaatacagcgtgatcctcatcgctgccaaagctgtggtgcttatgcaaatatctattgcaatatattgcttggatcaggccagtggcagtgtgttatatgtcggaaactgaatgcaagtgaaggggagtacattgcgcatagcaaggaagatcttcgcagatttccggaattatcctcacccatgtttgactatgttcaaactgggaacaagagacctggttttgttccagtttcagattccagaatgtctgccccaattgttcttgttatagatgaatgtttagatgaacctcacctacaccatctacaaagctctttgcatgcttttgttgattctctcccgacaacgacaagattaggaattatactatatggtcgtactgtatcagtgtatgatctttcagaagaggcaatggcatctgctgatgttcttcccggggacaaatcaccaagtcaagaatctttgaaagcactgatttatggtactggtatatacttgtctccgatgcatgcttcattggctgtagcacattccatattctcatcattgagggcatacaagttgaatataccagaagcttcccgagatcggtgcctaggaactgctgttgaggttgctcttgctataatccagggtccatctgctgatttgtcccggggggtggtcaaaaggtcagggggaaatagtagaattattgtctgtgctggcggaccaaacacttatgggcctggatctgttcctcattcttttaatcaccctaattatccttacatggaaaagacagcaattaaatggatggagaatcttggtcgtgaggctcatcgacacaatactataattgatattttgtgtgctggaacatgtcctgtaagagttcctatcttacatcctcttgcaaaagcatcaggtggagttttggttctacatgatgattttggagaagcctttggtgttaatttgcaaagagcatctgccagatcagcaggctctcatggtttgttagaattgcgcacgtcagatgatattctcatcactcaagttgttggtcctggggaagagtcacacgtagatacccacgaatcatttaaaaatgacactgctctttatattcaaatgctaagtgttgaagaaacacaaagtttctctctctccatggaaactgaaggagatatcaaaagtgattatgcctttttccaatttgcaattcagtattcaaacgtttatcaagctgatgtgtcgagggtcattactgttagactgccaacagtagatagtatttctgcatatcttgagagtgttcaggatgaagtggctgctgtcctcattgcaaaaagaaccctgttacgagccaaaaaccattctgatgcaattgatatgcgagcaacaatagacgaaagaatcaaggatattgctctaaagtttggctctcaattacctaaatcaaaacttcatagcttcccaaaggagctttctctcctaccggagctccttttccatctcaggagaggaccactattgggaagcatcattggtcatgaagatgagaggtctgtgctgaggaacttgtttctgaatgcatcctttgatctatctctcagaatggtagcacctcgttgtctaatgcacagggaggggggaacttttgaggagctaccagcgtatgatcttgctatgcagtctgatgctgctgttgtacttgaccatggcactgatgtcttcatttggttgggtgctgaacttgcagctgatgaaggaagaagtgctgctgctctagctgcatgtaggacattggccgaagagctgactgagtaccgatttccagctcctcgcatccttgcattcaaggagggtagctcccaggctcgatattttgtctctcgtctcattccagctcacaaggatcctccttatgagcaggaggcaagattcccgcaactgaggtcgttgacgtcagaacagcggacaaagctgaaagctagttttgttcactttgacgatcctagtttctgtgaatggatgcgaagtttgaaagtggtgccaccacaaccaagctgatgggagacctaaactgcatattccaacttgttggttattattctttgttaagttggtgaagccaagtttgtttgcatgatttgaggaacgcaatgagatcctgcacatgtctccaacacgctcgcttcagtgcatccttccattcatttgttcacttccgacaaacgtctaaaagctgcaaaaaaaatgttttttttggggggtgaggtgagatgaagactgtgacaaagaattttttttacaatttacggttaagatgttactatagagcaataaaaggatttctcgttatttatatttatagcacttgttgattgccaagtgttttcttcaatctctaatattttttgaatctttttctctagtccatccctaatgccgattggaattaattttgtttacaaaaataagtgtcagtacggagaatgggagtccagatccactttatgtcttttattactaacgttttaaagttttgagaatataataaattaggtggcaaaatgggttatagtcagctgatttgtcaaaaattagtgggttgagctagagattctggtcagtgaggtctacgttacctagcccatgagttcaccggcttaaattaagttattttagatttattttgtgtataatttataatttgttgtgtaataaatttgttgtgcatttaatttattttatatgtagtttctttatttattttattatttagggacactaatatatgtatgttctttaagtattgagaaaaaaaaatatgtttgaagaataattcaaaataaatatgta

SEQ ID NO: 4393 - DNA, 3514 bp, Phaseolus vulgaris
tggcgtgtgaaaaatctcaaaccccaaccctctcccaatccaaatccaattacgaaaacaatgggacatgagtttataaaacaaagaacagcgttttttcctaaacccactcgcgggactcggaattagcaagaagagtgcccaaaagtcaacaatttcgattcttgcccctttcatcattaatccttttgtcattcccccagcatttatcgtctctctctcagaggggatctgtgaccagttgatgatggatggtgactgggtaccctttggttgagtatctgagcaggttaggtagaatttagttgggaattattattgtcctgtgagtggaataagaatcttgattagggtctgtgtgctttcttggtagtattgatttttgtcaattcaattctggctttagcacaaagtctgcttcttgatattgtacctgtgactgtttcttgttagtggcctccttgattttcaatggctaacccaacacaacctaatgttgggttcacccctgagagagagagtgcaaaccctgagaagagtcccattccgccccctcctaattctgtagcgtcaccacctggttttccttcaccaaaactgcacttacagcaagatcaatcttcttcccgttccgttaaaacccctagcgttttatcaccagccaatggggttacaactggcagttctattcctcacttgagcacccctcccggacccccggtttttacgtcgccggtccgtccagctgcggttccttttcgaacatcacctgcatcgcctcagcctcttgcattttcttcaggttcttctttgccaacgtcatcatctccgctgcaattttcaaatggatcgtttgagttgcagcagcaagtttctgatagtatagacgacaaggttcccgttggagagtcatcatttgttcttttttcagctcgtaagatactgaaacagaagaaacaagccaatgtgcccagtttgggttttggggcattggtctctcctgggagggaggtttcaatgggcccccaggtaatacagcgtgatcctcatcgttgccaaagctgtggtgcttatgcaaatatatattgcaacatactacttggatcaggccagtggcagtgtgttatatgtaggaaactgaatggaagtgatggggagtacattgcacatagcaaggaagatcttcgcagatttctggaattatcttcaaccatgtttgactatgctcaaactgagaacaagagaccaggttttgttccagtttctgattctagaatgtctgccccaattgttcttgttatagatgaatgtttagatgaacctcacctacaccatctacagagttccttgcatgcttttgttgattctctctcaccaacaacgagattaggaattgtattatatggtcgcactgtttcagtgtatgatctttcagaagagtcaatggcatctgctgatgtgctgcctggggagaaatcaccaagtcaagaatctttgaaagcattaatttatggtactggtatatacttgtcaccaatgcatgcttcactggctgtagcacattccatattttcatcgttgagggcatacaagttaaatataccagaagcttctcgtgatcggtgcctaggaactgctgttgaggttgctcttgctataattcagggcccttctgctgatctgtccaggggggtggtcaaaagatcaggggggaatagtagaattattgtctgtgctggtggaccgaacacttatgggcctggatctgtccctcattcttttagtcatcctaattatccttacagggaaaagactgcaattaaatggatggaaaatcttggtagtgaggctcatcgacacaatactataattgatgttttatgtgctggaacatgtcctgtaagagtacctatcttacatcctcttgcaaaaacatcaggtggagtttttgttctccatgatgattttggggaagcctttggtgttaatttgcaaagggcatctgccagatcagcaggctctcatggtttgttagaattgcgcacatcagataatattgtcattactcaagtcgtcggcccaggggaagagtcacatgtagatacccatgaaacatttaaaaatgatactgccctttatattcaaatgctaagtgttgaagaaacccaaagcttctctctctccatggaaaccgaaggagatattagaagtgattttgtctttttccaatttgcaattcaatattcaaatgtgtatcaagctgatgtgtcgagggtcattactgttaggttgccaacagtagatagtatttctgcatatcttgagagtgttcaggatgaagtcgccactgtcctcattgcaaaaagaacactgttgcgagccaaaaaccattctgatgcaattgatatgcgatcaacaatagatgaaagaatcaaggatattgctctaaaatttggttcccaattacctaaatcaaaacttcacagcttcccaaaggagcttgctctcttaccagagcttcttttccatctcaggagaggaccactcttaggaagcattattggccatgaagatgagaggtctgtgctgaggaatttgtttctgaatgcatcatttgatctatcactcagaatggtagctccccgatgtttaatgcacagggaggggggaacctttgaggagctaccggcatatgatcttgctatgcagtctgatgctgctgttgtactagaccatggcactgatgtcttcatttggttgggtgccgaacttgcagctgatgaaggaagaagtgctgctgctctagctgcatgtaggacgttggctgaagagctgactgagtgccgttttccagctcctcgcatccttgcatttaaggagggtagctcccaggctcggtattttgtctctcgtctcattccagctcacaaggatcctccttatgagcaggaggcaagattcccacaactcaggtcgttgacatcagaacagcggacaaagctgaaagccagttttgttcacttcgatgatcctagtttttgtgaatggatgcgaagcttgaaagtggtgccaccacaaccaagctgatgatgaagggtctttggcgctgcatctttcaactctttggttattctttgttaagttggtcaagccaagtttgtttgcgtgatttggggtatacaatgtgatcttgcagatgtctccccaagactttggcttcaatgcctcctcccattcattttgttcacttccaagaatcctccgaagaagttttttctttttttggtttggggcagagggtgagggatgactgtgacaaagattttttttcacaatttacggttaagatgataccatagagcaataaaaggatttctcgttatttatatttatataccacctgctgattgccaagtgtattcttcaatttctgtgtttttggtatgtttttcttttacccgattgttttagattttgtacagttgattttaattttaaatatggaacatgaatg

SEQ ID NO: 4394 - DNA, 3514 bp, Lotus japonicus
gaaggtatactaatggggacgttgcatctcacgtgaggtgctcctggtggcgccgtctctctctcgagctatcgtaggtgggcaacatgccaacaaggaaagaaacacaaagataaaggggccgaaacatgtaggagaaaaacaccaaggttgagttgagaaggtttcactgccgttgttttttcttcttctcgtgtaaaaaacctacctccgatccaaaatcgctatcacaattacacagcaccaccattaccctttctcccccgatcccaattccgattaggggttcggaattcacacaacaagactctacaatttccccatttcatcactacccatttctcgtctctctctcagaggggatctccgatcaggtggaatttcattgagggtttaaggtctctgcgaattctgaccaatggaatgtgaatcttgatcaggctctctcttgtttcttgttagtattgattttcatcacttcctcactatcaattctacctgcaacactgtaaattcttgtaaaactttacttccttatactggttttgttagtctaccttgattttcaatggctaacccaacacaacctaatgttgggttcaccccttcaaacccagacagacagggtcaaaaccctgacaagggtccaattcccccacctcttagttttgcagctgcacctagatttcctccaccaaaattacagttacatcaagatcaagcttctccccaacccgctaaaaccccgagcccaaaccttgtttcaccggctaatggggttaccactggcagtccagttcctcacctgagcacccctcctggaccccctgtcttctcgtcacccgtccgtcctgctgctgttccgtttcgcacatcgcctgcatcacctcagccacttgctttttcgtcaagctcttctttgccaacgtcatcgtcgccccaatattccaatggagcatttgatttgcagtcccaagtttctgatagtattgcggaccatgctcctgttggggagtcatcctttgttcttttttcagctcataaggtactgaaacagaagaaacaagctaatgtgcccagtctgggttttggggcattggtctctcctgggagggaggtctcaacaggccctcaggtaatacagcgtgatccccatcgctgccaaagctgtggtggttatgcaaatatttattgcaacatactgcttggctcaggccagtggcagtgtgttatatgccggaaactgaatggaagtggtggtgagtacgttgcggctagcaaggaagatcttcacagatttccagaactgtcttcacccatggttgactatgttcaaactgggaacaagagacctggttttgttccagtttcagattccagaatgtctgccccagttgttcttgtaatagatgaatgtttagatgagcctcacttacaccatcttcagagttctttgcatgcttttgttgattctctccctccaacaacaagattaggaattgtactatatggccgtactgtatcagtgtatgacttctcagaagaatcaattgcatctgctgatgtgcttcctggggataaatcaccaagtgaagactctttgaaagctttgatttatggtacgggcatatatttgtcgcccatgcatgcttcattacctgtagcacattccatattttcatcattgagagcatataagttgaacatacctgaagcttccagagatcggtgcctaggaactgctgtggaggttgctcttgctataattcagggcccgtcagatctgtcccgaggggtagtcaaaaggtcagggggtaatagtagagttattgtctgtgctggtggaccgaacacttatgggcctggatctgttcctcattcttttagtcaccctaattatccttatatggaaaaaacagcattgaaatggatggagaatctgggtcgtgaggctcatcgacaaaatactgtggttgatattttatgtgctggaacatgccctgtaagagttcctatcttacatcctctcgcaaaagcatcaggtggagtttttattctccacgatgattttggagaagcctttggtgttaatttgcaaagggcatcagccagatcagcaggctctcatggactgttagaattgcgaacatcagatgatattctcattactcaagttgtgggtcctggggaagagtcacatgtagacacccacgaaacgtttaaaaatgacactgctctttatattcagatgctaagtgttgaagaaacacagtgcttctctatctccatggaaaccaaaggggatatcaaaagcgattttgtctttttccagtttactattcagtattcaaatgtatatcaagctgatgtgtccagggtcattactgttagactgccaacagtagatagcgtttcaggatatcttgagagtgttcaggatgaagtggctgctgtcctcattgcaaagagaactctgttacgagccaaaaaccaatctgatgcaattgatatgcgagcaacaatagatgaaagaattaaggatattgctctaaaatttggctcccaactaccaaaatcaaaacttcattgcttcccaaaggagctttctctcttacctgagatccttttccatctcaggagaggatcgctattgggaagcattattggccatgaagatgagaggtctgtgctgaggaacctgtttctgaatgcatcctttgatctatcactcagaatggtggctcctcgttgtctaatgcacagggaggggggaacttttgaggagctaccagcttatgatcttgcaatgcagtctgatactgctgttgtacttgaccagggcactgatgtcttcatttggttgggtgctgaacttggagcagatgaaggaaaaagtgctgctgctttggctgcatgcaggacattagctgaagaactgactgaattccgttttccagctcctcgtatccttgcattcaaggaggctagctcccaagctcgatattttgtctctcgtctcataccagctcacaaagatcctccttatgagcaggaggcaagattccctcaactcaggacattgacacaagaagcgcggacaaagctgaaaagcagctttgttcacttcgacgatcctagcttttgtgagtggatgcgaagtttgaaagtggtgccaccccaaccgagatgatgaccattctgctttaggtgatttggtgggttaatttatgagagcccgtaatggtcttgggcattgaatcttccaacttgttgcgtattctttgttgagttgttgacactgggttttttccatgttttgtgcaacacagtgttcttgtagatgtcccaaatctctcgcttcagtgcctcctcccattgattttgttcacctccgaagaaataatctttttttttttgtgttgggagggggtgacagaaatttttacaatttacatgacagttaatatgtttccatagagcaataatggatttctttttatttatatttatagca

SEQ ID NO: 4395 - DNA, 3060 bp, Trifolium pratense
caaattctatggagtcaagtcacaatctttgataaatatactttcttgacagttaatgttgttcattttgtaacctttttatatctctgcaaattctgggtttgttttgttgtaactgtattttttgagttatcttgattttcaatggctaataacccaacacaacctaatgttgggtttatcccttcaaacccagaagaagatagacaaactccaattcatcctcctccccctcctccaacttttgcacctagatttcctccaccaattttacatttacagaaagatcaaggttctgttcattccaatgctatatcacctgcaaatggcagtccagttcctcatatgagcacccctcctggacctcctgtttttacatcacctgtacgtccggctgctgttccttttcgaacatcacccgcttcgcctcagccgcctgctctttctactgcatcttctttgccaacatcatcgtccccgctttactcaaatggatcgtttgacttgcagtcacaagtttctggtggcatagaggatcacattccacttggggagtcgtcttcctttgtacttttttcagctcataaggtattgaagcagaagaaacaagctaatgtgcctagtttgggttttggggcattggtctctcctggtagggaggtctcaacaggtccccaggtaatacagcgtgatccccatcgctgtcaaagctgtggggcatatgcaaatatatattgcaatatattgcttggatcaggccagtggcagtgtgttatttgtcggaaactgaatggaagtgatggtgagtacattgcacatagcaaggaagatcttcacagatttccagaattatcttcaccgatggttgactttgttcaaactgggaccaagagacctggttatgttccagtttcagattccagaatgtctgcaccagtagttcttgtaatagatgaaagtttagatgaacctcacttacaccatcttcagagctctttgcatgcatttgttgattctctccctccaacaacaagattaggaattatactgtatggccgtactgtatcagtgtatgacttttcagaagagtcagttgcatctgctgatgtgcttcccggggacaagtcgccaagtcaagattctttgaaggctttgatttatggtaccggtatatatttgtcaccaatgcatgcttcactggctgtagcgcattccatattttcatcattgaggccatataagttgaacgtaccagaagcttccagagatcggtgcctaggaactgctgttgaggttgctctcgctataattcagggcccatctgccgatctgtcccgaggggtagtcaaaagatcagggggtaatagtagaattattgtctgtgccggtggtccaaacacttatgggcctggatctgttcctcattcttttaaccaccctaattatccatatatggaaaagacagcattaaaatggatggagaatttaggtcgtgaggctcaccgacacaatatattggttgatattttatgtgctggaacatgccctgtaagagttcctatcttacatcctcttgcaaaagcatcaggtggtgttttggttcttcacgatgattttggagaagccttcggcgttaatttacaaagggcatctgccagatcagcaggctcccatggattgttagaattgcggacatcagatgatattctcattacgcaagttgtgggtccgggggaagagtcgcacgtagacacccatgaaacatttaaaaatgacaccgctctttatattcaaatgctaagtgttgaagagacacagagcttctctctctccatggaaaccaaaggagatatcaaaggcgattttgttttttccagtttgcaattcagtattcaaatgtgtatcaggcggatgtctcaagggtcattactgttagattgccaacagtagatagtgtttcgggatatcttgagagtgttcaggatgaagtggctgctgtcctcattgcaaagagaactctgttacgagccaaaaaccattctgttgctgttgatatgcgggcaacaatagatgaaagaatcaaagatattggtctaaaatttggctctcaattacccaaatcaaaacttcattgcttcccaaaggagctgtctctcttaccggagctccttttccatctcaggagaggcccactattgggatgcattattggccatgaagatgagaggtctgtgctgaggaacctgtttctaaatgcatcctttgatctatcgcttagaatggtggctccacgttgcctaatgcacagggaggggggaacttttgaggagctaccagcttatgatcttgctatgcagtctgatactgctgttgtacttgaccatggcactgatgtcttcatttggctgggtgctgaacttgtagctgatgaaggaaaaagtgctgctgctttggctgcatgcaggacattggctgaagaattgaccgaattccgttttccagctcctcgtatcctagcattcaaggagggtagctcgcaggctcgatattttgtgtcgcgtctcataccagctcacaaggatcctccttatgagcaggaggcacggttcccacaactaagaacattaacatcagaacagagaacaaagctaaaaagcaattttgttcacttcgacgatccaagtttctgtgaatggatgcgaagtttgaaggtcgtaccaccgcaaccgagctgatgaccggtaatctgcggtcgcgcatggtttgatttattaaaccctgaaaaggtcttggtgaagccaagtttgtttgcatcttttgtggaatagatacatagagtgaaatcttgcagatgtcccaaaactcttgttgatttggagcctctcccattcattttgagaaacctccataaaagtgcaagttgcacttggaaaaaatgtttttcttttgtttttttttatttgagaatgtccttcggcagaaattttcacagtttacatgatgtcagttaatgttaccatagagcaataaaggatttctctttatttatattttttaata

SEQ ID NO: 4396 - DNA, 3820 bp, Cicer arietinum
atttatttaggtctatatcgatattagttggcacatagaagcgcttccgtggttgaagagtcctcaatggtagtgacgcagtgacgtggttttgggtgatggaagtcacgtgagaaccctggtggcatcttgagaagctgtcataggcagaaacacgccagctaggaaatacaaagggcgaaatacatgaattaatgtagaaaaaaaaaaaccgaggtttgagttgaggaatttatttgtttcagtgcgtgtgtggtccgttgttttctcttttgttcgtcttaataaccttttttatctcaattgtaaaattggattagagtgaggaggggacacaacattatagcacaacacaatagtaggattttgattttccatcttccaaccgatccctattcccattcattcattcattagtcggaatcaacaagagtcaacaattttcaccatcattctttctttttcatatcctcaaccttattagcactttctcgtctctctctcagatgggatctctctgattacttggctatccacctaattttgttcaggaattccaattcccggccggaggtttcaacaaattctgtggagtaaagttagaatctttgataaatatattttcttgatcgtcattgctgtaaattttgtaaccttttattatctcctgatacttgatactgggtttgtgtttggttgtgaagtgatcttttttttgcgttaccttgattttcaatggctaataataacccaacacaacctaatgttgggttcatcccttcaaacccagaacatagacagagtccaactccaaaccctgacaagactccaattcctccacctccaagttttgcagcagtgcctagatttcctccaccaatattacatttgcagaaagatcaagctacgccccattccaatggcagtccagttcctcacttgagcacacctcctggacctcctgtttttactacgcctgtccgtccggctgctgttccttttcgaacttcgcctgcttcgcctcagccacttgctctttcttcggcctcttctttgccaacttcatcgccgcctcattacacaaatagatcatctgacttgcagccacaagtttctgatagcatagaggatcacatttcacttggggagtcatcctttgtacttttttcagctcacaaggttttgaagcagaagaaacaagctaatgtacccagtttgggttttggggcattggtctctcctgggagggaagtctcaacaggcccacaggtaatacagcgtgatccccatcgctgccaaagctgtggggcatatgcaaatatatattgcaacatattgcttggatcaggccagtggcagtgtgttatttgtcgaaaactaaatggaagtgacggtgagtatgttgcacatagcaaggaagatcttcataggtttcctgaactatcttcaccaatggttgactttgttcaaactgggaacaagagacctggatttgttccagtttcagattccagaatgtctgccccagtagttcttgtaatagatgaatgtttagacgaacctcacttacaacaccttcagagctctttgcatgcatttgttgattctctccctccaacaacaagattaggaattatactatatggccgtactgtatcagtgtacgatttttcagaagatttagttgcatctgctgatgtgcttcccggggagaagtcactgagtcaagaatctctgaaatttttgatttatggtaccggtatttatttgtctccaatgcacgcttctttggccgtagcgcattccatattttcatcgttgaggccatataagttgaacatgccagaagcttccagagatcggtgcctaggaactgctgttgagattgctcttgctataattcagggtccgtcagctgatctgtcccgaggggtagtcaaaaggccagggggcaatagtagaattattgtttgtgctggtggaccgaacacttacgggcctggatccgttcctcattcttttaatcaccctaattatccttatatggaaaagacagcattaaaatggatggagaatttaggtcgcgaggctcatcgacacaatactgtgattgatattttatgtgctggaacctgccctgtaagagttcctattctacatcctcttgcaaaagcatcgggtggagttttggttcttcacgatgatttcggagaagcctttggcgttaatttgcaaagggcatctgccagatcagcaggctcccatggattgttagaattgcgcacatcagatgatattctcattactcaagttgtgggtccaggggaagagtcacatgtagacacccatgaatcatttaaacatgacaccgctctttatattcaaatgctgagtgttgaagagacacagagcttctctctctccatggaaaccaaaggagatatcaaaagtgattttgtctttttccagtttgcaattcagtattcaaatgtgtatcaggctgatgtctcgagggtcattactgttagattgccaacagtagatagcgtttcaggatatctcgagagtgttcaggatgaagtggccgctgtcctcattgcaaagagaactttattacgagccaaaagccattccgttgctgttgatatgcgatcaacaatagatgaaagaatcaaggatattggactaaaatttggctcccaattacccaaatcaaaacttcattgcttcccgaaggagctttctctcttaccggagctactcttccatctcaggagagggccgctattgggatgcattattggccatgaagatgagaggtctgtgctgaggaacctgtttctaaatgcatcctttgatctatcgctcagaatggtggcgccacgttgtctaatgcacagggaggggggaacttttgaggagctaccggcttatgatcttgctatgcagtctgatactgctgttgtacttgaccatggtaccgatgtcttcatttggctgggtgctgaacttgtagctgatgaaggaaaaagtgctgctgctttggctgcatgcaggacattggccgaagagctgaccgaattccgttttccagctcctcggatccttgcattcaaggagggtagctctcaagctcgatactttgtctcacgtctcataccagctcataaggatcctccttatgaacaggaggcaaggttcccacaacttagggcattaacatcagaacagagaacaaagctgaaaagcagctttgttcactttgatgatccgagtttctgcgaatggatgcgaagtttgaaggtcgtgccacctcaaccgagttgattacctggaagtagtctgctttaggtgttttggtggtttgatttataagctcctgaaaaggtccaagtttgtttgcatcttttgtggaatagatacatacagtgaaatcttgcagatgtcccaaaactcttgattcggagtctctcccattcattttgttcacttcttagaaacgaccacaaaggtgcaagttgcacttgaaaaatgtttttgttttgtttttgttttatttggggatgttcttcggccgaaattttcacaatttacatgacatcagttaatatgttaccatagagcaataaaggatttctctttatttatatttatagcaattgtttgttgccattttttccgttgtagctctgatttatggctatttgcaatattgcataccaatatctataaatataaagttgtataccacagtagtcacctcttaactagtaagtactcgattcaattgttttttcaactagaaaattttcaattttaa

SEQ ID NO: 4397 - DNA, 2926 bp, Trifolium pratense
ttttgagttatcttgattttcaatggctaataacccaacacaacctaatgttgggttcatcccttcaaacccagaacaagaacaagatagacaaactccaattcatcctcctccacctcctccaacttttgcagcaccacctagatttcctccaccaattttacatttacagaaagatcaaggttctattcattctgcaaatggcagtccagttcctcacttgagcacccctcctggacctcctgtctttacatcacctgtccgtccggccgctgttccttttcgaacatcacccgttttgcctcagccgcctgctctttctactgcatcttctttgccaacctcatcgtccccctcttactcaaatggatcgctcgacttgcagtcacaaccttctggtggattagaggatcacattccacttggggagtcatcatcctttgtactgttttcagctcataaggtattgaagcagaagaaacaagctaatgtgcccagtttgggtttcggggcattggtctctcctgggagggaggtctcaacaggtccccaggtaatacagcgtgatccccatcgctgtcaaagctgtggggcatatgcaaatatatattgcaatatattgcttggatcaggccagtggcagtgtgttatttgtcgaaaactgaatggaagtgatggtgagtacattgcacatagcaaggaagatcttcacagatttccagaattatcctcaccaatggttgactttgttcaaactgggaccaagagacctggttatgttccagtttcagattccagaatgtctgcgccagtagttcttgtaatagatgaatgtttagatgaacctcacttacaccatcttcagagctcgttgcatgcatttgttgattctctccctccaacaacaagattaggaattatactatacggccgtactgtatcagtgtatgacttttcagaagagtcagttgcatctgccgatgtgcttcccggggacaagtcaccaagtcaagattctttgaaggctttgatttatggtaccggtatatatttgtcaccaatgcatgcttcactggctgtagcgcattctatattttcatcattgagaccatataagttgaatgtaccagaagcttccagagatcggtgcctaggaactgctgttgaggttgctctcgctataattcagggcccatctgccgatctgtcccgaggggtagtcaaaagatcagggggtaatagtagaattattgtctgtgctggtggtccaaacacttatgggcctggatctgttcctcattcttttaaccaccctaattatccatatatggaaaagacagcattaaaatggatggagaatttaggtcgcgaggctcatcgacacaatatattggttgatattttatgtgctggaacatgccctgtaagagttcctatcttacatcctcttgcaaaagcatcaggtggtgttttggttcttcacgatgattttggagaagccttcggcgttaatttacaaagggcatctgccagatcagcaggctcccatggattgttagaattgcggacatcagatgatattctcattacgcaagttgtgggtccgggggaagagtcgcatgtagacacccatgaaacatttaaaaacgataccgctctttatattcaaatgctaagtgttgaagagacacagagcttctctctctccatggaaaccaaaggagatatcaaaggcgattttgttttttccagtttgcaattcagtattcaaatgtgtatcaggcggatgtctcaagggtcattactgtaagattgccaacagtagatagtatttcgggatatcttgagagtgttcaagatgaagtggctgcggtcctcattgcaaagagaactcttttacgagccaaaaaccattctgttgctgttgatatgcgggcaacaatagatgaaagaatcaaagatattggtctaaaatttggctctcaattacccaaatcaaaacttcattgcttcccaaaggagctgtctctcttaccggagctccttttccatctcaggagaggcccactattgggatgcattattggccatgaagatgagaggtctgtgttgaggaacctgtttctaaatgcatcctttgatctatcgctcagaatggtggctccacgttgtctaatgcacagggagggtggaacttttgaggagctaccggcttatgatcttgctatgcaatctgatactgctgttgtacttgaccatggcactgatgtcttcatttggctgggtgctgaacttgtatatgatgaaggaaaaagtgccgctgctttggctgcatgcaggacattggctgaagaactgactgaattccgttttccagctcctcgtatcctagcattcaaggagggtagctcgcaggctcgatattttgtgtcgcgtctcataccagctcacaaggatcctccttatgagcaggaggcaaggtttccacaactacgaacattaacatcagaacaaagaacaaagctgaaaagcagttttgttcacttcgacgatccaagtttctgtgaatggatgcgaagtttaaaggtcgtacccccgcaaccgagctgatgagaccgattgtctacagtggcatggtttgatttattaaacccggaaaaaggtcttggtgaagccaagtttgtttgcatcttttgtggaatagatacatagagtgaaaccttgcagatgttccaaaactcttgttgattcggagcctctcccattcattttgagaaacctccataaaggtgcaagttgcacttagaaaaaatgtttttcttttgtttttttggtttttttatttgaggatatccttcggcagaaattttcacagtttacatgatgtcagttaatgttaccatagagcaataaaggatttctcttt

SEQ ID NO: 4398 - DNA, 3336 bp, Medicago truncatula
gttctgtttcaccgcgtgtgtgtttttcttttctcaaaacaattggagaattttggagtaacgggacagaagaacacaacatagtagtttgtatttttcatcctcttccccgatccctcttccccattcatctttcttctttctctctcaggtatgaattccaattccaccggtggggtttcaacaggtctctgcaaattctttggactcaagttacaatctttaaataaatatattttcttgacaatcttgactcctcccaatcgccaatgctgtaaattttttaactttttacataatctcattctgggtttgattgcttgtaattgttttattgcgttaccttaaccttttcaatgtctaataacccaacacaacctaatgttgggttcatcccatcaaacccagaacaaaaacagactccaattccaattcttccccctcctccgcctccttcaactagtattttagcaccaccacctagatttcctccaccaatattacaactacagaaagatcatacttcatctgccaatggcagtccagttcctcacttgagtacccctcctggacctcctgtatttacatctcctgtccgtccagctgccattccttttcgaacttcacccgcttcgcctcagccgcctgctcgttcctcagcctcttctttgccaacctcgtcgccaccacgttactcaaatggatcttttgacttacagtcacaagtgtctggtggcttagaggatcatattccaaatggagagtcatcctttgtacttttctcagctcataaggtattgaagcagaagaaacaagcaaatgtacccagtttgggttttggggctttggtctctcctggtagggaggtctcaactggcccccaggtaatacagcgtgatccccatcgctgtcaaagctgtggggcatatgcaaatatatactgcaacatattgcttggatcaggccagtggcagtgtgttatatgtcgaaaactgaatgcaagtgacggtgagtacattgcacatagcaaagaagatcttcacagatttccagaactgtcttcaccaatggttgactatgttcaaactgggaccaagcgacctggttttgttccagtttcagattccagaatgtctgcaccagtagttcttgtaatagatgaatgtctagatgaacctcacttacagcatcttcagagctctttgcatgcatttgttgattctctgcctccaacaacaagattaggaattatattatatggccgtactgtgtcggtgtacgactttttagaagaatcagttgcatctgctgatgtgcttcctggggacaagtcgccaagtgaagattctttgaaggctttgctttatggtaccggtatatatttgtcgccaatgcatgcttcactggctgtagcgcattcaatattttcatcattgacgccgtataagttgaacgtaccagaagcttccagagatcggtgcctaggaactgctgttgaagttgctcttgctataattcagggcccatctgctgatctgtctcgaggggttgtcaaaaggtcagggggcaatagtagaattattgtctgtgccggtggaccgaacacttacgggcctggatctgttcctcattcttttaaccaccctaattatccgtatatggaaaagacagcattgaaatggatggagaatttaggtcgtgaggctcatcgacacaatatattggttgatatattatgtgctggaacatgccctgtaagagttcctatcttaaatcctcttgcaaaagcatcaggtggagttttggttcttcatgatgattttggagaagcctttggcgttaatttacaaagggcgtctgccagatcggcaggctcccatggactgttagaattgcgcacatcagatgatattctcatcactcaagttgtgggtccgggggaagagtcacatgtagacacccatgaaacatttaaaaacgacgccgctctttatattcaaatgctaagtgttgaagagacacagagcttcgctctctctatggaaaccaaaggagacatcaaaagcgattttgtctttttccagtttgcaattcagtattcaaatgtgtatcaggctgatgtctcaagggtcgttactgttagattgccaacagtagatagtgtttcgggatatcttgaaagtgttcaggatgaagtggctgctgtcctcattgcaaagagaactttgttacgagctaagaaccattcagttgctgttgatatgcgggcaacaatagatgaaagaatcaaggatattggcctaaaatttggctcccaattacccaaatcaaaacttcattgcttcccaaaggagctttctctcttaccggagctccttttccatctcaggagagggccactattgggatgcattattggccatgaagatgagaggtccgtgctgaggaacctatttctaaatgcatcttttgatctatctctcagaatggtggctcctcgttgtctaatgcacagggaggggggaacttttgaagagctaccggcttatgatcttgccatgcagtccgatactgctgttgtacttgatcatggaactgatgtcttcatttggctgggtgctgaacttgtagccaatgaaggaaaaagtgcttctgctttggctgcatgcaggacattggctgaagagctgaccgagttccgttttccagctcctcgtatccttgcattcaaggagggtagctcgcaggctcgatattttgtctctcgtctcataccagcacacaaggatcctccttatgagcaggaggcaaggttccctcaacttaggacattaacatcggaacagagaacaaagctgaaaagcagttttgttcacttcgacgatccaagtttctgtgaatggatgcgaagtttgaaggtcgtaccacctcaaccaagttgatgaacccggtagtcttctgcattaggtgatttggtggtttaatttataaaatcctaaaaagatcttggtgaagccaagtttgtttggcatgttttgtggaatagatacatacagtgaaatgtcgcatatgtcacaaaaactctcaaattcggagcctctcccattcattttgttcacttttgaaaaacgttcataaaggtgcaagttgcacttgaaaaaaaaaatgtttttctttgttttttggttttattattcgaagatgtccatcggcagaagttgatatgttatcatagagcaataaaggatttctctttatttatatttatagcatttgttgattgccatttttcacttatctctttggtcatggtctcatggaaactgtttcgaaaat

SEQ ID NO: 4399 - DNA, 3348 bp, Lupinus angustifolius
aaaagtaataatagtaataacaagaacattttcccaaattgaaagtggcatgacataaaatgataaaatctccattcattctttctttcttgtgagtttctctcagtgggtaactgagaatattcaatttttgaagagtttggttgatttatatcatttcttgtcactcttgaatttcaatcacatccccagaatcaattttacctataaaactgtacaaaattgtgtaaagtttaaatctttgatactgggtttataagggggactttactttcaataaagtttaattctttgatactgggtttataaagggactttactttcaatttcaatggctaacccaacacaacctaatgttgggttcacctcttcaaacacccaagaaagacagggtccaactcttcctaaccctgacaacaagactccaattctacctcctccaagttttgtaacaccacctaggtttcctccaccaacattacatttacaaaagcaagatcaagcctcaaatgttttgtcgccagccaatgacggggttattaaaactggtagtggtcatgttcctcatttgagtacccctcctggacctcctgtttttacctcacctgttcgtcccgctgctgttccatttcgcacgtcccctgcatcgcctcagccagttgccttttcttctggcccatctttaccatcattgtcacagccgcaattttcaaatggttcggatgagttgcagcagcaccgagattctgatagtataatacaagaccatgtccctgctgaagactcatcctttgttcttttctcagcacataaggtattgaaacagaagaaacaagctaatgtacccagtttaggttttggggcattgctctctcctgggagggagatctcgaccggaccacaagtaatacagcgtgatccccatcgctgccaaatttgtggtgcttatgcaaatatctattccaatatattgcttggatcaggccagtggcagtgtgttatatgtcggaaactgaatggaagtggtggtgagtacattgcgtataacaaggaagagcttcacagatttcctgaactatcttcacccatggttgactatgttcaaactgggaacaaggggcctagttttgttcctgtttcggattccagaatgtctgccccagttgttcttgttatagatgaatgtttagatgaaccccacttgcagcatctacagagctctttgcatgcttttgttgattctctccctccaacaacaagattaggaattgtactatatggccgtactgtatcagtatatgacttttcagaggagtcagttgcatctgctgatgtgcttcccggggacaagtcaccaagtcaagaatctttgaaagcattgatttatggtactggcatatacttgtcaccaatgcatgcttcactgcctgtagcacattccatattttcatcattgagggcatacaagttgaacataccagaagcttccagagataggtgcctaggaactgctgttgaggttgctcttgctataattcagggcccatcagctgatctgtcccgagggatagtcaaaaggttagggggaaatagtagaattattgtctgtgccggtggaccaaacacttatggtcctggatctgttccacattcttttagtcaccctaattatccttatatggaaaagacagcattaaaatggatggagaatctaggtcgtgaggctcatcgacacaatactgtggtagatattttatgtgctggaacatgccctgtgagaattcctatcttacagcctcttgcaaaagcatccggtggagttttggttcttcatgatgattttggggaagcgtttggtgttaatttgcaaagggcatctgctagatcagctggctctcttggtttgttagaattgcgaacatcagatgatattctcataactcaagttgtgggtcccggggaagagtcacatgtagacacccatgaatcatttaaaaatgacactgctctttatattcaaatgctgagtgttgaagaaacacagtgcttctctatctccatggaaactaaaggagatattaaaagggattctgtctttttccagtttgcaattcagtattcaaatgtttataaagccgatgtgtcaagggtcgtcactgttagactgccaacggtagatagtatttcaggatatctgcagagtgttcaggatgaagtggccgctgtcctcattgcaaagaaaactctgttacgggccaaaaaccattccgatgcaattgatatgcgagcaacaatagatgaaagaatcaaggatattgctctaaaatttggatcccaattacccaaatcaaaacttcatcgcttcccaaaagagatttctctcttaccggaactccttttccatctcaggagaggaccactattgggaagcattattggccacgaagatgaaaggtctgtgctgaggaacctgtttctgaatgcatcctttgatctatcacttcgaatgttggctcctcgttgtctgatgcacagggaggggggaacttttgaggagctaccggcttatgatcttgctatgcagtctgatgctgctgtagtacttgaccatggcactgatgtcttcatttggctgggttctgaagttgcagctgatgaaggaagaagtgctgctgctttagctgcttgccggacattggcagaagagttgaccgagttccgttttccagctcctcgtatccttgcatttaaggagggtagctcccaggctcgatactttgtctctcgtctcataccagcacataaggatcctccttatgaacaggaagcgagattcccacaacttaggtcattgacacaagaaaagcggacgaagctgaaaagcagttttgttcactttgacgatcctagtttctgcgagtggatgcgaagtttgaaagtggtgccaccggaaccacgctgatcaactctgctttggcggtggtcgattttacaccctttgtacaaggttgttgcatctttcaatcagcaagtgactggacatgtttgtttgccttattttttatgtttacttgggaaaacaaccaattttgttttgatgatgtttcacatgtgacatgtccctaaaactcttgcttcaatgtctgaatccattgattttgttcacttcccagaatagttatatgcaattgcaagttgcatttggagaaaaatagtgggactactcttgtttttttgtgtggaagaggcacataaaagttttgcaatttacatggtgttaaaactataccttagagtaataaagaatttgtcataataatttatcatatttgttatagcagatattga

SEQ ID NO: 4400 - DNA, 3338 bp, Trigonella foenum-graecum
gtgtaaaaaaccccatcctctcaattggagcgagtgagagtggagggaacaagaaatcacagtattattttcccatcttccccgatccctattttccccttttcatccttctttcttgtttcgagtctctctctctctcccaggaatttccaattccagtgaggtttctgcaaattctatggactcaagtcacaatctttgaataaatatattttcttgacaatcttgattttttatcacttccccatcgccaatgctgtaaattttctaactttttggatatttgattctgggtttgtttgttttgttgtaagtgttttattgcattaccttaatttccaatggctaataacccaacacaacctaatgttgggttcatcccttcaaacccagaacaaaaacagactccaattccaattcatcctccccctcctcctccttcaactagtagtattttagcaccaccacctagatttcctccacccatattacaattacagaaagatcaagctgccaatggtgctgttgcaactggcagtccagttcctcacttgagcacccctcctggacctcctgtctttacatcacctgtccgtccagctgctgttccttttcgaacttcacccgcttcgcctcagccacctgctctttcttcagcctcttctttgccaacgtcatcgccgcctcattactcaaatggatcatttgatttacaacaaatttccggtggcacagaggataatattccaattggagagtcatcctttgtacttttttcagctcataaggtattgaagcagaagaaacaagctaatgtacccagtttggggtttggggcgttggtctctcctgggagggaggtctcaaccggcccccaggtagtacagcgtgatccccatcgctgtcaaagctgtggggcatatgcaaataaatattgcaacatattgcttggatcaggccagtggcagtgtgttatatgtcgaaaattgaatggaagtgatggtgagtacattgcgcatagcaaggaagatcttcacagatttccagaactatcttcaccaatggttgactttgttcaaactgggaccaagagacctggttttgttccagtttcagattccagaatgtctgcaccagtagttcttgtaatagatgaatgtttagatgaacctcacttacagcatcttcagagctctttgcatgcatttgttgattctctccctccaacaacaagattaggaattatattatatggccgtactgtgtcagtgtatgactttttagaagaatcagttgcatctgctgatgtgctttccggggacaagtcgccaagtgaagattctttgaaagctttgctttatggtaccggtatatatttgtcaccaatgcatgcttcactggctgtagcgcattccatattttcatcattgaccccgtataagttgaacgtaccagaagcttccagagatcggtgcctaggaactgctgttgaggtcgctctggctataattcagggcccatctgctgatctgtctcgaggggttgtcaaaagatcagggggcaatagtagaattattgtctgtgccggtggaccaaacacttatgggcctggatctgttcctcattcttttaaccaccctaattatccgtatatggaaaagacagcattgaaatggatggagaatttaggtcgtgaggctcatcgacacaatattttggttgatatattatgtgctggaacatgccctgtaagagttcctatcttacatcctcttgcaaaagcatcaggtggagttttggttcttcatgatgattttggagaagcctttggcgttaatttacaaagggcatctgccagatcggcaggttcccatggattgttagaattgcgcacatcagacgatattctcatcactcaagttgtgggaccaggggaagagtcacatgtagacacccatgaaacatttaaaaacgacactgctctttatattcaaatgctaagtgttgaagagacacagagcttcgctctctctatggaaaccaaaggagacatcaaaagcgattttgtctttttccagtttgcaattcagtattcaaatgtgtatcaggctgatgtgtcaagggtagttactgttagattgccaacagtagatagtgtttcaggatatcttgagagtgttcaggatgaagtggctgccgtcctcattgcaaagagaactctgttacgagccaagaaccaatcagttgctgttgatatgcgggcaacgctagatgaaagaatcaaggatattggtctaaaatttggctcccaattacccaaatcaaaacttcgttgcttcccaaaggagctttctctcttaccggagctccttttccatctcaggagagggccactattgggatgcattattggccatgaagatgagaggtccgtgctgaggaacctgtttctaaatgcatcttttgatctgtctctcagaatggtggctcctcgctgtctaatgcacagggaggggggaacttttgaggaactaccggcttatgatcttgccatgcagtctgatactgctgttgtacttgaccatggcactgatgtcttcatttggctgggtgctgaacttgtagctgatgaaggaaaaagtgcttctgctttggctgcatgcaggacattggctgaagagctgaccgagttccgttttccagctcctcgtatccttgcattcaaggagggtagctcgcaggctcgatattttgtctctcgtctcataccagctcacaaggatcctccttatgagcaggaggcaaggttcccacaacttaggacattaacatcagaacagagaacaaagctgaaaagcagttttgttcacttcgacgatccaagtttctgtgaatggatgcgaagtttgaaggtcgtaccacctcaaccgagttgatgaccggtagtcttctgctttaggtgatttggtggtttaatttataaaaccctgaaaaggtcttggtgaagccaagtttgtttgcatcttttgtggaatagatacatacagttaaatcttgcagatgtcccaaaacccttgattcggagccgcctctcccattcattttgtttacttttgaaaaacgttcgtaaagaaacatgtttttcatttgctttttggtttttttatttggggatgtcattcatgtccatcggcagaagttgatatgttacaatagagcaataaaggatttctatttatttatatttatagtacttgttgatggtcatttttcttttatctcttagtcatggtctcatggaaaatgtttcgacaatgatttggtttgtaaccgatttc

SEQ ID NO: 4401 - DNA, 2756 bp, Prunus persica
tgtcgaatctttgatggctaatccacggcagccttccattggatactctgtctctatcactccctcacacccagacacaacatcgcctgaccccgagaaaatttccatacctccaccaactttaattacaccaggagctcccagatttcctctgccaaggtttcaacaggatcaagctccttctccatcactcaaaaccccaaatgcatcatcaccagctaatgggttgaaaactggcagccctattcctcatttgagtactccacctggacctcctgtctttacttcccctgtccggcctgctgctgtgccttttcgtgcttcacctgcaactcctcagccagttgctttctccccgggctcatctttgccaacatcttcgcccctcaatttttcaaatgggtcacatgagttgcagcatgaactttctaatgttacagaggatgatatagcgtctgttggagaatcaccatatgtcctattctcagctcataaggtgttgaaacagaagaaacaagcaaatatacccagtttgggttttggggcattggtttcacctggaagggagatttcaccagctcctcagataatacaacgtgatcctcatcgctgccacagttgcggagcttatgcaaatatctactgcaatatcttactaggctcaggtcagtggcagtgtgtaatttgccgagagctgaatggaagtgagggcgaatacatagctcccagcaaggaagatctttgtaattttccagagttgtcatctcccatggttgattatgttcaaactgggaacaatagacccggttttatcccagtttctgattcaagaatgtctgcacctattgttcttgtcatagatgagtgtttggatgaaccacatctctgggatttacaaagctccttgcatgcttttgtcgattcacttcccccaacaacaagaattggaataatactctatggtcgcacagtatcagtttatgatttttcagaggaatcgattgcatctgctgatgtgcttccaggagagacatcaccaagtcaggattccttgaaggcattgatatatggaacgggtatatacttgtctccaatgcatgcttcactgcccgtagcacatgccatattttcatcattgaggccatacaaattgaagattccagaagcttctagagatcggtgcctgggcacggcagtcgaggttgctcttgctatagttcaagggccatcaggagaaatgtctcgaggagtaattaaaaggtctggaggtaatagcagaatcattgtttgtgctggtggccctaatacatatggtcctggatctgttcctcattctttcagtcacccaaattatcctcatatggaaaagactgctttgaaatggatggagcatctgggtcacgaggcacaccgacacaatacagtagttgacattctatgcgctgggacatgccctgtaagagtacctattttgcaacctcttgcaaaagcttctgggggcgtttttgttctccatgatgactttggggaagcctttggtgtgaacttgcaaagggcatctaccagggcagcaggctcccgtgggttcttggcaatacgttgttccgatgatattctcataactcaagtcgtgggtcctggtgaagaggcacatatggacactcatgaaaccttcaaaaatgacacttctctttacatacaaatgcttagtgttgaagagacacagagcttctcgctctccttggaaaataagagggacattatgactgagtatgtgtacttccagtttacaatacagtatttaaatgtgtatcaagcggatatatcaagagtaattactattagattgccaacagttgatagtgtttcagcatatcttgcaagtgttcaagatgaagtggcagcagttcttattgcgaagaggactctcttgcgagctaaaaattattctgatgcaattgatatgcgagcaacaatagatgaaagaattaaagatattgctctgaaatttggttctcaagcaccaaagtcaaagcattatcggtttccaaaggaggtctctttattgccagagctcctgtttcatctaagaagaggcccacttttgggaagtattgttggccatgaagatgagagatctgtattgcggaacttgtttttaaatgcatcctttgatctctcactccgaatagtagcgcctcgttgtctaatgcatcgggaagggggaacatttgaggaactgccagcttatgaccttgctatgcagtcagatgcagcagttgttcttgatcatggcacagatgtcttcatttggttgggtgctgaacttgctgctgatgaaggaaaaagtgcagctgcattagcggcttgcaggacattagctgaagagctcaccgagttgcggtttccagctcctcggatcctttcattcaaggaaggaagctctcaggctcgatattttgtatcgcggctcataccggcacacaaggatcctccttatgagcaggaggcaagattcccgcagctacgaactttgacaacagaacagcggacaaagctgaaaagcagctttctcaattttgacgagcctagcttctgtgagtgggtacgaagcttgagagtggtgcctccagaaccaagctaggtgatctttactttgttaaacttgttggcataatgcggcttcaagaatgtagcgttgggagttgtatcagaggaaattgtggcaaaggaatttttcttcttcttctttcgtt

SEQ ID NO: 4402 - DNA, 3106 bp, Quercus alba
gtgctttgtacttgtttctttatcatctttagattgagattggtgcaattcactgaattttcctgcatgctcaaagtactgcctttgtatcttctttctaggactctgtttgggattgaattgtttgtggtttgccataaagtctggttcttgattctgtgtcctttttattgctcagttttcaataaagatagctttgaatttcaatggcaaatccaccaccaccttcacttggatactctgtctctatcactccctcaaacccggacatatcgaatccccacagtgagagaaatccaattcttcctcctcctcctccaccatcgaattcccctacaccgcccagatttcctccaccaaaattacaacaagatcagattccttcgtcttcaataaaaagccccaatgtaccatctccgtccaatggtgtcaaaatgggaagtcccattcctcacttaagcactccccctggaccccctgtctttacttcgcctgtccgtcctgctgctgtgcctttccgctcttcacctgcatctcctcagccagttgcattctcttcgggctcgtcattgccaacatcttcacctccccaattttcaaatggatcagttgagttgcagcaacaagtttctgatgatacgctggacttgacgccagctggggattcagcatatgttctattttcagctcatagggtattgaagcaaaagaagctagcaaacgtacctagtttaggttttggggcacttgtttctcctggcagggagatttcatcaggtcctcaagtaatacaacatgatccccatcgctgccaaagttgtggagcctatgtaaatttctactgcaaaatattaattggctcaggccagtggcagtgtgtaatatgccatgaactgaatggaagccagggtgaatatatagctcccaacaaggaacttcttcgtacctttccagaactgtcatcacctatggttgactatattcaaactagtaacaatagacctggttttattccagtttccgattcaagaatgtctgcacctattgttcttgtcatagatgagtgcttagatgaaccgcaccttcagcacttacagagctccctacatgcatttgtcgattcacttcacccgtcaacaaaattaggaattgtttcctatggccgtacggtatcagtgtatgatttttcggaggagtcggttgcatctgctgatgttcttcctggtgacaaatcaccaactcaggagcaactgaaagcattgatttacggaagtggcatatacttgtcacaaatgcatgcttcactacctgtagcacacgccatattctcatcaatgagaccatacaaattgaactttccagaagcttctagagaccggtgcttgggtacagcagttgaggttgctcttgcaataattcaagggccatcagcagaattgtctcgaggggtagttaagaggtcaggtggaaatagcaggattattgtgtgcgctggtggacctaatacttatggccctggatctgttcctcattcatttagtcacccaaattatcctcatatggaaaagatggcattgaaatggatggagcaactaggtcaggaggctcatcgacacaatacagtggttgacattctatgtgctggaacatgccctgttagagttcctgtgttgcagcctcttgcaaaagcttctgggggagttttggttcttcatgatgactttggagaagcctttggcgtaaacttacaaagggcatctagcagggcagtaggttcccatggtttgttggaaatacggtgttctgatgatattcttataactcaagttgtgggtcctggtgaagaggctcatttagatactcatgaaacttatacgaatgactcttctctatatattcagatgcttagtgttgaagaaacgcagagcttctcagtctccatggaaactaaaagagatattaagagggattatgtattttttcagtttgcagttcagttttcaaatatgtttcaagctgatatatccagagtaattactgttagattgcctactgtggatagtgtttcagcatatcttgagagtgttcaagatgaagtggcagcagttcttattgccaagaggaccctcttgcgagccaaaaactcttctgatgcagttgatatgcgaacaacaatagatgaaagagttaaagacattgctttaaaatttgggtcccaaataccaaagtcaaagctttatcggttccccaaagagctctctttattaccagagctcttattccatctcagaaggggcccacttttgggaagtattattggtcatgaagatgagaggtctgtattgcggtatttgtttttgaatgcatcatttgatctttcacttcgtatggtagcgcctcgttgtctaatgcaccgggaaaagggaactttcgaagagctgcccgctcatgaccttgctatgcagtcagatgcagcagttgttcttgaccatggcacagacgtcttcatttggttgggtgctgaacttgctgctgacgaaggaagaagtgcatctgctctggcagcttgcagaacattggctgaagagataactgaattgcgatttcctgctcctcgtatccttgctttcaaggaggggagctctcaggctcggtattttgtttctcgactcatacctgcccataaggatcctccatacgagcaggaagcgagatttccccagcttcgtagtctgacaacagaacagcgaatgaagctgaaaagcaattttcttcactttgacgatcctagcttctgtgagtggatgcgaagtttgaaatcagtgccaccagaaccaagctaagaagaaagggagtctgaatcgtttcatcatttcatcaccaatgggaaactttgtcatgtccctttttttaaaattttttctcactgttaaaattaatgtagttggtaatggtgatcagattgattacatctcatattcttcgtgtccacccctggaatttttgatttaaaaaaaaacatttatagttagaagagttcaagatcattctcattcagtttctcaattgtaatgctaagacagagtaataaagatttatttcttga

SEQ ID NO: 4403 - DNA, 4259 bp, Prunus mume
caaaaatcgtaaggtaaaaatctttaccgcaaatggtttccaaatttccatgtccaaatcctcctaaaacgtaaaacgtaaaacgtatatataagaagaaaaaaagattaagaaaaacacggggcaaaggccaagaaggacagaaaagaaagcttcttcaagtcaagagggtctttgatttttctgtgtttcaaaaaaaaaaaaaaaaaaaaaaaaaaaagcctcagattctctgtctcatcaatcctcctcattcgagtcttcgccaattctctctcggcgtcagtctcagattgacttctgtgtacaagagcggatatctaagcagtgagaagaagcttctactgtaaaatgatcgggacccagtaacgtgttgccctaaattccattccatttcatttcattcattttcctcttaattttggactggggttctaggaggtttttgcttatcaaaggcctccaatttgattatactttcttcaaaatctttgcgtttcaataagatccatgtgtgcatctacttttcccactgcttcatatcatccttcaattcaatttatatgaataactcgtttaatttgccttcaaacttgaagccctcactttctaagactgggtttcgacataatttgctgctgcttttccttataaaattgtaattatcgatcctgtctcagcttttttagttttcaagagagaaagtttcgaatctttgatggctaatccacggcagccttccattggatactctgtctctatcactccctcacacccagatacaacatctcctgaccccgagaaaatttccatacctccaccacctttaattacaccaggagctcccagatttcctgtgccaaggtttcaacaggatcaagctccttctccatcactcaaaaccccaaatgcaccatcaccagctaatgggttgaaaactggcagccctattcctcatttgagtactccacctggacctcctgtctttacttcccctgtccggcctgctgctgtgccttttcgtgcttcacctgcaactcctcagccagttgctttctccccgggctcatctttgccaacatcttcgcccctcaatttttcaaatgggtcacttgagttgcagcatgaactttctaatgttgcagaggatgatatagcgtctgttggagaatcaccatatgtcctattctcagctcataaggtgttgaaacagaagaaacaagcaaatatacccagtttgggatttggggcattggtttcacctggaagggagatttcaccagctcctcagataatacaacgtgatcctcatcgctgccacagttgcggagcttatgcgaatatctactgcaatatcttactaggctcaggtcagtggcagtgtgtaatttgccgagacctgaatggaagtgagggcgaatacatagctcccagcaaggaagatctttgtaattttccagagttgtcatctcccatggttgattatgttcacactgggaacaacagacccggttttatcccagttgctgattcaagaatgtctgcacctattgttcttgtcatagatgagtgtttggatgaaccacatctctgggatttacaaagctccttgcatgcttttgtcgattcacttcccccaacaacgagaattggaataatactctatggtcgcacagtatcagtttatgatttttcagaggaatcgattgcatctgctgatgtgcttccaggagagaaatcaccaagtcaggattccttgaaggcattgatatatggaacgggtatatacttgtctccaatgcatgcttcactgcctgtagcacatgccatattttcatcattgaggccatacaaattgaagattccagaagcttctagagatcggtgcctgggcactgcagtcgaggttgctcttgctatagttcaagggccatcaggagaaatgtctcgaggagtaattaaaaggtctggaggtaatagcagaatcattgtttgtgctggtggccccaatacatatggtcctggatctgttcctcattctttcagtcacccaaattatcctcatatggaaaagactgctttgaaatggatggagcatctgggtcacgaggcacaccgacacaatacagtagttgacattctatgcgctgggacatgccctgtaagagttcctattttgcaacctcttgcaaaagcttctgggggcgtttttgttctccatgatgactttggggaagcctttggtgtgaacttgcaaagggcatctaccagggcagcaggcttccgtgggttcttggcaatacgttgttccgatgatattctcataactcaagtcgtgggtcctggtgaagaggcacatatggacactcatgaaaccttcaaaaatgacacttctctttacatacaaatgcttagtgttgaagagacacagagcttctcactctccttggaaaataagagggacattatgaccgagtatgtgtacttccagtttacaattcagtatttaaatgtgtatcaagcggatatatcaagagtaattactgttagattgccaacagttgatagtgtttcagcatatcttgcaagtgttcaagatgaagtggcagcagttcttattgcgaagaggactctcttgcgagctaaaaattattctgatgcaattgatatgcgagcaacaatagaagaaagaattaaagatattgctatgaaatttggttctcaagcaccaaagtcaaagctttatcggttcccaaaggaggtctctttattgccagagctcctgtttcatctaagaagaggcccacttttgggaagtattgttggccatgaagatgagagatctgtattgcggaacttgtttttgaatgcatcctttgatctctcactccgaatggtagcgcctcgttgtctaatgcatcgggaagggggaacatttgaggaactaccagcttatgaccttgctatgcagtcagatgcagcagttgttcttgatcatggcacagatgtctacatttggttgggtgctgaacttgctgctgatgacggaaaaagtgcagctgcattagcggcttgcaggacattagctgaagagctcacggagttgcggtttccagctcctcggatcctttcattcaaggaaggaagctctcaggctcgatattttgtatcgcggctcataccggcacacaaggatcctccttatgagcaggaggcaagattcccgcagctacgaactttgacaacagaacagcggacaaagctgaaaagcagctttctcaattttgatgagcctagcttctgtgagtgggtacgaagcttgagagtggtgcctccagaaccaagctagatgatctttactttgttaaacttattggcataatgcggcttcaggaaggtagcgttgggagttgtatcagaggaaattgtggcaaaggaatttttcttcttcttcttctttcgttttcactgttggaggaaattgtagttaagatgtttcttgacagcaaatgatgtagctcccatcatcatcaatgtgatgaaccatcaacatcatccagtagttgctgaatgattattttatgctgctgaggcaaaagaaggaagtgttaatagtgaataatggattatttatatactcatggaaaaaagaaaggtattggacttgagtgatttctctgtttgttgtaactcctctcttcatgcaaagaagagaactgatgtcctaaatgtatcaaaggcgccactggtattggtattggtagtaggacaaatcgaaggtgaaacatcctcactgccttcaccatcgccaccgttaacgttgttaccatgatgatgatgatgatgatgaactacatggccatgtcgagcactctgaaaatttagcattgaattattggatcagtacatgtcttcagaagatatgattggtttggataattgctcttcttgatattctcaagaagcaccaaatgtggtcgcctcagcgcaaccaactcttgctcgtctttgtgaaacttgcatcgcgtcccttctttagcttctctcttgttttgtttcctcatctctttgttcttttccttttctcagtagtttcttctgtttgctccatcgtctttgccattgttatttgaggaattgatattagttaggtcttcttctcaatttatatttatatagctaaggatcactagtgatatctttgcttcttgttttaaatatcctattcctccaaaccgactgatcaaatccaattgtgg

SEQ ID NO: 4404 - DNA, 2644 bp, Manihot esculenta
aaaactttgaacttgaatggctaatccaccacaaccgtctcttggttatcctctaactgttactcccacaaaccctgataagtcaacacctcaacctgagaaaactccaatttctccttcccctccagtgctacctggagcctctatctttccttctcgtaatttgcaacaagatcagaactcttccccctcgatcaaaaccccaaatttactatcaccatccaatgggatcaaaactggaagtccaattcctcatttaagcactcccccaggccctcctgttttcacttcaccagtgaggcctgctgctgtgcctttccggacttctcctgcaacacctcagccagttgctttctcatcaggatcatcgttgccaacatcatcaccaccccatttctcagatgggtcacttgaattgcagcaccaagttcccctagcaatagaggattcaatatctcttgaggagttaccacatatcttgttctctgctcacaaggtgttgaagcagaagaaacttgcaaatgtatccagtttgggttttggggcattgatttctcctgggaggaagatttcaccaggtcctcagataatactgcgtgatccccatcgctgccaaaattgtggagcttatgcaaatctttattgcaaaatattacttggttcaggccagtggcaatgtgtgatttgcaggaaattgaatggaagtgatggtgaatacatagctccaagcaaagaagatcttcataacttcccagaaatgtcatcaaccatggttgactatgttcaaactgggaacaagagacctggttttgttccagtttctgattccagaatgtctgcacccatagttcttgttatagatgactgtttggatgaaccacacctgcaacatttgcagagctccttgcatgcgtttgttgattcacttcccccaacagcaagaattggaatcatattgtatggccgcacagtatcagtttatgatttttcagaggaatcaatggcatctgctgatgtacttccaggtgataaatcaccttctcaggaatccttgaaagcattgatctatggaactggtgtgtacttatcaccaatgcatgcttcaaaagaagtagcacaccaaattttttcatcactaacaccatataaattgaacattgcggaagcttcaagagatcggtgcctgggtactgcagttgaggttgcactgggtataattcaaggaccatctgcagaaatgtctcgaggcatagtcaaaagggctggaggtaatagcagaattattgtctgtgctggtggacctagtacttatggtcctggatcagtccctcattcttttagtcacccaaattatcctcatatggaaaagatggcattgaaatggatggaacatctgggttgtgaagctcatcgacagaatacagtggttgaccttttatgtgctggaacatgtcctgttagagttccagttttgcagcctcttgcaaaagcttctgggggtgttttggttcttcatgatgactttggagaagcatttggtgtaaacttgcaaagagcatctaccagggcatcgggttcccagggattattggagattcggtgttctgatgatattcttattactcaagttgtgggtcctggtgaagaggcacatatagacactcatgaagctttcaaaaatgatgcttctctctccattcaaatgttaagtgtagaagaaacccagagctttgctctctctatggaaactaaaggagacatcaagaccgattgggtatttttccagtttgcaattcaatactcaagcctttatcaagctgatatttcaagagttattactgtcagattgcctaccgttgatagtgtttcatcatatcttggaagtgttcaagatgaagtagctgcagtccttattgccaagaggactcttttgcgagccaaaaactattctgctgcaattgatatgcgggcgacaatagatgagagaattaaagatattgctttgaaatatgggtcccaattacagaagtcaaaactttatcgattccccaaggaactctcattgttgccagagttcctttttcatcttagaaggggaccacttttggggaacattgttggacatgaagatgagaggtctgtattacggaatttgtttctcaatgcatcttttgagctttcactccgtatggtagcgcctcgttgtttaatgcatcgggaagggggcacttttgaagaattacctgcttatgacctggcaatgcagtctgatacagctgttgttcttgaccagggtactgatgtcttcatttggttgggtgctgaattagctgctgatgaaggaagaagtgcagctgctttggcagcttgcagaacattggctgaagagctcactgaagtgcgatttccagctcctaggatccttgcatttaaggaggggagctctcaatctcgatactttgtttctcgcctcataccagcacacaaggatcctccttatgagcaggaggcaagatttccacagcttcgatctttaacgacagaacggcggacgaagctcaaatgcagctttattcactttgatgatcctagtttctgtgagtggatgcgaagcttgaaagtggtgccaccggaaccaagttaa

SEQ ID NO: 4405 - DNA, 3376 bp, Malus domestica
attgagttgtgtacgcaagtacaagagcgaatttggaagcagcgggaagaagaagcttcaattgtgaaatgttggcgacccagtagggttctgcccttgatttcattccattcggttcgattcaattttttactcttaattttggactctggggttttgggaggtttttgttcatcaaaggcctcctattagctcattctttcttcgaaatcttttgggtttcaatacgatccatgtgtgaacctacttatcacactgtttcttatcatccctcagttcaatttatatgaataactcgttcaatttgccttccaattcgaagcccttgctttctacaactgggtttcaacataatttatttctactgtgccataataaattttaattctcaatcccgggttcttgagcttcttttgttttctatagagggatttggaaactttcgatgtcaaatccaccgcagcctcccattggatactctgtcagtatcactccctcacgcccacacataccatctcctgaccctgagaaaatttctattcctccaccacctttaattactcctagattccctccaccaaagtttcaacacgatcaaactcctcctcctttgatcaaaaccccaaatgtaccatcaccagctaatgggttgaaaactggcagccctattcctcacttgagtacaccccctggacctcctgtttttacttcccctgtgcggcctgctgctgtgccttttcgtgcttcacctgcaactcctcagccagttgctttctccccgggtacatctttgtcaacatgttcgcctcccaatttttcgaatggctcacagcaccaactttctaatgatacagaggatgatgctgtgcctgttggagaatcaccatatgtcctattctcagcgcataaggtgttgaaacaaaagaaacaagcaaatgtacccagtttgggttttggggccttggtttcacctggaagggaaatttctccaggtccccagataatacaacgtgatcctcatcgctgccacagttgtggagcttatgccaatatttattgcaacatcttattgggctcaggtcagtggcaatgtgtaatttgccgagaactgaatggaagcgagggcgaatacagagctcccagcaaggaagatctttgtaattttccagagttgtcatctcctatggttgattatgttcaaactgggaacaatagacccggttttgttcccgtttctgactcaagaatgtctgcacctatagttcttgtcatagatgagtgtttagacgaaccacatctgtgggacttacagagctccttgcatgcatttgttgattcacttcccccgacaatgagaattggaataatactgtatggtcgcacagtatcagtttatgatttttcagaggaatcaattgcatctgctgatgtgcttccaggagataaatcaccaagtcaggacgccttgaaggctttgatatatggaagtggtttatacttgtctccaatgcatgcatcattaccagtagcacatgccatattctcatccttgaggccatacaaactgaaaatttcagaaacttctagagatcggtgcctgggtacggcagttgaggttgcacttgctatagttcaagggccatcaggagaaatgtctcgcggggtaattaaaaggtctgggggtaatagcagaatcattgtttgtgctggtgggcctaatacatacggtcctggatctgttcctcattctttcagtcacccaaattatcctcatatggaaaagactgcattgaaatggatggagcatctgggtcaagaggcacaccgacaaaatacagtggttgacattttgtgcgctgggcaatgccctgtaagagttcctgttttgcagcctcttgcaaaagcttctggaggcatttttgttctccatgacgactttggggaagcctttggtgtgaacttacaaagggcatctaccagggctgcaggctcccgtgggttcttggcaatacgctgttccgatgacattctcataactcaagttgtgggtcctggtgaagaggcacatattgacactcatgaaaccttcaaaaacgacacttccctttatatacaaatgcttagtgttgaggagacacagagcttctcactctccttggaaaataagagggacattaggactgagtatgtgtatttccagtttacaattcagtacttaaatgtgtatcaagctgatatatcaagagtaattactgttagattgccaacagttgatagtgtttcagcatatcttacaagtgttcaagatgaagtagcagcagttcttattgcaaaacggactctcttgcgagctaaaaactattctgatgcaattgatatgcgagcaacaatagatgaaagaattaaagacattgctctgaaatttgggtctcaagtaccaaagtcaaagttttatcggtttccaaaggagatctctttattgccagagctcctgtttcagctaagaaggggcccactgttgggaagcattgttggccatgaagatgagaggtctgtgttacgaaacttgtttctgaatgcatcctttgatctctcacttcgaatggtagcacctcgctgtttaatgcatcgggaagggggaacatttgaggaactaccagcttatgaccttgctatgcagtcagatgcagcagttgttcttgaccatggtacagatgtcttcatttggttgggtgctgaactcgctgctgatgaaggaaaaagtgcagctgctttagcagcttgcagaacattagctgaagagctcactgaactgcggtttccagctcctcggatcctgtcgttcaaggaaggaagttctcaggctcgatattttgtatcgcggctcatacctgcacacaaggatcctccttatgagcaggaggcaagattcccacagctacgaactttgacaacagaaaagcggacaaagctgaaaagcagttttattagttttgacgagcctagtttctgcgagtgggtacgaagcttgaaagtggtgcctccggaaccaagctagaggatgtttgctttcttaaacaaacttgttggctaatgtcgcttcaaaaaggcagaggaaattgtgtcaaaagggattcttcttttctttcttttctcgctgttaacgggaaattatagttatttttcttgtttttggtcaacagaggaaattgcagttaaagacatgagctcccatcccattccatccgatgatcaatatcattctcttcctctaggctatagttgctgcttttgttttaactgggacgataatgttgctttattatgcctatatattataatgaggcaaacaagaggttcacgaaagaaagaacaa

SEQ ID NO: 4406 - DNA, 3890 bp, Populus trichocarpa
gacggagagagctccctagcttgcgaggaaaaagacccataatcctaaaaatcacttcgaaaatatttccattttttaactgagattaaaaaaaaagggactgaagatttactctgcaaatccttcaattttccttctatccctctcagatgtctgtgcgagaggaagattttggtgcccaattgtgcagagagatcaggttttcttgcattcaatttgatctttgaagctgataattttggttctttagttgggttcttgactgtactggggatttcttgaactgggtttgcatcaaaaccctttcttgctctggggttttagattttaccggggggttttggtttgtcaaggtcctcccattcggtatcttcttccgcatcaacattgagattggatcgcaattcttgagctgctggtgtatcagacctttgtaggctgttttgtttatgattcttaattgaatttcaatcaataatcaattgacagtctcaaagttgtcactttgaattctcttgtcataattggccctgggatacaactgtctgtagctttatatagagtttgattttggcttctaggttattcttgattattcgataaagaaactttgaattgcaatgactaatccaccaccaccttcccttggatattctgttactgttactccctcaaaccctgactcatcaacccctcaaccagtgaagaattctgctcctcctcctacgatgttacctggagctccgcgatttcctcctcctaaattgcaacaagatcagatcccttctcctttttttcggaacccaaatttgttgtcacctgccaatggggttaggagcccagttcctcatctaagcaccccccctggtcctcctgtttttaaatcgccagtccggcctgctgctgtgccttttcggacttctcctgcaactcctcaaccaattgctttctcatcaggctcaacattgccaacatcctcgcctcctcatttttcaaatggttcagttgagttgcagcaccaagttcccctcgctacagaggactcaacacttgtcaatgaatcattatgtgctttgttctctgctcacaaggtcttgaagcaaaagaaactaacaaatgttccaagtttgggctttggggcattattttctcctgggagagagatttttccaggtcctcaaatattacagcgtgatcctcatcgttgccacaattgtggagcttatgcaaatctttattgcaagatattacttggttcaggccagtggcaatgtgtgatttgccggaaactgaatggaagtgaaggtgaatatgtagctccaagcaaagaagatcttcgcaactttccagaactttcatcacccattgttgattatgttcgaactgggaacaagagacctggttttattcctgtttctgattccagaatgtctgcacccgttgtacttgttatagatgactgtttagatgaaccccacctgcagcatttacaaagctctttgcatgcatttgtggattcactcccccctacagcaagaattggaataatactatatggccgtacagtgtcagtttatgatttttcagaggaatcaatggcatctgctgatgtacttcctggtgacaaatcacctattcaagagtccttgaaagcattgatctatggaactggtgtgtacttgtcaccaatgcatgcttcaaaggaagtagcgcacaaaatattctcatctttgagaccgtataaatcgaacattgcagaagctttaagagatcggtgcctgggtactgcagttgaggttgctctggctataattcaaggaccatcagcagaaatgtcccgaggtgtagttaaaaggaatggaggcaatagcaggatcatcgtgtgtgctggcgggcctaatacatatggccctggatcagttcctcattcttttagccacccaaattatcctcatctggaaaaaacagccttgaaatggatggagaacctgggtcgtgaagcgcatagaaataatgcagtagttgacattctgtgtgctggaacttgccctgttagaattccagttttgcagccgcttgcaaaggcatctggaggtgttttggttcttcacgatgactttggggaggcctttggtgtgaatttgcaaagggcatcttctagggcatcaggttcccatggtttgttggagattcgatgttctgatgatattttaattactcaagttgtgggtcctggtgaagaagcgcatgttgacacacacgaaactttcaagaatgacaatgcactgtgcattcaaatgctaagtgttgaagaaacacaaagctttgcactctctatggaaactaaaggagacatcaagagcgattgtgtatttttccagtttactgttctatacgcaaacatttatcaagctgatatttcaagagtggttactgtcaagttgcctactgtggatagtgtttcagcatatcttgaaagttttcaagatgaagtggctgcaatccttatcgccaagagaaccctcttgcgagccaaaaaccattcagatgccatggatatgcgtggaacaatagatgaaagaattaaagacattgctttaaaatttgggtccctagtacccaagtcaaaacttcatagatttcctaaagaactctctgcattaccagagctccttttccatcttagaaggggccctcttttgggaagcattgttggtcatgaagatgagaggtctgtgttgcggaatttgtttttgaatgcatcttttgatctttcactccgtatggtagcacctcgttgtctaatgcaccgagaagggggaacttttgaggaacttccagcttatgaccttgcgatgcagtctgatacagctgttgttcttgaccatggtacagatgtcttcatttggttgggtgctgagctagccgctgatgaaggaagaagtgcagctgctttagcagcttgcagaacattagttgaagagataactgaattgcggtttccagcacctagaatccttgcattcaaggagggaagctctcaagctagatattttgtttctcggctgatacctgcgcacaaggacccaccttatgaacaggaggcaagattcccgcagcttcgatctctgacaacagaacaacgaacaaagctaaaaagcagctttattcactttgatgatccaagtttctgtgagtggatgcgaagtctgaaagtggtgcccccagaaccaagttaatttgtagttttacataatttaattgctaatgtacttccagaaaaggggagtcttgggaactgcatcctgcctcgcctgtggaaatccatcttctcctgtctctattttttttttctttccgtggtcgagggggtgttacctggatggtgtcttcggtggctatcatctcatccttaatttttttttttttcacaaagaaaacatctgtactcaccgtcacttgaaaaggtttgaaatggtccccgtcctattctgtttcccggttgaaatgctttggatgagcaataaagccttcgtggttttgttccatcttcaccgttattttgatagcgtatcggatctcctttgctccgcctctttcaggcatgattcttcatgaagttttcaatttgctagagcaggtgtcatgccccacgtgttggatgttgaccttttaatctcttttatctcagatgaacatcctccatcattttgctttgcctagggcaggttgtgatttgaagtgtgaagccggtgttgcttcgcagaggaaatggttttcttcatttctgaatcaaacacgagagccaccagcttacattagtgtttttggagaaaaaatatttaccctgaaggaggggatactgtttaccatggaactgctcactcaca

SEQ ID NO: 4407 - DNA, 4022 bp, Ricinus communis
agaacggatgtgtagctaaatcccacagtccgtttgtcatgaacaaagaaccgggctgactcggttttaattgctcaagtcaagcgctcagtcaggactcaggagtcagggctcaggacccataatttgaaagaagtaaacaaaataaaacaagaaaaaaaaaaaaactctttcctatttttctcgattctcttcccctctttctcagatttcactatgcaagagggaaattttttgtacccaattttgcagatgcagaggtaaaaagtgctaggagataaggttttgatcacagtcctttgatctttcttgaggattcttgattgggtcttaactgttttggaattctttgagctgggttttgatcaaaactcgttgttggttcttgattgttctggggaatttagtttgtattgagcgttttggtttctctagactggcaatcctttgaattgtacttcaaagaataagtatcgagttagaactcatcagctgcttctgtggcagtaattcgttgtcttctctctttcgttgtttctttactcttcttaatcttggccgattgaaaattcattcgagtgtcaaagtctttactttgtatcatcttctcgtgtatttttagattgatacaatttgtagctttctttaaatcttatacttgattttgggtttttgaaagttcttgttctcgaataaaggtagtctgtaactgcaatggcaaataatccacctcaaccttccgttggatatcctctcactattactccaaaaattgatacatcaacacctgagaaaagtccaattcctccttcgcctccaattttagctcccagatttccccctccaattttgcaacaagaccaggtcctttccccctcaattaaaactccaaatttactatcatcagccaacggggttaatataggaagcccaattcctcacctaagtactccccctggccctcctgtgttttcttctcctgtccggcctgctgctgtgccttttcgaacttctcctgcaactcctcagccaattgctttctcatcaggctcttcattgcctacatcatcacctccgcatttcttaaatgggtcccctgagttgcagcaccaagttccccaagtttcagaggactcaatgcctgctgaggaattatcttgtatcttattctctgctcacaaggtattgaggcagaagaaacttgcaaatgtgcctagtttgggttttggggcattgatttctcctggaagagagatttcaccagctccccaaataattcagcgtgatccccatcgatgccaaaattgtggagcttatgcaaatctctattgcaagatattacttggttcaggccaatggcaatgtgtaatttgccgtaagttgaatggaagtgatggtgaatacatagctccaagcaaagaagatcttcgtaatttacctgaactgtcatcgcccctcgttgattatgtccaaactgggaacaagagacctggttttattccagtttctgattccagaatgtctgcacccactattcttgttatagatgactgtttagatgaagcgcacttgcaacatctacaaagctccttgcatgcgtttgttgattcacttccccctacggcaagaattggaatcatattgtatggccgaactgtatcagtttatgatttttcagaggaatcaatggcatctgctgatgtccttcctggtgataaatcacctactcaggaatccctgaaagcattgatatatggaactggggtgtacttatcgcctatgcatgcttcaaaagaagtagcacaccaaatattttcatcattgagaccatataaattgaacattgcagaaacttcaagagatcggtgtctgggtactgcagttgaggttgcgctggccataattcaaggaccatctgcagaaatgtctcgaagtgttgtcaaaagggctggaggtaatagtaggattatcgtgtgtgctgggggacctaatacttatggccctggatcagtccctcattcgtttagtcacccaaattatcctcatatggaaaagatggcactcaaatggatggagcatctgggtcatgaagctcatcgtcaaaatacagtggttgacatcctatgtgctggaacttgtcctgttagagttccaattttacagcctcttgcaaaagcatctgggggtgtcttgattcttcatgatgactttggagaagcatttggtgtaaacttgcaaagggcatctatcagggcatcaggctcccagggtttactggaagttcggtgttctgatgatattcttattagtcaagttgtgggtcctggtgaagaggcacatgtggaacctcatgaaacttttaaaaatgatacttcgctctctgttcaattgctaagtgtagaagaaacccagagctttgctctctccatggaaactaaaagagaaatcaacagtgattgtgtatttttccagtttgcaattcaatactcgagcatttatatagctgatatttcaagagttatcactgtcagattgcctacagttgatagtgtttcagaatatctcgagagcgttcaagatgaagtggctgcaattcttattgccaagaggaccctcttgcgagctaaaaactcttcagatgcaattgatgcgcgggcaacaatagatgagagaattaaagacatggccttgaaatttgggtcacaggtaccaaagtcaaaacttcatcggttcccaaaagaactttcgttattgccagagctcctttttcatcttagaagaggcccacttttgggtaacattgttggccatgaagatgagaggtctgtattacggaatttgtttctcaatgcgtcatttgatctttcactccgaatggtagcacctcgatgtttaatgcaccgagaaggtggcacatttgaggaattgcctgcttatgacctagcaatgcagtctgatacagctgttgttcttgaccacggcactgatgtcttcatctggttgggcgctgaactagctgctgatgaaggacgaagtgcagcagccttagcagcttgcagaacattagctgaagagctcactgaattgcggttcccagctcctaggatccttgcattcaaggaggggagttctcaagcccgatactttgtttctcggttaataccagctcacaaggatcctccttatgaacaggtgaaatgaataaaaatttcttggttttttacagcggacaaagctaaaatgcagctttattcattttgatgatcctagtttatgcgagtggatgcgaagcttaaaagtggtgccaccagaaccaagttaagctgtactcttttgcaatttagcggctagtgtacctttagaaagaatcttaggagctgcatcctactttggccatcggaaacctgtcttctctcatctgtctttttttttttttctcttttctttagtggttaaaggggatgcttcttggatgatgccaaggaatacatctaattatttcccccatttcttcttcttttggaagtaggaaacatctatactcgactgtcaaaaagttttgatattgtgtcatcgtactatgtttctaaattgagacactctttggggaagcaataaaaagattaccttttctgatgtaccctcccacttattttacagcagttgatatgatctctgaagcaaataacagatatgaccatgcatggaggcaactataatctatagttacacgtcattggatgtgaaactgcacacgttcctgaactcttcaaggggttgtaaagttctatctgtgctacttttaggttacaggcgctcaagtattaaaaatttacaagctcatccatttgttgcaatgtagcctgtgattcagtgtgctttggtggtgacataggaatagagagcatgagcacatgtgtgcatagcctaacagcagaatcttaaaagtattttcatacctaaggtgtgttgcacgattgtttttgcagctaatatattaataatgtgtctgcttatgcaac

SEQ ID NO: 4408 - DNA, 3736 bp, Theobroma cacao
cgatccagcagtgcgaaaaacattgccatgggtggggtgggcgcgtcaatggttactaattaccaagcataatacaccaaagagacaatgggctcttctgggggttgcctcgcgtcgcccgtttcgtaagcctaaccataacccaacacacagacgaagaaggagagtttaaagacatgatcacatgatgatgaaaatgaaaaagagtcaaagattattacttctatgattccaagtctttgataattcaaataaaagactctgccgttctatctaattttcctttcacatcagattgagttatggaagaagggattatattgaagcttgaattgaagtgaagatagagacctaagtgatcaagttccgttctttttttatctgggaaggtgaattgtggtgaatttatggggattcttggatcttgattgacttcttgcatttgatgtggatatcttgaattgggtttccttcaaaatccaatcttgttcattatatttttatgtggttttaaggttttgattgggctttttctcttgtgaacattgcattgaagttcttggcaaaagcttaaaacctgcaccttttcttctcgtccaagagctggaatttggttggcattatttgatatatctctggtgtttcactgttcgtgatattcaattaagaaaagctttcatttgcaatggctactccgccacaagcttctcctggatactctaagactattactcctcagatggattctccttcacctaatcctgatagaagtccaattgttcctgccccttccacaatctcacctgcagcacctagatttcctccgcccaatttacgaaaagatcagatcccttccccttcaataaaaaatcctactatgctatcaccagcaaatggggtcaaaactggaagccctattccccatctgagtactccacctggccctcctgtatttacatcacctgtacggcctgctgctgtgcctttccggacctctcctgcaactcctcagccagttgctttctcatcaggttcatctttgcccacatcttcacctccccacttttcaaatgggtcagttgagctgcaacagcagcttcccagtgctatagaggaatctttgcccgatggagagtcaccatgcgttttgttctcagctcagaaggtgttgaaacagaagaaacaagcaaatgtacctagcttaggctttggagtattagtttctcctgggagggagacttcaccaggtcctcaagtgatacaacgtgaccctcatcgatgccataattgtggagcttattcaaatttctattgcaacatactaattggctcaggccaatggcagtgtgtaatctgccggaatctgaatggaagtgaaggtgaatacataacatcaagcaaggaggatctctgcaattttccggagctgtcatcacctttggttgatttcattcaaacggggaataagagaccaagttttgttccagttactgattcaagaacatctgcaccgattgttcttgtcattgatgaatgtttagatgagccacatcttcagcatttacagagctccctgcatgcatttgtcgagtcagttctaccaacaacaagaattggaattattttgtatggtcgcacagtatcagtctatgacttttcagaggaatcgatagcatctgctgatgtgattccaggtggcacttcaccaactcaagagaacttgaaagcattgatttatggaactggcatatacttgtcaccaatgcatgcttccaaagaggtggcacaccagatattctcttcattgaggccatacaagttgaatgtgccagaagcgtcaagagatagatgcttgggtactgcagtcgaggttgctttggctattattcaaggaccatctgcagatatgtctcgaggtgtagttaaaaggccaggtggtaatagcagaatcattgtgtgctctggtggaccaaatacttatggccctggatctgtccctcattcttatactcaccctaattatcctcataaggaaaagacagcattgaaatggatggagggtcttggtcgtgaggctcatcaacataacacagtggttgacattctctgtgctggaacttgccctgtaagagttcctgtgttgcagcctcttgcaaaagcttcagggggtgttttggttcttcatgatgactttggtgaagccttcggtgtgaacttacaaagggcatctgcaagggcagctggttcccatggtttgttggagatacgctgttctgatgatattcttgttactcacgttgtgggtcctggtgaagaggcacacatagacacccatgaaaccttcaaaaatgatatttctctctgtattcaattgctgagtgtcgaagaaacacaatgcttctccatatcgatggagaataaacatgacatcaagagtgattatgtatatttccagtttgctattcaatactcaaatgtttatcaagctgacatagctagagtgattactatcagattgccaactgtggatagtgtttcagcctatcttcaaagtgttcaagatgaggtggctgcagtcctaattgccaagaggactctcttgcgagcaaacaattattctgatgcaattgacatgcgaacaacaatcgatgaaagagttaaagacattgcattaaaatttgggtctcaagtgccaaagtcaaagctttatcggttcccaaaggaaatctctttactaccagagcttctattccatcttagaaggggcccactgttgggaagtatagttggtcatgaggatgagaggtctgtactgcgtaatttgtttttgaatgcatcctttgatctgtcacttcgcatggttgcccctcgttgtttgatgcaccgagaaggaggcacttttgaagaattgccagcttatgatcttgccatgcagtctgatacagctgttgttctagaccatggtaccgatgtcttcatttggttgggtgctgaacttgcagctgatgaaggaagaagtgcagcagctttggcagcttgtagaacattggcagaagagctcacggagttacggtttccagctcctcggatccttgcattcaaggaggggagttctcaggctcgctattttgtttctcggctaataccagcacacaaggatcctccttacgagcaggaggcaagatttccacagcttcgaaccctgacaacagaacagcggacaaaactgaaaagcagttttattcattttgatgatcccagcttctgtgaatggattcggagtttgaaagtagtgccaccagaaccaagctaagagattttcttaaagatttttgcagttaatattcctccaaaggggagcaccggggagttgcatccaaccatcatttattggaatctttctactcttctttttgttcttcttctccctctaaagggaatgtaactccgttcatcttttctctttattattatttttttcttgtctagccctcactttacaaaaatcccctttccctcttttaaactacaaagaaacagttatacttggtagtaactcccctctcaaaattaacattgttgtctcattttttagttcaaaatactttgctagagcaatagttttaatttaactttgtatcattcctgtataagttatgcccttttataaatctcttccaattggtatccctactatcactgcaacatatctagttctgggcaaagtctaatccca

SEQ ID NO: 4409 - DNA, 3428 bp, Eucalyptus grandis
cccgagtcttgaactggacgaaccagggtaacttcggcctccccccagcacacgggcgcgcgcaagcgagcgagaggaagcgcgggggcgtccttcccaagtcagagcgaggtcaattccggaggggtcaaacccggaagtggggaaccaagatcgagatcaatttggcccttgtgatgatctcgctcgtgattgcttctttgtgcctggattggattcacgtgtcctgctcaggctcagctcgtcaaggtttcctcaggaaaacaagatcctcgatttgcatcatatgcttctgaaggggattttggttatttatggtcaagagtgattggttttagctttggattctggcatgtgtgttctcctcgagtgttagtgtagactactttgaagttcttgagaaatttattttcaataaagagaactcctgcttgcaatggctaaccaacggccaccttcacccggatactccatcaccatgactccatcaaatcctggaacaccagcccctcataccgacagaagtccaatccgtcctcctccgttgacacctgcagctcctagatttcctcctccgcaattacagcaagaacacctcgcttctcctttgatcaggaaccctaatctgcaatcaccaccaaatggggttcactctggcagcccaacccctcatatgagcacacctccgggccctccagtctttacttcgcctgtcaggccagccgcagtgcctttccgaagctctcctgcaaccccacagcctgttgcattctcttctggttcatcgttgccagcttcttccccccctcacttttcaaatggatcaggtgatttgcagcaccaagtttctgattctgcagaggacttgacatccactgggaaagcaccatatgtattgttttcagctcagaaggtattaaaacagaagagacaagctaatgtgcccagtttggcatttggggcattggtgtctccgggacgagaggtatcaacaggtcctcaaatactacaacgagacccacatcgttgccagaactgtggtgcttatgcaaatttttattgcaacatattgattggctcgggtcagtggcagtgtgtcatttgtcggaagctgaatgctagtgaaggagagtatatagcttccagtaaggaagaacttaggaattttccggagctttcatctccaatggttgattatgtgcaaactgggaatagaagacccggttttataccagtgtcggattcgcgaatgtctgcacccattgtgcttgtaatagatgagtgtctagatgagccgcacctccagcatttacaaagttcattacatgccttcgtcgattcactttcccccacaacaaggattggaatcatactctatggtcgcactgtctctgtctacgacttttcagaggagtcggttgcatcagctgatgtgctacctggtgacaaatcgcccactcaagagtccttgaaagcactaatatatgggacagggatatacctgtcgccaatgcatgcttcgctacctgtagcacatacaatgttttcgtcattcaggccatataagttggatgttcccgaggtttctagagacagatgcctcggcactgcgcttgaagttgctcttgctctaattcaaggaccatcagcagaaatgtctcggggaatagttaaaaggtcaggagggaatggcagaatcattgtatgtgctggtggtccttgtacttacgggcctggttcagtcccacattctttcactcatcctaactatgcccacatggaaaagacagcaacaaaatggatggaacaccttggtcgtgaggctcatcgaaataatacggtggttgacattctatgtgctggaacatgccctctgagagttcctgtcttgcagcctctagcaaaagcttccggtggtgtcttgatccttcatgacgactttggggaagcatttggtgtgaacttgcagagagcagctacaagagctgccgggtctcacgggttgctggagattcgttgttcagatgatattctcattacgcaggttgtaggtcctggtgaagaggcccatgtagacacccatgaaagctttaaaaatgatgctgctctttcgatccaaatgttaagtgttgaagaaacccagagtttctcaatctccatggaaacaaagaatgacatcaaaagtgatcatgtattttttcagtttgcaatacaatattcaaatgtgtatcaagccgatatctctagggtgattacagttagactacctgctgttgatagtgtttcagcataccttgacagtgtccaagatgaagtggcagccgttcttattgccaagcgaactctattgcgggcaaaaaatcattcagatgcaattgacatgcgagtgacaatagatgaaagaattaaggatattgctcagaagtttgggtcccaaataccaaagtcaaagctttgtcgttttccaaaggagctctctttgttgccggagcttctgtttcatcttaaaaggggtcctctgttgggtagcatagttggccatgaagatgagaggtctgttttgaggaatttgtttctaaatgcatcatttgatctctcacttcgcatggtagctcctcgatgtctcatgcaccgggaagggggcacttttgaagaacttccggcttatgacctggcaatgcaatctgatacagctgtagttctggaccatggcacagacatcttcatttggatgggtgccgaacttgctgctgacgaagggaaaaatgcagcaactttagcggcttgccgaactttggctgaagaactcacagaatcacgatttccagctcctagaatactggcatttaaggagggaagctctcaggcccggtattttgtttcccgtttgattccggcacacaaggatcctccttatgaccaggaagcaagattcccacaacttcggagtttgacggcagaacagaggacaaagctgaaaaacagtttccttcactttgatgatcctagcttctgcgagtggatgcgaagcttaagagcagttccccctgaacccagctgatgcaatcctgtggaatttttttgcggctaagttacttccgaactcaaatgctcggatctgcacctttatagtgccaaaaggagacccatcttctgtttcttcttgttttttggccacttttgtttctatcttgtttatttttgggttcccctggtaaagtttgagggggatgaaaacactgggattgtggtgggtatatggattggcagtagcatttcttctcttacattttttgccctaaacatttgatttttttggttggttaaattgtagctgaagttgtctctccattccaattcacagatgacagtgctatgaagcccatgagcaataaaaaattcatttagtcctttagctaatcttacaa

SEQ ID NO: 4410 - DNA, 2934 bp, Manihot esculenta
actttgattttcgatggctaaacaacctcaaccttcccttgcatatcctctcacagttgctcccacaaaccctgatacatcaacacctcaacctgagaaaactccaataaatccttctactccaatgctacctggagcccctagatttccctctcctaatttgcaacaagatcagagcccttctccctcaatcaaaactccaattttacaatcaccattcaatgggatcaaaactggaagctcgattcctcatttaagcactccccctggtcctcctgtttttacttcaccagtccggcctgctgctgtgcctttccggacttctcctgcaacacctcaaccagttgctttctcatcaggatcctcattgcccacatcatcaccaccgcatttctcaaatgggtcagcacagttgcatcaccaagttccccaagctacagaggattcaatatctattgaggaattaccctgcgtcttattctctgctcacaaggtgctgaagcagaagaaactagccaatgtatccagtttgggttttggggcattgatttttcctgggagggagatttcaccaggacctcagataatacagcgtgatccccatcgttgccaaaactgtggagcttatgcaaatctctattgcaagatattacttggttcaggccagtggcaatgtgtaatttgcaggaaattgaatggaagtgatggtgaatacatcgctccaagcaaagaagaccttagtaacttaccggaaatttcatcacctatggttgactatgttcgaactgggaacaagagacctggttttgttccagtttctgattccagaatgtctgcacccattgttcttgttatagacgaatgtttagatgaaccacacctgcaacatttgcaaagctccttgcatgcatttgtagattcacttccccctgcagcaagaattggaatcatattgtatggccgtacagtatcggtttatgatttttccgaggaatcaatggcatctgctgatgtacttcctggtgataaatcaccttctcaggaatccttgaaagcattgatctatggaactggtgtgtacttgtcaccgatgcatgcttcaaaagaagtggctcaccaaattttttcatcattaagaccttataaattaaagattgcggaagcttcaagagatcggtgcctgggtactgcagttgaggttgcactgagtataattcaaggaccatctgcagaaatgtcacgaggtgtagtcaaacgggctggaggtaatagcagaattattgtgtgtgctggtggacccagtacttatggccctggatcagtcccacattctcttagtcacccaaattatccttatatggaaaagacggcattaaaatggatggagcatctgggtcacgaagcatatcgacataatacagtggttgacattttatgtgctggaacatgtcctgtgagagttccacttctgcaacctcttgcaaaagcttctggaggcattttggttcttcatgatgactttggagaagcatttggtgtaaacttgcaaagggcatctactagggcatcaggatcccagggactattggagattcgctgttctgatgatattcttattactcaagttgtgggtccgggtgaagaggcgcatatagacactcatgaaactttcaaaaatgatgtttctttctcaattcaaatgttaagtgtagaagaaacccagagcttttctctttctatggaaaataaaggagacatcaagagtgattgtgtatatttccagtttgcaattcaatacatgagcctttatcaagctgatatttcaagagttattactgttagattgtctactgttgatagtgtttcagcatatcttgaaagtgttcaagatgaagtggctgcaatccttattgccaaaaggactctcttgcgagccaaaaactattctgatgcaattgatatgcggacaataatagatgagagaattaaagacattgctttgagatttggatcgcaggtaccaaagtcaaaacttcatcgattccccaaagaactctcgttgttaccagagttcctttttcatctcagaaggggaccccttttgggaaacattgttgggcatgaagatgagaggtctgtgctgcggaatttgtttctcaatgcatcctttgatctttcactgcgtatggtggcacctcgttgtttaatgcaccgtgaagggggcacttttgaagaattacctgcttatgaccttgcaatgcaatctaatacagctgttgttcttgaccatggtactgatgtcttcatctggttgggtgctgaactagctgctgatgaaggaagaagtgcagcagctttggcagcttgcagaactttagctgaagagctcactgaattgcgctttccagctcctaggatccttgcttttaaggaagggagctctcaagctcgatactttgtttctcgtctgatacctgcacacaaggatcctccttacgagcaggaggcaagattcccacagcttcgatctttgacaacagaacagcgaacgaagctaaaatgcagctttattcactttgatgatcctagtttgtgtgagtggatgcgaagcttgaaagtggtgccaccagaaccaagttaagcagtaacgtcctgcaattcagtggcaggtgtacctccagaaacaattttaggagctgcatcctacgttttggcgaacggaaacctgtcttctcctctttctatccctttcttatctgctctgtggataagggtaagttttcttggatgatatctttcaatatcatctaatctttattttttatttttgacataggaagcacctacatttgagtgtgaaaagttttgatattattctgtttatccattgaaatactttgcgggagcaataaaaattacctttcttgagccgtc

SEQ ID NO: 4411 - DNA, 3199 bp, Vitis vinifera
cgacacacgaagaacagaaaacaaggaaagagggaagagagagagagagagagaggggagagagagagagatagtgctcgcctgtcacactacccggaagaagaagtagaatgatgacgatgagggtactttgatatttaaaaaacaatatcatcttcttcgtcgcttcccaggagaattctgaattccaatggctaacccaccgcaaccttcccttggatactctggctctctcacccccacacagccagacgcccctactcttcgtcctgagaaaaattcaattcctccaccctttccctcacctgtagcagctagatttcctccaccaagattacagcaagaacagattccttccccctcaactagaactccaaatttgctatcaccagtcaatggggttaaaactggcagccctattcctcatttgagcactcctcctggccctcctgtcttttcttcaccactacggcctgctgctgtgcccttccggacatcacctgcaactcctcagcctgttgctatctcttctagttcatctttgcccacatcctcacctccttattattcaaatgggtcagctgagttgcagcaccgagtttctgatgctacagaggagtcattgcatcttgagaaatcaccgtatgttttattttcagcagataaggtattgaagcggaaaaaacaagcaaatgttccaagtttggggtttggagcattggtttctcctgggagggagatttcaccaggtcctcaagtaatacagcgtgatccccaccgctgccaaaactgtggagcttatgcaaatctttattgcaacatcttgcttggttcaggtcagtggcagtgtgcaatttgtcgaaatctgaatggaagtggaggtgaatacgtggctaccagcaaggaagagctccttaactatccagaactgtcgtctcctatggttgattatgttcaaactgggaacaagagacctggttttattccagttggcgatttgagaatttctgcacccattgttcttgtgatagacgagtgtttagatgaagcacacctccagcatttgcagagttccttgcatgcatttgttgattcactacccccaaccacaagaattggtattgtactgtatggtcgcactgtatcagtatatgatttttcagaggattcatttgcatctgctgatgtgcttcctggtgacaaatcaccaactcaggattctttgaaatcattgatttatggaactggcatatacctgtcagcaatacatgcttcactgcctgtaatacataccatattctcatcattgaggccatacaaattgaaccttccagaagcttctagagaccggtgcctgggtacagctgtggaggttgctctgcgtataattcaagggccatcagctgaaatatcaagaggaatagttaaaaggtcagggggtaatagcagaattattgtgtgtgctggtggaccaaatacttatggccctggatcggtccctcattccctgagtcatccaaactatcctcatatggagaaatcagcactaaagtggatggagcatctaggtcaggaggctcacagacaaaatacagtggtggacattctatgtgctggaacatgcccagtaagagttcccattttgcagcctcttgcaaaagcttctgggggtgctctggttcttcatgatgactttggggaggcctttggtgtgaacttacaaagggcatcgactagggctgcaggttcccatggtttgtttgagatacgctgctctgatgatattctcataactcaagttgtgggtcctggtgaagaggcacacactgatgctcatgaaacttttaaaaatgacacttctctctctattcaaatgctaagtgttgaagaaacacaaagctttgcactctccatggaaactaaaggagacatcaagagcgattacgtgtttttccagtttgcaattcaatattcaaacgtttatcaagccgatatttcaagggttattactgttaggttgccaactgtggatagtgtttcagcatatctagggagtgttcaagatgatgtggctgcagttcttattgctaagaggaccctcttgcaagcaaaaaactattctgatgctattgatatgcgagcaacaatagatgaaagagttaaagacatcactattaaatttggatcccaattaccaaagtcaaagctttatcggtttcccaaagagctctctgtattgccagagcacttattccatcttaggaggggtccacttttaggaagcattgtaggtcatgaggatgagaggtctgtattgcgaaatttgttcttgaatgcatcctttgatctgtctcttcgtatgatagcacctcgttgtctaatgcaccgggaagggggcacttttgaggaacttcctgcttatgatcttgctatgcagtctgatgctgcagttgttcttgatcatggcactgatgtcttcatttggttgggtgctgaacttgcctctgatgaaggaaaaagtgcttcagccttagcagcttgcagaacattggcagaagagctcactgaatcccggtttccggctcctcggatccttgcattcaaagagggaagttctcaggctcgatactttgtttctcgcctaataccagcacacaaagatcctccttacgagcaggaggcaagattccctcaacttcgaactttgacagcagaccagcgggttaagctgaaaagcagttttcttcactttgatgatcctagcttctgcgagtggatgcgtggtttgaaactagtgccaccagaaccaagctaagcctctcaatgaattgttttgtagttgatggttcctcccaaagggggagccttgggagtagttcatcctgctagcctcagtgaaaatctgtgtctcctgctcctccttgctttacttttttttcccatgataaatgaaatacaacacagaccatgttagtttgggaatggtgatcagacggatagaaccccaagttttttgttctttgttacattctatttttttttcctctcttttttatttcattggaaggagaaacatttatacccaaaatgtaactctagcttgaagttagtccttcacattctgtttctcaatttgaaatgccatggaacaataaagatcttccttgattcagatattatggtaacataattgtgctct

SEQ ID NO: 4412 - DNA, 3564 bp, Populus trichocarpa
gtggaccaatggtttctattttctaacgtagctgcctctctctcggaaaaaaccgaacacaactagagacgagagggaggttcttgattagtgaggacagaggaaccagaatccaaaaaattaataatccatttttgtattgatattttaaaaaaggaataaaagatttactttgcaaatctttcaattttcgttctcttcctctcaggtgtctgtgcggcacgaagattttggtgctcaattgcgcagagagatcaggttttcttgcttttaatttgatctctgaagctgtaaattttggttctttagacgggttcttgattgtattggggatttcttgaactgggtttgaatcagaatccattcttgttgctggggttttagattttattggggagttttggtttgtcgaactccttcaattctgtatcttcttctgcaacgaagtaaagattggtttgcaattcttgagctgccggtgtatcagacctttgtaggctgttttatctatgatttcttgattgattttctaccaataaatcaagtgacagtctcaaagttttcactttgaattctcctgtcctaattggctttgggataaaattgcttctagctttttgcagagtctgatttttgcttctaggttattcttgattatttgataaagaaatcttgaattgcaatggctaacccacctcaaccttcccttgggtactctgttactgctgttccctcaaaccctgactcatcaacccctcaaccagagaaaaattatgttcctcctcctacaatgttacctggagcttcccgatttcctcctcctaaattgcaccaagatcagatcccttccccttcgttccagaacccaaggttgttatcacctgccaatggggttaaaactgggagcccagttcctcatttaagcacccctcctggtcctcctgtttttacgtcaccagtccggcctgctgctgtgccttttcggacttctcctgcaactcctcaaccagttgctttctcatcaggctcaacattaccaacatcctcgcctccccatttttcaaatggttccattgagttgcagcaccaagttccccttgctacaaatgactccacacctttcgaggaatcatcatgtgctttgttctctgctcgcaaggtgttgaagcaaaagaaactagcaaatgtaccgagtttgggctttggggcattgttttctcctgggggagagatttctcctggtcctcaaataatacagcgtgatcctcaccgctgccacaattgtggagcttatgcaaatctttattgcaagattttactcggttcaggccagtggcaatgtgtaatttgccagaaactgaatggaagtgaaggtgaatatgtagctccaagcaaagaagaacttcgcaacttgccagaactttcatcacccatcattgattatattcaaattgggaacaagagacctggttttattccagtttctgattccagaatgtctgcacccactgttcttgttatagatgagtgtttagatgaaacccacctgcagcatttacaaagctctttgcatgcatttgtcgattcactcccccctacagcaagaattggaataatactatatggccgtacagtatcagtttatgatttttcagaggaattaatggcatctgctgatgtacttcctggtgacaaatcacctacccgagagtccttgaaagcattgatttatggaactggtgtgtacttgtcgccgatgcatgcttcaaaggaagtggcacacaaaatattctcatctttgagaccattcggattgaacattgcagaatcttcaagagaccggtgcctgggtactgcagttgaggttgctctggctataattcaaggaccatcagcagaaatgtctcgaggcataattaaaagggctggaggtaatagcaggattatcgcgtgtgctgggggaccaaatacatatggccctggatcagtcccgcattcttttagccatccaaattatcctcatatggaaaaaacagcattgaaatggatggagaatctgggtcgtgaagcgcatagacataatacagtagttgatattctatgtgctggaacttgccctgttagaattccagtcctgcagcctcttgcaaaagcttctggaggtgttttggttcttcatgacgactttggagaggcctttggtgtgaatttgcaaagggcagcttctagggcatcacgtttccatggcttgttggagattcgatgttctgatgatattctaattactcaagttgtgggtcctggtgaagaggcacatgtagacacacatgaaacttttaagaacaacaatgctctctgcattcaaatgctaagtgttgaagaaacacagagctttgcactttctatggaaactaaagaagacatcaaaagcgattgtgtatttttccagtttgctgttcgatacgctaatgtttatcaagctgatatttcaagagtggttactgtcaggttgccaactgtggatagtgtttcagcatatcttgaaagtgttcaggatgaagtggctgcaatcctcatggccaagagaaccctcttgcgagccaaaaaccattcagatgtcatggatatgcgaggaacaatagatgagagaattaaagacattgctttgaaatttgggtccctagttcccaagtcaaagcttcatcaatttcctaaagaactttctgcattatcagagctccttttccatcttagaaggggcccgcttttgggaagcattgttggtcatgaagatgagaggtccgtgttgcggaatttgtttttgaatgcatcttctgatctttcactccgtatggtagcacctcgttgtctaatgcaccgagaagggggcacttttgaggaactaccagcttatgaccttgcgatgcagtctgatacagctgttgttcttgaccatggtacagatgtcttcatttggttgggtgctgagctagctgctgatgaaggaagaagtgcagctgctttagcagcttgcagaacattagctgaagaaatcactgaattgcggtttccagctcctaggatccttgcattcaaggaggggagctctcaagctagatattttgtttctcggctgattcctgcacacaaggatccaccgtatgaacaggaggcaagattcccgcagcttagatctctgacaatagaacaacggatgaagctaaaaaccagctttattcactttgatgatccaagtttctgtgagtggatgcgtagtttgaaagtggtgcccccataaccaagttaatctgtaattttacataatttaatggctaatgtacccccagaaaaaggggttcttgggaactgcatcctgcattgccccccttgatggtgtcggtaggtatcatttcatctttaaatttttcaataagaaaacatccatacttgactgtcacttgaagaagtttgaaactgttccatcctattctgtttcccagctgacatgcttttagagagcaatacaaagttcctgtttttgcccccctcttcgcatcttcttag

SEQ ID NO: 4413 - DNA, 3292 bp, Fragaria vesca
agtttcaatccaatttgtataattttgtttagattgcttagcacacagtttaggttcactgaaatttagttgaattttcgatatagccgaggggtgttaaggtggttgtggctttgattgaaacaacattttcgattttcgatgtcgaatccgccaccgcaaccttcccttggatactttagtccctcaaagtcagacacttcatcacctgaccctgccagcaatgccattcctcctccacctttggtttcccccggacaatccagatttcctccgccaaagtttcagctggatcagctacctcccccatcaatcagaactccgaatgggccatcaccagctagtggtggactgaaaaccggcagccccattcctcatttgagtactccccccggacctcctgtttttacttcccctgtccgtcctgctgccgtgccttttcgtgcttcgcctgtaactcctcagccagttgctttctctccggcagcatctttgccaacttcttcgcctgtttatttttcaaatgggtctcatgagttggagcgcgaactgtccaatgtcacagatgatgatacagtgcctgttggtgaaccaccgtatgtcctattctcagctcataaggtgttgaaacaaaagaaacaagcaaatgtaccaagtttgggttttggggcattggtttcccctgggagggaagtttctccaggtcctcaaataatacaacgtgatcctcatcgctgccacagttgtggagcttatgcaaatatctattgcaacattttactgggctcaggtcagtggcagtgtgtaatctgccgagaactgaatggtagtgagggtgaatacatatcttctagcaaggaagaactttccaactatccagagttgttgtctcccatggttgattatgttcaaactgggaacaatagacctggttttgttccagtttctgattctagaatgtctgcacccattgttcttgttatagacgagtgtttagatgaaccacatctctggcatttacagagctccttacatgcctttgtcgattcacttcccccgacaacgagaattggaatagtactgtatggtcgcacagtatcagtttatgatttttcagaggagtcaatcgcatctgctgatgtgcttccaggtgacaaatcaccgtgccaggagtacttgaaggctttgatatatggaactggtatatatttgtctccaatgcatgcttcactgcctgtagcacatgccatattttcatcattaaggccgtacaaactgaacgtttcagaagcttctagagcccggtgccttggcacagcagttgaggttgcccttgctataattcaaggcccatcagcagacatttctcgaggggtaatcaaaaggtcaggaggtaatagcagaatcattgtttgtgctggtggacctaatacttatggtcctggatctgttcctcattctttcagtcatccaaattatgctcacttggaaaagaccgcgttgaaatggatggagcgtctgggtcaagaggcacaccgacacaatacggtagttgatattctttgtgctgggcaatgccctgtaagagttcctgttttgcagcctctcgcaaaagcttctgggggtgtttttgttctccatgatgactttggcgaagcctttggagtgaacttgcaaagggcatccgccagggcagcaggatcccgtgggttcttggcaatacgctgttcagatgatattctcataactcaagttgtgggtcctggtgaagaggcacatatagacactcatgaaaccttcaaaaatgatacttctctttacatacaaatgccaagtgttgaagaaacacagtgcttctcactctccttggaaaataagagggacattaggaccgagtatgtgtacttccagtttacaattcagtacctgaatgtttatcaagctgatatatcaagagtaataactgttagactgccaacagttgatagtgtttcagcatatcttgagagtgttcaagacgaagttgcagcagttcttattgcaaagaggacactgttgcgagccaaaaacagttctgatgcgtttgatatgcgatcaacaatagatgaaagaattaaagacattgctttgaaatttggttctcaagtaccaaaatcaaagcaatatcgtttccctaaggagatatcgttattaccagagctcttgtttcatcttagaagaggcccactgttgggaagcattgttggccatgaagatgaaaggtctgtgttacggaacttgtttctgaatgcatcctttgatctgtctctgcgaatggtagcacctcgttgtctaatgcatcgggaagggggaacgtttgaggaactaccagcttatgaccttgctatgcagtctgatgcagcagttgttcttgatcatggcacagatatcttcatttggttgggtgctgaactttcttctgatgaaggaaaaagtgcggctgctttagctgcttgcagaacattggctgaagagatcagtgaattgcggtttccagcccctcggattctttccttcaaggaaggaagttctcaggctcgatattttgtatcgcggctcattcctgcacacaaggatcctccttatgagcaggaggcaagatttcctcagctacgaactttgacaatagaacagcggacaaagctgaaaagcagttttattagttttgatgatcctagcttctgtgagtgggtacgaagcttgagagtggttcccccagaaccaagctagatggtattggccctctttaatcttgagggctaatgtttctacatgaagtcagtgttgcaagttgtaatagaggaaaatgtgtcattagtcattaccgaagaaaattttgtgttctttcattttcattggtaagaggaaattgtagttcagaaatgtctggacaggaaaggtatagttctcgtaatccctctatacggttagcagttaactttgttcaatagcattagctgcaacattttgtttggagcttcttttatttttaaatttataccttgtgtgggtattggggttaatagtcaattattgactggcctctcatgtcctatagatatttagtttgatatcacctttgtcatttgcagattttcttcacaatgttgtctactaaaagaacatagagagccgtgaacaaaaactcttcactctcatgagtagagtgtaaaccagtaaactctagaaatggcaaatcgagtgtcaagaacatgtttaaaataggattatgaaggccacccataagctctta

SEQ ID NO: 4414 - DNA, 3533 bp, Citrus clementina
aacacgggcatacacataacaccgttgagttaagggcaagagaaaaaggcttgctttatgcatcacataaaaaccacaacacataaaaactcgaattctgaaattcatgatatacattccggctttttgaatttgaaaaagatcacctttctctcaattcccttctctcagataattaattgtgggagaagggtacaattttgtggaaagagatagctaggtgagattttatcaaagcccgttagtttgtcgaagtgaaactgaatttaattttggaaggtattgagaattatcgttgcttagtaaaggatccttcgaatttctatggctaatcctccacaaacttcccttggatactctgttactatcggtccttcaaatcctgacatatcatcacctcagcccgagaaaagtctaattcctcctcctccaatgtcctccgcaccacctagatttcctccgccaaagttacaacaagatcatatgacttccccatctattaaaacgccaaatttactgtcacctgcaaatggggtaaaaactggcagcccaattcctcatttgagcactccacctggccctcctgtcttcacttcacctgttcggcctgctgctgtgcctttccggacctctcctgcaactcctcagcctgttgctttgtcttcgggttcatcttttcctacatcttcacctccccatttctccaatgggtcagctgaattgcagcatcaagttcctcatgctgcagaggagacgatgcctgttggggaatcctcatgtgttttattctcagcacacaaggtgttaaaaaagaagaaacaagctaatgtacccagtttaggttttggggccctggtttcaccaggaaaggaggtttcaccaagtttgcaaataatacagcgtgatcctcatcgatgccataattgtggagcatttgcaaacatctattgcaaaatattacttggctctggtcagtggcagtgtgtaatttgccggaatctaaatggaagtgaaggtgaatatgtagctcccagcaaggaagaacttcgcaactttcctgaactgtcgtcgcccatggttgattatgttcagactgggaacaatagatccagttatgttcctgtctctgattccagaatgtctgcacccattattcttgtaatagatgagtgcttagatgagccacacctccagcatctacagagctctctgcacgcatttgttgaatcaattccacctacagcgagaattggaatcatattgtatggtcggactgtttcagtttatgatttttcagaggattcaatagcatcgtctgatgtacttgctggtgacaaattgcctactgaggactccttgaaagctttgctttatggaactggagtatacttgtcaccaatgcatgcctcaaaacaagtggctcatgacatattttcttcactaagaccatataagttgaacattactgaagcttcaagagacagatgtctgggaacagcagtggaggttgcccttgccataattcaaggtccgtcagctgaaatgtctcgaggggtggttaaaaggccaggaggtaatagcagaattattgtgtgcgctggtggacctaacacttatggccctggatcagtccctcattcttttagtcatcccaactatcttcatatggaaaagatggctttgaaatggatggagcttctaggtcgaaaggctcatcagcacaacgctgttattgacattctatgcgctggaaattgccctgttagagttcctgttttgcagcctcttgccaaagcttcaggtggtgtgttggttcttcatgatgactttggtgaagcctttggtgtgaatttgcaaagagcatccacaagggctgcaggatcccatggtttcttggagatacgctgttctgatgatattcttgtaacccaaattgtgggtcctggtgaagaggcacacatagacactcatgaaacatttaaaaatgatgctgctctctctattcaaatgccaagcgtcgaagaaacacagagctttgcagtgtccatggaaaacaaaagagatattgagagtaatcatgtttttttccagtttgccattagatattcaaatgtctatcaagcagatatttcaagagtagtaactgtcaggttacccactgtggatagcgtttcagcttatctctcaagttttcaagatgaagtggctgcagtccttattgcgaagaggacgcttttgcgagccaaaattttttctgaagctattgatatgcgaaccatgatagatgaaagagttaaagatattgctttaaaatttggatcccaagtaccaaagtcaaagctttatcggtttccaaaggaactttctgctttgtcggagctcctatttcatcttagaaggagcccacttttaggaaatattattggccacgatgatgagaggtctgttctacgaaatttgtttctgaatgcatcctttgatctgtcgcttcgcatggttgcacctcgctgtcttatgtaccgtgaaggaggcacttttgaggagcttccagcttatgatcttgctatgcagtctgataaagcagttgttcttgaccatggcacagatgtcttcatttggttgggtgctgaacttgctgctgacgaaggaagaagtgcagccgcattagcagcttgcagaacattggctgaagaactctctgaatttcggtttcctgctcctcgtatccttgcattcaaggaggggagctctcaggctcggtactttgtaacccggttgataccagcacacaaggatcctccttatgagcaggaagcaagattcccacaacttcgatcattgacaccggaagagcggattaagctgaaaagcagttttttattctttgatgatcccagcttctgtgaatggatgcgaagcttgaaagtagtgcccccagaaccaagctaagcaatgttgtgaattctagtggctaaatatacctgaaaaaaggaagtctaggtagggagctcaaaccgctcagccctgtattctattggaggtgcaaaactgtcttctccttttctttttccttcattttgtccccaccgataaagaaattgtaacttggaggaagtctagggatatcttctggtctttttttcttttctcatgcaattttttttttcaaaaaacattttacaactgacagtagctggaaatttctgaaattggtacattaacatattgtttatttggttgatgtgatttggcagagcaataaacatatcctttcttcagttcactgacatgcagctgactatatgttcagcacttctgatgaaaagagtaaatgcagaaagtgagtaaaatgaatctgtaggtaacaaagatggttccaaattcatgggttaagtaagctaaacttgattcccaagcaaagagagggatggtgtactggtgtcgtatttttgtctatgcgatttaaagaaagattcatgattcttttatcatggaaccaaaaaacccaaggagcctaatggaacatcaaatca

SEQ ID NO: 4415 - DNA, 3539 bp, Citrus sinensis
cggcaacacgggcatacacatctaacaccgttgagttaagggcaagagaaaaaggcttgctttatgcatcacataaaaaccacaacacataaaaactcgaattctgaaattcatgatatacattccggctttttgaatttgaaaaagatcacctttctctcaattcccttctctcagagaattaattgtgggagaagggtacaattttgtggaaagagatagctaggtgagattttatcaaagcccgttagtttgtcgaagtgaaactgaatttgattttggaaggtattgagaattatcgttgcttagtaaaggatccttcgaatttctatggctaatcctccacaaacttcccttggatactctgttactatcggtccttcaaatcctgacatatcatcacctcagcccgagaaaagtctaattcctcctcctccaatgtcctccacaccacctagatttcctccgccaaagttacaacaagatcatatgacttccccatctattaaaacgccaaatttactgtcacctgcaaatggggtaaaaactggcagcccaattcctcatttgagcactccacctggccctcctgtcttcacttcacctgttcggcctgctgctgtgcctttccggacctctcctgcaactcctcagcctgttgctttgtcttcgggttcatcttttcctacatcttcacctccccatttctccaatgggtcagctgaattgcagcatcaagttcctcatgctgcagaggagacgatgcctgttggggaatcctcatgtgttttattctcagcacacaaggtgttaaaaaagaagaaacaagctaatgtacccagtttaggttttggggccctggtttcaccaggaaaggaggtttcaccaagtttgcaaataatacagcgtgatcctcatcgatgccataattgtggagcatttgcaaacatctattgcaaaatattacttggctctggtcagtggcagtgtgtaatttgccggaatctaaatggaagtgaaggtgaatatgtagctcccagcaaggaagaacttcgcaactttcctgaactgtcgtcgcccatggttgattatgttcagactgggaacaatagatccagttatgttcctgtctctgattccagaatgtctgcacccattattcttgtaatagatgagtgcttagatgagccacacctccagcatctacagagctctctgcacgcatttgttgaatcaattccacctacagcgagaattggaatcatattgtatggtcggactgtttcagtttatgatttttcggaggattcaatagcatcgtctgatgtacttgctggtgacaaattgcctactgaggactccttgaaagctttgctttatggaactggagtatacttgtcaccaatgcatgcctcaaaacaagtggctcatgacatattttcttcactaagaccatataagttgaacattactgaagcttcaagagacagatgtctgggaacagcagtggaggttgcccttgccataattcaaggtccgtcagctgaaatgtctcgaggggtggttaaaaggccaggaggtaatagcagaattattgtgtgcgctggtggacctaacacttatggccctggatcagtccctcattcttttagtcatcccaactatcttcatatggaaaagatggctttgaaatggatggagcttctaggtcgaaaggctcatcagcacaacgctgttattgacattctatgcgctggaaattgccctgttagagttcctgttttgcagcctcttgccaaagcttcaggtggtgtgttggttcttcatgatgactttggtgaagcctttggtgtgaatttgcaaagagcatccacaagggctgcaggatcccatggtttcttggagatacgctgttctgatgatattcttgtaacccaaattgtgggtcctggtgaagaggcacacatagacactcatgaaacatttaaaaatgatgctgctctctctattcaaatgccaagcgtcgaagaaacacagagctttgcagtgtccatggaaaacaaaagagatattgagagtaatcatgtttttttccagtttgccattagatattcaaatgtctatcaagcagatatttcaagagtagtaactgtcaggttacccactgtggatagcgtttcagcttatctctcaagttttcaagatgaagtggctgcagtccttattgcgaagaggacgcttttgcgagccaaaattttttctgaagctattgatatgcgaaccatgatagatgaaagagttaaagatattgctttaaaatttggatcccaagtaccaaagtcaaagctttatcggtttccaaaggaactttctgctttgtcggagctcctatttcatcttagaaggagcccacttttaggaaatattattggccacgatgatgagaggtctgttctacgaaatttgtttctgaatgcatcctttgatctgtcgcttcgcatggttgcacctcgctgtcttatgtaccgtgaaggaggcacttttgaggagcttccagcttatgatcttgctatgcagtctgataaagcagttgttcttgaccatggcacagatgtcttcatttggttgggtgctgaacttgctgctgacgaaggaagaagtgcagccgcattagcagcttgcagaacattggctgaagaactctctgaatttcggtttcctgctcctcgtatccttgcattcaaggaggggagctctcaggctcggtactttgtaacccggttgataccagcacacaaggatcctccttatgagcaggaagcaagattcccacaacttcgatcattgacaccggaagagcggattaagctgaaaagcagttttttattctttgatgatcccagcttctgtgaatggatgcgaagcttgaaagtagtgcccccagaaccaagctaagcaatgttgtgaattctagtggctaaatatacctgaaaaaaggaagtctaggtagggagctcaaaccgctcagccctgtattctattggaggtgcaaaactgtcttctccttttctttttccttcattttgtccccaccgataaagaaattgtaacttggaggaagtctagggatatcttctggtctttttttcttttctcatgcaattttttttttcaaaaaacattttacaactgacagtagctggaaatttctgaaattggtacattaacatattgtttatttggttgatgtgatttggcagagcaataaacatatcctttcttcagttcactgacatgcagctgactatatgttcagcacttctgatgaaaagagtaaatgcagaaagtgagtaaaatgaatctgtaggtaacaaagatggttccaaattcatgggttaagtaagctaaacttgattcccaagcaaagagagggatggtgtactggtgtcgtatttttgtctatgcgatttaaagaaagattcatgattcttttatcatggaaccaaaaaagccaaggagcctaatggaacatcaaatca

SEQ ID NO: 4416 - DNA, 3193 bp, Citrullus lanatus
cggaagttgagttttcaccgtagacgacggtcgacggacgtcgcggctgccgagaaagttcgactgcaacggcggttgccaccattgccagtctctgcttagtcagactcagtctgtttacgccgacgaacgctttttcctggttaggttatacgaatttgagatgaatttcgcttcattcgatcaattgcctgattcctttcatctgatcagtcttcgattttgtgcttcttctttgggttatttgcaatgaatgcatctggattccaccatcccctggaccttttttgactagtttgttatatgatatcatcctcattgtcctccgatcgtgttctcactcgtcgattctcgttgttctcgactcccaaatggcctatacaccgcagtcttcccctggattctccgccacgcaacccgacaccgcagcaccaagctctgagacaaatccgatacctccgcccttaatctcgacaggaacatccagatttcctccaaaattccaaccggatcagatgccatctccttctatcagaacgccatctgcaccctctccggcgaatggaattaaaactggcagtcccattcctcatttgagtactcctcccggaccccctgtttttacttctcccatcaggcctgctgctgtaccctttcgtacttcaccggcatctcctcagccaattatcttctcttctacttcgtccttgccagcttctacacctccacattttttgaatgcatcggctgtgttgcaacaccagatatctgatgttgcagaggactcaatgcttgtagaggaatcgccaaatgttctattttcttcgcagaaggtgctgaagatgaagaaacaagctaatgttcctagtttgggttttggagcactgctttcacctgggagggagatatcatcaggtcctcaaataatacagcgtgagccccatcgttgcccaagctgtggagcttattcgaatctgtattgcaagatcttaattggttcaggtcagtggcagtgtgtaatttgtaggaagttgaatggaagtgagggtgaatacgttgcaccgagcaaagaagatctttctcattttccagaactatcatcatctatggttgattatgtcagaactgggaaccggagaccaggatttattccagcttctgactcaagaacgtctgcacccattgttctggttattgacgagtctttagatgaaccacatctgcagcatctccagagctccttgcatgcttttattgattcagtttcccccactacaagaattggaattatactgtatggccgtactgtatcagtttatgatttttcagaagaatctgttgcctctgctgatgtgcttcctggagataaatcaccaactccggagtctttaaaagcattaatttatggaaccggaatatatttatcaccgatgcacgcctcactccctgtagcacacacaatattttcatcactgaggccttataaatcaagcattccagaagcttctagagatagatgccttggtactgcagttgaagttgctcttgccataatccaaggaccttcagcagaagtgtctcgaggagtggttagaaggtcgggggctaatagtagaattattgtttgtgctggtggaccgaacacatatggccctgggtcagttccccattctgtcagtcacccaaattacctgcacatggaaaagtctgctcttaattggatggagcatcttggtcgtgaggctcatcaacagaatacagtggttgatattctatgtgctggaacatgccctgtaagagttcctatcttgcagcctcttgccaaagcttctggtggtgttttggttcttcacgatgactttggggaggcctttggtgtaaacttgcagagggcatctgctagggctgcaggttctcatggtttattagaagtacgctgttctgatgacattgtaatcactcaagttgttggtccgggcgaagaggctcatatagatacacatgaaaccttcaaaaatgacacctctctgtacattcaaatgctaagtgtagaagaatcccagagcttctcactctccatggagactaaaagagacataaagagtgattttgtatttttccagtttgttgtacaatattcaaatgtttatcaagctgacatatctagagtaattactgtcagattacctactgttgatagcttatcagaatatctcgaaagtgttcaagatgaaatagctgcagtccttattgccaagaggacggctttgcaagctaaaagccagtctgatgcaatagatatgcgggctacaatagacgaaagagtaaaagatattgctttgaaatttgggaccccagcaccaaagttgaagatttatcggtttccgaaggaactatcttcaatgccagagcttctgtttcatttgagaagaggccctcttcttggaagcattgttggtcatgaagatgaaaggaccgtcttgagaaacttgtttttgaatgcatcttttgacctttccctccgtatggtagcacctcgctgtttaatgcaccgggaggggggtacttttgaagagcttccagcatatgacctagctatgcagtcagatgctgctgttgtgcttgatcatggaacagatgtcttcatttggttgggtgctgagcttgcagctgacgaaggaaaaagtgcagctgctttagcagcttgcagaacattggcagaagaacttactgaatcaaggtttccggctcccaggattcttgcattcaaggaagggagctctcaagctcggtattttgtttctcggctgataccggcacacaaggaccctccttacgaacaggaggcgagatttccacaacttagaacattgtccacagaacagaggacaaagctgaaaagtagttttcttcatttcgatgatcccagtttctgtgaatggatgcgaagcttgaagttgatcccaccagaaccaagttaaaagtaggatttactctctctctctctctctctctctctctctccttctttttgtggatctctccttccagtttttcctctctctctctctcttcatacgggaaaaatttataccgactaaagaagttctttcgcatttgtattcttacggatggttgcaataagctttggaggaacgatagattattttatgcgatctcgtgcgaggcaggt

SEQ ID NO: 4417 - DNA, 2479 bp, Castanea mollissima
gtgccatctccatccaatggcgttaaaatgggaagtcccattcctcacttaagcactccccctggaccccctgtctttacttcgcctgtccgtcctgctgctgtgcctttccgctcttcacctgcatctcctcagccagttgcattctcttccggttcgtcattgccaacatcttcacctccccacttttcaaatggatcagttgagttgcagcaacaagtttctgacgatacattggacttgacgccagctggggattcagcatatgttctattttcagctcataaggtattaaagcaaaagaagctagcaaacgtacctagtttaggttttggggcacttctttctcctggcagggagatttcatcaggtcctcaagtaatacaacatgatccccatcgctgccaaagttgtggagcctatgtcaatttctactgcaaaatattaattggctcaggccagtggcagtgtgtaatatgccatgaactgaatggaagccagggtgaatatatagctcccaacaaggaacttcttcgtacctttccagaactgtcatcacctatggttgactatattcaaactagtaacaatagacctggttttattccagtttccgattcaagaatgtctgcacctattattcttgtcatagatgagtgcttagatgaaccacaccttcagcacttacagagctccctacatgcatttgtcgattcacttcacccgtcaacaaaattaggaattatttcctatggccgtacggtatcagtgtatgatttttcggaggagtcggttgcatctgctgatgttcttcctggtgacaaatcaccaactcaggaggcactgaaagcattgatttacggaagtggcatatacttgtcacaaatgcatgcttcactacctgtagcacatgccatattctcatcaatgagaccatacaaattgaactttccagaagcttctagagaccggtgcttgggtacagcagttgaggttgctcttgcaataattcaagggccatcagcagaattgtctcgaggggtagttaagaggtcaggtggaaatagcagaattattgtgtgcgctggtggacctaatacttatggccctggatctgttcctcattcatttagtcacccaaattatcctcatatggaaaagatggcattgaaatggatggagcaactaggtcaggaggctcatagacacaatacaatggttgacattctatgtgctgggacatgccctgttagagttcctgtgttgcagcctcttgcaaaagcttctgggggagttttggttcttcatgatgactttggagaagcctttggcgtaaacttacaaagggcatctagcagggcagtaggttcccatggtttgttggaaatacggtgttctgatgatattcttataactcaagttgtgggtcctggtgaagaagctcatgtagatactcatgaaacttataagaatgactcttctctatatattcagatgctaagcgttgaagaaacgcagagcttctcactctccatggaaactaaaagagatattaagagggattatgtattttttcagtttgcagttcagttttcaaatatgtttcaagctgatatatccagagtaattactgttagattgcctactgtggatagtgtttcagcatatcttgagagtgttcaagatgaagtggcagcagttcttattgccaagaggaccctcttgcgagccaaaaactcttctgatgcagttgatatgcgaacaacaatagatgaaagagttaaagacattgctttaaaatttgggtcccaaataccaaagtcaaagctttatcggttccccaaagagctctctttattaccagagctcttattccatctcagaaggggcccacttttgggaagtattattggtcatgaagatgagaggtctgtattgcggtatttgtttttgaatgcatcatttgatctttcacttcgtatggtagcacctcgttgtctaatgcaccgggaaaagggaactttcgaagagctgcccgctcatgaccttgctatgcagtcagatgcagcagttgttcttgaccatggcacagatgtcttcatttggttgggtgctgaacttgctgctgatgaaggaagaagtgcatctgctctggcagcttgcagaacattggctgaagagatgactgaattgcgatttcctgctcctcgtatccttgctttcaaggaggggagctctcaggctcggtattttgtttctcgactcatacctgcccataaggatcctccatacgagcaggaagcgagatttccccagcttcgtagtttgacaacagaacagcgaatgaagctgaaaagcagttttcttcactttgatgatcctagcttctgtgagtggatgcgaagtttgaaatcagtgccaccagaaccaagctaaagaagaaagggagtctgaatcgtttcaccatttcatcaccaat

SEQ ID NO: 4418 - DNA, 2812 bp, Cucumis sativus
cctttcatctgatcagtcttcgatttttgtgcttgttcttcgtgttctttacaatgaatccatctgaattccaccatcctgtggagtttttcgactagtttgttgtatgatatcatcctcattgttattcgatcgttgaactcgttgattctcgttgttatcgtctccgaaatggcttatacatcgcagtcttctcctggattctctgccacgcaacccgacaccccagcgccaagctctgagacaaattcgattcctccgcccttaatctccacaggatcatccagatttccgccaaaattccaacaggatcagatgccatcgccttctattaaaacgccaggtgcagcttctccggcgaatggaattaaaactgggagtcccattcctcatttgagtactcctcccggaccccctgtttttacttctcccattaggcctgctgctgtcccctttcgtacttcaccggcatctcctcagccagttgtcttctcttctgcgtcgtccttaccagcttctacacctccacatttttttaatgcatcgtctgggttgcaacatcagatgtctgatgtttcagaggattctacgtctgtagcggaatcgccaaatgttctattttcttcgcagaaggtgccgaagacaaagaaactagctaatgttcctagtttaggttttggagcattggtttcgcctgggagggagatgtcatcgggtcctcaaatattacatcgggaaccccatcgttgctcaagttgtggggcttattcaaatctgtactgcaacatcttaatcggttcaggtcagtggcagtgtgtaatttgccggaagttgaatggaagtgagggtgaatacgtggcaccgagcaaagaagacctttgtcattttccagaactatcatcatctatggttgattatgtcagaactgggaaccggagaccaggatttattccagcttctgactcgagaacatctgcacctattgttctggttattgacgagtctttggatgagccacatctgcagcacctccagagctccttgcatgcttttattgattctgtttcccctacaacaagaattggaattatactgtatggtcgtactgtatcagtatatgatttttcagaagaatctgttgcctctgctgatgtgcttcctggtgataaatcaccaactccggattctttaaaagcattaatttatggaacagggatatatttatcgccaatgcacgcctcactcccagtagcgcatacaatattttcatcactgagaccttataaatcaagcgttccagaagcctctagagatagatgccttggtactgcagttgaagttgctcttgccataatccaaggaccttcagcagaagtgtctcgaggagtggttagaaggtcgggggctaatagtagaattattgtttgtgctggtggaccgaatacatatggccctgggtcagttccccattctgtcagtcacccaaattacctgcacatggaaaaatctgctctaaattggatggagcaccttggtcatgaggcccatcaacaaaataccgtggttgacattctatgtgctggaacgtgccctgtaagagttcctatcttgcagcctcttgcaaaagcttctggtggtgttttggttcttcatgatgactttggggaggcctttggtgtaaacttacagagggcatctgctagggctgcaggttctcatggtttattagaagtacgctgttctgatgacattctaatcacccaagttgttggtccgggcgaagaggcacatgtagatacacacgaaaccttcaaaaatgacacctctctttacattaaaatgctgagtgtagaagaatcccagtgcttctcactctccatggagactaaaagagacctaaagagtgattttttatttttccagtttgttgtacaatattcaaatgtttatcaagctgacatatcgagagtaattacagtcagattacctactgttgatagcttatcagaatatcttgaaagtgttcaagatgaaatagctgcagtccttattgccaagaggacagctttgcaagctaaaagccagtccgattcaacggatatgcgggttacaatagatgaaagagtaaaagatattgctttgaaatttggtagcctggcaccaaagtcaaagatttatcggtttccaaaggagttatcttcagtgccagagctgctgtttcacttgagaagaggccctcttcttggaagcattgttggtcatgaagatgaaaggtccgtattgaggaacttgtttttgaatgcatcttttgacctttccctccgcatgatagcacctcgctgtttaatgcatcgggaggggggtacttttgaagagcttccagcatatgatctagctatgcagtcagatgctgctgttgtgctcgaccatggaacagatgtcttcatttggttgggtgctgagcttgcagctgaagaaggaaaaagtgcagctgctttagcagcttgcagaacgttagcagaagagcttaccgaatcaaggtttccagctcccaggattcttgcattcaaggaagggagctctcaagctcggtattttgtttctcggctgattccagcacacaaggaccctccttacgaacaggaggcgagatttccacaacttagaacattatcgacagaacagagaacaaagctgaaaagtagttttcttcatttcgatgatcccagcttctgtgaatggatgcgaagcttgaagttgatcccaccagaaccaagttgaaaactaggatttactctctctttcttcttct

SEQ ID NO: 4419 - DNA, 3435 bp, Gossypium raimondii
ttaaaaccccaacaaatagaggaacaaagggtgagtgattaaaaagaataaaagattattatgattccaagtctatgatgattcaaacaaaaagattctcctttctttctcattttcctctcatatcagattttggattttggaagaaaggtattgtattgaagtttgaattgaggtgtaagatagagagctgagtgatcaaagctccttcatttggaaggtgaattttatgggtgggggattcttgaatcttgattgaattcttgcaaattgctttgttttgttttgtttttttgggttcccttcgaaatccaatcttggctgttgtttgtttatgggggttttatggttttcttttggtgaacaccgcatcgaagtttttcgcaaaagcttgaatttggtagggcgttacttgtttttagtccctttgtttcatcgttcttgatattcaattaagagaaagctttcaattcaattgcaatggctactccgccacaagcatctcccggagcacctaatactgataaaaagagtccaatgactcctgctcctcccacaatttcacctggtgcacctagattcactcctccaaatttacaacaagatcagatcgcttccccttcgataaagaatccgattatgctatcaccggaaaatggggtcaaaaccggaagccctgttccccatctgagtactcctcctggccctcctgtatttacatcgcctgtccggcctgctgccgtgcctttccgaacctctcctgtgaccccccagccggtggctttctcatcaggttcgtctttgcccacatcttcacctccccattttccgaatgggtcagctgagcttcaacagcaacttcccggtgctacggaggaatcaatgcccgcaggagagtcaccatgcgttttattctcagctcataagttgttgaaacacaagaagctagcaaatgtacctagtttaggcttcggagtattggtttctcctgggagggaaacttcaacgggtcctcaagtgatacaccgtgatcctcatcgatgccataattgtggagcttattcaaatctttattccaacatactaattggctcaggccaatggcagtgtgtaatatgccggaatctaaatggaagtgaaggtgaatatatagcttcaagcaaggaagagctccgtaattttcctgagctgtcatcacctttggttgattttattcaaacagggaataagaggccaagttttgtacctgttactgattccagaacttccgcaccggttgttcttgttattgatgaatgtttagatgaggcacaccttcagcatttacagagctccttgcatgcttttgtcgattcagtaccaccgacaaccagaataggaatcattttgtatggtagcacagtatcagtgtatgactttacggaggaatccatagcgtctgctgatgtgattcctggtggcacttcaccaacacaggagaccttgaaaggattgatttatggaactggtatatacttgtcgccaatgcatgcttcaaaagaggttgcacacctaatattctcttcattgaggccatacaagttgaatgttccagaagtgtcaagagatagatgcttgggtactgctgttgaggtcgctatggcaattattcaaggaccatctgtagatatgtctcgaggtgtagttaaaaggccaggtggcaatagcaggatcattgtttgtgctggcggaccaaatacttatggtcctgggtctgtccctcattcttatactcaccctaattatcctcatagagaaaagacagcaatcaaatggatggagcgacttggtcgtgaggctcatcaacataacatagtggttgacattctctgtgctgggacttgccctgtaagggttcctgtgctgcagccacttgcaaatgcttcaggaggtgtgttggttcttcatgatgactttggtgaagcctttggtgtaaacttacaaagggcatctgccagagctgccagttcccatggtttgttggagatacgttgttctgatgatattcttgttactcaggttgtgggtcctggtgaagaggcaaatatagacacccatgaaacctttaaaaatgatatggctgtctctattcaaatgctgagtgttgaagaaacacagtgcttctcaatatcgatgcagaataaacatgacatcaagagtgattacgtatttttccagtttgctattcaatactcaaatgtttatcaagctgatatagctagagtgattactatcagattgccaactgtggatagtgtttcggcctatcttcagagtgttcaagatgaggtggctgcagtcataattgccaagaggactctgctgcaagcaaaaagttattctgatgcaattgatatgcagacaacaatagatgagagagttaaagatattgcttcaaaatttgggtctcaagtgccaaagtcaaagctttatcggttcccaaaagaaatatctttactaccagagcttctattccatcttaggaggggcccactgttgggaagtatagttggtcatgaagatgagaggtctgtactgcggaatttgtttttgaatgcatcctttgatctttctcttcgcatgattgcccctcgttgtctgatgcaccgggaaggaggcactttcgaagaattgcctgcttatgatctcgccatgcagtctgatacagctgttgttctagaccatggtacagatgtcttcatttggttgggtgccgaacttgcagctgatgaaggaagaagtgcagcagctttggcagcttgtagaacattggctgaagagctcacggagttacgatttccagcacctcggatcctggcattcaaggagggcagctctcaggctcgatattttgtttctcggctcataccagcaaacaaggatcctccttacgagcaggaggcaagatttcctcagcttcgaaccctgacaattgaacaacggacgaaactgaaaagcagttttatacatttcgatgatccgagcttctgcgaatggattcggggtttaaaagcagtgcccccggaaccaatctaagagatgttttaggtatttttgcagttaaaatccctccaaaaaaggagtccccggagagttgcatccaatcatcatttattcggtaccattctgctctttctttttgttcttctccctgttgaaggaatgtaatctaactcattcatcttttcctttttcctaatcaattttttcccttttctagtttttttttttttaatacaagatttccctttttgttaaagaaacttgaaaggataagctatacttgatagtaaactgttacaagtttcagaattgttctttcatttttttagctgaaaatgatttgttagagcagtgcatggtgtcatttttatatcaaattattatgccattttt

SEQ ID NO: 4420 - DNA, 1514 bp, Abies balsamea
ttctaagaggaaatgggtttgtttgcatttgtgagtttgttcctcttcattgtattatcatccgttgaagcatggaggccatggcctcaatatttcaatcagactactacagctttgggactgaaacaacagccctacaaggcagatttgcagtttgggacttcgaagaagaatgaagggtcctcaccatatgtgaatatgaagtaccacatgggacctgtgctgacttctactatcaatgtccatacaatttggtatggcaggtggagtttgaaggagaagaggattataaatgagtttctgctgtctatctctaataatacaaagagcccttctgtgggtcagtggtggcaaacagtgcagctgtatactgatcaaactggtgccaatattagcagaaacatagtgatcgctagtcagcacgaagattattactcccatggcaagatactgagtaggctgactgttcaggaagttataaagaatgccataacctccaagagtagcccccttcccattgatcccaagaatggcctttacctcctcctcacttctagtgatgttgctgtccaggacttctgtagagcagtctgcgggtttcattattttacatttccatccattgtaggatacacattgccttatgcatgggttgggcactctggaaaacagtgcccggaagtctgtgcttatccttttgcagtaccaagttatatgactggaatgaaagcattcaaggcccctaatggggatgttggtgttgatgggatgataagtgtgattgcccatgaattggctgagctttcgtcgaatcctctgatcaatgcctggtatgctggtgaggatcctactgcgcctactgagattgcagatctctgtgaaggtctttatgggactggaggcggtggatcttacactggacaagtccttacagacaaatttggggctaattacaatgtccatggcattaggaggaggtatttagtgcaatggatatggagtcctattatgaatgcatgttctggaccaaatgcattggatacctgaaggatgttataatggtcattttagtggaaaatgggtttgctagtgtcatggtcagactctggggtttttctcaagccttcctatctcaaatgctgtttttgggttggatctagccggcttatccatggcttctttatgggtatagacctcaatgccttaggcatattgtacccaataatgcagaaaagtgtttcggagcacttgaggccttaaccccgttttatttcttgacagtatgtagtgactgttttcgttcaacggtcatcccactgtgcgtgcgtgcgtgtgtctatacagctttatatatttagactattctgagaattttatgtatttagactattcagagaattcgggcacaggagtattcatgtctgttgaatttttgaaggggatatattatgttcaagtggagaaatatatttatatgcacatcagagtttagtagagtttccatttatgatggc

SEQ ID NO: 4421 - DNA, 1787 bp, Pinus pinaster
tccaactgcagtccacgagcattatgaggaggagggtgggtttggctttactgtctacaatctccggtaacccccactgatatggcgcgctctgctctgtgagtcaggatttatgtttttagtcttgttttgtattccccacaacaacagtcacatgaacactctattcctcaagcatttgagtgttatataaagggtttgaatctcattgcattgtatccattgcattgttgctgtgtgttgttccagaagaaaatgggtgtgtttgcatgtgtgggtttgtttttattcattgtattatcttcagttgaagcatggaggccatggcctcaatatttcaatcagagtactactgctttgggactgggacagcagcccaataaggcagatttgcagtttgggacttcgaagaagaatgaagggtcctcaccatatgtgaatatgaagtaccacatggggcctgtgctgacttctgctatcaatgtccatacaatttggtatggcaggtggagtaagaaggagaagagggttatcaatgagtttctgctatctatctctaacaatacaaagagcccttcagtgggtcagtggtggcaaacagtgcagctatatactgatcagactggtgccaatattagtagaaacatagtgattactagtcagcacgaagattactactcccatggtaaggtactgagtaggcttactgttcaggaagtgataaagaatgccataacggccaagactagtccccttcccattgatcccaagaatggcctttacctccttctcacttccagtgatgttgctgtccaggacttctgcagagcagtctgtggatttcattattttacattcccatccattgtaggatacacactgccttatgcatgggttgggcattctggaaaacagtgccctgaagtctgtgcttatccttttgcagtgccaagttacatgactggaacgaaggcattcaaggcacctaatggggatgttggtatcgatgggatgataagtgtgattgcccatgaattggctgagctttcttcgaatcccctgatcaatgcctggtatgctggtgaggatcctacttctcctactgagattgcagatctctgtgaaggtctttatgggactggaggcggtggatcttacactggacaagtcctgacagacaaatttggggctaattacaacgtcaatggcattaggaggaagtatttagtgcaatggatatggagtcctattttgaatgcctgctcgggaccaaatgcattggatagctgaaggtgctctagtgttcttgttagtggaaaatgggtttgctagtgttatggtcagactcaggggtttttctcaagccttactatcacaaattctatttgtgggttggatctagacagcttattcatggcttcttattggtatagacctcaatatgccttaggattactgtacccaataatgcagaaaagtgttttggaacactggaggctctaatcccatttctatttcttgacagtttgtagtgactgttcttttaacagtcatctcactctgtgtgcttgcgtgtgtctatacagctttatctatttagactattcagagaaatatctatttagactattcagagaaatcttgaacagagagcattgtttacacagctttatatatttagactattcagagaaatcttgagcaaagagcattcatgtctgttgaatttttaagatctattttgattaagtagaggagtaattcctcatgtctgttgaatttttcag

SEQ ID NO: 4422 - DNA, 1709 bp, Pinus taeda
ttccagagagaaaatgggtgtgtttgcatgtgtgggtttgtttttgttcattgtattatcttcagttgaagcatggaggccatggcctcaatatttcaatcagagtactactgctttgggactgagacagcagcccaataaggcagatttgcagtttgggacttcgaagaagaatgaagggtcctcacaatatgtgaatatgaagtaccacatggggcctgtgctgacttctactatcaatgtccatacaatttggtatggcaggtggagtaagaaggagaagagggttatcaatgagtttctgctatctatctctaacaatacaaagagcccttcagtgggtcagtggtggcaaacagtgcagctatatactgatcagactggtgccaatattagtagaaacatagtgattactagtcagcacgaagattactactcccatggtaaggtactgagtaggcttactgttcaggaagtgataaagaatgccataacggccaagagtagtccccttcccattgatcccaagaatggtctttacctcctcctcacttctagtgacgttgctgtccaggacttctgcagagcagtctgtggatttcattattttacattcccatccattgtaggatacacactgccttatgcatgggttgggcattctggaaaacagtgcccggaagtctgtgcttatccttttgcagtgccaagttacatgactggaacgaaggcattcaaggcacctaatggggatgttggtatcgatgggatgataagtgtgattgcccatgaattggctgagctttcttcgaatcccctgatcaatgcctggtatgctggtgaggatcctacttctcctactgagattgcagatctctgtgaaggtctttatgggactggaggcggtggatcttacactggacaagtcctgacagacaaatttggggctaattacaatgtcaatggcattaggaggaagtatttagtgcaatggatatggagtcctattttgaatgcctgctcgggaccaaatgcattggatagctgaaggtgctctagtgttcttgttagtggaaatgggtttgctagtgttatggtcagactcgggggtttttctcaagccttactatcacaaattctatttgtgggttggatctagacagcttattcatggcttcttattggtatagacctcaatatgccttaggattactgtacccaataatgcggaaaagtgttttgtaacactggaggctctaatcccatttttatttcttgacagtttgtagtgactgttcttcttttaacagtcgtctcactctgtgtgctcgcgtgtgtctatacagctttatctatttagactattcagagaaatatctatttagactattcagagaaatcttgaacagagagcatttgtctacacagctttacatatttagactattcagagaaatcttgagcaaagagcattcatgtctgttgaatttttaagatctattttgattaagtagaggagtaattcctcatgtctgttgaatttttcagatctttattgattaagtagaggagtaattccttatgcacatcaaagttgactagaatttccatttatggtgacaggtttctagaatgatgtcaatgctgcgcgtttttcactagtcaagactctttcggatacatatcctgaaattcacccccctcccttt

SEQ ID NO: 4423 - DNA, 1414 bp, Pseudotsuga menziesii
tgtattatcctcagttgaagcatggaggccatggcctcaatatttcaatcagactactactgctttgggactgaaacagcagcccaacaaggcagatttgcagtttggggcttcaaaaaagcatgaagggtcttcaacgtttgtgaatatgaggtaccatatggggcctgtgctgacctctaccatcaatgtacatacaatttggtatggcagatggagcaagaaggagaagaggattatcaatgagtttctgctatctatctctaataataccaagagcccttctgtgggtcagtggtggcaaacagtgcagttctatactgatcagactggtgccaatattagcagaaacatagttattgctagtcagcatgaggattactactcccatggtaagatactgagtaggctgactgttcaggaagtgataaagaatgccataagtgccaagactagtccccttcctattgatcccaagaatggcctttatcttctcctcacttctagcgatgtagctgtccaggacttctgcagggcagtctgtgggtttcattattttacattcccttccattgtaggatacacactgccttatgcatggattgggcactctggaaagcagtgcccagaagtctgtgcttatccttttgcagtgccaagttatatgactggaatgaaggcattcaaaccccctaatggcgatgttgggattgatgggatgataagtgtgattgcccatgaattggccgagctttcttcgaatcccctgatcaatgcctggtatgctggtgaggatcctacttctcctactgagattgcagatctgtgtgaaggcctttatgggactggaggcggtggatcttacactggacaagtacttacagacaaatttggggccaattacaatgtcaatggcattaggaggaggtatttagtgcagtggatatggagtcctattttgaatgcctgttctggaccaaatgcattagatagctgaagatgatatagtcgtcctgttagtagaaaatgggtttgctagttgtcatgcttagactttggggtttgtctcaagccttactgttgcaaatgctgtttgtgggttggatctagccggcttattcatggcttttttcttggtatagacctcaatatgcctcaaaagtgttgtggaacacttaggttctcgtcccatttttatttcttgacagtatgtagtgactgtttttctttcaacggtcataccactgtgtgtgcgtgcgtatgtttatacagctttgtctatttagactattctcagagaaatcttgaacagagagcattcatgtctgttgaatttttaaggagatctattatgcttaagttttaaggacaccacacgggagggtggtgcagatgagggctcttttgatatggg

SEQ ID NO: 4424 - DNA, 1770 bp, Cedrus atlantica
agttcagtcatctcagttgagagcctggaattgatatttttaatggcaagctcaggaagttatgattcatctcccgagaggagaaactcggggatccagttattgcaagagctggaagctctgagccagtccttatacatgtcccagcagccattagcgcctcgcaggactggttcccttaccctgccaaatgcaaagaaattacagaagagagaagaacatggagtacaagacgaatatcctcatcctcagtcgaagcatggaggccatggcctcaatatttcaatcagactactactgcttttggactgaaacagcagcccaacaaggcagatatgcagtttgggacttcgaagaagaatgaagggtcctcatcatatgtgaatatgaggtaccatatgggccctgtgctgacttctgctatcaatgttcatacaatttggtatggtaggtggagtatgaaggagaagaggattatcaatgagtttcttctatcaatctctaataatacacagagcccttctgtgggtcagtggtggcaaacagtgcagctctatactgatcaaactggtgctaatattagcagaaacatagttattgctaatcagcacgaggatcgctactcgcatggtaaggtactaagtaggctgactgttcaggaagtgataaagaatgccataaccgccaagactagtccccttcccattgatcccaagaatggcctttacctcctcctcacttctagtgatgttgctgtccaggacttctgtagagcagtctgtgggtttcattattttacattcccatccattgtaggatacacactgccttatgcatgggttgggcactctggaaaacagtgtccggaagtctgtgcttatccttttgcagtgccaagttacatgactggaatgaaggcattcaaggcccctaatggggatgttggtattgatgggatgataagtgtgattggccatgaattggccgagctttcgtcgaatcccctgattaatgcctggtatgctggtgaggatcctacttctcctactgagatcgcggatctatgtgaaggtctttatgggactggaggcggtggatcttacactggacaagtacttacagacaaatttggggccaattacaatgttcatggcattaggaggaggtatttagtgcaatggatatggagtcctgttttaaatgcctgttctggaccaaatgcattggatacctgaagggtgttatagtgctcttgttagtagaaaatgggtttgctagtgtcatggtgagactctagggtttttctcaagctctactatcacaaatgctgtttgtgggttgatctagccgacttcttcatggtttctttattggtatctagacctcaatgccttaggcatattgtacccaataatgcagcaaagtgttctggaacacttgaggccttaaccctatttttatttcttgacagtatgtagtgactgttttctttcatcagtcatctcactgagtgtgcgtgcgtgtctctatacagttttatatatttagactattcagagaaatcttgaacagagagagcattcatgtctgttgaatttttaagatctgctatgcttaagtggaggaataaatctatatgcacatcagagtttagcagaatttccatttatggtggctgggatcctaaaatgatgtcaatgtggtggctttctcactagtcaaggctcacttgtgagccattggatacaccttttttaatttgaaaatagc

SEQ ID NO: 4425 - DNA, 1667 bp, Sequoia sempervirens
ctaccgccgcccagctgtagacaactgaactttcggaatggggacaaaaaggcgaaaagtgggacccattccagactccgcgtcccttcgtaaaccctaattcctatccaccatttcctgattctacaccatgaatgctttggtgcactcgttccaagtggccacggatacgcagcgtacaaccctagggtcatataaccaatgagagtagaaggggtataaccaatgagagtagaagggttcagggctgtgttatataactagtggccgctgttgttgtttaccattgcgttcccaacccaattcagaaatgggtatctgggcaacaacattccttcttgttgtctttctggtgttgtcagtggaaggatggagaccatggccagagcatttcaatcagacggtgaaagagcagtctggccttttgttcggaagctccaagaaaaatgaagggtcatcgccctatgtgaaaatgagataccacatgggtcctgttctaacgtctgctattaatgtccatgtgatctggtatggcagatggagcaacaaggaaaagagggttatcagggagtttctcctctccatttccaactctagcggtagcagcccttctgtgggcgagtggtggcggactgtgcagctctacactgaccagactggtgcaaatgtcagcagaaatgttgttatagcgagtgaacaccaggaccgctactcccacgggaagatcctcagtaggttgacagttcaggaggtgatcaagaatgccataactgccaagcccaatccccttcccatagaccctaaaaatgggctgtatctcctcctgaccgacagtgatgtgcaagtgcaggacttctgtagggcggtgtgtggcttccattacttcactttcccctccatagtgggctacacgctgccttatgcctgggttgggaactctggaaagcagtgcgctgatctgtgtgcatacccatttgcagtaccctcttatatgactggaatgaaggccttcactccccctaatggcgacgtgggcatagatgggatgatcagtgtcattgctcatgagttggcggagctctcatccaatcccctcataaatgcctggtatgctggtgaggatcccacttcccccactgagatagcagatctctgcgagggtgtttatggcacaggcggtggaggctccttcactggtcaagttctgactgataaaattggagcgaactacaatgcccatggcattcgtaggaagtatctggtgcagtggatttggaaccctaccatgaatgcgtgtgcaggaccaaatgcactagattaatgaacacggtctttcaagttggaggtttttgcttattcatgggtttttgaggtttgaggtttttgctcattcatggttagccagcaataatgtataaagtaggattgtttcccccacttaccctcaactacatcaatgcctctgtctcgagtgtgttgctttgtaagtcagaattagctttattctagcatttgcagattctcatcctaagcaggcttagtccgctggaagcgatatttgaatctttatctacaatgccccagttcaatatatgtttgctcttgtctgaactctgaagtacttgcggttgcttcagaacaaatgtatgagccgatgtatatgttcc

SEQ ID NO: 4426 - DNA, 3082 bp, Chrysanthemum coronarium
aaacacacacaaaagtaaccacaaaatggccggaggaaacaacaaccacccaccatcaaccccaaccgacccaccaacctcatcagaccacaacgacatccctaactcaagccagttcaacggcaacccacctggcacccccgactcccctacctctgcagggttcaacacggatcagctcccccgcacctccgataactactccgatgattcagaagacgaggctgaggttgagcctcgtcttatcaacgatgaaccggatgatgtcgtcgatgaagacgacgttgacggtgaagatctgtttaatgataacttcatcgatgattaccgtgatttgggtgagcaagatcaatatgaatctgctgggcttgatacttcctttgaggacgaaaggaatttggatcagattattaaggatcgtcaagctgctgaaatggagcttgataatagagatggtgttgcttctcagcgaaagattcctcagctgcttcatgatcaagatacagatgatgatagctaccgtccttcaaaaagaactagagctagaccagctccaggttctccaggtggtggttctccaggtggttcaccaccaaccagtccaccgagaggttcaagaggtccaccaagtgatacagatgacactgatgttcctatgactgatgcttttgaggacgacgatgacgatgaaggcgagtttgagatgtaccgtgttcagggaacactgagggagtgggttactagagatgaagtgcgtcgttttattgctaaaaagttcaaggaatttcttcttacctatgagaacccaaagagtgatcatcgtgatcttgaatatctcaggcaaataaatgagatggtgtcagttaacaagtgcagtttggagattgattacaaacagtttatctatactcacccaaatattgctatctggttggctgatgcacctcaatctgttcttgaggtcatggaagaagttgctaacaaagttgtgtttaatctacatccaaactacaaaagaattcatcaaaaaatctatatcagagtgaccaacttgcctgtgtatgatcagattcgcaacataaggcaaatccatttaaacacaatgattcgcgtaggaggagttgtaacacggcgatctggagtttttccccaattgcagcaggtgaagtatgactgtaacaaatgtggatcggtgttgggcccttttgttcaaaattcatattcagaggtgaaggttggttcttgcccagagtgccaatcaaagggaccgttcacggtcaatattgagcagactatatataggaattatcagaagcttacccttcaagagagcccgggcattgttccagctggcagattgccaagatacaaagaagtcatacttctgaatgatctgattgattgtgctcgccctggggaagagattgaggttacaggcatctacacaaacaactttgatttatcattgaatacaaaaaatggttttcctgtctttgcaactgtgattgaagcaaactatgttacaaagaagcaagacttattctcagcatataagcttacccaagaggataaggaagatatcgagaagctgtctaaagaccctcggattggagaaaggattatcaagtctattgctccatcaatctatggtcatgaggacataaagactgcaatagctcttgcaatgtttggaggtcaggagaaaaatgtgcaaggaaagcatagattgcgtggagacattaatgtgttgttgttgggtgatcccgggactgcaaaatctcagtttttaaaatatgttgaaaaaactggacagagggcagtttacacaacaggtaaaggagcttctgctgttggacttacagcagctgtgcacaaggacccagtcacacgagaatggacacttgaaggaggggctcttgttttagctgataaggggatatgccttatagatgaattcgacaaaatgaatgatcaagacagggtgagtattcatgaagcaatggaacagcaaagcattagcatatctaaagctggaattgtaacttcccttcaagctcgatgctctgtcattgctgctgctaaccctataggaggaagatatgactcatctaaaaacttttcacaaaatgttgagttaacagaccctatcgtctctagattcgatgttctctgtgttgtaaaggatgtggtggacccagtgatggatgagatgcttgcaaagtttgtggtggatagtcatttcaagtctacacccaaaggtggcaaagcggatgacaagtctacgaacaactctcaggaagatattcaagactttgccatgccagtggatcctgagatactttcgcaagacatgctaaagaagtacatcacatatgccaagttaaatgtattcccaaggttgcatgatgctgacttggacaaactcacacaagtttatgctgaattgcgaagagaatcatcacatggacaaggagttccaatagcagtaagacacatagaatctatgattcggatgtcagaagctcatgctcgaatgcaccttaggcagcatgtcactcaggaggacgtggacatggccatacgtgtgttgctcgactcctttatttctactcaaaagtttggtgtgcagaaggctttacagaagagctttaaaaagtatatgacattcaagaaagatttcaatgcaattgtgctgcatctattgaatcaacttgtgaaagaggcagtgcactttgaagagataatgtcgggtgctaacagaaacattgcacatattgatgtgaaggtggaggaattacaaagcaaggcgctggattacgggttaacagatctgaatgcattcttcaatagcccagagtttgctcgtgggaactttgagttggatgaagaaagaggtgtgataaggcataaccttgtaagatgatgggtggttgtctgcatgagttactaagtgatttcttttgaactaatgttaattttttatttggaaaaaacgagttgtcttgttgaaaaccgatggcatgggtttgcctatgacgaaaatttacttataagttattaagtcatgtgtttacattcggtg

SEQ ID NO: 4427 - DNA, 2973 bp, Chrysanthemum coronarium
caaccgacccaccatcctcagacaacaacgacaaccctaactcaagccaattcaacggcaacccacctggcacacctgactccccaacctcagctgggttcaacacggatcagctcccccgaacctccgaaaactactccgattcggatgacgaggccgaggtcgagcctcgtctcattaacgatgagccggatgaggttgttgacgaagatgatgttgatggtgaagatctgtttaatgataacttcatcgatgattaccgtgagttgggtgagcaagatcaatatgaatctgctgggcttgatgcttcgtttgaggacgaaagaaatttggatcagattataagggatcgtcaagctgctgaaatggagcttgataatagagatggtgttgcttcgcagcgaaagtttcctcagctacttcatgatcaagatacagacgatgatagctaccgtccttcaaagagaactagagctagacctcctggttcaccaggtggtggttcaccaccaaccagtccaccgagaggaggtccaagaggtccaccaagtgatacggatgacactgatgtgcctatgactgatgcgtttgaggatgatgacgatgacgacgaaggtgagtttgagatgtaccgtgttcagggaacacttagggagtgggttaccagagatgaagtgcgtcgttttattgctaagaagttcaaggaattccttcttacttatgagaacgcaaagagtgatcatcgtgatcttgagtatcttaggcaaataaatgagatggtgtcagtcaacaagtgcagtttggagattgattacaaacagtttatctatatccacccaaatattgccatctggttggctgatgcacctcaatctgttcttgaggtcatggaagaagttgctaacaaagttgtttttaatctacatccaaactacaaaagaattcatcaaaaaatctatgttagagtgaccaacttacctgtttatgatcagattcgcaacatcaggcaaatccatttgaacactatgattcgcgttggaggagttgtgacccgacgatctggagtttttcctcaattgcagcaggtgaagtatgactgtaacaaatgtggatcagttctaggaccttttgtccaaaattcatattcggaggtcaaggttggttcctgcccagaatgccaatcaaagggaccgttcactgtcaatattgagcagactatatataggaattatcagaagcttacccttcaagagagccctggcattgttccagctggcagattgccaagatacaaagaagtcatacttctgaatgatctgattgattgtgctcgccctggggaagagattgaggttacaggcatctacacaaacaactttgatttatcattgaatacaaaaaatggttttcctgtctttgcaacggtgattgaagcaaactatgttacaaagaagcaagacttattctcagcttataagcttacccaagaggacaaggaagatattgagaagttgtctaaagaccctcgtattggagaaaggattatcaagtccattgctccatcaatctatggtcacgaggacataaagactgcaatagctcttgcaatgtttggaggtcaggagaaaaatgtgcaaggaaagcatagattgcgtggagatattaatgtgttgttgttaggtgatcccgggactgcaaaatctcagtttttaaaatatgttgaaaaaactggacagagggcagtttacacaacaggtaaaggagcttctgctgttggacttacagcagctgtgcacaaggacccagtcacacgagaatggacacttgaaggaggggctcttgttctagctgataaggggatatgccttatagatgaattcgacaaaatgaatgatcaagacagggtgagtattcatgaagcaatggagcagcaaagcattagcatatctaaagctggaattgtaacttctcttcaagctcgatgctctgtcattgctgctgctaaccctataggaggaagatatgactcatctaagaacttttcacaaaatgttgagttaacagatcctattgtctctagattcgatgttctctgtgttgtaaaggatgtggtggacccagtcatggatgagatgcttgcaaagtttgtggtggatagtcattttaagtctacacccaaaggtggcaaagcggatgacaagtctacaaacaactctcaggaagatgttcaagactttgccatgccagtggatcctgagatactttcacaagacatgctaaagaagtacatcacatatgccaagttaaatgtattcccaaggttgcatgatgctgacttagacaaactcacgcaagtttatgctgaactacgaagagaatcatcacatggacaaggagttccaatagcagtaagacacatagaatcgatgattcggatgtcagaagctcatgctcgaatgcaccttaggcagcatgtcacccaggaagacgtggacatggccatacgtgttttgctcgactcctttatttccactcaaaagtttggtgtgcagaaggctctacagaagagctttaaaaagtacatgacattcaagaaagatttcaatgctatcgtgctccatctactgaatcaacttgtgaaagaggcactgcactttgaagagataatgtctggtcctaatagaaacattgcacatattgatgtgaaggtggaggagttgcaaagcaaggtcttggattatggcttaacagatctgaatgcattcttcaatagcccagaatttgctcgagggaactttgaattggatgaagaaagaggtgtgataaggcatcaccttataagatcatgagtggtctgtctggatgagttaactaagtgatttattttgaactaatgttagatttttatttggaagaaacggtcttccttgttgaaaacgatgacatttgtttcgcctgtgacaaaaagtactt

SEQ ID NO: 4428 - DNA, 2965 bp, Chrysanthemum coronarium
cagacaacaacgacaaccctaactcaagccaattcaacggcaatccacctggcacacctgactcccctacctcagccgggttcaacacggatcagctcccccgaacctccgaaaactactccgattcggatgacgaggccgaggtcgagcctcgtctcattaacgatgagccggatgaggttgtggacgaagatgatgttgacggtgaagatctctttaatgataacttcatcgatgattaccgtgagttgggtgagcaagatcaatacgaatctgctgggcttgatgcttcgtttgaggacgaaagaaatttggatcagattataagggatcgtcaagctgctgaaatggagcttgataatagagatggtgttgcttcgcagcgaaagtttcctcagctacttcatgatcaagatacagacgatgatagctaccgtccttcaaagagaactagagctagacctcctggttcaccaggtggtggttcaccaccaaccagtccaccgagaggaggtccaagaggtccaccaagtgatacggatgacactgatgtgcctatgactgatgcgtttgaggatgatgatgatgatgacgaaggtgagtttgagatgtaccgtgttcagggaacacttagggagtgggttaccagagatgaagtgcgtcgttttattgctaagaagttcaaggaattccttcttacttatgagaacgcaaagagtgatcatcgtgatcttgagtatcttaggcaaataaatgagatggtgtcagtcaacaagtgcagtttggagattgattacaaacagtttatctatatccacccaaatattgccatctggttggctgatgcacctcaatctgttcttgaggtcatggaagaagttgctaacaaagttgtttttaatctacatccaaactacaaaagaattcatcaaaaaatctatgtcagagtgaccaacttacctgtgtatgatcagattcgcaacatcaggcaaatccatttaaacacaatgattcgtgttggaggagttgtgacccgacgatccggagtttttccccaattgcagcaggtgaagtatgactgcaacaaatgtggatcagttttggggcctttcgtccaaaattcatattcagaggtgaaggttggttcctgcccagagtgccaatcaaagggaccgttcacggtcaatattgagcagactatatataggaattatcagaagcttacccttcaagagagccctggcattgttccagctggcagattgccaagatacaaagaagtcatacttctgaatgatctgattgattgtgctcgccctggggaagagattgaggttacaggcatctacacaaacaactttgatttatcattgaatacaaaaaatggttttcctgtctttgcaacggtgattgaagcaaactatgttacaaagaagcaagacttattctcagcttataagcttacccaagaggataaggaagatatcgagaagttgtctaaagaccctcgtattggagaaaggattatcaagtccattgctccatcaatctatggtcacgaggacataaagactgcaatagctcttgcaatgtttggaggtcaggagaaaaatgtgcaaggaaagcatagattgcgtggagatattaatgtgttgttgttaggtgatcccgggactgcaaaatctcagtttttaaaatatgttgaaaaaactggacagagggcagtttacacaacaggtaaaggagcttctgctgttggacttacagcagctgtgcacaaggatccagttacacgagaatggacacttgaaggaggggctcttgtgctagctgataaggggatatgccttatagatgaattcgacaaaatgaatgatcaagacagggtgagtattcatgaagcaatggagcagcaaagcattagcatatctaaagctggaattgtaacttctcttcaagctcgatgctctgtcattgctgctgctaaccctataggaggaagatatgactcatctaagaacttttcacaaaatgttgagttaacagatcctattgtctctagattcgatgttctctgtgttgtaaaggatgtggtggacccagtcatggatgagatgcttgcaaagtttgtggtggatagtcattttaagtctacacccaaaggtggcaaagcagatgacaagtctacaaacaactctcaggaagatgttcaagactttgccatgccagtggatcctgagatactttcacaagatatgctaaagaagtacatcacatatgccaagctaaatgttttcccaaggttgcatgatgctgacttagacaaactcacacaagtttatgctgaactacgaagagaatcatcacatggacaaggagttccaatagcagtaagacacatagaatcgatgattcggatgtcagaagctcatgctcgaatgcaccttaggcagcacgtcactcaggaagacgtggacatggccatacgtgttttgctcgactcctttatttccactcaaaagtttggtgtgcagaaggctctacagaagagctttaaaaagtacatgacattcaagaaagatttcaatgctatcgtgctccatctactgaatcaacttgtgaaagaggcactgcactttgaagagataatgtctggtcctaacagaaacattgcacatattgatgtgaaggtggaggagttgcaaagcaaggtcctggattatggcttaacagatctgaatgcattcttcaatagcccagaatttgctcgagggaactttgaattggacgaagaaagaggtgtgataaggcatcaccttgtaagatgatgggttgttgtctggatgagttagctaagtgatttattttgaactaatgttaattttttctttggaagaaactgtcttccttgttgaaaacccgtttgcatttgcttcgcctgtgacaaaaagtacttatatattat

SEQ ID NO: 4429 - DNA, 2974 bp, Chrysanthemum coronarium
acaacgacaaccctaactcaagccaattcaacggcaacccacctggcacacctgactccccaacctcagctgggttcaacacggatcagctcccccgaacctccgaaaactactccgattcggacgacgaggccgaggtcgagcctcgtctcattaacgatgagccggatgaggttgtggatgaagatgatgttgacggtgaagatctgtttaatgataacttcatcgatgattaccgtgagttgggtgagcaagatcgattatgaatatgctgggctagatgcttcatttgaggacgaaaaaatttggatcggattataagggatcgccaagctgttgaaattgagcttaatgctagagatggcgttgcttcgcagcaaaagtttcctcggctacttcatgatcaagatacagacgatgatagctaccgtccttcaaagagaactagagctagacctcctggttcaccaggtggtggttcaccaccaaccagtccaccgagaggaggtccaagaggtccaccaagtgatacggatgacactgatgtgcctatgactgatgcgtttgaggatgatgacgatgacgacgaaggtgagtttgagatgtaccgtgttcagggaacacttagggagtgggttaccagagatgaagtgcgtcgttttattgctaagaagttcaaggaattccttcttacttatgagaacgcaaagagtgatcatcgtgatcttgagtatcttaggcaaataaatgagatggtgtcagtcaacaagtgcagtttggagattgattacaaacagtttatctatatccacccaaatattgccatctggttggctgatgcacctcaatctgttcttgaggtcatggaagaagttgctaacaaagttgtttttaatctacatccaaactacaaaagaattcatcaaaaaatctatgttagagtgaccaacttacctgtctatgatcagattcgcaacatcagacaaatccatttaaacactatgattcgcgttggaggagttgtgacccgacgatctggagtttttcctcaattgcagcaggtgaagtatgactgtaacaaatgtggatcagttctagggcctttcgtccaaaattcatattcagaggtcaaggttggttcctgcccagaatgccaatcaaagggaccgttcactgtcaatattgagcagactatatataggaattatcagaagcttacccttcaagagagccctggcattgttccagctggcagattgccaagatacaaagaagtcatacttctgaatgatctgattgattgtgctcgccctggggaagagattgaggttacaggcatctacacaaacaactttgatttatcattgaatacaaaaaatggttttcctgtctttgcaactgtgattgaagcaaactatgttacaaagaagcaagacttattctcagcatataagcttacccaagaggataaggaagatatcgagaagctgtctaaagaccctcggattggagaaaggattatcaagtccattgctccatcaatctatggtcacgaggacataaagactgcaatagctcttgcaatgtttggaggtcaggagaaaaatgtgcaaggaaagcatagattgcgtggagacattaatgtgttgttgttaggtgatcccgggactgcaaaatctcagtttttaaaatatgttgaaaaaactggacagagggcagtttacacaacaggtaaaggagcttctgctgttggacttacagcagctgtgcacaaggatccagttacacgagaatggacacttgaaggaggggctcttgtgctagctgataaggggatatgccttatagatgaattcgacaaaatgaatgatcaagacagggtgagtattcatgaagcaatggagcagcaaagcattagcatatctaaagctggaattgtaacttctcttcaagctcgatgctctgtcattgctgctgctaaccctataggaggaagatatgactcatctaagaacttttcacaaaatgttgagttaacagatcctattgtctctagattcgatgttctctgtgttgtaaaggatgtggtggacccagtcatggatgagatgcttgcaaagtttgtggtggatagtcattttaagtctacacccaaaggtggcaaagcagatgacaagtctacaaacaactctcaggaagatgttcaagactttgccatgccagtggatcctgagatactttcacaagatatgctaaagaagtacatcacatatgcgaagttaaatgtattcccaaggttgcatgatgctgacttagacaaactcacacaagtttatgctgaactacgaagagaatcatcacatggacaaggagttccaatagcagtaagacacatagaatcgatgattcggatgtcagaagctcatgctcgaatgcaccttaggcagcacgtcactcaggaagacgtcgacatggccatacgtgttttactcgactcctttatttccactcaaaagtttggtgtgcagaaggctctacagaagagctttaaaaagtacatgacattcaagaaagatttcaatgcaattgtgctccatctactgaatcaacttgtgaaagaggcactgcactttgaagagataatgtctggtcctaatagaaacgttgcacatattgatgtgaaggtggaagagttgcaaagcaaggtccttgattatggcttaacagatctgaatgcattcttcaatagcccagaatttgctcgagggaactttgaattggatgaagaaagaggtgtgataaggcatcaccttataagatcatgagtggtctgtctggatgagttaactaagtgatttattttgaactaatgttaattttttctttggaagaaactgtcttccttgttgaaaacccgtttgcatttgcttcgcctgtgacaaaaagtacttatatattattacatcatgtgttt

SEQ ID NO: 4430 - DNA, 3367 bp, Amsonia hubrichtii
attatgccatcagttgcactgtgtttgagaaattcattaatcctctgaggagaccagcttctgcgcgcgccttcgtctaaagctaatgtctagagaaggtgaatcagggagcggtgacggaggtcggaggcagcgaatcgatgagccatcttcgccgtcggatcatgggaacgggaacggaaatcaaacgccgtcgacgcccgattcgcctacgtcggcagggtttaacacggaccagctaccaatgaacacgagccagaattactcggaagacgacgaagaggcctctgtggacccgcaaatcatcagagacgaggcagaaaatgaagaagaagaggaagaaggagaggacctcttcaacgacaactacatggacgattatcgaaggatggaggagcaagaccagtacgagtctttgggtctggacgattccatggaagacgagagggatttagatcagatcatggcagatcgcagggctgccgaggtggaactcgacaccagagacgttcgcgtcgtatcctctcaacgcaagcttccccatcttctcaatgaccaagatactgatgatgacaactataggccctcaaaacgaactcgagctgattttaggcttcccaccactccaagaagttttgatgatactgacgcgatgcagagttcaccgggtagatcacaaaggggacactctaaagacgatgtgcccatgactgaccctacagatgatgatccttacgaggacgatgacaatgaagaaggtgagtttgagatgtacagggtccagggtacacttcgagaatgggttaccagggatgaagtgcggcgtttcatagcaaagaagttcaaggagttcttgttcacatatgtgaatccaaagaatgaacatggggactttgagtacctccggcagattaatgagatggtgtcagttaatagatgtagccttgagatcgattacaaacagtttatctacatccacccaaatattgctatctggctggcagatgcgccccattcagtcctcgaggtaatggaagaagttgcaaacaaagttgtctttgatttgcacccaaactacaggcaaattcataagaaaatatacgttcgtattaccaacttgcctgtttatgatcagatacgcaatataaggcagatccacctgaacaccatgattcgtattgggggagttgtgacccgacgttctggtgtctttccccagttgcaacaagttaaatatgattgcaacaaatgtggagcaattttagggcctttcttccagaactcatattccgaagtcaaggttggttcctgcccagagtgccaatcaaaggggcctttcacagtcaatattgagcagacaatatataggaactaccagaaacttaccctccaagagagcccgggaattgttccagctggtagactaccaagatacaaggaagttatactgttgaatgatctgattgattgtgccagaccaggagaagagattgaggtgacaggaatttacacaaataattttgacctatctctcaacacaaagaacggatttcctgtttttgcaactgtaattgaagcaaatcatgtcacaaaaaagcaagatctcttttcagcttacaaacttacacaggaggacaaggaagagatagagaagttggccaaagacccaaggattggagaacgtattgtcaaatccattgcaccatcaatatatggtcatgaagacataaaaactgcaatttctcttgcaatgtttgggggccaagagaaaaatgttgaaggaaaacaccgactgcggggagacatcaatgtactcctgttaggtgatcctggcactgccaagtcacagttccttaaatatgttgagaagactggacaaagagctgtgtatactactggaaaaggtgcttcggctgtggggctgacagctgcagtgcacaaggacccggtcacgcgagagtggaccctagaaggaggggctcttgttctggctgatagagggatatgcctcattgatgaatttgataagatgaatgatcaggatagagtaagcattcatgaagcgatggagcagcaaagcatcagtatatcaaaggctggaattgtcacatctcttcaggcccgctgttctgtcattgctgctgcaaatcctattggaggaagatatgattcctcaaaaactttctcgcaaaatgtggaattaactgatccaatcatttcccgttttgtacattctttgtgttgttaaggatgtggttgatcctgtcactgatgagatgctagcaaagtttgtagttgatagtcatttcaagtcacaaccaaaaggtgctaatttggatgataggtctatgatcaattcacaagatgatgatttagctactacagttcccactgatcctgagataatttctcaagagttgcttaagaagtacataacctatgcaaaattgaatgtgttcccaaggttgacatgatgcagatttagacaagctcactcaagtatatgctgaattgcggagagagtcctcgcatggacaaggagttccaatagcagtgaggcacattgaatctatgataaggatgtctgaagctcatgcaaggatgcacctgaggcagcatgtcacccaagaagacgtggacatggcaatccgggtgctgttggactcgttcatatcaacacagaagtttggagttcaaaaagctttgcaaaagagcttcaagaagtacatgacattcaagaaggatttcaatgctattgtcctacatcttcttcgcgggcttgtaaaggatgtactgtactttgaagaaatcgtgtctggatctagagcaaatgtatcccatatagatattaaagtggaagagctgcaaagcaaggcgcttgattatggcattactgatctaaaaccattcttcaccagcactgagttttctaaagccaacttcgagttggatgagacccgaggcgtcataaggcatcgattcgcaagatgatatttgaactttgacatgatagtttgctataaatttgaaaatgtcttttgatgtgttccatgatgttcacgttttgtactgatatatctactgaagcaaacaattcttcaccggcgccgagttgcttttcctttctctttcttgttggtgggataggatggctagaacaaaacgggaagaattctattggtactaattagagtctatcttcttactcttgttttacttattttttctttccctgtgaatctaacaatgactctatctttcgtattgtacctagaaaactgtaaatttgactaactttgacaatacgaaaacttgacaactcgtacccgtgttacgggtaagggttaacttacgtttatttttttac

SEQ ID NO: 4431 - DNA, 3183 bp, Panax ginseng
aagcagtggtatcaacgcagagtacatggggatctaaacctaataaagaaattttaagaggagcgagaaatggcaatatcgtcgcagtcgtcttcagaggaagaaggcaacgtgaatgtgaacagcggtgggaatcagccgtcgacgccggattcgctaacatcagcgggtttcaacactgatcagcttccttttaacaccactagccggacatcagagaactactcggaggaggaagaggaagccgcagtcgatcaccgtatcatcagggacgatgagcccgacgacgacgaagaagaagaaggagaggatctcttcaacgacaattacatggacgattatcggaggatggaggaacatgatcagtatgaatcggtaggcctggatgaatcactggaagacgagagagatttggatcagattatggctgaccgaagggctgctgagattgagcttgaggccagagacgctgccactgctgctcccccaactctttctcatcgcaagcttcctcaccttctacatgaccaagatactgatgatgataactataggccttcgaaaagaactagagctgattttaagcctcctactatgcctagaagctttgacgatactgacgcaatgcaaagttcacctggtagatcgcaaaggggacactcaagagaagacgtgcatatgactgatcagaccgatgatgaaccatacgaggatgaagataatgatgaagccgaatttgaaatgtatcgtgttcagggaacacttagggagtgggttactagggatgaagtgcgtcggtttattggcaagaaattcaaggaattcatgctcacatatgtgaatgccaaaagtgaacatcgtgacttcgaatatttacgacagataaatgaaatggtttcagttaataggtgtagccttgagattgattacaagcaattcatatatatccacccaaatatagccatctggctagcagatgcaccccagtctgtactcgaggttatggaagaagtggctaataatgttgtcttcgacttgcacccaaactataagcaaatacaccagaaaatctatgtccgaatcaccaacttacctgtatatgatcagatacgcaacataagacagatacatttgaacaccatgatccgtataggtggtgtagtgacccggcgctctggagtgtttccccagctgcagcaagtaaagtatgattgcaacaagtgtggaatgattttgggtccatttttccaaaattcatatgcagaagtgaaggtcggttcttgccctgagtgccagtcaaaaggaccatttactatcaatattgagcagacattgtacaggaattatcagaaactcacccttcaagagagcccaggaattgtgccagctggtcgacttccaagatacaaggaagtgatattgctgaatgatctgatagactgtgcccgtcctggggaagagattgaggtcactggcatttacacaaacaattttgacttgtctttaaatacgaagaatggatttccggtctttgcaactgtgattgaagccaattatgttacaaagaagcaagacctattttcagcttacaaacttacccaggaggacaaagaagaaattgaaaagttgtctaaagaccccaggattggagaaaggataattaagtctgttgccccatcgatatatggtcacgaggacataaagactgcaattgctcttgcaatgtttggaggccaggagaaaaatgttgaaggaaagcatcgtttgcgaggagatattaatgtactcctgctaggtgatccaggcacagcaaaatcgcagttcctcaagtatgttgaaaagactggacagagggctgtctatacaactgggaaaggagcttctgctgttgggctcacagcagcagttcacaaggatccagtcacccgggagtggacccttgaaggaggggctctcgttctagctgataaagggatatgccttattgacgagtttgacaaaatgaatgatcaggacagggtaagtatccatgaagcaatggagcagcagagcattagcatatcaaaggctgggattgtcacttcactccaggcccgctgttctgttattgctgctgcaaatcctataggaggaagatatgattcgtccaagaatttctcacaaaatgtggagctgacagatccaattgtttctcgttttgatatcttatgtgttgtcaaggatgtggttgacccagttacagatgagatgcttgcaaagttcgtagttgatagtcatttcaagtcgcaagccaaaggtgctaatttagatgacaagtcgctcggccattcccaggaaaatattgaagccactgccatgacagctgatcctgagataattcctcaagatctgctaaagaagtacataacctataccaagttaaatgtattcccaaggttgcacgatgctgatctagacaagctcactcaagtttatgcagaattacggagagaatcttctcacggacaaggagttcctatagcagtaagacacatagaatcaatgatacggatgtctgaagcccatgccagaatgcatctcagacagcatgtcactcaagaagatgtggacatggcaattcgtgtgctccttgactcgtttatttcaacacaaaaatttggggtgcaaaaagctttgcaaaagagtttcaaaaagtatatgacgtttaagagggatttcaatggcatagttttgcatcttcttcgtcagcttgtgaaggatgcactgcattttgaagaaattgtgtctggttctacaacaggtcttgcccatgttgatgtgaaagtggaggagttgcaaagcaaggttcatgattatggaatcaccgatctaaaagcattcttttcaagtgtcgaattttctagagccaactttgagttggatgaggaaaggggagtgataagccaccgccttgcaagatgatgcacaacttgctcacttcatcatttcaacagtcaacgaggtactcagtgaattgaatttgcagtataacaagtttacagatgtcaaaaacactctcaatcatgagttttgaggatatattattattattattattattattgtttgtcaaatgaacaagatggatattattccagggctgcgtttaatttttaagctttgtttctgggttgtatgcagaaa

SEQ ID NO: 4432 - DNA, 3039 bp, Panax ginseng
ctaaacctaataaagaaattttaagaggagcgagaaatggcaatatcgtcgcagtcgtcttcagaggaagaaggcaacgtgaatgtgaacagcggtgggaatcagccgtcgacgccggattcgctaacatcggcgggtttcaacactgatcagcttcctttcaacaccactagccggacttcagagaactactcggaggaagaagaggaagccgcagttgatccccgtatcatcagggacgatgagcccgacgacgacgaagaagaagaaggagaggatctcttcaacgacaattacatggacgattatcggaggatggaggaacatgatcagtatgaatcggtaggcctggatgaatcactggaagacgagagagatttggatcagattatggctgaccgaagggctgctgagattgagcttgaggccagagacgctgccactgctgctcccccaactctttctcatcgcaagcttcctcaccttctacatgaccaagatactgatgatgataactataggccttcgaaaagaactagagctgattttaagcctcctactatgcctagaagctttgacgatactgacgcaatgcaaagttcacctggtagatcgcaaaggggacactcaagagaagacgtgcatatgactgatcagaccgatgatgaaccatatgaggatgaagataatgatgaagccgaatttgaaatgtatcgtgttcagggaacacttagggagtgggttactagggatgaagtgcgtcggtttattggcaagaaattcaaggaattcatgctcacatatgtgaatgccaaaagtgaacatcgtgactttgaatatctacgacagataaatgaaatggtttcagttaataggtgtagccttgagattgattacaagcaattcatatatatccacccaaatatagccatctggctagcagatgcaccccagtctgtactcgaggttatggaagaagtggctaataatgttgtcttcgacttgcacccaaactataagcaaatacaccagaaaatctatgtccgaatcaccaacttacctgtatatgatcagatacgcaacataagacagatacatttgaacaccatgatccgtataggtggtgtagtcgacccggcgctctggagttcgtttccccagctgcagcaagtaaagtatgattgcaacaagtgtggaatgattttgggcccatttttccaaaattcatatgcagaagtgaaggtcggttcttgccctgagtgccagtcaaaaggaccatttactatcaatattgagcagacattgtacaggaattatcagaaactcacccttcaagagagcccaggaattgtgccagctggtcgacttccaagatacaaggaagtgatattgctgaatgatctgatagactgtgcccgtcctggggaagagattgaggtcactggcatttacacaaacaattttgacttgtctttaaatacgaagaatggatttccggtctttgcaactgtgattgaagccaattatgttacaaagaagcaagacctattttcagcttacaaacttacccaggaggacaaagaagaaattgaaaagttgtctaaagaccccaggattggagaaaggataattaagtctgttgccccatcgatatatggtcacgaggacataaagactgcaattgctcttgcaatgtttggaggccaggagaaaaatgttgaaggaaagcatcgtttgcgaggagatattaatgtactcctgctaggtgatccaggcacagcaaaatcgcagttcctcaagtatgttgaaaagactggacagagggctgtctatacaactgggaaaggagcttctgctgttgggctcacagcagcagttcacaaggatcctgtcacccgggagtggacccttgaaggaggggctctcgttctagctgataaagggatatgccttattgacgagtttgacaaaatgaatgatcaggacagggtaagtatccatgaagcaatggagcagcagagcattagcatatcaaaggctgggattgtcacttcactccaagcccgctgttctgtcattgctgctgcaaatcctataggaggaagatatgattcgtccaagaatttctcacaaaatgtggagctgacagatccaattgtttctcgttttgatatcttgtgtgttgtcaaggatgtggttgacccagttacagatgagatgcttgcaaagttcgtagttgatagtcatttcaagtcgcaagccaaaggtactaatttagatgacaagtcgctcggccattcccaggaaaatattgaagccactgccatgacagctgatcctgagataattcctcaagatctgctaaagaagtacataacctataccaagttaaatgtattcccaaggttgcatgatgctgatctagacaagctcactcaagtttatgcagaattacggagagaatcttctcacggacaaggagttcctatagcagtaaggcacatagaatcaatgatacggatgtctgaagcccatgccagaatgcatctcagacagcatgtcactcaagaagatgtggacatggcaattggtgtgctccttgactcgtttatttcaacacaaaaatttggggtgcaaaaagctttgcaaaagagtttcaaaaagtatatgacatttaagagggatttcaatggcatagttttgcatcttcttcgtcagcttgtgaaggatgcactgcattttgaagaaattgtgtctggttctacaacaggtcttgcccatgttgatgtgaaagtggaggagttgcaaagcaaggttcatgattatggaatcaccgatctaaaagcattcttttcaagtatcgaattttctagagccaactttgagttggatgaggaaaggggagtgataagccaccggcttgcaagatgatgcataacttgctcacttaatcatttcaacagtcaacgaggtaatcagtgaattgaatttgcagtataacaagtttacagatgtcaaaaactctcaatcatgagtttt

SEQ ID NO: 4433 - DNA, 3164 bp, Tabernaemontana elegans
tgtcgagagaaggagactcaagaagccgcgacggaggtaggaggcagcgaagcgatgagtcatcttcgccgccggatcacgggaacggcaatccgacgccctcaacgccagattcgcctacgtcggcagggtttaatacggatcagctgcctctgaacacgagccagaactactcggaagacgatgaggaagcctctgtggacccgcggatcatcagggacgaggcagaaaatgaggtagaagaggaagaaggggaggacctcttcaacgacaactacatggacgattatcggaggatggaggagcaggacaagtacgagtcattgggcctggacgattccatggaggacgagagggatttagatcagatcatggcggatcgcagggctgctgaggtggaactggacgccagagacgttcgtgtcgtctcctctcaacgcaagcttccacaacttctcaacgaccaagatactgatgatgacaactataggccctcaaaacgaacacgagcagattttaggcctcccaccactccaagaagttttgatgatactgatgcaatgcagagttcaccaggtagatcacaaaggggacactccagagaggatgtgcccatgactgacccgacagatgatgatccttatgaggatgatgacaatgaagagggtgagtttgagatgtacagggtccagggaacacttcgagaatgggtaactagagatgaagtgcgacgcttcataggaaagaagttcaaggagttcttgtttacgtatgtgaatccaaagaatgaacatggggactttgagtacctccggcagattaatgagatggtgtcagttaatagatgtagccttgagattgattacaagcagtttatctatatccacccaaatattgcaatctggctggcagatgcaccccattcagtccttgaggtgatggaagaagttgcaaacaaagttgtgtttgacttgcaccctaactacaagcagattcataagaaaatctatgttcgtattactaacttgcctgtttacgatcagatacgcaacataaggcagatccatcttaacaccatgattcgtattgggggagttgtaaccagacgttctggtgtctttcctcagttgcaacaggttaagtatgactgcaacaaatgtggagcaattttaggccctttcttccagaactcatattctgaggtcaaggttggttcctgcccagagtgccaatcgaaagggcctttcacagtcaatattgagcagacaatatataggaactaccagaaacttactctccaggagagcccaggaattgtaccagctggtaggctgccaagatacaaggaagttatcctgttgaatgatctgattgattgtgccagacctggagaagagattgaggtgacaggtatttacactaataattttgacctgtctctcaacacaaagaatggatttcctgtttttgcaactgtaattgaagcaaatcacgtcacaaaaaagcaagacctcttttcagcttacaaacttacccaggaggacaaggaagaaatagagaagttggccaaagacccaaggataggagaacgtattgtcaaatccattgcaccatcaatatatggtcatgaagacataaagattgcaattgctcttgcaatgtttggggggcaagagaaaaatgtcgaaggaaaacaccgactgcggggtgacattaacgtactcctgttaggtgatcctggcactgccaagtcacagttcctgaaatatgtcgagaagactggacaaagagctgtgtatactactgggaaaggtgcttctgctgttgggttgacagctgcagtgcacaaggacccagtcacgcgagagtggaccctagaaggaggggctcttgttctggctgatagagggatatgccttattgatgaatttgataagatgaatgagcaggatagagtaagcattcatgaagcaatggagcaacagagcatcagtatatcaaaggctggaattgtcacatctctccaggcccgctgttctgtcattgccgctgcaaatcctattggaggaagatatgattcctcaagaactttctcacaaaatgtagaattaacagatccaatcatttctcgatttgacattctttgtgttgttaaggatgtggttgatccagtcactgatgagatgctagcgaagtttgtagttgatagtcatttcaagtcacaaccaaaaggtgctaatttggatgataggtccatgatcaattcacaagatgatgaccaagcttctacagttcccactgatcctgagataatttctcaagagttgctaaggaagtacataacctatgcaaagttgaatgtgttcccaaggttgcatgatgcagatttagacaagctcactcaagtgtatgctgaactgcggagagagtcatcgcatggacaaggggttccaatagcagtgaggcacatagaatctatgataaggatgtctgaagctcatgcgaggatgcacctaaggcagcatgtcacccaagaagatgtggacatggcaatccgggtgctattagactcgttcatatcaacgcagaagtttggagttcaaaaagctttgcaaaagagcttcaagaagtacatgacattcaagaaggatttcaatgcaattgtcctacaccttcttcgcggccttgtaaaggatgtactgtactttgaagaaattgtgtctggatctacagcaaacgtacctcatgtagatattaaagtggaagagctgcagagcaaggcgcttgattatggtattactgatctaaaaccattctttagcagcactgagttttctagagccaacttcgagttggatgagacacgaggcgtcattagacatcgacttgcaagatgatatcctaattttgacattgattaaaatttgctagcattaatgtatttgatgcgtttcatgacgttcacattttgtgcggatatatagccaccagaacaaagaattcctttcctttcgccttctctattcggtggaacttcgctggtatctttctttttcattctatgcgttgtggatttacggtgaactttgtggtgaactttgtatccgtcgggaaaaatgtgaaatttgcaagtgcaaaatgattaaggttgcagttgatgatat

SEQ ID NO: 4434 - DNA, 3649 bp, Vitis vinifera
aagcaatgccacgtatgcatatttggcgccaaaacttcccgccaaaaggaagagccttatcggaataatagcttagggcgaagggcgaagaacagttgctgacgcagtaaagcctcacaaacatggcgggagaagcttcgaactcggatccacatccacggcctagcgattccgacgctggtaattccggaaatccaccatccacacccgattcgcccacctctgctggtttcaacaccgatcaactccctcccagccgcacttccgagaactactccgacgaagatgaggccgccgtcgatccccacatcatcagagacgaaccagaagatgtggaggacgaggaggaaggcgaggatctttacaacgacaatttcatggacgattatcggaggatggatgagcacgaccagtatgaatcgttgggacttgacgagtctctggaagatgagagggatttggatcagatcatggaggatcgaagggctgctgagatggagctcgacactagagatactcgcataactgagacgaagcttcctcgtcttcttctcgaccaagatactgatgatgacaaccataggccttcaaaaagatcaagagcagattttaggcctccagctgcagcaagaagctatgatgatgctgatgcgatgttaagttcaccaggaaggtcacgaggacactcacgagaggatgttcccatgactgatcagactgatgatgaaccatacgaggatgatgatgatgatgatggtgagttcgagatgtaccgtgttcaaggaacgctaagggaatgggttactagagatgaagtgcgccgcttcattgcaaagaagtttaaggaattcttactcacctatgtgaacccaaagaatgaacatggtgattttgaatatgtgcgactgataaatgagatggtctcagctaacaagtgtagtttggagattgattacaaacagttcatctatatccatcccaatattgctatctggctggctgatgcccctcaatctgtccttgaggtcatggaagacgtagccaagaatgttgtctttgatttacatccaaactacaaaaatattcaccaaaagatctacgtccgcatcaccaacttaccggtttatgatcagatacgcaacatacggcagattcatttgaacaccatgattcgtattgggggagttgtaacccgacgttctggggtcttcccacagttacagcaggtaaagtatgactgcaacaaatgtggaatgattctggggccattcttccagaattcatattcagaagtcaaggttgggtcttgcccagaatgccaatcaaaaggaccattcactgtcaatatcgagcagacgatatacaggaactatcaaaaactcactctccaggagagcccaggtatcgtgccagcaggtcgtcttcctagatacaaggaagtgatactcttgaacgatttgattgattgtgcccgcccgggggaagagattgaggtcacaggtatttacacgaataattttgacctctccctgaatacgaagaatggatttcctgtatttgccactgtagtcgaggcaaattatgtcacaaagaagcaggatctcttttctgcttacaaacttacccaggaggacaaagaggaaattgagaagttggctaaagatcccaggattggagaaaggattgtcaagtccattgcaccatcaatctatggccacgaggatataaaaactgcaatggctcttgcaatgtttggaggccaagaaaaaaatgttgaagggaaacataggttgcgaggagacataaatgtacttctccttggtgatccaggcactgccaaatcacagtttttaaagtatgttgaaaagactgggcagagagctgtgtataccactggtaaaggtgcttccgctgtgggtctcacagcatcagtacacaaggatcctgtcacacgcgaatggacacttgaaggaggggctcttgttctagcagataaaggaatctgtctaattgatgagtttgacaagatgaatgatcaagacagagtgagcatccacgaagcaatggaacagcagagtattagcatatcaaaggctgggattgtcacttctctccaggctcgctgctctgtcattgctgctgcaaatccaattggaggaagatatgattcctcgaagacattttcacaaaatgttgaattgacagatccaatcgtttctcggtttgatgtcctctgtgttgtcaaggacgttgttgacccagtcacagacgagatgcttgcaaagtttgtggttgatagtcatttcaagtcacaacccaagggcactaatgtagaggataagtccttgagcaattcccaagatgatattcaaccatctgccaggcctcttgatcctgagatactctctcaagatttgctgaagaaatacttgacttacgctaagttgaatgtcttcccaaggttgcatgacgcagatctgaacaagctcacacatgtttatgctgagctgcggagagaatcttcgcatggacaaggagtcccaatagcagtaaggcatatagaatcaatgatacggatgtctgaagcacatgccagaatgcacctcagacagcatgttacccaggaagatgttgacatggctattcgtgtcctgcttgattctttcatttcaacacaaaaattcggggtgcagaaagccctacaaaagagcttcaaaaagtacatgaccttcaaaaaggattacaatgaactgctcctgtatctcctaagagggcttgtcaaggatgcactgcactttgaagagattgtatctgggtcaagttcaggacttccccatattgatgtgaaagtggaggagttgcaaagcaaggcacaggattatgaaatctatgatcttaaaccattcttttcaagcactcagttctctagggcccactttgagttggatgcagagcggggtgtgatcaggcatcgccttgcaagatgatgccaaaatgtaactaaattaatgctcggacagtgaagtttgcaaagcaagcaaagttaatggtcctaaattgttctggttattcagatgaagcagagtggaattcaacatcaacccagatctcatctgctctttaatgtattgaaattaaaacaggatttctattagacaaacaaattacagtgatttgaatagggatgggattagtactgaatgatgggtattgaagtgaattttagggactgaacatttcccatttggttttaataagttgtgcaggtaaggatagaaaaatctttggtaaatggcaagaatgcagtatagattgggtgggtgtttgctgcctatttcatctgaactgtgatgcaacttagcttcccgtgcaaggcattatcccataaaagggccagagggtgtgtttcagtttgcttcaagatgatgccaaaattgatggttacttacggtggtgggaaatcggagtttaatgttccatctgcgattgttacactgacttatattttggcaatttaaaaaatctttaaaatttctgattattgcagggaatcggacggcaagttgattgtagttaaaattgaaactgacgagagaaatttaaaaccaaatttaaatgcccatgaaagaaatgggcatccaaattgaag

SEQ ID NO: 4435 - DNA, 3112 bp, Petroselinum crispum
tcaatcatcatcgtcttccgatgaagaaggaaatgtgaatggtaacgacagtgtaggtaatcagccgtcaacgccaaattcaccaacatccgctgggtttaacactgaccagcttccattcaatagtacctccgatgtttactccgaggaagaagaggaagctgctgttgatcctcgtattatacgagatgaagaacccgaagacgaagaagaagaaggagaggatctattcaacgacaattacatggacgattatcggagaatggaggagcatgatcagtatgaatcactagggctggatgaatcccttgaagacgagagagatctggatcagattatggctgaccgtagagctgctgaggttgagctggaggctagagatgctgccaccactgccccgcccactctttctcaccgcaagctccctcaccttctccatgaccaagataccgatgaggacaactttaggcctcacaaaagaactagagctgatttcaaacctccacctactactcctagaagctttgatgacactgatgcaatgcacagttcaccaggtagatcacaatggggtaactctagagaggatgttcacatgactgatcagactgatgatgatccatatgaggatgaagacaatgacgaaggtgagtttgaaatgtaccgtgttcagggaacacttagggagtgggttacaagggatgaagtgcgtcgcttcatagcgaaaaaattcaaggaatttatacttacttacgcaaaccccaaaaatgaaaacactgagttagaatatcttcagcaaattaatgaaatggtatcagttaacaagtgtagccttgagattgactataagcagttcatctatatacacccaaatatagccatctggcttgcagatgcaccccaatctgtccttgaggttatggaagaagttgctaataaagttgttttcgagttgcatcctaactacaagcaaattcaccagaaaatttatgtccgcatcaccaacttacctgtgtatgatcagatacgcaacataaggcaaatacatttgaacaccatgatccgtattggtggagttgtaaccaggcgatctggagtgtttccccaattgcagcaagtgaagtacgattgcaacaagtgtggaatggttttgggtccatttttccaaaattcatatgcagaagtgaaagttggttcttgccccgagtgccaatcgaaagggccatttaccattaatatcgagcagacattgtacaggaattatcagaaacttactctacaagagagtccgggaattgtgccagctggtcggcttccgagatacaaagaagtgatattgctgaatgatctgatagattgtgcccggcctggggaagagattgaagtcacaggcatttatacaaacaacttcgacttgtctttaaatacaaaaaatggatttcctgtctttgccacagtgattgaagccaactatgttactaagaagcaagatctgttctcagcttataaactcacccaggaggacaaagaagaaattgaaaatttgtctaaagaccccaggattggagaaaggataatcaaatctgtggccccttccatatatggtcatgaggatataaaaactgcaatagctcttgcaatgtttggaggtcaggagaaaaatgttgaagggaaacaccgtctgagaggagatataaatgtactcttgctaggtgatccaggcacggccaaatcacagttcctcaagtatgttgaaaagaccggacagagggctgtttacacaacagggaaaggagcatctgctgttgggctcactgctgcagttcacaaggatccagtcactagggagtggacccttgaaggaggggcactcgttttggcagataaagggatctgtcttattgatgagtttgacaaaatgaatgatcaggacagagtaagtatccatgaagcaatggaacagcaaagtattagcatatcaaaggcagggattgtcacttccctccaagctcgatgttcagtgattgctgctgcaaatcctattgggggaagatacgattcctccaagaatttctcacaaaatgtggaattgactgacccaattgtttctcgttttgatattttatgtgttgtcaaggatgtggtcgatccagtcatagatgagatgcttgcgaagtttgtagttgatagtcactttaagtcccaagctaaaggtgctcatttaggtgacaagcccctaggtcattcccaggaagacgctgaagcctttgccatgacagatgatcctgagataatccctcaagacatgctgaaaaagtacataacctttgccaagttaaacgtctttccgaggttgcatgatgctgatctagacaaactcactcaagtttatgcagaattgcggagggaatcttctcatggacaaggtgttccaatagcagtgaggcacatagaatcgatgatacggatgtctgaagcacatgctaggatgcaccttaggcaacatgtaactcaagaagatgtcgatatggcaattcgtgtcctgcttgactcctttatctcaacccaaaagtttggggtgcagaaagcactgcagaagagttttaaaaagtatatgacgttcaagagggatttcaatggcattatcttgcatcttctccgacaacttgtgaaggatgcactgcattttgaagaaatcgtgtctggctctacaacggatcttactcatgttgatgtgaagattgaggaattacaaagcaaggtacaagattatggtattacggatctaaaagcattcttcacctctagcgagtttactagagccaactttgagttggatgaagaaaggagactgatacgccaccgccttgcaagataggcaattgcactgtgaagtgcaagcagcaactttgctggtcctcagatggttgaatatataacgttcaagaagctattttagatggcaaaatctcagtcaaatattcaaggggaaaatactaattctatgatgatttttgtaatgaatgaaatgtcatttcgaagtttctttattgttcagattcttttaagaattattcggagttggtatattatataacgcattcagttccat

SEQ ID NO: 4436 - DNA, 3164 bp, Sesamum indicum
cttaattcttctccccggcccggcgcaactctctctcttacacacacagtaaccggaggaaattctctgcggagaaaatggcgagggaagacgatgaatccagatcaggcggcgacgccgctgctgcaaatgggaatccgccgtctgtgccggactccccgacgtcagccggattcaacaccgaccagctgccgttcaataccagccagaattataccgatgatgatgatgaagcatctgttgatcctgaaattatcagggacgagcctgaggaggagaatcttaatgaagaggaggaggaaggggaggacctcttcaacgacaatttcatgaatgattatcggaggttggggcagcaggaccagtacgagtcattggggattgacgattccatggaggatgagagggatctggaccagattatggccgaccgcagagctgcagagatcgaacttgaggccagagaagctcgtgtgtcgcagcggaagcttccccagcttcttcacgaccaagacactgatgatgacaactacaggccatcaaaaaggacaagagctgactttaggcccccaaccactccaagaagcatggatgatactgatggaatgcgcagttcaccaggtggatcacaacaagggaactctagggatgacatccccatgactgatcagacagatgatgacccttatgatgacgaggagaatgatgaaggtgagtttgagatgtacagggttcagggaaccctgagagagtgggttactagagatgaagtgaggcgcttcattgccaagaaattcaaggagttcctactcacatatgtgaatccaaagagtgatcatggagactttgaatatctgaggcagatcaatgaaatggtctcagtcaacaagtgcagccttgagattgattacaaacagttcatctatatccatccaaacatagcgatctggctcgctgatgcccctcagtctgttcttgaggttatggaagaagttgccaacaagattgttttcgacttgcatccaaattacaggaaaatccatccaaaaatctatgtacgcatcaccaacctaccagtgtatgatcagatacgcaacattaggcagatacatttgaacactatgatccgtattggtggagttgtgactcgacgttctggagtctttccccaattgcagcaagttaaatatgactgtaccaaatgtggatcaattttagggccttttttccagaattcatattcagaggtgaaggttggttcttgtccagagtgtctatcaaaaggaccattcactgttaacattgaacagacaatatataggaactaccagaaactaactctccaagaaagccctggaattgtccctgctggtcgacttccaagatacaaggaagtgatactgttgaatgatctcattgattgtgcccgtccaggagaagagattgaggtcacaggcatatataccaataattttgatttgtctttgaatacaaagaatgggtttcctgtctttgccaccgtgattgaagcaaattatgtcaccaagaaacacgatctcttttcagcttacaagcttacccaagaagacaaagaagaaattgagaaattggcaaaagacccaagaatcggggaacggatcatcaagtccatagccccttcaatctatgatcatgaggacataaagactgcaattgctcttgctatgtttggtggtcaagagaaaaatgttgaaggcaaacaccgtctaagaggggatataaatgtactcctgctcggtgatcctggaaccgccaagtcccagttcctcaagtatgttgaaaagactggacaaagggctgtttacactactgggaaaggagcttctgcagtcggactcactgcagcagttcacaaggatccagtcacacgggagtggactctagaaggaggagctcttgttttggctgatagaggcatatgtcttattgatgagtttgataaaatgaatgatcaggacagggtaagtattcatgaggcaatggagcagcagagtattagcatatcaaaagccgggatagtcacatctctccaggctcgctgttctgtaattgcagcggcaaatcctattggaggaagatatgattcctcaaagacatttgctcaaaatgtggaactgactgatccaatcatctcccggtttgatattctctgtgttgtcaaggatgtggtggacccagtgactgatgagatgctggcacaatttgtagttgatagtcactgcaaatcgcagcctaaaggtgccaattttgatgatcggtctatggccaattcacaagatgatgtccaagcttccacaagacaaaccgatcctgagataataccccaagagttgctaaagaagtacctcacctatgccaagctgaatgtatttccgaggttgcatgatgcagatttagacaagcttacgcaagtttatgctgaattacggagagaatcatcacatggacagggagttcctattgccgtgagacacatagaatcaatgatacggatgtctgaagcccatgccaggatgcaccttagacagcatgtcactcaggaggatgtggacatggctattcgtgttctgttggattctttcatctcaacccaaaagttcggtgtgcagaaagctttgcagaagagcttcaaaaagtatatgatattcaagaaggacttcaatggaattgttttgcatcttctccgaagacttgtgaaggatgccttgcactttgaagaaatggtgtctggttcaactgtaaatctttctcacgtggatgtaaaagtggaagaactgcaaagcaaggcacttgattacggaataagtgatctgaaagctttcttcaacagcacagagttttcgagcgctcactttgagttggacgaggcacgaggtataatcagacatcgtctttcacactgataactagttaagaggatcttactacacaatgatgatgtttgtatcatatttacttaaacgtaccgtgctttctcaatttattgacatttcatgatgaatattgcaacacgtgttgcgtttccacacacagcaatgtcctaacaccactgtggtcttctctgatgtgtagttaaatttccaactcaaattaattcaactaactcgcctgtgtgtgcgcgcccg

SEQ ID NO: 4437 - DNA, 3068 bp, Ocimum basilicum
cccactctcacccaacacacacatttccgctgagagctactatggccggagatgacagttcatccaaatcgggagatgacggtgtggcggccaacaggattcctccgtctacacccgattccccaacatccgctgggttcaacactgaccaactgccgttcaataccagccaaaattacaccgacgacgatgatgaggcctccgtcgatcctgagattatcagagacgagatcgatgaagtaaacaacatcgaggatgaggaagaaggcgaggatctcttcaacgacaatttcatggatgattatcggaggatgggcgagcaggaccaatacgaaaggctggggattgacgattccttagaggacgatagggatttggaccagattatggccgaccgcagagccgccgagattgaacttgacgccaaagaagctcgcgtctcccagcgcaagcttccgcagcttcttcacgatcaagatactgatgatgaaagttacagaccgtcaaaaagaaccagagctgactttaggccgccagccactccggatgatactgatggaatggcaagctctccaggtaggtcgcagcgaggcaactccagggatgatgttcccatgactgatcagacagatgatgacccttatgacgatgaagagaatgacgaagacgggtatgcaatgtatagggttcagggaaccctcagagagtgggttactagagatgaagttaggcgtttcattggaaagaaatttaaggattttttgcttacatatgtgaaaccgaagagtgagaatgaagactatgagtatataaggcaaatcaatgaaatggtctcagttaacaagtgtagccttgagattgattacaaacaattcatctttatgcatcccaacattgcaatctggcttgcggatgctccacagtctgtccttgaggttatggaagaggttgccaataagcttgtttttgacttgtacccgaattacaagaaaatccatcaaaagatctatgtgcgcatcactaacttacctgtgtatgatcagatacgaaacataaggcagatacatttgaacaccatgattcgtattggtggagttgtcactcgacgctctggagtttttccacaactgcagcaagttaaatatgattgtaataaatgtggagcaattctgggaccttttgtccaaaattcgtattcagaggtgaaggttggatcttgtccagagtgtcaatcgaaaggaccatttacggttaacattgaacagacaatatataggaactaccagaaactcactcttcaagaaagccctggaattgttcctgctggtcgactaccgagatacaaggaagtgatactcttgaatgatctcatagattgtgcccgacctggagaagagatagaggtgaccggcatatataccaacaactttgacttgtctttaaatactaagaatgggtttcctgtttttgcaactgtggtggaagcaaattatgttgccaagaaacaggacctcttttcagcttacaagctgactcaagaagataaagaagaaattgagaagttggcgaaagaccccagaattggagaaaggattatcaagtcaatagccccatccatctatggtcatgaggacataaagactgcgatagctctcgcaatgtttggcggccaagagaagaatgttgaaggaaaacaccgtctgcgaggagatataaatgtactcctacttggtgaccctggaactgccaagtcccagttcctaaagtatgttgagaaaactggacaaagggcagtctacactactggcaaaggagcttctgctgtaggactcactgctgcagttcacaaggatccagtcacacgggaatggactctagaaggaggtgcacttgttttggctgatagaggcatatgtcttattgatgagtttgacaaaatgaatgatcaggacagagtaagcattcatgaagcaatggagcagcaaagtattagcatatcaaaagctggaatagtcacatctctccaggcccgctgttctgtaatagctgctgcaaatcccatcggaggaagatacgactcttcaaagacattttcgcaaaatgtggaactcacagatcccattgtttcccgctttgatattctctgtgttgtcaaggatgtggttgacccagtaattgatgagatgctggcacaatttgtagttgatagtcatttcaaatcacagcccaaaggtgccaactttgacgataggtctgtgaacaattcacaggatgatatccaagcttcagccggacagacagatccagagataatcccccaggagttgctgaagaaatacctaacctatgccaagctgaatgtgtttccaaggttacatgatgcagatttagacaagcttacacaggtttatgctgaattacgaagagaatcatcgcatggacaaggagttcctattgcagtgagacacatagaatcaatgatacggatgtctgaagcccatgccaggatgcacttaagacagcatgtcatacaagaggatgtggatatggccatccgagtcctgctggattcatttatctcaacccaaaagtttggtatgcagaaggccttgcagaagagcttcaaaagatacatgatattcaagaaggatttcaatggtattgtattgcaccttcttcgagaacttgtgaaggatgccctgcagtttgaagaaattgtgagtggttctacggcaaacctttctcatgttgacgtgaaagtggaagaactggaaaacaaggctcgtgattatggaatcagtgatctgaaagctttcttcaacagcagagagttccgaaatgcacactttgagttggatgaagaacggggtatgataaggcatcctcttgcccgttgatttatttaattttagggaggaccattacaattaatattattaagattttcccccttgtttttagttatcctgtgaaaatgtgatagatttcagtacttgagtattggatgtgaatttgtattgtcatgatgtacggccttgggtgagagttcaaatatgaagaagaatgag

SEQ ID NO: 4438 - DNA, 2820 bp, Vinca minor
gaataaatccgacgccgtcaacgccagattcgccaacatcggtagggtttaacacagatcagttacctctgaacacgagccagaactattccgatgatgacgaggcatccgtggatcccgaaatcatcagagacgatgaaggaggagaagaaattgaggaagaagaaggagaggatctattcaatgataattacatggaggattatcgaaggatggaggaacatgaccagtacgaatcgttgggacttgacgagtcgatggaggacgagagggatttagatcagatcatggccgatcgtagagctgctgaggttgaacttgataccagagaagctcgtgtggtcccctcctctcagcgcaagcttcctcaacttttccatgaccaagatactgatgatgacaactatagaccctcgaaacgaacccgggctgactttaggcctcaaacagctcaaagaagttttgatgataccgatgcaatgcagagttcacctggtagatcacaaagaggacactctaaagaggatgtaccaatgactgatgccactgacgacgatccttatgaggatgatgacaatgaagagggtgagtttgagatgtacagggtccagggaactcttcgcgaatgggttaccagagatgaagtacggcgtttcattgcaaagaagttcaaggagtttttgttcacatatgtgaatccaaagaatgaacatggggactttgagtacctccggcagatcaacgagatggtgtcagttaatagatgtagtcttgagattgattacaaacagttcatctatattcacccaaatattgccatctggctggctgatgcaccacattcagtccttgaggtcatggaagatgttgcaaacaaagttgtgtttgatttgcacccgaactacaagcagattcataagaaaatttatgttcgtattaccaacttgcctgtttatgatcagatacgcaacataaggcagatccacctaaacaccatgattcgtattgggggtgttgtgaccaggcgttctggcgtctttcctcagttgcaacaagttaaatatgattgcaacaaatgtggaacaattttaggacctttcttccagaactcatattccgaggtcaaggttggttcctgcccagagtgccaatcgaaagggccatttacagtcaatattgagcagacaatatataggaactaccagaaacttactctccaagagagcccgggaattgtaccagctggtagactaccaagatacaaggaagttatactgttgaatgatctgattgattgtgccaggcctggagaagagattgaggtgacaggtatttacacaaataattttgatctgtctctcaacacaaagaatggatttcctgtttttgcaacggtaattgaagcaaatcatgtcacgaaaaagcaagacctcttttcagcttacaaacttacccaggaggacaaggaagaaatagagaagttggccaaagatccaaggatcggtgaacggattgtcaaatcaattgcaccatcaatatatggtcatgaagatataaagactgcaattgctcttgcgatgtttgggggccaagagaaaaatgttcaaggaaaacatcgattgaggggtgacattaatgtactcctgatgggtgatcctggcactgccaagtcacagttccttaaatatgttgagaagactggacaaagagctgtttatactactggaaaaggtgcatctgcagttgggctgacagctgcagtacacaaagacccggtcacaagagagtggactctagaaggaggtgctcttgttcttgctgatagagggatatgccttattgatgaatttgataagatgaatgatcaggacagagtaagcattcatgaagcaatggagcagcagagcatcagcatatcaaaggcagggattgtgacatctcttcaggctcgctgttctgtcattgctgctgcaaatccaattggaggaagatacgattcctcaaaaactttctcgcaaaatgtggaattaacagatccaatcatttctcgttttgacattctttgtgttgttaaggatgtggtggatcccgtcactgatgagatgttagcaacatttgtagttgatagtcatttcaagtcacagccaaaaggtgctaatttagatgataggtccatgatcaattcagaagaagatgatcaagcctctgcagttcccaatgatcctgagataatttctcaagagttgctaaagaagtacataatctatgcaaagttgaatgtgttcccaagattacatgacgcagacttagacaagcttactcaagtatatgctgaattgcgcagagagtcctcccatggacaaggaattccaatagcagtgaggcacatagaatctatgataaggatgtctgaagctcatgcgaggatgcacttgagacagcatgtcacccaagaagatgtggacatggcaatccgggtgctgctggactcgtttatatcaacacaaaagtttggagttcaaaaagctttgcaaaagagcttcaagaagtacatgacattcaaaaaggatttcaatgctattgtcctacatcttcttcgagggcttgtaaaggacgcgctttactatgaagaaatattgtctggatctacaacaaatgcatcacatgttgatattaaagtcgaagagctgcagagcaaggcacttgactatgggatcactgatctaaagccattctttactagtaccgcgttctctagagctaacttcgagttggacgagacacgaggtgtcataagacatcggcttacaagatgatatc

SEQ ID NO: 4439 - DNA, 3110 bp, Solanum phureja
aaaaccctacaacgcacaacgcccgagtagattgagaaacagagagaaaatggccggcgaagattccaacggcgatagtggtagccgccgtccggcggagtcttcgtcatcttccgatcatagaaatggcaatccaccgtctactcctgattctccgacgtcagtaggattcaacaccgatcagcttcctttcaacactagccaaaactactctgaagaggatgaagcctctgttgatcctgatatcatcagagacgatccagaagatgctgacatggaagaggaagacggagaagaccttttcaacgacaattatctcgatgactatcagaggatgggtgaggctgaccagtacgagtcgctcggattggatgattccatggtggatgaaagagatctggatcaaatcatggcagatcgtcaggctgctgaagtggaacttgacaatagagatgtacatgtctctaaccgcaagcttcctcaacttcttcatgatcaagatactgatgatgacaactataggccatcaaaaaggactagagctgatttcagaaggaattttgatgatactgatgcaatgccaagttcaccaggggcatcacaacgagtaaactccagccaggatgtgccaatgactgatcaaactgatgatgatccctatgaggatgatgaaaatgatgaaggggagtttgagatgtacagggttcagggaacacttagggaatgggtaactagagatgaagtccggcgtttcattgcgaagaagttcaaggaattcttactcacatatgtaaacccaaaaaatgaacatggggactttgaatatcttcgacagatcaatgagatggtatcagttaataaatgcagccttgagattgattacaaacaattcatatatgtccatcccaatattgccatctggctggcagatgcaccacaatccgtccttgaagtgatggaagaagttgccaacaaagttgtctttgatcttcatcccaactataagcaaattcatcagaaagtctatgtaaggattaccaacttaccagtttatgatcagattcgtaatataaggcagatccatttgaacaccatgattcgtattggtggagtcgttacccggcgatctggtgtctttccccaattgcaacaagtgaaatatgactgtaacaaatgtggagcagtattgggtccttttttccagaactcatactcagaagtcaaggttggttcttgcccagagtgtcagtcaaaaggaccattcagtgtcaatgttgagcagacaatatacaggaactatcagaaactgacactacaagaaagcccaggaattgtgccagctggtcggcttcctagatacaaggaagtgatactgttgaatgatcttattgattgtgcccgaccaggagaagagatagaagtcacaggaatctacactaacaactttgacttgtccctgaataccaagaatgggtttcctgtcttttctaccgtgattgaagcaaattatgttacaaaaaagcaagacctcttttcagcttacaagctaactcaggaggacaaagaagaaattgaaaagctggccaaagaccctcggattggagaacgaatattcaagtccattgccccgtcaatttatggtcatgaagacataaagactgccatagctcttgcaatgtttgggggacaagagaaaaatgttgaagggaaacacagactgagaggagacataaatattctcctgctaggtgatccaggcactgcaaaatcacagttcctcaagtatgtcgagaagacgggacaacgagccgtctatacaactggaaaaggagcatctgctgtagggcttacagcagcagtacacaaggaccctgtcactcgggaatggaccctcgaaggaggagcactagttttggctgatagaggaatatgtttgattgatgagttcgataagatgaatgatcaggatagagtgagtattcatgaagcaatggaacagcagagtattagcatatcgaaggctggcattgtcacatctctccaggcccgctgttctgttattgctgctgcaaatcctattggaggaagatatgattcgtcgaagaatttcacgcaaaatgtggaattgacagatccaatcatttctcgatttgatgtactctgtgtggtcaaggatgtggttgatccagtcactgatgagatgcttgcaaagtttgttgttgatagtcattttaggtcacaagcaaaaggtgctactattgatgagaagtcatttactgattcacgggatgatgcccgtgccactatggctgcaactgatcctgagataattcctcaagagttgctaaagaagtacttaacttatgcaaagttgaacgtattcccaaaattacatgatgcggacttggacaagctcacacaggtttatgctgaattaaggagagaatcttcgcatggacaaggaattcccatagcagtgaggcacattgaatcgatgataaggatgtctgaagcccatgcaaggatgcatcttagacaacatgttactcaagaagatgtggatatggcaattcgtgtccttctggattcatttatatcaacccagaaatttggggtgcaaaaagcattgcaaaagagcttcaaaaagtacatgacatacaaaaaagatttcaatgctatcattcttcacctcctacgtgggcttgtaaaagatgcactgcagtttgaggaaattgtttcaggttctgctgccaacctagatcatattgatgtgaaggttgaggagctacaaagcaaggcacttgattatggcatgactgatctcaaagcatttttctcaagcaatgaatttactaaagcaaactttgagttgtacgaggatcagggtatcataagacatcgccttccagctcgatgagttatgtattgtttcagatttagtcatatggctggttaatctagttttcttaaattgtatacaaatgaatgcagaactctgagacgttcttaacatttgatcagttttagcttctacaaggaaaatttattgtttgctttttgttgtacttgtattacagataactcaattaagttgtttcaacagtgaaaag

SEQ ID NO: 4440 - DNA, 3316 bp, Solanum lycopersicum
aatctcttctcctctccaaaaccctacaaagcacaacgcccgagtagagagagaaacagagagaaaatggccggagaagattccaacggcgatagtggtagccaccgtccggcggagtctccgtcgtcttccgatcatagaaatggcaatccaccgtctactcctgattctccgacgtcagtaggattcaacaccgatcagctccctttcaacactagccaaaactactctgaagaggatgaagcctctgtcgatcctgatatcatcagagacgatccagaagatgctgacattgaagaggaagatggagaagaccttttcaacgacaattatctcgatgactatcagaggatgggtgaggctgaccagtacgagtccctcggattggatgattccatggtggatgaaagagatctggatcaaatcatggcagatcgtcaggctgctgaagtggaacttgacaatagagatgtacatgtctctaaccgcaagcttcctcaacttcttcatgatcaagatactgatgatgataactataggccatcaaaaaggactagagcagatttcagaaggaattttgatgatactgatgcaatgccaagttcgccaggggcatcacaacgagtaaactccagccaggatgtaccaatgactgatcaaactgatgatgatccctatgaggatgatgaaaatgatgaaggggagtttgagatgtacagggtccagggaacacttagggaatgggtaactagagatgaagtccggcgcttcattgcgaagaaattcaaggaattcttactcacatatgtaaatcccaaaaatgaacatggggactttgaatatcttcgacagattaatgagatggtatcagttaataaatgcagccttgagattgattacaaacaattcatatatgtccatcccaatattgccatctggctggcagatgcaccacaatccgttcttgaagtgatggaagaagttgccaacaaagttgtctttgatcttcatcccaactataagcaaattcatcagaaagtctatgtcaggattaccaacttaccagtttatgatcagattcgtaatataaggcagatccatttgaacaccatgattcgtattggtggagttgtcacccggcgatctggtgtttttccccaattgcaacaagtgaaatatgattgtaacaaatgtggagcagtattgggtcctttcttccagaactcatactcagaagtcaaggttggttcttgcccagagtgtcagtcaaaaggaccattcagtgtcaatgttgagcagacaatatacaggaactatcagaaactgacactacaagaaagcccaggaattgtgccagctggtcggcttcctagatacaaggaagtgatactgttgaatgatctaattgattgtgcccgaccaggagaagagatagaagtcacaggaatctacactaacaactttgacttggccctgaataccaagaatgggtttcctgtcttttctactgtgattgaagcaaattatgttacaaaaaagcaagacctcttttcagcttacaagctaactcaggaggacaaagaagaaattgagaagctggccaaagaccctcggattggagaacgaatattcaagtccattgccccgtcaatttatggccatgaagacataaagactgccatagctcttgcaatgtttgggggccaagagaaaaatgttgaagggaaacacagactgagaggagacataaatattctcctgctaggtgatccaggcactgcaaaatcccagttcctcaagtatgtcgagaagacgggacaacgagccgtctatacaactggcaaaggagcttctgctgttgggcttacagcagcagtacacaaggaccctgtcactcgggaatggacccttgaaggaggagcactagttttggctgatagaggaatatgtttgattgatgagttcgataagatgaatgatcaggatagagtgagtattcatgaagcaatggaacagcagagtattagcatatcaaaggctggcattgtcacatctctccaggcccgctgttctgttattgctgctgcaaatcctattggaggaagatatgattcctcgaagaatttcacgcaaaatgtggaattgacagatccaattatttctcgatttgatgtgctgtgtgtggtcaaggatgtggttgatccagtcactgatgagatgcttgcaaagtttgttgttgatagtcattttaggtcacaagcaaaaggtgctactatagatgagaagtcatttactgattcacgggatgatgctcgtgccactatggctgcaactgatcctgagataattccacaagagttgctaaagaagtacttaacttatgcaaagttgaacgtattcccaaaattacacgatgcagacttggacaagctcacacaggtttatgctgaattaaggagagaatcttcgcatggacaaggaattcccatagcagtgaggcacattgaatcgatgataaggatgtctgaagcccatgcaaggatgcatcttagacaacatgttactcaagaagatgtggatatggcaattcgtgtccttctggattcatttatatcaacccagaaatttggggttcaaaaagcattgcaaaagagcttcaaaaagtacatgacatacaaaaaagatttcaatgctatcattcttcacctcctacgtgggcttgtaaaagatgcattgcagtttgaggaaattgtttcaggttctgctgccaacctagaccatattgatgtcaaggttgaggagctacaaagcaaggcacttgattatggcatgactgatctcaaagcatttttctcaagcaatgaatttactaaagcaaactttgagttgtacgaagatcagggtatcataagacatcgccttccagctcgatgagttatgttattgtttcagatttagtcatatggcaggttgatctagtttgttttaaattgtacacatatgaatgcagaactctgagacgttcttaacatttgatcagttttagcttctacaaggaatttgttgtttgccttttgttgtacttgtattacagataatttaagttgtttcaacagtgaaaagttactttaatactaacaattgagccaaaaacacttgggttaacaatattttggtaacgctaaaaattgtaattaaccaaagatctttgaggtacttgtttttatcaagataaagacatgttcatttggatataaatttctcatattcaatgtgtaacttactagaaataaattgaaggagcaagttttgttca

SEQ ID NO: 4441 - DNA, 3442 bp, Panax ginseng
ctatctaaacctaataaagaaattttaagaggagcgagaaatggcaatatcgtcgcagtcgtcttcagaggaagaaggcaacgagaacgtgaacagcggtgggaatcagccgtcgacgccggattcgctaacatcggcgggtttcaacactgatcagcttcctttcaacaccactagccggacttcagagaactactcggaggaagaagaggaagccgcagttgatccccgtatcatcagggacgatgagcccgacgacgaagaagaagaagaaggagaggatctcttcaacgacaattacatggacgattatcggaggatggaggaacatgatcagtatgaatcggtaggcctggatgaatcactggaagacgagagagatttggatcagattatggctgaccgaagggctgctgagattgagcttgaggccagagacgctgccactgctgctcccccaactctttctcatcgcaagcttcctcaccttctacatgaccaagatactgatgatgataactataggccttcgaaaagaactagagctgattttaagcctcctactatgcctagaagctttgacgatacagacgcaatgcaaagttcacctggtagatcgcaaaggggacactcaagagaagacgtgcatatgactgatcagaccgatgatgaaccatacgaggatgaagataatgatgaagccgaatttgaaatgtatcgtgttcagggaacacttagggagtgggttactagggatgaagtgcgtcggtttattggcaagaaattcaaggaattcatgctcacatatgtgaatgccaaaagtgaacatcgtgacttcgaatatttacgacagataaatgaaatggtttcagttaataggtgtagccttgagattgattacaagcaattcatatatatccacccaaatatagccatctggctagcagatgcaccccagtctgtactcgaggttatggaagaagtggctaataaagttgtcttcgacttgcacccaaactataagcaaatacaccagaaaatctatgtccgaatcaccaacttacctgtatatgatcagatacgcaacataagacagatacatttgaacaccatgatccgtataggtggtgtagtgacccggcgctctggagtgtttccccagctgcagcaagtaaagtatgattgcaacaagtgtggaatgattttgggcccatttttccaaaattcatatgcagaagtgaaggtcggttcttgccctgagtgccagtcaaaaggaccatttactatcaatattgagcagacattgtacaggaattatcagaaactcacccttcaagagagcccaggaattgtgccagctggtcgacttccaagatacaaggaagtgatattgctgaatgatctgatagactgtgcccgtcctggggaagagattgaggtcactggcatttacacaaacaattttgacttgtctttaaatacgaagaatggatttccggtctttgcaactgtgattgaagccaattatgttacaaagaagcaagacctattttcagcttacaaacttacccaggaggacaaagaagaaattgaaaagttgtctaaagaccccaggattggagaaaggataattaagtctgttgccccatcgatatatggtcacgaggacataaagactgcaattgctcttgcaatgtttggaggccaggagaaaaatgttgaaggaaagcatcgtttgcgaggagatataaatgtactcctgctaggtgatccaggcacagcaaaatcgcagttcctcaagtatgttgaaaagactggacagagggctgtctatacaactgggaaaggagcttctgctgttgggctcacagcagcagttcacaaggatcctgtcacccgggagtggacccttgaaggaggggctcttgttctagctgataaagggatatgccttattgacgagtttgacaaaatgaatgatcaggacagggtaagtatccatgaagcaatggagcagcagagcattagcatatcaaaggctgggattgtcacttcactccaggcccgctgttctgttattgctgctgcaaatcctataggaggaagatatgattcgtccaagaatttctcacaaaatgtggagctgacagatccaattgtttctcgttttgatatcttatgtgttgtcaaggatgtggttgacccagttacagatgagatgcttgcaaagttcgtagttgatagtcatttcaagtcgcaagccaaaggtgctaatttagatgacaagtcgctcggccattcccaggaaaatattgaagccactgccatgacagctgatcctgagataattcctcaagatctgctaaagaagtacataacctataccaagttaaatgtattcccaaggttgcatgatgctgatctagacaagctcactcaagtttatgcagaattacggagagaatcttctcacggacaaggagttcctatagcagtaaggcacatagaatcaatgatacggatgtctgaagcccatgccagaatgcatctcagacagcatgtcactcaagaagatgtggacatggcaattcgtgtgctccttgactcgtttatttcaacacaaaaatttggggtgcaaaaagctttgcaaaagagtttcaaaaagtatatgacatttaagagggatttcaatggcatagttttgcatcttcttcgtcagcttgtgaaggatgcactgcattttgaagaaattgtgtctggttctacaacaggtcttgcccatgttgatgtgaaagtggaggagttgcaaagcaaggtagtctgaactcctgaacttttgttttgttgtctttttgttttattttgtttccagcagtagaagctaggcttctgacaaatagtattgacactttttatgttacaggttcatgattttgatgtctttcctgaatttttggtaactttctttttttatataatcgcctcagatggaaatcaaaagcagaaagcaatgactatagtgatgatataatatgtgtttcatagcaatgttcatacgagtatccctgtcagtcttggagcattcttttaatggattttcattttctcaataataagtattcatgaattgcccatgagtagaatgttctgagtttttttttaatgaaattggcgctcattagcatgtttcctttgatgcatacagcactggtcctttgtaatctagaatgcctattgccttgagcaggggcaaagaagtatatgagcagtgcgtttgaaaaaaattatattgtcgaggtgtcttcagagcatttatatgaagatattttaaatgttacataaatgtttatattatttgtaagcgtgaaagaattctacaaagagtacaattaagacatgtccttttagttaggtgatttagaatcccagtttttatgcatca

SEQ ID NO: 4442 - DNA, 3251 bp, Nicotiana benthamiana
aaaaccttacaaaaacttcccgcctagtagaaagcgataaagagagagaggaaatggccggcgaagattctaacggcgatagtgctcgtcctccggtgggttctccgtcatcgtccgatcacagaaacggaaatccggtgtcaactcccgattctccgacgtccgtaggattcaacactgatcagctccctttcaacactagccaaaattactccgaagaagatgaagcctctgtcgatcccgatatcattcaagacgagccagaagatatcgaagaggaagaagacggagaggaccttttcaatgacaattacctcgaggattatcggaggatggaagagcatgatcagtatgaatcgttgggattggatgattcgatggaggatgaaagagatttggatcaaatcatggcggatcgtcgggctgctgaagtggaacttgacactagagatgtacaggtcacgaaccgcaagcttccccaacttcttcacgatcaagatactgatgatgacaactataggccatcgaaaaggactagagctgatttcaagcccaccaactcacaaagaaacattgatgataccgatgcaatgccgagttcaccaggagcatcacaacgagtaaattctagtcaggatgtgccaatgactgatcaaactgatgatgatgcctatgaggatgatgaaaatgatgaaggagagtttgagatgtacagagttcagggaacacttagggaatgggtaactagagatgaagtccggcgtttcattgcaaagaagttcaaggaattcttactcacatatgtaaatccgaaaagtgagcatggggactttgaatatcttagacagattaatgagatggtatcagttaacaagtgtagcctcgagattgattacaaacaattcatatatgtccatcccaatattgccatctggctggctgatgcacctcaatccgtccttgaagtgatggaagaaattgctaacaaagttgtctttgatcttcatcccaactacaagcaaattcatcaaaaagtctatgtcaggattaccaacttaccagtttatgatcagattcgcaatataaggcagatccatttgaatacaatgattcgtattggtggagttgtcactcgacgttctggtgtctttccccagttgcaacaagtgaaatatgattgcaacaagtgtggaacaattttgggtccttttttccagaactcatactcagaagtcaaggttggttcttgcccagagtgccaatccaaaggaccattcactgtcaatgttgagcagacaatatacaggaactaccagaaactgacactacaagaaagtccaggaattgttccagccggtcggcttccgagatacaaggaagtgatactgttgaatgatcttattgattgtgcccgaccaggagaagagatagaagtcacaggagtctacacaaacaactttgacttgtccctgaataccaagaatgggtttcctgtctttgctactgtgattgaagcaaattatgtcacaaaaaagcaagacctcttttcagcttacaagctaactcaggaggacaaggaagaaattgaaaagctggcaaaagacccccgaattggagaatggatatctaagtccattgctccatcaatctatggccatgaagatataaagaccgccttagctcttgcgatgtttggtggccaagagaaaaatgttgaaggaaaacacagactgagaggagacataaatattctcctgctaggtgatccgggcactgcaaaatcacagttcctcaagtacgtagagaagacaggacagcgggctgtctatacaactggaaaaggagcttctgctgtagggcttacggcagcagtgcacaaggaccctgtcactcgggaatggacccttgaaggaggagcactagttctggctgatagaggaatctgtttgattgacgagttcgacaagatgaatgatcaggatagagtgagcattcatgaagcaatggaacagcagagtataagcatatcgaaggctggcattgtcacatctctccaggcccgttgttctgttattgctgctgcaaatcctattggaggaagatatgattcctcgaagactttgacgcagaatgttgaattgacagatccaatcatttctcgctttgatgtactctgtgtggtcaaggatgtggttgatccagtcatagacgagatgcttgcaaaatttgtagttgatagtcatttcaggtcacaagcaaaaggtgctactttagatgagaaatcctttactgattcacgggatgatgcccgtgccgctatggccccaactgaccctgagataattcctcaagagttgctaaagaagtacataacttatgcaaagttgaatgtattcccgaaattgcatgatggggacttggacaagctcacacaggtctatgctgaattaaggagagaatcttcgcatggacaaggagttcccatagcagtaaggcacattgaatccatgataaggatgtctgaagcccatgcaagaatgcatcttagacaacatgttactcaagaagatgtggacatggcaattcgtgtcctcctagattcatttatatcaactcagaaattcggggtgcaaaaagctttgcaaaagagcttcaaaaagtacatgacatacaaaaaagatttcaatgctatcattcttcacctcctacgtgggcttgtaaacgacgcaatgcaatttgaggaaattgtttcgggttctactgccaatctagaccatatcgatatcaaagtggatgagctacaaagcaaggcacttgattatggcattactgatctcaaagcatttttcacaagcaatgacttttctaaagcaaactttgagttggatgaggaacgaggtataataaggcataaaagagcatcgtcttaaagcttgatgatggtggtatatgttgcagtgtttcaagatttgtattagacatgatctatctgtttttcagatttagtcatggctggttaatcctgtggtttaatttaattgtattctcgaattgtatacaaactaagctctgatatttaacttaattttccatacaacgcccaacccatggaagttagttgcagccttgtgggcagttgtctatacaagaatgtgttctttggtttcaattgtatcaagagaaatcaatttgatttggtaaaatgaagttctttttggcagtatgatagatcctttataatttctagttga

SEQ ID NO: 4443 - DNA, 3224 bp, Nicotiana tabacum
gaaagcgataaacagagagagaaaatggctggcgaagattctaacggcgatagtgctcgtcctccggcgggttctccgtcatcgtcagatcacagaaatggaaatccggtgtcaactcccgattctccgacgtccgtagattcaacactgatcagctccctttcaacactagccaaaattactccgaagaagatgaagcctctgtcgatcccgatatcattcgagacgagccagaagatatcgaagaggaagaagacggagaggaccttttcaacgataattacctcgaggattatcggaggatggaagagcatgatcagtatgaatcgttgggattggatgattcgatggaggatgaaagagatttggatcaaatcatggcggatcgtcgggctgctgaagtggaacttgacactagagatgtacaggtcacgaaccgcaagcttccccaacttcttcacgatcaagatactgatgatgacaactataggccatcgaaaaggactagagctgatttcaggcccaccaacacacaaagaaactttgatgatactgatgcaatgccgagttcaccaggagcatcacaacgagtaaattctagccaggatgtgccaatgactgatcaaactgatgatgatgcctatgaggatgatgaaaatgatgaaggagagtttgagatgtacagagttcagggaacacttagggagtgggtaactagagatgaagtccggcgtttcattgcaaagaagttcaaggaattcttactcacatatgtaaatccgaaaagtgagcatggggactttgaatatcttagacagattaatgagatggtatcagttaacaagtgtagccttgagattgattacaaacaattcatatatgtccatcccaatattgccatctggctggcagatgcacctcaatccgtccttgaagtgatggaagaaattgctaacaaagttgtctttgatcttcatcccaactacaagcaaattcatcaaaaagtctatgtcaggattaccaacttacctgtttatgatcagattcgcaatataaggcagatccatttgaatacaatgattcgtattggtggagttgtcacccgacgttctggtgtctttccccagctgcaacaagtgaaatatgattgcaacaagtgtggagcaattttgggtccttttttccagaactcatactcagaagtcaaggttggttcttgcccagagtgccaatccaaaggaccattcactgtcaatgttgagcagacaatatacaggaactaccagaaactgacactacaagaaagcccaggaattgttccagctggtcggcttcctagatacaaggaagtgatactgttgaatgatcttattgattgtgcccgaccaggagaagagatagaagtcacaggagtctacacaaataactttgacttgtccttgaataccaagaatgggtttcctgtctttgctactgtgattgaagcaaattatgtcacaaaaaagcaagacctcttttcagcttacaagctaactcaggaggacaaggaagaaattgaaaagctggcaaaagacccccgaattggagaacgaatatctaagtccattgctccatcaatctatggtcatgaagatataaagaccgccttagctcttgcgatgtttgggggccaagagaaaaatgttgaaggaaaacacagactgagaggagacataaatattctcctgctaggtgatccgggcactgcaaaatcacagttcctcaagtacgtagagaagacaggacagcgggctgtctatacaactggaaaaggagcttctgctgtagggcttacggcagcagtacacaaggaccctgtcactcgggaatggacccttgaaggaggagcactagttctggccgatagaggaatctgtttgattgacgagttcgataagatgaatgatcaggatagagtgagtattcatgaagcaatggaacagcagagtataagcatatcgaaggctggcattgtcacatctctccaggcccgctgttctgttattgctgctgcaaatcctattggaggaagatatgattcctcgaagactttgacgcaaaatgttgaattaacagatccaatcatttctcgctttgatgtactctgcgtggtcaaggatgtggttgatccagtcatagacgagatgcttgcaaaatttgtagttgatagtcatttcaggtcacaagcaaaaggtgctactttagatgagaaatcctttactgattcacgggatgatgcccgtggcgctatggcaccaactgaccctgagataattcctcaagagttgctaaagaagtacataacttatgcaaagttgaatgtattcccgaaattacatgatggggacttggacaagctcacacaggtttatgctgaattaaggagagaatcttcgcatggacaaggagttcccatagcagtgaggcacattgaatccatgataaggatgtctgaagcccatgcaagaatgcatcttagacaacatgttactcaagaagatgtggacatggcaattcgtgtcctcctagattcatttatatcaactcagaaattcggggtgcaaaaagctttgcaaaagagcttcaaaaagtacatgacatacaaaaaagatttcaatgctatcattcttcacctcctacgtgggcttgtaaacgactcaatgcagtttgaagaaattgtttcgggttctactgccaatctagaccatattgatatcaaagtggatgagcttcaaagcaaggcacttgattatggcattactgatctcaaagcatttttcacaagcaatgacttttctaaagcgaactttgagttggacaaggaacgaggtataataaggcataaaagggcatcgtcttaaagcttgatgatggtggtatatgttgcagtgtttcaagatttgtattagatacatgatatatctgtgtttcagatttagtcatggctggttaatcctgtggtttaatttaattgtattctcgaattgtatacaaactaagctctgatatttaacttaattttccatacaacgcccaacacatggaagttagttgcagccttgtgggcagttgtctacacaagaatgtgttctttggtttcaattgtatcaagagaaatcaatttgatttggtaaaatgaagttctttttggcagtatgacagttcctttataatttctagttgac

SEQ ID NO: 4444 - DNA, 3281 bp, Mimulus guttatus
tctctctctctctctcttcatcacacaaaccacaacacagtcctcgagatcaaggattccgtgagtgacaatggcgagggacgacgacgattcatccaggggcgacggtgatggcgtaaatccgaaccctccgtccactccagattctcccacgtcggtaggtttcaacaccgaccagcttccgctgaacaccagccagaattacaccgatgacgaagatgaagcctctgtagatcctgaaattataagagacgataatattgaagatgaagaagaagaagacggagaggacctcttcaacgacaatttcatggatgattatcggaggatgggtgagcaggaccagtacgaaagagtagggcttgacgattccgcagaggatgaaagagatttggatcagataatggccgaccgccgagccgccgaggttgaacttgatgcccgagaaggccgcgtttctcagcgcaagcttccccaacttcttcatgaccaagacactgatgacgataactacagaccgtcgaaaagaacgagagctgactttagaccaccaaacactccaagaagtacagatgatacagacggaattccgagttcgccaggtagatcacaacgcgggaactctagggatgatgtgcccatgactgatcaaacagatgacgacccttacgatgatgatgagaacgatgaaggtgagtttgagatgtacagggttcaaggtaccctaagagagtgggttactagagatgaagttaggcgtttcattggcaagaaattcaaggacttcttgctcacgtatgtgaatccgaagagtgagaatggagacttcgagtatttaaggcagatcagtgaaatggtttcagtcaacaagtgtagccttgagattgattacaaacagttcatctatatccatcccaacattgcaatctggcttgcagatgctcctcagtcagtccttgaggttatggaagatgtcgctaataagattgttttccagttgcatccgaattacaataaaatcagtcaaaaaatatatgtgcgcatcaccaacctcccagtgtatgatcagatacgcaacataaggcagatacatttgaacactatgattcgcattggtggagttgtgactcgtcgttctggagtttttccccagttgcagcaagttaaatatgactgtaacaaatgtggggcaattttagggccatttttccaaaattcatattcagaggtgaaggttggttcttgtccagagtgtcaatcaaaaggaccgtttactgttaacgttgaacagactgtgtataggaattaccaaaaattaactctccaagaaagccctggaattgttccggctggtcgacttccaagatacaaggaagtgatactgttgaatgatctcatcgattgtgcccgacctggagaagagattgaggtgactggcatatataccaacaatttcgacttgtcgttgaatacaaagaatggatttccagtattcgcgactgtgattgaagcgaattacgttactaagaagcaggatctcttttcagcctacaagcttacgcaagaggacaaggaagaaattgagaaattggctaaagacccaagaattggagaacgaattgtcaagtcaatagccccatcgatctacggtcatgaggacataaagactgcaatagctcttgctatgttcggtggccaagagaaaaatgtcgaagggaagcatcgtttacgaggggatataaatgtactcctgctcggtgatcctggaactgccaagtcccagttcctcaagtacgtggaaaagactggacaaagggctgtttacactacgggaaaaggagcttctgctgtaggactgacagcagcggttcacaaagatccagtcacaagggagtggactttagaaggaggggctcttgttttagccgatagaggcatatgtcttattgacgagttcgataaaatgaatgatcaggacagggtaagcattcacgaagcaatggagcagcagagtattagcatatctaaagctggcatagtcacatctctccaggctcggtgttctgttattgctgcagcaaatcctattgggggaagatatgattcctcaaagacattcttgcaaaacgtggaattgactgatccaattatttcccgttttgatattctctgtgttgtcaaggatgtggttgacccagtaattgatgagatgcttgcacaattcgtagttgatagtcactccaagtcacaggcgaaaggtggcaattttgatgatcggaatttgaacaactcacaggatgatggacaagcttcagctagacaaacagattcagagataattccccaacagctgctaaagaaatacctaacctttgcaaagcttaacgtattcccaaggttgcatgatgcagatttagacaagcttacgctagtctatgctgaattacgcaaagaatcatcacatggacaaggaattcctattgcagtgagacacatagaatcaatgatacgaatgtccgaagcccatgcaagaatgcaccttaggcaacatgttactcaagaggacgtagacatggctattcgggttctgctcgattcattcatctcaactcagaaatttggtgttcagaaagctttgcacaagagcttcaaaagatatatgatattcaaaaaggacttcaacgcgattgttctgcacttactgcgcggccttgtgaaggattctatgcactttgaagatattgtgtctggttctactgcaaatctttcttatgttgatgtaaaagtggaagaactgcaaagcaaggcacttgattacggaattagtgatctcaaagctttcttcaatagctcagagttttctagtgcccactttgagctggacgaggcaagaggtataataaggcatcgtcttgcccactgatatgcattttaaggactctgttactatgcggggattgtttgtacggtattatttgtaacgaaggtcttgtctaagtctaaatctaaatttagtgatgcttcatcttaaatcttgttatctttcacgtatatttattacgcgaggattgtttagtacgaaattatttacaaggaagatgtctacgaaatttaattaatgttcatcttatgtttgatgatgttacatttcgtgtatattaattaatactgaaaaattagcaatgactgctgctgctgctctctctcgacaagttattggttttcacttttagctttttaatgtaaaaggattttgaactaaaaaaagcatttgcttcaat

SEQ ID NO: 4445 - DNA, 2878 bp, Prunus persica
aagagaaacggacaagttcagagaagttgagaggacgaaagaaatttaatttcaagaaatggccggaaatgccgagaacccgccgtcaacgcccgactcgccgacgtcagtggggttcaacacggatcagctgccgcacacgagccgcacatccgagaacttctcatcatcgtccgacgacgacgaggccgccgtcgacccggaaatagtcagggatgagcccgaagaagacgtcctccttgaagaggaggagggagaggatctcttccacgacaatttcctggatgattatcggagaatggatgagcacgaccagtacgagtcgttggggcttgatgactcggttgaggacgagagggatttggatcagatcatggccgaccgcagagccgctgaaattgagctcgatacccgcgatggcgtacaaacaactcgcaagctccctcatcttctccatgaccaagatactgatgatgacagctacaggccttcaaagagggcgagggctgatttcaggcctccaagaagctacgacgataatgatggaatgcagagttcaccaggaagatcacagtgcggaaactccagagaggatgtcccaatgactgaccagactgatgatgatggctatgaggatgatgatgaccaagaagccgagtttgagatgtatcgtgttcagggaacactcagggagtgggttactagagatgaagtgcgaagatttatagccaagaagttcaaagaatttctgctcacctttgtgaagaagggttcttctgacattgaatatgtgcgcctcattaatgagatggtattagccaataagtgtagtctggagattgattacaagcaattcattggtactcatcccaatattgccatttggttggctgatgctccccagtctgtcctggaagtcatggaagatgttgccaagaatgtggtgtttagtttacatcccaattacaaacgtatccatcaaaagatctacgttaggataaccaacttacctgtttacgatcagattcgcaacattcggcagatccatttgaataccatgattcgtattggaggcgttgtgacccgacgctctggggtctttccccaattgcaacaagtaaagtacgattgcaataaatgtggggcaatcttggggccattctttcagaactcttattcagaagttaaagttggttcttgccctgaatgccaatcaaaagggccgttcagtgtcaatattgagcagaccatatacaggaactatcaaaagcttacactccaagagagcccaggaattgtgcctgcaggtcggcttccaagatacaaggaagtgatactgttgaatgatctaattgattgtgctcgtccaggggaagagattgaggtcactggcatttattcaaataattttgacttatctttgaatacaaagaacgggtttcctgtatttgccactgtggttgaagcaaattatatcacaaagaagcaagacctcttttctgcttacaaacttacccaggaagataaagatgagatcgaaaagttgtctaaagacccaagaataggagaaaggattgtcaagtccattgcaccatcaatctatggccacgaggacataaagactgcaatagctcttgccatgtttggaggccaagagaaaaatgttgagggaaaacatcgactccgaggggatataaatgtacttctcctaggtgatcctggcacggcaaaatcacagtttcttaagtatgttgaaaagactgggcagagagctgtgtatactactggtaaaggagcatctgctgtgggactcacagctgctgtgcacaaggatcctgttacaagggagtggacccttgaaggaggagctcttgttcttgctgacaagggaatatgccttattgatgaatttgacaaaatgaatgatcaggatagggtgagtattcatgaagcaatggagcaacagagtattagcatatcaaaagctgggattgtcacttctctccaagcacgctgctcggtcattgcagctgcaaaccctgttggtggaagatatgattcctctaagacattttcacaaaatgtcgagttaacagatcccatcgtctctcgttttgacatcctctgtgttgttaaggatgtggttgaccccgtcactgatgaaatgcttgcaaagtttgttgttgatagccatttcaagtcgcaagctaagggagctaacatggataatatgcccttaagcaattccgaagaagatacctccgacagcccagtggatccagagatactttctcaagatatgctaaagaaatacttaacttatgccaagttaaatgtattcccaaggttgcatgacgctgatctggaaaagctcacacttgtttatgctgaattgcggagagaatcttcacatggacaaggagtacccatagctgtaaggcacatagaatcaatgattcgaatgtctgaagcacatgcaagaatgcaccttagacagcatgtaatacaagaagatgtggatatggcaattcgtgtgttactagattcgtttatctctacccaaaaatttggagtgcagaaagctcttcaaaagagcttcagaaagtacatgactttcaagaaggattacaacaatgtgctcctccatttactccgtcagcttgtgaaggacgcaattcactttgaagaaattgtttctggctctagttcagcgctcacccatattgatgtcagagttggagatttgcagagaatggcacaggagcatgagatctttgatctaaaacccttctttacgagtgcccttttttcatcagccggctttgtgttggatgaacagcagggattgattaggcatcaccttccaagataatgcaac

SEQ ID NO: 4446 - DNA, 3277 bp, Cannabis sativa
aaaagttagttgggcaaacacactcaacacaagggtttttccatttcactcaaaatgtctggtaatcccccctccacgcccgattctcccacctccgtcggcttcaacaccgatcaacttcctcacaccagtcggacctccgagaatttctccgacgacgaagaggctgcagtcgatcccgaaatcatccgcgatgaccccgaagagctccctaatgaggaggaagaggaggaaggcgaggatctctttcacgacaatttcatggaggactaccgccgaatggacgaaaacgataattatgagtctgtcggtctggatgattcccttgaggatgagagggatcttgatcagatcatggctgaccgtaaggctgccgaatcagagcttgatgctcgtgatgttcgtttgacctctcgcaagcttcctcaccttcttcatgatcaagacaccgatgatgatagctatagaccttccaagagggctagggctgacttcaggcctccatctgatgctgacgggttacagagttcaccaggaagatcgcaaagagctcattccagggaagatttgccaactactgatcaaactgatgatgacccctttgaggatgatgatgatgaagatggcgagtttgagatgtatcgtgtgcaaggaactctcagagagtgggtaactagggatgaagttcgccgttttatagccaaaaagttcaaggagtttctgctcacttatgtgaatccgaaaaatgaaagtactgattatgaatacgtccggttgattaatgagatggtctcagctaataagtgcagtctagagattgattacaagcaatttatctatatccatcccaatattgccatctggctggctgatgcccctcaatctgtcctggaagtcatggaggatgttgcaaaaaatgttgtctttagtttacatcctaactataaaaatatccatcaaaagatttacgtacggatcaccaacctaccagtgtatgatcagattcggaacataagacagattcatttgaatacaatgatccgtattgggggagttgtgacccgtcgatctggggtctttccccaattgcaacaggtcaagtatgattgcaacaagtgtggtactattttggggccattctttcagaattcatattctgaggtgaaggttggttcttgtcctgaatgccaatcaaaagggccattcaccatcaatattgagcagactatatatagaaattaccaaaagcttactcttcaagaaagcccaggaatcgtaccagcaggccgtcttcctagatacaaagaagttatactgctgaacgatttaattgattgtgctcgccctggagaagagattgaagttacgggcatttatacaaataatttcgatttgtctttgaacacaaagaatggattcccagtatttgctaccgtggtggaagccaactatgtgacaaagaaacaagacctcttttctgcctataaacttacccaagaagacaagaaagagatcgagaagctggctaaagaccccagaataggagaaaggattgttaagtcgattgccccatcaatctatggacatgaggacataaaaactgcattagccctggctatgtttgggggtcaagagaagaatgtagaagggaagcacagactacgaggagatattaatgtgcttctcctaggtgatcctggaacagccaaatcacaatttctcaagtatgtggaaaagactggacagagggctgtgtatactactggtaagggagcttctgcagtggggcttacagcagcagtgcacaaggacccagtcacaagggagtggactcttgagggaggggcccttgttcttgctgacagaggattatgtcttattgatgagtttgacaagatgaatgatcaggacagggtgagtattcacgaagctatggagcagcagagcattagtatttccaaggctgggattgtcacttcactccaagcacgctgctctgtcattgctgctgccaatcctgttggaggaagatatgattcctcaaaaacattttcacaaaatgttgaattgacagatcccatcatctctaggtttgatatcctctgtgttgtcaaggatgttgttgatccaatcgctgatgaaatgctggctaagtttgtagttgacagtcatttcaaatcacaagccaagggagctcatatcgaagataagactttcagtgaatcacaagatgatgtccaaatgtcaggcgaaccagcagacccagagatactttctcaagacatgcttaaaaagtacataacttatgccaagttgaatgtgttcccgaggttgcatgatgctgatatggagaaacttactcatgtttatgctgaattgcggagagaatcctcaaatggacaaggagtgccaatagcagtgaggcacattgagtcaatgattcggatgtctgaagcacacgcaagaatgcacctgagacagcatgtgactgaagaagatgtggacatgtcaattcgtgttctgcttgattcatttatctcaacccaaaaattcggtgtgcagaaggctctacgaaagagcttcagaaagtatatgactttcaagaaggatttcaatgagttcctcctgtatcttctccgcgagcttgtgaagaatgcgctgcattttgaagaaatcgtgtctggaactacttcaggactgacccaaattgatgtgaaagtagaggatttgcaaatcaaggcacaagaacatgagatctatgatctaaaaccattctttactagcacacacttttctcgagctaattttgttttggatgaacaacgtggagtaataacacatcgtctatgagaagatgcttcattcaatttgaaccatgggacaaacatacccaactcttatttcgtcactttttatttttttgctgttaacttgctcaatgttcttataaatcattatttactagagaaaattactatatatttatttattgttattgtcattggcaatctatttgcaaatgtaacaccatgtttttttttttgtacgactaagtatttccatagtacccatgttagatgggcatcgttagctgctatgcttaatttgttattgtagtatctgataatattggttgaaacttaggcagttgatttcttaaagtgttaataactgcaagtttaaatctaagaggagttctaaaaaaaattctgtagtgcattttctatgatcaatctagctcatgacagttcaatcagattgttttattaggaacaag

SEQ ID NO: 4447 - DNA, 3165 bp, Capsicum annuum
ctacaaatcactactcccagtaaagcaacaaaaccgagaaagcaaaaatggccggtgatgattccaacggcgacagtcctcgccgccgtccggcgaattctccgtcatcctccgatcacgtaaacggtaatccaccgtctactcctgattctccgacttcggtaggattcaacaccgatcagcttccgtacaacactagccaaaattactcggaagaagatgaagcttctgtagatcgtgatattattcgagatgatccagatgatgctgatgtggaagaggaagaagatggagaggaccttttcaatgacaattatctcgatgactatcgggtgatgggtgaggctgatcagtatgagtcattcggattggatgattcgatggtggatgaaagagatctggatcaaattatggcagatcgtcaggctgctgaagtggaacttgacaatagagataatgtacacgtctctaaccgcaagcttcctgaacttcttcaagatcaagatactgatgacgacaactacaggccatcaaaaaggactagagctgatttcagaaggaattttgatgataccgatgggatgccgagttcaccaggtgcatcacagcgagtaaattctagccaggatgtgccaatgactgatcaaactgatgatgatccttatgaggatgatgaaaacgatgaaggggagtttgagatgtacagggttcagggaacacttagggaatgggtaactagggatgaagtacggcgtttcattgcgaagaagttcaaggaattcttgctcacatatgtaaatccaaaaagtgaacacggggactttgaatatcttcgacagattaatgagatggtatcagttaataaatgtagccttgagattgattacaaacaattcatatatgtccatcccaacattgccatctggctggcagatgcaccgcaatctgtccttgaggtgatggaagaagttgccaacaaagttgtctttgatcttcatcccaactataagcaaattcatcagaaagtctatgtcaggattaccaacttaccagtttatgatcagattcgcaatataaggcagatccatttgaacaccatgattcgtattggtggagttgtcaccaggcgttctggtgtctttccccaattgcaacaagtgaaatatgattgtaacaaatgtggagcaatattgggtccttttttccagaactcatactcagaagtcaaggttggttcttgcccagagtgtcaatcgaaaggaccattcagtgtcaatgttgagcagacaatatacaggaactatcagaaactgactctgcaagaaagcccaggaattgtgccagctggtcggcttcctagatacaaggaagtgatactgttgaatgatcttattgactgtgcccgaccaggagaagagatagaagtaacaggagtctacacaaacaactttgatttgtccctgaataccaagaatgggtttcctgtcttttctaccgtgattgaagcaaattatgttacaaaaaagcaagacctcttttcagcttacaagttaactcaggaggacaaagaagaaattgagaagctggccaaagaccctcggatagctgaacgaatattcaagtcaattgccccatcaatttatggtcatgaagacataaagactgccatagctcttgcaatgtttgggggccaagagaaaaatgttgaaggaaaacacagactgagaggagacataaatattctcctgctaggtgatccaggcactgcaaaatcacagttcctcaagtacgtcgagaagacaggacaacgagctgtctatacaactggaaaaggagcttctgctgtggggcttacagcagcagtacacaaggaccctgtcactcgggaatggaccctcgaaggtggagcactagttttggctgatagaggaatatgtttgatcgatgagtttgataagatgaatgatcaggatagagtgagtattcatgaagcaatggaacagcagagtattagcatatcgaaggctggcattgtcacatctctccaggcccgctgttctgttattgctgctgcaaatcctatcggaggaagatatgattcctcgaagaatttcacgcaaaatgtggaattgactgatccaatcatttctcgatttgatgtactctgtgtggtcaaggatgtggttgatccagtaactgatgagatgcttgcaaagttcgttgttgatagtcatttcaggtcacaagcaaaaggtgctactatagatgagaagtcctttaccgattcacgggatgatgaccgttccgctgctgctgcaaccgatcctgagataattcctcaagatttgctaaagaagtacttaacttatgcaaagttgaatgtattccctaaattacatgatgcggatttggacaagctcacacaggtttatgctgaattaaggagagaatcatcgcatggacaaggaattcccatagcagtgaggcacatcgaatcgatgataaggatgtctgaagcccatgcaaggatgcatcttagacaacatgttactcaagaagatgtggatatggcaattcgtgtccttctggattcatttatatcgactcagaaatttggggtgcaaaaagcattgcaaaagagcttcaagaagtatatgatatacaaaaaagatttcaatgctatcattcttcacctcctacgtgggcttgtaaaagatgcgttgcagtttgagaaaattatttcgggtgctactgccaacctaaactatatcgaagtcaaagttgatgagctacaaagcaaggcacttgattatggcatgactgatctcagagcatttttcacgagcaacgaatttgctagtgctaactttgagttggatgaggtacgcagtgtaataaggcatcgccttgcacctgaaatgactgcagaagtctgatgtcttaacatggttatcggatgagcgcctaacatatggaaatcagttataacctctgtaggcttccacaaagaatgtgttctttgatttctgttgtaatcagagagttcaatttgatttcttgaaactaagttatttagaccgaaagaaagatcctttatagtttctatttaagcacttggtcacaatgacatcttaaattttgaaatgaatgtgtattatattccct

SEQ ID NO: 4448 - DNA, 2579 bp, Cichorium intybus
gggtaacctaaattccagtcaatttaatgggaatccaccgtctacaccagattctcctacctctgctggattcaacacagatcagcttcccttcaatagccgtacctcggagaattactctgactatgacgacgacgaggctgccgttgatccaaatattatcagggatgaacttgaagaaggagacgaggatgaaggggaaggcgaagatcttttcaatgacaattacatagaggattaccggaggatggatgagcatgatcaatacgaatcggctgggctggacgattcccacgaggacgagagagatttggatcagatcatggcagatcgtagggctgcagagatagagcttgatactagggatggtgttgcgtcaaggagaaaggtcccccatcttctccatgaccaagatactgatgatgatagctaccgaccttcaaaaagaactagagctcctcctggtccacgaggtggtgatgacaccgatgcaatgcaaagttctcctggtaggccacaaagggataactcggatgtacacatgactgatgcaacagatgatgatcagtacgaggatgatgataatgatgaaggtgagtttgagatgtaccgtgttcaaggaaccctaagagaatgggttactagagatgaagttcgtcgctttattgccaagaaattcaaggatttccttatcacttatgagaacccaaaaagtcaaaatgctgaatttccatatctcatacagataaacgagatggtctcagccaacaaatgcagtctggagattgattacaaacagtttatctatgtccacccaaatatcgccatctggttggcagatgcacctcagtctgttcttgaagtcatggaggaagtagctaataaagttgtgttcaatatacattcaaactacaaaaacatccaccaaaaaatctatgtcagagtcaccaacctacctgtttatgatcaaattcgaaacataaggcaaatccatttgaacacaatgatccgtataggaggagttgtgacccgaagatctggagtttttcctcaattgcagcaagtgaaatatgattgtaataaatgtggagcagttttagggccttttatccaaaattcatattcagaagtcagagttggttcatgtccagagtgccaatcaagaggaccattcactgtcaatattgagcagactatatacagaaattatcagaagcttacccttcaagaaagtcctggcattgttccagctggcagattgccaagacacaaggaagtcatacttttgaatgatctcattgattgtgcccgccctggagaagagattgaggtcacaggcatctacacaaacaactttgatctatctttaaatacaaaaaatgggtttcctgtatttgctacgataattgaagcaaaccatgttacaaagaaacaagacctgttttcagcctataaacttaccgatgaggacaagaaagaaattgagaagctgtctaaagatccaagaattggagaaaggatagtcaagtcaattgctccatcaatctatggacatgaagacataaagactgcaatagctcttgcaatgtttggaggtcaagagaaaaatgttgaagggaaacatagactgcgtggtgacataaatgttttgcttttaggtgatcctggaactgcaaaatcccagtttttaaaatacgttgaaaaaaccggacagagggcagtttacacaaccggaaaaggagcttcagctgtgggacttacagcagcagtccacaaggatccggtgactagggagtggacacttgaaggtggtgcccttgttcttgctgacaagggtatatgtctcatagatgaatttgacaaaatgaatgatcaagatagagtgagtattcatgaagctatggaacaacaaagcataagcatatcaaaagctggaatagtaacttcccttcaagctcgttgctctgtcattgctgctgctaacccaataggcggaagatacgattcctccaaaaacttttcacaaaatgttgaattaacagatccaattgtttcaagattcgatgttctctgtgttgtgaaggatgtggtggaccctgtgatggatgagatgcttgcacagtttgtggttgatagtcacttcaaatcccaaccaaaaggtgccaacttggatgacaaatccatgaacaattctcaggaagacattcaagcttctgccatgatgatggatcctgagatacttcctcaagatatgctaaagaagtacataacatatgcaaaactacacgtattcccaagattgcatgatgctgatttggacaaactgacacaagtttatgccgagttacgaagagaatcatcgcatggacaaggggtgccaatagcagtgaggcacatagagtcaatgataagaatgtcagaagctcatgcgagaatgcatttgaggcagcatgtgactcaggaagatgttgacatggccatccgtgttttgctggactcttttatttccacgcagaaatttggcgtgcagaaggctttacagaagagctttaaaaagtatatgacgttcaagagggatt

SEQ ID NO: 4449 - DNA, 676 bp, Ambrosia trifida
ccacccacaagcctataaatacaaccactaaatcagacgatcctcattgttaccaacaatatgcagactctgcaacagaaggctactgaatggagtggtgttaagcaggaagatgcttttgctattgatgaggttaatctgtttgagaaattaggacttcaagcttttattaatctgtctactgatttctacacaagggtttatgatgatcaagaagagtggtttaggtctatttttgccgattcgaagaaggaagatgcaattcagaaccaatatgagttttttgtgcaaagaatgggagggcctcctttgtactctcaaaggaaaggtcaccctgctctgataggccgccaccgcccgtttcctgtgactcataaggcggcagagaggtggctgcaccacatgcaacaagcattagataacgccgctgacattgatcatgaatcaaaaaccagaatgctaaatttcttcaggcatactgcatactttttggtggctggcaatgatctaaaaaatgaaagccaaggacctccaccttgtaagcatggagatagcaaaccagttgcagattaattttttttgggttagaaaagagcggtttagacagatttgttacccaaaaagggacataaatgtcatgtacctttgattaaaatagatttgaatgataattgat

SEQ ID NO: 4450 - DNA, 922 bp, Echinacea purpurea
ggttcgaaccaatcttggaaaaacagagagaatacaataaagattagccgttcaaaaaatacaataaagattagcttagcagcccacagattcttcaaatttataaaaccccatttctgtgtgttggtcgttggggatttatacacattaaaaacgtgccctccacgcgccgcccacaacccttataaattcaaccaccaatcctcattgcactcggagcaattttgaccggcgatatgcagacactgcaacagaaagcttctgaatggagcggcgttaagcaggaagacgcgttcgctattgacgaggttaatctcttccagaagcttgggcttcaaactttcatcaatctttccactgatttctacacgagggtttatgaagatgaagaagagtggtttaggtctatttttgcggattcgaagaaggaagatgcaattcagaatcaatatgagttttttgtgcaaagaatgggagggcctcctttgtactctcaaagaaaaggtcaccctgctctgataggccgccaccgcccatttccggtgactcataaggcggcagagaggtggctacaccacatgcaacaagcattagataacaccactgacatagatcatgattcaaaaaccagaatgcttaatttcttcaggcatactgcatactttttggtggctggaaatgatctgaaaaatgaaagcaaaggagctccaccttgtaagcatggagaaaacaaaccagctgcagattaattgttttcttaggttctggaaaaaagggattaatacaagatttttacccaaaagagacataaatgtcatgtacctttgatcaaaatagatttgaatgatacttgttcattttttgtgatacttttacctaaattatttattaacatggatattagatttgaatgatacttgtt

SEQ ID NO: 4451 - DNA, 626 bp, Flaveria ramosissima
cgcaatcggtgcaatttcgacaatatgcagactctgcaacagaaggcttcagaatggagtggggttaagcaggaagatgcctttgcgattgatgaggttaatctttttgaaaagttagggcttcagacgttcatcgatctttccactgatttctacacgagggtttatgatgatcaagaagagtggtttaggtctatttttgcagattcgaagaaggaagatgcaattcagaatcaatatgagttctttgtgcaaagaatgggagggcctcctttgtactcacaaagaaaaggtcaccctgctctaataggccgccaccgcccatttccggtgactcataaggcggcagagaggtggctgcaccacatgcaacaagcattggataacaccactgacattgatcatgattcaaaaaccagaatgctaaatttcttcaggcatactgcatactttttggtggctggaaatgatcttaaaaatgaaagccaaggaactccaccttctaagcagggagataacaaaccagctgcagtttaattctttttatctttttcagaaaagaaattattgaaacataattgttaccaaaaagaggacaaatgtcatgtactttcaattaaaataga

SEQ ID NO: 4452 - DNA, 661 bp, Flaveria ramosissima
ataaataccaccaacatccacacgatctgcaccgcaatcggtgcaatttcgacaatatgcagactctgcaacagaaggcttcagaatggagtggggttaagcaggaagacgcctttgcgattgatgaggttaatctttatgagaagttagggcttcagacgttcatcgatctttccactgatttctacacgagggtttatgatgatcaagaagagtggtttaggtctatttttgcggattcgaagaaggaagatgctattcagaatcaatatgaattttttgtgcaaagaatgggagggcctcctttgtactctcaaagaaaaggtcaccctgctctaataggccgccaccgcccatttccggtgactcataaggcggcagagaggtggctgcaccacatgcaacaagcattggataacaccactgacattgatcatgattcaaaaaccagaatgctaaatttcttcaggcatactgcatactttttggtggctggaaatgatcttaaaaatgaaagccaaggaactccaccttctaagcagggagataacaaaccagctgcagtttaattcttttttatctttttcagaaaagaaattattgaaacataattgttaccaaaaagaggacaaatgtcatgtactttcaattaaaatagatc

SEQ ID NO: 4453 - DNA, 883 bp, Cirsium arvense
gccatggattcatgaaacccccatttctgtgtgtaatagttgggctccatttataaatttccaagaaaaagcgttctccccacgcgacgcccacgagcctataaatacaatcacccattcacaccaatcttcattgcaattcgacgatatgcagaccctgcaacagaaagcttcagaatggagtggcgttgaccagcaagatgcattcgccattgacgagattaatcttttcgagaagctagggcttcagactttcatcgatctctctaccgatttctacacaagggtttacgacgatgaagaagagtggtttaggtcaatttttgccaactcaaagaaggaagatgcaattcagaatcaatacgagtttttcgtgcaaagaatgggaggccctcctctctactctcaaaggaaaggccaccctgctctgattggccgccaccgcccatttccggtgactcataaagcggcagagaggtggctacaccacatgcaacaagcattagataacaccacagagattgatcaagactcaaaaacaagaatgctgaatttcttcaggcatactgcttactttttggtggctggaaatgatttgaagaaccaaagccaaggagctcctccaccttgtaagcatggagccaacaaaccagctgcagtttgaatctattttttcttatagaacaatttgatatgaacaaattcgttactggaaacaactgtttttactctttgggttaaaggtcaggtctctatacatccctccttatagagtgatgggatatattgtgatagattggtttggttttagattttacaacttggaaaacggatgtcatgtaacttaagtaaagcagattttaattgataaatgttctttttt

SEQ ID NO: 4454 - DNA, 772 bp, Carthamus tinctorius
cgctaggcggggacatcttccttgcagacatgcagaccctgcagcaaaaggcctcagagtggagtggcgttgaccagaaagatgccttcgccattgacgacattaatcttttccaaaagctaggccttcaaaccttcatcgatctctccaccgatttctacaccagggtttatgacgacgaagaagagtggtttaggtctatttttgccaactcgaagaaggaagatgcaattcaaaatcaatacgagtttttcgtgcaaagaatgggaggcccccctctctactctcaaaggaaaggccaccctgctctgattggccgccaccgcccatttccggtgactcataaggcagcagagagatggctacaccacatgcaacaagcattagataacaccacagacattgatcaagactctaaaacaagaatgctaaatttcttcaggcatacagcatactttttggtggctggaaatgatttgaagaatcaaagtgaaggaactccaccttgtaagcatggagctaacaaaccagctgcagtttgaatctattttttatttagaacaaaatgtgatcagatttgttattgaaacaactgttttactctttgggtagggtagaggtcaggtcaggtttgcatacattccaccttatagagtgatggggtatactgggataggttggtttggttttagatttgttacttgggaaagggacatggatgtcatgtaacttaaataaaatagattttaaatgataaatgttcttgcgtttc

SEQ ID NO: 4455 - DNA, 916 bp, Cichorium intybus
ataaacatatgtaattcattgaataaacgattaaccaataaagaaccagcagcccgcagattcgtgaaacccattcctgtgtgtaggtcgttggggacatcggctccattaattgcgtttcccccacgcgacgcccacgagcctataaaaacaatcagccattcataagatcctcattgtacccactgagttgagacttaaagccacgatatgcagactctgcaacagaaggcttcagagtggagtggcgttgaccaggaagatgccttcgccattgacgaggttaatctttatgagaagctagggcttcagaccttcatcaatctctccactgatttctacacacgggtctatgatgatgaagaagagtggtttaggtctattttcactaactcaaaaaaggaagatgcaattcagaatcaatacgagttttttgtgcaaagaatgggagggcctcccatgtactctcaaagaaaaggccaccctgctctgataggtcggcaccgcccatttccggtaactcatagggcggcagagaggtggctacaccacatgcaacaagcattagataacaccacagatattgatcatgattcaaaaaccagaatgctaaatttcttcagacatactgcatattttttggtggctggaaatgatctgaaaaatcaaagccaaggagctccaccttgtaaacatggaaccaacaaaccagctgcagaataattctattcttttctttgtttagaaaaatgtgatataaagaaatttggaactagaaaatgaacatagatgtcatgtaatgtcacttcaaataaattagtttttaatgataaatgttgttcgatatacttgtggttttcttcatactttgaaaagagggggtttgcttaataacactgcatgcttgttatgtctg

SEQ ID NO: 4456 - DNA, 776 bp, Cichorium intybus
cgggggtccactgagttgagacttaagctacgatatgcagactctgcaacagaaggcttcagagtggagtggcgttgaccaggaagatgccttcgccattgacgaggttaatctttatgagaagctagggcttcagaccttcatcaatctctccactgatttctacacacgggtctatgatgatgaagaagagtggtttaggtctattttcactaactcgaaaaaagaagatgcaattcagaatcaatacgagttttttgtgcaaagaatgggagggcctcccatgtactctcaaagaaaaggccaccctgctctgatagggcggcaccgcccatttccggtaactcatagggcggcagagaggtggctacaccacatgcaacaagcattagataacaccacagatattgatcttgactcaaaaaccagaatgctaaatttcttcagacatactgcatattttttggtggctggaaatgatctgaaaaatcaaagccaaggagctccaccttgtaaacatggaaccaacaaaccagctgcaggataattgtattcttttctttgtttagaaaaatgtgatataaagaaatttggaactagaaaatgaacatagatgtcatgtaatgtcacttcaaataaattagtttttaatgataaatgttgttcgatatgcttgtggttttcttcatactttgaaaagagggggtttgcttaataacactgcatgcttgttatgtctgtaaaatcttttaagtttatacatcgttgttggattt

SEQ ID NO: 4457 - DNA, 518 bp, Flaveria ramosissima
ccgcaatcggtgcaatttcgacaatatgcagactctgtaacagaaggcttcagaatggagtggagttaagcaggaagacgcctttgcaattgatgaggttaatcttttccagaagttagggcttcagacgttcatcgatctttcaaccgatttctacacgagggtttatgatgatcaagaagagtggtttaggtctatttttgccgattcgaagaaggaagatgcaattcagaatcaatatgagttttttgtgcaaagaatgggagggcctcctttgtactctcaaaggaaaggtcatcctgctctgataggccgccaccgcccatttccggtgactcataaggcagcagagaggtggctgcaccacatgcagcaagcattggataacaccactgacattgatcatgattcaaaaaccagaatgctaaatttcttcaggcatactgcatactttttggtggctggaaatgatctgaaaaatgaaagccaagaactccaccttctaagcatggagataa

SEQ ID NO: 4458 - DNA, 987 bp, Lactuca sativa
attcataataaacaaattgagatatgtttcatgcttgtatagttgataaaaagtgtattatattttgataaaaacacgtaatttcatcgcataaataaatgattgaccaataaagaagaagcagcccacagattcttcaaaaccccatttactgtgtgtagttcgttggagacatcggctccataatctcgcgtttccccaacgcgacgcacacgagcctataagaacaatcaatctcccattcataacatcctcaattcttcattgcacgcattgagttgagacttgggagcatcgatatgcagagtctgcaacagaaagcttcagagtggagtggcgttgaccaggaagatgccttctccattgacgaggttaatctttttgagaagctagggcttcagactttcatcaatctctccactgatttctacacaagggtttatgatgatgaagaagagtggtttaggtctattttcgctgactcaaaaaaggaagatgccattcagaatcaatacgagttttttgtgcaaagaatgggaggacctcctctgtactctcaaaggaaaggccaccctgctctgatagggaggcaccgcccatttccggtgactcataaggcggcagagaggtggctacaccacatgcaacaagcattagataacactacagacattgatcatgattcaaaaaccagaatgctaaatttcttcaggcatactgcatattttttggtggctggtaatgatctgaaaagtcaaagccaaggagctccaccttgtaagaatggaaccaacaaacaagctgcagaataattttattcttttttttctgaaaaatgtgatataaagaaatttgttactggaaaagagacatagatgtcatttaacttcaaataaattagttttttaatgataaatgttcttcaatacacaatatgcttatggttttattcatgcttccaaaagagggggctgcatgtttgtgctt

SEQ ID NO: 4459 - DNA, 2490 bp, Centaurea maculosa
tcctcattcccccaatttaaaccctcaatctcaatctacccacatccaatttaccaccatcaatcatgcaaacatcttcaatctcgctaaacccttcaatttcacttccaacttcaacttcatcttcatcaacttccattgttactacttcaagaatttcatgtttctatgcgtttaaaccaaaacccatctgttttactccctcaaagactcgattatttcgttacgaacgaagagcacgaaccccaattgtggtttcttcaggtgaacaagtgaaaattgaggaattgagtagagatgatgataaagatgaagatgaagagggtcctccttctcaggttgaatctgaggttactactaaacctaggcgtattgcgctattcgtcgagccatctccctttgcgtatgtttccgggtacaagaatcggtttcagaacttcattaaatacctgcgcgagatgggggatgaggtgatggtcgtaactactcatgaaggggtgcctcaagaatttcacggagcaaaattggttggctcacgaagcttcccttgcccatggtaccaaaatgtgccactttctcttgcattgagccctagaatcatcaatgaggtgaaacaatttaagcccgacatcatccacgtaacatctccgggtattatggttttcggcgcacttgctattgccaaaatgttgtgcgttccgattgtcatgtcctatcatacacatgtcccggtttacataccaagatacacgtttagctggctcgtcacacctatgtggttagttttaaagtttcttcacagggcagctgatctgacgttggtgccatcggctgctattgcaaaggatctacgacaagcaagagtgacagccgctaacaaaatccgtctatggaataagggagtcgactcggatagtttcaatcccgtcttccgttctcaagaaatgcgagttagactaaccaacggtgaacctgatcggccgttggttgtacacgttgggcgtcttggtgtcgagaagagcttagatttccttaaaggtgtcatggaaaagatcccagaggcacggatcgctttcatcggagacggtccacatcgggaggatttggagaagttattcgtaggcatgccggccgtattcacgggtatgttacaaggcgaggagctatctcaagcatacgctagcggtgacgtattcgtgatgccgtcggaatctgaaaccctcggctttgttgtccttgaagccatgtcatccgggctgcctgtggttgctgcccgagctggcggcatacccgacatcattcctgaagaacaagagggcaaaaccgggtacctttacactcccggagacctcgatgattgtttaaacaaattggtaccactcttgcacgatgccaagttacgggagagtatagggcaggctgcccgggtggaggtggagaagttcgattggcgggcagccacgaagatgattcggaaccaacagtataacgcggccatatggttttggaggaagaaacgagctcagctactgaaaccggtgcaatgggtggcaaaaaccttttcccgtttcaacgacaacggaaattaaccaccggcgggttgtgatcggtgacggaaatgtcgttagttgtgattgactgtatagaatttgtacgatatggactcttttacgtatttcataggttacaatatgaagtagaaatgaaattctgatttcaaaaaagaacatttatcatttcaaatctattttatttaagttacatgacatccatgtccctttcccaagtaacaaatctaaaaccaaaccaacctatcccagtataccccatcgctctataaggtgggatgtatgctgacctgacctctaccccaaagagtaaaacagttgtttcaataacaaatctgttcacattaaattgttctagagaaaaaatagattcaaactgcagctggtttgttagctccatgcttacaaggtggagctccttcactttgattcttcaaatcatttccagccaccaaaaagaatgcagtatgcctgaagaaatttagcattcttgtttttgagtcttgatcaatgtctgtggtgttatctaatgcttgttgcatgtggtgtagccacctctctgccgctttatgagtcaccggaaatgggcggtggcggccaatcagagctgggtggcctttcctttgagagtagagaggagggcctcccattctttgcacgaaaaactcgtattgattttgaattgcatcttcctttgttgagttggcaaaaatagacctaaaccactcttcttcgtcatcataaaccctagtgtaaaaatcggtggaaagatcgatgaaagtttgaaggcctagcttctggaaaaggttaatttcgtcaatggcgaatgcatctttctggtcaacgccactccactctgaagctttctgctgaagggtctgcatatcgatggaagtgctgaatgaagatggtccccgccaag

SEQ ID NO: 4460 - DNA, 731 bp, Cirsium arvense
cgatatgcagacccttcagcaaaaggcctccgagtggagtggcgttgaccagaaagatgctttcgccattgacgacattaatctcttccaaaagcttggccttcaaaccttcatcgatctttccaccgatttttacactagggtttatgacgacgaagaagagtggtttaggtccatttttgccaactcgacgaaggaagatgcaattcaaaatcaatatgagtttttcgtacagagaatgggagggcctcctctctactctcaaaggaaaggtcacccggctctgattggccgccatcgcccatttccggtgactcataaagcggcagagaggtggctacatcacatgcaacaagcattagataacaccacagacattgatcaagactcaaaaacaagaatgctaaatttcttcaggcatactgcatactttttggtggctggaaatgatttgaagaatcaaagtgaaggagctccaccttgtaagcatgcagctaacaaaccagctgcagtttgaatctattttttcttagaacaatttaatgtgaacagatttgttattgaaacaactgttttactctttgggtagaggtcaggtcaggtctgcatacatcccaccttatagagtgaaggggtatactgggataggttggtttggttttagattgttacttgggaaagggacatggatgtcatgtaacttaaataaatagatttaaattgataaatag

SEQ ID NO: 4461 - DNA, 785 bp, Artemisia annua
cggggaagtcacaaccctataaatacaaaaacacacacactcaaaacacacatacattcatttcaaatcaaaacataatgcaaactctacaagaaaaagcttcagaatggagtggcgttgaccatgaagatgcatttgctattgaccaaaccaatctttatcagaaactaggccttcaaacgttcattaatctgtcaactgatttctatacaagggtttatgaagatgaagaagagtggtttaggtctatttttgcagactcgaaaaaagaagatgcaattcagaatcagtacgagttttttgtgcaaagaatgggaggtcctcccttgttctctcaaagaagaggtcaccctgctctgattggtcgccaccgcccgttcgatgtaactcataaagctgcagagaggtggctacaccacatgcaacaagcgttagataacgccacagacattgatcaagactcaaaaaccagaatgctaaatttcttcaggcatactgcatattttttggtggctggaaacgatttgaaaaatcaaagccaaggagctccaccttgtaagcatgcagctaacaaaacagctccagaataattatattttttagacagaattctttactcaaaaaggaacaaagatgtaatgtaacttcgattaaactagactttgttatgaaagctatcccatttacatgtgttctgctttatggattgtacggctgtattacacttacatttgtaactttgatcaagatctcaaggattgagatcgagttatgcaacgaaatag

SEQ ID NO: 4462 - DNA, 774 bp, Chrysanthemum coronarium
gcatcataacattcatttccaaatcaaaatacagtagtatatagaataatgcaaactctacaagaaaaagctgcagaatggagtggcgttgaccatgaagatgcatttgctattgaccaaaccaatctttaccaaaaacttggccttcaaaccttcattaatctctctactgatttctacacaagggtttatgaagatgaagaagagtggtttaggtcaatttttgcagactcgaaaaaagaagatgcaattcagaatcagtacgagttttttgtgcaacgaatgggaggtcctcctctcttttctcagagaagaggccaccctgctctgattggtcgccaccgcccgtttgaagtaactcataaagccgcagagaggtggctacaccacatgcaacaagcgttagataacgccacagacattgatcaagactcaaaaaccagaatgctaaatttcttcaggcatactgcatattttttggtggctggaaacgatttgaaaaatcaaagccaaggagctccaccttgtaagcatgcagctaacaaagcagctccagaataactatattttttagacagaattctttactcaaaaaggaacaaagatgtaatgtaacttcgattaaactagactttgttatgaaagctattccctttacatgtgttctgctttatggattgtacggctgtattacacttacatttgtaactttgatcaagatcattaaggattgagatcgagtaacgcaacgaaatagcttgaacacaagactgc

SEQ ID NO: 4463 - DNA, 512 bp, Flaveria ramosissima
accgcaatcggtgcaatttcgacaatatgcagactctacaacagaaggcttctgaatggagtggcgttaagcaggaagacgcctttgcgattgatgaggttaatctttatgagaagttagggcttcagacgttcatcgatctttccaccgatttctacacgagggtttatgatgatcaagaagagtggtttaggtctatttttgcggattcgaagaaggaagatgctattcagaatcaatatgagttttttgtgcaaagaatgggagggcctcctttgtactctcaaagaaaaggtcaccctgctctaataggccgccaccgcccatttccggtgactcataaggcggcagagaggtggctacagcacatgcagcaagcgttggataacaccactgacattgatcatgattcaaaaaccagaatgctgaattttcttcaggcatactgcattacttttggtggctggaaatgatctagaaaatgaaagccaaggaactccaccttctaagca

SEQ ID NO: 4464 - DNA, 700 bp, Cirsium arvense
gagtggagtggcgttgaccagaaagatgccttcgccattgacgacattaatctcttccaaaagcttggccttcaaaccttcatcgatctttccaccgatttttacaccagggtttatgacgacgaagaagagtggtttaggtctatttttgccaactcgacaaaggaagatgcaattcaaaatcaatacgagtttttcgtgcaaagaatgggaggccctcctctctactctcaaaggaaaggccacccagctttgattggccgccaccgcccatttccggtgactcataaagcggcagagaggtggctacaccacatgcaacaagcattagataacaccacagacattgatcaagactcaaaaacaagaatgctaaatttcttcaggcatactgcatactttttggtggctggaaatgatttgaagaatcaaagtgaaggagctccaccttgtaagcatggagctaacaaaccagctgcagtttgaacctatttttctttaaaacaatttaatgtgaacagatttgttattgaaacaactgttttactctttgggtagacgtcaggtcaggtctgcatacatcccaccttatagagtgatggggtatactgggataggttggtttggttttagatttgttacttgggtaagggacatggatgtcatgtaacttaaataaaatagattttaattgataaat

SEQ ID NO: 4465 - DNA, 781 bp, Taraxacum officinale
ttgttttgtggtagagagttgagatctaggtggcagttagtggcaccaccacttacggtggtagcggtgagtcggtgaccactcctttagcgtaataacaatcagcttgctattcataatatcatcgcacccagtgagttgagactctagactctcgacatcgtcgatatgcagactctgcaacagaaagcttcggagtggagtggagttgaccgggaagatgccttcgccattgacgaggttaatctttttgagaagctagggcttcagactttcatcaatctctccaccgatttctacacaagggtttatgatgatgaagaagagtggtttacgtctatttttgcaaactcaaaaaaggaagatgcaattcaaaatcaatacgagttttttgtgcaaagaatgggagggcctcctatgtaccctcaaagaaaaggccaccctgctttgatagggcggcaccgcccatttccggtgactcatagggcggcagagaggtggctacaccacatgcaacaagcattagataacactacagacattgatactgactcaaaaaccagaatgctaaatttctttaggcatactgcatattttttggtagctggaaatgatttgaaaggtcaaagccaagaagccaataaaccaactgctgaataattctattcttttgtttagaaatttgtgatataaagaaattcgtgatactggataagggacatagatgtcaataatttgacttaaattagtcttttgttataatatacttgtggtttacttc

SEQ ID NO: 4466 - DNA, 848 bp, Daucus carota
aaaaactggccctcaaagatcctctcgttctttctctctatatatttacgcacaccctttacaacacacgagcataattcttgagttcaattcgctgttattgtaaaaaagagtaagagggtgttggttataagcactaaagatgcaatctttgcagcagaaagcatctggatggagtggggtggcaacagaagatgcattcgggattgatgaaaccaatctttttcagaaacttggtctccaacccttcatcaatctgtccactgatttctacaccagggtttatgatgatgaagaagaatggtttagatcaatttttgccaattcgaagaaagaagatgctatacagaatcaatatgaattctttgtgcaaagaatgggagggcctcctctgtattctcagagaaaaggccatcccgcactaatagggcgtcatcgaccattccccgtcactcatcgagctgctgagaggtggttacatcacatgcagcaagcattagacaacagcacagacattgatgctcagtcaaaaattaaaatgatgaacttttttaggcacactgccttttttctggtggctggagatgagttgaaaaattcaaatcatggagtatcccctaagccaggagctagcaaaccagcagcagcgtaaacaacttgactttctatcttggggttccttcatgaacatgattatatgtatacttcattctatcttacaaaatcacattggtttaagatgaacttcccatcattcaagcttactgaaattaagcttaaagattagattttatatattctacgagtgacaaagtttagatttatcaatgaaaaaagttattagtcac

SEQ ID NO: 4467 - DNA, 706 bp, Petroselinum crispum
gagtggggatgcaatctttacagcaaaaggcgtcagaatggagtggagtagcgacagaagatgcatttgggattgatgcaaccaatctttttcaaaaactgggtctccaacctttcatcaatctctccactcatttctacaccagggtttatgacgatgaagaagaatggtttcgatcaatttttgccaattcgaagaaagaagatgctattcagaatcagtatgaattctttgtgcaaagaatgggagggcctcctctatattctcagagaaaaggacatcctgcactaataggacggcatcgaccattccctgtcactcatcgagctgcagagaggtggttatatcacatgcagcaagcattagacaacagcacggacattgatgctgaatcaaaagtcaaaatgatgaacttttttaggcacactgcattttttctggttgctggagatgagctgaagaatccatatcatggagtatcccctaagcctggagctagcaaaccagcgacagcgtaaacaattcaaatatctcttttggggtaccttaataaactgataaacatgatcaaaagtatactttattgaagcttacagagttgtggtatcaaatgaatttgaactttttcgaccttattgaaattaaagcgtcaaatactagatttgaatttatacaaagtttagagtttttaattggtcgaaggaaa

SEQ ID NO: 4468 - DNA, 737 bp, Bupleurum chinense
aaaaaaggggtagccactagtgaaggatgcaatcgctgcagcagaaagcctcagaatggagtggtgtgagtagagaagatgcattcgcaattgatgaaaccaatctttttgagaagattgggctccaacctttttatcaatctctccactgatttctataccagggtctatgatgacgaagaagaatggtttcgatcaatttttgctaattcaaagaaagaagatgctatccaaaatcaatatgaattctttgtgcaaagaatgggagggcctcctctgtattctcagagaaaaggtcaccctgcactgataggacggcatcgaccattccccgtgactcatcgagctgcagaaaggtggttacatcacatgtatcaagcattgaacaacagcacagacattgatgctccatcaaaaattaaaatgatgaatttctttaggcatacggcattctttctggttgctggagacgagttaaagaatccaaaccaaggcgtgtctcctaagccaggatccaacagaccagcagaagtgtagactcaaccttatttatgacttctggttgtttcataaacattattatatgcataatttattgaagcatacacacttatttacattttcccaacctatgttgaaacttgaaagtagtgaaatagttcacttttattgtggttaagataataaatactacatgcatcagttatagtagtacttggtatgaattcagcataaaa

SEQ ID NO: 4469 - DNA, 735 bp, Cynara scolymus
gatgcatttcgatatgcagaccctgcacagaaggcgtcgagtggagtcgcgttgaccagcaagatgccttcgccattgacgagatcaatcttttcgacaagctagggcttcagactttcatcgatctctccaccgatttctatacaagggtttatgacgatgaagaagagtggtttaggtctatttttgccaactcgaagaaggaagatgcaattcagaatccatacgagtttttcgtgcaaagaatgggagggcctcctctctactctcacaggaaaggccatcctgctctgattggccgccaccgcccgtttccggtgactcatgaagcggccgagaggtggctactccacatccaacaagcactagataacaccacagacattgatcaagactcgaagacaagaatgctaaatttcttcaggcatactgcatactttttggtggctggaaatgatttgaagaaccaaagccaaggagctccaccttgtaagcatggagccaacaaaccagcagcagtctgaatctaattttttctttaaaacaatttgatagaaaaggatttgttaccggacaaaactgttctactctttgggatagatatcaagtctgcattcatcccaccttagtgagtgaggggaatactccggtggttttagattcgttacctggcaaagcgacatggatgtcatgtaacttgagtaaagtagattttaatttataaatgttcttgcc

SEQ ID NO: 4470 - DNA, 740 bp, Vitis vinifera
gtagactgtggccaacgagatttaaaatgcagagcctacaggagaaggcctcggagtggagcggagtctcccaaaacgacgcctttgaaatcgacaacaccaatctctttcagaaattgggccttcagaccttcatcaacctctccaccaatttctacaccagggtttatgacgatgaagaggaatggtttcgtttgatttttgctaattctaagaaagaagaagcaattcagaatcaatatgagttctttgtacagcgaatgggagggccccctttatattcccaaaggaaaggccatccagcgctgattggacgtcatcggccattccccgtcacccaccaagctgcggagaggtggttgcatcacatgcaacaagcactggatagtgtcacagaaattgatgcagattcaaaaaccaaaatgatgaattttttcaggcacactgctttcttccttgtggctggagatgagttgaagaatcgtaaccaaggagttccctgtaagcatggagccagcaaaccagctgcagtatgacataatttcttgcttccatttttagaagaacacatttaagattttaccatttaaaaactactttgatcttattattataaatgtgaaaaagggataaaattttcacagccttcatatcaagaacaatcttgaaaagtgaatgtttacatccatatccagattgattcacaatatctaattatagatctgggttctcgagattat

SEQ ID NO: 4471 - DNA, 1218 bp, Panax ginseng
tccgaatttcaacattctgctaatatagcaacgtaaggctcaatttggcaaattcccatgtccctctcttgtccccactccgcacaaatcttcgtcccttctacgcgaccaccacaagccctccatcagctccctatagagagagcgtgtatagctgacagttggtagagatagaaaaaaatgcaatcgctgcagcagaaagcttcggaatggagtggggtagctactgatgatgcgttcgcaattgataaaactaatttatttcagaagctcggtctccaagcattcatcaatctctccaccaatttctatacaagggtttatgatgacgatgaagaatggttcaggtcaattttcgccaattcaaagaaagaagatgcaattcagaatcagtatgagttctttgtgcaaagaatgggaggacctcctctgtattctcagagaaaaggccatcctgcgctgattggacgacaccggccatttcctgtcactcatcgagctgcagagaggtggttacatcacatgcaacaagcattagatgacggtacggatattgatgccgactcaaaaactaaaatgatgcatttttttaggcacactgcatattttttggttgctggagatgagttgaagaatccaaaccaaggagtgccccctaagcctggagccagctaaccagaagcagtgtaaacctgcaacagaagtttttaattttagttcttcccgcaagaacatgatgaaatatataacttattaatctctcagatgtaaaatacataatttttcatcaagtttatttgaaattaagcttggagttagatttttattttgctactgctgacaaattccagaattactgatatatccgagaatacagaacagtgatagccattccaaaatcaagttgcagttttcaagttctgatctgtgtatagatccttgcgaatagccggttcgttaacaaaccggtccgtgctaaatgtaatatttttatagctaaatgtgtgattaatgagagaaattaggtgaaaggtgtgatgaaaatgatcattatccgtgattatacgtgatcacagtattagttttctggttcttgtatttgctatgaccgtgcagtgcatagaaataatgatactgtaagatatttaaagaacaaaaaacacatgtagttcaccctttgatttaagttattataagatgttgcaaaaaaaaaaaaac

SEQ ID NO: 4472 - DNA, 607 bp, Tabernaemontana elegans
gtgagcaagagtgagagaatgcagtcattgcagcagaaggcgtcagaatggagtggggtgagcaatgatgatgcgtttgctattgatgatgagaacctttatgagaagctgggccttcagaccttcatcaatctgtctactaatttctataccagggtttatgatgatgaggaagaatggtttcgatcaatttttgcaaattcaaagaaagaagatgcaattcaaaatcaatacgagttttttgtgcaaagaatgggtgggcctcctctctactctcggagaaagggccatcctgctctcattggacgccacagaccttttcctgttacccaccgagctgcagagaggtggttacatcacatgcagcaagcattagacagcagtacggatatcgacttggcttctaaaactaaaatgatgaattttttcaagcacacagcattctttcttgtggctggagacgagttgaagaatcaaaaccaaggagttccatgtaagcatgcagctagcaaaccagccacatagcttcctaacaaaattgcctttctacttgatgtggaaagacagcagtagaattgcagatatagatgaaaactccaggctaaac

SEQ ID NO: 4473 - DNA, 678 bp, Chelidonium majus
gagaggcacgaaaaatgcagtctttacaggagaaggcttcggaatggagtggagtcaaatccagtgatgcattcgctattgatgaaactaatctctttcaaaaattagggcttcaaactttcattaatctctccactaatttctatacaagggtttatgatgatgaagaagagtggtttcgttcaatttttgcggattcgaagaaagaagatgctattcagaaccaatacgaattttttgtgcaaagaatgggaggacctcctctgtattctcagaggaaaggccatccagcactgattggaaggcacaggccattccctgtcacacatcaagcagcagagaggtggttacatcacatgcaattagcagtggacagtgtcccagaaattgattcagattcaaaaatcaagatgatgaatttctttaggcacactgcatttttcctagtggcaggagatgagctgaagaatcaaaaccaacaaggaccaccctgtaagcatgcggcaaccaaacctaccgcagtgtaatatttttactaaccacatagtgatatcattctaattaaggacacaaacaaaagatgagaaaactcataatttatccaacaattgtgtgtaaaaggaagtttctgtttctttctctatgaaataaatatcagaaacccaaatattttacatc

SEQ ID NO: 4474 - DNA, 966 bp, Helianthus annuus
cggcgggggctgaatctccgatcatcaaattcttcatctttctcagcatccgatcatggccaagattagggcttttttcatcctcgctcttcttcttctctcttcttctttcttccttcaagttgctaggtctcagtctgatccagactcagaagcggatgccgaacttgtggcggaaactgtcgaggaaggaagtcatgttggtgacgatgttgaggatatcggtattgggaattataatccggctcctggtgtggaaaccgtggcggttttccctaaaaactttgcgaaattggtagtagcagggcaagaaactgaacttttgattggattgaaaaacgaaggagaacaaaacgttaaggtttttgctgttcacgctagtattcatcttcctttcgatcatcggatgttggttcaaaacctctctacagtggctttcaacgatgcatcggtccctgcttcagttcaagctacattcccctatacatttgctgtcagcaaattcttgcagcctggaacatttgatcttgttgggacaatagtgtacgagatcgaccaattaccataccagaacgtattctataatggcaccattgaagttactgaagccggtggtcttgttagcgttgagaccgtgttcttggtgtcacttggacttgctcttcttgtgctgttcggcttgtgggtccgcactcagctacagtctctttccaagaaaactaagaagataaccaaggtggaagttggaacccgaactgttgatgcatcaatggacgagtggctgcagggaactgcttatactcaatcacaatcgaacaaactgaagaagaagaagtagaggagtagttttcgatgttgagcaaaggtagtcagtcggttgtagagcgaccaacattctcgttttctgttgagttttaactagcaattacaggcatttgttttctttttagtagtgtttatatacct

SEQ ID NO: 4475 - DNA, 880 bp, Helianthus annuus
ttcatttcgatcatcaaattcttcatctttctcaagcatccgatcatggccaagattagggttttttccatcctcgctcttcttcttcttctctcttcttctttcttccttcaagttgctaggtctcagtctgatccagactcagaagcggatgccgaacttgtggcggaaactgtcgaggaaggaagtcatgttggtgacgatgttgaggatatcggtgttgggaattataaaccggctcctggtgtggaaacggtgtcggttttccctaaaaactttgcgaaattggtagtagcagggcaagaaactgaacttttgattggattgaaaaacgaaggagaacaaaacgttaaggtttttgctgttcacgctagtattcatcttcctttcgatcatcggatgttggttcaaaacctatctacagtggctttcaacgatgcatcggtccctgcttcagttcaagctacatttccctatacatttgctgtcagcaaattcttgcagcctggaacatttgatcttgttgggacaatagtgtacgagatcgaccaactaccataccagaacgtattctataatggcaccattgaagttaccgaagccggtggtcttgttagcgttgagaccgtgttcttggtgtcacttggacttgctcttcttgtgctcttcggcttgtgggtccgcactcagctacagtctctttccaagaaaacgaagaagataactaaggtggaagttggaactcgaactgtcgatgcatcaatggatgagtggctgcagggaactgcttatactcaatcacaatcgaacaaactgaagaagaagaagtagaggagtagttttcgatgttgagcaaaggtagtcagtcggttgtagagcg

SEQ ID NO: 4476 - DNA, 900 bp, Helianthus annuus
tccttcaagttgctaggtctcagtctgatccagacgcagaagcggatgccgaacttgtggcggaaactgtcgaggaaggcagtcatgttggtgacgatgttgaggatatcggtattgggaattataaaccggctcctggtgtggaaacggtgtcggttttccctaaaaactttgcgaaattggtagtagcagggcaagaaactgaacttttgattggattgaaaaacgaaggagaacaaaacgttaaggtttttgctgttcacgctagtattcatcttcctttcgatcatcggatgttggttcaaaacctctctacagtggctttcaacgatgcatcggtccctgcttcagttcaagctacatttccctatacatttgctgtcagcaaattcttgcagcctggaacatttgatcttgttgggacaatagtgtacgagatcgaccaactaccataccagaacgtattctataatggcaccattgaggttaccgaagctggtggtcttgttagtgttgagaccgtgttcttggtgtcacttggacttgctcttcttgtgctgttcggcttgtgggtccgcactcagctacagtctctttccaagaaaactaagaagataaccaaggtggaagttggaacccgaactgttgatgcatcaatggacgagtggctgcagggaactgcttatactcaatcacagtcgaacaaactgaagaagaagaagtagatgagtagttttcgatgttgagcaaaggtagtcagtcggttgtagagcgagcaacattctcgttttctgttgagttttaactagcaattacaggcatttgttttctttttagtagtgttttataccttcaatttagttttggtcaaattttctaacgactttcctaactacgttt

SEQ ID NO: 4477 - DNA, 1228 bp, Lactuca sativa
attaatttacatgttattttgtaattttcttcatttccgtttacatccaaaggtccaaactttcacgcttatataaacatcaggagctcgatatcatcgttgttgaatctcttgccatttccgattgtcaaattcgatatctttctcaagcattcgatcatgacaaagattagggtttctttcatcctcgctctaattcttcttctctcctcttctttcttcattcaagttgctaggtcacagtctgattcagactccgactccgattccaatgctgatcttgttgccgaaactgttgcggaaggagcagttagtgatgaaacccaggactttggtgttgggaattttagtccatcacctgatgttgaaacagtctgtgttttccctaaaaactctgccaaattggtagtagcagggcaagaaaccgaacttttgattggaatgaaaaacgagggggaacaaaatgtcaaggtccttgcagtttattctagtgtccatcttccttttgatcataaaatgttggtccaaaatcttactacacagactttcaacaatgcatctgttccttcttcagttcaagctacctttccctatatgtttgcagtcagcaagttcttacagcctggaacatttgatcttgttgggacaatagtgtatgagataggtgaagtcccataccagaatacattctataatggcaccattgaagtaactgaagctggaggccttgttagtgttgagacagtgtttctagtttctcttggatttgctcttcttgtcctccttggcttatgggttcgtggtcagctacaaaatctttccaagaaaactaagagggtgaaggtggaagttggaacaaagactgttgatgcatccatggatgagtggctgcagggaactgcttatactcagtcacagtctttcaaattgaaaaagaagaagtagagaggagaggggtattacgggaatagaaagaattttgtaattcgtgttgagcaaatgttaatgtactcttttgtagaatgagcacggagtctcgttttcttggagttttagctagcaatacctgacatttgttaatttttagaatattttatataattgcagttttacttttgccaaattttaatgtggtttctttgtgttcattaatcacttctaccgatgagattttatattttttcagattagagattgtttctcttatatagtggatgttctatggggg

SEQ ID NO: 4478 - DNA, 857 bp, Flaveria ramosissima
catcacccattcatccaacaccacaactataaaaagtcaagatctacaaactcaaaataccaattcaaaccaaaccaaaatgtctttagtgacagaagaaatcaaagcaagtgcatcagaagtttaccatggggatgcaatctgtcaagaaaagtctaagtttttgctgacagaaatgggactacccaatggccttttgcctttggaggacattgaggagtgtggatatgtcaaagacactggctttgtgtggcttaaacaaaagaaatcaaaggtgcataagtttgaaaagattgggaaactcgtgtcatatgcgactgaggtaaccgcggtcatagagaagttcaagatcaagaaactcactggtgttaaaagtaaggagcttttgatgtggatcacactgagtgagatcagtgttgatgatccacccaccggaaagatcacttttacggccacttctggcctttataggacctttccggtgtcggcttttcaaattgaggatgttaagaaagatgttggaggtgaggaggtgaagaaagatgttgcacaagttgatgtggctaaggaggcacaagttaaggaggtttgagttagtgttttgcatcaagttatgaagtttttatttcatatataccaatgaagtaatgtttgttgatgcttttcgctttatgttgtaccttcttatcaataactaaagatcatccgcatcaagactttcggttttaatagaatcatctacttttgttgtactttctttctacgatgtattcgtatattataatcgaagtgaatcatgtttaaattatcaatttgatttgtatattatgcgatcaaaatcatgaaaacgtttaata

SEQ ID NO: 4479 - DNA, 792 bp, Flaveria ramosissima
aactccacaactataaaagtcaagatctatagactcaaaatctcaattcaaaccaaaccaaaatgtctttagtgacagaagaaatcaaagcaagtgcatcagaagtttaccatggggatgcaatctgtcaagaaaagtctaagtttttgctgacagaaatgggactacccaatggccttttgcctttggaggacattgaggaatgtgggtatgtcaaagacactggctttgtgtggcttaaacaaaagaaatcaaaggtgcataagtttgaaaagattggaaaacttgtgtcatatgcgactgaggtaaccgcggtcatagagaagttcaagatcaagaaactcactggtgttaaaagtaaggagcttttgatgtggatcacactgagtgagatcagtgttgatgatccacccaccggaaagatcacttttacggccacttctggcctttataggacctttccggtgtcggcttttcaaattgaggatgttaagaaagatgttggaggtgaggaggtgaagaaggatgttgcacaagtggatgtggctaaggaggcacaagttaaggaggtttgagtgagtgttttgcatcaagttatgaagtttttatttcatatataccaatgaagtaatgtttgttgatgcttttcgctttatgttttcttatcaataactaaagaccatctgcttcaagactttcggttttaatagaatcatctacttttgttgtactttctttctacgatgtattcgtatattataatcgaagtgaatcatgtttaaagtaaatatt

SEQ ID NO: 4480 - DNA, 2668 bp, Helianthus annuus
atacatacatatttcaacctccactataaccgcaacgaaacgatcggtgctaccgtacagggtgtggcacaacacgtatacgaaagcagaattgcttctgtatgtcagtagattgtacgcactgcaactactactattacggtggatttactgagcttgctaaccccttacaatggcctcagcttcgaaaacgacgtcgcattcctccgatcatcattctcttccaattgcctccgcctccgccgacgtcatcgtcgtcgacgattggagtaacgacgatcgaccgcttccgatcaacagtcccgtaatcaactcttctgatccttcgtctactgcttccactaaaggaatccaagtcctcacaagggctcaaagcagtcatcctttggatccattatctgccgctgaaatcaaagtagccgttgcaactgtcagggccgctggagcaacccctgaggtcagagatggcatgcgatttgtggaggtggttctatcagaaccagataaaagcgttgtggcgcttgcagatgcgtacttctttccaccgttccaatcatcattgttacccagaagcaaaggaggagctgtaatacctactaaacttcctccaaggagagctcggcttgttgtttataataaaaaatcaaatgagacaagcgtatggatcgttgaattatctgaggtacatgcagcaactcgcggtgggcatcacagaggaaaagtcatttcatcacaagtaatcccagatgtacagcctcccatggatgctgtggaatatgctgaatgtgaagctgttgtgaaagattatcctccctttcgggaggctatgaagaagaggggtatcgatgatatggatctagtgatggttgatgcttggtgtgtgggatatcacagcaaggctgatgctcctagccgcagactagcaaaaccacttatattttgtaggacggaaagtgatagtccgatggaaaatggatatgcacgtccagttgaaggaatatatgttctcgttgatatgcaaaatatggcagtgcttgaatttgaagaccgtaagcttgttccccttccaccagctgatccgttaagaaactacactcctggtcatacacgaggcggcgttgaccgcagtgatgtaaaacctctacatattcttcagcctgatggaccaagcttccgtgttaatgggcactatgtagagtggcaaaagtggaactttcgcatcggtttcactccgagggagggtttggtaatacattcggttgcatatgttgatggtaatagaggtagacgaccgatagctcatagattgagctttgtggagatggttgtgccttatggtgatccaaatgatccgcattacagaaagaatgcatttgatgctggtgaagatggccttggaaagaatgctcactctcttaaaaagggatgtgattgcttaggatatatcaagtactttgatgcacattttaccaacttcattggaggtgttgaaacaattgaaaattgtgtatgtatgcatgaagaggaccatggaatcttatggaagcaccaagattggagaactggcttagctgaagttcgacgatcccgacgacttacagtttcttttatatgcaccgttgcaaactatgaatatggcttctattggcatttttatcaggatggaaagattgaagctgaagttaaactcactggaattctaagcttgggagcattgcagccaggagaagttagaaaatacggcactacaattgcaccaggactgtatgcaccggttcatcaacatttttttgtttctcgaatggatatggcggttgattgtaagcccggagaagcatacaatcaggttgttgaagttgatgttaaagtcgaggaacctggaaacaacaatgttcataataatgcattctacacacaagaaacattgcttaaatctgaatctcaagcaatgcgggattgtaatccgttatctgctcgtcattggattgttagaaacacgagaaccgtgaatcgaacggggcaattgacggggtacaagctggtacctggttcaaactgcttgcctttagcaggttcagaagccaagtttttgagacgggccgcttttctaaaacataatctgtgggttacaccatatgcagctggtgaggaatttcccggaggagagtttccgaaccaaaacccacgggttggtgaaggtctggcctcatgggtccagaaaaaccgatctcttgaagaaactgatatcgtcctctggtatgtgtttgggatcactcatgttcctaggttggaagactggcctgtaatgccagtggagcggattgggtttatgcttcagccacatgggttctttaattgctctccggctgtcgatgttcctcctggagcttgtgagtcagatgtgaaagatacgaaggcggtttcaaatgggttactagctaagctttgatttgatcttaatttggtgtatgaatgtgaactagtacaacctttcgttgggtttatatacttttttgttgaatttgtgtttaagtttatacctcaagtttgcacacgtatatgtttgtatggtatacaacagtggtgatgtcttgtaaaacatgttgacgtgggcaatgctgccattcagctgggtcataaagtaataaaactaagacgtgattatagc

SEQ ID NO: 4481 - DNA, 2563 bp, Lactuca sativa
atcaaaaagaattcaatactcaactccaacaccctcttaacccctcttgtcacgtgagatcagcagtcttcatctgctacttctccaccttcatatatatctccccttctccgtaaattctgttttagattcataaaaaaccacaagccctacttccctcttcttctcatcctcctcctgctgtgatatctcattatccacagattcctacactgtaatcgaaatccattgatccagttgaagaggctaacgtcaggggagatagagtgagtgggatcattattatacacagagagaattgcttctgtatgtcagtagattgtacacactgcaattactacggtggatttggtgagcttgctaaccccctacaatggcctcaacttcgcaaaaggcgtcgcattctaccgatgattcacttccgatccaccgtcaggcggtttccgctgacgtcgttgttgtcgaaaactggcacaacaacgatcagaagacgccgatcaagaatacatcaatcgctaccttgatcaatactaccgatccttccgcttcctctaaaggaatccaaatcctcacacgggctcaaacaagccatccattggacccattatctgctgctgaaatcaaagtagcagtagcaactgtcagggcagctggagcgacacctgaggtcagagatggtatgcggtttgtggaggtggttctatcagaaccagataaaagtgttgttgcacttgcagatgcatatttctttccacctttccaaccttctctactacccagaagcaaaggtggtgctgtaatacctagtaagcttcccccaaggagagctagacttgttgtctacaataaaaaatcaaacgaaacaagcatatggattgttgaattatccgaagtacatgcaacaactcgtggtggacatcatagagggaaagtcgtttcttcaagaacaattcaagatgttcagcctcccatggatgctgttgaatatgctgaatgtgaagctgttgtgaaagagtactttccctttcaagaagctatgaagaagaggggtattgaagatatggatcttgtgatggttgatgcttggtgtgttggttatcatagtgaagcagatgctcctagcagaagattagcaaaaccacttatcttctgtaggactgaaagtgatagcccaatggaaaacggatacgcccgacccgttgaaggaatttatattcttgttgacatgcaaaacatggttgtcattgactttgaagaccgaaaacttgtcccattgccacctgctgatcctttaagaaactacactcctgctcatacacgaggtggcgttgaccgaagcgatgtaaagcccttacaaattcttcagcccgatgggcccagcttccgtgttaatggccaatatgttgagtggcaaaagtggaactttcgtattgggtttactccaagggagggattagtgatacactcggttgcatatgttgatggaagcagaggtagaagaccaattgctcatagattgagctttgttgaaatggttgttccttatggtgatccaaacgatccacattacagaaagaacgcgtttgatgcaggtgaagatggtcttggaaaaaatgctcattctcttaaaaagggatgtgattgcctaggttatatcaagtactttgatgcacattttacaaacttcactggaggtgttgaaacaattgaaaattgtgtatgtatgcatgaagaggatcatggaatcctgtggaagcatcaagactggagaactggcttagcggaagtacgaagatctcggcgtcttacagtgtcatttatatgtactgttgccaattacgaatacggtttctattggcacttttaccaggatggaaagattgaagctgaagttaaacttacagggattttgagtttaggagcattgcagcctggggaagttagaaaatatgggacaacaattgcaccagggttgtatgcgccagttcatcaacacttttttgttgctcgtatggatatggctgttgattgcaagcctggagaagcatataaccaggttgttgaagttaatgtgaaagttgaagaatctgggaaagataacgtccataataatgcattctacaccgaagaaactttacttaaaactgaaaatgaagctatgcgtgattgcaatcagttatctgctcgtcattggattattagaaacactcggactgtgaataggacggggcagctgacagggtataagctggtaccaggttcaaattgcttgccattagcaggttcagaggctaagtttttgagaagggctgaatttcttaaacataatctttgggttacaccgtatgcacttgatgagaattttcctggaggagagtttcctaatcagaatccacgtgttggtgaaggcttagcctcatgggtcaagcaaaatcgttctcttgaggaaactgatatcgtactttggtatgtatttgggatcactcatgttcctaggttagaagactggcctgttatgccagtggaacacattggttttatgcttcaggtaatcatctactta

SEQ ID NO: 4482 - DNA, 2667 bp, Chrysanthemum coronarium
ccagaacctatacatacacatctcctatatctatacaaactctaacaacttttccatttactactataaatataaatataaatacgatcaggtggtggttcgttgttacataatcacaaagtgacatcatcgatcagaagctgtatgtcagctgattgttgttgttcacactcttgtaattgtggtggtgagcttgctaatcccaaacaatggcctcagcttcgaaaacgacgtcgcattccactaatgcatcagacctcgtcgttgttgtcgatgatcggaaccccgtagccgttaccaattctgctgttgttgctgatccttctgctaatgctaattccacaaaaggaatccaagttctcacaagggctcaatcaagtcatcccttggatccattatctgctgctgaaatcaaggttgctgtggcaactgtcagggcagctggagcaacaccggaggtaagagacggtatgcggtttgtggaggtggttctatcagaaccagataaaaatgtcgtggcgcttgcagacgcgtacttcttccctccatttcaaccatcgttgctaccgagaagcaaaggaggagctctgattcctatcaaacttcctgcaaggagagctcgtctcgttgtttataataagaagtcaaatgagacgagcgtatggattgtcgaactatctgaggtacatgcagcaactcgaggtgggcatcatagaggaaaagtcatttcttcaagagttgtcccagatgtgcagcctcccatggatgctgtggaatacgctgaatgtgaagctgtcgtgaaagatcatcctccctttatagaggctatgaagaagaggggtatagaagatatggaccttgtgatggttgatgcttggtgtgtcggatatcacagtgatgctgatgctcctagccgcagattagcgaaaccacttatattttgtaggacagaaagtgacagtccaatggaaaatggatatgcacgcccagttgaagggatatatgttcttgttgatatgcaaaatatggtagttcttgaatttgaagatcgtaagcttgttcccttaccaccggctgatccgttgagaaattacactcctggtcatacacgaggtggtgttgaccgcagtgatgtgaaggctttacagatccttcagcctgatggaccaagctttcgtgtgaacgggaactatgtggagtggcaaaagtggaacttccgtattggtttcactccaagggaaggattggtaattcattcaattgcatatgttgatggtagtcgaggtagaagacccatagctcatagattgagcttcgtagagatggttgtgccgtatggtgatccaaatgagccacattacagaaagaatgcgtttgatgctggggaagatggccttggaaaaaatgctcattctctaaagaagggatgtgactgtttgggttatatcaagtactttgatgcgcattttaccaacttcattggtggagttgaaacaattgaaaattgtgtatgtatgcacgaagaagaccatggaatgctctggaagcatcaagactggagaacaggcttagcagaagttcgaagatcccgacgactcacagtttcttttgtatgtactgttgcaaactatgagtatggtttctattggcacttttatcaggacggtaagattgaagctgaagttaaactcactggaattttgagcttaggagccttgcagccaggtgaagttcgaaaatatggcacaaccatcgcaccaggactgtatgcacctgttcatcaacatttctttgttgctcgaatggacatggcggttgattgtaagcctggagaagcacacaaccaggttgtggaagttaatgttgaagttgaggaaccaggaaaggataatgttcacaataatgctttttacactcaggagacattgcttaaatctgaatctcaagcaatgagagattgtaatcagttatctgctcgtcattggattgttcaaaacacgaggaatgtgaataggacagggcaactgacaggctacaagctggtacctggttcgaactgcttgcctttggctggttcagaagccaagtttttgagaagagctgcctttctgaagcataatttgtgggtcacacagtatgcatctggtgaggattttcctggaggagagttccctaaccaaaatccacgtgtcggtgaaggtttggcatcatgggtccaacaaaatcgatctcttgaggaaactgatatagtcctctggtatgtatttgggatcactcatgttcctaggttagaagactggcctgtgatgccagtggagcggattgggtttatgcttcagccacatgggttctttaattcctctcctgctgtagacgttccccctggagcttgtgaatcggatgcgaaagattgccatgttaaagacaaagacacaattgttcccaagtcagtttcgaatgggttgatggccaagctttgatcacttaccttccaaccctttatctcgtgtcttgatttcaagttaaactatgtaaagagagactgaatgttatgaaactggtgaaaccttgtgttttggtgtatgaatcttggccaatgtaatcctctagggtttctatactttctgttgaacttctgttttcagttactaagaacatggatttttt

SEQ ID NO: 4483 - DNA, 2687 bp, Helianthus annuus
ggcgggggtaatctaaatctgttttagattcagaacaaaccagaacccctatttatttccaccaccacctatacatacagattcctatctctatactaacctaacctaaccggtgatagtgcagggagcgtggtggtactgcacttatacggagacagaattgcttctgtatgtcagtagattgtacgcactgcaactattacggtggatttggtgagcttgctaaccccttacaatggcctcagcttcgcaaaagacgtcgcattcttccgttgattccgttaccatccgccgtcagattgctccggccgctgcctccgccgctacagccgtcgtcggcgattggaataacgacgatcgcccgttgccgatcaaaaattccgtgattaatccgcctgatccttccgctaatgcttcatcgaaaggaatccaagtcctcacaagggctcaaactagtcatcctttggacccattatctgcagctgaaatcaaagtagccgttgcaactgtcagggctgctggagcaacccctgaggtcagagatggcatgcgatttgtggaggtggttcttttagaaccggagaaaaatgttgtggcgcttgcagatgcatacttctttccgccattccaaccatcattgttacccagaagtaaaggaggggttgtgatacctactaaacttcctccaaggagagctcggcttgttgtttataataaaaagtcaaatgagacgagtgtatggattgttgaattatctcaggtgcatgcagcaactcgaggtggtcatcatagaggaaaagtcatttcatcacgagttgtcctagatgtgcagcctcccatggatgctgtggaatatgctgaatgtgaagctgtagtgaaagattatcctccctttcgggaggctatgaagaagaggggcatagatgatatggatctagtgatggttgatgcttggtgtgttggataccatagtaaggctgatgcaccaagccgtagattagcaaaaccacttatattttgtaggacagaaagtgacagtccaatggaaaatggatatgcacgcccagttgaaggcatacgtgttcttgttgatatgcaaaatatggtagtgcttgaatttgaagaccataagcttgttcccctaccaccagccgatccattgcggaactacactcctggtcatacacgaggcggtgttgaccgcagtgatgtaaagccgctacagattcttcagcctgatggaccaagctttcgtgttaacgggcactatgttgagtggcaaaagtggaactttcgtatcggtttcactccaagggagggtttagtattacattcggtggcatatgttgatggtaatagaggtcgaagatcaatagctcatagattgagctttgtggagatggttgtgccttatggcgatccaaatgatccgcattaccgaaagaatgcattcgatgctggtgaagatggccttggaaaaaatgctcattccctaaagaagggatgtgattgcttaggatatatcaagtactttgatgcacattttacaaacttcattggaggtgttgaaacaattgaaaattgcgtatgtatgcatgaagaggaccacggaatcctctggaagcatcaagattggagaactggcttagcagaagtccgaagatctcgacgactcacagtttcttttatatgcactgttgcaaactatgaatatggtttctattggcacttttaccaggatggaaagattgaagctgaagttaaactcactggaattctgagcttaggggcgttgcagccaggagaagttagaaaatacggcaccactattgcaccaggactctatgcgccggttcatcaacatttttttgttgctcgtatggacatggcggttgattgtaagcctggagaaacatgcaatcaggttgttgaagttgatgttaaagttgaagaaccaggaaaagacaatgttcacaataatgcattctacacacaggaaactttgcttaaatctgaatctcatgcaatgcgggattgtaatccgttatctgctcgtcattggattgttagacacacaaggaccgtgaataggacgggccaactgacaggctacaagctggtacctggttcgaactgcttgcctttggcaggttcagaagccaagtttttgagaagggccgcctttctgaagcacaatctgtgggtcacaccttacgcacctggtgaggattttcctggaggagagtttcctaaccaaaacccgcgtgttggtgaaggtctggcctcgtgggtacagaaagatcgatctcttgaagaaaccgatatcgttctctggtacgtgtttgggatcactcatgttcctaggttggaggactggcctgtgatgccagtggagcggattgggtttatgcttcagccacatgggttctttaactgctctccggcggtagatgttcctcctggagcttgtgagtcagatgtgaaagagagtcatgttaaagacacagttggtcccaagccggttccaaatgggctaatagccaagctttgatttaatcataaacagtgtaagatagactgatgtgaaacattgggttagttttgaaccctgatcttttgttttataagggttagttttgaaccctgattatttgttttataaatctcgaaccagtacaatccttgga

SEQ ID NO: 4484 - DNA, 2572 bp, Daucus carota
tgagagagagtggtgagctatacataaatataactgctgtatgtcagcaagttgttccaggcattactacggtggatttggtgagcttgcgaaccccttacaatggcctcaattaagaaaacgccgtcgttttcaagttccgatgactctcccgtcgtttctcgccgcgctgaagttgcgccggagtggattgtttcgtcctccgatgatcgcccgatcaaagcttccgccattgcttccttgattcgtcctgattcttccgctagttctactgcttctactaaaggaatccagataatgctaagggctcaaagtagccatcctttagaccctttatcttcagctgagatctcagtggccgtagcaactgtcagagcagctggagctactcctgaggtcagagatggcatgcggtttgttgaggttgttctgtcagaaccaagtaaaaatattgttgcattggcagatgcgtacttcttccctccctttcaaccctcattgctgccgagaactaaaggtggagctgtaattcctagtaaactacctccaaggcgagccagacttgtggtttacaacaagaagtcaaatgaaacaagcatatggatagtagaactgtcagaagtacatgcagcaactagaggtggacatcacagggggaaagtgatttcctcacaagttgttcctgatgtacagccaccaatggatgccatggaatatgctgagtgtgaagcagttgtaaaagagtatcctcctttccgtgaagctatgaagaagcgtggtattgaggatatggatcttgtgatggtggatgcttggtgtgttggttactatagtgacactgatgctcctaaccgtagactcgctaagccgcttattttctgtagaacagaaagcgattgtccaatggaaaatggttatgcacgcccagttgaaggcatatatctacttgttgatatgcagaacatggttgtgatagaatttgaagatcgtaaacttgtcccattacctccagctgatccattaagaaactatactcctggtgaaacaaggggaggggttgatcgaagtgatgtaaagccattacagattgttcagcctgagggtccaagctttcgagttagtggacactatgtagaatggcaaaagtggaatttccgaattggtttcactccaagggaaggcctggttatacactctattgcatacgttgatggtagtagaggccgaagacccatagctcatagattaagttttgttgagatggttgtcccctatggagatccaaatgacccccattacaggaaaaatgcatttgatgctggggaagatggccttggaaagaatgctcactctcttaagaagggatgtgattgtctgggctatattaagtacttcgatgcacattttacaaatttcaccgggggcgttgaaacaatagaaaattgtgtatgtcttcatgaagaggatcatgggattctctggaagcaccaggattggagaacaggcttagcagaagtgcgaagatctaggcgactcacagtttcttttatatgtactgtggctaattacgaatatggtttttactggcacttctatcaggatggaaaaattgaggctgaagtgaaacttactggcatcctcagcttaggagcattgcagcctggagagtctcgaaaatatggtacaacaattgcaccaggactgtatgcacctgttcatcaacatttctttatagctcgtatggatatggctgttgattgcaagcctggggaagcatacaatcaggttgttgaggttgatgtcaaagtcgaagaacccgggaacgacaatgtacataacaatgcattctacactgaagaaacgttactaaaatctgaattgcaagcgatgcgtgattgtaactttccagctgcccgtcattggattgttagaaacacaagaacagtgaataggacgggacagctgacaggctacaagctggtacctggttccaactgtctgcctttggctggtccggaggccaagtttttgagaagagctagtttcttgaagcacaatctctgggttacaccctatgcacaggatgagaattttccaggaggagagtttcctaaccagaatccacgagttggtgaaggtttagcttcatgggttaagcaggacaggtccctagaggaaacaaatatagttctttggtatgtttttggtataacacatgttcctcgtttggaagattggcctgtcatgcctgtagaacgcatcggttttatgctccagccacatggattcttcaactgctcacctgctgtagacgtcccgcccaatgcctgcgagctggacgtgaaagacggtgatcccaaagaaagcggagacaccaaatcagtctcagacgggctaatggctaagctctgatgccttccatcaccacatctgcgttttccccactcctattctttctaaagacatctctaaatagttgtatgaaacaaggttaatcagcaattacgtcctcgccgtcaacttcccttgacgcttttgtacattaacttttgacgttgattgataactcttt

SEQ ID NO: 4485 - DNA, 3050 bp, Petroselinum crispum
gagagatagagagaagcgctgtatgtcagtaagttgtggaacaaagcaattctacggtggatttggtgagcttgcgaatcctttacaatggccacagcttcgaaaacgacgacgcttcttccttgtcacgattcatcttcatcttctcgcaaggcttcttccgagctcgccgacgatcactccgtttctccggccgccattgcttccttgatccgaactgattcttcctctaatgtttcttctactaaagggatcccgatcatgctgagggcccaaagtagccatcctttggaccctttatctgccgcagaaatctcagtggccgtagcaactgtcagggccgctggagctacccctgaggtcagagatggtatgcgttttgtggaggttgtgctgtcagagccagataaaaatgttgttgcattggcagatgcatacttctttccaccattccaaccatcattattgccaagaaccaaaggaggagctgtaattcctagtaagctccctgcaaggagagctagactggtggtatacaacaagaaatcaaatgagacaagtgtttggattgtggagctatctgaagtacatgctgcaaccagaggtggacatcatagaggaaaagttatatcctcgcaagttgttcgcgatgtccagccaccaatggatgctgtggagtatgctgaatgtgaagcagttgtgaaagagtatcctccttttcgggaagctatgaaaaagaggggtattgaggatatggatcttgtcatggttgatgcttggtgtgtcggttatcatagtaatgctgatgctcctagccgcagactggccaaaccactaatattttgtagaacagaaagtgactgcccgatggaaaatggctatgcacgtccggttgaaggcatttatgcgcttgttgatatgcaaaacatggttgttattgagtttgaagaccgaaagctagttcccttacctccagctgatccgttgaggaactacactcctggtgaaacaaggggaggggttgatcgaagtgatgtgaagcctttgcaaattgttcaacccgaaggtccaagttttcgagtcagtggacattatatagagtggcaaaagtggaattttcgtattggtttcactcctagagagggtttggttatacattccattgcttatgttgatggaagtagggggcgaaggcccattgctcataggttgagttttgtggagatggttgtaccctatggcgatccaaatgatcctcattacaggaagaatgcatttgatgcaggggaggatggccttggaaaaaatgctcactcacttaaaaagggttgtgattgtttgggctatataaaatactttgatgcccattttacaaattttactggaggagttgatacaattgagaactgtgtatgcttgcatgaggaggatcatggcatcctttggaagcatcaggactggagaactggcttagccgaagtgcggaggtccaggcgtctcacagtttcttttatatgtactgttgctaactatgaatatggtttctattggcacttctatcaggatggaaaaattgaggcggaagttaaacttactggagtcctcagcttaggagcattgcagccaggggaggttcgaaaatatggtacaacaattgctcctggactatatgcacctgttcaccagcacttttttgttgctcggatggatatggctgttgattgcaagcctggagaagcatttaatcaggttgttgaggttgatgttaaagttgaagaagctgggaaggacaatgtccacaacaatgctttctataccgaagaaacagttcttaaatctgaattgcaagcaatgcgtgattgcaacttttcgtctgctcgccattggattgttaggaatacaaggacagtaaataggactggacagctgacaggctacaagttggtgcccggttctaattgtcttcctctggctggtcctgaggccaaatttttaaggagagctgcattcttgaagcataatctctgggttacaccatacacacgtgacgaggattttccaggaggagaattccctaatcagaatccacgagccggcgagggtctggcttcttgggtaaagcaaaaccggtctctggaggaaacaaatatcgttctctggtatgtatttggaatcacacatgttccgcgattggaagactggcctgtaatgccagtagaacgtatcggtttcatgcttcagccacatgggttcttcaactgctcacctgctatagatgtcccgccaaatccatgtcagttggaagcaaaagacagtgacactaaagacaatggacaagcgaaaccaagtcccagtggattgatagctaaactgtgatacgaatttgcaaccgaagcaaaacctgcctgctggttgtcaacgcattagagtggaaagtggtatagtcgtcctagttgtacgttttctgtaaacaagtatctacggtgtgagatttggaactcccctactcgggtaaatatgaatctcctcggattgtcacttaatctacaactctctcccattaattgggtttctgttcttgtgtgataatgttgtgttctgtacaccttgagtatttcttctgtgccttttgaactttgtaagatttatcaactcctaatgtgtaacgagaattgcagaccttgttggtttttgtttgacttaaaatattgctgataggtgtgattgatcaagtataatacatagatcaccattatatctgtgacctcttgtgacatccttggccctttcctcgttgacataaagatgtctgtagtttctgaagtttaccttttttcttgatcgagtcatctttgacattgaaaagaagtgcattgtatattagttgaaagagcgctttttattaacatttctttgctgaaatgtttatactgttttccatccgtctaagttaatggcatggagtacattagttttgtagttggttagttgaagtaaagttttttcattctgtactggatacataaaatttgggaaggtatacctgtttt

SEQ ID NO: 4486 - DNA, 4084 bp, Daucus carota
aagctgcaaagaaacttttcaggaacaagaaatttatatttcaaaagtcctgacatcttttcattcataactcccaaccaccaattgtaatgtgtactcgctttctttgctaacgatacagaccacggaaaaggtatactgattttacatcaaatataagtcttcaaattttacagatccacacaaataacaataataagttgagtagcatacacataacgagaggagaatacaatctataatttcttgacaaggtggtaaagggagatctgatctatacaggccatggcatcactttcacaattcatttgatctccttcaactcaatgcagacaatttagatgagcatatcatgtggtattctcagttacttggttcatttccccatacaccatcccatgcaccagatggagcaaccttgggaccttccaaggaatttggaccacctgggaaattatgtggacctggaagtccattaggtccagggggctggactttctggggcttcgtcctgattccaagcaatctaaatacaaacctagccagctctccatacagcatgcctgatcgatcaaacaactgtaaaagtgcagacatgaacatgtgaaaagcctgagtattctggtctattaacatagcaacacggccaaaaaaggttaccacaccttgcatcacatgcatgaaagaaacccaaaaacctggaggagatgatggagcagcaaaaggattgtttgggtcttgatcgccatatggaggaccacccatacccattcccatgcccatccccatccctccataactacccattccacctccaaaactactgttatacattcccccaccatacattcctcctccatagagacttccagtgccaccatacatgcctcctcgatacatgctatttccatacattcctcctccataagaccctccagccccatatgatccgtaagttccagaaccataaccagaattatagtttaaaccggaaccgtaaccaacacctcctcctaatgcagtggtgttgttatatgtttgctgctcccaaggcctagatggtagaggtctcccaagtgcatttctgtttgcaactgtatttccatccgctgttgtaacaatttcacccggccttgctgttccagaggcttcaacaatatcacttgtgctcccagaagatgggggcttaaaaggcgcaggaccagatgaagaccctgatcgctcccaaggttttggaggagcactggtacctgactgttgaggtcggttcgggttctccatcgtgagagagagagaaagtgtggagaggagagagaggaaacgcagagagggtcgctgtatgtcagataggtgtggaaggcaattctacggtggatttggtgagcttgctaatcctttgcaatggccgcagctaagaaaacgacgacgtttccttcctgtcacgattcatcttcctcgtcttcttcgccttctatttctcgtagggcttcttcggagctcgtcgacgatcactccatttctccggccgccattgcttccctgattcgtactgattctgtctcttctagtgcttctgcgaaagggatcccgatcatgctgagggcccaaagtagccatcctctggaccctttatctgctgctgaaatatcagtagctgtagcaaccgtgagggctgctggagctacccctgaggtcagagatggtatgcgtttcgtggaggttgtgctgtcagagccagataaaaatgttgtcgcattggcagatgcatacttctttccaccattccaaccatcattgttgcctagaacaaaaggaggagctgtaattcctagtaagctacctgcaaggagagctagacttgtggtatacaacaagaagtcgaatgagaccagtgtttggattgtggagctatctgaagtacatgctgcaactagaggtggacaccatagaggaaaagttatatcctcacaagttgttaaagatgtccagccaccaatggatgccgtggagtatgctgaatgtgaagcagttgtgaaagagtatcctcctttcagggaagccatgaaaaagaggggcattgaggatatggatcttgtcatggttgatgcctggtgtgttggttatcatagtgatgctgatgctcctagccgtagactggccaaaccacttatattttgtagaacagaaagtgactgcccgatggaaaatggctatgcacgtccggttgaaggcatttatgcacttgttgatatgcaaaacatggttgtgattgagtttgaagaccgaaaacttgttcccttacctccagctgatccgttgaggaactacactcctggcgaaacaaggggaggggttgatcgaagtgatgtgaagcctttgcaaattgttcagcccgaagggccaagttttcgcgttagtggacattacatagagtggcaaaagtggaattttcgaattggtttcactcctagagagggtttggttatacattccattgcttatgttgatggaagtagggggcgaaggcccattgctcataggttaagttttgtggagatggttgtaccctatggcgatccaaatgatcctcattacaggaagaatgcatttgatgcaggggaagatggccttggaaaaaatgctcactcacttaaaaagggttgtgattgcttaggatatatcaaatactttgatgcccatttcacaaattttacgggaggagtcgatacgattgaaaattgtgtatgcttgcatgaggaggatcatggcatcctttggaagcatcaggactggagaactggcttagctgaagtgcggagatccaggcgactcacagtttctttcatatgtacagttgctaactatgaatatggtttctattggcacttctatcaggatggaaagattgaggcggaagttaaacttactggagtcctcagcttaggagcattgcagccaggggaggttcgaaaatatggtacaacaattgctcctggactgtatgcaccagttcaccagcacttttttgttgctcgaatggatatggctgttgattgtaagcctggagaagcatttaatcaggttgttgaggttgatgttaaagttgaagaagctgggaaggacaatgtccacaacaatgctttctatactgaagaaacagttcttaaatctgaattgcaagcaatgcgtgattgcaatttttcttctgctcgccattggattgttaggaatacaaggacagtaaataggactggacagctgactggctacaagttggtgcccggttctaactgtcttcctctggctggttctgaggccaaatttttgcgaagggctgcattcttaaagcataatctctgggttacaccatacacacgtgatgaggattttccaggaggagaatttcctaatcagaatccacgagctggcgagggcttggcttcctgggtaaagcaaaaccggtctctggaggaaacaaatatagttctctggtatgtgtttggaatcacccatgttcctcgattggaagactggcctgttatgccagtagaacgtattggtttcatgcttcagccacatgggttcttcaactgctcacctgctatagatgtccctccaaatccatgtcagttggaggcaaaagacagtgatactaaagacaatggacaagcgaagccaagtccaagtggattaatagctaaactgtgatgggaaattgctgccaactcaaaacctacctgctgattgttattgcatgagagtggtataattgtcctagctgtatgtctttgccgaacaaatatctacagtatcagatatggaaaaccccttctctggtacatatatgaatatcctcggattgtcatgtgatctacatctatctgtgtaatttgatttctcttcctgtgtgaaaatgttgtgttttttacaccttgagtatgttcttctgtgcccttagagatttgtaagatagataaacccctaatgtgtaatgatttgcataccttaatggtctttgttttcatcaaatattgctggtcggtgtgattgataaagtataatacatagggccttttgaaagtac

SEQ ID NO: 4487 - DNA, 2774 bp, Valeriana officinalis
ttctctacatctacacatttctccataaaaccaattcaattctcacacaataaaccctagcttcccttcccttcccttccgatcatataagtataatataccactagtgcatcgataagtgtggagaggggaggagatagagttcggtggtgtacagactcctgctgtatgtcagattgctgcacgcactattacgctggatttggtgaactcgctaaccccttgcaatggccacaacttcgcaaaagacgacgcattcctgtcacgcttcctctcaatcacctcccgtccctcgccaggcttcttccctcatgtctccgcccaccggagatgctcccgaggttgtccagaactggcctaaactgtccaatgaacgcctatccgacgatcgtcctatcaaaaaatctcccatgcctaccttgatccatcctgattcttccaccactgcttccactaaagggcttcccatcatgctaagggctcaaagcagccatcctttggaccctttatctgctgccgaaatctcggtggctgtagcaactgttagggcagctggagccactcctgaggtgagagatggcatgcgattcgttgaagtggttttgctagagccagacaaaaatgtcatagcattggctgacgcctactttttcccacccttccaaccatcactattacccagagtcaaaggtggagctgttattcctagtaaacttcctccaaggagagctagacttgttgtttacaataaaaaatcaaatgagacgagcatatggattgttgagctatctgaagtgcacgctgcaacgcgaggtggacaccaccgcggaaaagtcatttcgtcaaaaattattcatgatgttcagcccccgatggatgctgtggagtatgctgaatgtgaagctgtcgtaaaagatcaccctccatttatagaggccatgaagaaaagaggtatcgaagatatggatcttgtgatggttgatgcttggtgtgtcggttattacagtgaagctgatgctcctagtagaagactggcaaaaccacttattttttgtagaactgagagcgactgtccaatggaaaatggttacgcacgtcctgttgagggcatttacgtccttgttgatatgcagaatatggttattcttgaatttgaggaccgcaaacttgtaccgttacccccagctgatccattgagaaattacactcctggtgaaacaagaggtggggttgatcgaagtgatgttaaaccattacaaattgttcagcctgaaggtccaagcttccgagttaacggtcattatgtagagtggcagaagtggaatttccgaattggttttactccaagagagggtttggttatacattcggtcgcatatgttgatggcagccgaggtcgaagacagatagcccaaagattgagttttgtagagatggttgtgccttatggtgatccgaatgaaccacattataggaagaatgcgtttgatgctggtgaagatggtcttgggaaaaatgctcattctcttaagaaggggtgtgattgtttgggatatatcaagtactttgatgcccattttacaaattttactggaggtgttgacacgtttgagaatgtcgtatgcttgcacgaagaggatcatggaatgctctggaagcatcaagactggagaactgggttagccgaagttaggaggtctaggcggttaacagtttctttcatatgtactgtggcaaattacgaatatggcttctactggcacttttatcaggatggaaaaattgaggctgaagtaaaactcactggagttcttagtctcggagcactacaacctggggaatctagaatatatggtacaacaattgcgccaggattatatgcaccagttcatcaacattttttcgttgctcgcatggatatggctgttgattgcaagcctggagaaccttacaatcaggttgtggaggtgaatgttaaagttgaagaacctggacagaataatgtccacaacaatgcattctacacggaagaaacattgcttaaatctgagttacaagcatcgcgcgacttcaatcctttctctgctcgccactggattgttaggaacacaagaacagtaaacagaactgggcagcttacagggtacaaacttgtacctggttcaaactgtttgccattagctggtccagaggccaagttcttgcgaagagctgcgttcttgaaacataatctctgggttactccatatgcccaagacgaaacattccctggaggagaattccctaaccagaatcctcgtgctggcgagggtttggcttcttgggttaagcaagaccgttctctagaagaaactgatattgttctttggtatgtatttggaattacacacgttccgagattggaggattggccggtcatgcctgtggagcacattggttttatgcttcagccacatggattcttcaactgctcgcccgctgtggatgtgccacctggcacctgcgagtcggatgtgaaagacggtgatgttaaagacagtggagttgcgaaaccaattccaaatggattgttgtccaagctataagctgctctaaaacctagtcttgtttatagttgagattgcattcagctttagaacaaatccaactctgtcgctctttctcttatttcgaaactatgtttttactgtctgttggtttgtgtttgtttgtgcatatttctattttcctatcgaactactgattttactcgcacattttcaccagttcttggt

SEQ ID NO: 4488 - DNA, 2863 bp, Amaranthus tuberculatus
agttgcctaatttagagtaccattatcaatgtccggattcatctaccccgatatttgcacgtaaaaagacctgcacgtttctttataaaaatacacccactcatacctcaattatcagtttatgacccatcaccactgcaaaaataacagtagagggaaaaattgaggagatcctagagagagaaagctccattggaggagaagagtaggatacagagcgtgaaagtgttgctgtatgtcagttgtggattacttttttgctgacgattattgcaattactattattattacagtggaatctgtaatcctcttcaatggccacaacttcgcaaaaagcgacgtctccctgttgtgattccacggagatcggaaaatcttcgatcgtcagtgatccgaattcttcggcgatcggagatagggtttccgatgagagatcgtcgaatttgattcggaatgttgaggtgcttcctgaaagtcaaactgctggtgcggctgtaatagccaaagggattccaattccattaagagctcagtcaagccaccctttggatccattatctgccaccgaaatcaaagtggctgttgctactgtcagggctgctggagcaactcctgaggagagagatgccatgcggtttattgaggtggttttattggagcctgaaaagcgtgtgattgctatggcagatgcttatttcttccctccttttcagccttctttgcttcccaggacaaaaggcaaagctgttataccatctaagcttcctccacggcaggcaagacttgtggtttacagcaaaaagtcgaatgagactagtgtatggattgttgagctcactgaagttcatgcaactacaagaggggggcatcataggggcaaagtcatttcttccaaagttgttcctgatgtgcagcctccgatggatgctgtagaatatgctgaatgtgaagctgttgtaaaggactatcctccatttcgagaggctatgaaaaagaggggcattgatgatatggagcttgttatggtggatgcatggtgtgtaggttatcacagcgaggctgatgcgcccagccgtaggcttgctaagcctcttatattctgcagaaatgagagtgattgtccaatggagaatggttatgctcgtccagtagaaggaatatatgtccttgttgatatgcaaaatatggtagtggttgagtttgaagacaggaaatttgttccgctcccacctgctgatccattaagaaattacactcctggtgaaacaagaggtggtgttgatcgcagtgatgtgaaaccattacttattcttcagcctgaaggccctagttttcgtgtgaatggccattttgttgaatggcaaaagtggagtttccgtgtcggttttactccacgggaaggtttggtcatacattctgttgcatatgttgatggaagtagaggccgtcgtgctgtagctcagaggttaagctttgttgagatggtggttccttatggtgatccaaatgaaccacattacaggaagaatgcttttgatgctggtgaagatggcttgggcaagaatgctcattctttgaaaaagggttgtgattgtttaggttatattaaatattttgatgcccattttacgaacttcactggaggtgttgaaactattgaaaattgtgtctgcttgcacgaggaagaccatggaatattatggaagcaccaagattggcgaactggcttagctgaagtaagaagatctaggaggctcactgtatcctttatctgcacggtggccaattatgagtatggattctactggcacttttaccaggatggaaaaattgaggctgaggtcaaacttactgggattcttagtgtaggagctcttcagcctggtgaagttcggaaatacggtactacaattgcccctgggttgtatgcgcctgtacaccaacacttctttgttgctcgtatggatatggctgtagattgcaagcctggtgaagcattaaatcaggttgttgagttaaatgtcaaggtagaggaaccaggtaaaagtaatgttcataacaatgccttttatgctgaggaaaaagtacttaaatctgaatcacaagcgatgcgggattgtaatcctttgactgcccgccattggattgttaggaatacaagaactgttaatcgtacaggccagctgaccggttacaagttaatgccggggtcaaactgtttgccactagctggtcctgaggcaaaatttctaaggagagcaaccttcttgaagcataacttatgggttacaccgtatgccagagatgagatgtttcccggtggagaatttccaaatcaaaatcctcgtgctggtgaaggtctcgctacttgggttaaacaaaaccgcccattggaagaggctgatatagttctttggtatgtatttgggttgacacatataccacgtttggaggactggccagtcatgccagtggaacatctgggttttatgctcatgcctcatggattcttcaactgttcaccagcggttgatgttccacccaacactcacgaatccgatgtcaaggaaaataatggcgtggttgctaagcctgttcaaaatgggcttattgccaaactctgagcaaacttcctcttttgtattctcacattacgtcattgaaacgatttccttccaatttgtcttatttttcattaaaattatattttttacgaagatgagatttgatttcacgttctgtatatcaatatcgacataagttccattatttgaatatacctcctagtcctatgtaatcttctgtattaatggttacgtacacttttgttggtaaatcaacaagtattgtgtattttcatgc

SEQ ID NO: 4489 - DNA, 2930 bp, Vitis vinifera
cgataaggtctggtgtggccttgactcacaagatcatggttttggtaggcgaaaatgcacgtgaataccgtccttcccgtctatagactcccccacttccgactgcgatttttcacctttattttttcagtcgatcaatttcaatcctaacaaaccctagctctgtccagcagttatatttaacttcatcttgggagagtagagtgagaggaagtgcgagaaagagtgggggatagagagagagtggtgtggcgagtgtggaagtgaggggtttgtgagaatttgctgtatgtcagaagattgttgctacagtgagaattgctgcagtggattcggtgagcttgctaaccctctacaatggccgcagctacggaaaaggcgacgacttgttgcattgaggacgccaagccagctccggttaggaaggcttccaacgtcttgcaggactggagcgtcgccggttctgctccctctgaggatcagatcagcaagagagcgaccgtggcgacgctgattcgttcggttgactcactccctcaacccgctgctaatcctactgctaccaaagggattccaatcatgttgagagctcagaccagccaccctttggaccctttatccgctgctgaaatctcagtggcagtggcaactgtcagagcagctggagcaacccctgaggtcagagatagcatgcggtttgttgaagtggttctggtggaaccagaaaaacatgttgttgcactggcagatgcatatttcttccctcctttccagccatcattgctccccagaacaaaaggtggaccagtaattcctagtaagcttcctccaaggcaagctagacttgtcgtttacaacaaaaggtcaaatgagacaagcatatggattgttgaactttcagaagtgcatgcagcaactcgaggtggccaccacaggggcaaggtcatttcatccaaagttgttgctgatgtccagcctcctatggatgctgtagaatatgctgaatgtgaagctgttgtaaaggattttcctccatttcgggaggcaatgaagaaaaggggtattgaggatatggatcttgtgatggtagatccctggtgtgttggatatcacagtgatgctgatgctcctagtcgtagacttgcgaaaccacttatcttttgtcgaaccgagagtgattgtccaatggaaaatggttatgctcgtccagttgaaggtatatatgttcttgttgatatgcaaaatatggtggtggttgagtttgaagaccgtaaactcgttcccctacctccagctgatccactaagaaattacactcctggtgagacacgtggaggtgttgatcgaagtgatgtgaaacccttgcaaatcattcaacctgaaggacctagctttcgtgttaatgggtactttgttgaatggcagaagtggaattttcgtattggtttcacccccagagagggtttggttatttattctgttgcatatattgatggtagtcgaggtcgaagatctgtggcccataggttaagtttcgttgagatggtggttccttatggggatccaaatgatccccattatagaaagaatgcatttgatgctggtgaagatgggctgggtaaaaatgcacattctctaaagaagggctgtgattgcttaggatatatcaagtactttgacgcacattttacaaatttcactggtggtatcgaaacaattgaaaattgtgtttgcttgcatgaagaggatcatggaatgttatggaagcatcaagattggagaacaggtctagcagaggttcgtcgttctagaaggctaacagtgtcttttgtatgcactgttgcaaactatgagtacggattcttctggcatttttatcaggatggaaaaattgaagctgaggttaaactcacaggaattctcagcttaggagccctgcaaccaggggaaatccgaaaatatggtacaactattgcacctggattatatgcaccagtccatcagcacttctttgtagctcgtatggacatggctgttgattgtaagcctggggagacattcaatcaggttgttgaggtcaatgttaaagttgaagaaccagggaagaataatgttcataacaatgcattctatgctgaagagaaactgcttaggtctgaaatgcaagcaatgcgtgattgcaatcctttatctgcccgacactggattatcagaaacacaagaactgtcaacaggactgggcagctaacaggttacaagctggtacctggttcaaattgtttaccattagctggttctgaggcaaaatttttgagaagagctgctttcttgaagcataatctttgggtcacaccttatgcacgtgatgagatgtatccaggaggagagtttcctaatcaaaatccacgtgtgggggagggattggctacttgggttaaccagaatagatcgttggaagaaacagacatagttctttggtatgtatttggagtgacacacattcctcgcctggaagactggcctgtcatgccagtggagcacattggttttaggctcatgcctcatgggttctttaactgctcaccagcggtggatgtccctcccagcacatgtgatctggacctaaaggacaatggggtgacggggaagcctatccagaatggattactagcaaagctctgaaaggatgttaagcagggttggatcctaccttattcagtgtgtttctattattttgggggaggccaaataatttagccggcttcatttgatgtcttgacagtagccaaataatcaagccattggcccaaaacgtcatgccatacgattttcaagtatcgaattgcctgtttgcataatcatgtgactatttgtttgtttgtcatggtctgatcttccgcagcacggtctcctaattaaaaatggctatt

SEQ ID NO: 4490 - DNA, 3111 bp, Prunus mume
gctggctctgtttcttgtttcgctcagatcacactctccctgtctcttcctgtatctctccgctctctgaaaacccatggttaaaagctcgcatttaaaccctagtttccagcaagtgtgaagaaatataatatttgaattatagaaaaaaagaaaaaaaagagtctaattcatttcttctcactctcgcgtcgcgctcgatcgttttctctctgtttctcgtactttctccgggtttctcgaactttctccgagcttctcgcggtgtgcggttacagagagcgcgagagaggggggagaggcgtcgagcatttcagcaccgtagagacttgtgctgtatgtcagtagactgtgtagagacctactgtggtggaattggtgagctcgcgaaccccttgcaatggcctcagcttcgaaaaaaacgtcgtcttcttgttgcttccgctccgattcggctcccattccacgcgaggcggcgccggctccgaacgccgtcgtttcggcctccgtggttcaagattggaccgccatcgcgggttccgaggatcggcgagatgatcagcgccccaaaaagatcgggatggcgtccttgattaccgaaccgtccgccaatgcatccaccactggcatcccgatcatgcttaggcctcaaacaaggcatccactggaccctttatctgctgccgagatctctgtggcagtggcaaccgtcagggctgctggagccacacctgaggttagagatagtatgcgttttgttgaagttgttctactggaaccagataaacacgttgtaggtttagcagatgcgtacttcttcccccctttccaaccatcattgcttcccagaaccaaaggtggacctataatcccgactaagcttcccccaaggcgagctaggcttgttgtgtacaacaaaaagtctaatgagacaagcacatgggttgttgagctgtcagaagtgcatgcagccactcgaggtggacatcacagaggaaaagtaatatcctcacaagttgttccagatgttcagcctcccatggatgctgtggagtatgctgaatgtgaagctgttgtgaaagactttcctccatttagagaggctatgaagaagaggggtattgaagatatggaccttgtgatggttgatgcctggtgcgttggttaccatagtgatgctgatgctcccagtcaaagacttgctaaaccacttatattctgtagaactgagagtgactgcccaatggaaaatggttatgcacgcccagttgagggcatctatgtacttgttgatatgcaaaacatggtggtggtagagtttgaagaccgtaagcttgttcctctacctccagctgatccattgaggaactatactcctggtgaaacaagaggtggtgttgatagaagtgatgtgaaacctttacaaattcttcagcctgaaggtccaagctttcgtgttaatgggtactttgtggagtggcagaagtggaattttcgtatcggattcactcctagggagggactggttatatattcggtggcatatgttgatggcagtagaggacgaaggcctgtagcccataggttgagttttgtggaaatggtggtgccatatggtgatccaaatgacccgcattacagaaaaaatgcttttgatgctggggaagatggcctgggtaaaaacgcacattctctcaagaaggggtgtgattgtttggggtatatcaaatactttgatgcacattttacaaatttcaccggaggtattgaaactattgaaaattgtgtatgcttgcacgaagaagatcatggaattctgtggaagcatcaggactggagaacaggcttagcagaagtgcgcaggtcaaggcggctaacagtgtcatttatatgtactgtggctaattatgagtacggattcttctggcacttttatcaggacgggaagattgaagctgaagttaaacttacaggaatactcagtttaggagcactgcaacctggagaagttcgaaaatatggtactgttattgcaccagggttatatgcaccagttcatcaacatttttttgttgctcgtatggatatggctgttgattgcaaacctggggaaacttacaatcaggttgtggagctggacgtaaaggttgagaaacctggggataataatgtccacagcaatgcattttatgctgaagagacacttctcaggactgaattgcaagcaatgcgtgactgtaatcctttgactgctcgccactggattgtaaggaacacgcgaactgttaacaggactggacagttaacaggctacaagctcgtacctggttcaaactgtttgccactagctggttctgaggccaagtttttgcgaagagcagcattcttgaaacataacctttgggttacgccatatgcccaagatgagatgtttcctggaggagagtttccaaaccaaaatccacgtgttagtgaaggattggccacatgggttaacaagaaccgatctctggaagaaactgatattgttctttggtatgtttttggaataacacatgtaccacgattggaagactggcctgtcatgccggtggagcgcattgggtttatgctcatgcctcatggattcttcaactgctctccagcggtggatgttccacctagtgcatgtgaattggaggccaaagacaatgatgtaaaagacaatggggtagccaagtcaattccgaatggcttgctagcagcaaagctttgaagccaaaaaagaaagagcaaaaaaatactgtcatctgtctcttccaatacatttcaatcggtctttttggaaacaagtttactattcccatttccaatttcaactgggcgcgcagaaaacacatggcctttgtttggtctttttttgctattcagacacgctttctgtgaatcgagctagatttcttcttgttttttttgttcatttttaaaattgtttttcgatttcatactttttaatgagaccactcctttatgctttgcaacggtttcccggcaactcacataaagcttctaacacgaaacataaaagaaagaagggctccatcttcttcatatactacacttgaattccac

SEQ ID NO: 4491 - DNA, 2611 bp, Trifolium pratense
gttgtggaaggaaggtggaagaagagggattactattactgtatgtcagtggaatattacagtggaatatattacggtgaacttgctaatcctttgcaatggccacagttgaggaaaaaacgacgcctatttgttgttccaaggctgctgttactgcaacttcaacctcttctaatgttcctaaacagaaacagcaaccgtctttcgtttcggctgtcgattcccgccttgatcctcctcccaaatcagcttcttccaaaggtattacagtaatggcgaaagctcaaactctacatcctttggatcctcttactgctgctgaaatatcagtagctgtagcaactgttcgagcagccggagcaacacctgaggtgagggatagcatgaggttcattgaagtagacttggtagaaccagaaaagcaagttgttgcattagcagatgcatacttctttcctcctttccaaccctcgttgcttccgaggacaaaaggtggacctgtgattccatcgaaacttcctccaaggaaagcgagattggttgtctataataagaagtcaaatgagacaagcatatggatcgttgaacttacagaagttcatgcaacgactcgtggtggacatcataggggcaaagttatttcttctacaattgttccggatgttcagcctcccatggatgccgttgagtatgctgaatgtgaagctgttgtaaaggactatcctccgtttcgagaggcaatgaagaaaagaggaatcgaagatatggatctcgtgatggtggatccttggtgtgccggatatcacagtgaaggtgatgctccaagccgcagacttgctaaaccgctattcttttgtaggaccgagagtgactgtcctatggaaaatggctatgctcgtcctgttgaagggatacatgtacttgtcgacatgcaaaatatggttgtcctcgagtttgaagatcgtaagcttgttcccctcccacaggctgatccgctaagaaattatacttctggtgaaacccggggaggagttgaccgaagtgatgtgaaaccgttacagattattcagccagacggtccaagttttcgtgtcaatgggaacttcgttcaatggcagaagtggaactttcgtattggattcactcctagggagggtttggttgtttattcagtagcttatattgatggaagccgtggccgaagacctgtggcacacagattgagttttgttgagatggttgtcccttatggagatccaaatgatcctcactatagaaaaaatgcttttgatgccggtgaagatggcctcggtaaaaatgctcattcactcaagaagggttgtgattgtttaggctatatcaagtacttcgatgcgcactttacgaacttttatggcagtgttgaaacaattgagaattgtgtttgcatgcatgaagaagatcatggcatgttatggaagcatcaagattggagaacaggtttagctgaagttcgacgttctagaaggctgacagtgtcttttatatgcactgtggctaactatgagtatggattttactggcacttttatcaggatggaaaaatagaagccgaggtcaagctgacgggaatactcagcttaggtgcattgcaacaaggcgagactcgaaaatatggtacaactattgcgcctggattatacgcgcctgtccatcaacacttttttgttgctcgtatggacatggcagttgattgcaagcccggcgaagcatttaatcaggttgttgaggtgaatgtgaaagttgaagagccaggaaagaataatgttcacaacaatgcattttatgctgaagaaaaactgcttaaatcagaattagaagcaatgcgcgattgtgaccctttatctgctcgtcattggatagttaggaacacgaggagtgtgaaccgaaccggacatctaaccggttacaaactagttcctggttcaaattgcttacctttagctggatcagaggctaagtttttaagaagagcagctttcttgaagcacaatctttgggttactgcttacgcacgtgacgaattgcatcctggaggagagttccctaatcaaaatcctcgcgttggtgagggtttggcttcttgggttaagctaaatcgatcactcgaagaagctgatatagttctttggtacgtatttggggtgacacatattcctcgattagaagactggcctgttatgcctgtggagcacattggttttatgcttatgccacatggatttttcaattgctcaccagcagtagatgtaccaccaagcccaagtgatttggatgataaggaaaatggcatgcctgccaagcctagtcagaatggattaattgctaagctttgaaagtcctaaaaatcagagatatttaggctcattcagcctctttatgtggttgtgttcatcatctgaataagtttctacctataattgaacatttaatattgctgcttgtgttaattaatcaatggtggtgtggtgtgtaacctggttatttaatttaagaaaggcttattgtgtaattttataaaaaaattctcttacttttacgattgagataatgatttcattgttatttatgt

SEQ ID NO: 4492 - DNA, 2926 bp, Glycine max
aattaaccattaacccagttgagttcccatcccatcgctttcctctctcattggaaaaaaaaagcattaaagacagatgctacttacatatccgtcttcttcgaaatctatcattattattctacatctaagataaaaaaaaaaataataaataaaggaaaaagaaaaaaacaagctactgctaataatatttggttttgtttttctttataatcaaaacacaacctcgtgtgattccattgagtagttgttgttatttctgcaagtagtggtggtggcggcggcgacagcggtggtggcggcgaagagtggaaacaacaactggcagcattattgttgctgtatgtcagtggaatattattgcagtgggatttactacgctgagcttgctaaccctctccaatggccacagctcaggaaaaaacgacgccatgttgcgccacccaaaataacaacaaggtcgcactcgcagcacctccaacttcttcttcttctgcgccacaacaacaatcacaatcacaacaacggccctctgttgccaccttcatttccgccatcgattctcctcccaaaaccgcttctgccaaaggtatcactgtcatggtgagagctcaaaccagccaccctttggatccactaactgctgctgaaatatcagtagctgtagcgaccgttcgagcagctggggcaacacctgaggtgagggatggcatgcgctttattgaagtagacctggtagaaccagaaaagcaagttgttgcattagcagatgcatatttcttccctcctttccaaccatcactgctccctaggacaaaaggtggacctgtgattccaactaaacttcctccaaggaaagcaagactagttgtttacaataaaaagtcgaatgagacaagcacatggattgttgaacttagagaagttcatgcaacaactcgaggtggacaccataggggcaaagtgatttcatctacagttgttcctgatgttcagcctccaatggatgctgtggagtatgctgagtgtgaagctgttgtaaaggactttcctccctttcgtgaagcaatgaagaagagagggattgaggatatggatctcgtgatggtagatccctggtgtgctggatatcacagtgaagctgatgctcctagccggagacttgctaaaccactaatcttttgtaggactgaaagtgactgccctatggaaaatggctatgcccgtccagttgagggaatccatgtacttgttgacatgcaaaatatggttgttcttgaatttgaagatcgtaaacttgtcccccttccacctgctgatccactaagaaattatacttctggtgaaacccaaggaggagttgaccgaagtgatgtgaaacccttgcagattattcagcctgaaggtccaagttttcgtgttaatgggcacttcattgaatggcagaagtggaattttcgtattggattcactcctagggagggtttggttattcattcagtagcctatattgatggaagtcggggacggagaccagtggcccatagattgagctttgttgagatggtggtcccatatggagatcctaatgatcctcactataggaaaaatgcttttgatgctggggaagatggcttgggtaaaaattctcattctctgaagaagggctgtgattgtttaggctatatcaaatactttgatgcgcatttcacaaacttctatggaggtgttgaaacaattgaaaactgtgtttgtttgcacgaagaagatcatggtattttatggaagcatcaagattggagaacaggtttggctgaagttcgaaggtctagaaggctgacagtttcttttatatgcactgtggctaactatgagtatggatttttctggcacttttatcaggatggaaaaatagaagcagaggtcaagctcacaggaattctcagcttaggagcattgcaaccaggtgaaactcgaaaatatggcacaaccattgcacctggactatacgcgcctgtccaccaacatttttttgttgctcgtatggacatggcagtagattgcaagcctggtgaagcatttaatcaggttgttgaggtgaatgtcaaagttgaaaagccaggagacaataatgttcataacaatgcattttatgctgaagaaaaactgcttaaatcagaaatggaagcaatgcgtgattgtgaccctttatctgctcgtcactggattgttaggaacactaggactgtaaaccgaactgggcatctaactggttacaagctagtacctggctcaaattgtttacctttagctggctcagaggccaagtttttgagaagggcagctttcttgaaacacaacctttgggttactccttatgcacgcgatgaaatgcatcctggaggagagttccctaatcaaaatccacgtgttggagagggtttggctacttgggttaagcaaaatcgatcactggaggaagctgatatagttctttggtacgtatttggagtgacacacattcctagattggaagactggcctgttatgcccgtggaacgcattggtttcatgcttatgccgcatgggtttttcaattgctcgcctgctgttgatgttccaccaaaccaaagtgatttggatgacaaagagaatggcctgccagccaagcctattcagaatgggctaattgccaagctttgaaaggataaaaaatgaggaggatctgcctctctacgtggttatgttcaaattattaaataaaatattcaatacaactgtttgtgctggtttcaacctggctggatatttaagaaacgcctattactgtaatttgtactgtataacttgtatgtacgtttgttgcatggtaatgcttggtaacttaaatgttcatttgatttgatgtggaatctgtgctgctgaa

SEQ ID NO: 4493 - DNA, 2615 bp, Trifolium pratense
gttgtggaaggaaggtggaagaagagggattactattactgtatgtcagtggaatattacagtggaatatattacggtgaacttgctaatcctttgcaatggccacagttgaggaaaaaacgacgcctatttgttgttccaaggctgctgttactgcaacttcaacctcttctaatgttcctaaacagaaacagcaaccgtctttcgtttcggctgtcgattcccgccttgatcctcctcccaaatcagcttcttccaaaggtattacagtaatggcgaaagctcaaactctacatcctttggatcctcttactgctgctgaaatatcagtagctgtagcaactgttcgagcggctggagcaacacctgaggtgagggatagcatgaggttcattgaagtagacttggtagaaccagaaaagcaagttgttgcattagcagatgcatacttctttcctcctttccaaccctcgctgctcccgaggacaaaaggtggacctgtgattccatcaaaactgcctccgaggaaagctagattggttgtctataataagaaatcaaatgagacaagcatatggattgttgaacttacagaagttcatgcaacgactcgtggtggacatcataggggcaaagttatttcttctacaattgttcctgatgttcagcctcccatggatgctgtggagtatgctgagtgtgaagctgttgtaaaggactatcctccgtttcgagaggcaatgaagaaaagaggaatcgaagatatggatcttgtgatggtggatccttggtgtgccggatatcacagcgaaggtgatgctccaagccgcagacttgctaaaccgctattcttttgtaggactgagagtgactgtcctatggaaaatggctatgctcgtcctgttgaaggaatacatgtacttgtcgacatgcaaaatatggttgtcctcgagtttgaagatcgtaagcttgttccccttccacaggctgatccactaagaaattatacttctggtgaaacccggggaggagttgaccgaagtgatgtgaaaccgttacagattattcagccagacggtccaagttttcgcgtcaatgggaactttgttcaatggcagaagtggaactttcgtattggattcactcctagggagggtttggttgtttattcagtagcttatattgatggaagccgcggccgaagacctgtggcacacagattgagttttgttgagatggttgtcccttatggagatccaaatgatcctcactataggaaaaatgcttttgatgccggagaagatggcctcggtaaaaatgctcattcactcaagaaggggtgcgattgtttaggatatatcaagtactttgatgcacactttacaaacttttatggcagtgttgaaacaattgagaattgtgtttgcatgcatgaagaagatcacggtatgttatggaagcatcaagattggagaacaggtttagctgaagttcgacggtctagaaggctgacggtgtcttttatatgcactgtggctaactatgagtatggattttactggcacttttatcaggatggaaaaatagaagctgaggtcaagctgacaggaatactcagcttaggtgcattgcaacaaggcgaaactcgaaaatatggtacaacgattgcacctggattatatgcacctgtccatcaacacttttttgttgctcgtatggacatggcagttgattgcaagcccggtgaagcatttaatcaggttgttgaggtgaatgtgaaagttgaagagccaggaaagaataatgttcacaacaatgcattttatgctgaagaaaaactgcttaaatcagaattagaagcaatgcgcgattgtgaccctttatctgctcgtcattggatagttaggaacacgaggagtgtgaaccgaaccggacatctaaccggttacaaactagttcctggttcaaattgcttacctttagctggatcagaggctaagtttttaagaagagcagctttcttgaagcacaatctttgggttactgcttacgcacgtgacgaattgcatcctggaggagagttccctaatcaaaatcctcgcgttggtgagggtttggctacttgggttaagcaaaatcgaccactcgaagaagctgatatagttctttggtacgtatttggggtgacacatattcctcgattagaagactggcctgttatgcctgtggagcacattggttttatgcttatgccacatggatttttcaattgctcaccagcagtagatgtaccaccaagcccaagtgatttggatgataaggaaaatggcatgcctgccaagcctagtcagaatggattaattgctaagctttgaaagtcctaaaaatcagagatatttaggctcattcagcctctttatgtggttgtgttcatcatctgaataagtttctacctataattgaacatttaatattgctgcttgtgttaattaatcaatggtggtgtggtgtgtaacctggttatttaatttaagaaaggcttattgtgtaattttataaaaaaattctcttacttttacgattgagataatgatttcattgttatttatgtccat

SEQ ID NO: 4494 - DNA, 3132 bp, Glycine max
ctcgcacctcgttataagttccacttcccttggattttgtgttgttgggtcatattattcattcgttggttgctgaatgttgccgagtgctgactggccacaatgtccgaaacagtctaaactattggtgcctctcctctgtaagcgtcaccgacaacaaacaagagcggtgaagaaaattaaaaaaaaaaaacaacaacacagaaacgatatctatcattattaactttaccgaacccactttcctcacggaaaagcagtggtggcttgtccctattcattgaatgaatcgataaggtgtccatatctatcatcaaatcattcaaatgcacctgttgttgtgattgtgaaactaaaacaccgtatcttatcgatcttcaagtacagcaaaacagtggcagcagttattttgaggttgttttgttgggtggcggcggagagtggaagctgctaattaaaggaaggaaagcattgctgtatgtcagtggaatacaactactacagttacggttagctcgctaaccctttacaatggccacaactcaggaacaaaaagccacgccaaacattctcaataacaccaccaccaccacttcttcttgggctgatcccctccgcaaccgaccctccgtcgccaccgtcatctccgccgttgactccttctccgatcctccccccaacaccacttccaccaccaaaggtatcccagtcatgaccagagctcaaacctgccaccctttggatccactatcagctgctgaaatatcagtagctgtagctacagttcgagctgctggggcaacccctgaggtgagggatagcatgcgctttgttgaagtagtcttggtagaaccagataagcaagttgttgcattagcagatgcatatttcttccctcctttccagccatcattgctccccaggactaaaggaggacctctgattcctactaaacttcccccaaggaaagcacgattggttgtttacaacaaaaggtcaaatgagacaagcatatggattgttgaacttagagaagtacatgcagcaactcgaggtggtcatcatagaggcaaagtaatttcttctaaagtcgttccaaatgttcagccaccaatggatgctgtggagtatgctgaatgtgaagctgctgtgaaagatttccctccatttcgtgaagcaatgaagagaagagggatagaggacatggatcttgtgatggtggatgcctggtgtgttggatatcatagtgaagcggatgctcctagccgccggcttgctaaaccgctaatcttttgtagaactgagagtgactgcccaatggaaaatggctatgcacgtccagttgaaggaatccatatacttgtagacatgcaaaatatggaaattcttgagtttgaagaccgtaaactaattccccttccacctgctgatccattgagaaattatacttctggtgaaactaggggaggagttgatagaagtgatgtgaaaccattacagattattcagcctgaaggtccaagttttcgtgtcaacgggcacttcattcaatggcagaagtggaactttcgcatcggttttactcctagggaaggtttggttatttattctgtagcctatattgatggaagtcgagggcgaaggcctgtggcccacagattgagttttgttgagatggtggtcccttatggagatccaaatgatcctcactataggaagaatgcttttgatgcaggagaagatggtctgggtaaaaatgctcattctctaaagaagggttgtgattgtttaggctatatcaagtactttgatgctcacttcacaaactttaatggaggtgttgaaacaatagagaattgtgtttgcttgcatgaagaggatcatggtattttatggaagcatcaagattggagaacaggtttggctgaagttcgacggtctagaaggctgacagtgtcttttatatgcactgtggctaactatgagtatggatttttctggcacttctatcaggatggaaaaatagaagctgaggtcaagctcacgggaattctcagtttaggagcattgcaaccaggtgaaagtcgaaaatatggcacgactattgcacctggattatatgcacctgtccaccaacacttttttgttgctcgtatggacatggctgttgattgcaagcctggtgaagcatttaatcaggttgttgaggtggatgtcaaaattgaagagccaggaaagaataatgttcacaacaatgcattttatgctgaggaaaaactgcttaaatcagaatcggaagcaatgcgtgattgtaaccctttatctgctcgacattggattgttaggaacacaaggacggtaaaccgaactgggcagctaacaggatacaagctagtacctggttcaaattgtttacccttggctggttcagaggccaagtttctgaggagagcagctttcttgaagcacaatctttgggtcactccttatgttcccggcgaaatgcatcccggaggggagtttcctaatcagaatccacgcgttggagagggtttggctacttgggttcagaagaatagatcattggaagaagccgatatagttctttggtacgtgtttggtataacacacattccccgattggaagactggccagttatgccagtggaacgcattggctttatgcttatgccacatgggtttttcaattgctccccagctgtagatgttcccccaagtgcaagtgatttggatgataaggagaatgggatgtctgcaaagcctattcagaatgggatgattgccaagctctaaaaggaccaaaagtagagatacttgattatgtttaccatcacctaagtgagtgcatcactttaattaattaaaaatcgtcaataacaaagtttttctcatggtccacagaatagctatttaggtgatgcatttgatgtgtaattgtaaaatgatagtactttattggtttctctgaaatctaaattgatgcgacgttcctattgtgagaaattgaagtgtgttggattaaaataagttctcatgtattatatactgtttgcgcttggtaaaattcagtttcatatatttacacaaggataatagttgagtctgtttcga

SEQ ID NO: 4495 - DNA, 2809 bp, Populus trichocarpa
gatcactcttgctttttttttttttgaaatttatgtattttcttctctcttgattccatttattgtttaaaggaagggggagagagagagagtagcggagaggagggagatcagagggtggtaaagaagaaattaaagtagtgttgtatgtcagtgaattgtaaagagatttatgcgggtggaattggtgagcttgtgaatcctttacaatggcctcaacttcgaaaaaaacgacgtcttctccttcttgttgtgactctagtgctaccactcctccccttcccattcgccgtgatgctacgaagacgtcggctttggtgcggcaagattggactattcctgttccctcccctgagcaccgccccgtcgtcgattctctcccggaaccttccagaaccgcctccgctaccaaaactgctatcccagtcatgttaagggctcagaccagccatcctttggatcctttgtctgccgctgaaatctctgttgcagtggcaactgttagggctgctggagctactcctgagctcagagacagcatgcgcttcattgaggtggttctgcttgaaccagataaacatgttgttgcgctggcagatgcatatttcttccctccttttcaaccatcattgctacctagaacaaaaggtggacctataattcctatgaagctgcctccaagaagggctagacttgttgtttacaacaaacggtcaaatgagacaagcatatggattgtggagctctctgaagtacacgcagcaactcgaggtggacatcatagaggcaaagtgatttcatctcaagttgttccagatgttcagcctccaatggatgctgtagaatatgctgaatgtgaagctgttgtcaaagactttcctccatttagagaggcaatgaaaaaaagaggtattgaagacatggaacttgtgatggttgatgcctggtgtgttggttatcacagtgatgctgatgctccaagcagaagacttgctaaaccacttatattttgcagaactgagagtgactgcccaatggaaaatggttatgcacgaccagttgagggcatccatgtactcgttgatatgcaaaacatgaaggtggttgaatttgaagatcacaaacttgttcccttacctctagctgatccattgaggaactatactcctggtgaaacaagaggtggtgttgatcgaagtgatgtgaaacctttacaaattatccagcttgaaggtccaagctttcgtgtcaaaggacactatatagaatggcagaagtggaattttcgcattggatttactcctagggagggcctggttatacattctgttgcctatgttgatggtagcaggggtagacgacctgtagcccacaggttaagctttgtagagatggttgtgccttatggagatccaaatgaaccacattatcggaagaatgcttttgatgcaggagaagatggtcttggtaaaaatgcacattccctaaaaaagggctgtgattgtttgggctttatcaaatacttcgacgctcactttactaacttcactggaggtgtcgaaacaattgaaaattgtgtatgtttacatgaagaggatcatggaattttatggaagcatcaggattggaggacaggtttagcagaagtacggaggtctaggcggcttacagtgtcctttatttgtaccgtcgctaattatgagtatggatttttctggcacttctatcaggatggaaagatcgaagctgaagttaagctaacaggaatccttagcttaggagcattacaacctggggaaactcgaaaatatggtacaaccattgccccgggtctctatgcaccagttcatcaacacttctttgttgctcgtatggacatggctgttgattgcaaatctggtgaagctttcaatcaggttgttgaggtaaatgttgaggttgagaaacctggggagaaaaatgtccacaataatgcgttttatgccaaagagacactgcttcaatcagaactgcaagcaatgcgtgattgcaatccccaaactgctcgccattggattgtgagaaacactagaactgtaaacagaactggacaattaacgggatacaagctagtacctggttcaaattgtttgccattagctggtcctgaggcgaagtttttgaggcgagctgcttttttgaatcacaatctttgggttactccttatacacatggagagatgtttcctggaggagagttcccaaatcaaaatccacgtgttggtgaaggactggctacatgggttaagcagaatcggccattagaagaaactgatatagttctttggtatgtatttgggatcacacatgttcctcggttggaagattggccagtcatgccagtggagcgcatcggttttatgcttatgcctcatgggtttttcaactgctcccctgctgtggatgttcctcccagtgcatgcgaattggatgctaaagacaacgatgctaaagacaacagtgtatcaaagccacttcaaaatggggtgctggccaagctctaagctaactacaaaatagtagtcttccccatcaccaaaagaagtcaagctctggatttgccgtgatgctgagaagggactgcatgcagcaagtgctaaccaaatactagattaatgtcactggttttgtgcatcatgaacatctagattgggttcttctggtttgatttgacatgttgatatgttgtggatttgaatgctgattaattgatcaatgtataaaaaaccttgttttccgttagtagcaggttcatgtgactgtatgtttt

SEQ ID NO: 4496 - DNA, 2788 bp, Euphorbia peplus
atatatagcccagcccccccccacactctctctttctctctgtatacagcccccactgtttagcattcaaatttttgattacggtgattctggaaggttctgatcggaggtgatattttgatcggaagagatttttttgggggaggtggtggaagtaagtgaagaagagaattgctgtatgtcactagattgtattgagacttatctaggtggaattggcgaactcgcaaaccctctacaatggcctcagctacgcaaaaaacgacgtcatcttcttgttgctccgttcaaactgactccgttactccccttcgccgtgatgctgctcctgctccctcggcttccgtcgtcgcgaatgccgtgcaggatcagcagcttggaaccaagaagcctgccatcgcgtccttgattcgacctgtcgattctcttcctgaagcttccaccaaagcgagcattccagtcatgttgagagctcaaaccagtcatccattggatcctttgactgctgctgaaatatctgtagctgtagcaactgttcgggctgctggagctactcctgaggtcagagatagcatgcgcttcatggaggtggttcttttggaaccggaaaaaaatgttgttgcattggcagatgcttatttcttcccacctttccaaccatccttgctgcctagattaaaaggtggtggtcctgtgattcctacgaaattgcctccaagaagagctaaactcattgtgtacaataaaaggtccaatgaaacaagtgtatggatcgtggagctatcagaagtccatgctgtaacacgaggtggacatcacaggggaaaagtgatttcttcagaagttgttccggatgttcagcctccaatggatgctgttgaatatgctgaatgcgaagcagttgtaaaagatttccctccatttagagaggcaatgaagaaaagaggcattgaagatatggaacttgttatggttgatgcctggtgtgtaggatatcatagtgacgctgatgctccaagtaaaagacttgcaaagcccctcatattctgtagaactgagagtgattgccctatggagaatggttatgcacgaccagttgagggcatctatgtgcttgttgatatgcagaacatgacggtgattgagtttgaagatcgtaaacttgttcccttgcctccagctgacccattgaggaattatactcctggggaaacaagaggtggtgttgatcgaagtgatgtaaaacctttacaaattattcagcccgaaggcccaagctttcgtgtcaatggacactttgtagaatggcaaaagtggaattttcgtattggattcacacccagagagggtttggtgatacattctgttgcatatgtcgatggtagtagggggagaaggcctgttgcccacaggttaagttttgtagagatggttgttccttatggagatccaaatgacccacattacaggaaaaatgcatttgatgcaggggaagatgggcttggtaaaaatgcgcatgctcttaagaagggttgtgattgtttgggcgttatcaaatactttgatgcccactttacaaatttcaccgggggtgttgaaaccattgaaaactgtgtatgcttgcatgaagaggatcatggaattttgtggaagcatcaagattggcgaactgggttagcagaagtacgaaggtctagacgactaacagtttcttttgtatgtacggttgctaattatgagtatggattcttctggcacttctatcaggatggaaaaattgaagctgaagttaaacttaccggaatccttagcttaggggcattacaacctggagagaccagaaaatatgggacaaccatcgctcctggtctatatgcaccagttcatcaacatttttttgttgctcgtatgaacatggctgtcgattgcaaacctggtgaagcattaaatcaggtggttgaagtggatgttaaagttgaggaacctggggagaacaatatccataataatgcattttatgctgaagagagattactcggatcagaattggaggcaatgcgggactgtaatcctcttagggcgcgccattgggttgtaaggaacactagaactgtcaataggacaggacaattaaccgggtacaagctggtacctggttcaaactgtttgcccttagctggtcctgaggccaagtttttgaggagagcagcttttttgaagcacaatctttgggtcacacctttttcaaatgagcaaatgtttcctggaggagagttccctaatcaaaatccacgtgttggagaaggcctgtctacatgggtaaagaagaatcgatccctggaagaaactgatgtagttctttggtatgtgtttgggatcacacatgttcctcggctggaagattggccagtaatgccagtagagcggattggttttatgctaatgccacatggattcttcaactgctctcctgctgtggatgtccctcccagctcatgtgaaatggatacgaaggacaacgatgttaaagagaataccatagttaagcctttgcaaaatgggttgttggctaagctctgaacttacttctaacttggcatggcaaatatgctcatgctatgagcagataactgttacgggtttttttttttgcatcatcgtctgggtacttagtcaattaggcttgcttttgtttgatggtttgatacatttatatttatgttgatatctgtgaatttgaatgttgttggattagttgatgattgacagtggataaaaataatgtttg

SEQ ID NO: 4497 - DNA, 2836 bp, Citrus sinensis
ccacttctcttttttataaaaggccacccctcggatctcgattcttcttcagtttctttcactctcttttcttttagaaagaaagtgattttgaatttgctgttccgtggcctgtggctgtggctgtgtgtgagtgaaaggggatagtgttaagaggaggacgcagcgataatttgctctgtatgtcagtggaatactactgtgataaattctgcggtggatacggtgcgcttgctaagcctttacaatggccacaactcaggaaaagacgacgcctacttgttgcattaacaactcctccaagccttccgccactgaacccgtcaaagattggaaggtttccgggtcggatccttccttggatcctgtccgtaagcgtgactccgttaccactctcatccgtcccgttgaatccctccctgatcctcctcctcctcctaacaccatttcctcaaccaaaggaattccaatgatggtcagggcccaaacaagccatcctttagaccctttatctgctgctgagatctccgtggcagtagccactgttcgggctgccggagcaacccctgaggtgagagacagcatgcggtttgtggaagtggttcgagtggagccagataaacaagtggttgcattagcggatgcttatttcttccctccttttcagccgtcattaattcccaggacaaaaggtgggccaataatccctactaaacttcctcctagacgagcaagacttgttgtttacaacaaaaggtcgaatgagacaagcatatgggttgttgaactgtcggaggttcatgctgcaactcgaggtggtcaccatagaggaaaagttatttcatcgaaagttgttccagatgtccagcctcccatggatgctgtggaatatgctgaatgtgaagctgttgtcaaagactttcctccatttcgggaggcaatgaaaaagaggggtattgaggacatggaccttgttatggtggatccatggtgtgtagggtatcacagtgatgcggatgctccaagtcgcagacttgctaaaccgctcatcttctgcagaactgagagtgactgcccaatagaaaacggttatgctcgtccggtggaaggaatccatgtgcttgttgatatgcagaatatggtggtgatcgagtttgaagaccgtaagcttgttcacctaccaccagctgatccgttaagaaactacacagctggtgaaacaagaggaggtgttgaccgaagcgatataaaaccgcttcagattgttcagcctgagggtccaagcttccgtgttaatggacattttgttgaatggcagaagtggaatttccgtattggttttactcctagggaaggtttgatcatctattctgttgcgtatgttgatggtagtcgaggtcggaggcctgtagcccacaggttaagctttgttgagatggtggtcccttatggggatccaaatgatccccattacaggaaaaatgcatttgatgcaggggaagatgggctgggtaaaaatgcacattctcttaagaagggttgcgattgtttgggctacatcaagtattttgatgcacatttcaccaattttgctggaggtgttgatacaattgagaattgtgtttgtttgcatgaagaggaccacggtatcttatggaagcatcaggattggagaacaggattggcagaagttcgaaggtctagaaggctatcagtgtcatttatatgtactgtggccaactatgaatatgcatttttctggcacttttaccaggatgggaagattgaagctgaggttaagctcacaggaattctcagcttaggtgcactgcaacctggagaagtgagaaaatatgggactattattgcacctgggttatacgcacctgttcatcaacacttttttgttgctcgtatggacatggcggttgattgcaagcctggtgaagcacataatcaggtagttgagatgaatgttaaagtggaagaaccagggaagaataatgttcacaataatgcattctatgctgaagaggaactgctcaaatcagaattgcaagcaatgcgtgattgtaatcctttaactgctcgtcattggattatcagaaacaccagaactgttaaccgtactggacagctaactggttataagttagtacctggttcaaactgtttgccattagctggctctgaggcaaaagttttaagacgagctgctttcttgaagcataatctttgggtcactccttatgcacatgatgaaatgtatcctggaggagagtttcctaatcaaaatcctcgagttggcgaaggattggctacttgggttgagcaaaatcgctctctggaagaaactgacatagttctgtggtatgtatttggagtgactcacattcctagactggaagactggcctgtgatgcctgtggatcgcattggttttatgctcatgccacatgggttcttcaattgctcaccagcagtggatgtccctccaaatgaaagcgatttggatctcaaggacactgcgatcgccgaaaagcccgtccagaatgggctgcttgccaagctctgaatgtatatccctggttggttgagttcgtggctgcttgctttcttcttttagtgggttgtttgtttaaaaatttaggtctttggacaacttcaggcaaataataattttttatccaataactaaagtactatttgaatggacgtcgtgtggtgttgttacttgtttgttaacaagtatttatttcctttagaaaaaaaaaattattattattattatgaattggtaaaatttgtttttaagaacttattattattattattt

SEQ ID NO: 4498 - DNA, 2903 bp, Glycine max
accaaactccactaaaccgagttcccaccccatcgctttcctctcccattgggaaaaaaaaaaaagcattgaagactacttacgtatccatcttccaagcataagtatctctcattattctacatctcagataaaaaaaaaaaaaagaaagaagaaaaaaagctactactagtattttgttttgttttctttataataaaaacacaacctcgtgcgattccattgaactgttgttgttgctgctgcgcgcagttggtggtagtggtggtggcggaggcggtggcgaagagtggaaacaacaactggcattattgttgctgtatgtcagtggaatattacagtgggatttactacgccgagttcgctaaccctctccaatggccacaactcaggaaaaaacgacgccatgttgcgcccctcaaaataacaacaaggtcgcagcaacatcatcttcttcttcagcgccaccccaacaacaatcacaacaacaacaacgaccctctgttgccaccttcatttccgccatcgattctcctcccaaaaccgcttctgccaaaggtatcactgtcatggtgagagctcaaaccagccaccccttggatccactaactgctgctgaaatatcagtagctgtagcgaccgttcgagcagctggagcaacacctgaggtgagggatagcatgcgctttattgaagtagacctggtagaaccagaaaagcaagttgttgcattagcagatgcatatttcttccctcctttccaaccatcactgctccctaggacaaaaggtggacctgtgattccaacaaaacttccaccaaggaaagcaagactagttgtttacaataaaaggtcaaatgagactagcatatggattgttgaacttagagaagttcatgcagcaactcgaggaggacaccataggggcaaagtggtttcatctactgttgttccagatgttcagcctccaatggatgctgtggagtatgcagagtgtgaagctgttgtaaaggactttcctccatttcgtgaagcaatgaagaagagagggattgaggatatggatctggtgatggtggatccctggtgtgctggatatcacagtgaagttgatgctcctagccgaagacttgctaaaccactaatcttttgtaggactgaaagtgactgccccatggaaaatggctatgcccgtcctgttgatggaatccatgtacttgttgacatgcaaaatatggttgttcttgaatttgaagaccgtaaacttgtcccacttccacctgctgatccactaagaaattatacttctggtgaaacccggggaggagttgaccgaagtgatgtgaaacccttacagattattcagcctgaaggtccaagttttcgtgttaatgggcacttcattgaatggcagaagtggaattttcgtattggattcactcctagggagggtttggtaattcattcagtagcctatattgatggaagtcggggacgaagacctgtggcccatagattgagctttgttgagatggtagtcccgtatggagatcctaatgatcctcactataggaaaaatgcttttgacgctggggaagatggcctgggtaaaaatgctcattctctcaagaagggctgcgattgtttaggctatatcaaatactttgatgcgcacttcacaaacttctatggaggtgttgaaacaattgagaactgtgtttgtttgcatgaagaagatcatggtattttatggaagcatcaagattggagaacaggattggctgaagttcgaaggtctagaaggctgacagtgtcttttatatgcactgtggctaactatgagtatggatttttctggcacttttatcaggatggaaaaatagaagcagagatcaagctcacaggaattctcagcttaggatcacttcaaccaggtgaaactcgaaaatatggcacaaccattgcacctggactatatgcgcctgtccaccaacatttttttgttgctcgtatggacatggcagtagattgcaagcctggtgaagcatttaatcaggtcgttgaggtaaatgtcaaagttgaaaagccaggagacaataatgttcataacaatgcattttatgccgaggaaaaactgcttaaatcagaattggaagcaatgcgtgattgtgatcctttatctgctcgtcactggattgttaggaacacaaggactgtaaaccgaactgggcatctaactggttacaagctagtacctggctcaaattgtttacctttagctggctcagaggctaagtttttgagaagagcagctttcttgaaacacaacctttgggttactccttatgcccgtgatgaaatgcatcctggaggagagttccctaatcaaaatccgcgcgttggagagggtttggctacttgggttaagcaaaaccgatcattggaggaagctgatatagttctttggtacgtatttggagtgacacacattcctcgattggaagactggcctgttatgcccgtggaacgcattggtttcatgcttatgccgcatgggtttttcaattgctcgcctgctgtagatgttccacctaacccaagtgatttggatgacaaagagaatggcttgccagccaagcctattcagaatgggctaattgccaagctttgaaaggataaaaaatgaggatctgccactttacgtggttatgttcaaattattaaatattaaatactattgtttgggctggtgttcaaaccttagctggataattaagaaacgcctatattgtataatttgtatgtgtttgttgcatggtagatgctgggtaactaacttaatgtcttttgatttgatgtggaatctatgctgaagcctcattgtgcgaagttttaaataaat

SEQ ID NO: 4499 - DNA, 3087 bp, Prunus mume
ggccttgttcacttgtttgtttgtttgtttattaccaaacaaaagcaaaaaaaaagaagcaaaaaaaggataatatataaacttctcaaccccaccgccttttgtactctctcttttgtatccttcttcaaattagctagccagctagctatcagattcagcagcagattggttgacatcaattttcccgggaaagtgagagagaaagagcgagaaagttcgagagcgttttcattccctcaatctgttgctgagagaggcattgctgtatgtcagtggaaaactactccagtgacagttactacggtggatacggtgagctcgataacccttcgcaatggccgcaactcaggaaaaagcgacgccttgttgcctggacgctgcacccgccaaatcctcggctctgcttcgcaaggcctccgacccgatgcgcgattggaccgtttcgggctccgatccgtcccaggatccgatccgcaacagagctgctgtgccgaccttgatccgacccatcgagacccttcctgctccttctacaaacaccactgccaccaaaggcatcccagtcatgttgagggctcaaaccagccatcctttggagcctttatctgctgctgaaatctctgtggcagtggccactgtcagggcagctggagcaacccctgaggtgagggatagcatgcgctttgttgaagtggctttggtagaaccagataaacacgttgttgcattggcagatgcatatttcttccctcctttccagccatcattgcttcccagaactaaaggtggacctatgattcctagtaaacttcctcccaggcaagcaagacttgtggtttataacaaaaagtccaatgagacgagcatctggatcgttgaactatcagaagttcatgctgcaactcgaggtggtcaccataggggtaaagtcatttcatccgaagttgttccagatgttcagcctcccatggatgctatggagtatgctgaatgtgaagctgttgtaaaggactttcctccatttcgggaagcaatgaagaagaggggtattgaggatatggaccttgtgatggtggatccttggtgtgctggataccacagtgaagctgatgctcctagccgcaggcttgcgaaaccgcttatcttctgtagaactgagagcgattgccctatggaaaatggttatgctcgtccagttgaaggaatccatgtgcttgttgatatgcaaaatatggtggttcttgaatttgaagaccgcaaacttgttcccctgcctcctgctgatccattgagaaattatactccaggtgaaacacgaggaggtgttgatcgaagtgatgtgaaacctctacagataattcagcctgaaggaccaagttttcgtgttaatgggcactttgttgaatggcagaagtggaatttccgtattggttttacttccaaggaaggtttggttatctattctgtcgcgtatattgatggtagcagaggccggaggcctgtagcccataggttaagttttgttgagatggtggtcccttatggtgatccaaatgctccgcattacaggaagaacgcatttgatgcgggagaagatgggctgggtaaaaatgcgcattctcttaaaaagggttgtgattgtttaggctatattaagtacttcaatgcacactttacaaatttcactgggggtgttgaaacaattgagaattgtgtttgtttgcatgaggaggatcatggaattttatggaagcatcaggattggagaacaggtttagcagaagttcgacgatctagaaggctgacagtatcttttatttgcactgtcgctaactatgagtacggattttactggcatttttatcaggatgggcatattgaagctgaggtgaaacttacaggaattctaagcttaggtgcactgcaaccaggagaaacccgaaagtatggtacaactattgcacctggactatatgcaccagtgcatcaacacttttttgtagctcgtatggacatggcagttgatagtaagcctggtgaaactttcaatcaggtggttgaagtaaatgttaaagttgaagaaccaggaaagaataatgttcacaacaatgcattctatgctgaggaaaaattgctgaaatcagaattgcaagcaatgcgtgattgtaatcctttatctgctcgccattggattgtcagaaacaccagaaatgtcaaccgcaccgggcagctaacaggttacaagctagtacctggttcaaattgtttaccactagctggttctgaggcaaaatttctgagaagagctgcttttttgaagcataatctttgggtcacatcttatgcacgcgatgaagtgtatcctggaggagaatttcctaatcaaaatccacgcattggggagggattggccacttgggttaagaaaaatcggtcactggaagaagctgacattgttctttggtatgtatttggagtgacacacattcctcgactggaagactggccggtgatgcctgtagaacgtattggttttacgctcatgccacatgggttctttaattgctcaacggcggtggatgtccccccgaatacatgcgatttggacctcaaggacaatgggatgacagcaaaacctattcagaatggactactggctaagctctaaaaacgaagaggacgatgatgcatgctacagagatattcgaccaaaacctatttaggtagtcaagtggcatgcttatggtcagattagttatattttaatatagatcaacgaacttgttctcttattataaaacaatgtatggtgctgacatatctttgtccaactcttttctttggtgctcaaactgaggctgatcatagcatgacatgagtcatggtcgcgctgtgtgtggcttccattccatatacaagaagcttctcacatttggtttgattataatatccctgaaatgattgtcatttaaacgttgcaatcttactcttattatatagagctcttccagttatcggaggacgtaatattatctcacgcacagtttttttatttttgttaattataaatgtcaacttttcaag

SEQ ID NO: 4500 - DNA, 2810 bp, Gossypium hirsutum
atttcctccttttgtcttaaactttctattcttccatttggcttccgaattttgaaggttagaaactgagaatccagaccagagacatagtacttgctgtatgtcactagaatacttcagtgacaatttctacggtggatactgtgaggttgctaaccctttgcaatggcctcaactcaggaaaaagcgacgcacaagaacaacaccccttctccttcttcttcatcctctgctcaggttttgcagaactggagtcttgctgctccctccgaggatcccatccccaaggcagcttccatggcagccctgatccgacctgctgagaccatcgccgatcctcctgctactaagactactaccagcaaaggaatttcaatcatgccaagggctcagaccagccatcctctggatccattatctgctgctgaaatctcggtggcggtggcaactgtaagggcagctggagcaaccccagaggtgagagatagcatgcgctttattgaggtggttttggtggaaccagataagcatgttgttgcattggcagatgcatatttctttcctcctttccagccttcattactccctaggacaaagggtggacctgtgattcctagtaaacttcctccacggaaagcaagacttgtggtttacaacaaaaggtccaatgagactagtatatggatagttgaattgtcagaagttcatgctgcaactcgaggaggccaccataggggcaaagtcatttcgtctaaagttgttccaaatgtccagcctcccatggatgccatggaatatgctgaatgtgaggctgttgttaaggattttcctccatttcgagaggcaatgaagaagaggggcatcgaggatatggatcttgtgatggttgatccctggtgtgcaggatatcatagcagtgctgatgcccctagccgaagacttgctaaaccacttatcttctgcagaactgagagtgactgccccatggaaaatggttatgctcgtccggttgagggaatccatgtccttgttgacatgcaaaatatggtggtcattgaatttgaagaccgcaaacttgttccccttccgccagctgatcctttaagaaattacactgctggtgaaacacgaggaggtgtcgatcggagtgatgtgaaaccactacaaattattcagactgaaggtcccagttttcgtatcaatggaaattttattgcatggcagaagtggaatttccgaattggtttcactcctagggagggtctggtaatctattctgttgcttatattgatggtagtcgtggtcggaggcctgtagctcatcgattaagttttgttgaaatggtagttccttatggtgatccaaatgatccgcattataggaagaatgcatttgatgcaggagaagatgggctgggcaaaaatgcacattctcttaagaagggttgtgattgtttgggatatatcaagtactttgatgctcattttacaaatttcactggaggtgttgaaacaattgagaattgtgtttgtttgcatgaggaggaccatggtatcttatggaagcatcaagattggagaactggtttagcagaagtccgccggtcaagaaggctaacagtgtcgtttatatgcactgtggctaattatgagtatggatttttctggcatttctaccaggatggtaaaattgaagctgaggttaaactcactggaattctcagtttaggagctttgcagcctggtgaaactcggaaatatggcacaaccattgctcctggattatatgcccctgttcatcaacactttttcgtggctcgcatggacatggcagtagattgtaaacctggtgaagcatttaatcaagttgttgaggtgaatcttaaagttgaagaaccagggaaggataatgttcataataacgcattctatgctgaagaggaactactgagatctgaactgcaagcaatgcgtgattgtaatccgttgactgcacgccactggattgttagaaacacaagaaatgtcaaccggactgggcagctaacaggtttcaaactggtacctggttcaaattgtttgccactggctggatctgaggcgaaatttctaagaagagctgctttcttgaagcataatctttgggtcacaccctatgcacatgatgaaatgtatccagggggggagtttccaaatcaaaatccacgtgttggggagggattagctacttgggttaagcagaatcgttctttggaagaagctgatgtagttctgtggtatgtctttggagtgatacatattcctcggctggaagactggcctgtcatgccggttgatcgcattggctttatgcttatgccacatggtttctttaactgctccccggcggtcgatgttcctcctagcacgactgatctggagctcaaggacaacgacattgcaacaaagcctatccaaaatgtgataatcgcgaagctttgatttcatctctgcagtctgcaaaatttttagcaaactacaaacaattgagccattgattggcctcacattattaaaaaagtatgatcatctgcatttgtttgtcctcattttttaaccgcccttgaacctttgtgatataattaactctggttgaatcctaatgtaatacttcactctgaataattggatcgattgtagttagttaacatttaaggtgtgttaaaaaaattaacttcaatacaaaatatatatatatattggtgctgtggtatacccattgtgtgggtgaaagaaataaaatatatttaagcaattcattttcaaaaaga

SEQ ID NO: 4501 - DNA, 2866 bp, Olea europaea
acgcgggggcattactgaatctatagatacatagagatacaggcgcgttttgatcgaagggaagacctagatttcagtcacaggtttgcactaattttggattgtgataaattttcagattgaggtttggcggtggtggttgtggtggtgccgtggcggtggcggtggaagtgtgaagagtacagtggttgctgtatgtcagtagattgcgactcgcattgcggtggattgggtgagcttgctaatcagttacaatggccacaactgcgaaaaaggcgacgcctactaatgtttgttgcgctgccgatggtggaaaatcggcggctgccgttgccggtgtccgccgtgaggcggcttctgcctttgcctctgctgttgattggagtgttccgtctgtgactgccgaagatctgcaggacaagaaagctgctgccatgacgtctgtgatccgacccgagccttcatctaacgccgctactaaagggatccaggttatgcctagggctcaaacggttcatcctttggatcctttatctgctgctgaaatctctgtagccgtggcaactgtcatggcagctggtgccacccctgaggtgagagacggcatgcgttttatcgaagtggttctactggaaccagataaacatgtggttgcactggcagatgcctatttcttttcacctttccaaccatcgttgttacctagaaccaaaggaggactgacaattcccagcaagcttcctccaaggcgggctagactagttgtctacaataaaaaatcgaatgagacaagtatatggattgttgaactaactcaagtacatgcaacaactcgaggtgggcatcacaggggaaaagttatctcatccacagttgttctggatgttcagccacctatggacgctgtggaatatgctgaatgtgaagctgttgtcaaagattaccctccatttatagaggcaatgaagaaaaggggtattgatgatatggatctagtcatggttgatccttggtgtgttggttatcaccgtgagtctgattctcctagtcgtagacttgcgaaaccacttatattttgcagaaccgagagtgaccgtcctttggaaaatggctatgcacggccagtggaaggaattcatgttcttgtcgatatgcaaaatatggtagttatcgagtttgaagatcgtaaatttgtccccttacctccagctgatccattgaggaattacactcctggtgaaacaagaggaggggttgatagaagtgatgtgaaacccctgcaaattgttcagccagagggacctagctttcgagttaatggacgttatgtagagtggcagaagtggaactttcgggttggtttcactccgagagagggtttagttatccactcggttgcctatgttgatggtagtcggggtcgaagacctatagctcacaggttgagctttgtggagatggttgttccctatggggatcccaatgatccacattacaggaagaatgcatttgatgctggggaagatggccttgggaagaatgctcactctcttaagaagggatgtgattgtttgggatatataaagtattttgatgctcatttcacaaattttactggaggagttgaaacaacggaaaactgtgtatgtttgcacgaagaggattatggaatcctgtggaagcatcaagattggagaacaggattggcagaagttcgaagatcaagacgtcttaccgtttcttttatttgcactgttgccaattatgaatatggattctattggcacttttatcaggatgggaaaattgaagcagaagttaaacttactggaattctcagtttaggagcactgcaaccaggagaatctcgaaaatatggcacaacaattgccccaggattatatgccccagttcatcagcacttttttgttgctcgtatggatatggcagttgactgcaagcctggagaagcacacaatcaggttgttgaagtgaatgtcaaagttgaagaacctggaaaggataatgttcacaacaatgctttttatgctgaggaaactttgcttagaagtgaattagaagccatgcgtgattgtgatcctttctcagctcgccattggattattagaaacacgagaactgtaaataggaacgggcagctgacgggctataaactggtacctggttctaactgtctcccactggctggtccggaggccaagtttatgagaagagctgcatttttgaagcataatctatgggttacacaatatgagaggggggaggactttcctggaggagagtttcctaatcagaatcctcgcgttggagagggattggcttcttatgtgaagcaaaatcggtctctggaagaagccgatattgttctatggtatgtttttggaatcacacatgttcctcggttggaagactggccggttatgcctgtggaacgcattggttttatgcttcagccacatgggttcttcaactgctccccagcagtggacgtcccgcctaatgcttgcgagacagatgccaaggagaatgacgcaaaagacaacagtggagcaaagtctatcccatcggctgttatggcaaagctttgaagggatagccatgggatcactctctttcatgagaaaaattctcactgtcactcttatgaataccttatgtttcagattatgtggaatattttagttttacgtatgttggatctatatgtttatatagaaatggatttcactgcttccgtttgggtccgtgttatagagtctcttactagttgttaagagacttttacttgtttatttgctttcttgagtcgaacatttgcttaaactatgctggaaaatttttataa

SEQ ID NO: 4502 - DNA, 2826 bp, Gossypium raimondii
agccaatcgaaataccatctaagcccatttctcccttgtctttgtcttagaaccaatcaatttcctccttttgtcttaaactttctattcttccatttggcttcctaattttgaagtgaaggttagaaactgagaatccagaccagagacatagtacttgctgtatgtcactagaatacttcagtgacaatttctacggtggatactgtgaggttgctaaccctttgcaatggcctcaactcaggaaaaagcgacgcacaagaacaacaccccttctccttcttcttcatcctctgctcaggttttgcagaactggagtcttgctgctccctccgaggatcccatccccaaggcagcttccatggcagccctgatccgacctgctgagaccatcgccgatcctcctgctactaagactactaccagcaaaggaatttcaatcatgccaagggctcagaccagccatcctctggatccattatctgctgctgaaatctcggtggcggtggcaactgtaagggcagctggagcaaccccagaggtgagagatagcatgcgctttattgaggtggttttggtggaaccagataagcatgttgttgcattggcagatgcatatttctttcctcctttccagccttcattactccctaggacaaagggtggacctgtgattcctagtaaacttcctccgcggaaagcaagacttgtggtttacaacaaaaggtccaatgagactagtatatggatagttgaattgtcagaagttcatgctgcaactcgaggaggccaccataggggcaaagtcatttcgtctaaagttgttccaaatgtccagcctcccatggatgccatggaatatgctgaatgtgaggctgttgttaaggattttcctccatttcgagaggcaatgaagaagaggggcatcgaggatatggatcttgtgatggttgatccctggtgtgcaggatatcataccaatgctgatgcccctagccgaagacttgctaaaccacttatcttctgcagaactgagagtgactgccccatggaaaatggttatgctcgtccggttgagggaatccatgtccttgttgacatgcaaaatatggtggtcattgaatttgaagaccgcaaacttgttccccttccgccagctgatcctttaagaaattacactgctggtgaaacacgaggaggtgtcgatcggagtgatgtgaaaccactacaaattattcagactgaaggtcccagttttcgtatcaatggaaattttattgcatggcagaagtggaatttccgaattggtttcactcctagggagggtctggtaatctattctgttgcttatattgatggtagtcgtggtcggaggcctgtagctcatcgattaagttttgttgaaatggtagttccttatggtgatccaaatgatccgcattataggaagaatgcatttgatgcaggagaagatgggctgggcaaaaatgcacattctcttaagaagggttgtgattgtttgggatatatcaagtactttgatgctcattttacaaatttcactggaggtgttgaaacaattgagaattgtgtttgtttgcatgaggaggaccatggtatcttatggaagcatcaagattggagaactggtttagcagaagtccgccggtcaagaaggctaacagtgtcgtttatatgcactgtggctaattatgagtatggatttttctggcatttctaccaggatggtaaaattgaagctgaggttaaactcactggaattctcagtttaggagctttgcagcctggtgaaactcggaaatatggcacaaccattgctcctggattatatgcccctgttcatcaacactttttcgtggctcgcatggacatggcagtagattgtaaacctggtgaagcatttaatcaagttgttgaggtgaatcttaaagttgaagaaccagggaaggataatgttcataataacgcattctatgctgaagaggaactactgagatctgaactgcaagcaatgcgtgattgtaatccgttgactgcacgccactggattgttagaaacacaagaaatgtcaaccggactgggcagctaacaggtttcaaactggtacctggttcaaattgtttgccactggctggatctgaggcgaaatttctaagaagagctgctttcttgaagcataatctttgggtcacaccctatgcacatgatgaaatgtatccagggggggagtttccaaatcaaaatccacgtgttggggagggattagctacttgggttaagcagaatcgttctttggaagaagctgatgtagttctgtggtatgtctttggagtgatacatattcctcggctggaagactggcctgtcatgccggttgatcgcattggctttatgcttatgccacatggtttctttaactgctccccggcggtcgatgttcctcctagcacgactgatctggagctcaaggacaacgacattgcaacaaagcctatccaaaatgtgataatcgcgaagctttgatttcatatctgcagtctgcaaaatgtttagcaaactacaaacaattgagccattgattggcctcacgttattaaataagtatgaacatctggatttgtttgtcctcattttttaaccgcccttgaacctttgtgatataattaactctggttgaatcctaatgtaatacttcactctgaataattggatcgattgtagttagttaacatttaaggtgtgttaaaaaaattaacttcaatacaatatatatatatattggtgctgtggtatacccattgtgt

SEQ ID NO: 4503 - DNA, 2780 bp, Malus domestica
gcgagaaagtttcgtttcgtttcaatctctgtgcctgtggggttgctgagagtgagacgacgcagtgctgtatgtcagtggaatactactccagtgactgttactacggcggattcggtgagctcgataacccttcccaatggccacaactcaggaaaaagcgacgcctcgtgacgctgcatccgccgaatcctcggctctgctccgcaaggccggcgagccggttcgaaattggaccggttcggcctccgatctggactcggatccgatccgcaccagagcgtccgtgccgaccttgatccggcccatggagtcccttcctgctccttctactaacaccgctgccaccaaaggcattccagtaatgttgagggctcagagcagccaccctttggagcctttatctgctgctgaaatctcagtggcagtggccactgtcagggcagctggagcaactcctgaggtgagagatagcatgcgctttgttgaagtggctttggtagaaccagataaacgtgtcgtggcactcgcagatgcgtatttcttcccacccttccaaccgtcattgcttcccagaaccaagggtggacctatgattcctagtaaacttcctccgaggcaagcgagacttgtggtttataataaaaaatcaaatgagacgagcatctggattgttgaactatcggaggtgcatgcggcaactcgaggtggtcaccataggggtaaagtcatttcatccgaagttgttccagatgttcagccccccatggatgctgttgaatatgctgaatgtgaagctgttgtgaagaactttcctccatttagggaagcaatgaagaagcggggtattgaggatatggaccttgtgatggtggatccctggtgtactggatatcacagtggtgctgatgctcctagccgcaggcttgctaaacctctcatcttctgtcgaactgagagtgactgccctctggaaaatggttatgctcgtccagttgaaggaatccgtgtgctagtggatatgcaaaatatggtggttcttgagtttgaagaccgtaaacttgttcccctgcctcctgctgatccactgagaaattatactccaggtgaaacacgaggaggtgttgatcgaagtgatgtgaaacccctacagataattcagcctgaaggaccaagttttcgtgttaatgggcactttgttgaatggcagaagtggaatttccgcattggttttacctccaaggaaggcttggttatctattctgtagcatatattgatggtagtcgaggccggaggcctgtggctcataggttaagttttgttgagatggttgttccttacggagatccaaatgatccacactacaggaagaatgcatttgatgcaggggaagatgggctgggtaaaaatgcacattctcttaaaaagggttgtgattgtttaggctatatcaagtactttgatgcgaactttacaaatttcaccgggggtgttgaaacaattgaaaattgtgtttgcttgcatgaggaggatcatggaatcttatggaagcatcaggattggaggacaggtttagcagaagttagacgagctagaaggttgacagtgtcttttatttgcactgtcgccaactatgagtacggattttactggcatttttatcaggatgggcatattgaagctgaggtgaaacttacaggaatactaagcttaggtgcactgcaaccaggagaaacccgaaagtatggtacaactattgcacctggactatatgcacctgtgcatcagcacttctttgtggctcgtatggacatggcagttgatagtaagcctggtgaaactttcaatcaggtggttgaagtaaatgtcaaagttgatgagccaggaaagaataatgttcataacaatgcattttatgctgaggagaaattgctgaaatcagaactgcaagcaatgcgcgattgtaatcctctatctgctcgccattggattgtcagaaacaccagaaacgtcaaccgcactgggcagctgacaggttacaagctagtacctggctcaaattgtttaccattagctggttctgaggcaaaatttctgagaagagctgcttttttaaagcataatctttgggtcacatcttatgcacgtgatgaaatgtatcctggaggagaatttcctaatcaaaacccacgtattggggagggattggccacttgggttcagaaaaatcggtcgctggaagaagctgacattgttctttggtatgtatttggagtgacacacattcctcgactggaagactggccggttatgcctgtggaacgtattggttttacgctcatgccgcacgggttctttaattgctcaccggcggtggacgtccctccgagcacatgcgagttggacctcaaggacaacgggatggctgcaaaacctattcagagcgggttactcgccaagctctgaaaggatgacgtacctacgtacgaatcacagggagagattgtacgtacccatctgtatttaaataatgcggcgtgcttatgagctcctaattatttttaaaggtagacgatgaactgctaaccatgttataaaacatctggtgctcaaacgtctctgtcgacccctttgaatacacaatgacaatgtgatgctccgaatgggggtggctttattttattttattttttaatttatgtattgtaatatctgaaataaatggatttcattttaaacatggttgttaatatttgttattatataattcttccgccca

SEQ ID NO: 4504 - DNA, 2908 bp, Cocos nucifera
gtgagccaaatctctccgccacctctgtttctattactggcggcgaaccggaaggagaaagagccgtgagtgcgagaagggaaagaaaggagtggaggcaggtattccagctctctttttgagagagaggaaaggaaggattataaacgagagagttgggagaggaagagggggggggggggggggggggggaggcgagaggagagggttcgagagagagggaaaggcaacggaggcctgctgtatgtcagatcgtagtgagggatactacggcggattcggtgagctcgcgaaccccctgcaatggccacaactgaggaaaaagcgacgccctgctgcgcttccgctacctccggcggcgacggaggcctccgacgggaggctgccggggccgtccgagaatggacggccggcgagaagcagtctgtggcaacggcggccatgagctctctgatccaccccgtcgaggagattccggatccgtccgcgaagccttccgccaaggggcttccgatgatgatgagggcccagacaaaacaccctttagacccattatctgctgctgaaatctctgtggcagtagcaactgttagggctgctggagcaactcctgaggtgagagatagtatgcggtttgttgaagttgttcttctggaaccagagaaacatgtggtggcattagctgatgcctacttttttccccctttccaaccatcgctactccctagaatgaagggtggccccgtcattccaagtaagcttcctgctaggagggccaggctcgttgtctataacaagcaatcaaatgagacaagcatctggattgttgaactatcagaagtacatgcagcaactcggggtggccatcacaggggaaaggtcatttcatcagaagttgttcctgatgtccagcctcctatggatgctgtggaatatgcagaatgtgaagctgttgtgaaaagttaccctccattcatagaggccatgaaaaagagaggtatagaggatatggatcttgtgatggtagatgcctggtgtgctggctatcacagtgaagctgatgctcctagccgccggcttgccaagccactaattttttgtagaactgagagtgattgccccatggaaaatggttatgcacgtcctgttgaaggcattcatattcttgttgatattcagaataatgtggtaattgagtttgaagatagaaaactggttcctctacctccagcagatccattaagaaattatactcctggagaaacacgaggaggtgttgaccgtagtgatgtgaaacctctgcatattcttcagcctgaaggcccaagttttcgagttaatggtcactttgtagaatggcagaagtggaattttcgaattggttttactccaagggagggtttggtaatttattctgttgcatatattgatggtagtcgtggtcggagacccgtagctcacaggttgagttttgttgagatggtagttccatacggagatccaaatgaaccacattaccgtaagaatgcatttgatgctggagaagatggccttggaaaaaatgcacactcacttaaaaagggctgtgactgtttgggctatattaagtactttgatgcccattttacgaattacaccggtggcatagagactattgaaaattgtgtttgcttgcatgaagaggaccatggaatcttatggaagcatcaagattggagaacaggcttagcagaagtaaggcgatcaaggaggcttactgtgtcatttatatgtacagtagctaattacgagtatggctttttctggcatttctatcaggatggtaaaattgaagcagaagtgaaactaactggaattctcagtttaggtgcattgcttcctggtgaatcgagaaaatatggtacaaccattgctcctggtttatatgcacctgttcatcagcatttctttgttgcacgtatggacatggctgttgattgtaagcctagtgaagccttcaatcaggtggttgaggtgaatgttaaagttgaaggaccaggccaaaataatgttcataacaatgcattttatgctgaagaaaagctcctcagatctgaattgcaagctatgcgtgattgtgatccttcatctgctcgccactggattgtaaggaacacaagaactgttaatcgaactggccaacctacaggatacaagcttgtgcctggttctaattgtctacccttagctggtccagaggcaaaatttttgagaagagctgcatttttgaagcataatctttgggttacaccatataatcgtgatgagatgtaccctggaggagagtttcccaatcaaaatccacgcccaaatgagggattagcgacatgggttaagaagaacaggtcacttgaggaaactgacattgttctctggtatgtatttggggttacccatattccaaggttggaagattggcctgtcatgcctgtggaacgcataggttttatgctcatgcctcatgggttcttcaattgttcccctgctgtcgatgtgcctcctggtcccagtgaggtggaggtcaaggacaataatggaacgccaaagttgattcagaacggactgcttgcaaagctgtgaggggagatgtggaaggagaaactggaggaaacaaaaagaactttaatgttgtgcctgcaggatgtctgaaagttgcaataaatatgactttggattgcgttgtttgttgttttctttattggcatatgttcgacctagctcgtacttcatttaagccataggtctttcctgcagctagaagaaattccattgaacctataaattcttagggtatgtttgattgaaatgagaattgcttggaaaacatatttttcttggacaatctagagcttgcttggcattattaaaa

SEQ ID NO: 4505 - DNA, 2851 bp, Populus trichocarpa
gcaaaatcctcatccttctttattctctcactcaactcaactcaactcaactcggtctcactcgcaccaatccatcttctttctttctcggtatcgtataaaaaagagaaggaaagggcttgagcaagaagtcgagaaagtttaggtgaagaatcaaatcactcaactaattgaatcctaccttacctttgctagctagctagagctacacaatttttagttgtagaatttttttgctgtatgacagcgaaatactacagtgacagttattacggtgagcttgctaaccctttacaatggccacagctcaggaaaaggcgacgcctacttcctttgcgtctgctgctggaaaagcagcagcagcagatggggtcttgcagagctggaccgatccctcccaggatcccatcaccaagagatcacccacctcggtttccctgatccgtcctgtttcctccctctcacctgatcctaatactaaagggattacgataatgacgagggcgcaaacctgccaccctttagaaccactaactgctgctgagatttctgttgcagtggcaactgttagggcagctggagcaacccctgaggtgagggatagcatgcgatttgtggaagtagttttggtggagcctgtcaagcacgtggttgcattggcagatgcgtatttctttcctcctttccagccttcattacttcccagaacgaaaggtggaccagtgattcccactaaacttcctccgagacgagcaagacttgttgtttacagcaaaaggtcaaatgagacaagcatatggattgttgaactggcagaagttcgtgcaacaactcgaggtggccaccacaggggcaaagtcatttcatctgaagttgttccgaatgttcagcctcccatggatgctgtggaatatgctgaatgcgaagctgtggtgaaagatttccctccatttcgcgaggcaatgaaaaagaggggtattgacgacatggatcttgtgatggtggacccgtggtgtgctggatatcacagtgattctgatgctcctagccgcaggcttgctaaacctcttatcttttgcagaactgagagtgattgccctatggaaaatggttacgcccgcccggttgaaggaatccatgttcttgttgatatgcaaaatatggtcgtgattgagtttgaagaccgtaaactgattcccttaccgcctgctgatccattgagaaattatacttcaggcgaaactcgaggaggtgttgatagaagtgatattaaacctctacagatcattcaacctgaaggtccaagttttcgtgtcagtggacacttcatcgaatggcagaagtggaattttcgtattggtttcacacccagggagggcttagtcatctattctgttgcatatgttgatgatggtcgaggtcggagacctgtggctcacaggttaagttttgttgagatggtggtcccttatggagatcctaatgacccacactataggaagaatgcatttgatgctggagaagatggactgggtaaaaatgcacattctcttaagaagggttgtgattgtttaggctatataaagtacttcgatgcacactttacaaatttcacaggaggtgttgaaacgattgagaactgtgtttgtttacatgaagaggatcatgggatcttatggaagcatcaggattggagaacaggattagcagaagtccgacgttctagaaggctttcagtgtcttttgtgtgcactgttgctaattatgagtatggatttttctggcacttttatcaggatggaaaaattgaagccgaggttaaactaactggaattcttagcttaggagcacttccacctggagaaactcgaaaatatggaacaacaattgctccgggattgtacgcgcctgtccatcaacacttttttgtggcacgtatggatatggctgttgattgtagacctggtgaaacattcaatcaggtcgttgaggtgaatgttaaaattgaagagccaggaaaggataatgtccataacaatgcattctatgctgaagaggaactgctcagatctgagttacaagcaatgcgagattgtaatccattatctgctcgccattggattatcagaaacacaagaactgtcaaccggagcgggcagctaacaggttacaagctgatgcctggttcaaactgtttaccgttagctggttctgaggcaaaattcttgagaagagctgctttcttgaaacataacctttgggttacgccatatgcacgtgatgaaatgtatcctggaggcgagtttcctaatcagaatccacgtgttggtgagggattggctacttgggtgaagcaaaatcgatcacttgaagaaactgatgtggttctttggtatgtatttggtgttacacacattcctcggctagaagactggcctgtcatgccggtggaacgaattggttttatgcttatgccacatgggttctttaatagctcaccggcggttgatgtccctccaagtgcatctgatctggatctcaaggacaatgtggtagctgcaaagccgatccagaatgggcttctcgctaagctctgaacagttgggtgccacttacttttccttgaataaattaacaattgtcccaacttctagcaaatgctctttgattattattattattatatgcaccgttgcttggcatggcaaacctttgtcatgggcgcatcttcacgaacaattacttctatattttgaaattccgttaatgagatcatttattgggggcagatgtcattgttagtgccttttttgccttggagtaacttcatatccagatactggcgtgctgc

SEQ ID NO: 4506 - DNA, 2757 bp, Arabidopsis lyrata
tcaaccaaaaatcaaactcctcaaaaaaaaaaaaaaaaaaaacaaattgaatcagcactagtagtacgcgatcacagagaactcaagatccggtgacgaatccaacttcttgtgacggagctcaagtcgagagacgacagtagtagtagtagctgtggatttttgtgtcatcatcggagatcttcttcttcttcttcttcttcttcttcttcttggagcttgtagaagtggagagaagggggaagatcaagcgacggatagtgataggttttgctgtatgtcagtagattgtgttgaaactgattttggtggatttggagaacttgtgaaccctattcaatggcctcagcttcgaaaaagacgacggcatgtcctcaccacggtggctctgtttcgcctccgaaactcgtctccgctgctcccgatacggttgctgtatggtccgacggtgacgatcagcgagcctctaaggttgttttggaatccgttatccgccctgtcgattcgcttcctgataccgccaagaaacctgccaacaaaggtatttctgtgatgccaaggactgaaaccaagcacccattggatcctctatctgctgcagaaatatcagttgctgtggcaactgttcgcgcggctggtgccaaccctgaggttagggatggcatgcgtttcattgaggtggcatcagtggaaccagataaacaagttgtggcgctggctgatgcttactttttcccaccgttccagccatcactacttccaagaactaaatctggacctgtgattccgatgaagctccctccaaggcgagcaagacttgttgtttacaaccaaaagtccaatgagacaagtgtatggattgtggagttgtctgaagttcatgctgtcactcgggggggccatcacaggggaagagttgtttcctcacaagttatacctgatgttcagccacccatggatgcggctgaatatgctgaatgtgaagcgattgtcaaagacttcccaccattcatagaggcaatgaagaggagaggtattgaagacatggatctagtgatggttgatccctggtgtgtgggttatcacagtgaagctgacgctcctagtcgtaggcttgcaaagccccttatatactgtcggactgatagtgattcccctatggaaaatggctatgctcgtccagttgagggaatttatgtacttgtagacatgcaaaacatggtggtgattgagtttgaagaccgtaagtttgtgccactccccccacctgacccattgaggaattataccccaggtgaaagtagagggggtgttgatagaagtgatgttaagcctctccaaattattcagcctgaaggtccaagttttcgtgtaaggggttactttgtcgagtggcagaagtggaactttcgtattgggttcactccaagagaaggtttagtcatacattcggtagcatatgttgatggcagtcgaggtcgaaggcctgttgcacataggctaagttttgtggagatggttgtgccttatggcgatccaaatgagccacattacaggaaaaatgcttttgatgcaggggaggatggtctcgggaaaaacgcacattcacttaagaaggggtgtgactgtctgggatctatcaagtacttcgatgcccatttcacaaatttcactggaggagttgaaacaattgagaactgtgtttgtttgcatgaagaagatcatgggattttgtggaaacatcaggactggagaacaggattagctgaagtgcgaagatctaggaggctaactgtctcttttctatgtactgttgctaactacgagtatgggttttactggcacttctaccaggatgggaaaatcgaagccgaagtaaaacttactggtatcctcagtttaggagctctgcagccaggtgaaactcgaaagtatggtactactattgctcctgggttgtatgcaccagtccatcaacatttctttatcgctcgcatggatatgtctgttgactgtaaacctggtgaagcttttaatcaggtagttgaggtaaatgttagagttgacgagccaggtgagaacaatgtccacagcaatgcgttttatgcggaagagaagttacttagatctgaggcagtggcgatgcgtgactgtgaccctctttctgctcgccattggattgtaaggaacacaaggactgtaaacaggacgggccaattaacgggatacaaacttgttccgggttcaaattgtttgccattagctcgaccagaggctaagtttctaagaagagccgctttcctgaagcataatctctgggttacccgttacgccccagacgagaagtttcctggaggagaattcccaaaccaaaacccacgtgctggtgaaggtcttgccacatgggttaaacagaatcgctccttggaagaatccgacgtcgttctttggtacgtgtttgggatcacacatgttccgagacttgaagattggccggttatgcccgtcgaacatattggtttcactctaatgccacatggatttttcaactgctcaccggccgtagatgtgccaccgaatccatgcgagttggagacaaaggacagtgaagtcaaagaggttgtagcaccgaagcctcttcagactggtttactttcaaagctttgaaggatatcatttgttttcttccttttctctcttaagaaaattggatttgaatcttttagcgtttggtgtgtgtttgcaagactaaagatc

SEQ ID NO: 4507 - DNA, 2808 bp, Triphysaria pusilla
aaaaaattccccaaaaccttgattaaactctgataactcatattgctaagttagatacagctagaattacactttctagttgccgattacttttctgcgcctatacagacaggaattcgtatctaaagattgtggtggcgcttgtgaggaggagttacactgtttgctgtatgtcagtgggctgcgacgcgcattgcggtggatccggcgagcttgctaaccagttacaatggccacaactccgaaagaagcgacggtcgctgttagcttcggtcagaaagtcgtcgtcgagtctgccagtgccgccgtggtccgccgtgagaatgcttccgcctccgcagctgctgattggggcgtctcttctgcggctgaaaatttgcagagcaagaatttggcatccttgttcagacccgatccttctactaaagctccaaccaaaggtatccaaagcatgccaagggcccaaaccaaacatcctttggatcctttatccgctgccgaaatctacgtagcagtggcgactgtccgagcagctggagccacacccgaggtcagagatagcatgcggtttgtcgaggtggttctacttgagccagagaaaaatgtagtggcactagcagacgcttatttctttcctccttttcaaccctcgttgttgcctagaaccaaaggaggacaagcaattgctattaaactcccgccaaggcgagcaaggctagttgtctacaataaaaggtccaacgagactagtttgtggattgtcgagcttgcagaagtacacgctacaactcgtggagggcatcacaggggaaaagtgatttcttctacagttgtccctgacgttcagccaccaatggacgctgtagaatatgctgaatgtgaagctgtcgtcaaagattaccctccatttattgaagccatgaagaagaggggtattgatgacatggatctagtaatggttgacccatggtgtgctggttaccacagcgaggctgattctcctagtcgtaggctcgcaaaaccacttattttttgccgaacagagagtgactgcccattggaaaatggttatgcacgacccgttgaaggaattcatgtgctcgtcgatatgcaaaatatggtattaatcgagtttgaagatcgtaagattgttcccttgcctccagctgatccattgagaaactatactcctggtgaaacacgaggaggggtggatagaagtgatgtgaaatcccttcaacttgttcaacctgaaggtccgagttttcgagtaaatgggcattacattgagtggcagaagtggaactttcgcattggcttcactccgagggagggtttggtcattcattctgttgcctatgttgatggtagccggggtcgaagacctatagcccataggttgagttttgtagagatggttgtgccttatggagatcccaacgatccgcattatagaaagaatgcatttgatgctggggaagatggcctcggaaagaatgctcattctcttaagaagggatgtgattgtttgggatatgtaaaatattttgatgctcatttcactaattttactggaggagctgaaacgattgagaactgtgtgtgcttgaacgaagaagatcatggaatcctatggaagcatcaagattggagaactggcctggctgaagttcggcgatcaaggcgcctaaccgtttcttttatttgcactgtggctaattatgaatatggattctactggtacttttatcaggatgggaaaattgaagccgaagttaaactaactggaattcttagtttaggagctttacaacctggagaatctagaaagtatggtacaacaattgcaccaggattgtatgctccagttcatcaacacttttttgttgctcgtatggatatggcagtcgactgtaagcctggagaaatgcacaatcaggttgttgaagtgaatgtcagagttgaagaagttggaaacgataatgttcacaataatgcattctatgctgaaaaaactttacttagatctgaactggaagccatgcgtgattgtgacccattatcggcacgtcactggattataagaaacacaagaaccgtaaaccgcaacgggcagctgacagggtacaagttggtacctggttcgaattgcttgcccttagctggtcccaaggctaagtttctcagaagagctgcatttctgaagcataacttatgggttacaccttacgcgcatggggaggactttcctggtggagagtttcctaaccagaatccacgtgtcggggaggggcttgcttcttgggttaagaaaaaccgcccccttgaagaaactaatattgtcctctggtatgtttttggaataactcatgttccacgcttggaagactggcctgttatgccagtcgaacacatcggttttgtccttcagccgcatgggtttttcaactgttcaccggcagttgatgtgccaccgaacgcttgtgatgcggatgcaaaagagaacgatgtgaaagacaatggtgtctccaagtctataccttctggtttgattgcaaagctctgaagggatatgaagaaaaaaggtcattttcattatcccaatagtgttgggaaaaaaaatattatctcgttatctgagttctacgtatcggtcaaagcttattgcgtgttgttgtgtcattccctattacatcattttcaaaatttaatgttatcatcgtattatcaaagctagcgtgttcttaataatagtaataattattattattaaaaaaaaaaaaaaaaaacaaaaaaaaaaaaaacaaa

SEQ ID NO: 4508 - DNA, 2834 bp, Arabidopsis thaliana
aacaaaaatcaaactctttaaaaaaacaaacaaattgaagagcgattatacgatcacggagaactcaagatccggtgacgaatccaacttcttgtgacggagctcaagtcgagagagagaagactgtactagtagtagtagctgtggatttttgtgtcatcatcggagatcggaatcttcttcttcttcttcttcttggagcttctagaagtggagagaagggggaagatcaagcgacggatagtgataggttttgctgtatgtcagtggattgtgttgaaactgattttggtggatttggagaacttgtgaaccctattcaatggcctcagcttcgaaaaagacgtcggcatgtcctcaccacggtggctctcttccgcctcccaaactcgtctccgctgctcccgataccgttgctgtatggtccgacgctgacgatcagcgagcctctaaagtttctttggaatccgttatccgccctgtcgattcgtttcctgataatactgccaagaaacctgccaacaaagggatttctgtgatgccaaggactgaaaccaagcacccattggatcctctttctgctgcagaaatatcagttgctgtggcgactgttcgcgcagctggtgccaatcctgaggttagggatggcatgcgtttcattgaggtggcatcagtggaaccagataaacaagttgtggcgctcgctgatgcttactttttcccaccgttccagccatcactacttccaagaactaaatctggacctgtgattccgatgaagctccctccaaggcgagctagacttgttgtttacaaccaaaagtctaatgagacaagtgtatggattgtggcattgtctgaagttcatgctgtcactcggggtggacatcacaggggaagagttgtttcctcacaagttatacctgatgttcagccacccatggatgcggctgaatatgctgaatgtgaagcgattgtcaaagacttcccaccattcatagaggcaatgaagaggagaggtattgaagacatggatctagtgatggttgatccctggtgtgtgggttatcacagtgaggctgacgctcctagtcgtaggcttgcaaagccccttatatactgtcggactgatagtgattcccctatggaaaatggatatgctcgtccagttgagggcatttatgtacttgtagacatgcaaaacatggtggtgattgaatttgaagaccgtaagtttgtgccactccccccacctgaccctttgaggaattataccccaggtgaaagtagagggggtgttgatagaagtgatgttaagcctctccagattattcagcctgaaggtccaagttttcgtgtaaggggttactttgtcgagtggcagaagtggaactttcgtattggattcactccaagggaaggtttagtcatacattcggtagcatatgttgatggcagtcgaggtcgaaggcctgttgcacacaggctaagttttgtggaaatggttgtgccttatggcgatcctaatgagccacattacaggaaaaatgcttttgatgcaggggaggatggtctcgggaaaaacgcacattcgcttaagaaggggtgtgactgtctgggatctatcaagtacttcgatgcccatttcacaaatttcactggaggagttgaaacaattgagaactgtgtttgcttgcatgaagaagatcatgggattttgtggaaacatcaggactggagaacaggattagccgaagtgcgaagatctaggagactaactgtctcttttctatgtactgttgccaactacgagtatgggttttactggcacttctaccaggatgggaaaatcgaagctgaagtaaaacttactggtatcctcagtttaggagctctgcagccaggtgaaactcgaaagtacggtactactattgctcctgggttgtatgcaccagtccatcaacatttctttatcgctcgcatggatatgtctgttgactgtaaacctgctgaagcttttaatcaggtagttgaggtaaatgttagagttgacgagcgaggtgagaacaatgtccacaacaatgcgttttatgcggaagagaagttacttaaatctgaggcagtggcgatgcgtgactgtgaccctctttctgctcgccattggattgtaaggaacacaaggactgtaaacaggacgggccaattaacgggatacaaacttgttccgggttcaaattgtttgccattagctcgacccgaggcgaagtttctaagaagagccgctttcctgaagcataatctctgggttacccgttacgccccagacgagaagtttcctggaggagaattcccaaaccaaaacccacgggctggtgaaggtcttgccacatgggtgaaacagaatcgctccttggaagaatctgacgtcgttctttggtacgtgtttgggatcacacatgttcctagacttgaagattggccggttatgcccgtcgaacatattggtttcacactaatgccacatggatttttcaactgctcaccggcagtagatgtgccaccgaatccatgcgaattggagactaaggagagtgaagtcaaagaggttgtagcaccgaaagctcttcagactggtttactttcaaagctttgaagaatatgaatatcatttgttttctttctttgatctcttaaaaaattggaggcgttgctgttggttaagaacaatttcatatttgaatcttttattttcgtgtttggtgtgtgtgtttgcaagactaaaaagacctttgtcattggaatatttctattaaaatttcatatttgaatctttt

SEQ ID NO: 4509 - DNA, 2947 bp, Cicer arietinum
aaattattgttaaaaatgtgaagaaaaacaacagatacataaatgtccgattacttggttcgctgttgatcggtgattagcgaaagcaatgtccgaaacagtacaccgtggctggtttctgtcacaaacatgtggtggtaaaaagcataaaaactttataaagaaaataataataataataataaataataaaataacatcttcaccaaacccactgcatcgctttagattttcacggaaaagcaaacctctgttgattgaacacgttgaaacacaatttcttcttctttgctgagagaagaaaatcatttgctgtatgtcagtggaatactacactacagttttctacggtacccaactttctaaccctttacaatggcctcagctcaggaaaaagcgacgccccccaacaactctccctcctcctccgcaccaccaccaccaccacctccttcttctacttggcccgaccctactcaagatccaacccggaacactacctctcttgattccttccctcctaaaaccactcctactactaaaggtatcccggtcatgatgagagctcaaacttgccatcctttagatccattaaccgctgccgaaatatcagtagctgtagcaactgttcgtgcagccggagcaacccctgaggtgagggatagcatgcgctttgttgaagttgtcttggtagaaccagttaagcaagttgttgcattggcagatgcatatttcttccctcctttccagccgtcgttgctcccgaggaccaaaggaggaggacctttgattcctactaaactccccacaaggaaagcacggctcgtcgtgtacaataaaaagtcaaatgagacaagcatatggattgttgaacttcgagaagttcacgcagcaactcgaggtggcccccataggggaaaagtaatttcttctcaagtcgtgccaaatgttcagccaccaatggatgctatggagtatgctgaatgtgaagctgttgtgaaggacttccctccatttcgagaagcaatgaagagaagagggattgaggatatggatcttgtaatggtggatgcctggtgtgttggatatcacagtgaagccgattctcccaaccgcaggcttgctaagccactaatcttttgtagaagtgagagtgactgccctatggaaaatggctacgctcgtcctgtcgaaggaatctatgtacttgttgacatgcaaaatatggttgttcttgagtttgaagacaggaaactaatcccccttccacctaccgatccactacgaaattatacttctggtgaaacacgaggtggagttgatagaagtgatgtgaaacccttacagattattcagcctgaaggtccgagctttcgtgtcaacggacacttcattcaatggcagaagtggaattttcgtattggtttcactcctagggaaggtttggttatttattcagtagcttatattgatggaagtcgagggcgaaggccggtggcacacaggttgagttttgttgagatggtggtcccgtacggagatccaaatgatcctcactataggaagaatgcatttgatgccggagaagatggccttggtaaaaatgctcattctctcaagaagggttgtgattgtttaggctatatcaagtactttgatgctcacttcacaaacttcactggaggcgttgaaacaatagagaactgcgtttgcttgcatgaagaggatcacggtattttgtggaaacatcaagattggagaacgggtttggctgaagttcgaaggtctagaaggttgacagtgtctttcatatgcacagtagctaactatgaatatggatttttctggcacttttatcaggatgggaaaatagaagctgaggtcaagctcacaggaattctcagcttaggagcaatgcaacctggtgaagctcgaaaatatggaacgactattgcacctggattatatgcgcctgttcaccaacatttttttgttgctcgtatggacatgtccgttgattgcaagcctggtgaagcatttaatcaggttgttgaggtggatgtcaaagttgaagatccaggaaagaataatgttcacaacaatgcattctatgctgaggaaaaactgctcaaatcagaattggaagcaatgcgtgattgcaaccctttatctgctcgacactggatagttagaaacacgcggaccgtaaaccgaactgggcagctaacaggttacaggctagtccctggttcaaattgtttacctttagccggttcggaagccaagtttctgagaagagcagctttcttgaagcacaatctttgggtcactccttatgttcacaatgaaatgcatcctggaggagagttccctaatcaaaatccacgcgttggagagggtttggctacttgggttaagcaaaatagatcattggaggaagctgatatagttctttggtatgtatttggagtgacacacattccgcgattagaagactggcctgttatgccggtggaacacattggttttatgcttatgccacatgggtttttcaattgctccccagctgtagatgttccaccaagtgcaggtgatttggatgataaggagaatgtcatgtctgctaagccaattcagaatggtttgattgcaaagctctgaataaaccaaaagtagtgacattttgtgttatgtgtttatgtttatctaattattcagtgcatcaatctgatttaaatttagtgcttgctagttatacaaattcaaagttaagcttcttgagggatatttatgagtatctatttagaagatgcacttgatgcaattggaaaatgatactagctctctaactatttataactccctttaccatttttcagatatattttgaaaaattaggagtgtatttaatttatctattatatatatatatatagatgttattaaa

SEQ ID NO: 4510 - DNA, 3075 bp, Eucalyptus grandis
ggggttcttgctcttttcatgtatataagtccactccatctctctctctctctctctgtctctctgtctcccctcgtccctctccctctcacaggtagaaatcatcccccacccgtggctctttccatgcgtggcatgatctgtatttccacattcctgccggtgtccctggttcatggacatcagcgcatcttgggtcacgggtatcccttgtttccttgaataaagctctctccttttcgcccttcccaccctcgagttcttgaagtttccgggcgaaagattcgagcttcgggtggtgggtaggcgggcgggcgggcgagccagcgagagagggtggcggagagttcttgctgtatgtcagtagattgcgtggagactctgtgcaacggtggtttaggagcgattaccaaccccctacaatggcctcagctccgcaaaaagcgacgccttcctctcgtttcctccaagacgttcccccggccgtctccggttgggccgcgccgccgggcgccgatccccgcgacggtcagctcccgaggaaggcttcggtgatccggccagtagattcgcttcccgagccttccgctactgctctgacaaaaggtgttgcagtcatgcaaagggctcagactagtcaccctttggaccctttgtctgccgctgaaatttctgttgcagtggcaacagttagagctgcaggatccactcctgagatccgggatggcatgcggtttgttgaagtggttttgttggaacctggtaaacatgttgttgcattggcggatgcctactttttccccccattccaaccttccttacttcccagaaccaagagcggacctgtacttcccgccaagctccctccaaggcgagctaggcttatcgtttacaataagaagtcaaatgaaacgagtgtatggattgtggagctatcagaagtgcatgcagcaactagaggtggacatcaccgaggaaaagtgatctcatcaaagattattcctaatgttcagcctccaatggacgcaagtgagtatgctgaatgtgaagctgctgtgaaggaatttccacaatttagagaggctatgaagaaaaggggtattgaggacatggatcttgttatggttgacgcgtggtgtgctggttatcatagtgatgccgatgctccaagtcgaaggctcgccaagcctcttattttctgtagaactgagagtgactgccctatggaaaatggttatgcacgtccagttgagggcattcacattctagttgatatgcagaacatggtggtgattgagttcgaggatcgtaaacttgttcccctacctccagccgatccattaaggaactatactgctggcgaaactagaggtggtgttgaccggagtgatgtgaagcccttactaatagttcagcctgaaggtccaagttttcgtgttaatgggcattatgtagcgtggcagaagtggaattttcgcattggcttcacaccaagggagggccttgttatccattctgttgcttatgtagatggtagtcgtggtagaagacctgtagctcataggctgagctttgtggagatggtcgtgccttatggagatccaaatgacccacactacagaaaaaacgctttcgatgcaggcgaagatggccttgggaagaatgcacattctcttaagaagggatgtgattgtttaggctacattaagtactttgatgcttatttgcccaatttcactggaggggtcgacactattgaaaattgtatatgtctacatgaagaggatcacgggatcctatggaagcatcaagactggagaacaggattggcagaagttaggaggtcaagaaggctaagtgtatctttcatatgtactgtggcgaattatgagtatggattcttctggcacttttaccaagatggaaaaattgaagctgaagttaaacttacaggaatcctcagcttgggagctttgctacctggggagtcccgaaaatatggtacaatgattgcacctggtctttatgcaccagttcatcagcatttctttgttgcacgtatggatatggctgttgactgcaaacctggagaatcattcaatcaggttgttgaggttgatgttaaggttgaagaacctggggagaaaaatgttcataacaatgcattctatgctgaggagacactacttagatccgagttgcaggcaatgcgtgattgcaatcctttgaccgcacgccattggattgtaaggaatactaggaccgtaaatagaactggacagctaacgggctacaagttagtgcctggttcaaactgtctgccactagcaggttctgaggccaagtttttgagacgagctgcttttttaaagcataacctttgggttacggcttatgcaccagatgagatgtttccagggggagagttccctaatcagaatccacgtgttggtgaagggctgtctacatgggttaagcgaaatcgacctctggaagagactgatgtggttctttggtatgtatttggaatcacccatgttccccgcttggaagactggcctgttatgccggtggagcgcattggtttcatgcttatgccacacggattcttcaattgctcgcctgcagttgatgtccctcccagtacctgtgatatggacgccaaggacaatgaggtcaaagacaatggtgaaaataaacaagtccctggtgtaattcctgcaaagctttgaagaaaattcagcagagtggtcttctcccttaggctgcgcctacttttgttgtcactctttgatccagcagcattcctggttctgtcaaagcaggctaaagtgttgcccatgactgagtcttgtagtttttgcttttcaatgacatgagacaagactgtaaatatcattaataacgtccaatgtcctaaataactctttcatgtgttaggatgtttcttccctttcagacatcttttggtcgattggttctgatgaatgaacaatattgggactctgcagttctggaaactaatttctggcatgtgcgattttcgtgatgcttttgctgaacgggttctcctat

SEQ ID NO: 4511 - DNA, 3045 bp, Theobroma cacao
gttttgtttagctctttaatatttcttttgcgtttttttgtctttataattacagtttatttgccgctcaaaccagctcgtaacgaatctgcgatcaaaagcttgttattcctgtatcgttttttgttatatcggaagattcttgaaggttgtttgaacttcggagagagaaaagagagagagagagagggagagcgaaaaatttgctgtatgtcagtagattgtattgagacttactgcggtggatttggcgagcttgcgaaccctttacaatggcctcagctaagaaaaaggcgacgcttttttcatctgcctcttcctctccctcctcctcctcctccccttcttcgtgttgcgcagtcgactctgctgtttccgccgcgcccgccgctgccgctgctgccaatgtggtgcaggagtggaccgtcgcgtctagggatcgccgcgacgatcaacgcgccaccaaagctgccatggcgtcgttgattcaccccgttgattctcttcctgatacttccaccgccgctccttccaccaaagggatccaaattttgccgagggctcaaaccagccatcctttggacccgttatctgctgctgaaatctctgttgcagttgctactgtcagggctgctggagccactcccgaggtaagagatggcatgcgctttgttgaagtggttcttttggagccagacaagcatgttgttgctttggcagatgcgtatttcttcccacctttccaaccctctttacttcccaggaccaaaggtggtccggtgatccctaccaagctccctccgaggcgagctagactgattgtctataacaaaaagtctaatgagacaagtgtatggattgttgagttatcagaagtacatgcagtaactcgaggaggacatcacaggggaaaagtaatatcatcaaaagtagttccagatgttcagcctcctatggatgctatggaatatgctgaatgtgaagccgttgtaaaagactttcctccattccgagaggcaatgaagaagaggggtattgaggacatggaacttgtgatggttgatccttggtgtgttggttatcatagtgatgctgatgctcctagcagaagacttgctaaaccacttatattctgtagaacagagagtgactgtcccatggaaaatggctatgcccgccctgttgagggaatctatgtacttgttgatatgcaaaagatgaaggtgattgagtttgaagactgtaagtttgttcccttacctctggctgatcctttgaggaattatactcctggagaaacaagaggtggtgtcgatcgaagtgatgtgaaacccttacagattgttcagcctgaaggtccaagctttcgagttaatgggtgctttgtagagtggcagaagtggaatttccgtattggtttcaccccaaaggagggtttggttatatactctgttgcatatgttgatggtagtcgaggacgaaggcctgttgctcatagattgagtttcgtggagatggttgtgccttatggggatccaaatgatccacattaccggaaaaatgcttttgatgcaggggaagatggccttggaaaaaatgcacattcattgaagaagggatgtgattgtttgggctatatcaaatactttgacgctcactttacaaatttcactggaggtgttgaaaccattgaaaattgtgtctgtttgcatgaagaggatcatgggattttatggaagcatcaagattggagaacaggtttggcagaagttcgaaggtctaggcggctaacagtgtctttcatatgcactgttgctaactatgagtatggattttactggcacttttatcaggatggaaagattgaagctgaagttaagcttactggaattcttagcttaggagcattgcagcctggagaatttcgaaaatatggtactatgattgccccaggtttgtatgcaccagttcatcaacacttctttgttgctcgtatggacatggctgttgattgcaaacctggtgaagctttcaatcaggttgttgaggttaatgcaaaagtcgaggagcctggggaaaataatgttcacaacaacgcattctatgcggaagagacactgcttaaaactgaactgcaagcaatgcgtgattgtaaccccttcacagctcgccattggattgtgaggaatactagaacagtaaacaggactggtcaattgactggctacaaacttgtacctggttcgaactgtctacctctagctggctctgaggctaagtttttaagaagagctgctttcttgaagcataacctttgggttacacggtatgctcctgatgagatgtttcctgggggagagtttccaaatcaaaatcctcgtgctggtgaaggattggctacatgggttaagcaggatcgtcctctagaggaaactgatatagttctctggtatgtttttggaattacccatgtccctcgattggaagactggcctgttatgccagtggagcacattggtttcatgctaatgccgcatggattctttaactgctctcctgctgtggatgtcccgcccaatgcctgcgaattggataccaaagacaacgaaattaaagaaaacgtggtacccaagtctactcagaatggtctgctggcaaagctctgaggagggaggtgtgctacatctctaaacacattctctcttttttactctcggaacattccatccttgagtgtctgtagaatttccatctataaaccgtctgctaaatttgttcctgtttctgagtgtcttctctctctgtgtacaaggatatgtttgaaaggtttgctatgaatatttattgtattagtctacacatggaggaatgttccaccatgtgctgtgagaacgttttcttggccttttttttttttatttatttttcaaaaaagaaatccggtcatgtctttttcttttttaattttctcgtgctcctttttttgtgaagttgaaaggcaaagcacgcttagaggaagtgtcgcgaagccataatgaaaaagct

SEQ ID NO: 4512 - DNA, 2876 bp, Cicer arietinum
aaaagattgaaagaaaaaaaaaacagagacacgtgacttgaatttggcactataaatgtaagagactctcgtctttgagtgtagcacggcttggttctttcttttccggtgatttcttcttcctctttttgtcgtaactgtattggagattgacgttgtgcgcggtggaagagaggaagagggtgagttaccctacctgcatgtcagtgtactgtcttgatacctattctgctcttagaattggcgaattagcgaatcctttacaatggcctcagcttcgcaaaagacgacgtctcctccttgctgtccccccggcgactcttcccgcttagctgtttcctccatcgttaagccacaagatcgcatcgctaataacgttgccttgattcgccctctcgattcgcttcctgaatcttccaccaccaatgctcctactgctaagggaataacttcactgacaaggcctcagtcaagtcatcctttggaccctttatctgctgctgaaatatctgtggcagtggcaactgtgagggctgctggagccactccagagcttagagatagtatgcgcttcattgaagtagttttgctggaaccagataaacatgttgttgcactggcagatgcttatttttttccacctttccaaccatcattacttcctagaagtaaaggagggcctgtaattcccactaagctccctccgagatgctctagacttgttgtttacaataagaaatcaaatgagactgctctgtggattgtcgaattatcacaagtacatgcagtaactcgaggtggccatcatcgaggaaaagtcatttcatcacatgttgttcctgatgttcagcctccaatggatgctgaggaatatgcagaatgcgaggctgttgttaaaagttatcccccatttatagaggctatgaagaaaaggggtatcgaagacatggaagttgttatggttgatccctggtgtgttggttatcatagtgaagctgatgctcctggtcgaagacttgctaaaccactcatattttgtcggtctgagagtgactgccctatggaaaatggttatgcccgcccagttgagggaatctatgttcttgttgatatgcaaaacatggtggtgatagagtttgaagaccgtaaacttgttcctctgcccccggttgatcccttgaggaactatactcctggtgaatccagaggtggctcggatagaagtgatgtaaaacccttacaaattgttcaacctgaaggtccaagctttcgtgtcaatgggtattatgttgaatggcagaagtggaattttcgtattggattcacacccaaagaagggttggttatatattctgttgcgtatgttgatggtagtcggggaagacggcctgttgctcataggctgagttttgtggagatggttgtgccctatggagatcccaatgatccacattataggaaaaatgcttttgatgctggggaagatggcttgggaaaaaatgcgcattccctcaaaaagggatgtgattgtttgggctacatcaaatattttgatgcccacttcacaaatttcactggtggagtggaaactatcgaaaattgtgtatgtatgcatgaagaggatcgtgggattctctggaaacatcaagactggagaactggcttagcagaagtccgaaggtctagaagactttcggtttcttttgtatgcacagtggccaactatgagtatgcatttttttggcacttttatcaggatggaaagattgaagctgacgtcaagctaactggaattctcagcttaggagccttgatgcctggagaatatcgaaaatatggtaccatgattgcacctggtctatatgctccagttcatcaacatttttttgttgcacgtatggacatgtctgtcgattctagacctggtgaagctttgaatcaggttgtggaggtcaatatgaaagttgaagaacccggtgagaataatattcacaataatgcattctatgccgaagagactttgctcaaatctgaatcggaagcaatgcgtgattgcaatcctttgactgctcggcattggattgtaaggaacacaagaactggcaatagaaccggacaattgaccggctacaagctggtaccaggctcaaactgcttgccgttggcaggttctgaggccaagtttttaagaagagctgctttcttgaagcacaatgtttgggtaacagcatattcacgtgatgaaatgtttcctggaggagaatttcccaatcaaaatccacgagttggcgaaggattagctacatggattaagcaagaccgatcgttggaagaaactaatatagttctttggtatgtatttggaatcacgcatgttcctcgtctggaagactggcctgtcatgccagtagaacatattggtttcatgctcatgcctcatggattcttcaattgttcccctgcggtggatgtgccgcctagttcatgtgaagcggaatctaaagacaatgacatcaaggataatggtgctcccaagccaattccgagcgggttagcatcaaagctttaggtgcttgtcccattagaaaattatggcttcctgctgctgatacactacatatgcaagtgctattttggcacccactgaaacaccaagttgagcagattgtatttttttaatcttcattaatattaataatcaaccttggaccttaatcctgatgttctagttatgctgggaaagttggctagtaatattcattacatttgtctatgtacctgagaggattgtgttatcaaatttgatgtgaaagtaatgctaagcttaaaataagtaggctgttattatcatattattgagattcagaaatcgctta

SEQ ID NO: 4513 - DNA, 3105 bp, Papaver somniferum
cgggacgaaaaaaatctatctcggccggtttatagaaagattaaaaaaaaaacggccagtttttaatgtgtgtcataaaggtggctactttaataaaaaacccttcaaattttgtaatactgcataggataacctgaagtctgtatcccggacaagtcccgtatatatattacataaagaaggtaggtgataaccaaacaaacaaagggtcttcatcgcacgcctatgtatataaccagttcaagaaaatcacgtcagatacaattctccctttctacattgaacaaagacacctttccctctctctctagatcatttatagaaaccctaattttcggtctaaaatttcctttctagattttctccattcgattcatttctaagagaaatttgggtggaagtttttgctctataaaaaaagtgtgttgagaattgctgtatgtcagtagttgattgcactgagaattgttatcacggtggaatcggtgttgttaagaatccattacaatggccacaattaagaaagaaaagacgccatcttcttcgttttgctgtaaaaatggtggttccattcaaagagagataacttcatctgcttctgttgttgaagtacctaataccaatgatccaaagaaaaacagcagaccttctgtttcaactactatggagactgtaattcgttctgttgattcccttcctgaaacttctactaatacttccatcaaaggtattcagatcatgatgagggctcaaagtagtcacccattggatcctttatcaggtgctgaaatttcagtagcagtggggactgttagagctgctggagccactcctgaggttagagatagtatgcggtttgttgaagtggtcttgttggaaccagataaacaagttgttgcattagcagatgcatatttctttcctccttttcagccatctttacttcccaaaacaaaaggtggaccttttattcctagtaaacttcccccgaggagggctagacttgttgtttacaacaaacggtccaatgagacaagtgtatggattgttgagctaactgaagtacatgctgcaactcgtggtggtcatcataggggaagagtcatctcctcagaagtggttccagatgttcagccccccatggatgcggaggaatatgctgaatgtgaagctattgttaaggattatcctccgtttcgggaggcaatgaaaaagaggggtatcgaagatatggatcttgtgatggttgatgcctggtgtgttggatatcatagtgaacatgatgcacctagccacagacttgccaaaccacttattttttgcagaacggagagtgactgccccatggaaaatggatatgctcgcccagtggaaggcattcatctagttgttgatatgcaaaatatggtaatacttgagtttgaagaccgtaaactcgttcccttacctcctgctgatccgttgagaaactatactgctggagaaactcgaggaggagttgatagaagcgatgtgaagcctctacagattatccagcctgaaggtccaagctttcgggtcagcggacactttatagaatggcaaaagtggaattttcgcattggtttcacaccaagggaaggtcttgtgatccattctgttgcatatattgatggtagtcgtggtcgcagagctgttgcccacaggttgagtttcgtcgagatggtggtaccttatggagatcctaatgaaccccattataggaagaatgcatttgatgccggggaagatggccttggtaaaaatgcacattcccttaaaaaggggtgtgattgcttagggtatatcaaatatttcgatgcccactttacaaacttcagtggaggtgttgagacaattgaaaactgcgtatgtttgcatgaagaggatcatggtattttatggaagcatcaggactggagaacagggttagctgaagttcggaggtccagacgtctgacagtatcctttatatgtactgtggctaattatgagtatgggttcttctggcacttctatcaggatggaaaaattgaagctgaagtcaagcttactggaattcttagcttaggagctttgcagcctggggaattcagaaaatatggtacgaccattgcaccaggattatatgctccagtgcaccagcacttttttgtagctcgtatggatatggcagtcgactgcaaacctggtgaaaagcataaccaggtcgtagaagtgaacgttaaagttgaaaaaccagggcagaataatgtacacaacaatgcattttatgctgaagaggaacttctcagaacagaacagcaggcaatgcgtgattgcaatcctctctctgctcgccattggattatcaggaatacaagatctgttaaccggactggacaacttacagggtacaagctcgtacctggctctaattgtttgccattagctggtgcagaggcaaagttcttgagaagagctactttcttgcagcacaatctatgggttacatcctatgcaccaggtgagatgtatcctggaggagagttcccgaatcaaaacccacgtgctggtgagggtctgggaacatggattaagcagaaccgttcccttgaagaaactgacattgttctctggtatgtgtttggaattacacacatccctcgactggaggattggcctgtcatgcccgtggagcacatcggtttcatgcttcagccacatggattcttcaaccgttctccagcagtggatgtcccacctagtacttgtgagttggtggaccttaaagaaaatggctcttcgaaaccaacaattcagaatgctgtacttacagcaaaactttaaagagggcagaaacatcttcttggttggtcagtccacaacaatgtcgcatgcatctgtgacgaaaccggccaattagtttgtaagtaggctgcagaaattgagacctttaagaaagcgttattgagcattcagaacatcgatcagtttaaaccttatggaatttcagttattgttaataacgtcacttgtgaactcgagttaaatctagttttcaacaatatcatgaaaggattccagttggttttccctatttacaat

SEQ ID NO: 4514 - DNA, 3065 bp, Gossypium hirsutum
gtttctggttctggtttccttttctcttcacatttctttctcccgatgagcaaacgctcctttgtcgttacaattagagtttattgccactcaactcaccactatttgatctgaccttggttatttctgcttcatttttttctcttttaatttttcttgtattttcttgaagcttctttccaacggagaaatagatagaagagagagggagagccagagagagtcgactgagaaagttttgctgtatgtcagtagattgtattgagacttactgcggtggatttggcgagcttgcaaaccctttacaatggcctcagctaagaaaaagacgacgcttcattcttcttcatcttcttccccttcttcatgttgcgcatcgcactccgttgtttccgccgcgcctcctgcttcttcatctgcctccgccaccgcctccaatctgctgcacgagtggaccctcggttctacggatcgccgcgacgatagcagcgtcaccaaagctgccatggcgtccttgattcgccccgttgattctcttcccgatacttccaccaaaggcatccaaatctttacaaggcctcaaaccagtcatcctttggaccctttatctgctgctgagatctctgttgcagttgctactgtcagagctgctggtgccactcctgaggtaagagacagcatgcgcttcgttgaagtggttcttttggagccagacaagcatgttgttgctctggcagatgcttatttcttcccacctttccaaccctcattacttcccaggaccaaaaatggcccagtgatacctaccaagctccctctcaggcgagctagattggttgtctataacaagaagtccaatgaaacaagtatatggattgttgagttatctgaagtacatgcagtaactcgaggagggcatcacaggggaaaagtaatatcatctcaagttgtaccagatgttcagcctcctatggatgctatggaatatgctgaatgtgaagctgttgtaaaagactttcctccattccgagaagcaatgaagaagaggggtattgaggacatggaccttgtgatggttgatccctggtgtgttggttatcatagtgatgctgattctccaagcagaagacttgctaaaccacttatattctgtagaactgaaagtgactgccccatggaaaatggctatgctcgcccagttgaggggatttatgtacttgttgatatgcaaaagatgaaggtgattgagtttgaggaccgtaaatttgttcctttacctccggctgatcctttgaggaactatacttctggagaaacaaggggtggtgttgatcgtagtgatgtgaaacccttgcagattgttcagcctgaaggtccaagctttcgtgttaatgggtgtttcgttgagtggcagaagtggaatttccgtattggtttcaccccaaaggagggtttggttatatactcagttgcttatgttgatggtagtcgaggtcgaaggcctgttgctcataggttgagttttgtggagatggttgtgccatatggggatccaaatgatccacattaccgaaagaatgcttttgatgctggggaagatggccttggtaaaaatgcacattctctcaagaagggatgtgattgtctcggctatatcaaatactttgatgctcactttactaatttcactggaggtgttgaaacgattgaaaattgtgtctgtttgcatgaagaggatcatgggattttatggaagcatcaagattggagaacaggtttggcagaagttcgaaggtctagaaggctaacagtgtcattcatatgcactgttgctaactatgagtatggattttactggcacttttatcaggatggaaagattgaagctgaagttaagcttactggaattcttagcttaggagcattacagcctggggaatctcgaaaatatggtacaatgattgccccgggtttatatgcacctgttcatcaacacttctttgttgctcgtatggacatggctatcgattgcaaaccaggcgaagctttcaatcaggttgttgaggttaatgctaaagttgaggaacctggggaaaataacattcataataatgcattctatgcggaagaaaccctgcttaaaacagaactccaagcaatgcgtgattgtaatcccttaacagctcgccactggattgtgaggaatacaaggacagtaaacaggagtggtcaactgactggttacaaacttgtacctggctccaactgtctaccactagctggttctgaggccaagtttttaagaagagctgctttcttgaagcataacctttgggttactcagtgtgctcctaatgagatgtttcctggaggagagtttcctaatcaaaatccacgtgctggtgaaggattggctacatgggtcaagcaggatcgatctctggaggaaactgatatagttctctggtatgttttcggaattacccatgtccctcgactggaagactggcctgtgatgccagtggagcgcattggtttcatgctgatgccgcatggattctttaactgctctcctgctgtggatgtccctcctaatgcgtgcgaattggatacgaaagacaatgatatcaaagaaaatgtggtacccaagtctattcagaatggtctgatgtcaaaactttgagcatatattgggccgtggaggcattgcatttgtgtgcaataaaaacatggtactatcaatcaccatcactgctgtagaatttcatataaatttgtctgctttttaagggtttgtgtactaggatgtgtgaattattatcgtaaaagaatactttttttttcttcaacaaaacagaaaaatctatatttttctttgtaaaaatgactttgataagcatagcatgcttatgccacttgtttggagtgtggtagtaggtagggttggaaatgatttgagtttgaacgactaatagtttgtttacttttatgttagtttgtgtgcccattgtgtttgttaagaattttaaattatgtttgttcttgtatttgtttgtttaaattaa

SEQ ID NO: 4515 - DNA, 2787 bp, Gossypium raimondii
ctccgtctatccaactctaccattgattttttttttcctttttccttttgttttgtttctggttctggtttcctttttctcttcacatttctttctcccgatgaacaaacgctcctttgtcgttagaattagagtttattgccactcaactcaccactatttgatctgaccttggttatttctgcttcatttttttctcttttaaattttcttgtattttcttgaagcttctttccaacggagaaatagatagaagagagagggagagccagagagagtcgactgagaaagttttgctgtatgtcagtagattgtattgagacttactgcggtggatttggcgagcttgcaaaccctttacaatggcctcagctaagaaaaagacgacgcttcattcttcttcatcttcttccccttcttcatgttgcgcatcgcactccgttgtttccgccgcgcctcctgcttcttcatctgcctccgccaccgcctccaatctgctgcacgagtggaccctcggttctacggatcgccgcgacgatagcagcgccaccaaagctgccatggcgtccttgattcgccccgttgattctcttcccgatacttccaccaaaggcatccaaatctttacaaggcctcaaaccagtcatcctttggaccctttatctgctgctgagatctctgttgcagttgctactgtcagagctgctggtgccactcctgaggtaagagacagcatgcgcttcgttgaagtggttcttttggagccagacaagcatgttgttgctctggcagatgcttatttcttcccacctttccaaccctcattacttccaaggaccaaaaatggcccagtgatacctaccaagctccctctcaggcgagctagattggttgtctataacaagaagtccaatgaaacaagtatatggattgttgagttatctgaagtacatgcagtaactcgaggagggcatcacaggggaaaagtaatatcatctcaaattgtaccagatgttcagcctcctatggatgctatggaatatgctgaatgtgaagctgttgtaaaagactttcctccattccgagaagcaatgaagaagaggggtattgaggacatggaccttgtgatggttgatccctggtgtgttggttatcatagtgatgctgattctccaagcagaagacttgctaaaccacttatattctgtagaactgaaagtgactgccccatggaaaatggctatgctcgcccagttgaggggatttatgtacttgttgatatgcaaaagatgaaggtgattgagtttgaggaccgtaaatttgttcctttacctccggctgatcctttgaggaactatacttctggagaaacaaggggtggtgttgatcgtagtgatgtgaaacccttgcagattgttcagcctgaaggtccaagctttcgtgttaatgggtgtttcgttgagtggcagaagtggaatttccgtattggtttcaccccaaaggagggtttggttatatactcagttgcttatgttgatggtagtcgaggtcgaaggcctgttgctcataggttgagttttgtggagatggttgtgccatatggggatccaaatgatccacattaccgaaagaatgcttttgatgctggggaagatggccttggtaaaaatgcacattctctcaagaagggatgtgattgtctcggctatatcaaatacttcgatgctcactttacaaatttcactggaggtgttgaaacgattgaaaattgtgtctgtttgcatgaagaggatcatgggattttatggaagcatcaagattggagaacaggtttggcagaagttcgaaggtctagaaggctaacagtgtcattcatatgcactgttgctaactatgagtatggattttactggcacttttatcaggatggaaagattgaagctgaagttaagcttactggaattcttagcttaggagcattacagcctggggaatctcgaaaatatggtacaatgattgccccgggtttatatgcacctgttcatcaacacttctttgttgctcgtatggacatggctatcgattgcaaaccaggcgaagctttcaatcaggttgttgaggttaatgctaaagttgaggaacctggggaaaataacattcataataatgcattctatgcggaagaaaccctgcttaaaacagaactccaagcaatgcgtgattgtaatcccttaacagctcgccactggattgtgaggaatacaaggacagtaaacaggagtggtcaactgactggttacaaacttgtacctggctccaactgtctaccactagctggttctgaggccaagtttttaagaagagctgctttcttgaagcataacctttgggttactcagtgtgctcctaatgagatgtttcctggaggagagtttcctaatcaaaatccacgtgctggtgaaggattggctacatgggtcaagcaggatcgatctctggaggaaactgatatagttctctggtatgttttcggaattacccatgtccctcgactggaagactggcctgtgatgccagtggagcgcattggtttcatgctgatgccgcatggattctttaactgctctcctgctgtggatgtccctcctaatgcgtgcgaattggatacgaaagacaatgatatcaaggaaaatgtggtacccaagtctatgcagaatggtctgatgtcaaaactttgagcatatattgggccgtggaggcattgcatttgtgtgcaataaaaacatg

SEQ ID NO: 4516 - DNA, 3237 bp, Phaseolus vulgaris
cgatgggacataaggtccatccagctgtcactggagctccacttgcaggtggttgtattgtatgttccgctttcctatgttggagtctgatgtgttgtgttggctcacatttgttgattgctgaatgctgaatgctgaatggccatgatgctccaaacagcatagactattggtgacttctctgaggtcacgacaacaaagaccaacaaagagaaggaaaagacaattgtctttatcaaccaaacccacttacggctgctttcaatcttcgttcaaaagaagcagtggtgacgaatccccgtacgatcaatttctttcaatcttcatggaaaagcaacactgctgacacagccccatccccaattagttcaattactttcgatattcagggaaaaacaactgtggtgacgcaaccgcatacgttcaatcaatcattccagaaccaccatcttccaccacaacagcggataacagtttttgaggttgtggttgctgctgctgctgctgtcgtgtgggggtggcggcgagtgttgcgttgtgcagtgaggcgttgctgtatgtcagtggaatactactgcggtggagttttctacggtgagctcgctaaccctttacaatggccacagctcaggaaaaagcgacgccaaataatctcagtaacaaccccactgcttctaattcctccgcagttccctcttcttgggcccaccccactgccgatcccttccgaaacagaccctccgtctccgccctcgtttccgccgtcgactccttccccgatcctcctcccaaaaccacctccaccaccaaaggtatcccagtcatgatgagagttcaaacctgccaccctttggatccactgtcagctgctgaaatatcagtggctgtagcaacagttcgggctgctggggcaactcctgaggtgagggatagcatgcgctttgttgaagtagtgttggtagaaccagctaagcaagttgttgcattggcagatgcatatttcttccctcctttccagccttcgttgcttcccaggactaaaggaggacctgtgattccttctaaacttcccccaaggagagcacgattggttgtttacaacaaaaggtcaaatgagacaagcgtatggattgttgaactcagggaagtgcatgcagcaacacgaggtggtcaccatagaggcaaagttatttcttccaaagtcgttccaaatgttcagccaccaatggatgctgtggagtatgctgaatgtgaagctgttgtgaaggacttccctgcatttcgagaagcaatgaagagaagagggattgaggacatggatcttgtgatggtggatgcatggtgtgttggatatcatagagaaacagatgctcctagccgcaggcttgctaaaccactaatcttttgtagaactgaaagtgactgccccatggaaaatggctatgctcgtccagttgaaggaatcaatatacttgttgacatgcaacatatggaaattcttgagtttgaagatcgaaaactgatccctcttccacctgctgatccattgagaaactatacttctggtgaaacccggggaggagttgatagaagtgatgtgaagccattacagattattcaacccgaaggtccaagttttcgtgtcaacgggcacttcattcaatggcagaagtggaactttcgtattggttttactcctagagaaggtttggttatttattctgtagcctatattgatggaagtcgaggaagaaggccagtggcccacagattgagttttgttgagatggtggttccttatggagatccgaatgatcctcactataggaagaatgcttttgatgcaggagaagatggtctgggtaaaaatgcgcattctctcaagaagggttgtgattgtttaggctatatcaaatatttcgatgctcacttcacaaactttaatggaggtgttgaaacaatagagaattgtgtctgcttgcatgaagaggatcatggcatcttgtggaagcatcaagactggagaacaggtttggctgaagttcgacggtctagaaggctgacagtatcttttatatgtactgtggctaactatgagtatggatttttctggcacttctatcaggatggaaagatagaagctgaggtcaagctcacgggaattctcagtttaggagcattgcaaccaggcgaaactcgaaaatatggcacaactattgcacctggattatatgcgcctgtccaccaacacttttttgttgctcgtatggacatggctgttgattgcaagcctggtgaagcatttaatcaggttgttgaggtggatgtcatagttgaagagccaggaaagaacaatgttcacaacaacgcattttatgcagaggaaagactgcttaagtcagaattggaagcaatgcgtgattgtaaccctttatctgctcgacattggattgtgagaaacaccaggacggtaaaccgaacagggcagctaacaggatacaagttggtacctggttcaaattgtttacccttggctggttcagaggccaagtttctgaggagagcagctttcttgaagcacaatctttgggtcactccttatgttcccgaagaaatgcatcctggaggagagttccctaatcagaatccacgtgttggagagggtttggctacttgggttcagcaaaatagatcactggaggaagctgatatagttctttggtacgtgtttggtgtgacacacattccccgattggaagactggccagttatgccagtggaacgcattggctttttgcttatgccacatgggtttttcaattgttccccagcagtagatgttcccccaagtgcaagtgatttggatgataaggataatgggatgtctgcgaagccaattcaaaatggggtgattgccaaactttaaaaggacaaaagctagaaacatgtcacttgtttatcatcaccacagtaagtgcatcaatataaaaataacgaagcttattgtggcgcacttggatatttaagaataggtattttggtgatgcatgtgatgatgtaattagaaagtgtttggcctaaataaattcgcatataccatacactgttgcactttgttaggttcagtttcatatgtttttatacaaggattgttcttaatactatgatatatacattctttgtcctttacatgtgtcacgcatggattcgtataatttcggtagtacaaattaccaa

SEQ ID NO: 4517 - DNA, 2984 bp, Gossypium raimondii
aagtcactttttctttgttttcgtctttcactgaaaaaccaacaaactcgcttcctgcttttgtctataaaagcaaagccatccttcatttctaatttgggtattctctggaagccttttgaagtgaaaggttagaagttcagaatccaaaacagtaaacacagagatttagtatttgctgtatgtcagtagaatactacagtgataagtactacggtggatacggtgaggttgctaacccctcgcaatggcctcaactcaggaaaaggcgacgcattgttgcattcccaaaaccaacgacgacatcaaaaacaacaacaaggcccctcctcctcctcctccttcttcatctactaaggtgttgcagaactggagtgttgctcttgtttctgggtctaatccgtctgaggataccatttccaagagagcttccatggcaaccctgatccgccctgttgaacccatctcggatcctcctgctaccaataccactaccagcaaaggaatttcaatcatgccaagggctcaaaccagccatcctttggatccattatctgctgctgaaatctcggttgcagtggcaactgtaagagcagctggaaaaacccctgaggtgagagatagcatgcgctttattgaggtggccttggtggaaccagagaagcacgttgttgcattggcagatgcgtattttttccctcctttccagccttcattgcttcccaggacaaagggtggacctgtgattcctagtaaacttcctccgcgccaagcaagacttgttgtttacaataaaaggtccaatgagacgagtatatggatagttgaattatcagaagttcatgctgcaactcgaggaggccaccacaggggcaaagtcatttcgtctaaagttgttccggatgtgcaacctcccatggatgctatggaatatgctgaatgtgaggctgttgttaaggactttcctccttttcgagaggcaatgaaaaagaggggcattgaggatatggatcttgtgatggttgatccctggtgtgtggggtatcatagcgatgctgatgctcctactcgaagacttgctaaaccccttatcttctgcagaactgagagtgactgccccatagaaaatggttatgctcgtccagttgagggaatacatgtccttgttgacatgcaaaatatggtggtgattgaatttgaagaccgtaaacttgttcctcttccaccagctgatcctttaagaaattacactgctggtgaaacacgaggaggtgttgatcgaagtgatgtgaaaccactacaaatcattcaaccagaaggtcccagttttcgtgtcagtgggaattttgttgaatggcaaaagtggaatttccgaattggtttcactcctagggagggtctcgtaatatattctgttgcttatgttgatggtagtcgtggtcggaggcctatagcccatagattaagtttcgttgaaatggtagttccttacggagatccaaatgagccacattataggaagaatgcatttgatgcaggagaagatgggctgggtaaaaatgcacattctcttaagaagggttgcgattgtttgggatatatcaagtactttgatgctcattttacaaatttcactggaggtgttgaaacaattgagaattgtgtttgtttgcatgaagaggatcatggggtcttatggaagcatcaggactggagaacaggtttagcagaagtccgacggtcgagaaggctaacagtatcttttatatgcactgtagctaactatgagtatgggtttttctggcatttctatcaggatggtaaaattgaagctgaggttaaactcactggaattctcagcttaggagcattgcagcccggtgaaacacggaaatatggcacgaccattgctcctggattgtatgcccctgttcatcaacactttttcgtggctcgcatggacatggcagttgattgtaaacccggtgaagcgtttaatcaagtggttgaggtgaatcttaaagttgaagaaccagggaagaataatgtccataacaatgcattctatgctgaagaggaactactcaaatctgaactacaagcaatgcgtgattgtgatccattgtctgcacgccactggattgttagaaacacaagaaatgtcaacaggactgggcagctgacaggcttcaaactggtacctggttcaaattgtttgccactggctggctctgaggcaaaatttctgagaagggccactttcttgaaacataatctttgggtcacaccatattcacgtgaagaaatgcatcccggaggggagtttcccaatcaaaatccacgtgttggggagggattagctacttgggttaagcagaatcgatctttggaagaagctgatatagttctgtggtatgtctttggtgtgacacacgttcctcggctggaagactggcctgtcatgccagtggaacgcattggtttcatgctcatgccacatggtttctttaattgctcaccagcggttgatgttcctcctagcgcaactgatctggagctcaaggacactgacattgcaacaaagcctatccaaaacgggataattgctaagctttgaattgatcttcaattcggattttagcaaagattatgctttgcagtttgcagtgtgcaatatatacatcaaatattaaatagttgagccattggcctcagagctcaaactattagttactaaattgtttgtatttgcatgggacaagcctttgaatcagtgtcatctcttttactgttacagaatcacaatgtattttgaggttctgaattacagagttcttgccttattatgttggtcttcatgaagatcatcactctatttctttctgaagaaatatttatgtgcttatgaactatatatccatatctatatttatgtactttggttgtaagcatatggcttttgtgagtgaatgcaaatgtcatac

SEQ ID NO: 4518 - DNA, 3070 bp, Ricinus communis
ctccttttctcgactgtgatcgcgcacagtctctctctctctctcctccatagctcccaagagccactactcttctatgtctcttactgtttatttccatgaatattaacgcatttttcactatatagaaaaaaagaaataaatcaagagaaaaaaggagagtaaagatttagtttctttttctgtttgtttctctgtttttcttaaagattttctctgataatataagatattttagcgcgattaaaaaataaaaattagataacagagagacatagcgagggagagaggtaaagaagagaattgctgtatgtcagtagattgttgtatcgagacttactttggtggaattggcgagcttgcaaatcctctacaatggcctcaacttcgcaaaaaacgacgtcttcttgttgcgtttctaaaactccaactgattcttctgcttccttccttctccgccgtgaagcttcttctgctcctgctcctgctgctccgtcgtctactgtggtggctaacgtgctgcaagattggatcgatcgccctatcaacaagggcgccgatgataataagcttcctgccaaaaacgctgccgttgcttcattgattccagaaccttctactactaactccaccaataaaggcatcccagtcatgctgagagctcaaactagccatccactagatcctttgtctgctgctgaaatctctgtggcagtggccactgtccgagctgctggagccactcctgaggtcagagatagcatgcgttttgtcgaggtggtacttctcgaaccagataaacaggttgttgcgctggcagatgcttatttctttccccctttccaaccatcattgcttcccagaacaaaaggtggtgggcctgtaattcctaccaagttgcctccaaggagagctagacttgttgtttacaacaaaaggtcaaatgagacaagtgtttggattgtggagctatcagaagtacatgcagtaactcgaggcggacatcatagaggaaaagtaatttcgtcacaagttattccagatgttcagcctcctatggatgctgtcgagtatgctgaatgtgaagctgttgtaaaagacttccctccatttagagaggcaatgaagaagagaggtattgatgatatggaacttgtaatggttgatgcttggtgtgttggttatcacagtgctgctgatgctccaagtaaaagacttgccaaaccccttatattctgcagaactgagagcgactgcccaatggaaaatggttatgcacgcccagttgagggcatctatgtgcttgtagatatgcagaacatgaaggtgattgaatttgaagatcgtaaacttgtccccttacctccagctgatccattgaggaactatacgcctggggaaacaaggggtggtgttgatcgaagtgatgtaaaacctttacagatcgttcagcctgaaggtcctagttttcgtgtcaatggatactttgtagaatggcagaagtggaattttcgtattgggttcactccgagagagggtttggttatacattctgtcgcatatgttgatggtagtcgggggcgaagacctgtagctcacaggttaagttttgtagagatggttgtgccttatggagatccaaatgaaccacattataggaagaatgcttttgatgcaggggaagatggccttggtaaaaatgctcattcacttaaaaagggatgtgattgtttgggttacatcaaatactttgatgcccacttcacaaacttcacaggaggggttgaaactattgagaattgtgtgtgcttgcatgaagaggatcatggaattctatggaagcatcaagactggagaacaggcttagcagaagtacgaaggtctagaaggctcacagtgtcttttatatgtacagttgcaaattatgagtacggattctactggcacttttatcaggatggaaaaatcgaagctgaagttaaacttacgggaatcctcagcttaggagcattgcaacctggagagactcgaaaatacggcacgaacatagctccaggtctatatgcaccagttcatcaacatttttttgttgctcgaatcaatatggctgttgactgcaagcctggtgaagctttcaatcaggttgttgagatggatgttaaagttgagaaacctggggaaaacaatgtacacaacaatgcattttatgcagaagagacccttctcaaatccgaattgcaagcaatgcgggcctgtaatcctctgacagctcgccattggattgtgagaaatactaggactgtcaataggatgggacaattaacagggtacaagctggtacctggatctaactgtttgccgctagctggtcctgaggccaaatttttgagaagagctgcttttttgaagcacaatctttgggtcacaccttatgcacgcgatgagatgtttccgggaggagagtttcctaaccaaaatccacgtgttgctgaaggcctatctacatgggtgaagcagaatcgatctctggaagaaactgatgtagttctttggtatgtatttgggatcacacatgtaccgcggttggaagactggcctgtaatgccggtagagcgcataggttttatgcttatgcctcatgggtttttcaattgctctcctgctgtggatgtcccacccaatgtatgcgaactggatataaaagagaatgatgtcaaagaaaatggcgtggctaagcctcttcaaaatggtttgctggcaaagctctgaagccactcccaagttcgtgtccgcatgcaagaacctcaaggattactataaagcactaagcaataagtcggatcaggattaactggtttctgtaaaacttgaacgatcatgattttctttgttaatttagctttagctttggtctgatggatttattttagtttttggtgacaagtattggatttgaatgctggttagttgatccaagttgaaaagcagaatttcaattttccccgttatttctcgtccgtcgtttggtaatgtatttctttttcgaaccgagtccgtcgtggcaggtttg

SEQ ID NO: 4519 - DNA, 2919 bp, Ricinus communis
ccaagagccactactcttctatgtctcttactgtttatttccatgaatattaacgcatttttcactatatagaaaaaaagaaataaatcaagagaaaaaaggagagtaaagatttagtttctttttctgtttgtttctctgtttttcttaaagattttctctgataatataagatattttagcgcgattaaaaaataaaaattagataacagagagacatagcgagggagagaggtaaagaagagaattgctgtatgtcagtagattgttgtatcgagacttactttggtggaattggcgagcttgcaaatcctctacaatggcctcaacttcgcaaaaaacgacgtcttcttgttgcgtttctaaaactccaactgattcttctgcttccttccttctccgccgtgaagcttcttctgctcctgctcctgctgctccgtcgtctactgtggtggctaacgtgctgcaagattggatcgatcgccctatcaacaagggcgccgatgataataagcttcctgccaaaaacgctgccgttgcttcattgattccagaaccttctactactaactccaccaataaaggcatcccagtcatgctgagagctcaaactagccatccactagatcctttgtctgctgctgaaatctctgtggcagtggccactgtccgagctgctggagccactcctgaggtcagagatagcatgcgttttgtcgaggtggtacttctcgaaccagataaacaggttgttgcgctggcagatgcttatttctttccccctttccaaccatcattgcttcccagaacaaaaggtggtgggcctgtaattcctaccaagttgcctccaaggagagctagacttgttgtttacaacaaaaggtcaaatgagacaagtgtttggattgtggagctatcagaagtacatgcagtaactcgaggcggacatcatagaggaaaagtaatttcgtcacaagttattccagatgttcagcctcctatggatgctgtcgagtatgctgaatgtgaagctgttgtaaaagacttccctccatttagagaggcaatgaagaagagaggtattgatgatatggaacttgtaatggttgatgcttggtgtgttggttatcacagtgctgctgatgctccaagtaaaagacttgccaaaccccttatattctgcagaactgagagcgactgcccaatggaaaatggttatgcacgcccagttgagggcatctatgtgcttgtagatatgcagaacatgaaggtgattgaatttgaagatcgtaaacttgtccccttacctccagctgatccattgaggaactatacgcctggggaaacaaggggtggtgttgatcgaagtgatgtaaaacctttacagatcgttcagcctgaaggtcctagttttcgtgtcaatggatactttgtagaatggcagaagtggaattttcgtattgggttcactccgagagagggtttggttatacattctgtcgcatatgttgatggtagtcgggggcgaagacctgtagctcacaggttaagttttgtagagatggttgtgccttatggagatccaaatgaaccacattataggaagaatgcttttgatgcaggggaagatggccttggtaaaaatgctcattcacttaaaaagggatgtgattgtttgggttacatcaaatactttgatgcccacttcacaaacttcacaggaggggttgaaactattgagaattgtgtgtgcttgcatgaagaggatcatggaattctatggaagcatcaagactggagaacaggcttagcagaagtacgaaggtctagaaggctcacagtgtcttttatatgtacagttgcaaattatgagtacggattctactggcacttttatcaggatggaaaaatcgaagctgaagttaaacttacgggaatcctcagcttaggagcattgcaacctggagagactcgaaaatacggcacgaacatagctccaggtctatatgcaccagttcatcaacatttttttgttgctcgaatcaatatggctgttgactgcaagcctggtgaagctttcaatcaggttgttgagatggatgttaaagttgagaaacctggggaaaacaatgtacacaacaatgcattttatgcagaagagacccttctcaaatccgaattgcaagcaatgcgggcctgtaatcctctgacagctcgccattggattgtgagaaatactaggactgtcaataggatgggacaattaacagggtacaagctggtacctggatctaactgtttgccgctagctggtcctgaggccaaatttttgagaagagctgcttttttgaagcacaatctttgggtcacaccttatgcacgcgatgagatgtttccgggaggagagtttcctaaccaaaatccacgtgttgctgaaggcctatctacatgggtgaagcagaatcgatctctggaagaaactgatgtagttctttggtatgtatttgggatcacacatgtaccgcggttggaagactggcctgtaatgccggtagagcgcataggttttatgcttatgcctcatgggtttttcaattgctctcctgctgtggatgtcccacccaatgtatgcgaactggatataaaagagaatgatgtcaaagaaaatggcgtggctaagcctcttcaaaatggtttgctggcaaagctctgaagccactcccaagttcgtgtccgcatgcaagaacctcaaggattactataaagcactaagcaataagtcggatcaggattaactggtttctgtaaaacttgaacgatcatgattttctttgttaatttagctttagctttggtctgatggatttattttagtttttggtgacaagtattggatttgaatgctggttagttgatcca

SEQ ID NO: 4520 - DNA, 2846 bp, Elaeis guineensis
ctccgccacctctgtttttatttctggcggcgaaccggaaggagagagccctgcgtgcgagaaaggaaagaaaggagcggggacagaggtattccagctctctttttgagagagagggaaggaaggatcataaacaagagagttgggagaggaagaggagagagaggagacgagaggagggggttcgagagagagggaaaggcaacggaggcctgctgtatgtcagatcgtagtgagggatactacggcggattcggtgagctcgcgaaccccttgcaatggccacaactgaggaaaaagcgacgccttgctgcgcttccgcccccgccggcggcgacggaggcctccgaagggaggcggccggggtggtccgggaatggaccgccggcgagaagcagaccgtggcaacggcggccatgagctctctgatccgccccgtcgaggagattccggagccatccgcgaagccttccaccaaggggcttccgatgatgatgagggcccagacaaaacaccctttagacccattatctgctgctgaaatctctgtggcagtagcaactgttagggctgctggagcaactcctgaggtgagagatagtatgcggtttgttgaagttgttcttctggaaccagagaaacatgtggtggcattagctgatgcctactttttcccccctttccaaccatcgctacttcctagaacgaagggtggtcctgtcattccaagtaagcttcctgctaggagggccaggcttgttgtctataacaagcaatcaaatgagacaagcatctggattgttgaactatcagaagtacatgcagcaacccggggtggccatcacaggggaaaggtcatctcgtcagaagttgttcctgatgttcaacctcctatggatgctgtggaatatgcagaatgtgaagctgctgtgaaaagttaccctccattcatagaggccatgaaaaagagaggtatagaggatatggatcttgtgatggtagatgcctggtgtgctggctatcacagtgaagctgatgctcctagccgcagacttgccaagccactaattttttgtagaaccgagagtgattgccccatggagaatggttatgcacgtcctgttgaaggcattcatattcttgtcgatattcagaataatgtgataattgagtttgaagatagaaaactggttcctctacctccagcagatccattaagaaattatactcctggagaaacacgaggaggtgttgaccgtagtgatgtgaaacctctgcatattcttcagcctgaaggcccaagttttcgagttaatggtcactttgtagaatggcagaagtggaattttcgaattggttttactccaagggagggtttggtaatttattctgttgcatatattgatggtagtcgtggtcggagacccatagctcacaggttgagttttgttgagatggtagttccatacggagatccaaatgaaccacattaccgtaagaatgcatttgacgctggagaagatggccttggaaaaaatgcacactctcttaaaaagggctgtgactgtttgggctttattaagtactttgatgcacattttacgaattacaccggtggcatagagaccattgaaaactgtgtctgcttgcatgaagaggaccatggaatcttatggaagcatcaagattggagaacaggcttagcagaagtaaggcgatcaaggaggcttactgtatcatttatatgtacagtagctaattacgagtatggctttttctggcatttctatcaggatggtaaaattgaagcagaagtgaaactaactggaattctcagtttaggtgcattgctgcctggtgaatcaagaaaatatggtacaaccattgctcctggtttatatgcacctgttcatcagcatttctttgttgcacgtatggacatggccgttgattgtaagcctagtgaagcattcaatcaggtggttgaggtgaatgttaaagttgaaggaccaggccaaaataatgttcataacaatgcattttatgccgaagaaaagcttcttagatctgagttgcaagctatgcgtgattgtgatccttcatctgctcgccactggattgtaaggaacacaagaactgttaatcggactggccaacctacaggatacaagcttgtgcctggttctaattgtctacccttagctggtccagaggcaaaatttttgagaagagctgcatttttgaagcataatctttgggttacgccatataatcgtgatgagatgtaccctggaggagagtttcccaatcaaaatccacgtccaaatgagggattagcaacatgggttaagaagaataggccacttgaggaaactgacattgttctctggtacatatttggggttacccatattccaaggttggaagactggcctgtcatgcctgtggagcgcataggttttatgctcatgcctcatgggttcttcaattgctcccctgctgtggatgtgcctcctggtcatagtgaggtggaagtcaaggacaataatggaacgccaaagttgattcagaacggactgcttgcaaagctgtgaggggagatgtggaaggagaaactggaggaaacaaaaggaactttaatgttgtgcctgcaggatgtctgaaagttgcaataaatatgactttggattgcgttgtttgttgttttctgtattggtatatgttcgatctagctcgtacttcatttaagccatatgtctttcctgcagttagaagaaataccattgaacgtataaatttttagggtatgtttggttgtaatgagaattgctgggaaaacatatttt

SEQ ID NO: 4521 - DNA, 2781 bp, Medicago truncatula
ctttgcttcatcttctttattctagaaatttcttttgtttcagtggtgttacagatttcacgacgacgacggttgcgcggtggaagatcggaagaaaaagaaggtgagtcgccgtacctgcatgtcagtgtactgtcttgatacctattgtggtgctggaatcggcgaaatagcgaatcctttgcaatggcctcagcttcgcaaaagacgacgtcatcaccgtcttcttcttgttgtacccctctcgactcttcccgcttagctgctgtctccgccgcccccgccgttgctcaatccgatcacgttgctttgattcgtccgcttgattcgcttcctgaaccttctagtaccaatgctcccacttctaagggaatcacgtcaatgacaaggcctcagtcaagccatcctttggaccctctatctgcagctgaaatttctgtggcagtggcaactgttagggctgctggagctactccagagcttagagatagtatgcgcttcattgaagtagttttgctggaaccagataaacatgttgttgcactagcagatgcttatttttttccaccttttcaaccatcattacttcctagaagtaaaggaggacctgtaattcccacaaaacttcctccaagatgcgctagacttgttgtttacaataagaaatcaaatgagactactctgtggattgttgagttatcacaagtgcatgcagtaactcgaggtggccatcatcgaggaaaagtaatttcatcaaatgttgttcctgatgttcagcctccaatggatgctgaggaatatgcagaatgcgaggctgttgttaaaagttttcccccttttatagaggctatgaagaaaaggggtattgaagacatggatcttgtaatggttgatccctggtgtgtcggttatcatagtgaagctgatgctcctggtcgaagacttgctaaaccactcttattttgtcgatctgagagcgactgccctatggaaaatggttatgcccgcccagttgagggcatctatgttcttgttgatatgcaaaacatggtggtgatagagtttgaagaccgtaaacttgttcctctgcctccagttgatcccttgaggaactatactcctggtgaatccagaggtggttccgatagaagtgatgtgaaacctttacaaattattcaacctgaaggtccaagctttcgtgtcaatgggtattatgttgaatggcagaagtggaattttcgtattggattcacacccaaagaaggtttgattatatattctgttgcatatgttgatggtagtcgagggagaaggcctgtggctcataggctgagttttgtggagatggttgtaccctatggagatccaactgaaccacattataggaaaaatgcttttgatgccggcgaggatggcttgggaaaaaatgcacattccctcaagaagggatgtgattgtttgggctatatcaaatattttgatgctcacttcacaaatttcactggtggagttgaaactatcgaaaattgtgtatgtttgcatgaagaggatcatgggattctctggaagcatcaagactggagaactggcttagcagaagtccggaggtccagaagactttcagtttcttttgtatgcacagtggccaattatgagtacgcatttttttggcacttttatcaggatggaaagattgaagctgaagtcaagctgactggaattctcagcttaggagccttgatgcctggagaagttcgaaaatatggaaccatgattgcaccaggtctatatgctccagttcatcaacactttttcgttgctcgcatggacatgtctgttgattctagacctggtgaagctttgaatcaggttgtggaggtcaatatgaaagttgaagaacctggtgagaaaaatattcacaataatgcgttctatgccgaagagactttgctcaggtctgaattggaagcaatgcgtgattgcaatcctttgactgctcgacattggattgtaaggaacacaagaactggcaatagaactggacaattgacaggctacaagctggtaccaggttcaaactgcttaccattggcaggttctgaggccaagtttttaagaagagctgctttcttgaagcataatgtttgggtaacagcatattcacgtgatgaaatgtttcctggaggagaatttcctaatcaaaatccacgagttggcgaaggactagctacatggattaagcaaaaccggtctttggaagaaactaatatagttctatggtatgtatttggaatcacacatgttcctcgtctagaagactggcctgttatgccagtagaacacattggttttatgctcatgcctcatggattcttcaattgttctcctgcagtagatgtcccacctaattcatgtgaagtggaatctaaagacagtgatatcaaggataacggtgcttcaaagccaattcagggcgggatagcgtcgaagctttaggcacttgctgagacgggaaacgcaagttctattttggcgtccactgaaacaccaagttgagcagattgtatttttaatctacaataataataaagctatggacttaaatcttgattttctagtttatgatggggtgtttgctagtaatattcattagatttgtcttcgtacatgtgaaagctctgcttagcctaaaataagtggttcattacatgctgtgttatcaaagattcagaaatcactaaatctggcggtgttattgtgtgtgcctgtttttttttgccc

SEQ ID NO: 4522 - DNA, 2739 bp, Citrus sinensis
gaagcccaaactcttcccactctccctgcaaattgtttcagtttcgctgatcacactatactcccttcacattcttttgttcaagaacgaaaaggtttcttgaagattcaaggagttccgtaaagagaaagaaagaaagtagtgttgcagagagagtgagattggaagattggagtgaagagggtccttgctgtatgtcaaaagattgtaaagagacttattgtggtggaattggagagcttgctaaccctttgcaatggcctcaacttcgaaaaaggcgacgctttcttctttcagcgctcaggcactcgctcaagattctgtttctgtttctgctcccagagcctctatggtacgggattggagtagtgatcagccgcccaagaacgctgccatagcttctttgattcgccctgttgatccccttgccgaaacttccttaaacccttcatctaaaggaataactgccatgcccaggcctcaaaccagccatcctttggaccctttgtctccagccgaaatctctgtagcagtggcaactgtcagagctgctggacccactccagaggtcagagatagcatgcgctttgttgaagtggtcctggtggaaccagataaaaatgttgtggcactagcagatgcttacttcttccccccattccaaccatcattgcttcccagaaccaaaggcgggcctgttattcctagcaagctccctcctaggagagctagactggttgtgtataacaaaaagtctaatgaaactagtatatggattgttgagttatcacaagtacatgctgtcactcgaggtggacatcataggggaaaagtcgtatcatcacgcgtcgttcctgacattcaacctccaatggatgctgaggaatatgctcaatgtgaagctgctgtgaaagcctttcctccatttaaggaggcaatgaagaaaaggggaattgaagacatggatctcgtgatggtcgatgcctggtgtgttggttattacagcgatgctgatgcccctagccgaagacttgctaaacctcttatattctgtagaactgagagtgactgtccaatggaaaatggttatgcccgcccagttgagggcatctatgtacttgttgatatgcaaaacatggtggtgattgagtttgaagaccgaaaacttgttccactgcctccagcagatcctctgcggaactatacccgtggtgaaacaagaggtggtgttgatagaagtgatgtgaagcctttgcaaattgttcaacctgaaggtcctagttttcgcgtcaatgggtactttgtacaatggcaaaagtggaattttcgtattggtttcacccctagggaaggattggtaatctactctgttgcataccttgatggtagtcgaggtcgaagatctgttgctcacagattgagttttgttgagatggttgtgccttatggcgatcccaatgagccacattacaggaagaatgcttttgatgcaggggaagacggccttgggaaaaatgcacattctcttaaaaaggggtgtgactgtttgggctatattaaatactttgatgcccactttacaaattttactggcggtgttgaaacaatagaaaattgtgtatgcttgcatgaagaggatcatgggatgttatggaagcatcaagattggagaactggcttcgcggaggttcgaagatctagacggctaacagtgtcttttatttgtactgtggccaactatgagtatgggttctattggcacttttatcaggcaagtggaaaatcatatggtttttgtgatggaaaaatagaagctgaagttaagcttacaggagtcctcagcttaggggcactgcaacctggagaatcccgaaaatatggtacaatgattgcaccaagtttatatgcaccagttcatcaacacttcttcattgcccgtatggatatggaagttgactgtaaacctggtgaagctttcaatcaggttgttgaggtagatgtgaaagttgagaaacctgggggctccaatgttcataataatgcattctatgctgaagagacgctgcttaaatctgaaatgcaagcaatgcgtgattgtaatcctcttactgctcggcactggattgtgaggaatacgagaactgtaaaccggactggtcagctaacagggtacaagttggtacctggttcgaattgtttgccattggctggtcctgatgccaccgtttttagaagagctgcctttttgaagcataacctttgggttacagcatatgctcgcgacgagatgtttccaggaggagaatttccgaatcagaatcctcgtattggtgaaggactgccagcatgggtgaagcagaatcggccgttggaagaaagcgatatagttctttggtatgtatttggcatcacacatgttcctcggctggaagattggcctgttatgcctgtggagcgcattggcttcatgcttatgccgcacgggttcttcaattgctctcctgctgttgatgtcccgccgagtgcatgcgaattggatgccaaagacaacgatgtcaaagataacactgtaccaaagcctatacgagagggattgctggccaagatctgatttctaaagcaattggccatttcagctcttggcatgcaggactgccttctatcctccaatgtggatttcatcttacaagtcaaaactttctttgtattgaactagtggctgtttctgttttttctttc

SEQ ID NO: 4523 - DNA, 2739 bp, Citrus clementina
gaagcccaaactcttcccactctccctgcaaattgtttcagtttcgctgatcacactatactcccttcacattcttttgttcaagaacgaaaaggtttcttgaagattcaaggagttccgtaaagagaaagaaagaaagtagtgttgcagagagagtgagattggaagattggagtgaagagggtccttgctgtatgtcaaaagattgtaaagagacttattgtggtggaattggagagcttgctaaccctttgcaatggcctcaacttcgaaaaaggcgacgctttcttctttcagcgctcaggcactcgctcaagattctgtttctgtttctgctcccagagcctctatggtacgggattggagtagtgatcagccgcccaagaacgctgccatagcttctttgattcaccctgttgatccccttgccgaaacttccttaaacccttcatctaaaggaataactgccatgcccaggcctcaaaccagccatcctttggaccctttgtctccagccgaaatctctgtagcagtggcaactgtcagagctgctggacccactccagaggtcagagatagcatgcgctttgttgaagtggtcctggtggaaccagataaaaatgttgtggcactagcagatgcttacttcttccccccattccaaccatcattgcttcccagaaccaaaggcgggcctgttattcctagcaagctccctcctaggagagctagactggttgtgtataacaaaaagtctaatgaaactagtatatggattgttgagttatcacaagtacatgctgtcactcgaggtggacatcataggggaaaagtcgtatcatcacgcgtcgttcctgacattcaacctccaatggatgctgaggaatatgctcaatgtgaagctgctgtgaaagcctttcctccatttaaggaggcaatgaagaaaaggggaattgaagacatggatctcgtgatggtcgatgcctggtgtgttggttgttacagcgatgctgatgcccctagccgaagacttgctaaacctcttatattctgtagaactgagagtgactgtccaatggaaaatggttatgcccgcccagttgagggcatctatgtacttgttgatatgcaaaacatggtggtgattgagtttgaagaccgaaaacttgttccactgcctccagcagatcctctgcggaactatacccgtggtgaaacaagaggtggtgttgatagaagtgatgtgaagcctttgcaaattgttcaacctgaaggtcctagttttcgcgtcaatgggtactttgtacaatggcaaaagtggaattttcgtattggtttcacccctagggaaggattggtaatctactctgttgcataccttgatggtagtcgaggtcgaagatctgttgctcacagattgagttttgttgagatggttgtgccttatggcgatcccaatgagccacattacaggaagaatgcttttgatgcaggggaagacggccttgggaaaaatgcacattctcttaaaaaggggtgtgactgtttgggctatattaaatactttgatgcccactttacaaattttactggcggtgttgaaacaatagaaaattgtgtatgcttgcatgaagaggatcatgggatgttatggaagcatcaagattggagaactggcttcgcggaggttcgaagatctagacggctaacagtgtcttttatttgtactgtggccaactatgagtatgggttctattggcacttttatcaggcaagtggaaaatcatatggtttttgtgatggaaaaatagaagctgaagttaagcttacaggagtcctcagcttaggggcactgcaacctggagaatcccgaaaatatggtacaatgattgcaccaagtttatatgcaccagttcatcaacacttcttcattgcccgtatggatatggaagttgactgtaaacctggtgaagctttcaatcaggttgttgaggtagatgtgaaagttgagaaacctgggggctccaatgttcataataatgcattctatgctgaagagacgctgcttaaatctgaaatgcaagcaatgcgtgattgtaatcctcttactgctcggcactggattgtgaggaatacgagaactgtaaaccggactggtcagctaacagggtacaagttggtacctggttcgaattgtttgccattggctggtcctgatgccaccgtttttagaagagctgcctttttgaagcataacctttgggttacagcatatgctcgcgacgagatgtttccaggaggagaatttccgaatcagaatcctcgtattggtgaaggactgccagcatgggtgaagcagaatcggccgttggaagaaagcgatatagttctttggtatgtatttggcatcacacatgttcctcggctggaagattggcctgttatgcctgtggagcgcattggcttcatgcttatgccgcacgggttcttcaattgctctcctgcagttgatgtcccgccgagtgcatgcgaattggatgccaaagacaacgatgtcaaagataacactgtaccaaagcctatacgagagggattgctggccaagatctgatttctaaagcaattggccatttcagctcttggcatgcaggactgccttctatcctccaatgtggatttcatcttacaagtcaaaactttctttgtattgaaccagtggctgtttctgttttttctttc

SEQ ID NO: 4524 - DNA, 2333 bp, Aquilegia formosa
acaaatctgaaaaatctctgatgtccataactccagaaaaagcgacgtattgttgcattaataacaccaagaaatcaaacttatccaatcttcccatgcttaccgatcaaaacaaacagcagcaagaacaacagcagaagaaagtttcagctatggcgtccttaattaatcctgttgaatctattccagaaccttcaactcatctgccaactaaagacctccagatcatgatgagggctcaaagcagccaccctttggatcctttatccgcagcggaaatatcagtggcagttgggactgtcagggctgctggagctacacctgaggttagagacagtatgcggtttattgaagtggttcttttggaaccagataaacatgttgttgcactggcagatgcatatttctttccaccttttcaaccttccttacttcccaaaacaaaaggtggacctgttattgccagtaagctcccccctaggcgggccagacttgttgtttacaataaaaagtcgaatgagacaagcatctggattgttgagctgagtgaagtacatgctgcgactcgaggtggccatcacaggggaaaggttatttcgtcagaaatagttccagatgtacaacctcctatggatgctgtggaatatgctgaatgtgaagctgttgtaaaagacttccctccctttcgagaggcgatgaagaagaggggtattgaggatatggatctcgtgatggttgatccatggtgtgttggttactatagtgattctgatgctcctagtaggaggcttgctaaaccactaattttctgtagaactgagagtgactgcccaatggaaaatggttatgcacgcccggttgaaggcatctacatagttgtagatatgcaaaatatggttgtagttgaatttgaagatcgtaaactagttcctcttcctcctattgatccattaagaaactatacttcgggtgaaacgcggggaggtgttgaccggagcgatgtgaaacctctgcaaataattcaaccagaaggtccaagtttccgtgttcatggtcactttgtcgaatggcaaaagtggagttttcgaatcggcttcactccgaaggagggtctggtactatattcggtagcatatactgatggttgtaggggaaggagacctgtagctcacaggctgagttttgttgagatggtggtaccctatggggacccaagtgagccacattacaggaaaaatgcctttgatgctggagaagatggccttggtaaaaatgcccactcccttaagaaggggtgtgactgcttgggatacatcaaatacttcgatgcacattttacaaatttcactggaggagtcgagacaactgaaaactgtgtttgtttacatgaagaggatcatggcatgctatggaagcatcaagattggaggacaggcttggcagaagttaggcgttctagacgccttacagtttcttttgtatgtacaatagctaactatgagtacggattcttctggcacttctatcaggatgggaaaattgaagctgaggtaaaacttacaggaattctcagtttaggagcactgcaaccaggggaatctagaaaatatggtacaacgattgctccaggattatatgcacctgttcatcaacatttctttgttgctcgcatggacatggctgttgactgtaagcctggtgaaacgtttaatcaggttgttgaagtgaatgtcaaagttgaagaacctggaaagaacaatgtccacaacaatgcattctatgctgaagaggaactgcttacatcggagctggatgctattcgtgactgcagtcctttgactgctcgtcattggattgtcaggaatacgagaacagtcaaccgaactggccagttaacgggctataagctagtgcctggatcaaattgtttgcctttagctggctctgaagcaaaatttttgagaagagctgcattcttaaagcataatctttgggttacttcctatgctcctggtgagatgtatcctggtggagagtttcctaatcaaaatccacgtgttggtgaaggtttggctacgtgggttaagcaaaaccggtctcttgaagaaactaatatagttctctggtatgtatttggtgtgacgcacattccaagattagaagactggcctgtcatgccagtggagcacatcggttttaagcttatcccacatggtttcttcaactgctcccctgctattgatgtgccaccctcttcaagtgatctggaagtaaaggaaaatggagtgtcaaagccttttcagaatgggttgctagcaaagctttaataaact

SEQ ID NO: 4525 - DNA, 2862 bp, Eutrema parvulum
tgcaattgaatcagtgttttcctccaccaccatcacgggaaaggtacgatcaagataccttcgaaactcagatccggtgaagagagtccaccgttacagtaagcttttcgaacttcggagctgaagttgagagtcagtagctgtgatttgtgtcaccggtgatcggagatttataactctccgggaaaaaccggttgttacgggaacttagtggaaatctgcttggagcttccttcttttttataaaccgagagtggtggagagaaggggggagatcaagcgacggatagagatagtttttgctgtatgtcagtagattgtgttgagacttattttggtggatttggagagctcgtgaaccctattcaatggcctcaacttcgaaaaagacgacggcatgtactcaccacggtggctctgctccgcctccgaaactcgcctccgccatggccaatacggttgctggatggtccgaaggtgagaatcagcgagcctctaaggttgctttggaatccgtaatccgccctgtcgattcgcttcctgatacggccaagaaacctgcgaacaaaggaatttctgtcatgccaaggacggaaacaaagcacccattggatcctctatctgctgcagagatatcagttgccgtggcgactgtccgcgctgctggtgctaaccctgaggttagggatagcatgcgtttcatcgaggtggcgtcagtggaaccagagaaacatgttgtggcgctggcagatgcttacttttttcctccgttccagccatcactacttccaagaattaaagctggacctgtgatccctatgaaactccctccaaggcgagcaagacttgttgtgtacaacaagacgtccaatgagacaagtgtctggatcgtggagttatctgaagttcatgctgtcactcggggtgggcatcacaggggaaaagttgtttcctcacaagtgatacctgatgttcagccacccatggatgcggctgaatatgctgaatgtgaagcgattgtcaaagacttccctccattcattgaggcaatgaagaggagaggtattgaagacatggatctagtgatggttgatccctggtgtgtgggttatcatagtgaatctgacgctcctagtcgtaggcttgcaaagccccttatatactgtcgaactgatagtgattcccctatggaaaatggctatgctcgtccagttgagggcgtttatgtacttgtagacatgcaaaacatggtggtgattgagtttgaagaccgtaagtttgtgccacttcccccacctgaccctttgaggaattatacacccggtgagactagagggggtgttgatagaagtgatcttaagcctctccagattattcagcctgaaggtccaagttttcgcgtaaggggttactttgtcgagtggcagaagtggaactttcgtattgggttcactccaagggaaggtttagtcatacattcggtagcatatgttgatggcagtcgaggtcgaaggcctgttgcacacaggctaagttttgtggagatggttgtgccttatggtgatccgaatgagccacattacaggaaaaatgcttttgatgcaggggaagatggtcttgggaaaaacgctcattcgcttaagaaggggtgcgactgtctgggatctataaagtactttgatgcccatttcacaaattttactggaggagttgaaacaattgagaactgtgtatgcttgcatgaggaggaccatggaattttgtggaaacatcaggactggagaacaggattagctgaagtgcgaagatctaggaggctaactgtctcctttttatgtactgttgctaattacgagtatggattttactggcacttctaccaggatgggaaaatcgaagctgaagtaaaacttactggtattctcagtttaggagcgctgcagccaggagaaactcgaaagtatggtactactattgctcctgggttgtacgcaccagttcatcaacatttctttatcgctcgtatggatatgtctgttgactgtaaacctggtgaagcttttaaccaggtagttgaggtaaatgccagagttgacgagcctggtgagaacaatgtccacaacaatgcgttttatgcggaagagaagttacttaaatctgaggcagaggcgatgcgtgactgtgacccttttagtgctcgccattggattgtaaggaacacaaggacagtaaacaggacggggcaattaacggggtacaaacttgttccgggctcaaattgtttgccattagctcggcccgaggccaagtttctaagaagagctgctttcctgaagcataatatttgggttactcgttatgcccctgaagagaagtttccaggaggggagttcccaaaccaaaacccacgtgctggtgaaggtctagccacatgggttaaacagaatcgctccttggaagaatctgatgtcgttctttggtatgtctttgggatcatacatgttcctagacttgaagattggccggttatgcccgtcgaacatattggtttcacgctaatgccacatggattcttcaactgctcaccggccgtggatgttccgccgaatccagcatgcgaattggatactaaggagagtgaggtcaaagaggttgtagcaccaaagcctcttcagactggtttactttcaaagctttgaagaacacaatttcttcccttttccattttttctcttaatactaataaattttggagacgttgctgtacgctcagttcaatttcggattcgaatcttttgttgtttggtgtgttggttgcagaccaaaagacctttgtcattggaatattccttttcttttctc

SEQ ID NO: 4526 - DNA, 2618 bp, Silene vulgaris
gagagtagagagtgaatctccggcaacgaaatatctctcgtcgtcgtcggagataagatatttcgagaaattttagaaatctaccaaaaaaaggaaaggtgaatattctgtatgtcaattgtagtaaatagcagtgatcaatacaataattacgattcatattctggcattttctctaatcctcttcaatggcctcaacttcgaaaaaagcgtcgtctccttcgccttcggtttgctgtagtcaacttaattccgtctccatgtccgtcgcttcttccgccgtctctgccgccgccgccgctgacaaggtcgttgataagtccgctgtcggtgtttccgttgatcagaatccggtgacggaagtgtcggcgcagttgattcgtcctattgattcgctttccgatgcggcaaagccgaaagggattccactgtctttgagggctcaaacaagtcaccctttagatccgttgtctgctactgaaatcaaagttgcagttgctacagtcagggctgctggtgcaactcctgaggtgagggatggaatgcggtttattgaggtagttttatgggagccagaaaagcacgtggttgctatggcagatgcatatttctttcctccgttccagccgtctttgcttcccaggataaaaggcagacctgtaataccagctaaacttcctcctaggcaggcaagacttgttgtctacaacaaaaagtcaaatgagactaccttatggacagtcgaactcacagaagttcacgcaactactcgtagcggtcaccataggggcaaagtaatttcgtccgtagttgttcctgacgtccagcctcctatggacgcagtagaatatgctgaatgcgaagcagttgtgaaggattatcctcctttcagtgaggctatgaaaaagaggggtattgaggatatggatcttgttatggttgatgcatggtgtgttggctatcacagtgaggttgattccccaagtcggagacttgctaagcctcttattttctgtagaactgagagcgactgcccgatggagaacggttatgctcgcccagttgaaggaatctatatccttgttgacatgcaaaatatggtagtggtggagtttgaagacaggaaatttgttcctttaccgcctgcagatccattaagaaattacactcctggtgaaacacgaggaggtgttgaccggagtgatgtgaaaccactgcatattcttcagcctgaaggcccgagtttccgtgtgaatggccactttgttgaatggcaaaagtggagtttccggataggctttactccacgggaaggtttaattatacattctgttgcttatgttgatggaagtagaggccgtcgttctgtggctcacaggttgagttttgttgagatggttgttccttatggtgatcccaatgaaccgcattacaggaagaatgcatttgatgctggtgaagatggcctgggcaagaatgctcactctctaaagaaggggtgtgattgtttaggttatattaagtattttgatgctcattttacaaactttacgggaggtgtcgaaacaatagaaaactgtgtctgtctacatgaggaagaccatggaatattatggaaacatcaagattggcgaactggattagctgaagttagaagatccagaaggcttactgtgtccttcatttgcacggtggccaactatgagtatggattctactggcacttttaccaggatggaaagattgaggctgaggttaaattgacaggaattctcagcttaggagcacttctgcctggtgaagtcagaaaatatggaacaacaatcgctcctggcctgtatgcaccagtgcatcagcacttttttgttgcccgtatggacatggcagtggattgtaagcctggtgaagctctaaatcaggtggttgagttaaatgttaaggttgaggatcctgggaaagacaatgttcataataatgcgttctatgctgaggagaaaatactcaaatctgaactgcaagcaatgagagattgcaatccgttgactgctcgccattggattgtcaggaatacaaggaccgttaatagaacagggcaactaactggatacaagctagtccctggttccaattgtttaccattagcaggcccagaggcaaaatttctaagaagagccgccttcttgaagcataacctttgggttactccatatgcactcaatgagatgtatccaggtggagaatttccaaatcaaaatccgcgtgctggagaagggttgtctacttgggttaaacaaaatcgctccttggaagaggctgatatagttctttggtatgtattcggggttacacatataccacgtcttgaggactggcctgtcatgcctgttgaacgtttgggctttatgctcatgcctcatggattcttcaattgttcaccggctgttgatgtcccaccgaacacacatgaatctgatatcaaagaaagtgccgttgtggtcgctaagcctgcccagaatgagcttattgccaaactttgaaaatccattaaccttgaaaatttcatctttttaagttggccgtaaaaaaatgtgttttgtaatataccgtagttgcttttt

SEQ ID NO: 4527 - DNA, 2382 bp, Manihot esculenta
cgaaccctctgcaatggcctcaactacgcaaaagacgacgcctcctccttcttcgtgttgcgcctctccaagtgactctgcttccgttcgtctcgaggctgctacagctccttcttccgtggtgccgaatgcggtgcaagattggagtgatcgccgcctcgaggatcagttaggcgagaaggctgccatcgcgtccttgattcgccctgccgattcgcttcccgaaccttccacaaacgccactgccaaagcgggcatcccagtgatgttgagggctcaaacaaggcatcctttggatcctttatctgctgctgaaatctctgtggcagtggcaactgtcagggctgctggagccactcctgaggtcagagatggcatgcggttcattgaagtggttcttttggaaccagataaacatgttgttgcgctggcagatgcatatttcttcccccctttccaaccatcattgcttcatagaacaaaaggtggacctgtaattcctaccaagctgcctccaaggagagctagaatagttgtttacaacaaaaggtcaaatgagacaagtaaatggattgtggagctatcggaagtacatgcagtaactcgaggtggacatcataggggaaaagtaatttcatcacaagttgttccagatgtacagcctcccatggatgccgttgaatacgctgaatgtgaagctgttgtaaaagacttccctccatttagagaggcaatgaagaaaagaggtattgaagatatggaacttgtgatggttgatgcatggtgtgttggttatcacagtgaggctgatgctccaagcaaaagacttgctaaacctcttatattctgcagaactgagagtgactgcccaatggaaaatggttatgcacgcccagttgagggcatttatgtgcttgttgacatgcagaacatgaaagtgattgagtttgaagatcataaacttgtgcctttacctccagctgatccattaaggaattatactcctggtgagacaaggggtggtgttgaccgaagtgatgtgaaacctttacaaattgttcagcctgaaggtccaagctttcgtatcaatggctactttgttgaatggcaaaagtggaattttcgtattggattcaatcccagagagggtttggttatacattctgttgcatatgttgatggtagcggggggcggagacctgttgcccacaggttaagcttcgtagaaatggttgtgccttatggagatccaaatgatcctcactatcggaaaaatgcttttgatgctggggaagatggccttggtaaaaatgcacattctcttaaaaagggatgtgattgtctgggttatatcaaatactttgatgcccactttacaaatttcacaggaggtgttgaaacaattgaaaattgtgtatgcttgcatgaagaggatcatggaattctatggaagcatcaagactggagaactggattagcagaagtacgaaggtccagacggctcacggtgtcttttatatgtacagttgctaattatgagtatggattcttctggcacttctatcaggcaagttggatttctgatggcaagattgaggcagaagttaaacttacaggaatcctcagcttaggagcagtgcaaccaggagaaactcgaaaatatggcacaatcattgctccaggtctatatgcaccagttcatcagcatttctttgttgctcgtatgaacatggctgttgattgcaaacctggtgaagctctcaatcaggttgttgaggtggatgttaaggttgagaaacctggggagaacaatgtccacaataatgcattttatgctgaagagactctgcttagatcggaattgcaagcaatgcgggactgtaatcctctaacagctcgccattggattgtgagaaatactagaactgtcaataggatgggacagttagcagggtacaagctggtacctggttcaaactgtttgccattagctggtcctaaggccaaggttttgaggagagctgcttttttgaagcataatctttgggttacaccttatgcacgtcatgagatgtttcctggaggagagtttcctaaccaaaatccacgtgttggagaaggacttgctacatgggtgaagcagaatcggtatgtttttggaatcattcatgttcctcgattggaagactggccagtgatgcccgtagagcgcattggttttatgcttatgccgcacgggttcttcaactgctctcctgctgtggatgtcccaccaaatgcatgtgaattggataccaaagacactgatatcaaagacaatggcgtggccaagcctcttcaaagtgggttgcttgcaaagctctgaatgggcttccaaattac

SEQ ID NO: 4528 - DNA, 2618 bp, Centaurea maculosa
tagtttgttgttgctatatgtcactggaggagtacttccacagtggtgatcaggaggaggaatacggtgcttacagtgagcttgataaccctctccaatggcctcagcttcggaaaaagcgacgtcacttctcctccgagaggtcgcttcctcctccgccgccgccgccgatgtggtgcaggattggaccaccgatccttccgtcggagatcagattcgccaccgcggcacggcggctgctgtcggtgagttaattcgtccggtcgttaatcaatcgtccgctgctgcaactgctgctaaaggaactgggccgacgagtatggtcagggcgcagactcgccatccacttgatcctctagctgctgctgaaatctccatagccgtggcaactgttagggctgccggagcaactccagaggtaagagatagcatgcgatttatagaggttgtgttggtggaaccagcaaaaagtgtggttgcattagcggatgcatattttttcccaccttttcaaccgtcgttgttgcccaggacaaagggaggacccataattcccacaaaacttccacctcgacaagctagacttatcgtttacaacaagaaatcaaatgaaactagcatatggattgttgagctatcagaggttcatgctctaactcgaggtggccaccatagaggcaaggtcatttcatctaaagtagtgcctgatgtacaacctcctatggatgccgtggaatatgctgaatgtgaagccattgtaaaggacttccctccatttcgcgaggccatgaagaggaggggaattgaagatatggatcttgttatggtagatccttggtgtgttggttatcatagtgaagctgatgctcctaaccgtagactagccaaaccacttatattttgtcgaacagaaagcgactgtcccatggaaaatggttatgctcggcctgttgaaggaatcgacgtgctagttgatatgcaaaatatggtggtgatcgagtttaaagaccgcaaacttgttcctctaccaccagcagatccattaagaaattacacggctggtgaaacaaggggaggtgttgatcgaagtgatgtgaaaccgctaaacattgttcagcctgatggtccaagttttcgtgttgatggccattttgttcaatggcagaagtggaattttcgtattggtttcactcctagggagggtttggtcatttattccgttgcatatgttgatggtagccgaggtcgtaggcctgtggcccacagattaagcttcgtggaaatggtggttccttacggtgatcccaacgatccccattacaggaagaatgcattcgatgcaggggaagatggactaggtaaaaatgcccattctcttaaaaagggttgtgattgtttgggctatgtcaagtattttgatgcacacttaacaaatttcactgggggtgtcgaaacaattgaagattgtgtttgcttacatgaggaggatcacggaatcttatggaagcatcaggactggagaacaggtttagctgaagtacgccggtcaagaaggctagtagtgtcttttatatgtaccgtggccaactacgagtatgggttctactggtacttttatcaggatggaaaaatagaagctgaggtgaaattaactggaattctcagcttaggagctttacaacccggggaagctagaaaatatgggactatgattgctcctggactctatgctcctgttcatcaacacttctttgttgctcggatggatatgtctgttgactgtaagcctggtgaatcccacaatcaggtggttgagttggatgttaaagttgaaggaccaggagatgcaaatgtgcacaacaacgcgttctatgctgaagagaaactgttgaaatccgaattagaagcaatgcgtgattgtaatccttcatctgcccgacattgggttatcaggaacacaaggactgtaaaccgaactgggcagttgacaggctacaaactagtacctgggtcgaattgtttaccgctaggtggtgcagaggccaagtttttgagaagagcagctttcttgatgcacaacctatgggttacgccatatgaaccaaacgaaatgttccctggtggggagttccctaatcagaatccacgtgtcggagagggattggctacttgggtcaagcagaatcggtctctagaagaaaccgacctggttctttggtatgtatttggaataacacacgttcctcgactggaagactggcctgttatgccagtagaacacatcggcttcgttctcatgccacacggattcttcaactgctcaccagcagtggatgttcccccgagctcgatggctgatttggaattaaaggaaaacggattggtagaaaaggcatgccacaatggtctcgtttcaaagatgtgaaatgacggatctgtaccacgtaagtttactctatttaatgctcttcttatttgtgctctaaaatgctatatttaaaaaccattctttaggttacaataattaatatattcttttgaacttcggtattggtttcgtttttaattcttacgtgtttagtttccgttgtaaaaaagtaaaaagtaaccgactagcg

SEQ ID NO: 4529 - DNA, 2730 bp, Cichorium intybus
ttttagagagggaaacatatagacacatatacgtatagagcgagagatagagtttttgctgtatgtcagtggagtactactacagtggtgaccaaaaatacggcgcttacagtgagcttcataaacctctgcaatggcctcatcttcggaaaaagctacggctcttctcctccgagacgttacgtcgtcctctgccgccgatgtcgtccaggattggacctctgatccctccgtcggcgatcagattcgccaccgcggcacagctacttctgtcggtaacttgattggtcccgttgttactcaaacctccgctgctactgctgctgctaaaggaactgggccaacaagtatggtgaggatgcagagtcgccatccacttgatcctttagctgctgctgaaatctccatagccgtggcaactgtcagagctgcaggagcaactccagaggtgagagacagcatgcggtttatagaagtagtccttgtggaaccatcaaaaagtgtagttgcattagccgatgcatacttcttcccaccttttcaaccatcattacttccaagaacaaaaggaggccccataatcccaacaaaactcccccctcgacaagctagactcattgtctacaacaagaaatcaaacgaaaccagcatatggattgtcgagttatcagaagtccatgctttaactcgaggtggtcaccatagagggaaagtcatctcatctaaagtagtccctgatgtacaacctccaatggatgctgttgaatatgctgaatgtgaagcgattgtaaaggacttccctccatttcgtgaggccatgaagagacggggtattgaagacatggatcttgtgatggtagatccatggtgtgttggttaccacagtgaagccgatgcacctaaccgtaggctagctaaaccgcttatattttgtaggacagaaagcgattgtcccatggaaaacggttatgcgcgtccggttgaaggaattgatgttttagttgacatgcaaaatatggttgtaatcgagtttaaagaccgtaaacttgttcctttaccaccagctgatccattgagaaattacacagctggcgaaacaagaggaggtgttgaccgaagtgatgtcaaacccttaaatattgttcagcctgatggccctagttttcgtgttaatggccattttgttcaatggcaaaagtggaattttcgtattgggttcactccaagagagggtttgatcatatattctgtagcatatgttgatggaagccggggtcgtaggcccgtggcccacagattaagctttgtagaaatggtggttccttatggtgatccaaatgatcctcattacaggaaaaatgcatttgatgcaggtgaagatggactaggaaaaaatgctcattctcttaaaaagggttcggattgtttggggtatgtcaagtattttgatgcccacttgacaaatttcacaggtggtgttgaaacaattgaagattgtgtttgcttacatgaagaagatcatggaattttatggaagcatcaagattggagaacaggtttagctgaagtaagacgttctagaaggctagttgtgtcttttatatgtactgtcgccaattacgagtacggattctactggtatttttatcaggatggaaaaatagaagctgaggtaaaattaactggaattttaagcttaggagctttacaacctggtgaagctaggaaatatgggactatgattgctcctggactttatgctcctgttcaccaacacttctttgttgctcgaatggatatgtctgttgattgtaaacctggtgaatcacacaatcaggtggttgagctggatgtaaaagttgaaggaccaggggaatcaaatgtacacaacaatgctttctatgctgaagagaagcttttgaaaacagaactagaagcaatacgtgattgtaacccttcatctgcacgacattgggtgatcaggaatacgagaactgtaaaccgaacgggtcagttgaccgggtacaaactagtacctggatctaattgtttaccgttaggtggggcagaggctaagtttttaaggagggccgcttttttgatgcataatttgtgggtgacgccgtatgtaccggaagaaatgtttccaggtggcgagtttcctaatcagaatccacgtgttggtgagggattggctacttgggttaaacagaatcggtctctagaagaaacagacctagttctttggtatgtgtttggaattacacacgtcccacgactggaagattggcctgttatgccggtggagcatattggatttgttcttatgccacatggattctttaactgctcgccagctgtggatgttccacctagctccttggctgatttggaaatgaaggaaaatggaatggtggataagccatgtcataatggtcttgtttcaaagatgtgaaatgaagcactaaaaccacgtaagtgtcccccatgtgcttatacaatgccatcttattaatgcaaatgatggtatattgcatcacattcgcgtttgtactatatttctattttacaattgaaaataatttcaagactctgtacaacagcatgtaatgcaaagaaggctaaatcgtcctaggattaaactacaacattgtctaaaaatacttttaactataatataactactgttgtgcgttatttatattattgataaaatattaaattatatgc

SEQ ID NO: 4530 - DNA, 2795 bp, Allium cepa
atattttctcctccctcgtttcggatttgcagttttcctctaatttatttccgaatttaaggttcacaactttcccttttccgctctttcttgacatatattttttgccagaaaacacaaccttttcccatttcttgattggagagcgagagagagaacgcgcgggggataaagtgtgaaaaaggcgacggaggacatccgctgtatgtcagattgctgtagcgaaggcgatttgagttacggagcaagattcggcgaactcgctaaccctaaacaatggccacaactgcggaaaaagcgacggtttgttgtaacaccaataatcgttcgaatgacaagagtttgattaagagcagcggtgttgttgataaaaaaggatcggatgttgttagagctgctgccgcgatgaattccttaattggaaccgttgatgctccacctgctgctaaagctcctgccagtaaagggattccaataatgatgagggctcagtcaagccaccctttagatccattgtctgcagctgaaatctctgttgctgttgcaacagtacgagctgctggaaaaacaccagaggtgagagatagcatgcgctttgtcgaagttgttttatttgaacctgaaaagagcatcgtcgcattagctgatgcatattttttcccacctttccaaccatcgctagtgcctagaacaaagggtggacctgttattcctagcaagcttcctcctagaagagctagacttgttgtctataacaaacaatcaaatgagacaagtgtgtggatcgtagagttgaatgaagttcacgctgcaacacgtggaggccaccatagaggcaaggtcatttcatctgaagttgtccctgatgtacaaccgcctatggatgctgtggaatatgcggagtgtgaagctgtggttaaagaataccctccttttcaagatgcaatgaaaaggcgaggtattgaagacatggatctcgttatggtagatgcttggtgtgttggctatcatagtgaatcagatgctccaaacaggcgtcttgctaaaccacttatattttgtcgaactgagagtgattgtgctatggaaaatggttatgcacgtccagttgaaggcatacatgtgcttgttgatattcaacatgtggagataattgagtttgaagacaagaagctggttcctctgcctccttcagacccgctaagaaactacacaccaggagaaaccagaggaggtgttgatcgtagtgatgtgaaacctcttcaaattattcagcctgaaggtcctagttttcgtgtcagtggtcactttgttgaatggcaaaagtggaattttcgtgtgggtttcactccaagggaagggttggtaatatattcagtggcatatgttgatggtaatcgtggtcgaaggccagttgcacatagactgagttttgttgaaatggtggtaccttatggagatccgaatgagccacattatcgtaaaaatgcatttgatgcaggggaggatggacttggaaagaatgcacattctctaaagaagggatgtgactgtcttggctacatcaaatattttgatgcacattttaccaactataccggtggagtggaaactatcgaaaattgtgtttgtttgcatgaagaggatcatggtatattatggaagcatcaagactggagaactggactagcagaagttagacgttctagaaggcttacagtttcatttatatgcacagtagcaaactatgagtatggatttttctggcatttttaccaggatggtaaaattgaagcagaagttaaacttacaggaatattaagtctgggagcattacctccaggagaatcaaggaaatatggcacaactattgctccaggtttatatgcaccagtccatcaacatttttttgttgcacgcatggacatggctgttgattgtaaacctaatgaaacatataatcaggtggttgaagtaaatgtaaaggttgaagagccaggccagaataatgtccataacaatgcattttatgctgaagaaacacttcttagaagtgaacagcaggcaatgcgcaattgtgatcctttagctgctcgtcattggattgtaagaaatacaagaacagtgaatcgaactgggcaacttacaggctacaaacttgtacctggttcaaattgctcaccgttagctggtcctgaagcaatgtttttaagaagggcagcatttctgaagcacaatctttgggtgactccgtacaaacgtgatgaaatgtatcctggaggagagtttcctaatcagaatcctcgccaaaatgagggtttagctacttgggtcaagaagaatagatctcttgaggaaactaatattgtactctggtatgtgtttggagtgactcatatacctcgtcctgaagattggcctgttatgcctgtggagcacataggtttcatgctcatgcctcatggattcttcaactgctcaccggctgtggatgttcctcccagcagtacagatatggaaatgaaggaaaatggaggatctaagcccatttcaaatggtgttttacttgctaagctttaaatatggtcattctctgaagctgtaattgaactgcatctatgtttgtgtgttgggttttgtatgtatgaactgatgttgcattttagtgcatgatctatgcctcctgtcttgaattcatgcgaactctttgttgtgaaagaataaataccgtgtctttttatttgcagctatattttgtatgcgtcgttatgtattttattattgcaaacatgagg

SEQ ID NO: 4531 - DNA, 2587 bp, Brassica oleracea
gttgagacttactttggtggatttggcgaactcgtgaaccctattcaatggcctcagcttcgaaaacggcgacggtttgtgctcacggaggaggaggctcttcgaaactcgtctccgttgcggcggatacggttgccggaaggtccgagggtgaggatcggcgagattcttctaagtttggtttggaatccgtgatccgccccgtcgattcgatgcctgatactgccaagaaacctgctaccaaaggaatctctgtgatgccaatgccaaggacggaaacaaagcaccctttggatcctctctccgctgcagaaatatctgttgctgtggccactgttcgcgcggctggtgctaaccctgaggttagagatagcatgcgttttattgaggtggcgtctgtggaaccggagaagaatgttgtggcgttggcagatgcgtattttttccctccgttccagccatcactacttccaagaactaaagctggacctgtgatacctatgaggcttcctccaaggcgagcaaaacttgttgtgtacaacaagaagtctaatgagacgagtgtgtggattgttgagttgtccgaggttcatgctgtgactagaggtggacatcacaggggaagagtagtttcctcggaagtgatacctgatgtacagccacccatggatgcggctgaatatgctgaatgtgaagcaattgtcaaagacttccccccattcattgaggcaatgaagaggagaggtattgatgacatggatctagtgatggttgatccctggtgtgttggctatcatagcgaagctgacgctccaagtcgtaggcttgcgaagcctcttatatactgtcgtactgatagtgattcccctatggaaaatggctatgctcgtccagttgagggcatttatgtacttgtagacatgcagaacatggtggtgatcgagtttgaagaccgtaagtttgtgccacttcccccacctgaccctttgaggaattacacaccaggtgagagtagaggaggtgttgatagaagtgatgttaagcctctccagattattcagcctgaaggtccaagcttccgcgtaaggggttactttgtcgagtggcagaagtggaactttcgtattgggttcactccaagggaaggtttagtcatacattcggtagcatatgttgatggcagtcgaggtcgaaggcctgttgcacacaggctaagttttgtggagatggttgtgccttatggtgatccgaatgagccacattacaggaaaaatgcttttgatgcaggggaggatggtcttggaaaaaacgcacattcgcttaagaaggggtgcgactgtctcggaactattaagtacttcgatgctcatttcacaaatttcactggaggggttgaaacaattgagaactgtgtatgcttgcatgaagaggaccatgggatcttgtggaaacatcaggactggagaacaggattagctgaagtgcgaagatctaggaggctaactgtctcctttttatgcactgttgctaactacgagtatggattttactggcacttctaccaggatgggaaaatcgaagctgaagtaaaacttactggtatcctcagtttaggagcgctacagccaggagaaactcgaaagtacggtactactattgctcctgggttgtacgcaccagttcatcaacatttctttatcgctcgtatggatatgtctgttgactgtaaacctggtgaagctttcaatcaggtagttgaggtaaatgtcagagttgacgagccaggtgagaacaatatccacaacaatgcgttttatgcggaagagaagttacttagatccgaggcagaggcgatgcgtgactgtgacccttttagtgctcgccactggattgtaaggaacacaaggacagtgaacaggacggggcaattaacgggatacaaacttgttccgggctcaaactgtttgccattagctcgacccgaggccaagtttctaagaagagcagcgttcctgaagcataatctttgggttacccgttatgaccctggagagaagtttccaggaggagagtttccaaaccaaaacccacgttctggtgaaggtcttgccacgtgggtgaaacagaaccgttccttggaagagtctgacgtcgttctttggtatgtgtttgggatcatacatgttcctagacttgaagattggccggttatgccagttgaacatattggtttcacactaatgccacatggatttttcaactgctcaccagccgtggatgttccaccgaatccagcatgcgaattggagaccaaggacagtgaggtcaaagaggtagtagcagcacccaagcctggtttactttcaaagctttgagcatgaaagactttttttttataatttggagacactgctgttgctctattcattttcggattggaaaccgttgttatttggtgtgtgtttgttgcaaactaaaagacatttgtcattggaatgttctttgcttttgtcaaacattatggttttttatctcaaatcagatagtaatgttcattactaatacatagttatcccaataatcgaag

SEQ ID NO: 4532 - DNA, 2754 bp, Glycine max
attcataacagctggctcctctgcttcccatttattcattcctcttttactggtctctgtcttgagtagtttctttcttggtttctttcaaatcaggttgtgcgcagaagaagagggtgaatttcttgctgtatatgtcagtgtactgcgcccagacttattggggtggcggaatccctgaaatagcaaatcctctccaatggcctcagtttcgcaaaagacgacgtcaccctcctcctcttcttgttccgccaccaacgcagccgccgccattccccgcctagctgctgccccctcccccgcccccgccaccgccgccgccgtgccgcaagactggactgctgccgtcaccgacgtcccccgcatttcttccaccaatgcatctgctgccaagggagtcgttgctgcaatgccaagggcacagtcaagccaccctttggatcctttatctgctgctgaaatctctgtggctgtggcaactgtgcgggctgctggatctactcctgagcttagagatagtatgcgcttcattgaaatagttttactggagccagataaaaatgttgttgcactggcagatgcatatttctttccacctttccaaccatcattacttccaagagctagaggaggacctctgattccagctaaactccctccaagatgtgccaggcttgttgtttacagtaggaaaacaaatgagactagtatatggattgttgagttgtcgcaagtacatgcggtaactcgaggtggtcatcaccgagggaaagtaatttcatcacatgttgttcctgatgttcagcctccaatggatgctgaggaatatgcagaatgcgaggctgttgtcaaaagttttcccccatttatagaggctatgaagaaaaggggtattgaagacatggaccttgtaatggttgatccgtggtgtgttggttatcacagtgaagcagatgctcctgggaaaagacttgctaaaccactcatattttgtcgatctgagagtgactgtcctatggaaaatggctatgcccgacctgttgagggtatctatgttcttgttgatatgcaaaacatggtggtgttagagtttgaagatcgtaaacttgttcccctcccaccggttgatcccttgaggaactatactcctggtgaaacccgaggtggctctgatagaagtgatgtaaaacccttgcaaattattcagcctgaaggtccaagcttccgtgtcaatgggtattttgttgaatggcagaagtggaatttccgtattggattcacacccaaagaaggtttggttatatattctgttgcatatgttgatggtagtcatggacgaaggcctgttgctcataggctgagttttgtggagatggttgttccctatggagatccaaatgatccacattacagaaaaaatgcttttgatgctggggaagatggattgggaaaaaatgcacattccctcaagaagggatgtgattgtttgggatacatcaagtattttgatgctcacttcacaaatttcactggtggggtggaaacaattgaaaattgtgtatgtttgcatgaagaggatcatggaatgctctggaaacatcaagactggagaactggcttagcagaagtccgaagatctagaagacttacagtttctttcatatgtactgttgccaactatgagtatggatttttttggcatttttatcaggatggaaggatcgaagctgaagtaaagctaactggaattctcagcctaggagccttactgcctggagagtttcgaaaatatggaaccatgattgcgcctggtctatatgcaccagttcatcagcacttttttgttgctcgcatggacatgtctgttgattctaaacctggtgaagctttgaatcaggttgtggaggtcaatatgaaagtcgaggaaccaggtgagaagaatgttcacaataatgcattctatgctgaagagactttgctcagatctgaattggaagccatgcgtgattgcaattctttgactgctcggcattgggttgtaaggaacacgagaacatgcaatagaactggacagttgacaggctataagctggtacctggctctaactgcttgccattggcaggctctgaagccaagtttttaagaagagctgctttcttgaagcataacttttgggtaacaacatattcacgtgatgagttgtttcctggaggagaatttcctaatcaaaatccacgtgttggtgaaggactagctacatgggttaagcagaaccgatctttggaagaaactaatgtagttctttggtatatatttggaatcacacacgttcctcgtttggaagactggcctgttatgccagtagagcgcattggttttatgctcacgcctcatggattcttcaactgttcccctgcagtagatgttccgccaaatgcatgtgaaatggattctaaagataatgacattaaggataatggttcttcgaaaccaattcagagtgggttaacggcaaagctttaggaacttgaccctccaaaagttatggctctgtgctgctgatatggagaaacatgagtactattctgatatatgttgttgagctcattataattttgaatctagaatattaataaagctattgaaataaatagtggtttcgttttaaagcttgcctgctggtaatattcatttgatttactttgtacccagaatactggcttcaaatttgactcaaggaatttaaccgggaa

SEQ ID NO: 4533 - DNA, 2733 bp, Chenopodium quinoa
tctccggcggcggagttccggcgattgaggcggcgagtgggcggtgcaacctacagagagagtgaaagtgctgctgtatgtcaattgttgagtactttgctgacgataattactattactattacactgggatctctaatcctcttcaatggcctcaacttcgcaaaaaacgacgtcttcttcttcttctccaatctgctgtaattccggcgagatccgtgattcttcgccgtcttccgtcgtcgtcgatcggtctccggtcaccgatgatcggattgtcggtgagagacaagcgagtttgattcatcctgttgaatcgcttcctgaaagtcctaccgtaactgctgcttccaaagctaaaggggcctctttgccatggaggggtcgaacaagccacccattggatccattatcagctactgaaatcaaggtggcagttgctactgtaagagctgcaggagcaactccggaggagagagatagcatgcggtttattgaggtggttttagtggagccagaaaagcttgtcattgctatggcagatgcatatttctttcctcctttccagccctctttgctgcccagggtaaaaggcaggcctgtaataccttctaagcttcccccgcgtcaggcaagactcattgtctacaataaaaagtcaaatgagactagcatatggattgttgaactcctcgaaattcatgctactacacgagggggccaccataagggcaaagtcatttcgtccaaagttgttcctgatgttcagcctcccatggatgctgtagaatatgctgaatgtgaagcagttgtgaaggattatccaccattccgagaggcaatgaaaaagaggggtattgatgatatggatcttgttatggtagatgcatggtgcgttggttatcacagtgaggctgactctccaagccgtaggctcgctaagcccctcatcttctgcagaactgagagtgattgtccaatggagaatggttatgctcgtccagttgaaggaatccatgttctggttgatatgcaaaatatggtattggttgagtttgaggacaaaaaatttgttcctctaccacctgctgatccattaagaaattacacacctggtgaaacaagaggaggtgttgatcgaagtgatgtaaaaccattgcatattcttcagcctgaagggcccagttttcgagtgaaaggccattttgttgaatggcaaaagtggagttttcgtgttggatttactcctcgggaaggattggttatacattctgttgcatatgttgatggaagtagaggccgccgttctgtagctcagaggttaagctttgttgagatggtggttccttatggtgatccaaatgaaccacattacaggaagaacgcatttgatgctggtgaagatggtctgggaaagaatgcgcactctctgaaaaagggttgtgattgtttaggctctatcaaatattttgattcccattttacaaactttactggaggtgttgaaacaattgaaaattgtgtctgtttgcacgaggaagaccatggaatattatggaagcatcaagactggcgaacagggttagctgaagtgagaagatctagaaggcttactgtttccttcatctgcacagtggccaattatgagtatggattctattggcacttttaccaggatggcaagattgaggctgaagttaaactcactgggattctcagcgttggagcacttctgcctggtgaagtacgaaaatatggtactacaattgctcctgggttgtatgcacctgtacatcagcactttttcgttgctcgtatggacatggctgttgattgcaagcctggcgaagctctgaatcaggttgttgagctgaatgtcaaggtagaggaacctgggaaagacaatgttcataataatgcattctatgctgaggagaagctacttagatctgagttacaggcagtgcgtgattgtaatccattgactgcccgccactggattgtcaggaatacaagaacagttaaccgtactggccagctgactggttacaagcttatgccggggtcaaactgtttaccattagcgggtcctgaggcgaaattcctgagaagagctgccttcttgaagcataacttatgggttacacaatatgctcctaatgagatgtttcctggaggagaatttccaaatcaaaatccacgtgctggggaagggctggcttcttgggttaaacaaaatcgttctttggaggaggctgatgtagttctttggtatgtatttgggttgacacacataccgcgtctggaggactggccagtcatgcctgtcgaacatctgggctttacactcatgccccatggattcttcaattgttcacctgcagttgatgtaccacccaacacacatgagtctgatatgaaggaagctaatgttgtgggtgctaagcctattcaaaatgcgatgattgccaaactctaaggaaaaatatgtttcttgagaatgtctgtttacttgtaattgcagtgtccattagcttgaaatctatcattggagttgctcaataatttcttgttataacgatgtcaataggttgatcccaatgtgaaccatagtgtttagattgaatatggtttatgatggtacttttgacaaagtgcaatattgcaaatcaatttgggatatttgagatgagaccaattactaacgtgagagtttgatatggtttgcatgcg

SEQ ID NO: 4534 - DNA, 1870 bp, Chrysanthemum coronarium
aagcaaacatggttaatgcaaaagacttgttgataacatttataaacaacagatggctagtgttcatagcagcaatgtggatacaatcatgtgcaggaataggttacttgtttggaagtatatcaccagttataaagtcttcattaaactataaccagaaacaagtagcaaggttaggtgttgctaaggatcttggtgacagtgttggttttttggctgggagtatgtctgagatactacccttgtgggccctactgcttgttggtgctattcagaattttgttggctatggttgggtttggcttgttgttactggtaaagctcctatgttgccattgtgggtgatgtgccttctcatattcattggaacgaatggcgaaacctacttcaacacagcagcattagtttcatgtgttcaaaacttccccaaaagccgtgggccagtggtcggaatattaaaaggattcgcagggctcagtggtgcaatattaacccaaatatacgcattaataaactcacccgataaagcctcaattattttcatggttgctgtcgggccttcaatggtagtaattgcactcatgttcattgttagaccggttggtggtcacagacaacttagagcatcagatgcatcgaatttctcagtaatatactgcgtgtgtctcattttagcctcttatttaatgggagttatgcttgttgaagatttagttgatttaaaacaaacaatagtcaaaatttttaccgccatattatttgtgctcttagtgtgtccaattgggattcctatatacttgactttttcttctgaccggagaacccctgaacaagaagctcttttatctgaaccacaacataaagaacctgaaacatcacatgacccaaatgaaattatatttagtgaagttgaagaggagaagcctcatgatgtagacttacttccagcatcagaaaggcaaaagagaatagcacagttacaatcgaagttggcgcaagcagctgcagaaggagcggtgaggattaagaggacaaggggcccacatagaggagaagactttgaccttacacaggctttgattaaagctgatttttggttacttttttgcacccttttgttagggtcgggttcaggtttgactgtgatcgacaatttggggcagatgagtgagtctttagggtatgataatactcatatttttgtttcaatgatcagcatttggaacttcttgggtcgtgttggtggtggctatgtctcagagatcgtcgtcagggattacgcatacccaaggccagtagctctggctgttgcacaggccataatggctatcgggcatttgttctttgctatgggttggcctggtgcaatgtacattggtacccttttgatcgggctaggctacgggttccactgggctatcataccagctactgcctccgaattatttggagtcaaaaagtttggagctttatataatttcctcaccctggcaaatcctgctggttcactagtctttaatggtctcattgctagtcacatatacgactccgaagcagaaaaacaagccggactacacacaagttcagcttcttatctgacaaagctttttgacacggatgatgcccttaagtgctcgggttccatatgcttctttctcacttacatgataatgtcaggactctgtatcattgcatgtatcctgagtttgattctcgtacgccgaactaagactgtctaccagaacctctacggtaaaagaacataaatttcttgaaatgatcgaatcctgggtgtatgtatctctttgtttcacataattcaaatgtgttattccggaatgttgattttggtttgtatattgttatttat

SEQ ID NO: 4535 - DNA, 1907 bp, Chrysanthemum coronarium
acacagtagtaaacagcaaagcaatctaaatccatccttgaaacacaaacacaaaaacattttgaaaaaagaagcaaagatgggtattaaggcaaaagagttgttgataacatttataaacaacagatggctagtgttcatagcagcaatgtggatacaatcatgtgcaggaatagggtacttgtttggaagtatatcacctgttataaagtcatcattaaactataaccagaaacaagtagcaaggttaggtgttgctaaggatcttggtgacagtgttggtttcttggctgggagtatgtctgagattctgcctttgtgggccttgcttttggttggtgctattcagaattttgttggctatggttgggtttggcttgttgttactggtaaagctcctgttttgcctttgtggctgatgtgccttctcatattcattggaaccaatggcgaaacctacttcaacacagcagcattagtttcatgtgttcaaaacttccccaaaagccgtgggccagtggtcggaatattaaaaggattcgcagggctcagtggtgcaatattaacccaaatatacgcattaataaactcacccgataaagcctcacttatattcatggttgctgtcgggcctacaatggtagtaattgccctcatgttcattgttcgaccagttggtggtcacagacaacttagattatcagatgcgtcgaatttctcaataatatactgcatttgtctcattttagccgcgtacttaatgggagttatgcttgttgaagatttagttgatttaaaacaaacaatagtcaaaatttttaccgccatattatttgtgctcttagtgtgtccaattgggattcctatatacttgactttttcttctgaccggagaacccctgaacaagaagctcttttatctgaaccacaacataaagaacctgaaacatcacatgacccaaatgaaattatatttagtgaagttgaagaggagaagcctcatgatgtagacttacttccagcatcagaaaggcaaaagagaatagcacagttacaatcgaagttggcgcaagcagctgcagaaggagcggtgaggattaagaggacaaggggcccacatagaggcgaagactttgaccttacacaggctttgattaaagctgatttttggttacttttttgcacccttttgttagggtcgggttcaggtttgactgtgatcgacaatttggggcagatgagtgagtctttagggtatgataatactcatatttttgtttcaatgatcagcatttggaacttcttgggtcgtgttggtggtggctatgtctcagagatcgtcgtcagggattacgcatacccaaggccagtagctctggctgttgcacaggccataatggctatcgggcatttgttctttgctatgggttggcctggtgcaatgtacattggtacccttttgatcgggctaggctacgggttccactgggctatcataccagctactgcctccgaattatttggagtcaaaaagtttggagctttatataatttcctcaccctggcaaatcctgctggttcactagtctttaatggtctcattgctagtcacatatacgactccgaagcagaaaaacaagccggactacacacaagttcagcttcttatctgacaaagctttttgacacggatgatgcccttaagtgctcgggttccatatgcttctttctcacttacatgataatgtcaggactctgtatcattgcatgtatcctgagtttgattctcgtacgccgaaccaagactgtctaccagaacctctacggtaaaagaacataaatttcttgaaatgatcgaatcctgggtgtatgtatctctttgtttcacataattcaaatgtgttatt

SEQ ID NO: 4536 - DNA, 1954 bp, Chrysanthemum coronarium
aaacacagtagtaaacagcaaagcaatctaaatccatccttgaaacacaaacacaaaaacattttgaaaaaagaagcaaagatgggtattaaggcaaaagagttgttgataacatttataaacaacagatggctagtgttcatagcagcaatgtggatacaatcatgtgcaggaatagggtacttgtttggaagtatatcacctgttataaagtcatcattaaactataaccagaaacaagtagcaaggttaggtgttgctaaggatcttggtgacagtgttggtttcttggctgggagtatgtctgagattctgcctttgtgggccttgcttttggttggtgctattcagaattttgttggctatggttgggtttggcttgttgttactggtaaagctcctgttttgcctttgtggctgatgtgccttctcatattcattggaaccaatggcgaaacctacttcaacacagcagcattagtttcatgtgttcaaaacttccccaaaagccgtgggccagtggtcggaatattaaaaggattcgcagggctcagtggtgcaatattaacccaagtatacgcattaataaactcacccgataaagcctcacttatattcatggttgctgtcgggcctacaatggtagtaattgccctcatgttcattgttcgaccagttggtggtcacagacaacttagattatcagatgcgtcgaatttctcaataatatactgcatttgtctcattttagccgcgtacttaatgggagttatgcttgttgaagatttaattgatttaaacgaaacaatagtccaaatttttaccgccatattatttgtgcttttagtggttccaattggaattcctatatacttgactttttcttctgaccggagaacccctgaacaagaagctcttttatctgaaccacaacataaagaacccgaaacatcacatgacccgaatgagattatatttagtgaagtagaagaggagaagcctcatgatgtagacttgcttccggcttcagaaaggcaaaagagaatagctcagttacaatctaagttggctcaagcagctgcagaaggggctgtgaggattaagaggacaaggggcccacatagaggcgaagactttgaccttacacaagctttgataaaggctgatttttggctactctttttcacccttttgttagggtcaggttcgggtttgactgtgattgacaatttggggcagatgagtgagtctttagggtacgataatactcatatctttgtttcaatgatcagcatttggaacttcttgggtcgtgttggtggtggctatgtctcagagatcgtcgtcagggattacgcatacccaaggccagtagctctggctgttgcacaggccataatggcaatcgggcatttattctttgcaatgggttggcctggtgcaatgtacatcggtacccttttgatcgggctaggctacgggttccactgggctatcataccagctactgcctccgaattatttggactcaaaaagtttggagccttatataatttcctcaccctggcaaaccctgccggttctctagtctttaatggtctcattgctagttacatatacgactctgaagcagaaaaacaagctcaactacacacaagttcagcttcttatttgacaaagctttttgacacggacgatgcccttaagtgctcgggttccatatgcttctttctcacttacatgataatgtcaggactctgcatcattgcatgtatcctgagtttgatactcgtacgccgaactaagagtgtctaccagcacctttacggtaaaagaacataaatttcttgtaatgatcgaatcctgggtgtatgtatctctttgtttcacataattcaaatgtgttattccggaatgttgattttggtttgtatattgttatttattattcaaa

SEQ ID NO: 4537 - DNA, 1678 bp, Cirsium arvense
ttcgggagtatgtcgccggtgattaagagttcattaagctataatcagaagcaggttgccagattgggtgtggctaaggatcttggtgattctgttggatttttggccggaagtctgtcggagatattgccgatgtgggctcttttgcttcttggtgctattcagaactttgttggatatggatgggtctggctcatcgtcacgggtaaagcaccggtgctgccattgtgggttatgtgccttctcatattcatcggaaccaacggagaaacctacttcaacacagtagcattggtttcatgtgttcaaaactttcccaaaagccgtggtcctgttgtcggaatactaaagggatttgcaggtctgagcggtgccatattgacacagatatatgcgttgtaaactcacccgataatgcctccctaatattcatggttgccgtgggcccttttatggtcattatcgctcttatgttcatcgtgaggccagttggaggtcacagacaaatcagattattagatggttcaagtttctcgctaatctactgtgtgtgtcttgttttggccgcttatttgatgggagttatgcttgtggaagatttggttgatctgaacgagaccatagtccaaattttcacagccattttgtttgtgcttatagtgtgtccaattgggattccgttatggttaactttttcttcggatccacgaacccctgaagaagaatctctactatccgagccacaaaataaagaacccgaaagagtattagagcatgatccaaatgagatcatatttagtgaggtggaagacgagaaacctagggaagtagaccttctaccggcttcagaaaggcaaaagaggatcgctcaacttcaatctaagttggctcaagcggctgcagaaggagcggtcaggatcaagagacgaagaggaccacatagaggcgaagactttgatctcacacaggctttgatcaaggctgatttttggctcatctttgtgtcacttctattgggatctggttcgggtttgacagtgattgacaatttaggtcagatgagccagtctttaggatacgacaacacgcacatattcgtctccatgatcagcatttggaactttttaggccgggttggcggaggctatttctctgagatcgttgtcaaggactatgcttacccaaggccagtagccattgctgttgcccaggccataatggcaattgggcatttgttctttgccttgggttggcctggtgcaatgcacagtcggcacccttttgatcggtctaggctatggagctcactgggctattgtaccggctacagcctctgagctatttgggatcaagaagtttggagctttgtacaatttcctcaccctggctaaccctgccggttcactagtcttctcgggccttcttgccagccatatatacgactctgaagcagaaaagcaagctaaacaacgccatcaaatcgttacaaattctgcttcttttttgacaaagctttttgccacagatgatgatgttctcaaatgcgaaggttcaatttgcttctttctgacttgcatgataatgtcgggactctgtatcatagcggctatcctaagtttgatactcgttcgccgaactaaggttgtctaccagaacctttacgggaaaacccgatcat

SEQ ID NO: 4538 - DNA, 1501 bp, Cichorium intybus
ctctccttcctcttcctcctgtctatctccgccaccgttcacggccacaacatcacccgcatcctcgccaagcaccccgaattttccactttcaaccactacctcactatcactcacctcgccaatgaaatcaaccgccgtcagaccatcaccgtctgcgccgtcgacaatgctgcaatgtcgtcgttgctctcgaaaggcctatctattcagaccataaagaatgttctctccctccatgttttcgccgattacttcggctccaaaaagctccatcaggtcaccaaaggttcgacctccaccgccaccatgtatcaagcaacaggggaggctccaggaaccgccggttacgttcatatcaccgacgtcaaaggcggtaaagtccgattcactcctgaagacaatccgagtcaaaccgacaccacgtatgtcaaatctatcttggagatgccttacaatatctccgtcattcaaattagtgcgattttacagtcgccggaagccgaggctccgactgctgcaccagatctaaacttaacctcgttgttacaacgagacggttgccaagcgttttacgatctgttaacaacttcaggagcaattggaacgtttttaagcaacgccgacggcggagtaactgtgttttgtcccggggacgacgctattgcggcgttcgcgccaaaatacaagaacttgacggcggaagggaagacgtcgttgttactttaccatggcgttccgacctataattccatggggatgctgagatcaagcaatgggttgatgaatacattagcgactgaaggggctaacaaatacgacttcactgtacaaaacgatggcgaggatgttaagttgaagacaaaggtggtgacggcagcgatcacagggacggtgatcgacgaagaacctgtggcgctttacaagattaataaggttttgttgccgagggagttatttaagggggcggttgaggccgatgagcctgccgcggcaccgaaggcggcgaagaagaaaaagaaggcggcgaagaagggtgatgatgcggaagccccggggccggactcttcggacgattatggaggcggtgatgcggcggatcagacggccaattccggtaggaggctggtggcctcggcgggttcggtgttgtgtctggccctcgtttttgtttgaggctttttgtgtcgacgagatggagtgacggcgcggttttaccggtcccatgactttggcacttagaatctccggttatttttgtgtgagtagtatttttttatgagagaatttcatttatgtcctctttaaatataaatgtattgtattttgtaaatgtgagcttaattttggatattaaaatataataactaatcgtatcatttgagctgtccacatcaactattgtcaatgttcatgtggaaggcaaattacaaaacactagagattttatgagtgtgttagggtttgaatcgtagatatcttatgtggaatttcactcttc

SEQ ID NO: 4539 - DNA, 1470 bp, Flaveria ramosissima
gacgatattaactgaaactccaaatctcacatcctcaatgccgacagatcaagcagacctcaattccgatcaggttttgaggagggacatcccatgggagacctacatgacaactaagctgatcacaggaacagcccttcagttattaaggcgctatgacaaaaagaccgaaaatgaaagggcaccactgcttgagaacgatggtccgtcttatattcgtgtatttatcagcatcttgcgtgacatacagaaagaggacactgttgaatatgtgttggctttaattgatgagatgcttacagccaaccccaatagagcaaagttgtttcatgacaaatctcttgcagatgaagatatttacgaacctttcttaagattgttatggaaaggtagctggttcgttcaagagaagagctctaagatacttactttagtagtgagtgctagatcaaacaagaatggtttgactgcaaacggagaagccacaaattcaaagaagaaaatcaccacaagtgatgatgttttgaaaggattagtggagtggctttgtgttcagctgaaaaagccctcccatccaaaccgtagcattccagcttctatcaactgtctagcagctttgttaaaggaacctgttgttagatcttcatttgttcaagcagatggtgtgaagctgcttgtgccactgatttctccagcatctactcagcagtcgatgcagctactgtatgaaacatgcctgtgtgtttggctcttgtcatattatgaacctgcaatcgagtacttggctacatctagagcccttccacggttgttggaggttgtcaaaggttcaacaaaagagaaggttgtgaggttgatagtgttgactttcaagaacttgctttcaaaaggaacctttggagctcagatggtagatcttggacttccacaaattgttcaaagtttgaaagcacaagcctggagtgatgaggacctcttggatgctctaaatcatctggaagacgggctgaaagataacatcaagaaattgagttctttcgataagtacaagcaggaagtccttcttggtcatcttgattggtctccaatgcataaagatcctagtttctggcgagataatattacatattttgaagataatgatttccagactctacgggtcctgctcacgatactggaaacatcaagtgatccaagggcattagccgtggcatgctttgatctgtcccagtttattcaataccatccagcgggccgagtcatagtcactgacctcaaagcaaaagagcgtgtgatgaaactgatgaaccatgagagcgcagaggtcaccaaaaacgctttactctgcatccaaaggcttttccttggggccaagtatgcaagctttttgcaagcataatatgcgtctcatggacccttctctgttaaaagcttgttattttgaataaaattgatgtctgtattttaagc

SEQ ID NO: 4540 - DNA, 1446 bp, Flaveria ramosissima
tcaccacacacagacgatattaactgaaactccaaatctcacatcctcaatgccgacagatcaagcagacctcaattccgatcaggttttgaggagggacatcccatgggagacctacatgacaactaagctgatcacaggaacagcccttcagttattaaggcgctatgacaaaaagaccgaaaatgaaagggcaccactgcttgaaaacgatggttcgtcttatattcgtgtatttatcagcatcttgcgtgacatacagaaagaggacactgttgaatatgtgttggctttaattgatgagatgcttacagccaaccccaatagagcaaagttgtttcatgagaaatctcttgcagatgaagatatttatgaacctttcttaagattgttatggaaaggtagctggttcgttcaagagaagagctctaagatacttactttagtagtgagtgctagatcaaacaagaatggtttgactgcaaagggagaagccacaaatttaaagaagaaaatcaccacaagtgatgatgttttgaaaggattagtggagtggctttgtgttcagctgaaaaagccctcccatccaaaccgtagcattccagcttctatcaactgtctagcagctttgttaaaggaacctgttgttagatcttcatttgttcaagcagatggtgtaaagctgcttgtgccacttatttctccagcatctactcagcagtcgatgcagctactgtatgaaacatgcctgtgtgtttggctcttgtcatattatgaacctgcaatcgagtacttggctacatctagagcccttccacggttgttggaggttgtcaaaggttcaacaaaagagaaggttgtgaggttgatagtgttgactttcaagaacttgctttcaaaaggaacctttggagctcagatggtagatcttggacttccacaaattgttcaaagtttgaaagcacaagcctggagtgatgaggacctcttggatgctctaaatcatctggaagacgggctgaaagataacatcaagaaattgagttctttcgataagtacaagcaggaagtccttcttggtcatcttgattggtctccaatgcataaagatcctagtttctggcgagataatattacatattttgaagataatgatttccagactctacgggtcctgctcacgatactggaaacatcaagtgatccaagggcattagccgtggcatgctttgatctgtcccagtttattcaataccatccagcgggccgagtcatagtcactgacctcaaagctaaagagcgcgtgatgaaactgatgaaccatgagaacgcagaggtcaccaaaaacgctttactctgcatccaaaggcttttccttggggccaagtatgcaagctttttgcaagcataatatgcgtctcatggacccttctctgttaaaagctt

SEQ ID NO: 4541 - DNA, 1619 bp, Flaveria ramosissima
acccgcgatctcaaactcaccacacacacactctagatttcgacgatactaatcgaagccccaaatctcatcaataatgccgacggatcaagcggagctcaattccgatcaggttttgaggagggacatcccatgggagacctatatgacaactaaactgatcacgggaacagcccttcagctattaaggcgctatgacaaaaagtctgagaacgaaagggcgccactgcttgagaatgatggtccatcttatatccgtgtttttatcaacatcttgcgtgacatacagaaagaggacactgttgaatatgtgttggctttaatagatgagatgcttacagtcaaccccaacagagctaagttgtttcatgacaaatctcttgcagatgaagatatttatgaacctttcctgagattgttatggaaaggtagctggttcattcaagagaagagctctaagatacttactttggtagtgagtgctaggccaaacaaaaatggttcaactgcaaatggagaaggcacaaagaagaagaccgcatcaagtgatgatgttttgaaaggtttagtggagtggctttgtattcagctgaaaaagccctctcatccaaaccgtagcattccaactgctatcaactgccttgcaactttgttaaaggaacccattgttaggtcttcatttgttcaggcagatggggtaaagctgcttgtgccactaatttctccagcatccactcagcagtctattcagcttctctatgaaacatgcctctgtgtttggctcttgtcctactatgaacctgcagttgagtacttggctacatccagagcactgcctcggttgttggaggttgtcaaaggttcaacaaaagagaaggttgtgaggatgatagtgttgaccttcaaaaacttgctttccaaaggaacctttggagctcagatggtggatcttggacttccacaaattgttcaaagtttgaaagcgcaggcttggagtgacgaggacctcttggaggcgttaaatcatctggaggaggggctgaaagataatatcaagaaattgagctcctttgacaagtacaagcaggaagtccttcttggtcatcttgattggtctccaatgcataaagatcctaatttctggcgagataatattacaaagtttgaagagaacgatttccagactttacgggtcctgctcacaatattggaaacatcaagtgacccaagggcattggccgttgcttgctttgatctgtcccagtttattcagtaccatcctgcagggcgtgtcatagtcaccgacctcaaagcaaaagagcgggtgatgaaactgatgaaccatgagaatgccgaggtcaccaaaaacgccttactctgcatccaaaggcttttccttggtgccaagtatgcaagctttttgcaggtttaagcacgggcccttttatgtttcactggtttcattttgaataaagattcatgtctgtattttatgctgtttatgaaataaaaagttgagggctattcattatttttttaattattattgtaaatcaaacttaatctatgtgtttaatttgtgtttggtgatccatcatatctgcaggatatgacactag

SEQ ID NO: 4542 - DNA, 1643 bp, Tragopogon dubius
atcatcgtggacaaaacaacagagagattaaccccaaatcaatccccgatctcaaactcaccacacacataaacacactctagatttcgacgatactaaccggaaacgccaaagcttgtcaatgccgacggatcaagccgagctcaattccgaacaggttttgaggagggatatcccatgggaaacctacatgacaaccaagctgatcacaggaacatcccttcagctactaaggcgctatgacaaaaagtctgaacatgacagagcacaactgcttgataatgatggtccatcttatatccatgtctttattagcatcttgcgcgacatacagaaagaggacacagtcgaatacgtattggctttaatcgatgagatgcttacatccaaccccaaaagggcaaagttgtttcacgacaagtctcttgcagatgaagacatttatgaaccattccttagattgttatggaaaggaagctggttcatacaagagaagagctcaaagatacttactttgacagtgagtgctaggccaaagcagaatggtcttactgcaaatggacaaacagattcaaagaagaaaataactgcaagtgatgatgttttgaaaggattggttgagtggctttgtattcagctgaaaaaaccttctcatccaacacgtagcattccagcttccattaactgcttagcaactttgttgaaggagcctgttgttaggtcatcatttgttcaagcagatggggtgaaacttcttgtgccactcatctctcctgcttccactcaacaatcaattcagctgctgtatgaaacatgcctctgtgtttggcttttgtcctactatgaacctgcaattgagtacttttctacttctagagcacttccaagattgttggaggttgtcaaaggttcaacaaaagaaaaggttgtcaggttgatcgtgttgactttcaagaacttgctgtccaaaggatcgtttggagctcagatggtggatcttggacttccacaaattgttcaaagtttgaaagctcaggcctggagtgatgaggacctgttggatgctttaaatcatctggaagaggggctgaaagataacatcaagaaattgagttcttttgataagtacaaacaggaagttcttcttggtcatcttgattggtctccaatgcacaaagatcctattttctggcgtgacaatattacaaactttgaagagaatgatttccagactctgagggtgttattgacaatattggaaacttcgggggatccaagggcactagcagtcgcctgctacgatctctcccaattcatccaataccacccagctggccgcatcatagtgaccgatctcaaagccaaagagcgcgtaatgaaactcatgaaccacgaaaacgctgaggtcaccaaaaacgcattgctctgtatccaaaggctcttccttggtgccaagtacgcaagctttttgcaagcttaaataaggtaatcttacttaccgcacaaaaacctcttttatttatgttgatcgttttttcttttattttttgggaataaaatttgatattttgtatggatgagatcaaataaaagttatttatattgttgtatgttgaactcattttatatgggatgcgtcgtcg

SEQ ID NO: 4543 - DNA, 1661 bp, Flaveria ramosissima
aacaaaacaatagccagattacccccaaatcaacccccgatctcaatctcaccacacacataaacacacacacacacacactctagatctcgacgatactaatcgaagccccaaatctcatcaataatgccgacggatcaagcggagcttaattccgatcaggttttgaggagggacatcccatgggagacctatatgacaactaaactgatcacgggaacagcccttcagctattaaggcgctatgacaaaaagtctgagaacgaaagggcgccactgcttgagaatgatggtccatcttatatccgtgtttttatcaacatcttgcgtgacatacagaaagaggacactgttgaatatgtgttggctttaatagatgagatgcttacagtcaaccccaacagagctaagttgtttcatgacaaatctcttgcagatgaagatatttatgaacctttcctgaggttgttatggaaaggtagctggttcattcaagagaagagctctaagatacttactttggtagtgagtgctaggccaaacaaaaatggttcaactgcaaatggagaaggcacaaagaagaagaccgcatcaagtgatgatgttttgaaaggtttagtggagtggctttgtattcagctgaaaaagccctctcatccaaaccgtagcattccaactgctatcaactgccttgcaactttgttaaaggaacccattgttaggtcttcatttgttcaggcagatggggtaaagctgcttgtgccactaatttctccagcatccactcagcagtctattcagcttctctatgaaacatgcctctgtgtttggctcttgtcctactatgaacctgcagttgagtacttggctacatccagagcactgccttcggttgttggaggttgtcaaaggttcaacaaaagagaaggttgtgaggatgatagtgttgaccttcaaaaacttgctttccaaaggaacctttggagctcagatggtggatcttggacttccacaaattgttcaaagtttgaaagcgcaggcttggagtgacgaggacctcttggaggcgttaaatcatctggaggaggggctgaaagataatatcaagaaattgagctcctttgacaagtacaagcaggaagtccttcttggtcatcttgattggtctccaatgcataaagatcctaatttctggcgagataatattacaaagtttgaagagaacgatttccagactttacgggtcctgctcacaatattggaaacatcaagcgacccaagggcactagccgttgcttgctttgatctgtcccagtttattcagtaccatcctgcaggtcgtgtcatagtcaccgacctcaaagcaaaagagcgggtgatgaaactgatgaaccatgagaacgccgaggtcaccaaaaacgccttactctgcatccaaaggcttttccttggtgccaagtatgcaagctttttgcaggtttaagcacgggcccttttatgtttcactggtttcattttgaataaagattcatgtctgtattttatgttgtttatgaaataaaaagttgagggctattcatatttttttaattatcgttgtaaattaaacataatctatgtgtttaatttggtgtttggtgatgcatcatatctgcaatatt

SEQ ID NO: 4544 - DNA, 1467 bp, Flaveria ramosissima
tctctagatctcgacgatactaatcgaagcccaaatctcatcaataatgccgacggatcaagcggagctcaattccgatcaggttttgaggagggacatcccatgggagacctatatgacaactaaactgatcacgggaacagcccttcagctattaaggcgctatgacaaaaagtctgagaacgaaagggcgccactgcttgagaatgatggtccatcttatatccgtgtttttatcaacatcttgcgtgacatacagaaagaggacactgttgaatatgtgttggctttaatagatgagatgcttacagtcaaccccaacagagctaagttgtttcatgacaaatctcttgcagatgaagatatttatgaacctttcctgagattgttatggaaaggtagctggttcattcaagagaagagctctaagatacttactttggtagtgagtgctaggccaaacaaaataggttcaaactagaaatggagaaggcacaaagaagaagaccacatcaactgatgatgttttgaaggtttagtggagtggctttgtattcagctgaaaaagccctcccatccaaaccgtagcattccaactgctatcaactgccttgcaactttgttaaaggaacctgttgttaggtcttcatttgttcaggcagatggggtaaagctgcttgtgccactaatttctccagcatccactcagcagtctattcagcttctgtatgaaacatgcctctgtgtttggctcttgtcctactatgaacctgcagttgagtacttggctacatccagagcactgcctcggttgttggaggttgtcaaaggttcaacaaaagagaaggttgtgaggatgatagtgttgaccttcaaaaacttgctttccaaaggaacctttggagctcagatggtagatcttggacttcctcaaattgttcaaagtttgaaagcgcaggcctggagtgacgaggacctcttggaggcgttaaatcatctggaggaggggctgaaagataatatcaagaaattgagctcctttgataagtacaagcaggaagtccttcttggtcatcttgattggtctccaatgcataaagatcctaatttctggcgagataatattacaaagtttgaagagaacgatttccagactttacgggtcctgctcacgatattggaaacatcaagcgacccaagggcactagccgttgcttgctttgatctgtcccagtttattcagtaccatcctgcaggtcgcgtcatagtcaccgaccttaaagcaaaagagcgggtgatgaaactgatgaaccatgagaatgccgaggtcaccaaaaacgccttactctgcatccaaaggcttttccttggtgccaagtatgcaagctttttgcaggcttaatcatgggcccttttatgtttcactggtttcaatttgaataaagattcatgtctgtattttatgtt

SEQ ID NO: 4545 - DNA, 1529 bp, Flaveria ramosissima
cacacacactctagatttcgacgatactaatcgaagccccaaatctcatcaatgccgacggatcaagcggagctcaattccgatcaggttttgaggagggacatcccatgggagacctatatgacaactaaactgatcacgggaacagcccttcagctactaaggcgctatgacaagaagaccgagaacgaaagggcgccactgcttgagaatgatggtccatcttatatccgtgtttttatcaacatcttgcgtgacatacaaaaagaggacactgttgaatatgtattggcattaattgatgagatgcttacagcaaaccccacaagagcaaagttgtttcatgacaaatctcttgcagatgaagatatctatgaacctttcctgagattgttatggaaaggtagctggttcattcaagagaagagctcgaagatacttactttggtagtgagtgctaggccaaacaaaaatgattcaactgcaaatggagaaggcacaaagaagaaaaccacatcaagtgatgatgttttgaaaggattggtggagtggctttgcattcagctgaaaaagccctcccatccaaaccgtagcattccaaccgctatcaactgccttgcaactttgttaaaggaacccgttgttaggtcttcatttgttcaagcagatggggtaaagctgcttgtgccactaatttctccagcatccactcagcagtcaattcagcttctgtatgaaacatgcctctgtgtttggctcttgtcctactatgaacctgctgttgagtacttggctacatccagagcactgcctcggttgttggaggttgtcaaaggttcaacaaaagagaaggttgtgaggatgatagtgttgaccttcaaaaacttgctttccaaaggaacatttggagctcagatggtagatcttggacttccacaaattgttcaaagtttgaaagcgcaggcttggagtgacgaggacctcttggaggcgttaaatcatctggaggaggggctgaaagataatatcaagaaattgagctcctttgacaagtacaagcaggaagtccttcttggtcatcttgattggtctccaatgcataaagatcctaatttctggcgagataatattacaaagtttgaagagaacgatttccagactttacgggtcctgctcacaatattggaaacatcaagcgacccaagggcactggccgttgcttgctttgatctgtcccagtttattcagtaccatcctgcaggtcgcgtcatagtcaccgacctcaaagcaaaagagcgggtgatgaaactgatgaaccatgagaacgccgaggtcaccaaaaacgccttactctgcatccaaaggcttttccttggtgccaagtatgcaagctttttgcaggtttaagcacgggcccttttatatttcactggtttcattttgaataaagattcatgtctgtattttatgttgtttatgaaataaaaagttgagggctattcatatttttttaattattattgtaaatc

SEQ ID NO: 4546 - DNA, 1559 bp, Flaveria ramosissima
gagataactgtcattggttttttcgaacgtgaacaaaacaatagccagattacccccaaatcaaaccccgatctcaaactcaccacacacactctagaatttcgacgatactaatcgaagccccaaatctcatcaatgccgacggatcaagcggagctcaattccgatcaggttttgaggagggacatcccatgggagacctatatgacaactaaactgatcacgggaacagcccttcagctactaaggcgctatgacaagaagaccgagaacgaaagggcgccactgcttgagaatgatggtccatcttatatccgtgtttttatcaacatcttgcgtgacatacaaaaagaggacactgttgaatatgtattggctttaattgatgagatgcttacagcaaaccccacaagagcaaagttgtttcatgacaaatctcttgcagatgaagatatctatgaacctttcctgagattgttatggaaaggtagctggttcattcaagagaagagctcgaagatacttactttggtagtgagtgctaggccaaacaaaaacgatccaactgcaaatggagaaggcacaaagaagaaaaccgcatcaagtgatgatgttttgaaaggattggtggagtggctttgcattcagctgaaaaagccatcccatccaaaccgcagcattccaaccgctatcaactgccttgcaactttgttaaaggaacccgttgttaggtcttcatttgttcaagcagatggggtaaagctgctcgtgccactaatttctccagcatccactcagcagtcaatacagcttctgtatgaaacatgcctctgtgtttggctcttgtcctactatgaaccagctgttgagtacttggctacatccagagcactgcctcggttgttggaggttgtcaaaggttcaacaaaagagaaggttgtgaggatgatagtgttgaccttcaaaaacttgctttccaagggaacctttggagctcagatggtagatcttggacttcctcaaattgttcaaagtttgaaagcgcaggcctggagtgacgaggacctcttggaggcgttaaatcatctggaggaggggctgaaagataatatcaagaaattgagctcctttgataagtacaagcaggaagtccttcttggtcatcttgattggtctccaatgcataaagatcctaatttctggcgagataatattacaaagtttgaagagaacgatttccagactttacgggtcctgctcacgatattggaaacatcaagcgacccaagggcactagccgttgcttgctttgatctgtcccagtttattcagtaccatcctgcaggtcgcgtcatagtcaccgaccttaaagcaaaagagcgggtgatgaaactgatgaaccatgagaatgccgaggtcaccaaaaacgccttactctgcatccaaaggcttttccttggtgccaagtatgcaagctttttgcaggcttaatcatgggcccttttatgtttcactggtttcaatttgaataaagattcatgtctgtattttatgtttat

SEQ ID NO: 4547 - DNA, 1797 bp, Centaurea maculosa
ataaaaaacctagttatatgaaagggaggataggagatcgtgattagaatagataactgtcaattggtctttttgaaccttacgatccaaaagattacccccaaatcaatcatcgatctcaaactcaccacacacacacacactcttcttctagatttggaagaacaacatactacttgaatccctaatgccgacggatcaagccgagctcaattccgaacaggttttgaggagggatatcccatgggagacatacatgacaactaagctgatcacaggaacatcccttcagctcttaaggcgctatgacaaaaagagtgaaaatgacagggcaccactgctcgataatgatggtccatcttatattaaagtttttattagcatcttgcgcgacatacaaaaagaggaaacggttgaatatgtgttggctttaattgatgagatgcttacagcaaatcccaaaagagcactgctgtttcatgacaagtcgcttgcagatgaggacatttatgaacctttcctgagattgctatggaaaggtagctggttcatacaagaaaagagctctaagatacttactttgatagtgagtgctaggccaaagcagaatggtcggactgcaaatggagccacggattcaaagaagaaaataacctcaagtgatgatgttttgaaaggattggtggagtggctttgtattcagctgaagaagccttcccatccaagccgtagcattccagcttctgtcaattgcctagcaaccttgttgaaggaatctgttgttaggtcttcatttgttcaagcagatggagtaaagctgcttgtgccactaatttctccagcatccactcagcagtcaattcagattctctatgaaacatgtctctgtgtttggctcttgtcctactatgagcctgccattgagtatttagctacatctcgagccctgcctcgcttattggatgttgtcaaaggctcaactaaagagaaggttgtcaggttgatagttttgactttcaagaacttgctttccaagggaagctttggagctcagatggtagatcttggacttccacaaattgttcaaagtttgaaagcacaggcctggagcgatgaggacctgttggacactttaaatcatctggaagaggggctgaaagataacatcaagaaattgagctcttttgataagtacaagcaggaagtccttcttggtcatcttgattggtctccaatgcataaagatcctattttctggcgagataacattacaaactttgaagagaatgatttccagactttacgggtcctgttgacaatattggaaacatctagcgacccaagggcactggccgtagcttgctttgatctctctcagtttatccaataccaccctgctggccgggtcatagtcaccgacctcaaggcaaaagagcgagtcatgaaactgatgaaccatgagaacgctgaggtcaccaagaacgccttgctctgcatccaacggctttttcttggcgccaagtatgcaagctttttgcaggcttaaacgtgctcaaggtgatgcagcagcatttctctcgggtgctgctgctgtgttaaggctttcatttgcttaacgggtttttttcggaataaaatttgatgtctacttttatgctgtttattttggatggatgaataaaataaagagttgagggctattcatatttattgttgttaaattgtaatttaatctaatgtgtttttagattgggtgtttgaatgatgttgatgcttcatatctgctagggtttcaat

SEQ ID NO: 4548 - DNA, 1518 bp, Cirsium arvense
tcatcgatctcaaactcaccacacacactcttcttctagatttggaagaacaacatactacttgaatccccaatgccgacggatcaagccgagctcaattccgaacaggttttgaggagggatatcccatgggagacatacatgacaactaagctgatcacaggaacatcccttcagctattaaggcgctatgacaaaaagagtgaaaatgacagggcaccactgcttgataatgatggtccatcttatattaaagtttttattagcatcttgcgcgacatacaaaaagaggaaacggttgaatatgtgttggctttaattgatgagatgcttacagcaaatcccaaaagagcgcagctgtttcatgacaagtctcttgcagatgaggacatttatgaacctttcctgagattgctatggaaaggtagctggttcatacaagaaaagagctctaagatacttactttgatagtgagtgctaggccaaagcagaatggtcggactgcaaatggagccacggattcaaagaagaaaataacctcaagtgatgatgttttgaaaggattggtggagtggctttgtattcagctgaagaaaccttcccatccaagccgtagcattccagcttctgtcaactgcctagcaaccttgttgaaggaatctgttgttaggtcttcatttgttcaagcagatggggtaaagctgcttgtgccgctaatttctccagcatccactcagcagtcaattcagattctctatgaaacatgcctctgtgtttggctcttatcctactatgaacctgccattgagtatttagctacatctagagccctgcctcgcttattggatgttgtcaaaggctcaactaaagagaaggttgttaggttgatagtcttgactttcaagaacttgctttccaaaggaagcttcggagctcagatggtagatcttggacttccacaaattgttcaaagtttgaaagcacaggcctggagtgatgaggacctgttggacactttgaatcatctggaagaggggctgaaagataacatcaagaaattgagctcttttgataagtacaagcaggaagtccttcttggacatcttgattggtctccaatgcataaagatcctattttctggcgagataacattacaaactttgaagagaatgatttccagactttacgggtcctgttgacgatattggaaacatctagcgacccaagggcactggccgtagcttgctttgatctctctcagtttatccagtaccaccctgctggccgggtcatagtcaccgacctgaaggcaaaagagcgagtcatgaaactgatgaaccatgagaacgctgaggtcaccaagaacgccttgctctgcatccaacggctttttcttggcgccaagtatgcaagctttttgcaggcttaaacaggctcaaggtgatgtagcattctctcgggtgctgctgctgtgttaaggctttcatttgcttaacgggtttttttcggaataaaa

SEQ ID NO: 4549 - DNA, 1472 bp, Flaveria ramosissima
cacacactctagatctcgacgatactaatcgaagccccaaatctcatcaataatgccgacggatcaagcggagctcaattccgatcaggttttgaggagggacatcccatgggagacctatatgacaaccaaactgatcacgggaacagcccttcagctattaaggcgctatgacaaaaggtctgagaacgaaagggcgccactgcttgagaatgatggtccatcgtatatccgtgtttttatcaacatcttgcgtgacatacagaaagaggacactgttgaatatgtgttggctttaattgatgagatgcttacagtcaactccaacagagctaagttgtttcatgacaaatctcttgcagatgaagatatttatgaacctttcctgagattgttatggaaaggtagctggttcattcaagaaaagagctctaagatacttactttggtagtgagtgctaggccaaacaaaaatggttcaactagaaatggagaaggcacaaagaagaagaccacatcaactgatgatgttttgaaaggtttagtggagtggctttgtattcagctgaaaaagccctcccatccaaaccgtagcattccaactgctatcaactgccttgcaactttgttaaaggaacctgttgttaggtcttcatttgttcaggcagatggggtaaagctgcttgtgccactaatttctccagcatccactcagcagtctattcagcttctgtatgaaacatgcctctgtgtttggctcttgtcctactatgaacctgcagttgagtacttggctacatccagagcactgcctcggttgttggaggttgtcaaaggttcaacaaaagagaaggttgtgaggatgatagtgttgaccttcaaaaacttgctttccaaaggaacctttggagctcagatggtggatctcggacttccacaaattgttcaaagtttgaaagcgcaggcttggagtgacgaggacctcttggaggcgttaaatcatctggaggaggggctgaaagataatatcaagaaattgagctcctttgacaagtacaagcaggaagtccttcttggtcatcttgattggtctccaatgcataaagatcctaatttctggcgagataatattacaaagtttgaagagaatgatttccagactttgcgggtccttctcacaatattggaaacatcaagcgacccaagggcactggccgttgcctgctttgatctgtcccagtttattcagtaccatcctgcaggtcgtgtcatagtcaccgacctcaaagcaaaagagcgggtgatgaaactgatgaaccatgagaatgctgaggtcaccaaaaacgccttactctgcatccaaaggcttttccttggtgccaagtatgcaagctttttgcaggtttaagcgaggggtcccttttatatttcgtctggtttctattttgaataagattcatatcgttgttatt

SEQ ID NO: 4550 - DNA, 1569 bp, Ambrosia trifida
tcaatctgaggacacataaacaacacagacgataaatctcgtcaatgccgatcgatcaagcagacctcacttccgataaggttttgaggagggacatcccatgggagacctacttgacaagtaagctgatcacaggaaaagcccttcaacaaataaggcgctatgataaaaagagtgaaaatgatagagcaccactgcttgagaatgatggtccgtcttatgttcgtatgtttattagcatgttgcgtgacatacagaaagaggacactgtcgaatatgtgttggctttaatcgatgatatgcttacagcaaaacccattagagcaaagttgtttcatgacaaatctcttgcagatgaagatgtttatgaacctttcttgagattgttatggaaaggtagctggttcattcaagagaagagctctaagatacttactttagtagtgagtgccaggccaaacaagactgcaaatggagaagctacagattcaaagaagaaaatcacaacaagtgatgatgttttgaaaggattagttgagtggatttgtattcagctgaaaaagccttcccacccaaaccttagcattccagcatctatcaactgtcttgcagctttgttaaaggaacctgttattagatcttcatttgttcaagcagatggtgtgaagctgcttgtgccgctaatttctccagcaaccactcagcagtcaattcaacttctgtatgaaacatgcctctgtgtttggctcttgtccttctacgaacctgcaatcgagtacttggctacatctagagccctacaacggttgtcggaggttgtcaaaggttcaaccaaagagaaggttgtgaggttgatagtgttgactttcaagaacttgctttcgaggggaacctttggagctcagatggtagaacttggacttccacaaattgttcaaagtttgaaagcacaagcctggagtgatgaggacctcttggatgctttaaatcatctggaacaagggctgaaagataacatcaagaaattgagttctttcgataagtacaagcaggaagtccttctcggtcatcttgactggtctccgatgcataaagatactattttctggcgagataatattacaaattttgaagagaacgatttccagactctacgggtcctgctcacgatactggaaacatcaagtgatccaagggcactagccgtggcgtgctttgatctgtcccagtttattcagtaccatcctgctggccgagtcatagtcactgacctcaaagcaaaagagcgggtcatgaaactgatgaaccacgagaatgccgaggtcactaaaagcgctttactctgcatccaaaggcttttccttggtgccaaatatgcaagctttttgcaagcttgatgtgcatttctcatgggccctttctgttaaaggcttgttattttgaataaaaattgatctgtatttttatgctgttaaggggtggtgataaaataaaggtttgagggctattcatacttattattcaaacagaactataattttaaactatttatttacattaaagttttaa

SEQ ID NO: 4551 - DNA, 1678 bp, Centaurea maculosa
ggacgtgattagaatagataactgtcaattggctttttgaaccttaaccgatccaaaagaattacccccaaactcaatcatcgatctcaaactcaccacacacacacactcgtcttctagatttggaagaacaacatactacttgaatccccaatgccgacggatcaagccgagctcaattccgaacaggttttgaggagggatatcccatgggagacatacatgacaactaagctgatcacaggaacatcccttcagctattaaggcgctatgacaaaaagagtgaaaatgacagggcaccactgctcgataatgatggtccatcttatattaaagtttttattagcatcttgcgtgacatacaaaaagaggaaacggttgaatatgtgttggctttaattgatgagatgcttacagcaaatcccacaagagcgctgctgtttcatgacaagtctcttgcagatgaggacatttatgaacctttcctaaggttgctatggaaaggtagctggttcatacaagaaaagagcgctaagatacttactttgatagtgagtgctaggccaaagcagaatggtcggactgcaaatggtgccacagattcaaagaagaaaataacctcaagtgatgatgttttgaaaggattggtagagtggctttgtattcagctgaagaagccttcccatccaagccgtagcattccagcttctgtcaactgcctagcaaccttgttgaaggaatctgttgttaggtcttcatttgttcaagcagatggggtaaagctgcttgtgccgctaatttctccagcatccactcagcagtcaattcagattctctatgaaacatgcctctgtgtttggctcttgtcctactatgaacctgccattgagtatttagctacatctagagccctgcctcgcttattggatgttgtcaaaggctcaactaaagagaaggttgtcaggctgatagtgttgactttcaagaacttgctttccaaaggaagcttcggagctcagatggtagatcttggacttccacaaattgttcaaagtttgaaagcacaggcctggagcgatgaggaccttttggacactttaaatcatctggaagaggggctgaaagataacatcaagaaattgagctctttcgataagtacaagcaggaagtgcttcttggtcatcttgattggtctccaatgcataaagatcctattttctggcgagataacattacaaactttgaagagaatgatttccagactttacgggttctgttgacgatattggaaacatctagcgacccaagggcactggccgtagcttgctttgatctctctcagtttatccagtaccaccctgctggccgggtcatagtcaccgacctcaaggcaaaagagcgagtcatgaaactgatgaaccatgagaacgctgaggtcaccaagaacgccttgctctgcatccaacggctttttcttggcgccaagtatgcaagctttttgcaggcttaatcgtgctcaaggtgatgcagcatttctctcgggtgctgctgtgttaaggctttcatttgcttaacgggtttttttcggaataaaatttgatgtctacttttatgctgtttattttggatggatgaataaaataagagttgagggctattcatatttattgttgtaa

SEQ ID NO: 4552 - DNA, 1466 bp, Cichorium intybus
ttcaatgccgacggatcaagccgagctcaattccgaacaggttttgaggagagatatcccatgggagacctacatgacaacaaagctaatcacaggaacatcccttcagctattaaggcgctatgacaaaaagactgaaaatgacagagcacaattgcttgataatgatggtccatcttatattcatgttttcattagcatcttgcgcgacatacagaaagaggacacagtcgaatatgtgttggctttaatcgatgaaatgcttacagcaagccccaaaagggcaaagttgtttcatgacaagactcttgcagatgaagacatttacgaaccattcttgagattgttatggaaaggtagctggttcatacaagagaagagctccaagatacttacttttgtagtgagtgccaggccaaaacaaaatggtcgaactgcaaatggacaatctgctgattcaaagaagaaaatcactgcaagtgatgatgttttgaaaggattggtggaatggctttgtattcagctgaagaagccttcacatcctacccgtagcattccagcttcagtcaactgtttagcaactttgttgaaggaacctgttgttaggtcttcatttgttcaagcagatggggtcaaacttcttgtgccattaatttctccagcatccactcaacagtcaattcagcttctgtatgaaacatgcctctgtgtttggcttttatcctactacgaacctgcaatcgagtacttagccacttctagagcccttccaagattgttggaggttgtcaaaggttcaacaaaagagaaggttgtaaggttgatagtcttgactttcaaaaacttgctctctaaaggaacattcggtgctcaaatggttgaccttggactcccacaaatcgttcaaagtctaaaagcccaagcttggagtgacgaggacctcttggacgcattaaaccatctggaagaaggtctcaaagacaacatcaagaaattaagctctttcgataaatacaaacaagaagtcctcctcggtcaccttgactggtctccaatgcacaaagaccctattttctggcgcgacaatatcacaaactttgaagaaaatgatttccagactcttcgtgtccttctgactattctggaaacttccggagacccgcgagcacttgcggtcgcgtgttacgacctgtctcagtttatccaataccatccagctggacgcgtgatagtgactgatttaaaagcgaaagagcgcgtcatgaagcttatgaaccatgagaatgctgaggtcactaaaaacgcattgctttgtattcagaggctgtttctgggtgccaagtacgcgagctttttgcaggcgtagtggtgacggtaagttttctttttaatctgtttttggaataaaagtcggtatgtgtattttttatatggagtgaaataaaaggtgaggggtattattatta

SEQ ID NO: 4553 - DNA, 1599 bp, Cichorium intybus
actgtcattgttttctggatcattgtggacaaaacaagccagagattaaccccaaatcaatccccgatctcaaactcaccacacacataaacacactctagatttggacgatactaactgaaacgccaaatctcttcaatgccgacggatcaagccgagctcaattccgaacaggttttgaggagagatatcccatgggagacctacatgacaacaaagctaatcacaggaacatcccttcagctattaaggcgctatgacaaaaagactgaaaatgacagagcacaattgcttgataatgatggtccatcttatattcatgttttcattagcatcttgcgcgacatacagaaagaggacacagtcgaatatgtgttggctttaatcgatgaaatgcttacagcaagccccaaaagggcaaagttgtttcatgacaagactcttgcagatgaagacatttatgaaccattcttgagattgttatggaaaggtagctggttcatacaagagaagagctccaagatccttacttttgtagtgagtgccaggccaaaacaaaatggtcgaactgcaaatggacaatctgctgattcaaagaagaaaatcactgcaagtgatgatgttttgaaaggattggtggaatggctttgtattcagctgaagaagccttcacatcctacccgtagcattccagcttcagtcaactgtttagcaactttgttgaaggaacctgttgttaggtcttcatttgttcaagcagatggggtcaaacttcttgtgccattaatttctccagcatccactcaacagtcaattcagcttctgtatgaaacatgcctctgtgtttggcttttatcctactacgaacctgcaatcgagtacttagccacttctagagcccttccaagattgttggaggttgtcaaaggttcaacaaaagagaaggttgtaaggttgatagtcttgactttcaaaaacttgctctctaaaggaacattcggtgctcaaatggttgaccttggactcccacaaatcgttcaaagtctaaaagcccaagcttggagtgacgaggacctcttggacgcattaaaccatctggaagaaggtctcaaagacaacatcaagaaattaagctctttcgataaatacaaacaagaagtcctcctcggtcaccttgactggtctccaatgcacaaagaccctattttctggcgcgacaatatcacaaactttgaagaaaatgatttccagactcttcgtgtccttctgactattctggaaacttccggagacccgcgagcacttgcggtcgcgtgctacgacctgtctcagtttatccagtaccatccagctggacgtgtgatagtgactgatttaaaagcgaaagagcgagtcatgaaacttatgaaccatgagaacgctgaggtcactaaaaacgcattgctttgtattcagaggctgtttctgggtgccaagtacgcgagctttttgcaggcgtagtggtgacggtaagttttctttttaatctgtttttggaataaaagtcggtatgtgtattttttatatggagtgaaataaaaggcgaggggtattattatt

SEQ ID NO: 4554 - DNA, 1852 bp, Cichorium intybus
gggagacgtgtttacaagagataactgtcattgttttctggatcattgtggacaaaacaagccagagattaaccccaaatcaatccccgatctcaaactcaccacacacataaacacactctagatttggacgatactaactgaaacgccaaatctcttcaatgccgacggatcaagccgagctcaattccgaacaggttttaaggagagacatcccatgggagacctacatgacaacaaagctgatcacaggaacttcccttcagctattaaggcgatatgacaaaaagactgaaaatgacagagcacaattgcttgataatgatggtccatcttatattcatgttttcattagcatcttgcgcgacatacagaaagaggacacagtcgaatatgtgttggctttaatcgatgaaatgcttacagcaagccccaaaagggcaaagttgtttcatgacaagactcttgcagatgaagacatttacgaaccattcttgagattgttatggaaaggtagctggttcatacaagagaagagctccaagatacttacttttgtagtgagtgccaggccaaaacaaaatggtcgaactgcaaatggacaatctggtgattcaaagaagaaaatcactgcaagtgatgatgttttgaaaggattggtggaatggctttgtattcagctgaagaagccttcacatcctacccgtagcattccagcttcagtcaactgtttggctactttgttgaaggaacctattgttaggtcttcatttgttcaagcagatggggtcaaacttcttgtgccattaatttctccagcatccactcaacagtcaattcagcttctgtacgaaacatgcctctgtgtttggcttttatcctactacgaacctgcaatcgagtacttagccacttctagagcccttccaagattgttggaggttgtcaaaggttcaacaaaagagaaggttgtaaggttgatagtcttgactttcaaaaacttgctctctaaaggaacattcggtgctcaaatggttgaccttggactcccacaaatcgttcaaagtctaaaagcccaagcttggagtgacgaggacctcttggacgcgttaaaccatctggaagaaggtctcaaagacaacatcaagaaattaagctctttcgataaatacaaacaagaagtcctcctcggtcaccttgactggtctccaatgcacaaagaccctattttctggcgcgacaatatcacaaactttgaagaaaatgatttccagactcttcgtgtccttctgactattctggaaacttccggagacccgcgagcacttgcggttgcgtgctacgacctgtctcagtttatccagtaccatccagctggacgtgtgatagtgactgatttaaaagcgaaagagcgagtcatgaaacttatgaaccatgagaacgctgaggtcactaaaaacgcactgctttgtattcagaggctgtttctgggtgccaagtacgcgagctttttgcaggcgtaatggtgatggtaagttttttccgtatatgatattgaggaacaatggatggttaatgtttgttgtggatggttcaatgtttccgcggcctgcaatttggttattgagatttgagtgcttattttcctcacaatctcggaaaatgggacccacgggccacgggtagattcacatatgcacaaagaatctttttattattatttatttcgtgtttagtacatgaaaaataagtatgaataagagggaaaatagagaaaatagttaatttgatatttgccaaagaccttgtggtctagtgacacaggcgaatgcccggcctccttgaggtcttg

SEQ ID NO: 4555 - DNA, 1517 bp, Cichorium intybus
actgtcattgttttctggatcattgtggacaaaacaagccagagattaaccccaaatcaatccccgatctcaaactcaccacacacatacacactctagatttggacgatactaactaaaacgccaaatctcttcaatgccgacggatcaagccgagctcaattccgaacaggttttgaggagggatatcccatgggagacctacatgacaacaaagctgatcacaggaacatcccttcagctattaaggcgctatgacaaaaagactgaaaatgacagagcacaattgcttgataatgatggtccatcttatattcatgttttcattagcatcttgcgcgacatacagaaagaggacacagtcgaatatgtgttggctttaatcgatgaaatgcttacagcaagccccaaaagggcaaagttgtttcatgacaagactcttgcagatgaagacatttacgaaccattcttgagattgttatggaaaggtagctggttcatacaagagaagagctccaagatacttacttttgtagtgagtgccaggccaaaacaaaatggtcggactgcaaatggacaatctggtgattcaaagaagaaaatcactgcaagtgatgatgttttgaaaggattggtggaatggctttgtattcagctgaagaagccttcacatcctacccgtagcattccagcttcagtcaactgcttagcaactttgttgaaggaacctgttgttaggtcttcatttgttcaagcagatggggtcaaacttcttgtgccattaatttctccagcatccactcaacagtcaattcagcttctgtatgaaacatgcctctgtgtttggcttttatcctactacgaacctgcaatcgagtacttggctacttctagagcccttccaagattgttggaggttgtcaaaggttcaacaaaagagaaggttgtaaggttgatagttttgactttcaaaaacttgctctctaaaggaacattcggagctcaaatggttgaccttggactcccgcaaatcgttcaaagcctaaaagcacaagcttggagtgacgaggacctcttggacacgttaaaccatctggaagaaggtctgaaagacaacatcaagaaattaagctctttcgataaatacaaacaagaagtcctcctcggtcaccttgactggtctccaatgcacaaagaccctattttctggcgcgacaatatcacaaactttgaagaaaatgatttccagactcttcgtgtccttctgactattctggaaacttccggagacccacgcgcacttgcggttgcgtgttacgacctgtctcagtttatccagtaccatccagctggacgtgtgatagtgactgatttaaaagcgaaagagcgagtcatgaaacttatgaaccatgagaacgctgaggtcactaaaaacgcattgctttgtattcagaggctgtttctgggtgcaaagtacgcgagctttttgcaggcgtaatggtgacggtaagtttttt

SEQ ID NO: 4556 - DNA, 1668 bp, Flaveria ramosissima
agataactgtcattggttttttcgaacgtgaacaaaacaatagccagattacccccaaatcaaaccccgatctcaaactcaccacacacactctagatttcgacgatactaatcgaagccccaaatctcatcaatgccgacggatcaagcggagctcaattccgatcaggttttgaggagggacatcccatgggagacctatatgacaactaaactgatcacgggaacagcccttcagctactaaggcgctatgacaagaagaccgagaacgaaagggcgccactgcttgagaatgatggtccatcttatatccgtgtttttatcaacatcttgcgtgacatacaaaaagaggacactgttgaatatgtattggctttaattgatgagatgcttacagcaaaccccacaagagcaaagttgtttcatgacaaatctcttgcagatgaagatatctatgaacctttcctgagattgttatggaaaggtagctggttcattcaagagaagagctcgaagatacttactttggtagtgagtgctaggccaacaaaaacgatccaactgcaaatggagaaggcacaaagaagaaaaccgcatcaagtgatgatgttttgaaaggattggtggagtggctttgcattcagctgaaaaagccatcccatccaaaccgcagcattccaaccgctatcaactgccttgcaactttgtaaaggaacccgttgttaggtcttcatttgttcaagcagatggggtaaagctgctcgtgccactaatttctccagcatccactcagcagtcaattcagcttctgtatgaaacatgcctctgtgtttggctcttgtcctactatgaaccagctgttgagtacttggctacatccagagcactgcctcggttgttggaggttgtcaaaggttcaacgaaagagaaggttgtgaggatgatagtgttgaccttcaaaaacttgctttccaagggaacctttggagctcagatggtagatcttggacttcctcaagttgttcaaagtttgaaagcgcaggcctggagtgacgaggacctcttggaggcgttaaatcatctggaggaggggctgaaagataatatcaagaaattgagctcctttgataagtacaagcaggaagtccttcttggtcatcttgattggtctccaatgcataaagatcctaatttctggcgagataatattacaaagtttgaagagaatgatttccagactttgcgggtccttctcacaatattggaaacatcaagcgacccaagggcactggccgttgcctgctttgatctgtcccagtttattcagtaccatcctgcaggtcgtgtcatagtcaccgacctcaaagcaaaagagcgggtgatgaaactgatgaaccatgagaatgctgaggtcaccaaaaacgccttactctgcatccaaaggcttttccttggtgccaagtatgcaagctttttgcaggtttaagcaggggcccttttatatttcgctggtttcattttgaataaagattcatatctgtattttatgttgtttatgaaataaaaagttgagggctatccatacttttttaattattattgtaaatcaaacttaatctatgtgtttaatttggtgtttggtgatgcatcatatctgcaggatatga

SEQ ID NO: 4557 - DNA, 1538 bp, Cichorium intybus
agacgtgtttacaagagataactgtcattgttttctggatcattgtggacaaaacaagccagagattaaccccaaatcaatccccgatctcaaactcaccacacacataaacacactctagatttggacgatactaactgaaacgccaaatctcttcaatgccgacggatcaagccgagctcaattccgaacaggttttgaggagagatatcccatgggagacctacatgacaacaaagctgatcacaggaacatcccttcagctattaaggcgctatgacaaaaagactgaaaatgacagagcacaattgcttgataatgatggtccatcttatattcatgttttcattagcatcttgcgcgacatacagaaagaggacacagtcgaatatgtcttggctttaatcgatgaaatgcttacagcaagccccaaaagggcaaagttgtttcatgacaagactcttgcagatgaagacatttacgaaccattcttgagattgttatggaaaggtagctggttcatacaagagaagagctccaagatacttacttttgtagtgagtgccaggccaaaacaaaatggtcgaactgcaaatggacaatctgctgattcaaagaagaaaatcactgcaagtgatgatgttttgaaaggattggtggaatggctttgtattcagctgaagaagccttcacatcctacccgtagcattccagcttcagtcaactgtttggctactttgttgaaggaacctattgttaggtcttcatttgttcaagcagatggagtcaaacttcttgtgccattaatttctccagcatccactcaacagtcaattcagcttctgtatgaaacatgcctctgtgtttggcttttatcctactacgaacctgcaatcgagtacttggctacttctagagcccttccaagattgttggaggttgtcaaaggttcaacaaaagagaaggttgtaaggttgatagttttgactttcaaaaacttgctctctaaaggaacattcggagctcaaatggttgaccttggactcccgcaaatcgttcaaagcctaaaagcacaagcttggagtgacgaggacctcttggacacgttaaaccatctggaagaaggtctgaaagacaacatcaagaaattaagctctttcgataaatacaaacaagaagtcctcctcggtcaccttgactggtctccaatgcacaaagaccctattttctggcgcgacaatatcacaaactttgaagaaaatgatttccagactcttcgtgtccttctgactattctggaaacttccggagacccacgcgcacttgcggtcgcgtgttacgacctgtctcagtttatccaataccatccagctggacgcgtgatagtgactgatttaaaagcgaaagagcgcgtcatgaagcttatgaaccatgagaatgctgaggtcactaaaaacgcattgctttgtattcagaggctgtttctgggtgccaagtacgcgagctttttgcaggcgtagtggtgacggtaagttttc

SEQ ID NO: 4558 - DNA, 1656 bp, Flaveria ramosissima
gaacaaaacgagagagtgattacccctaaatcaatctccaatctcaacctcaccacacacagacgatattaactgaaactccaaatctcacatcgtcaatgccgacagatcaagcagacctcagctccgatcaggttttgaggagggacatcccatgggagacctacatgacaactaagctgatcacaggaacagcccttcagttattaaggcgctatgacaaaaagactgaaaatgaaagggcaccactgcttgagaatgatggtccgtcttatattcgtgtatttatcagcatcttgcgtgacatacagaaagaggacactgttgaatatgtgttggctttaattgatgagatgcttacagtaaaacccaatagagcaaagttgtttcatgacaaatctcttgcagatgaagatatttatgaacctttcttaagattgttatggaaaggtagctggttcattcaagagaagagctctaagatacttactttagtagtgagtgctaggtcaaacaagaatggttcgactgcaaacggagaagccacaaattcaaagaagaaaatcaccacaagtgatgatgttttgaaaggattagtggagtggctttgtattcagctgaaaaagccttcccatccaaaccgtagcattccagcttctatcaactgtctagcagctttgctaaaggaacctgttgttagatcttcatttgttcaagcagatggtgtgaagctgcttgtgccactgatttctccagcatctactcagcagtcaattcagcttctgtatgaaacatgcctgtgtgtttggctcttgtcatattatgaacctgcaatcgagtacttggctacatctagagcccttccacggttgttggaggttgttaaaggttcaacaaaagagaaggttgtgaggttgatagtgttgactttcaagaacttgctttcaaaaggaacctttggagctcagatggtagatcttggacttccacaaattgttcaaagcttgaaagcacaagcctggagcgatgaggacctcttggatgctctaaatcatctggaagacgggctgaaagataacatcaagaaattgagttctttcgataagtacaagcaggaagtccttcttggtcatcttgattggtctccgatgcataaagatcctagtttctggcgagaaaatattacatattttgaagataatgatttccagactctacgggtcctgctcacgatactggaaacatctagtgatccaagggcactagccgtggcatgctttgatctgtcccagtttattcaataccatcccgcgggccgagtcatagtcactgacctcaaagcaaaagagcgcgtgatgaaactgatgaaccacgagaacgcagaggtcaccaaaaacgctttactctgcatccaaaggcttttccttggggccaagtatgcaagcttttgcaagcataatatgcatctcctggagacctggacccttctctgttaaaagtttgttattttgaataaaattgatgtctgtattttatgctgtttatggatggtgagaaaataaaaagtttgagggctattattatattaaaccgaactttgatgttaacatttcacattaaagtgaattttctataattattattgtaaagtttatt

SEQ ID NO: 4559 - DNA, 1641 bp, Cirsium arvense
aacgagcgacagattacacccaaatcaatccccgatctcaaactcaccacacactctagatttcgaagatactgcttgaagcgtcaatgccgatggatcaagccgaactcaattccgaacaggttttgaggagggatatcccatgggagacatacatgacgactaagctgatcacaggaacatcccttcagctattaaggcgctatgacaaaaagagtgaaaatgacagggcaccactgcttgataatgatggtccatcttatattcatgtttttattagcatcttgcgtgacatacaaaaagaggaaacggttgaatatgtgttggctttaattgatgagatgcttacagcaaatcccaaaagagcgctgctgtttcatgacaagtctcttgcagatgatgacatctacgaacctttcctgagattgctatggaaaggtagctggttcatacaagaaaagagctctaagatacttactttggtagtgagtgctaggccaaagcagaatggtcggacaaatggaggagccacagattcaaagaagaaaacaaccacaagtgatgatgttttgaaaggattggtggagtggctttgtattcagctgaagaagccttcccatccaagccgtagcattccagcttctgtcaactgcctagcaaccttgttgaaggaatctgttgttaggtcttcatttgttcaagcagatggggtaaagcttcttgtgccactaatttctccagcatccactcagcagtcaattcagattctctatgaaacatgcctttgtgtttggcttttgtcctactatgaacctgcaattgagtatttggctacatctagagccctgccacgcttattggaggttgtcaaaggttcaacgaaagagaaggttgtgaggttgatagtcttgactttcaagaacttgcttgccaaaggaagcttcggagctcagatggtagatcttggacttccacaaattgttcaaagtttgaaagcacaggcctggagtgatgaggatctgttggacaccttaaatcatctggaagaggggctgaaagataacataaagaaattgagttcttttgataagtacaagcaggaagtccttcttggtcatcttgattggtctccaatgcataaagatcctattttctggcgagataacattacaaactttgaagagaatgatttccagactttacgggtcctcctcacgatattggaaacatctagtgatccaagggcattggccgtagcttgctttgatctatctcagtttattcagtaccatcctgctggccggatcatagtcactgacctcaaagcaaaagaacgggttatgaaactgatgaaccatgagaacgctgaggtcaccaaaaacgccttactctgcatccaacggcttttccttggtgccaaatatgcaagctttttgcaggtttaaaacgttaccattctcggatcgtcatatgcatttctcgggttcttcgcttttatttgcttatcgggttctttttcggaataaaattttatgactctacttttatgctgtttatggatggaataaaataaagagatgaggcctatttattcatatttatttgttgtaaagtgaacgtaaatcaatgtgtttaaatttg

SEQ ID NO: 4560 - DNA, 1652 bp, Helianthus annuus
atcacccccaaaatcaaatctcaaactcaccacacaaacacacacaaactcactccagatttgcaccaattctcctcaatgcctacggatcaagccgagctcaattccgatcaggttttgcggagggacatcccatgggagacctatatgactactaagctgatcaccggaacagctcttcagctattaaggcgctatgacaaaaagagtgaaaacgaaagggcaccactgcttgagaatgacggcgcatcttatatccgtgttttcatcaacatcttgcgtgacatacagaaagaggacactgtcgaatacgtgttggctttaattgatgagatgcttacagcaaaccccaaaagagcaaagttgtttcacgataaatctcttgaagatgaagatatttatgaaccttttatgagattgttagggaaaggtagctggttcattcaagagaagagctctaagatacttactttggtagtgagtgctaggtcaaacaaaaatggttcgattgcaaacggagaaggctcaaagaagaagggcacctcaagtgatgatgttttgaaaggattagtggattggctttgtattcagctgaaaaagccctcccatccaaaccgtagcattccatctgccgtcaactgcctagcaactttgttaaaggaacctgttgttaggtctgcatttgttcaagctgatggggtaaagctccttgtgccactaatttctccagcatccactcagcagtcaattcagcttctgtatgaaacatgcctctgcgtttggctcttatcctactacgaacccgcaatcgagtacttagctacatctagagccctaccgcggttattggaggttgtgaaaggttcaacaaaggagaaggttgtgaggttgatcgtgttgactttcaaaaacttgcttgcaaaaggaacgtttggagctcagatggttgatattggacttcctcaagttgttcaaagtttgaaagcgcaggcctggagtgacgaggatctcttggatgcgttaaatcatctggacgaggggctgaaagataatatcaagaaactgagctcttttgacaagtacaagcaggaagtccttcttggtcatcttgattggtctccaatgcataaagatcctaatttctggcgagagaatattacaaggtttgaagagaatgatttccagactttacgggtcctgctcacaatactggaaacatcaagcgacccaagggcgctagccgttgcttgctttgatctgtcccagtttatccagtaccatcctgcaggccgcgtcatagtcaccgacctcaaagcaaaagagcgcgtgatgaaattgatgaaccacgagaacgccgaggtcaccaaaaacgccttactctgcatccaaaggcttttcctcggtgccaagtatgcaagcttcttgcaggtttaatcatggattcatgagtccttttaagtttaccggtttcctttttgaataaaatttatgtctgtatttttatgttgtttatgaaataaaaaagttgagggcttttagtattttattattgttattattgtaaattaaatttcatctatgtatttagtttgatgttgggtgatgcatcatatctgccagatttgactggttttgttgtatgttttgtttgc

SEQ ID NO: 4561 - DNA, 1637 bp, Flaveria ramosissima
tcattggttttttcgaacgtgaacaaaacaatagccagattacccccaaatcaacccgcgatctcaaactcaccacacacacactctagatttcgacgatactaatcgaagccccaaatctcatcaatgccgacggatcaagcggagctcaattccgatcaggttttgtggagggacatcccatgggagacctatatgacaactaaactgatcaccggaacagcccttcagctattaaggcgctatgacaagaagagcgagaatgaaagggcgccactgcttgagaatgatggtccatcttatatccgtgtttttatcaacatcttgcgtgacatacaaaaagaggacactgttgaatatgtattggctttaattgatgagatgcttacagcaaacccacaagagcaaagttgtttcatgacaaatctcttgcagatgaagatatctatgaaccttgcctgagattgttatggaaaggtagctggttcattcaagagaagagctcaaagatacttactttggtagtgagtgctaggccaacaaaaacgatccaactgcaaatggagaaggcacaaagagaaaacctcatcaagtgatgatgttttgtaaggattggtggagtggctttgcattcagctgaaaaagccatcccatccaaaccgtagcattccaaccgctatcaactgccttgcaactttgttaaaggaacccgttgttaggtcttcatttgttcaagcagatggggtaaagctgctcgtgccactaatttctccagcatccactcagcagtcaattcagcttctgtatgaaacatgcctctgtgtttggctcttgtcctactatgaaccagctgttgagtacttggctacatccagagcactgcctcggttgttggaggttgtcaaaggttcaacgaaagagaaggttgtgaggatgatagtgttgaccttcaaaacttgctttccaagggaacctttggagctcagatggtagatcttggacttcctcaagttgttcaaagtttgaaagcgcaggcctggagtgacgaggacctcttggaggcgttaaatcatctggaggaggggctgaaagataatatcaagaaattgagctcctttgataagtacaagcaggaagtccttcttggtcatcttgattggtctccaatgcataaagatcctaatttctggcgagataatattacaaagtttgaagagaacgatttccagactttacgggtcctgctcacgatattggaaacatcaagcgacccaagggcactagccgttgcttgctttgatctgtcccagtttattcagtaccatcctgcaggtcgcgtcatagtcaccgaccttaaagcaaaagagcgggtgatgaaactgatgaaccatgagaatgccgaggtcaccaaaacgccttactctgcatccaaaggcttttccttggtgccaagtatgcaagctttttgcaggtcttaatcatgggtcccttttatgtttcacttggtttctaatttgaaataaagatttcatgttctgttattttattgtttatagaaattaaaaagttgagggtctttccattatttttttaattatctattagttaatttaaacaaaatctattgttgtttaatt

SEQ ID NO: 4562 - DNA, 1469 bp, Flaveria ramosissima
aatgccgacggatcaagcggagctcaattccgatcaggttttgaggagggacatcccatgggagacctatatgacaactaagctgatcacgggaacagcccttcagttattaaggcgctatgacaaaaggtctgagaatgaaagggcgccactgcttgagaatgatggtccgtcttatattcgtgttttatcagcatcttgcgtgacatacagaaagaggacactgttgaatatgtgttggctttaattgatgagatgcttacagtcaactccaacagagctaagttgtttcatgacaaatctcttgcagatgaagatatttatgaacctttcctgagattgttatggaaaggtagctggttcattcaagagaagagctctaagatacttactttggtagtgagtgctaggcctaacaaaaatggttcaactgcaaatggagaaggcacaaagaagaagaccgcatcaagtgatgatgttttgaaaggtttagtggagtggctttgtattcagctgaaaaagccctatcatccaaaccgtagcattccaactgctatcaactgccttgcaacttgtaaagaccattgtaggtcttcatttgttcaggcagatggggtaaagctgcttgtgccactaatttctccagcatccactcagcagtctattcagcttctctatgaaacatgcctctgtgtttggctcttgtcctactatgaacctgcagttgagtacttggctacatccagagcactgcctcggttgttggaggttgtcaaaggttcaacaaaagagaaggttgtgaggatgatagtgttgaccttcaaaaacttgctttccaaaggaacctttggagctcagatggtggatcttggacttccacaaattgttcaaagtttgaaagcgcaggcttggagtgacgaggacctcttggaggcgttaaatcatctggaggaggggctgaaagataatatcaagaaattgagctcctttgacaagtacaagcaggaagtccttcttggtcatcttgattggtctccaatgcataaagatcctaatttctggcgagataatattacaaagtttgaagagaacgatttccagactttacgggtcctgctcacaatattggaaacatcaagcgacccaagggcactagccgttgcttgctttgatctgtcccagtttattcagtaccatcctgcagggcgtgtcatagtcaccgacctcaaagcaaaagagcgggtgatgaaactgatgaaccatgagaacgccgaggtcaccaaaaacgccttactctgcatccaaaggcttttccttggtgccaagtatgcaagctttttgcaggtctaagcacgggcccttttatgtttcactggtttcattttgaataaagattcatgtccgtattttatgttgtttatgaaataaaaagttgagggctattcatatttttttttaattattattgt

SEQ ID NO: 4563 - DNA, 1641 bp, Ambrosia trifida
acgatctcgacctcacacacacaaactcactcgtgatttgcccttattctcgtcaatgccaatggatcaagccgagcttaattccgatcaggttttgaggagggatattccatgggagacctatatgactactaagctgataactggaacagcccttcagctattaaggcgctatagacaaaaaaactgaaaatgaaaaggcacaactgcttgagaatgatggcccatcttatatccgtgtttttatcaacatcttgcgtgacatacagaaagaggacactgttgaatatgtgttggctttaattgatgagatgcttgcagcaagccccaaaagagcgaagctgtttcatgacaaatctcttgaagatgaagatatttatgaacctttcatgagattgttatggaaaggtagctggttcaatcaagagaagagctctaagatacttagtttagtagtgagtgccaggtcaaacaaaaatggttcgactgctaatggagaaggctcaaagaagaagaccacctcaagtgatgatgttttgaaaggattagtggactggatttgtattcagctgaaaaagccctctcatccaaaccgtagcattccatcgtctatcaactgcctagcaactttgttaaaggaacctgttgttaggtcttcatttgttcaagcagatggggtaaagctgcttgtgccactaatttctccagcatcaactcagcagtcaattcagcttctgtatgaaacatgtctctgtgtttggctcttgtcctactatgaacctgcaattgagtacttggctacatctagagccctgccacggttaatggaggttgtcaaaggttcaacaaaggagaaggttgtgaggttgatcgtgttgactttcaaaaacttgctttcaaaaggaacctttggagctcagatggttgatcttggacttcctcaaatcgttcaaagtttgaaagcacaggcctggagcgacgaggatctcttggatgcgttgaatcatttggacgaggggctgaaagataatatcaagaaattgagctcttttgacaagtacaagcaggaagtccttcttggtcatcttgattggtctccaatgcataaagatcctaacttctggcgagagaatgttacaaggtttgaagagaatgattttcagactttacgggtcttgctcacaatattggaaacatcaagcgacccaagggcactagccgtggcttgctttgatctgtcccagtttatccagtaccatgctgcaggccgtgtcataatcactgacctcaaagcaaaagagcgggtgatgaaactgatgaaccatgagaatgccgaggtcaccaaaaacgccttgctatgcatccaaaggcttttccttggtgccaagtatgcaagctttttgcaggtttaatcatgggttctttgatgtctactggcttcccttttgaataaaattttaagtctgtatttttatgttcatgaaataaaaaagttgagggctattaatatttttattattgtaaattaaacttgatctatgtatttaattggtgttgggtcatgcatcatagattcatggattcaaatctgcaggatgtgactaaatttgttgtatgttttgtttgcttattgatttctca

SEQ ID NO: 4564 - DNA, 1793 bp, Chrysanthemum coronarium
aacgcataggtaatcagcaaccaggacaagaacagaaggcaaatactactccctattacactaaagtataaacacacacacataaacacatactagatttattataaactcataatcattatcaatgccgatggatcaagcagagctcaattccgatcaggttctgaggagggacatccaatgggagacatacatgacaaccaagctaatcacaggaacatcgcttcagctattaaggcgctatgacaaaaagactgaaaccgaaagggcatcattgctcgagaatgatggtccatcttatatccgtgtttttatcagcatcttgcgtgatattcagaaagaagacacggttgaatatgtgttggctttaattgatgagatgctaacagccgacccaaaaagagcgaagctgtttcatgacaagtctcttgcagatgaagatatttatgaacctttcttgagattgttatggaaaggcagctggtttattcaagagaaaagctccaagatacttactttggtagtgagtgctaggccaaagcagaatggttcgagcgcaaatggtgaacccgcagattcgaagaagaaaatcaccgcaagtagtgatgttttgaaaggattggtggagtggctttgtattcagctgaaaaagccttctcatccgagccgtagcattccagcttctgtcacctgcctatcaacattgttgaaggaacctatcgttaggtcttcatttgttcaagcagatggggttaagctacttgtgccacttatttctccagcatccactcagcagtcgattcagcttctctatgagacatgcctctgtgtttggctcctatcctactatgaacctgcaattgagtatttggctacatctagagccctgccacggttgttggaggttgttaaaggttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgatgaggacctcttggacgctctaaatcatctggaagaagcgctgaaagataatatcaaaagattgagttcttttgagaagtacaagcaggaagtcctccttggtcatcttgattggtctcccatgcataaagatcccaatttttggagagataatatcacaaactttgaagagaatgatttccagactctacgggtcctgctcacgatactggacacatcgagtgatccaagggcactagccgttgcttgctatgatctttcccagtttattcagtaccatcctgctggtcgggtcattgtcacagatctcaaggcaaaggagcgggtcatgaaactgatgaaccacgagaacgccgaggtcaccaaaaacgccttactctgtatccaaaggctcttcctcggtgccaagtacgcaagctttttgcaagtttaatgtacacacgtatggatcaaatcgtctctgcacgagttagtggacatcatttgtcaaaatgtttgagcgtacgtgcgtctcttgggcacttctctgttaaggcttattataattcgttttaacggtttctttttgaataaaagttgatgtctgtaatttttatggtgtttatggatggtgaataaaataaagggttgagggctatatattcatatttatatttgttaatgttattatttgttgtaaatcataatcacaaaattgaattgggttgatgcatcatatctatcaggatttgtgacttttg

SEQ ID NO: 4565 - DNA, 1681 bp, Chrysanthemum coronarium
aaacacacacacataaacacatactagatttattataaactcataatcattatcaatgccgatggatcaagcagagctcaattccgatcaggttctgaggagggacatccaatgggagacatacatgacaaccaagctaatcacaggaacatcgcttcagctattaaggcgctatgacaaaaagactgaaaccgaaagggcatcattgctcgagaatgatggtccatcttatatccgtgtttttatcagcatcttgcgtgatattcagaaagaagacacggttgaatatgtgttggctttaattgatgagatgctaacagccgacccaaaaagagcgaagctgtttcatgacaagtctcttgcagatgaagatatttatgaacctttcttgagattgttatggaaaggcagctggtttattcaagagaaaagctccaagatacttactttggtagtgagtgctaggccaaagcagaatggttcgagcgcaaatggtgaacccgcagattcgaagaagaaaatcaccgcaagtagtgatgttttgaaaggattggtggagtggctttgtattcagctgaaaaagccttctcatccgagccgtagcattccagcttctgtcacctgcctatcaacattgttgaaggaacctatcgttaggtcttcatttgttcaagcagatggggttaagctacttgtgccacttatttctccagcatccactcagcagtcgattcagcttctctatgagacatgcctctgtgtttggctcctatcctactatgaacctgcaattgagtatttggctacatctagagccctgccacggttgttggaggttgttaaaggttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgatgaggacctcttggacgctctaaatcatctggaagaagcgctgaaagataatatcaagagattgagttcttttgagaagtacaagcaggaagtcctccttggtcatcttgattggtctcccatgcataaagatcccaatttttggagagataatatcacaaactttgaagagaatgatttccagactctacgggtcctgctcacgatactggacacatcgagtgatccaagggcactagccgttgcttgctatgatctttcccagtttattcagtaccatcctgctggtcgggtcattgtcacagatctcaaggcaaaggagcgggtcatgaaactgatgaaccacgagaacgccgaggtcaccaaaaacgccttactctgtatccaaaggctcttccttggcgccaagtacgcaagctttttgcaagtttaatatgcacacgtatggatcaaatcgtctctgcacgagttagtggacatcatttgtcaaaatgtttgagcgtacgcgtctcttgggcacttctctgttaaggcttattataatttgttttaacggtttctttttgaataaaagttgatgtctgtaatttttatggtgtttatggatggtgaataaaataaagggttgagggctatatattcatatttatatttgttaatgttattatttgttgtaaatcataatcacaaaattgaa

SEQ ID NO: 4566 - DNA, 1724 bp, Chrysanthemum coronarium
atcacacaactagatttataactaactcatcatcataatcattatcaataatgccgatggatcaagcagagctcaattccgatcaggttctgaggagggacatccaatgggagacatacatgacaaccaagctgataacaggaacatcacttcagctattaaggcgctatgacaaaaagactgaaaccgaaagggcatcacttctcgagaatgatggtccatcttatatccgtgtttttatcagcatcttgcgtgatatacagaaagaagacacggtcgaatatgtgttggctttaattgatgagatgctaacagccgacccaaaaagagcgaagctgtttcatgacaagtctcttgcagatgaagatatttatgaacctttcttgagattgttatggaaaggcagctggtttattcaagagaagagctccaagatacttactttggtagtgagtgctaggccaaagcagtatggttcgagcgccaatggtgaatccgcagattcaaagaagaaaatcaccgcaagtagtgatgttttgaaaggattggtggagtggctttgtattcagctgaaaaagccttctcatccgagccgtagcattccagcttctgtcacctgcctatcaacattgttgaaggaacctatcgttaggtcttcatttgttcaagcagatggggttaagctactcgtgccacttatttctccagcatccactcagcagtcgattcagcttctctatgagacatgcctctgtgtttggctcctatcctactatgaacctgcaattgagtatttggctacatctagagccctgccacggttgttggaggttgttaaaggttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgatgaggacctcttggacgctctaaatcatctggaagaagcgctgaaagataatatcaagagattgagttcttttgagaagtacaagcaggaagtcctccttggtcatcttgattggtctcccatgcataaagatcccaatttttggagagataatatcacaaactttgaagagaatgatttccagactctacgggtcctgctcacgatactggacacatcgagcgatccaagggcactagccgttgcttgctatgatctttcccagtttattcagtaccatcctgctggtcgggtcattgtcacagatctcaaggcaaaggagcgggtcatgaaactgatgaaccacgagaacgctgaggtcaccaaaaacgccttactctgtatccaaaggctcttccttggcgccaagtacgcaagctttttgcaagtttaatatacacacacgtatggatcaaatcaaatcgtctctgcacgagttagtggacatcatttgtcaaaatgtttgagcgtacccgtctcttgggcttctctgttaaggcttattattattcgttttaacggtttctttttgaataaaagttgatgtctgtaatttttatggtgtttatggatatggtgaataaaataaagggttgagggctatatattcatatttatatttgttaatgttattatttgttgtaaatcataatcacaaaattgaattgggttgatgcatcatatctatcaggatttgtgacttttg

SEQ ID NO: 4567 - DNA, 1552 bp, Chrysanthemum coronarium
aatgccgatggatcaagcagagctcaattccgatcaggttctgaggagggacatccaatgggagacatacatgacaaccaagctgataacaggaacatcacttcagctattaaggcgctatgacaaaaagactgaaaccgaaagggcatcacttctcgagaatgatggtccatcttatatccgtgtttttatcagcatcttgcgtgatattcagaaagaagacacggttgaatatgtgttggctttaattgatgagatgctaacagccgacccaaaaagagcgaagctgtttcatgacaagtctcttgcagatgaagatatttatgaacctttcttgagattgttatggaaaggcagctggtttattcaagagaaaagctccaagatacttactttggtagtgagtgctaggccaaagcagaatggttcgagcgcaaatggtgaacccgcagattcgaagaagaaaatcaccgcaagtagtgatgttttgaaaggattggtggagtggctttgtattcagctgaaaaagccttctcatccgagccgtagcattccagcttctgtcacctgcctatcaacattgttgaaggaacctatcgttaggtcttcatttgttcaagcagatggggttaagctacttgtgccacttatttctccagcatccactcagcagtcgattcagcttctctatgagacatgcctctgtgtttggctcctatcctactatgaacctgcaattgagtatttggctacatctagagccctgccacggttgttggaggttgttaaaggttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgatgaggacctcttggacgctctaaatcatctggaagaagcgctgaaagataatatcaaaagattgagttcttttgagaagtacaagcaggaagtcctccttggtcatcttgattggtctcccatgcataaagatcccaatttttggagagataatatcacaaactttgaagagaatgatttccagactctacgggtcctgctcacgatactggacacatcgagtgatccaagggcactagccgttgcttgctatgatctttcccagtttattcagtaccatcctgctggtcgggtcattgtcacagatctcaaggcaaaggagcgggtcatgaaactgatgaaccacgagaacgccgaggtcaccaaaaacgccttactctgtatccaaaggctcttcctcggtgccaagcacgcaagctttttgcaagtttaatgtacacacgtatggatcaaatcgtctctgcacgagttagtggacatcatttgtcaaaatgtttgagcgtacgcgtctcttgggcacttctctgttaaggcttattataatttgttttaacggtttctttttgaataaaagttgaggtctgtaattttatgctgtttatggatggtgaataaaataaag

SEQ ID NO: 4568 - DNA, 1704 bp, Chrysanthemum coronarium
tttttatcattgttattgttttcagaacgtgaacaaaacaaacaaacaaatcaatcttcgatcttaaactcaccacagaaaacacacagagacacataaacacgcactagatttgtaactaactcatcatcatcattatcaatgccgatggatcaagcagagctcaattccgatcaggttctgaggagagacatccaatgggagacatacatgacaactaagctgatcacaggaacatcccttcagctactaaggcgctatgacaaaaagactgaaagcgaaagggcatcgctgctcgagaatgacggtccatcttatatccgtgtttttatcagcatcttgcgtgatatacagaaagaagacacggtcgaatatgtgttggctttaattgatgagatgctaacagccgacccaaaaagagcgaagctgtttcatgacaagtcccttgcagatgaagatatttatgaacctttcttgagattgttatggaaaggcagctggtttattcaagagaagagctccaagatacttactttggtagtgagtgctaggccaaagcagtatggttcgagcgcaaatggtgaatctgcagattcaaagaagaaaatcaccgcaagtagtgatgttttgaaaggattggtggagtggctttgtattcagctgaaaaagccttctcatccgagccgtagcattccagcttctgtcacctgcctatcaacattgttgaaggaacctatcgttaggtcttcatttgttcaagcagatggggttaagctacttgtgccacttatttctccagcatccactcagcagtcgattcagcttctctatgagacatgcctctgtgtttggctcctatcctactatgaacctgcaattgagtatttggctacatctagagccctgccacggttgttggaggttgttaaaggttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgatgaggacctcttggacgctctaaatcatctggaagaagcgctgaaagataatatcaagagattgagttcttttgagaagtacaagcaggaagtcctccttggtcatcttgattggtctcccatgcataaagatcccaatttttggagagataatatcacaaactttgaagagaatgatttccagactctacgggtcctgctcacgatactggacacatcgagtgatccaagggcactagccgttgcttgctatgatctttcccagtttattcagtaccatcctgctggtcgggtcattgtcacagatctcaaggcaaaggagcgggtcatgaaactgatgaaccacgagaacgccgaggtcaccaaaaacgccttactctgtatccaaaggctcttccttggcgccaagtacgcaagctttttgcaagtttaatatgcacacgtatggatcaaatcgtctctgcacgagttagtggacatcatttgtcaaaatgtttgagcgtacgcgtctcttgggcacttctctgttaaggcttattataatttgttttaacggtttctttttgaataaaagttgatgtctgtaatttttatggtgtttatggatggtgaataaaataaaggggtttcgagg

SEQ ID NO: 4569 - DNA, 1786 bp, Artemisia annua
gatctcaaactcaccacaaaacacacacatcacacaactagatttataactaactcgtcatcatcaataatgccgatggatcaagcagagctcaattccgatcaggttctgaggagggacatccaatgggagacatacatgacaactaagctcataacagggacatcccttcagctattaaggcgctatgacaaaaagactgaaaccgaaagggcatcgctgctcgagaatgacggtccatcttatattcgtgtttttatcagcatcttgcgtgatatacagaaagaagacacggtcgaatatgtgttggctttaattgatgagatgctaacagccgacccaaaaagagcgaagctgtttcatgacaagtctcttgcagatgaagatatttatgaacctttcttgagattgttatggaaaggcagctggtttattcaagagaagagctccaagatacttactttggtagtgagtgctaggccaaaacagtatggttcgggcgcaaatggtgaatccgcagattcaaagaagaaaatcaccgcaagtagtgatgttttgaaaggattagtggagtggctttgtattcagctgaaaaagccttctcatccgagccgtagcattccagcttctgtcaactgcctatcaactttgttgaaggaacctatcgttaggtcttcatttgttcaagcagatggggttaagctactcgtgccacttattgtaccagcatccactcaacagtcgattcagcttctctatgaaacatgcctctgtgtttggctcctatcctactatgaacctgcaattgagtacttggctacatctagagccctgccacggttgttggaggttgttaaagcttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgatgaggacctcttggacgctctaaatcatctggaagaagcgctgaaagataatattaagagattgagttcttttgataagtacaagcaggaagtccttcttggtcaccttgattggtctcccatgcataaagatcccaatttttggagagagaatatcacagcctttgaagagaatgatttccagactctgcgggtcctgctcacgatactggacacatcgagtgatccaagggcactagccgttgcttgctatgatctttcccagtttattcagtaccatcctgctggtcgggtcattgtcacagacctcaaggccaaggagcgggtcatgaaactgatgaaccacgagaacgctgaggtcaccaaaaacgccctactctgtattcaaaggctcttccttggcgccaagtatgcaagctttttacaggtttaaaatatacgtatggatcaaatcgtctctgcacgagttagtggacttcatttgtcaaaatgtttgagcatatgcatctcttgggcacttctctgttaaggcttattattattattcgttttaacggtttctttttgaataaaagttgatgtctgtaattttatgctgtttatggatggtgaataaaataaaggttgagggcttttggtatttatatttattaatatttatattgttgtaaatcactaaagttgatgtgataaatttgtaattgggcgatgcatcatatctagcaggatttgtcaatttgaaattgttgtatgttttgaacaaaaaaaaaaaaaaagtcggactagaa

SEQ ID NO: 4570 - DNA, 1512 bp, Conyza canadensis
aggttttgaggagggatatcccatgggagacctacatgaacactaagttaatcaccacaactgcttttcagcgtctaaggcgttacgacaaaaagtccgaaattgaccgcacacccttgttagagaatgatggtccatcttacatccgtgtatttattagcatcttgcgtgacatacagaaagaggatacagtcgaatatgttttggctttaattgatgatatgcttacagcaaatcccaaaagagcaaagttgtttcatgacaagtctctcgcagatgaagatatctatgaacctttcctgagattgctatggaaaggtagctggttcatacaggagaagagctctaagatacttacattggtcgtgagtgctaggtccaagcagaatggcctgactttaaatggggattcaaagaagaaaatcacctcaagtgatgacgttttgaaaggattagtggaatggttttgtcttcagcttaaaaagccttcccaccccagtcgtagtattccagcttcggtcaacagcctagcaacattgttgaaggaacctgttgttaggtcatcatttgttcaagcagatggagttaagctgcttgtgcctctcattgctcccgcatccactcagcagtcgattcagcttctctatgaaacatgcctctgtgtttggctattgtcctactatgaacctgcaattgagtacttggctacatctagagccctgccacggttgttggaggtcgtcaaaggttcaaccaaagaaaaggttgtgagattgatagtgttgactttcaaaaacttgctttcgaaggggagttttggagctcagatggtagatcttggacttccacatattgttcaaagtttaaaagcacaagcatggagtgacgaggacctcttggatgctttaaatcatctagaagaagggctgaaagataacatcaagaaattgagttcttttgacaagtataaacaggaagtccttcttggtcatcttgattggtctccaatgcataaagatgctatattctggagagataatattacaaactttgaagagaacgatttccagactctacgagtcctgcttacgatattggaaacatcaagtgatccaagggcattggccgttgcttgctttgatctgtcccagtttattcaataccatcctgcaggccgggtcatagtcaccgacctcaaagcaaaggagcgagtcatgaaactaatgaatcatgagaatgccgaggttaccaaaaacgccttactctgtatccaaaggcttttccttggtgccaagtatgcaagctttttgcaggtgtaatatatgttgctaaaggagaacttttggatcggatcttaatacaaagtgtatgcttcccttgggaccccctctgttaagcctgtttttatttgtttaatggtttccttttttgaataaaagttgatgtctgtattttttatgctgttcaaggatggtttattaaaataataagaaagttgagagctattcatat

SEQ ID NO: 4571 - DNA, 1651 bp, Chrysanthemum coronarium
tcaataatgccgatggaccaaaacaaagaaacaaacgaaccaatccttgatctcaaactcaccacaaaacacacacatcacacaactagatttattataactaactcgtcatcataatcattatcaataatgccgatggatcaagcggagctcaattctgatcaggttctgaggagggacatccaatgggagacatacatgacaactaagctcataacagggacatcccttcagctattaaggcgctatgacaaaaagactgaaaccgaaagggcatcactgcttgagaatgacggtccatcttatatccgtgtttttatcagcatcttgcgtgatatacagaaagaagacacggtcgaatatgtgttggctttaattgatgagatgctaacagccgacccaaaaagagcgaagctgtttcatgacaagtcccttgcagatgaagatatttatgaacctttcttgagattgttatggaaaggcagctggtttattcaagagaagagctccaagatacttactttggtagtgagtgctaggccaaagcagtatggttcgagcgccaatggtgaatccgcagattcaaagaagaaaatcaccgcaagtagtgatgttttgaaaggattggtggagtggctttgtattcagctgaaaaagccttctcatccgagccgtagcattccagcttctgtcacctgcctatcaacattgttgaaggaacctatcgttaggtcttcatttgtcaagcagatggggttaagctacttgtgccacttatttctccagcatccactcagcagtcgattcagcttctctatgagacatgcctctgtgtttggctcctatcctactatgaacctgcaattgagtatttggctacatctagagccctgccacggttgttggaggttgttaaaggttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgacgaggacctcttggacgctctaaatcatctggaagaagcgctgaaaccttttgagaagtacaagcaggaagtcctccttggtcatcttgattggtctcccatgcataaagatcccaatttttggagagataatatcacaaactttgaagagaatgatttccagactctacgggtcctgctcacgatactggacacatcgagcgatccaagggcactagccgttgcttgctatgatctttcccagtttattcagtaccatcctgctggtcgggtcattgtcacagatctcaaggcaaaggagcgggtcatgaaactgatgaaccacgagaacgctgaggtcaccaaaaacgccttactctgtatccaaaggctcttccttggcgccaagtacgcaagctttttgcaagtttaatatacacacacgtatggatcaaatcaaatcgtctctgcacgagttagtggacatcatttgtcaaaatgtttgagcgtacccgtctcttgggcttctctgttaaggcttattattattcgttttaacggtttctttttgaataaaagttgatgtctgtaatttttatggtgtttatggatatg

SEQ ID NO: 4572 - DNA, 1481 bp, Chrysanthemum coronarium
gaacaaaacaaacaaacaaatcaatcttcgatcttaaactcaccacagaaaacacacagagacacataaacacgcactagatttgtaactaactcatcatcatcattatcaatgccgatggatcaagcagagctcaattccgatcaggttctgaggagggacatccaatgggagacatacatgacaactaagctgataacagggacatcccttcagctattaaggcgctatgacaaaaagactgaaaccgaaagggcatcactgcttgagaatgacggtccatcttatatccgtgtttttatcagcatcttgcgtgatatacagaaagaagacacggtcgaatatgtgttggctttaattgatgagatgctaacagctgacccaaaaagagcgaagctgtttcatgacaagtctcttgcagatgaagatatttatgaacctttcttgagattgttatggaaaggcagctggtttattcaagagaagagctccaagatacttactttggtagtgagtgctaggccaaagcagtatggttcgagcgccaatggtgaatccgcagattcaaagaagaaaatcaccgcaagtagtgatgttttgaaaggattggtggagtggctttgtattcagctgaaaaagccttctcatccgagccgtagcattccagcttctgtcaactgcctagcaactttgttgaaggaacctatcgttaggtcttcatttgttcaagcagatggggttaagctacttgtgccacttatttctccagcatccactcagcagtcgattcagcttctctatgagacatgcctctgtgtttggctcctatcctactatgaacctgcaattgagtatttggctacatctagagccctgccacggttgttggaggttgttaaaggttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgatgaggacctcttggacgctctaaatcatctggaagaagcgctgaaagataatatcaaaagattgagttcttttgagaagtacaagcaggaagtcctccttggtcatcttgattggtctcccatgcataaagatcccaatttttggagagataatatcacaaactttgaagagaatgatttccagactctacgggtcctgctcacgatactggacacatcgagtgatccaagggcactagccgttgcttgctatgatctttcccagtttattcagtaccatcctgctggtcgggtcattgtcacagatctcaaggcaaaggagcgggtcatgaaactgatgaaccacgagaacgccgaggtcaaccaaaacgccttactctgtatccaaaggctcttcctcggtcgccaagtacgcaagtcttttgctaagttaatgtacac

SEQ ID NO: 4573 - DNA, 1550 bp, Arnica chamissonis
aaacgggcgagaggggtacccctaaatcaaacccccatctcaaactcaccactcataaacacggacgatattaaccgaagcgccaaatctcgtcaatgccgatagatcaagccgagctaaattccgatcaggttttgaggagggacatcccatgggagacctacatgacaactaagctgatcacaggaacagcccttcagctattaaggcgctatgacaaaaagactgaaaatgaaagggcaccattgcttgagaatgatggtccgtcttatattcgggtttttatcagcatattgcgtgacatacagaaagaggacactgtcgaatatgtgttggctttagttgacgagatgcttacagcaaaacccagtagagcaaagttgtttcatgacaaatcttttgcagatgaggatatttatgaacctttcctgagattgttatggaaaggtagctggttcattcaagagaagagctctaagatacttactttagtagtgagtgcgaggttaaacaagaatggtttggctgcaaatagagaagccgcagattcaaagaagaaaatcaccacaagcgatgatgttttgaaaggattagtggagtggctttgtattcagctgaaaaagccttcccaaccaaaccgtagcattccagcttctataacctgtctagcagctttgttaaaggaaccggttgttaggtcttcatttgttcaagccgatggtgtaaagctgcttgtgccactaatttctccagcatccactcagcagtcaattcagcttctgtatgaaacatgcctctgtgtttggctcttgtcttactatgaacctgcaatcgagtacttggctacatctagagcccttccacggttgtcggaggtcgtcaaaagttcaacaaaagagaaggttgtgaggttgatcgtgttgactttcaagaacttgctttcaaaaggaacttttggagctcagatggtagatcttggacttccacaaattgttcaaagtttgaaagcacaagcctggagtgatgaggacctcttggatgctttaaatcatctggaagaggggatgaaagacaacatcaagaaattgagttctttcgataagtacaagcaagaagtccttctcggtcatcttgattggtctccaatgcataaagatcctattttctggcgcgataatattacaagttttgaagagaatgatttccagactctgcgggtcctgctcacgatactggaaacatcaagtgatccaagggcactagccgtagcgtgctttgatctgtcccagtttattcagtatcatcctgcgggtcgagtcatagtcactgacctcaaagcaaaagagcgggtgatgaaactgatgaaccacgagaacgccgaggttcgaaaaacgctttactctgcatccaaaggcttttccttggtgccaagtatgcaagctttttgcaagtttaatatgcatctcatgggtgttctctggtaaaggcttgttattttgaataaaaattgatgtctgtatttttatgctgtttatggatgtgataaataa

SEQ ID NO: 4574 - DNA, 1730 bp, Ambrosia trifida
gagaaaacaggcgtatccagaagatataactgtcattggttttttcgaacgtgaacaaaaccattaccccaaatcaaatcaaaccacgatctcaacctcaccacacacacacactcactcgagatttgcccctattctcgtcaatgccaatggatcaagccgagcttaattccgatcaggttttgaagagggacatcccatgggagacctatatgactactaagctgatcactggaacagcccttcagctattaaggcgctatgacaaaaagactgaaaatgaaagggcacaactgcttgagaatgatggcccatcttatatccgtgtttttatcaacatcttgcgtgacatacagaaagaggacactgttgaatatgtgttggccttaattgatgagatgcttgcagcaaaccccaaaagagcaaagctgtttcatgacaaatctcttgaagatgaagatatatatgaacctttcatgagattgttatggaaaggtagctggttcaatcaagagaagagctctaagatacttagtttagtagtgagtgctaggtcaaacaaaaatggtttgactgctaacggagaaggctcaaagaagaagatcacctcaagtgatgatgttttgaaaggattagtggactggatttgtattcagctgaaaaagccttcccatccaaaccgtagcattccgtcgtctatcaactgcctagcaactttgttaaaggaacctgttgttaggtcttcatttgttcaagcagatggggtaaagctgcttgtgccactaatttctccagcatcaactcagcagtcaattcagcttctgtatgaaacatgtctctgtgtttggctcttgtcctactatgaacctgcaattgagtacttggctacatctagagccctgccacgattaattgaggttgtcaaaggttcaacgaaggagaaggttgtgaggttgatcgtgttgactttcaaaaacttgctttcaaaaggaacctttggagctcagatggttgatcttggacttcctcaaattgttcaaagtttgaaagcacaggcctggagcgatgaggatctcttggatgcgttaaatcatctggacgaggggctgaaagataatatcaagaaattgagctcttttgacaagtacaagcaggaagtccttcttggtcatcttgattggtctccaatgcataaagatcccaacttctggcgagagaatgttacaaggtttgaagagaatgattttcagactttacgggtcttgctcacaatattggaaacatcaagcgacccgagggcactagccgtggcctgctttgatctgtcccagtttatccagtaccatcctgcaggccgtgtcatagtcaccgacctcaaagcaaaagagcgggtgatgaaactgatgaaccatgagaatgccgaggtcaccaaaaacgccttactatgcatccaaaggctttccttggtgccaagtatgcaagctttttgcaggtgtaatcatgggttctcttatgtttactggttcccttttgaataaaattgaagtctgtatttttatgtttatgaaataaaaaagttgagggctattaatattttattattgtaaattaaacctggtcatatgtatttatttggtgttgggtgatgcatcatagattcatatctgcaggatttgactaaatttgttgtatgttttgtttgcttctagtttcatgccactttattgtta

SEQ ID NO: 4575 - DNA, 1639 bp, Flaveria ramosissima
gagaactgtcattggttttttcgaacgtgaacaaaacaatagccagattacccccaaatcaacccgcgatctcaaactcaccacacacacactctagatttcgacgatactaatcgaagccccaaatctcatcaatgccgacggatcaagcggagctcaattccgatcaggttttgaggagggacatcccatgggagacctatatgacaactaaactgatcaccggaacagcccttcagctattaaggcgctatgacaagaagagcgagaatgaaagggcgccactgcttgagaatgatggtccatcttatatccgtgtttttatcaacatcttgcgtgacatacaaaaagaggacactgttgaatatgtattggctttaattgatgagatgcttacagcaaaccccacaagagcaaagttgtttcatgacaaatctcttgcagatgaagatatctatgaaccttgcctgagattgttatggaaaggtagctggttcattcaagagaagagctcaaagatacttactttggtagtgagtgctaggccaaacaaaaacgatccaactgcaaatggagaaggcacaaagaagaaaacctcatcaagtgatgatgttttgaaaggattggtggagtggctttgcattcagctgaaaaagccatcccatccaaaccgtagcattccaaccgctatcaactgccttgcaactttgttaaaggaacccgttgttaggtcttcatttgttcaagcagatggggtaaagctgctcgtgccactaatttctccagcatccactcagcagtcaattcagcttctgtatgaaacatgcctctgtgtttggctcttgtcctactatgaaccagctgttgagtacttggctacatccagagcactgcctcggttgttggaggttgtcaaaggttcaacgaaagagaaggttgtgaggatgatagtgttgaccttcaaaaacttgctttccaagggaacctttggagctcagatggtagatcttggacttcctcaagttgttcaaagtttgaaagcgcaggcctggagtgacgaggacctcttggaggcgttaaatcatctggaggaggggctgaaagataatatcaagaaattgagctcgtttgataagtacaagcaggaagtccttcttggtcatcttgattggtctccaatgcataaagatcctaatttctggcgagataatattacaaagtttgaagagaacgatttccagactttacgggtcctgctcacgatattggaaacatcaagcgacccaagggcactagccgttgcttgctttgatctgtcccagtttattcagtaccatcctgcaggtcgcgtcatagtcaccgacctcaaagcaaaagagcgggtgatgaaactgatgaaccatgagaacgccgaggtcaccaaaacgccttactctgcatccaaaggcttttcctcggtgccaagtatgcaagctttttgcaggcttaatcatgggcccttttatgtttcactggtttcaatttgaataaagattcatgtctgtattttatgttgtttatgaaataaaagttgagggctattcattatttttttaattatcattgtaaattttacaaaatctgtgtttaatttggtgtt

SEQ ID NO: 4576 - DNA, 1266 bp, Flaveria ramosissima
caccactgcttagaaacgatggttcgtcttatattcgtgtattatcagcatcttgcgtgacatacagaaagaggacactgttgaatatgtgttggctttaattgatgagatgcttacagcaaccccaatagagcaaagttgtttcatgacaaatctcttgcagatgaagatatttatgaacctttcttaagattgttatggaaaggtagctggttcgttcaagagaagagctctaagatacttactttagtagtgagtgctagatcaaacaagaatggtttgactgcaaagggagaagccacaaattcaaagaagaaaatcaccacaagtgatgatgttttgaaaggattagtggagtggctttgtgttcagctgaaaaagccctcccatccaaaccgtagcattccagcttctatcaactgtctagcagctttgttaaaggaacctgttgttagatcttcatttgttcaagcagatggtgtaaagctgcttgtgccacttatttctccagcatctactcagcagtcgatgcagctactgtatgaaacatgcctgtgtgtttggctcttgtcatattatgaacctgcaatcgagtacttggctacatctagagcccttccacggttgttggaggttgtcaaaggttcaacaaaagagaaggttgtgaggttgatagtgttgactttcaagaacttgctttcaaaaggaacctttggagctcagatggtagatcttggacttccacaaattgttcaaagtttgaaagcacaagcctggagtgatgaggacctcttggatgctctaaatcatctggaagacgggctgaaagataacatcaagaaattgagttctttcgataagtacaagcaggaagtccttcttggtcatcttgattggtctccaatgcataaagatcctagtttctggcgagataatattacatattttgaagataatgatttccagactctacgggtcctgctcacgatactggaaacatcaagtgatccaagggcattagccgtggcatgctttgatctgtcccagtttattcaataccatccagcgggccgagtcatagtcactgacctcaaagcaaaagagcgtgtgatgaaactgatgaaccatgagaacgcagaggtcaccaaaaacgctttactctgcatccaaaggcttttccttggggccaagtatgcaagctttttgcaagcatagtatgcgtctcatggacccttctctgttaaaagcttgttatttgaataaatt

SEQ ID NO: 4577 - DNA, 1544 bp, Helianthus annuus
gcttcggccggggaatggcatgtctagaagatagatataaataataactgtcatttgttttttggaacgtgaacaaaccaatcacccccaaaatcaaatctcaaactcaccacacacacaaactcactccagatttgcaccaattctcctcaatgcctatggatcaagccgagctcaattccgatcaggttttgcggagggacatcccatgggagacctatatgactactaagctgatcaccggaacagctcttcagctattaaggcgctatgacaaaaagagtgaaaacgaaagggcaccactgcttgagaatgacggcgcatcttatatccgtgttttcatcaacatcttgcgtgacatacagaaagaggacactgtcgaatacgttttggctttaattgatgagatgcttacagcaaaccccaaaagagcaaagttgtttcacgataaatctcttgaagatgaagatatttatgaaccttttatgagattgttagggaaaggtagctggttcattcaagagaagagctctaagatacttactttggtagtgagtgctaggtcaaacaaaaatggttcgattgcaaacggagaaggctcaaagaagaagggcacctcaagtgatgatgttttgaaaggattagtggattggctttgtattcagctgaaaaagccctcccatccaaaccgtagcattccatctgccgtcaactgcctagcaactttgttaaaggaacctgttgttaggtctgcatttgttcaagctgatggggtaaagctccttgtgccactaatttctccagcatccactcagcagtcaattcagcttctgtatgaaacatgcctctgcgtttggctcttatcctactacgaacccgcaatcgagtacttagctacatctagagccctaccgcggttattggaggttgtcaaaggttcaacaaaggagaaggttgtgaggttgatcgtgttgactttcaaaaacttgcttgcaaaaggaacgtttggagctcagatggttgatattggacttcctcaagttgttcaaagtttgaaagcacaggcctggagtgacgaggatctcttggatgcgttaaatcatctggacgaggggctgaaagataatatcaagaaactgagctcttttgacaagtacaagcaggaagtccttcttggtcatcttgattggtctccaatgcataaagatcctaatttctggcgagagaatattacaaggtttgaagagaatgatttccagactttacgggtcctgctcacaatattggaaacatcaagcgacccaagggcgctagccgttgcttgctttgatctgtcccagtttatccagtaccatcctgcaggccgcgtcatagtcaccgacctcaaagcaaagagcgcgtgatgaaattgatgaaccagagaaggccgaggtcaccaaaaacgccttactctgcatccaaaggcttttcctcggtgccaagtacgccagctttttgcaggtttaatcatggattcatgagtccttttatgtttaccggtttcc

SEQ ID NO: 4578 - DNA, 1770 bp, Gossypium hirsutum
aaaaaaaatttcctttccatccaaacaacaggctctctttcccgtctctgcatttacgttctaaaaaaaaactaaagggatttgagttcgtctggatttgaagtactttcttgagcatatatggaccgtgctgaactatccactgaacaggttctgaagagggacatcccatgggaaacatacatgacaactaagctgatttcaggaacaggcttgcagctgttaaggcgttatgataatagagctgaaagtgtcagggcacagttgttggatgatgatggtccagcctatgttcaagtgtttgttaacatcttacgggatatctttaaagaagaaacagtggaatatgttctggctttaattgatgaaatgcttacagccaatccgaaacgagccagactatttcatgacaagtctcttgctaatgaagatacttatgaacctttcctaaggttgctgtggaaaggcaactggttcatacaagaaaagagctgcaagatactggccttgatagtaagtgcaaggccaaaaacccaggatggcgttgttgcaaatggagaaaattcaaagaagaagggcactaccattaatgatgtactaaaggaattggttgaatggctgtgcacacagctgaagaagccttcccatcctacttgtggtattccaactgctattaactgccttgcatcattactgaaggaacctgtcgtcagatcttcctttgttcaagcagatggggtgaagttactgattcctttaattactccggcatctacccagcaatctatccagcttctctatgaaacatgcctctgcgtgtggctgttatcttattatgagccagcaatcgagtatttagcaacatctagggctcttccaagactggttgatgttgttaggagttccacaaaggagaaggttgtcagggttgttgtattgacctttaggaacttgttatccaaaggcacattcggtgctcagatggttgaccttggactgccgcagattgttcagagtttgaaagcacaagcctggagtgatgaggatctattggaggctctcaatcacctggaagatgggttgaaggataacattaagaaactgagttccttcgataaatataagcaagaagttctccttggtcatcttgattggtcacccatgcataaagatccattgttttggcgggataatgtttcatgctttgaagagaatgatttccaggttctaagggtcctcattacaattatggagacatccagtgacccaagagctctggctgttgcttgcttcgatctctcacaatttattcagcaccatcctgctggccgggtgatagtaaacgacctcaaggcaaaggagcgggtgatgaagttgatgaaccacgacagtgcggaggttaccaagaatgccttgctctgcatccagaggcttttcctaggtgccaaatatgctagctttttgcaggcgtagttttgcttcattgtgctcggtcatgtctcatcggatggtaagtaaattatgctttgtaggagttttatattctcgttcaagttcagtcgggatggctgatatttctattggatacttcatttcgaacatgtctaaggaagaattgttttgattcttttgtcaaaaaaaaccttcaaaattagtgtctttaaaattttgagttgtggtgggtgtagaataaaatgtatgcagtccttgccctatttttaaaataaactgcattacaatgaacaacttatttttagcttgaatattttg

SEQ ID NO: 4579 - DNA, 1886 bp, Gossypium raimondii
aaatttcctttccatccaaacaacaggctctctttcccgtctctgcatttacgttctatttttttttttagatttattttttaaaaaaaaactaaagggatttgagttcgtctggatttgaagtactttcttgagcatatatggaccgtgctgaactatccactgaacaggttctgaagagggacatcccatgggaaacatacatgacaactaagctgatttcaggaacaggcttgcagctgttaaggcgttatgataatagagctgaaagtgtcagggcacagttgttggatgatgatggtccagcctatgttcaagtgtttgttaacatcttacgtgatatctttaaagaagaaacagtggaatatgttctggctttaattgatgaaatgcttacagccaatctgaaacgagccagattatttcatgacaagtctcttgctaatgaagatacttatgaacctttcctaaggttgctctggaaaggcaactggttcatacaagaaaagagctgcaagatacttgccttgatagtaagtgcaaggccaaaaacccaggatggcgttgttgcaaatggagaaaattcaaagaagaagggcactaccattaatgatgtactaaaggaattggttgaatggctgtgcacacagctgaagaagccttcccatcctacttgtggtattccaactgctattaactgccttgcatcattactgaaggaacctgttgtcagatcttcctttgttcaagcagatggggtgaagttactgattcctttaattactccggcatctacccagcaatctatccagcttctctatgaaacatgcctctgcgtgtggctgttatcttattatgagccagcaatcgagtatttagcaacatctagggctcttccaagactggttgatgttgttaggagttccacaaaggagaaggttgtcagggttgttgtattgacctttaggaacttgttatccaaaggcacattcggtgctcagatggttgaccttggactgccgcagattgttcagagtttgaaagcacaagcctggagtgatgaggatctattggaggctctcaatcacctggaagatgggttgaaggataacattaagaaactgagttccttcgataaatataagcaagaagttctccttggtcatcttgattggtcacccatgcataaagatccattgttttggcgggataatgtttcatgctttgaagagaatgatttccaggttctaagggtcctcattacaattatggagacatccagtgacccaagagctctggctgttgcttgctttgatctctcacaatttattcagcaccatcctgctggccgggtgatagtaaacgacctcaaggcaaaggagcgggtgatgaagttgatgaaccacgacagtgctgaggttaccaagaatgccttgctctgcatccaaaggcttttcctaggtgccaaatatgctagctttttgcaggcgtagttcagcttcatcgtgctcggtcatgtcctcatcggatggtaagtaaattatgctttgtaggagttttatattctcgttcaagtccagttgggatggctgatatttctgtcggatacttcgttgcgaacatgtctaaggaagaattgttttgattcttttgtcaaaaaaaaccttcaaaattagtgtttttaaaattttgagttgtggtgggtgtagaataaaatgtatgcagtccttgccctatttttaaaataaactgcattacaatgaacaacttatttttagcttgaatattttgaactttgatgactgtttttttttttttttttcttactctttggtatctagtaaatacaaatacatatgggcagtggtggagccagaaactttatt

SEQ ID NO: 4580 - DNA, 1789 bp, Gossypium hirsutum
attttattttaatgtatgctaattttaactgagaagtgaattgaagtataagttagattaatcagattggatctgttaattttgttcttcagatttgaaattatagggatttgagttcgtgtggatttgaagtactttcttgagcatatatggaccgtgctgaactatccactgaacaggttctgaagagggacatcccatgggaaacatacatgacaactaagctgatttcaggaacaggcctgcagctgttaaggcgttatgataatagagctgaaagtgtcagggcacagttgttggatgatgatggtccagcctatgttcaagtgtttgttaacatcttacgtgatatctttaaagaagaaacagtggaatatgttctggctttaattgatgaaatgcttacagccaatctgaaacgagccagattatttcatgacaggtctcttgctaatgaagatacttatgaacctttcctaaggttgctctggaaaggcaactggttcatacaagaaaagagctgcaagatacttgccttgatagtaagtgcaaggccaaaaacccaggatggcgttgttgcaaatggagaaaattcaaagaagaagggcactaccattaatgatgtactaaaggaattggttgaatggctgtgcacacagctgaagaagccttcccatcctacttgtggtattccaactgctattaactgccttgcatcattactgaagggacctgttgtcagatcttcctttgttcaagcagatggggtgaagttactgattcctttaattactccggcatctacccagcaatctatccagcttctctatgaaacatgcctctgcgtgtggctgttatcttattatgagccagcaatcgagtatttagcaacatctagggctcttccaagactggttgatgttgttaggagttccacaaaggagaaggttgtcagggttgttgtattgacctttaggaacttgttatccaaaggcacattcggtgctcagatggttgaccttggactgccgcagattgttcagagtttgaaagcacaagcctggagtgatgaggatctattggaggctctcaatcacctggaagatgggttgaaggataacattaagaaactgagttccttcgataaatataagcaagaagttctccttggtcatcttgattggtcacccatgcataaagatccattgttttggcgggataatgtttcatgctttgaagagaatgatttccaggttctaagggtcctcattacaattatggagacgtccagtgacccaagagctctggctgttgcttgctttgatctctcacaatttattcagcaccatcctgctggccgggtgatagtaaacgacctcaaggcaaaggagcgggtgatgaagttgatgaaccacgacagtgctgaggttaccaagaatgccttgctctgcatccaaaggcttttcctaggtgccaaatatgctagctttttgcaggcgtagttcagcttcatcgtgctcggtcatgtcctcatcggatggtaagtaaattatgctttgtaggagttttatattctcgttcaagttcagttgggatggctgatatttctgtcggatacttcgttgcgaacatgtctaaggaagaattgttttgattcttttgtcaaaaaaaaccttcaaaattagtgtctttaaaattttgagttgtggtgggtgtagaataaaatgtatgcagtccttgccctatttttaaaataaactgcattacaatgaacgacttatttttagct

SEQ ID NO: 4581 - DNA, 1383 bp, Cichorium intybus
tgtttacagagatactgtcattgttttctggatcattgtggacaaaacaagccagagattaaccccaaatcaatccccgatctcaaactcaccacacacataaacacactctagatttggacgatactaactgaaacgccaaatctcttcaatgccgacggatcaagccgagctcaattccgaacaggttttgaggagagatatcccatgggagacctacatgacaacaaagctaatcacaggaacatcccttcagctattaaggcgctatgacaaaaagactgaaaatgacagagcacaattgcttgataatgatggtccatcttatattcatgttttcattagcatcttgcgcgacatacagaaagaggacacagtcgaatatgtgttggctttaatcgatgaaatgcttacagcaagccccaaaagggcaaagttgtttcatgacaagactcttgcagatgaagacatttatgaaccattcttgagattgttatggaaaggtagctggttcatacaagagaagagctccaagatccttacttttgtagtgagtgccaggccaaaacaaaatggtcgaactgcaaatggacaatctgctgattcaaagaagaaaatcactgcaagtgatgatgttttgaaaggattggtggaatggctttgtattcagctgaagaagccttcacatcctacccgtagcattccagcttcagtcaactgtttagcaactttgttgaaggaacctgttgttaggtcttcatttgttcaagcagatggggtcaaacttcttgtgccattaatttctccagcatccactcaacagtcaattcagcttctgtacgaaacatgcctctgtgtttggcttttatcctactacgaacctgcaatcgagtacttagctacttctagagcccttccaagattgttggaggttgtcaaaggttcaacaaaagagaaggttgtaaggttgatagttttgactttcaaaaacttgctctctaaaggaacattcggagctcaaatggttgaccttggactcccgcaaatcgttcaaagcctaaaagcacaagctcggagtgacgaggacctcttggacacgttaaaccatctggaagaaggtctgaaagacaacatcgagaaattaagctctttcgataaatacaaacaagaagtcctcctcagtcaccttgactggtctccaatgcacaaagaccctattttctggcgcgacaatatcacaaactttgaagaacatgatttccagactcttcgtgtccttctgactattctggaaacttccggagacccacacgcacatgcggttgcgtgttacgacctgtctcagtttatccagtaccatccagctagacgcgtgatagtgac

SEQ ID NO: 4582 - DNA, 1008 bp, Ambrosia trifida
attcttctttatttcatcaacacacacaagaaactaaacaagaaaaccccaaacaattttttatccaacattacaagttttcaatctttctttattcgtcgtttgtcctccagacaaacaatgagattttggttagatatatacaacgatcgaagaacagacaaacacatattgtccattggagagaagacacaaaaacatcacatgattttacaattttaggagttggttgagatgattaggagttgatgattacttgattagtttcctgttgttacaaaaatttgtagagatattaaaaaaaaaaaagaagaagaagaagaagaaaatatgatgtctcctggaattaacttggtgatgactgtaattggatttacagtgagtactatgtttattttgttcgtgtgtactagactcatctgtgctcgtattcattacgtatcttcaagaagatcttttcgtatgtcttctagatctgatctcaacgctttggagcgcggcaagcgcggtgctgaaccttttgttggagcaagcttccctacaaagaaatatagcgatccgtttttttcgtgctcaaaagatgctcaatgtatagtttgtctttcagaataccatgctgatgacacccttcgtattctgccatcatgtggacactttttccactcgtcgtgtatcgacatctggctgcagcagcactgcacatgtcctgtttgtcgagtctcgttgcgtgaagtttttgacaagaaatgcttaatgcaaccaatgttcagttctgctatcagattcccatcacgagcggatgacatccgtaggatggacccaaccactgatggtcaaccaaggtcaactggcaacgtactagaagcgcgcctaaacaattcaaatatcattgagaatggacccgatggctcaaaaagtccgaggaacaagcaatttgaaagcccatcggatgtttaagatcacatatgtgtgatcaaagtttgcagccattgagtgagggtaaagtgg

SEQ ID NO: 4583 - DNA, 795 bp, Ambrosia trifida
aaatatgatgtctcctggaattaacttggtgatgactgtaattggatttacagtgagtactatgtttattgtgttcgtgtgtaccagactcatctgtgctcgtattcattacgtatcttcaagaagatcctttcgtatgtcttctggatctgatctcaacgctttggagcgtggcaagcgcggtgctgaaccttttgttggagcaagcttccctacaaagaaatatagtgatccgtttttttcgtgctcaaaagatgctcaatgtatagtttgtctttcagaataccatgctgatgacacccttcgtattctgccatcatgtggacactttttccactcatcgtgtatcgacatctggctgcagcagcactgcacgtgtcctgtttgtcgagtctcattgcgtgaagtttttgacaagaaatgcttaatgcaaccaatgttcagttctgctatcagattcccatcaagagcggatgacatccgtaggatggacccaaccactgatggtcaaccaaggtcaactggcaatgtgcatgaagcgggaccaaacaattcaaatatcatcgagaacggacccgctggctcaaaaagtctgaggaacaagcaagttgaaagcccatcggatgtttaagatcacatatatgtgaacaaagtttgcagccattgagtgagggtaaagtggccaagatgcaaggggtattattgtcttttttaggaatttgtttgtgttggtttagcactagtatttgtaaatattgaaaaatcagaatagtttgattagtagattgttgtcat

SEQ ID NO: 4584 - DNA, 1150 bp, Flaveria ramosissima
attgggaatgttgctctgaacatcacaaatccactattttcccttgtagattcttctaaatcatcaacacccacaaaagatttccatcattttcaaacaatttcgatccaacatcacaagttttcaattcctcttgattcgtcgtttgtccacaagacaaacaatgagatttcaaggagatatctacaacaatagcacaacagacaaatacagagtgtcgattggttgcagagagagatgacagaaagatcacatgatttcagaagtttagggtttgttgtttagatgatgatgtaagcaaaagtgaccttcaatcgttgatttctgcacagttcatgattagttttcagttcaattgagaaatctgtagacgaatttgatagattgtttgtgagaaaacatgatgtctcctgggattaacttggtgatgactgtaattgggtttacagtgagtactatgttcatcgtcttcgtgtgtactagactcatatgtgctcgaattcattacatatccgcaagaagatcgtttcgtatgtcttctagatctgatctcaacgctttggagcgtggagtgcgcggtgctgaggcttttgttgcagcaaacttccctacaaagaagtatagcgatccgtttttttcttgcgcaaaggatgctcaatgtatagtttgtctttcagaataccatgcagatgacacgcttcgtattctgccctcgtgtggacactttttccactcatcgtgtatcgacatctggctgcagcagcactgcacgtgtcccgtttgtcgagtctcattgcgtgaagtttttgacaaacgatgctcaatgcaacccatgttcagttcagccatcagattcccatcaagagcaaatgacagccgtaggatggaccccaccgcagatggtcaaccaaggtcaactggcaacatacaagaagtgggcctaaacaactccaacgtgaacgagaatgatcctgctggatccaaaagtccgaggaacaaacaacttgaaagcccatcgggtgtttaagatagcgtagatgtgatcaaagtttgcagcatttgagtgaaggtaaaatgacaaagatgtaaggggtgttatgctttttagaatttgtttgttttgatgtactcctagtatttgtaaataact

SEQ ID NO: 4585 - DNA, 1223 bp, Flaveria ramosissima
aatgttgcactgaacatcacaaatccactattttcccttgtagattcttctaatcatcaacacccacaaaaaaattccatcattttcaaacaatttcgatccaacatcacaagttttcaattcctcttgattcgtcgtttgtccacaagacaaacaatgagatttcaaggagatatctacaacaatagcacaacagacaaatacagagtgtcgattggttgcagagggagatgacagaaagatcacatgatttcagaagtttaaggtttgttgtgtagatgatgacgtgagcagaagtgaccttcaatcgttgatttctgcacagttcatgattagttttcagttcaattgagaaatctgtagacgaaattgatagattgttcgtgagaaaacatgatgtctcctgggattaacttggtgatgactgtaattgggtttacagtgagtactatgttcatcgtcttcgtgtgtactagactcatatgtgctcgaattcattacatatcagctagaagatcgtttcgtatgtcttctagatctgatctcaacgctttggagcgtggagtgcgcggtgctgaggcttttgttgcagcaaacttccctacaaagaagtatagcgatccgtttttttcttgcgcaaaggatgctcaatgcatagtttgtctttcagaataccatgcagatgacacgcttcgtattctgccctcgtgtggacactttttccactcatcgtgtatcgacatctggctgcagcagcactgcacgtgtcccgtttgtcgagtctcgttgcgtgaagtttttgacaaacgatgctcaatgcaacccatgttcagttcagccatcagattcccatcaagagcaaatgacagccgtaggatggaccccaccgctgatggtcaaccaaggtcaactgacaacgtacaagaagtgggactaaacaactccaacgtgaacgagaatgatcctgctggatcaaaaagtccgaggaacaaacaacttgaaagcccatcgggtgtttaagatagcatagatgtgatcaaagtttgcagcatttgagtgaaggtaaaatgacaaagatgtcagggtgttatgcttttttagaatttgtttgttttgatgtactcctagtatttgtaaatattgaaggatgaaaagagtttgattagtagattgttgtcatagctgtatacatacataaaaagtataattatagatggtttgtg

SEQ ID NO: 4586 - DNA, 780 bp, Flaveria ramosissima
ctgtagacgaatttgatagattgttagagagaaaacatgatgtctcctgggattaacttggtgatgactgtaattgggtttacagtgagcactatgttcatcgtcttcgtgtgtactagactcatatgtgctcgaattcattacatatccgcaagaagatcgtttcgtatgtcttctacatctgatctcaacgctttggagcgtggagtgcgcggtgctgaggcttttgttgcagcaaacttccctacaaagaagtatagtgatccgtttttttcttgtgcaaaagatgctcaatgtacagtttgtctttcagaataccatgcagatgacacgcttcgtattctgccctcgtgtggacactttttccactcatcgtgtatcgacatctggctgcagcagcactgcacgtgtcccgtttgtcgagtctcgttgcgtgaagtttttgacaaacgatgctcaatgcaacccatgttcagttcagccatcagattcccatcaagagcaaatgacagccgtaggatggaccccaccgctgatggtcaaccaaggtcaactggcaacgtacaagaagtgggcctaaacaactccaacgtgaacgagaatgatcctgctggatccaaaagtccgaggaacaaacaacttgaaagcccatcgggtgtttaagatagcgtagatgtgatcaaagtttgcagcatttgagtgaaggtaaaatgacaaagatgtaaggggtgttatgctttttagaatttgtttgttttgatgtactcctagtatttgtaa

SEQ ID NO: 4587 - DNA, 1165 bp, Flaveria ramosissima
acaaatccactattttcccttgtagattcttctaaatcatcaacacccacaaaaatttccatcattttcaaacaatttcgatctaacatcacaagttttcaattcctcttgattcgtcgtttgtccacaagacaaagaatgagatttcaaggagatatctacaacaatagcacaacagacaaacacagagcgtcgattggttgcagagagagatgacagaaagatcacatgatttcagaagtttagggtttgttttttagatgatgatgtaagcaaaagtgaccttcaatcgttgatttctgcacagttcatgattagttttcagttcaattgagaaatctgtagacgaatttgatagattgttcgtgagaaaacatgatgtctcctgggattaacctggtgatgactgtaattgggtttacagtgagtactatgttcatcgtcttcgtgtgtactagactcatatgtgctcgaattcattacatatccgcaagaagatcgtttcgtatgtcttctagatctgatctcaacgctttggagcgtggagcacgcggtgctgaggcttttgttgcagcaaacttccctacaaagaagtatagcgatccgtttttttcttgcgcaaaggatgctcaatgtatagtttgtctttcagaataccatgcagatgacacgcttcgtattctgccctcgtgtggacactttttccactcatcgtgtatcgacatctggctgcagcagcactgcacgtgtcccgtttgtcgagtctcgttgcgtgaagtttttgacaaacgatgctcaatgcaacccatgttcagttcagccatcagattcccatcaagagcaaatgacagccgtaggatggacctcaccactgatggtcaaccaaggtcaactgacaacgtacaagaagtgagactaaacaactccaacgtgaacgagaatgatcctgctagatcaaaaagtccgaggaataaacaacttgaaagcccatcgggtgtttaagatagcgtagatgtgatcaaagtttgcagcatttgagtgaaggtaaaacgacaaagatgtcatggatgttgtgttttttttagtaatttgtttgtttttgtatgtactcctagtatttgtaaatattgaaggatgaaaagagtttgattagtagattgttgtc

SEQ ID NO: 4588 - DNA, 1266 bp, Chrysanthemum coronarium
atccaaaacaattattagtctataataaatccccctataaataaaatcttgcaagtagtaaatccctatcatcatagttacacactctcccaatccccatcacaaacacatatttttccaatttcatcaaacacccaccaagaatctccaacctttagtcacaaaaacattattcaatcgttcaagcaatgaaatttcgacttaataagacaacaaacaaacacagtgtctcctcccttgtttctatctacagaaacatcacatgattttggtgttttagttaacgatgtttgtgagcttcaatcattagtttctttatacttcttgattggttggtttttgtttttggaagaaaataattaacatgatgtctcctgggataaatttagtgatgacagtgattggatttacagtaagtaccatgtttattgtgttcgtgtgtacgaggttaatatgtgccagaattcattacatatcttcaagaagatcttttcgtatgtcttctagatctgatctcaactctttggagcgaggcgcacgtggtgcagaacctttcgttgctgcaaattttcctacaaagaagtatagtgatccgttcttttcttgtgcaaaagatgctcaatgcatagtctgtctttcggaataccatgcagatgatacactgcggattctgcctttttgtggacactttttccattcatcgtgtatcgacatatggctgcagcagcactgcacgtgccccgtttgtcgagtctcgttacgtgagatgtttgacagacggttatcaatgcaacccatgttcagttcagcagtgagattctcatcaagatccgatgacagtcctaggatggaacccacaactaatagccaaccccggtcgactgacaatgaacaagaagcaggacagcacaactcaaacgtgaatgagaacagtccagctggatcaaaaaattcgggtaacaaacagtttgaaagcccgtctgatgtttagaagcatatcagcaaccaaagttgcagcacttaagcgatggtaaaattccaaagatgtcaggggaattgtcgtattttaggagtatgtttgttttgttctactagtattttgtaaatatttgaaagttaaggagagtttggtaagtagcttgtttttgcctcagttgtacacatatataggaagttgaccctttgtattgacgtcgtctcaacctacctgttaaaatgattgtatcgtgatttaccgaaagtaatcgcatgatgttttttgaccta

SEQ ID NO: 4589 - DNA, 1161 bp, Flaveria ramosissima
tcacaaacccactatttttccttgtagattcttccaaatcatcaacacccacaaaaaatttccttcattttccaaacaatttcgatccaacatcacaagttttcaattcctcttgattcgtcgtttgtccacaagacaaacaatgagatttcaaggagatatctacaacaatagcagaagagataaatacagagtgtcgattggttgcagagagagatgacagaaagatcacatgatttcagaagtttagggtttgttttgtagatgatgatgtgagcagaagtgaccttcaaatcttcaattgatacagttaatgattagatttcagttcaatttgagaaatctgtagacgaatttgatagattgttcgagagaaaacatgatctctcctgggattaacttggtgatgactgtaattgggtttacagtgagtactatgttcatcgtctttgtgtgtactagactcatctgtgctcgaattcattacatatccgcaagaagatcgtttcgtatgtcttctagatctgatctcaacgctttggagcgtggagtacgcggtgctgaggcttttgttgcagcaaacttccctacaaagaagtatagcgatccgttcttttcttgcgcaaaggatgctcaatgtatagtttgtctttcagaataccatgcagatgacacgcttcgtattctgccctcgtgtggacactttttccactcatcgtgtatcgacatctggctgcagcagcactgcacatgtcccgtttgtcgagtctcgttgcgtgaagtttatgacaaacgatgctcgatgcaacccatgtttagttcagccatccgattcccatcaagagcagataacaaccgtaggatggaccccaccgctgatggtcaaccaaggtcaactgacaacgtacaagaagtgggactaaacaactccaacatgaacgagaatggtcccgctggatcaaaaagtccgaggaacaaacaacttgaaagcccatcgtgtgtttaagataacgtagatgtgatcaaagtttgcagcatttgagtgaaggtaaaatgccacagatatcagggtggttactgtcttttagaatttgtttgttttgatgtactgctagtatttgtaaatattagaaaatcagaagtagtttgatgagtagattg

SEQ ID NO: 4590 - DNA, 1000 bp, Flaveria ramosissima
tgttgcactgaacatcacaaatccactatttttccttgtagattcttctaaatcatcaacacccacaaaaaaaatttccatcattttcaaacaatttcgatccaacatcacaagttttcaattcctcttgattcgtcgtttgtccacaagacaaacaatgagatttcaaggagatatctacaacaatagcacaacagacaaatacagagtgtcgattggttgcagagggagatgacagaaagatcacatgatttcagaagtttacggtttgttgtgtagatgatgacgtgagcagaagtgaccttcaatcgttgatttctgcacagttcatgattagttttcagttcaattgagaaatctgtagacgaaattgatagattgttcgtgagaaaacatgatgtctcctgggattaacttggtgatgactgtaattgggtttacagtgagtactatgttcatcgtcttcgtgtgtactagactcatatgtgctcgaattcattacatatcagctagaagatcgtttcgtatgtcttctagatctgatctcaacgctttggagcgtggagtgcgtggtgctgaggcttttgttgcagcaaacttccctacaaagaagtatagcgatccgtttttttcttgcgcaaaggatgctcaatgcatagtttgtctttcagaataccatgcagatgacacgcttcgtattctgccctcgtgtggacactttttccactcatcgtgtatcgacatctggctgcagcagcactgcacgtgtcccgtttgtcgagtctcgttgcgtgaagtttttgacaaacgatgctcaatgcaacccatgttcagttcagccatcagattcccatcaagagcaaatgacagccgtaggatagacctcaccactgatggtcaaccaaggtcaactgacaacgtacaagaagtgggactaaacaactccaacgtgaacgagaatgatcctgctggatcaaaaagtccgaggaacaaacaactt

SEQ ID NO: 4591 - DNA, 1204 bp, Artemisia annua
ggcatctctctcaatccccatcacaaacccatcttttccaatttcatcaaacacccaccaaaaatctccaatctttattcacaaacacattaaaaagattcaatcttgaatctttcaaacctttgtctatcagacaaacaatgaaatttcaacttaatatattcaacaacaagacttcaaacaaacacagagtgccatctctagtttctatctacagaaacataacatgatttattttttttacaattttagacgatgtttgtgagcttcaatcattagtttctttatagttgctgattggtttttgtttttggaaggaaataatatgatgtctcctgggataaatttagtgatgacagtgattggatttacagtaagtaccatgtttattgtgttcgtgtgtacgaggttaatatgtgccagaattcattacatttcttcaagaagatcttttcgtatgtcttctagatctgatctaaactctttggagcgtggcgcacgtggtgcagaaccttttgttgctgcaaattttcctacaaagaagtatagtgatccgttcttttcttgtgcaaaagatgctcaatgcatagtctgtctttcggaataccatgcagatgatacactgcggattctgcctttttgtggacactttttccattcatcgtgtatcgacatctggctgcagcagcactgcacgtgccccgtttgtcgagtctccctacgtgagatgtttgatagacggtattcaatgcaacccatgcccagttcagcagtgagattctcatcaagatccgatgaaagtcctcggatgaaccccacatctaatactcaaccccggtcaactgacaacgaacaagaagcaggacagcacaactcaaacgtgaatgagaacagtccagctggatcaaaaaaatcaggtaacaaacagtttgaaagcccgtctgatgtttagaagcatatcagcaaccaaagttgcagcacttaagcaatggtaaaatttcaaagatggcaggggaattgttgtgttttaggagtttgtttgttttgatctactagtatttgtaagtatttaaaagtttagaagagtttgctaagtagcttgtttttgcctcagttgtacacgtatatagaaagttgacccatcgtattgacgtcgtctcaacctacctgttaaaattattatatcatattatcatggtttacc

SEQ ID NO: 4592 - DNA, 902 bp, Chrysanthemum coronarium
gatgtctcctgggattaatttagttatgacagtgattggatttactgtaagtaccatgtttattgtgttcgtgtgtacgaggttaatatgtgccagaattcattacatatcttcaagaagatcttttcgcatgtcttctagatctgatctcaactctttggagcgtggcacacgtggtgctgaaccttttgttgctgcaaattttcctacaaagaagtacagtgatccgttcttttcttgtgcaaaagatgctcaatgcatagtttgtctttcggaatatcatgcagatgatacactgcggattctgcctttttgtggacactttttccattcatcgtgtatcgacatatggctgcagcagcactgcacctgccccgtttgtcgagtttcattacgtgagatgtttgatagacgatattcaatgcaacccatgttcagttcagcagttagattctcatcaagatccaatggcagtcctaggatggatcctacaactaatagtcaaaccccctcaactgacaacgaacacgaagcaggacagcacaactcaaacgtgaatcagaacagtccagctggctcaaaaaatttaggtaacaaacaatttgaaagcccatctgatgtttagaagcatatcagcaaccgaagttgcagcactggagtgatggtaaaatttcgaagatggcaagaggaattgttgcatcttaggagtttgtgtgttttggtctatagtatctgtaaatatttaaaagtttagaagagtttggtaagtagcttgtttttgcctcagttgtacacgtatatagaaagttggccctttgtattcacgtcgtctcacgtacctgttaaaattatcacagtatatcatattatcatggtttactgaatgtagttgcatgatggtt

SEQ ID NO: 4593 - DNA, 850 bp, Helianthus annuus
gagtcttgattgtatctacagctgaaaaagttatacaaaattgatcggatgaaatgatgtctcctggaattaacttagtgatgactgtaattgggtttacagtgagtactatgttcatcgtgttcgtgtgtacaaggttaatatgtgctcgtattcattacatatctgcaagaagatcgtttcgtatgtcttctagatctgatctcaacgctcgggagcgtggcatgcgtggtgctgaatctttcgttgcagcaagcttccctacaaagaagtatagcgatccgttcttttcctatgcaaaagatgctcaatgcatagtttgtctttcaaactaccatgcagatgacacgcttcgcattctgccatcatgcggacactttttccactcatcatgcatcgacatatggctgcaacaacactgcacgtgtcctgtttgtcgagtctcgttacgtgaaatatttaacaacccgtgcccgttgcaacccatgtacagttcagctgtcagattctcatcaagagcagatgacagtaataggatggacccctccactgaaagtcaaccacggtcaactgacaacatacaagaagcaggaccaaacagctcaaacataaacgataatggtccagctggctcgaaaaaatcagtgagcaaacaatttgaaagcccgtcggatgtttaagatgtagtcaaagtttgcagggtttgagtgatggtaaaatgtcaaaaagtcaagggtgtttaactgtctatcatctctttaggaatttgtttgttttgtctactactagtatttttgtaaatattgaaaaatcagaacagtttgacacgtaaatagattgtttttgccat

SEQ ID NO: 4594 - DNA, 1172 bp, Cichorium intybus
aaattttcaatcgattttcaaaaatttcgatccaacattaggaagtttcagtttttcttgattccacgtttgtctatgagacaaacaatgagatttcgaggagatatatacaacgatatgcgaacagacaaatacagagtctcgataggttctagagagaaaaaacagacaaagatcacatgattttaagttgagctgaattttagggtttcagtagatgatgatatgagcataagtgactttcagttgttagtttcttcacagttcacgattggtttttcggtttaactgagcaaatttgtatacgaattagagaaaagttttggaagaaaaatgatgtctcctgggattaatctggtgatgactgtaatcggatttactgtgagtactatgttcatcgtcttcgtgtgtacaagactcatctgtgctcgtattcattacatatcttcaagacgatcctttcgtatgtcttctagatctgatctcaacgttttggagcgtggcatacgtggtgctgaacctcttgttgcagcaagcttccctacaaagaagtacagtgatccgttcttttcttgtgcaaaagatgctcaatgcatagtttgtctttcggaataccatgcagatgacactttgcgcattctgcctttctgtgggcactttttccattcatcatgtatcgacatatggctgcaacaacactgtacgtgtcccgtttgtcgagtctcgttacgtgaaatattcgacaaacggtacacgatgcaaccgatgtccagctcagcaatccggttctcgtcaagaaccgatgacagccgtaggatcgaccgcaccactgatggtcaaaaccggtcaactgacaccgcgcgagaaaccgaacaaaacaactcaaatgtgaatgagaacaatccggctggatcgaaaaactcggggagtaaacaatctgaaagcccatcagacgtttaagagctcttaattgcctgttagagtgatggtaaaatgtgattattgttggttagggatttgtttgttttgttgtactagtattttgtaaatattgaaaaatcagaaagagtttgatgaggctgagtaatgagtgagtaatgagtagcttgtttttgtgatagttgtttacatacatatatagaagaaagttggctcttcctttttattacaaa

SEQ ID NO: 4595 - DNA, 1144 bp, Cirsium arvense
ttttttcacacaatttcaatccaccattatccaattccaatttcccccaattccacctttgcctatgagacaaacaatgagatttcaaagtgatgatatttacaaagatatgaaaacaacaacagaagacaaatacagagtgtccacaagctctagagacagaaattcacaaaacaaacacttgtttctaagcttcagttgattgaattcattctagggttttctctattttcaattttgaccttcaatttgttagttttatgtttcgatttcggtttgaattagagaaatcggtagtgaaatttgggaaattttgaggtataaatgatgacccctggagtcaatttggtgatgactgtaatcggatttacagtgagcaccatgttcatcgtcttcgtgtgtaccagactcatctgtgctcgaattcattatatatcttcacgaagatcgtttcgtttgtcttctagatctgatctcaattctttggagcgtggtgtacgtggtgctgaaccactcgttgcggcaagctttcctacaaagaagtacagcgatccgttcttttcttgtgcaaaagatgctcaatgcgtggtttgtctttcggactatcacgcagatgatacgctccgcattctgccattttgtggacactttttccattcgtcgtgcatcgacatatggctgcagcagcactgcacgtgtccggtttgtcgagtctcgttacgcgagatgtttgagaaacggtgtttgatgcaacccatgttcagctcagcggtccgtttctcgtcgagagcggatgacggtcgtaggacggaccccaccaccaatggtcaactccagtctaccaataacgaacgagaagttagaccggataactcgaacacgaacgagaacagttccggtgggtcgaaaaattcggtgaacaaatcatttgaaagcccatcagatgtttaggaggtctttagattggaaccaaagtttgaagtattttgagtgatggtagaaaatatcatagatgtccaagggcattatggttcttttgtctgatagtatttgtaaatagtgaaaagtctaaagattgtttgtatgcatatatagaaggttgaccttttttgtgtattgaccctgtttaatgttgtttggttac

SEQ ID NO: 4596 - DNA, 940 bp, Helianthus annuus
aaacctcattctcctcattcaacctttttctttcacacaaacaatgaaatttcaacaacacgtacacaacaatacaacaacacacaaatacagagtcttgattgtatctacagctgaaaaagtcatacaaaattgatcggatgaaattatgtctcctggaattaatttagtgatgactgtaattgggtctacagtgagtactatgttcatcgtcttcgtgtgtacaaggttaatatgtgctcgtattcattacatatctgcaagaagatcgtttcgtatgtcttctagatctgatctcaacgctcgggagcgtggcatacgcggtgctgaatctttcattgcagcaagcttccctacaaagaagtatagcgatccgttcttttcttatgcaaaagatgctcaatgcatagtttgtctttcaaactaccatgcagatgacacgcttcgcattctgccatcatgcggacactttttccactcatcatgcatcgacatatggctgcagcaacactgcacgtgtcccgtttgtcgagtctctttacgtgaaatatttaacaacccgtgcccgttgcaacccatgtacagttcagctgtcagattctcatcaagagcagctgacagtaataggatggaccccaccactgaaagtcaaccacggtcaactgacaacatacaagaagcaggaccaaacagctcaaacacaaacgataatggtccagctgggtcgaaaaattcggtgagcaaacaatttgaaagcccgtcggatgtttaagatgtagtcaaagtttgcagggtttgagtgatggtaaaatgtgaaaaagtcaagggtgtttaactgtttatcatctctttaggaatttgtttgttttgtctactactagtatttgtaaatattgaaaaatcagaacagtttgacacgtaaatagattgtttttgccat

SEQ ID NO: 4597 - DNA, 1398 bp, Cirsium arvense
acgcggggattccttgtctgcactattctgcctcttccaatcccctcaaatcacaaacccactatttctttcttgtaaattcttctaaattcatcaaaacccacaaagatcttcgatcgttttttaaaaaaaaatcgattcaacattagggaatttcgatttttcttgatcctacgtttgtctatgagacaaacaatgagatttcgaggatatatttacaacgatacgagaacaacagataaatacagagtgtcgattggttctagagagagaaagacagaaaaggatcacatgatattaagctgagttgaatttttagggttttttttcttcttctaaagtagaatagttgatgatggcgtgaccttcaattgctagtttcttcacagttcatgtttgattttcggtttaatttagaaatttgaagtggaattatagaaattttgcgaaataaatgatgactccgggcgtcaatttggtgatgactgtaatcggatttacggtgagtactatgttcatcgtcttcgtgtgtaccagactcatctgtgctcgtatccattacatatcatcaagacgatcttttcgtttatcttctagatctgatctcaactctttggagcgtggcttacgtggtgctgaacctctagttgcagcaagctttcctacaaagaagtatagcgatccattcttttcgtgtgcaaaagatgctcaatgcgtagtttgtctttcggactatcaggcagaggatacactccgtattcttccattttgtgggcactttttccattcatcgtgtatcgatatatggctgcagcagcactgcacgtgtccggtttgtcgagtctcgttacgtgagatcttcgagagacggtgtttgatgcagccgatgttcagttcggcggttagattctcatcaagagccgatgacagccgtaggacggaccccaccaccaatggtcaactccagtcaactgatgatgaacaagaagttagacaggtcaactcaaacacgaatgagaacagttccggtggatcgaaaaattcggtgaacaaacgatttgaaagcccatcagatgtttaggagctcttagatggagatggaaccaaactttgcagtatttgagtgatggtaaacatgtcaaagatgtccaagggcattatggtcttttgttttacaactactactgctagtatttgtaaatattgataaattaaaagattgttttttgttaaagctgtatgcatatatagaaggttgactttctttttatattgaccatgtgtaatgttggttggttacaacgattgtgtcatgttttatggatatgttactaatgacaattggattgatcgaaaaaaaattgtataatgctccttctggtcttttatgtgtatgca

SEQ ID NO: 4598 - DNA, 1407 bp, Centaurea maculosa
cttcttctcctagattcttctaaactacataaaattcatcaaaacccaccaaaatctccaatcttttttcacacaatttcaatccaccattatccaattccaatttcccccaattccacctttgcctatgagacaaacaatgagatttcaaggtgatgatatttacaaagatatgaaaacaacaacaacagacaaatacagagtgtccacatgctactctagagacagaaattcacaaaacaaacacttgtttctaagcttcagttgattgaattcattctagggttttctctattttcaattttgaccttcaatttgttagttttatgtttcgatttcggtttgaattagagaaatcggtagtgaaaattgggaaattttgaggtataaatgatgacccctggagtcaatttggtgatgactgtaatcggatttacagtgagcaccatgttcatcgtcttcgtgtgtacaagactcatctgtgctcgaattcattatatatcttcacgaagatcgtttcgtttgtcttctagatctgatctcaattccttggagcgtggtgtacgtggtgctgaaccgctagttgcggcaagctttcctacaaagaagtacagcgatccgttcttttcttgtgcaaaagatgctcaatgcgtggtttgtctttcggactatcatgcagatgatacgctccgcattctgccattttgtggacactttttccattcgtcgtgcatcgacatatggctgcagcagcactgcacgtgtccggtttgtcgagtctcgttacgcgagatgtttgagaaacggtgtttgatgcaacccatgttcagctcagcggtccgtttctcgtcgagagcggatgacggtcgtaggacagacctcaccaccaatggtcaactccagtcaaccattaacgaacgagaagttagaccggataactcgaacacgaacacaaacgagaacagttccggtgggtcgaaaaattcggtgaacaaatcatttgaaagcccatcagatgtttaggaggtctttagattggaaccaaagtttgaagtattttgagtgatggtagaaaatatcatagatgtccaagggcattatggtcttttgtctgatagtatttgtaaatagtgaaaagtcaaaagattgtttgtatgcatatatagaaggttgaccttttttgtgtattgaccctgtttaatgttgtttggttacaaggattgtacaagattaatgtaactcggttagttgcttgtattttaaaagaaaaaagaaaaaaataccgactgcgactctgcggggggactggtgtgattatatatcattctgaagaaatgggattggttgcagtggacaagaatacggttgctatatcagcatcagatgtgatgctatcttttgctgcct

SEQ ID NO: 4599 - DNA, 848 bp, Ambrosia trifida
tataaacaaattaatcaatgatgtctcctggggttaatttagtgatgactgtgattgggtttacagtgagtactatgtttattgtgtttgtgtgtacaagacttatatgtgctcgtattcattacatatctgcaagacgatcctttcgtatctcttctagatctgatctaaacgctcgggagcgtggcatgcgtggtgctgaatcctttgttgcagcaaacttccctacaaaaaagtatagcgatccgttcttttcttatgcaaaagatgctcaatgcatagtttgtctttcaaactacaatgcagatgacacgcttcgcattctgccctcatgtggacactttttccattcgtcatgtatcgacatatggctgcagcaacactgcacatgtcccgtttgtcgagtctcgctacgcgagatatttgacaacccgtgctcaatgcaacccatgtacagttcagcggtcagattctcatcaagagaagataacaatcataggatggaccgcaccactgatagtcaaccacggtcaactgacaacatacatgaagcgggatcaaacagctcaaacatgaacgataatggtctggctggctcgaaaaatccagtgaaccgatcatttgaaagccagtcgaatgtttaagaactcatagatgtaaagcattttagcgatggtaaactgtagaaagttaagggtgttttttttagtttcttaggtatttttgttagtttgttttgtctacttagtttatgtaagtattgtaaaagtagtaagtagtttagataagtaaatatagattagttttaggactaaaaatatagtacataatattagacaagttaggac

SEQ ID NO: 4600 - DNA, 1364 bp, Helianthus annuus
aaggcaaaacattgcctccgtgtctccttgaggtattcaacctctcttctctggtgccactcttccacacatacatactcaccctcaactgccttgcctttagtacaaatggttatcgcatctgctagaatcagtacttgtggttcaatggaactagctccagcttcattcagtacgcgacatgtaggtcgtgactgtgtttatctcaaaagtacgagttcccagtggctgaagaagccgcctcgatggtttggtttttcccatgacaaaataagtaaatttaatcattcagcttgctcggtgagtatggtgtcaaataattatgttggaagaagcacttacagaattaagaaggataatgatgataagatatataggaggcttgattcttgtttagttattcctccacctaaaggcaagaagccgaaagccattattaaattccttggtggcgcctttattggcgcagttccggaagttacctatagctatcttcttgggctattggcaaatgaaggctatcttatcatttctgtgccgtataacgtaacttttgatcactcgcaagctgcaagagaagtctatgagaggtttcattcctgcttgaattcaatactaacatcaggattgcccgatgatggcctgttagcagccgaacttgttgatcttcctctttattctgttggtcatagtaacggtgcgctacttcaagtactcactgggagctatttttcggataagctaccaaaggctaatgccataatatcatacaacaacaggccagcaacagaggcggtaccctactttgaacaattaggtcctctagtaagccagttgatgcctgtcgtggaagcatctccggtatcttccatggctaagggtgctgcagatgcgtggaaagccctgcttgatacagccgaagcgatgacgcctgattatgatcccgaagctagagtttcattggacaagtttgttgatcagttaccttcagtttttaatcaggttgctcaaggaatatcggaattcaaaccaacaccaactgaaaaccgtgaatgttgcaagaactcgtataatgtcaagaaaacactcctggtgaagttcaatactgatgccattgatgagacagatcttcttgaggagactttgaggcctcgtgtggaagctataggtggaacgcttgaaaaagtttcattgagtggtaaccacatcacaccatgcatccaggaaccaaaactgcaagtaggtgatgtatacactccagcggacgcgatcgcgcaagggcttaagaatctttcgctacatgagactaaagtcgcgggcagaaccattgcagactggcttagcagcattggttagtaattgta

SEQ ID NO: 4601 - DNA, 1479 bp, Ambrosia trifida
atgttcaatgtcgatttttattgaaaattgaaaaaattatacgtctcgtatggatctacgtaagatgtcaaaataaacgttgagggtgtcgacatagagtgagcctaataataatatccaacacagcctccgtgtctccttgaggtattcaaacctctgcgttacaactcttccacacacatactcaccctctcatatcaactccttcagaacaaatggttatcgcgtctactagaatcggtacttgtggctcaatggaactagctccagcttcattcagtacgcgacatgtaggtcgtgactgtgtttatctcaaaagtattagttccccgttgctgcagaagcagcctcggtggtttggtttttctcgtgacagaaatagtaccttcagtcattcagcttgctctttgaggatggtttcaaatgattatgttggaagaagcacctacagaattaagaaggataatgataataaattatataggaggcttgattcttgtttggttattcctccacctaaaggcaagaagccaaaagccattattaagttccttggcggtgcctttataggcgctgttccggaagttacctatagctatcttcttgggctattggcaaatgaaggctatcttattatatctgtgccgtataatgtgacttttgatcactcacaagctgctagagaagtctatgagaggtttcattcctgcttgaattcaatactaacatcaggattgcccgatgatggtctattagcatcagaacttgtcgatcttcctctttattctgttggtcatagtaatggtgccctactccaagtactcagtgggagctacttttcagataagctaccgaaggctaatgccataatatcatacaacaacaggccagcaacagaggcggtaccctacttcgagcagttaggtcctctagtaagccagttgatgcctgttgtggaagcatctccggtatcttccatggctaagggtgctgcagacgcctggaaagctctacttgatacagcccaagcaatgacacctgattacgatcctgaagctagggtttcattggacaaatttgttgatcagttgccttcagtttttaatcaggttgctcaaggaatatcagaattcaagccaacaccaactgagaaccgtgaatgttgcaagaacatgtataatgtcaagaaaacactcctggtgaagttcaatgttgatgccattgatgagacggatcttcttgaggaaactttgaggcctcgtgtggaagccataggtggaacacttgaaaaagtttcattgaacggtaaccatatcacaccatgcatccaggaaccaaaactgcaagtaggtgatgtatacactccagcagacgcaattgcacaaggacttaagaatctttccctaaacgagaccaaaatcgttgccaggaccattgcagactggtttagcagcatcagttagtaactgtaagttctaa

SEQ ID NO: 4602 - DNA, 1514 bp, Ambrosia trifida
ctaataatatccaacacagcctccgtgtctccttaggtattcaaacctctgtgtttgcccctcttccacacacacatactcaccctctcatatcaactcctttagaacaaatggttatcacatctactagaatcggtgcttgtggctcaatggaactagctccagcttcattcagtacgcgacatgtaggtcgtgactgtgtttatctcaaaagtattagttccccgttgctgcagaagcagcctcggtggtttggtttttctcgtgacagaaatagtaccttcagtcattcagcttgctctttgaggatggtttcaaatgattatgttggaagaagcacctacagaattaagaaggataatgataataaattatataggaggcttgattcttgtttggttattcctccacctaaaggcaagaagccaaaagccattattaagttccttggcggtgcctttataggtgcagttccggaagttacctatagctatcttcttgggctattggcaaatgaaggctatcttattatatctgtgccgtataacgtgacttttgatcactcacaagctgctagagaagtctatgagaggtttcattcctgcttgaattcaatactaacatcaggactgcccgatgatggtctattagcatcagaacttgtcgatcttcctctttattctgttggtcatagtaatggtgccctactccaagtactcagtgggagctatttttcagataagctaccaaaggctaatgccataatatcatacaacaacaggccagcaacagaggcggtaccctacttcgagcaattaggtcctctagtaagtcagttgatgcctgttgtggaagcatctccggtatcttccatggctaagggtgctgcagacgcctggaaagctctacttgatacagcccaagcaatgacacctgattatgatcctgaagctagggtttcattggacaaatttgttgatcagttgccttcagtttttaatcaggttgctcaaggaatatcagaattcaagccaacaccaactgagaaccgtgaatgttgcaagaacatgtataatgtcaagaaaacactcctggtgaagttcaatgttgatgccattgatgagacagatcttcttgaggagactttgaggcctcgtgtggaagctataggcggaacacttgagaaagtctcattgagtggtaaccatatcacaccatgcatccaggaaccaaaactgcaagtaggtgaggtatacactccagctgacgcgattgcacaaggacttaagaatctttccctaaacgagaccaaaatcatggccagaaccattgtagactggtttagcagcatcagttagtaactgtaagtgctactgtttagaaactttaatagcttcagccacattatgtgaatattcacgtgaaacacacgtatatctacatgtagtaaattaaattgccaccatacttcatttgatttgaccttggggatcaatagaagatgcagattatag

SEQ ID NO: 4603 - DNA, 1463 bp, Echinacea purpurea
atccaccaacacaaaaacaaacaccgccttggtgtctatttgaggtattcaagctctctttgacactcttccacacatactcgccctcctgatatcacctgcttccgtaatggaattagctccatcttcattcagtacacgacatttacgccgtgactgtgtttatctcaaaggtttgagttcccagtggttgcagcagcagaggcagcctcggtggtttggtttttctcgtgacagaattagtaccttcaatcaatcagcttgctctgcgagaatggtttcaaataattatgttggaagaaatacctacagaactaggaaggataatgatgataagatatatagaaggcttgattcttgtttggttattcctccacctaaaggcaagaagccaaaagcaataattaaattccttggtggtgcctttataggcgcggttcctgaagttacctatagctatcttcttgggctattggcaaatgaaggctatcttattatttccgtaccgtataacgtgacttttgatcactcacaagctgctagagaagtctatgagaggtttcattcttgcttgaattcaatactaacgtcaggattgcctgatgatggcctgttagcagccgaacttgttgatcttcctctttattctgttggtcatagtaatggtgccctacttcaagtactcactgggagctattattcagaaaagctaccaaaggctaatgccataatatcatacaacaacaggccagcaacagaggcggtaccctacttcgagcagttaggtcctctagtaagccagttgatgcctgttgtggaagcatctccggtatcttcaatggctaagggtgctgcagatgcatggaaagcactgcttgatacagctgaagctatgacacctgattatgatcctgaagctagggtttcattggacaaatttgtcgatcagttgccatctgtttttaatcaggttgctcaaggaatatcagaattcaagccaacaccaactgagaaccgtgattattgcaaaaactcgtataatgtcaagaaaacactcctggtgaagttcaatgttgatgccattgatgagacagatcttcttgaggagactttgaggcctcgtgtggaagctataggcggaacacttgaaaaagttacattgagtggtaaccatatcacaccatgcatccaggaaccaaaattgcaagtaggtgatgtatacactccagcggacgcgattgcacaagggcttaagaatctttcgctaaatgagacgaaaatcatggctagaactattgcagattggtttagcagcattaattagtaactataagtactaattgttttaaaagtttgagtttaactagccaaattgtgtgaatattaacttggaacacacatacatctacatgttgtaatatgaatgaccactatacttgatctgatatgacacaagggactga

SEQ ID NO: 4604 - DNA, 1314 bp, Flaveria ramosissima
tctccttgaggtattcaacctctccggtgccacacttccacacatactgctttagtaaaaatggttatggcatctactagaaccagtagttgtggctcgatggaactagctccatcttcattcagtcgtcgacatgtacatcgtgactgtgtttatccgaaaagtttgagttcgcgggggctgcagaagcagcctcggtggtttggtttttctcgtgacaaaataagtaactgcagttattcagcctgctcagtgaggatggtttcaaataattatgttggaagaaacacctacagaattaagaaggatgataatgataagatatttaggaggtttgattcttgtttggttattcctccacctaaagggaagaagccaaaagcaattattaagttccttggaggcgcatttataggtgcagttcctgaagtcacctatagctatcttctcgggctattggcgaatgaaggctatcttataatttctgtaccatataacgtgacatttgatcactcacaagcggcaagagaagtctatgagaagtttcattcctgcttgaatgcaatacttacatcaggattgcccaatgatggcctgctagcagctgaacttgttgatcttcctctttattctgttggtcatagtaatggtgctctactccaagttcttgctgggagctacttttcagataagctaccgaaggctaatgccataatatcatacaacaacaggcccgcaacagaggcagtaccgtacttcgagcagttgggtcctctagtaagccagttgatgcctgttgtggaagcatctccggtatcttctatggctaagggtgctgcagatgcctggaaagcgctgcttgatacagcccaggcaatgacacctgattatgatcctgaagcaagggtttcattggacaaatttgttgatcaattgccttcagtttttaatcaggttgctcaaggaatatcagaattcaagccaacaccaaccgagaaccgtgaatgttgcaagaactcgtataatgtcaagaaaaccctcctggtaaagttcaatgttgatgccattgatgagaccgatcttcttgaggagacattgaggcctcgcgtggaagctataggcggaacacttgaaaaagtttcattaagtggtaaccatatcacaccatgcatccaggaaccaaagctgcaagtaggtgatatatacactccagcagacgcaattgcacaaggactcaagaatctttcactaaacgagaccaaagtcgtggccagaaccattgcagattggtttaacagcatcagttagtaattg

SEQ ID NO: 4605 - DNA, 1471 bp, Echinacea purpurea
aaaacaaacaccgccttggtgtctatttgaggtattcaacctctctttgacactcttccacacatactcaccctcctgatatcacctgcttccgtaaaaagttgtggctcaatggaactagctccatcttcattcagtacgcgacatttacgccgtgactgtctttatcacaatggtttgagttcccagtggttgcagcagcagaagcagcctcggtggtttagtttttatcgtgacagaattagaaccttcaatcaatcagcttgctctgcgagaatggtttcaaataattatgttggaagaaatacctacagaactaagaaggataatgatgataagatatataggaggcttgattcttgtttggttattcctccacctaaaggcaagaagccaaaagcaataattaaattccttggtggtgcctttataggcgcggttcctgaagttacctatagctatcttcttgggctattggcaaatgaaggctatcttattatttctgtaccgtataacgtgacttttgatcactcacaagctgctagagaagtctatgagaggtttcattcttgcttgaattcaatactaacatcaggattgcccgatgatggcctgttagcagccgaacttgttgatcttcctctttattctgttggtcatagtaatggtgccctacttcaagtactcactgggagctattattcagataagctaccaaaggctaatgccataatatcatacaacaacaggccagcaacagaggcggtaccctacttcgagcagttaggtcctctagtaagccagttgatgcctgttgtggaagcatctccggtatcttcaatggctaagggtgctgcagatgcatggaaagcactgcttgatacagctgaagctatgacacctgattatgatcctgaagctagggtttcattggacaaatttgttgatcagttgccgtctgtttttaatcaggttgctcaaggaatatcagaattcaagccaacaccaactgagaaccgtgattattgcaaaaactcgtataatgtcaagaaaacactcctggtgaagttcaatgttgatgccattgatgagacagatcttcttgaggagactttgaggcctcgtgtggaagctataggcggaacacttgaaaaagtttcattgagtggtaaccatatcacaccatgcatccaggaaccaaaattgcaagtaggtgatgtatacactccagcggacgcgattgcacaagggcttaagaatctttcgctaaatgagacgaaaatcatggctagaactattgcagattggtttagcagcattaattagtaactataagtactaattgtttaaaaagtttgagtttaactagccaaattgtgtgaatattaacttggaacacacatacatctacatgttgtaatatgaatgaccactatacttgatctgatatgacacaagggactgagtgaag

SEQ ID NO: 4606 - DNA, 1329 bp, Flaveria ramosissima
gggaaactgcattcgtgtctccttgaggtattcaacctctccggatactgctttagtaaaattggttatggcatctactagaaccagtagttgtggctcgatggaactagctccatcctcattcagtcgtcgacatgtacatcgtgactgtgtttatccgaaaagtttgagttcgcgggggctgcagaagcagcctcggtggtttggtttttctcgtgacagaataagtaactgcggttattcaccctgctcagtgaggatggtttcaaataattatgttggaagaaacacctacagaattaagaaggatgataatgataagatatttaggaggtttgattcttgtttggttattcctccacctaaaggcaagaagccaaaagcaataattaaattccttggtggcgcctttataggagcggttcctgaagttacctatagctatcttctcgggctattggcgaatgaaggctatcttataatttctgtaccatataatgtgacatttgaccactcacaagcggcaagagaagtctatgagaagtttcattccagcttgaattcaatactgacatcaggattgcccaatgatggcctgctagcagctgaacttgttgatcttcctctttattctgttggtcatagtaatggtgctctactccaagttcttgctgggagctacttttcagataagctaccgaaggctaatgccataatatcatacaacaacaggcccgcaacagaggcagtaccgtacttcgagcagttgggtcctctagtaagccagttgatgcctgttgtggaagcatctccggtatcttctatggctaagggtgctgtagatgcctggaaagcgctgcttgatacagcccaggcaatgacacctgattatgatcctgaagcaagggtttcattggacaaatttgttgatcaattgccttcagtttttaatcaggttgctcaaggaatatcagaattcaagccaacaccaactgagaaccgtgaatgttgcaagaactcgtataatgtcaagaaaaccctcctggtaaagttcaatgttgatgccattgatgagaccgatcttcttgaggagacattgaggcctcgcgtggaagctataggcggaacacttgaaaaagtttcattaagtggtaaccatatcacaccatgcatccaggaaccaaagctgcaagtaggtgatatatacactccggcagacgcaattgcacaaggactcaagaatctttcactaaacgagaccaaagtcgtggccagaaccattgcagattggtttaacagcatcagttagtaattgtaagtgccgatatt

SEQ ID NO: 4607 - DNA, 1471 bp, Flaveria ramosissima
ggtattcaacctctcaggtggcactcttccacacatactcaccctcacatatcaactaaagagcttttgtcaaccacagcaaaaacggctatggcatctgcaagaaccagtacatgtggcaagatggaactagctccatcctcattcagttgccgacatgtatatcgtgactgtgtttatccgaaagttttgagttctcggtggctgcagaagcagcctcgttggtttggtttttctcgtgacaaaagaactaacttcagttattcagcgtgctcgttgaggatggtttcaaataattatgttggaagaaacacctacagaattaagaaagataatgataagatatttaggaggtttgattcttgtttggttattcctccacctaaaggcaagaagccaaaagccattattaaattccttggtggcgcctttataggtgcagttcctgaagtttcctatagctatcttctcgggctattggcgaacgaaggctatcttataatttctgtaccatataacgtgacgtttgatcactcacaagcggctagagaagtctttgagaagtttcattcctgcttgaattcaatactgacatcaggattgcccaatgatggcctgctagcatctgaacttgtagatcttcctctttattctgttggtcatagcaatggtgccctactccaagtacttgctgggagctacttttcagagaagctaccgaaggcaaatgccataatatcatacaacaacaggccagcaacagaggcagtaccatatttcgagcagttgggtcctctagtaagccagttgatgcctgttgtggaagcatctccggtatcttccatggctaagggcgctgcagatgcctggaaagcactgcttgatacagcccaagcaatgacgcctgattatgatcctgaagctagggtttcattggacaaatttgttgatcagctgccttcagtttttaatcaggttgctcaaggaatatcagaattcaagccaacaccaacagagaaccgggaatgttgcaagaactcgtataatgtcaagaaaaccctcctggtgaagttcaatgttgatgccattgatgagactgatcttcttgaggagactttgaggcctcgcgtggaagctataggcggaacacttgaaaaagtttcattaagtggtaaccatatcaccccatgcatccaggaaccaaagctgcaagtaggtgatatatacactccggcagacgcaattgcacaaggactcaagaatctttcactaaacgagaccaaagtcgtggccagaaccattgcagactggtttagcagcataagttagtaactgtaagtgccaatattcagaatgtttgaacttaagtagtttcagccaaagtggtggatcttaatatgatgttgtatataataatagaatatagcaaccgtgtgcttattaacttgtaacacacgtatatctacatgtt

SEQ ID NO: 4608 - DNA, 1438 bp, Chrysanthemum coronarium
ctcactcacccactcagactgtacgactaaagtgaaaatggctatactatctactgggactagtacatgtggctcaatggaactagttgcaacctcatttagtccccgatatacacaacgtgactgcgtggatttcaagagtttgagtacccaaaggcaacatcaacggccttggtggtttgggttttcttatgacaaagtaagaaaattaggtgctccaggacgctcattgaggatgatttcgaatgggtatgttgggagagacacatacaggataaaaaaggataatgatgataagatttataggaggcttgattcgtgtttggttattcctccgcctaaaggaaagaagccgaaagccattattaagttccttggtggtgcgtttataggtgcagttcctgaggttacatatagctatctacttgggctattggcaaatgaaggctatctcattatttctgtaccatataacgtgacgtttgatcactcacaagctgctagagaagtttttgagaggtttcattcctgcttgaattcagtgttaacgtatggattaccgagtgatggcctgctagcagctgagcttgctgatcttcctctttattctgttggtcacagtaatggtgccctactccaagtactcgctggaagctatttttcggataagctaccaaaggcgaatgccataatatcttacaacaacaggcccgcaacagaggcagtaccctacttcgagcagttgggtcctctagtaagccaaatgatgcctatggtggaagcttctcctgtatcctccatggctaagagtgctgcagatgcctggaaagcagtgcttgatacagctgaagcaatggcacctgattatgatcctgaaactagggtctcgttggacaaatttgttgatcagctaccatcggttttcaatcaggttgctcaaggaatatcagaattcaaaccaacaccaactgaaaaccgagaattttgcaagaattcatataatgtcccgaaaacactcctggtgaagttcaatactgatgccattgacgagacagatctccttgaggaaactttgaggcctcgtgtggaagctattggtggaacactggacattgtttcattgagtggtaaccatatcacaccatgcatccaggacccaaaattgcaagtaggtgatatatacactccagcagatgcgattgcacaaggactcaagaccctttcgctaaatgagacaaaaattcttgccagaaccattgtagactggtttagtagcatcaactagtaagttcagtgcggagattcagtaaatgtaaactaaacttagcttcaaccaaattttcggatcttgtatatattaatatagaagcaaccattgtgtgaatatagaccggaaacacatactttatttgcgagtttgaggtcaaacaattctggg

SEQ ID NO: 4609 - DNA, 1766 bp, Artemisia annua
atcaatctgtaccttataattcacctgctgttcaattatatgtatacactactgttcaactatagtgaaaatggccatactatctactgggacgagtacatgtggctcaatggaactagttgcatcctcatttagtccccgatatacacaatgtgactgcgtgcaattcaagagtttgagtacccaaaggcaacatcaacagcctcggtggtttgggttttcttatgacaaagtaagaaaattaggtgctccgggtcgctcattgaggatgatttcaaatgggtatgttgggagagacacatacaggataaaaaaggataatgatgataagatttataggaggcttgattcttgtttggttattcctccgcctaaaggaaagaaggcaaaagccattattaagttccttggtggtgcgtttataggagcagttcctgaggttacatatagctatctacttgggctattggcaaatgaaggctatctcattatagttgtaccatataacgtgacgtttgatcactcacaagctgctagagaagtttttgagaggtttcattcctgcttgaattcagtgttaacgtatggattaccgagtgatggcctgctagccgctgaacttgctgatcttcctctttattctgttggtcacagtaatggtgccctactccaagtactcgctggaagctatttttcggataagctaccaaaggcgaatgccataatatcttacaacaacaggcccgcaacagaggcagtaccctacttcgagcagttgggtcctctagtaagccaaatgatgcctatggtggaagcttctcctgtatcctccatggctaagagtgctgcagatgcctggaaagcactccttgatacagctgaaacaatggcacctgattatgatcctgaaactagggtctcgttgaacaaatttgttgatcagctaccatcggttttcaatcaggttgctcaaggaatatcagaattcaaaccaacaccaactgaaaaccgagaatgttgcaagaattcatataatgtcccgaaaaccctcctggtgaagttcaatactgatgccattgatgagacagatctccttgaggaaactttgaggcctcgtgtaaaagctattggtggaacactggacattgtttcattgagtggtaatcatatcacaccatgcatccaggacccaaaattgcaagtaggtgatatatacactccagcagatgcgattgcacaaggactcaagaccctttcgctaaacgagacaaaaattcttgccagaaccatagcagactggtttagtagcatcaactagtaagttaagtgcggagattcagtaaatgtaaactaaacttagcttcaaccaaatttttggatctttgtatatattaatatagaagcaaccattgtgtgaatataaactcgaaacacatactttattttattgtctcccatactatattttatttgacattgggggatagatggaagttaagtgctttttgttccttttgtgcccttgcccatttgctttcttgcttttatgctcttttgtctatgcttttgcccccttctctagcgctttctttttgccttttgtccgttttgtatgtgttctcctgtggcttatgctttttgtttgtttgtttgtcctttttcccttagttttttttatgatgattttcgtttattgcttgtttgcttgttttgcttatttgcttgtttctcgttgtatgtttgtttttgcactttcgtgctctttt

SEQ ID NO: 4610 - DNA, 1206 bp, Helianthus annuus
aaaacattgcctccgtgtctccttgaggtattcaacctctctggtgccacactgccactcttccacacatacatactcaccctcaactgcctagccttcagtacaaacggttatcgcatctgctagaatgagtacttgtggttcaatggaactagctccagcttcattcagtacgcgacatgtaggtcgtgactgtgtttatctcaaaagaaagagttcccagtggctgaagaagccgcctcggtggtttggtttttcccatgacaaaataagtaaatttaatcattcagcttgctcggtgagtatggtgtcaaataattatgttggaagaagcacttacagaattaagaaggataatgatgataagatatataggaggcttgattcttgtttagttattcctccacctaaaggcaagaagccgaaagccattattaaattccttggtggcgcctttattggtgcagttccggaagttacctatagctatcttcttgggctattggcaaatgaaggctatcttatcatttctgtgccgtataacgtaacttttgatcattcgcaagctgcaagagaagtctatgagaggtttcattcctgcttgaattcaatactaacatcaggattgcccgatgatggcctgttagcagccgaacttgttgatcttcctctttattctgttggtcatagtaacggtgcgctacttcaagtactcactgggagctatttttcggataagctaccaaaggctaatgccataatatcatacaacaacaggccagcaacagaggcggtaccctacttcgaacagttaggtcctctagtaagccagttgatgcctgtcatggaagcatctccagtatcttccatggctaagggtgctgcagatgcgtggaaaagcctgcttgatacagccgaagcgatgacgcctgattatgatcccgaagctagagtttcattggacaagtttgttgatcaagtgccttcagtttttaatcaggttgctcaaggaatatcggaattcaaaccaacaccaactgagaaccgtgaatgttgcaagaactcgtataatgtcaagaaaacactcctggtgaagttcaatactgatgccattgatgagacagatcttcttgaggagactttgaggcctcgtgtggaagctataggtggaacgcttgaaaaagtttcattgagtggtaaccacat

SEQ ID NO: 4611 - DNA, 1546 bp, Centaurea maculosa
tagttctaacgactctctgctctacactctacacacacacacacacttgtccacacaaatcaaccgcttttctattcagtaagaatgtcaatcgtatctatgggaactagtacttgtggctcaatggaactagcggcttattcattcagtccccgacatgcacaacatgacgttggttatctcaaaagtttgagttcccagtggcagcagcaacggccttggcggtttggattttcttgtcataaaatacgtaatgtagatgcttcaggtcactccttcaggatgatttcaaatggttacgttgggcgagacacctacaaggtgaaaaaggataacgatgataaaatatataggaggcttgattcttgtttggtcattcctccacctaaaggcaagaagccaaaggcaatcattaagttccttggtggtgcttttataggagcggttcccgaagttacctatagctatcttcttgggctattggcaaatgaaggctatctcattatttctgtgccgtataacgtgacttttgatcactctcgagctgctagcgaagttcatgagaggtttaattcctgcctgaatttaattttaacggctggattgccgaacgatgatctgctagcagctgaacttgttgatcttcctctttattctgttggtcatagtaatggtgccctactccaagtactcaccggaagttatttctcggataagataccaaaggctaatgccataatatcatacaacaaccggccagcaacagaggcagtaccttacttcgagcagctgggtcctctagttagccagttgatgcctgttgtcgaagcatctcccgtatcttccatggctaagggtgctgctgatgcttggagggttctacttgatacagctgaagcgatgacacctgattatgatcctgaagctagggtttctttgaacaaatttgttgatcagttgccatccgtttttaatcaggttgctcaaggaatatcggaattcaggccaacacccattgagaaccgtgaattttgcaagaactcatataatgtccggaaaacactgctggtgaagttcaacgttgatgcaattgacgagacagatctccttgaggagactttgaggcctcgagtggatgccatcggtggaagactggataaagtttcgttgaatggtaaccatatcacaccatgcatccaggagccaaaactgcaagtaggtgatgtatacactccggcagatgcaattgcgcaaggactcaagactctttcactaaacgagaccaaaatccttgccagaaccattgctgactggttcagcagcatcaccgagtgaggaggtaaagtggctttttgccgatttggtggttcttctgtttctgatatttgttgtatatatgaattactacacaaacatcaattaagtaaatagaaatacacctacacttgtgaactaagttaattatacttgattatatcttgttgatgaaggtttcttgcttatgctcataaccttattttgaaaaaagaaaaagtaccgaactgcg

SEQ ID NO: 4612 - DNA, 1537 bp, Cirsium arvense
gccactattgttgtattatcaactgcctcggtgtctccttctggtattcaagctttctcttgctccaaaacacacacacacacacacacacttttctccccatccaattcaaccgctgttcagtaagaatgtcaatcatatctatgggaactagtacttgtggctcaatggaactagcggcttattcattcagtccccgacatacacaatatgatgtcttttgtcccaaaagtttgagttcccagtggcagcagcaacggccatggcggtttggattttcttgtcataaaatacgtaaagtagatgcttcaggtcgctccttgaggatgatttcaaatggttacgttggacgagaaacctacagggtgaaaaaggataacgatgataaaatatataggaggcttgattcgtgtttggtcattcctccgcctaaaggcaagaaaccaaaagcaatcattaagttccttggtggtgcttttataggagcggttcccgaagttacctatagctatcttcttgggctattggcaaatgaaggctatctcattatttctgtgccgtataacgtgacttttgatcactctcgagctgctagcgaagttcatgagaggtttaattcctgcctgaatttaattttaacggctggattgccgaacgatgatctgctagcagctgaacttgttgatcttcctctttattctgttggtcatagtaatggtgccctactccaagtactcaccggaagttatttctcggataagataccaaaggctaatgccataatatcatacaacaaccggccagcaacagaggcagtaccttacttcgagcagctgggtcctctagttagccagttgatgcctgttgtcgaagcatctcccgtatcttccatggctaagggtgctgctgatgcttggagggtactacttgatacagctgaagcaatgacacctgattatgatcctgaagctagggtttctttgaacaaatttgttgatcagttgccatccgtttttaatcaggttgctcaaggaatatcggaattcaggccaacacccattgagaaccgtgaattttgcaagaactcatataatgtccggaaaacactgctggtgaagttcaacgttgatgcaattgacgagacagatctccttgaggagactctgaggcctcgagtggatgccatcggtggaagactggataaagtttcgttgaatggtaaccatatcacaccatgcatccaggagccaaaactgcaagtaggtgatgtatacactccggcagatgcaattgcgcaaggactcaagactctttcactaaacgagaccaaaatccttgccagaaccattgctgactggttcagcagcatcaccgagtgaggaggtaaagtggctttttgccgatttggtggttcttctgtttctgatatttgttgtatatatgaattactacacaaacatcaattaagtaaatagaaatacacctacacttgtgaactaagttaattaatacttgattatattttgttagaaaaaag

SEQ ID NO: 4613 - DNA, 1390 bp, Chrysanthemum coronarium
actgtacgactaaagtgaaaatggctatactatctactgggactagtacatgtggctcaatggaactagttgcaacctcatttagtccccgatatacacaacatgactgcgtgtatttcaagagtttgagtacccaacggcaacatcggtttgggttttcttatgacaaagtaagaaaattaggtgctccgggtcgctcattgaggatgatttggaatgggtatgttgggagagacacatacaggataaaaaaggataatgatgataagatttataggaggcttgattcctgtttggttattcctccgcctaaaggaaagaagccgaaagccattattaagttccttggtggtgcgtttataggagcagttcctgaggttacatatagctatctacttgggctattggcaaatgaaggctatctcattatttctgtaccatataacgtgacgtttgatcactcacaagctgctagagaagtttttgagaggtttcattcctgcttgaattcagtgttaacgtatggattaccgagtgatggcctgctagcagctgagcttgctgatcttcctctttattctgttggtcacagtaacggcgccctactccaagtactcgttggaagctatttttcggataagctaccaaaggcgaatgccataatatcttacaacaacagacccgcaacagaggcagtaccctacttcgagcagttgggtcctctagtaagccaaatgatgcctatggtggaagcttctcctgtatcctccatggctaagagtgctgcagatgcctggaaagcagtgcttgatacagctgaagcaatggcccctaattatgatcctgaaactagggtctcgttggacaaatttgttgatcagctaccatcggttttcaatcaggttgctcaaggaatatcagaattcaaaccaacaccaactgaaaaccgagaattttgcaagaattcatataatgtcccgaaaacactcctggtgaagttcaatactgatgccattgacgagacagatctccttgaggaaactttgaggcctcgtgtggaagctattggtggaacactggacattgtttcattgagtggtaaccatatcacaccatgcatccaggacccaaaattgcaagtaggtgatatatacactccagcagatgcgattgcacaaggactcaagaccctttcgctaaatgagacaaaaattcttgccagaaccattgtagactggtttagtagcatcaactagtaagttaagtcggagatttcagtaaatgtaaacgaaccttagcttccacaaaattgttggatcttatatatattactatagaagcaaccaatgtgttaatataaactcgaaacacctattcacctacaattgtg

SEQ ID NO: 4614 - DNA, 1512 bp, Cirsium arvense
attatcaaatgcctccgtgtctccttgaggtattcaaactctcttctccaacacttccacacacacttgttcatccaaatcaaccgcttttcagtaaaaatggctatagtatctatgggaaccagtacttgtggctcaatggaactagctgcatattcattcagtccccgacatgcacaacgtgacgttgtttatcccaagagtttgagttcccagtggcagcaacaacgaccttggtggtttggattttcttgtcacaaaatacgtaatgcagatgcttcaggtcactccttgaggatgatttcaaatagttatgttgggagagacacctacaggatgaaaagggataccgatgataaaatatataggaggcttgattcttgtttggtcattcctccacctaaaggcaagaagccaaaggcaatcattcaattccttggtggtgcttttataggagcagttcccgaagttacctatagctatcttcttggactattggcaaatgaaggctatctaattatttctgtgccgtataacgtgacttttgatcactctcaagctgctagcgaagtttatgataggtttaattcctgcctgaaattaatgttaacgtctggattgcccaccgatgatctgctagcagctgaacttgttgatcttcctctttattctgttggtcatagtaatggtgccctactccaagtactcactggaagctatttctccgagaagataccaaaggctaatgccatcatatcatacaacaacaggccagcaacagaggcagtaccttacttcgagcagttgggtcctctagttagccagttgatgcctgttgtagaagcatctcctgtatcttccatggctaagggtgccgcagatgcatggagggtactacttgatacagctgaagcaataacacctgattatgatcctgaagctagggtttcattgaacaaatttgttgatcagttgccatcagtttttaatcaggttgctcaaggaatatcagaattcaggccaacacctgttgagaatcgtgaattttgcaaaaactcatataatgttgagaaaacactgctggtgaagttcaatgttgatgcaattgatgaaacagatctccttgaggagactttgaagcctcgggtggaagctattggcggaacattggataaagtttcattgagtggtaaccatatcacaccatgcatccaggagccaaaactgcaagtaggtgatgtatacactccagcagatgcgattgcacaaggactcaagactctttcactaaatgagaccaaaatccttgccagaaccattgcagactggtttaacagcatcaacgagtgaggtaatgtgccatgattcagaaaatatacatttcattagctttcgtcaattatttgtcactttttgtgttgtatatataaattactacataaacagcaatcgagtaaatatatataaactcagaatgggatatacacctacaaaaaagaaaaaagtaccgac

SEQ ID NO: 4615 - DNA, 1456 bp, Arnica chamissonis
caggttaaatttgcaccataatctcgccattaatgattagtgtttcctcagtgaaaatgaatataatatctaccggaatcagtacctgtggttcaatggaactagctccgtcgttattcagtccacgacacagacaacgtgactgcttctatctcaagagtctgagctcccggtggatgcagcaccggccgcaggggtttggatattcgtgtgacagattacagagttatgattcaggtcggatgatgatttcaaatggttatgttgggatagacacttacagaatgaagaaggttaatgatgacaagatacataggaggcttgattcttgtttggttattcctccacctaacggcaagaagccaaaagcgatcattaaattccttggtggtgcctttataggtgcagttcctgaagttacctatagctatcttttggggctattggcaaatgaaggctatctaattatttccgtgccatataacgtgacttttgatcactcacaagctgctagagaagtctacgagaggtttcattcgtgcttgaattcaatattaacatcaggattgcccagtgatgacctgctagcagctgatcttgttaatcttcctctttattctgttggtcacagtaacggtgccctactccaagtactcactggaagctatttctcagagaagttaccaaaggctaatgccataatatcatacaacaacaggccggcaacagaggcagtgccctactttgagcagttgggtcctctagtaagccagttgatgcctgttgtggaagcatctcctgtatcttccatggctaagggtgctgcagatgcctggaaagcactgcttgatacagctgaagcaatgacacctgattatgatcctgaagctagaatttcgttgaacaaattcgtcgatcagttgccatcagtttttaatcaggttgctcaaggaatatcagaattcaagccaacaccaactgagaaccgtgaatgttgcaggaactcatataacgtccagaagacactcctggtgaagttcaatgttgatgctattgatgagacagatcttcttgaggaaactttgaggcctcgtgtggaagctataggtggaacattggaaaacatttcattgagtggtaaccatatcacaccgtgcattcaggaaccaaaactacaagtaggtgatgtatacactccagcagatgcgatcgcacaaggactcaaatcactttcactaaacgagaccaaaatcctagccagaaccattgcagactggtttagcagcatcaattagtaactgtaagtgccaatttcagaaagtttaaactaaaccagattcatccaaattggtagatcttcggttagtgatattaccctgtatatactaatacagaaacagctaccgtattaactcggaacacatacatgtacttcattttattcgactgtgggggt

SEQ ID NO: 4616 - DNA, 1293 bp, Chrysanthemum coronarium
cacacacccacactctctctctcagtgaatatactacgcaccgggactagtgcacgtggctcaatggaactagttgcaacctcatttagtccccgatatacacaacgtgactgcgtgtatttcaagagtttgagtacccaacggcaacatcggtttgggttttcttatgacaaagtaagaaaattaggtgctccaggacgctcattgaggatgatttcgaatgggtatgttgggagagacacatacaggataaaaaaggataatgatgataagatttataggaggcttgattcgtgtttggttattcctccgcctaaaggaaagaagccgaaagccattattaagttccttggtggtgcgtttataggagcagttcctgaagttacatatagctatcttcttgggctattggcaaatgaaggttatcttattatatccgtaccatataacgtaacgtttgatcactcacaagctgctagagaagtttttgagaggtttcattcctgcttgaattcagtgttaacgtatggattaccgagtgatggcctgctagcagctgagcttgctgatcttcctctttattctgttggtcacagtaatggtgcgctactccaagtactcgctggaagctatttttcagataagctacctaaggcgaatgccataatatcttacaacaacaggcccgcaacagaggcagtaccctacttcgagcagttgggtcctctagtaagccaaatgatgcctatggtggaagcttctcctgtatcgtccatggctaagagtgcggcagatgcctggaaaacacttcttgatacagctgaagcaatggcacctgattatgatcctgaaactagggtctcgttggacaaatttgttgatcagttaccaggggttttcaatcaggttgctcaaggaatatcagaattcaaaccaacaccaactgaaaaccgagaatgttgcaagaattcatataatgtcccgaaaacactcttggtgaagttcaatactgatgccattgacgagacagatctccttgaggaaactttgaggcctcgtgtggaagctattggtggaacactggacattgtttcattgagtggtaaccatatcacaccatgcatccaggacccaaaattgcaagtaggtgatatatacactccagcagatgcgattgcacaaggactcaagaccctttcgctaaatgagacaaaaattcttgccagaaccattgtagactggtttagtagcatcaactagtaagttcagtgcggagattcagtaaatgtaaac

SEQ ID NO: 4617 - DNA, 1401 bp, Chrysanthemum coronarium
agattgttaaacgatagtgaaaatggctatactatctactgggacgagtagatgtggctcaatggaactagttgcatcctcatttagtccactacatatactacgtgacagcgtgtatctcaatagtttgagttcccaaaggaagcagcaacggcctctctggtttagatattcttatgacagacttagtaaatcaggtgcttcaggtcgctcccccagaatgattttgaatgggtatgttgggagagacacctataggatgaaaaaggataacgatgagaagatgtataggaggcttgattcgtgtttggttattcctcctcctaaaggaaagaagccgaaagctattattaagttccttggtggtgcgtttataggagcagttcctgaagttacatacggctatctacttgggctattggcaaatgaaggctatcttattatatctgtaccatataacgtgacatttgatcactcacaagctgctagagaagtttttgagaggtttcattcctgcttgaattcagtgttaatgtatggattaccgagtgatggcctgctagcagctgagcttgttgatctccctctctattctgttggtcatagtaatggagccctactccaagtactgtctggaagctatttctcagataagttgccaaaggcgaatgccataatatcatacaacaacaggccagcaacagaggcagtaccctacttcgagcagttgggtcctctagtaagccagatgatgcctatggtggaagcatctcctgtatcctccatggctaagagtgccgcagatgcctggaaagcagtgcttgatacagctgaagcaatgacacctaattatgatcctgaaactagggtctcgttgaacaaatttgttgatcagttaccaggggttttcaatcaggttgctcaaggaatatcagaattcaaaccaacaccaagtgaaaaccgagaatgttgcaaaaatttgtataatgtccacaaaacactcctggtgaagttcaatactgatgccattgatgagacagatctccttgaggaaaccttgaggcctcgtgtggaagctataggtggaacactggacattgtttcattgagtggtaaccatatcacaccatgcatccaggacccaaaactgcaagtaggtgatatatacactccagcagatgcgattgcacaaggactcaagaccctttcactaaacgagacaaaaatccttgccagaaccattgtagactggtttagtagcatcaactagtaagttaaatgtggagattcagtaaatgtaaactaaacttagcttcaaccaaattttcggatcttgtatatattaatatagaagcaaccattgtgtgaatatagaccggaaacacatactttatttgcgag

SEQ ID NO: 4618 - DNA, 1396 bp, Chrysanthemum coronarium
tgacacacacacccacactctctctctcagtgaatatactacgcaccgggactagtgcacgtggctcaatggaactagttgcaacctcatttagtccccgatatacacaacatgactgcgtgtatttcaagagtttgagtacccaacggcaacatcggtttgggttttcttatgacaaagtaagaaaattaggtgctccgggtcgctcattgaggatgatttggaatgggtatgttgggagagacacatacaggataaaaaaggataatgatgataagatttataggaggcttgattcgtgtttggttattcctccgcctaaaggaaagaagccgaaagccattattaagttccttggtggtgcgtttataggagcagttcctgaggttacatatagctatctacttgggctattggcaaatgaaggctatctcattatttctgtaccatataacgtgacgtttgatcactcacaagctgctagagaagtttttgagaggtttcattcctgcttgaattcagtgttaacgtatggattaccgagtgatggcctgctagcagctgagcttgctgatcttcctctttattctgttggtcacagtaacggcgccctactccaagtactcgctggaagctatttttcggataagctaccaaaggcgaatgccataatatcttacaacaacaggcccgcaacagaggcagtaccctacttcgagcagttgggtcctctagtaagccaaatgatgcctatggtggaagcttctcctgtatcctccatggctaagagtgctgcagatgcctggaaagcagtgcttgatacagctgaagcaatggcacctgattatgatcctgaaactagggtctcgttggacaaatttgttgatcagctaccatcggttttcaatcaggttgctcaaggaatatcagaattcaaaccaacaccaactgaaaaccgagaatgttgcaagaattcatataatgtcccgaaaacactcctggtgaagttcaatactgatgccattgacgagacagatctccttgaggaaactttgaggcctcgtgtggaagctattggtggaacactggacattgtttcattgagtggtaaccatatcacaccatgcatccaggacccaaaattgcaagtaggtgatatatacactccagcagatgcgattgcacaaggactcaagaccctttcgctaaatgagacaaaaattcttgccagaaccattgtagactggtttagtagcatcaactagtaagttcagtgcggagattcagtaaatgtaaactaaacttagcttcaaccaaattttcggatcttgtatatattaatatagaagcaaccattgtgtgaatatagaccggaaacacatactttatttgcgag

SEQ ID NO: 4619 - DNA, 1424 bp, Chrysanthemum coronarium
agattgttaaacgatagtgaaaatggctatactatctactgggacgagtagatgtggctcaatggaactagttgcatcctcatttagtccactacatatactacgtgacagcgtgtatctcaatagtttgagttcccaaaggaagcagcaacggcctctctggtttagatattcttatgacagacttagtaaatcaggtgcttcaggtcgctcccccagaatgattttgaatgggtatgttgggagagacacctataggatgaaaaaggataacgatgagaagatgtataggaggcttgattcgtgtttggttattcctccacctaaaggaaagaagccgaaagcgattattaagttcctcggtggtgcgtttataggagcagttcctgaagttacatatggctatctgcttgggctgttggcaaatgaaggctatcttattatatctgtaccatataacgtgacgtttgatcactcacaagctgctagagaagtttttgagaggtttcattcctgcttgaattcagtgttaatgtatggattaccgagtgatggcctgctagcagctgagcttgttgatctccctctctattctgttggtcatagtaatggagccctactccaagtactgtctggaagctatttctcagataagttgccaaaggcgaatgccataatatcatacaacaacaggccagcaacagaggcagtaccctacttcgagcagttgggtcctctagtaagccagatgatgcctatggtggaagcatctcctgtatcctccatggctaagagtgccgcagatgcctggaaagcagtgcttgatacagctgaagcaatgacacctaattatgatcctgaaactagggtctcgttgaacaaatttgttgatcagttaccaggggttttcaatcaggttgctcaaggaatatcagaattcaaaccaacaccaagtgaaaaccgagaatgttgcaaaaatttgtataatgtccacaaaacactcctggtgaagttcaatactgatgccattgatgagacagatctccttgaggaaactttgaggcctcgcgtggaagctattggtggaactttggacattgtttcattgagtggtaaccatatcacaccatgcatccaggacccgaaactgcaagtaggagatatatacactccagcagatgcgattgcacaacgactcaagaccctttcactaaacgagacaaaaatccttgccagaaccattgtagactggtttagtagcatcaactagtaagttaagtcggagatttcagtaaatgtaaacgaaccttagcttccacaaaattgttggatcttatatatattactatagaagcaaccaatgtgttaatataaactcgaaacacctattcacctacaattgtgtaatgctcagtaaatttatc

SEQ ID NO: 4620 - DNA, 1222 bp, Chrysanthemum coronarium
agtacatgtggctcaatggaactagttgcatcctcatttagtgcacgacactgtgtgtatctcaagagtttaagctcccaaaggcagcatcagcggcctcgatggtatcgatattcttgtgacaaattaagtaaaataggtacttcaggaggccccccaaggatgcttttgaatggttatgttgggagagacacctataggatgaaaaaggataacgatgagaagatttataggaggcttgattcgtgtttggttattcctccacctaaaggaaagaagccgaaagcgattattaagttcctcggtggtgcgtttataggagcagttcctgaagttacatatggctatctgcttgggctgttggcaaatgaaggctatcttattatatctgtaccatataacgtgacgtttgatcactcacaagctgctagagaagtttttgagtaggtttcattcctgcttgaattcagtgttaatgtatggattaccgagtgatggcctgctagcagctgagcttgttgatctccctctctattctgttggtcatagtaatggagccctactccaagtactgtctggaagctatttctcagataagttgccaaaggcgaatgccataatatcatacaacaacaggccagcaacagaggcagtaccctacttcgagcagttgggtcctctagtaagccagatgatgcctatggtggaagcatctcctgtatcctccatggctaagagtgccgcagatgcctggaaagcagtgcttgatacagctgaagcaatgacacctaattatgatcctgaaactagggtctcgttgaacaaatttgttgatcagttaccaggggttttcaatcaggttgctcaaggaatatcagaattcaaaccaacaccaagtgaaaaccgagaatgttgcaaaaatttgtataatgtccccaaaacactcctggtgaagttcaatactgatgccattgatgagacagatctccttgaggaaactttgaggcctcgtgtggaagctattggtggaacactggacattgtttcattgagtggtaaccatatcacaccatgcatccaggacccaaaactgcaagtaggtgatatatacactccagcagatgcgattgcacaacgactcaagaccctttcactaaacgagacaaaaatccttgccagaaccattgtagactggtttagtagcatcaactagtaagttaag

SEQ ID NO: 4621 - DNA, 1262 bp, Chrysanthemum coronarium
tcaatggaactagttgcaacctcatttagtccccgatatacacaatatgaccgcatgtatttcaagagtttgagtacccaaaggcaacatcaacggcctcggtggtttggggtttcttatgacaaagtaagaaaattaggtgctccgggtcgctcattgaggatgatttggaatgggtatgttgggagagacacatacaggataaaaaaggataatgatgataagatttataggaggcttgattcgtgtttggttattcctccgcctaaaggaaagaagccgaaagccattattaagttccttggtggtgcgtttataggagcagttcctgaggttacatatagctatctacttgggctattggcaaatgaaggttatcttattatttctgtaccatataacgtgacgtttgatcactcacaagctgctagagaagtttttgagaggtttcattcctgcttgaattcagtgttaacgtatggattaccgagtgatggcctgctagcagctgagcttgctgatcttcctctttattctgttggtcacagtaatggtgccctactccaagtactcgttggaagctatttttcggataagctaccaaaggcgaatgccataatatcttacaacaacaggcccgcaacagaggcagtaccctacttcgagcagttgggtcctctagtaagccaaatgatgcctatggtggaagcttctcctgtatcctccatggctaagagtgctgcagatgcctggaaagcagtgcttgatacagctgaagcaatggcacctgattatgatcctgaaactagggtctcgttggacaaatttgttgatcagctaccatcggttttcaatcaggttgctcaaggaatatcagaattcaaaccaacaccaactgaaaaccgagaattttgcaagaattcatataatgtcccgaaaacactcctggtgaagttcaatactgatgccattgacgagacagatctccttgaggaaactttgaggcctcgtgtggaagctattggtggaacactggacattgtttcattgagtggtaaccatatcacaccatgcatccaggacccaaaactgcaagtaggtgatatatacactccagcagatgcgattgcacaaggactcaagaccctttcgctaaatgagacaaaaattcttgccagaaccattgtagactggtttagtagcatcaactagtaagttcagtgcggagattcagtaaatgtaaactaaacttaagcttcaac

SEQ ID NO: 4622 - DNA, 1366 bp, Chrysanthemum coronarium
ctcagactgtacgactaaagtgaaaatggctatactatctactgggactagtacatgtggctcaatggaactagttgcaacctcatttagtccccgatatacacaacgtgactgcgtgtatttcaagagtttgagtacccaaaggcaacatcaacggcctcggtggtttggggtttcttatgacaaagtaagaaaattaggtgctccgggtcgctcattaaggatgatttggaatggttatgttggaagagacacatacaggacaaaaaaggataatgatgataagatttataggaggcttgattcgtgtttggttattcctccgcctaaaggaaagaagccgaaagccattattaagttccttggtggtgcgtttataggagcagttcctgaggttacatatagctatctacttgggctattggcaaatgaaggctatctcattatttctgtaccatataacgtgacgtttgatcactcacaagctgctagagaagtttttgagaggtttcattcctgcttgaattcagtgttaacgtatggattaccgagtgatggcctgctagcagctgagcttgctgatcttcctctttattctgttggtcacagtaacggcgccctactccaagtactcgttggaagctatttttcggataagctaccaaaggcgaatgccataatatcttacaacaacaggcccgcaacagaggcagtaccctacttcgagcagttgggtcctctagtaagccaaatgatgcctatggtggaagcttctcctgtatcctccatggctaagagtgctgcagatgcctggaaagcagtgcttgatacagctgaagcaatgacacctaattatgatcctgaaactagggtctcgttggacaaatttgttgatcagctaccatcggttttcaatcaggttgctcaaggaatatcagaattcaaaccaacaccaactgaaaaccgagaattttgcaagaattcatataatgtcccgaaaacactcttggtgaagttcaatactgatgccattgacgagacagatctccttgaggaaactttgaggcctcgtgtggaagctattggtggaacactggacattgtttcattgagtggtaaccatatcacaccatgcatccaggacccaacactgcaagtaggtgatatatacactccagcagatgcgatcacacaaggactaaagactttttctctaaacgagacaaaaatccttgccagaaccattgtagactggtttagtagcttcaactagtaagttaagtacgatgattgtgtgaatataaacctgaaacgctcattcacctacaattgtgtaatgttcaagtaaatttattgcttccggaag

SEQ ID NO: 4623 - DNA, 1273 bp, Centaurea maculosa
ggcaatctatctatgggaaccggtacttatggctctaatggaactagcggtctttatttcattcagtccccgacatgcacaacgtgacgttatatatctcaaaagtttgagttcccagtggcagcagcaacggccttggcggtttggattttcttgtcataaaatacgtaatgtagatgcttcaggtcgctccttgaggatgatctcaaatggttacgttggacgagaaacctacagggtgaaaaaggataacgatgataaaatatataggaggcttgattcttgtttggtcattcctccgcctaaaggcaagaaaccgaaggcaatcattaaattcctcggtggtgcttttataggagcggttcccgaagttacctatagctatcttcttgggctattggcaaatgaaggctatcttattatttctgtgccgtataacgtgacttttgatcactctcaagctgctagcgaagtttacgagaggtttaattcgtgcctgaatttaatgttgacggctggattgcccaatgatgatctgctagcatccgaacttgttgatcttcctctttattccgttggtcatagtaatggtgccctactccaagtactcagcggaagctatttctcggagaggataccaaaggctaatgccataatatcatacaacaaccggccagcaacagaggcagtaccttacttcgagcagttgggtcctctagttagccagttgatgcctgttgtggaagcatctcctgtatcttccatggctaagggtgccgttgatgcttggaaggtactacttgatacagctgaagcgatgacacctgattatgatcctgaagctagggtttctttgaacaaatttgttgatcagttgccatccgtttttaatcaggttgctcaaggaatatcggaattcaggccaacgcccattgagaaccgtgaattttgcaagaactcatataatgtccggaaaacactgctggtgaagttcaatgttgatgcaattgatgaaacagatctccttgaggagactttgaggcctcgagtggaagccatcggtggaagactggataaagtttcgttgaatggtaaccatatcacaccatgcatccaggagccaaaactgcaagtaggtgacgtatacactccagcagatgcgattgctcaaggactcaagactctttcgctaaacgagaccaaaatcctcgccagaaccattgctgactggtcagcagcatcacgagtgaggaggtaaagtggctttttagcc

SEQ ID NO: 4624 - DNA, 1592 bp, Cichorium intybus
ctcatacttccacacaaacttccccttccaaaatccaaatcaaccactcctatcttctcctttctctagttttctgattccatttctgaaacaaatcgtcaattgcaacacactcgatttcgttggccatttgtagaacgttaacggttaactctacgtagtaacaatgtctataacatctatgggaaccagtacttgtggctcaatggaactggctgcatcttcatttactcccaagaattttttgagtgccaggtggcagaaaaaacagacacattggtttggattttcatgggacaaaatgtgtaatttaaaatcttcaagtcgttcattgaggatgatttcaaatgggtatagtggaagagacatttacaaaatgaaaaaagataatgatgataagatatatagaaggctcgattcttgtttagttattcctccacctaaagggaaaaagccaaaagcaattattaaatttcttggtggtgcctttattggagctgttcctgaagttacttacagctatcttcttggactattagcaaatgaaggctatcttattatttcagtgccatataatgtgacttttgatcactcacaagctgcaaaagaagtttatgagagatttcattcatgtttaaattcaatattaacatctggattgccaaatgatgacgtgtcaccatttgaccttgttgaccttcctctttattctgttggtcatagcaatggagctctacttcaagtactctctggaagctatttcacagacaagattccaaaagctaatgccataatatcatacaacaacaggccagcaacagaggcagtgccctactttgagcagttgggtcctctaatgagccagttgatgcctgttgtggaagcatctcccgtgtcttctatggccaagggcgctgcagatgcgtggagagtattgcttgatacagcggaagcaatgacacctgattatgatcctgaaactagggtttcattaaacaaatttgttgatcaattgccatcggtttttaatcaggttgctcaaggaatatcagaattcaagccaacacctagtgagaaccgcgaatgttgcaagaattcgtataatgtccggaaaacactccttgtaaagtttaatttcgatgccattgatgagacagatctacttgaggagactttgaggcctcgtgtggaagctatcggtggaacactggataaaatctctttaaatggtaaccatatcacaccatgcattcaggaaccgaaactgcaagtgggtgatgtatacactccagcagatgcaatcgcacaaggactcaagactctttcactaaacgatactaaaattcttgctacaactatctcagactggttcactagcatcaacaactagacaagtgccaacattgcattgcatatatatttatactaatacacatcaatcatgttaatattaacattagtgataaatgtaatattgcttacataacctcaattcccactagacttatttgaccttggggaatcgatcaatattcaattatttggaaggtgaaatatgaacatgacctagacaaatgtgaatatttttatcc

SEQ ID NO: 4625 - DNA, 1437 bp, Cichorium intybus
agtaataatgtctataacatctatggggaccagtacttgtggctcaatggaactggctgcatcttcatttactcccaagaattttttgagtgccaggtggcagaaaaaacagacacatttgtttcgattttcatgggacaaaatgtctaattttaaaccttcaagtcgttcattgagaatgatttcaaatgggtatagtggaagagacatttacaaaatgaaaaaagataatgatgataagatatatagaaggcttgattcttgtttagttattcctccacctaaaggaaaaaagcctaaagcaattattaaatttcttggtggtgcctttattggagctgttcctgaagttacttacagctatcttcttggacttttagcaaatgaaggctatcttattatttcagtgccatataatgtgacttttgatcactcacaagctgcaaaagaagtttatgagagatttcattcgtgtttgaattcaatattgacatctggattgccaaatgatgacgtgtcaccatctgagcttgttgatcttcctctttattctgttggtcatagcaatggagctctacttcaagtactctctggaagctatttcacagacaagattccaaaagctaatgccataatatcatacaacaataggccagcaacagaggcagtgccctactttgagcagttgggtcctctaatgagccagttgatgcccgttgtggaagcatctcccgtgtcttctatggccaagggcgctgcagatgcgtggagagtattgcttgatacagcggaagcaatgacacctgattatgatcctgaaactagggtttcattaaacaaatttgttgatcaattgccatcagtttttaatcaggttgctcaaggaatatcagaattcaagccaacacctagtgagaaccgtgaatgttgcaagaattcgtataatgtccggaaaacactccttgtaaagtttaattttgatgccattgatgagacagatctacttgaggagactttgaggcctcgtgtggaatctatcggtggaacactggataaaatctctttaaatggtaaccatatcacaccatgcatccaggaaccgaaattgcaagtgggtgatgtatacactccagcagatgcgatcgcgcaaggactcaagactctttcactaaatgatactaaaattcttgctacaactatctcagactggttcactagcatcaacaactaagacaagtgccaacattgtattgtacatatatattaatattaatacagaaacatcaatcatgttaatattaacattagtgaaaaatgtaatattacataacctcaattaccactagacttatttgaccttggggaattgatgaatatccaattatttggaaggtgaaatatgaacatgacctagacaaatgtaaatatttttatccg

SEQ ID NO: 4626 - DNA, 1553 bp, Cichorium intybus
tttagttactctcttattggttaaaaacattttgcggcttgtaatgatgcccgtcctctattgacctcccgcgcggaattgcaaatgcggtaatatccccgccttcgtgtctccttcagtaacaatgtctataacatctatgggaaccagtacttgtggctcaatggaacttgctgcatcttcatttactcccaagaattttttgagtgccaagtggcagaaaaaacagacacattggtttaaattttcatgggacaaaatgtgtaatttaaaaccttcaagttgttcattgagaacaatttcaaatgggtatagtggaagagacatttacaaaatgaaaaaagataatgatgataagatatatagaaggcttgattcttgtttagttattcctccacctaaaggaaaaaagccaaaagcaattattaaatttcttggtggtgcctttattggagctgttcctgaagttacttacagctatcttcttggactattagcaaatgaaggctatcttattatttcagtgccatataatgtgacttttgatcactcacaagctgcaaaagaagtttatgagagatttcattcatgtttgaattcgatattaacatctggattgccaaatgatgatgtgtcaccatttgaccttgttgaccttcctctttattctgttggtcatagcaatggagctctacttcaagtactctctggaagctatttcacagacaagattccaaaagctaatgccataatatcatacaacaacaggccagcaacagaggcagtgccctactttgagcagttgggtcctctaatgagccagttgatgcctgttgtggaagcatctcccgtgtcttctatggccaagggcgctgcagatgcgtggagagtattgcttgatacagcggaagcaatgacacctgattatgatcctgaaactagggtttcattaaacaaatttgttgatcaattgccatcggtttttaatcaggttgctcaaggaatatcagaattcaagccaacacctagtgagaaccgcgaatgttgcaagaattcgtataatgtccggaaaacactccttgtaaagtttaatttcgatgccattgatgagacagatctacttgaggacactttgaggcctcgtgtggaagctatcggtggaacactggataaaatctctttaaatggcaaccatatcacaccatgcatccaggaaccgaaactgcaagtgggtgatgtatacactccagcagatgcgattgcacaaggactcaagactctttcactaaacgatactaaaattcttgctacaactatctcggactggttcactagcatcaacaactaatacaagtgccaacattgcattgtatatatatattaatattaatacaagaacatcaatcatgttaatattaacattagtgataagtgtaatattacataaatttaattcccactagacttatttgaccttggggaattgatgaatatccaataatttggaaggtgaaatatgaacatgacctagacaaatgtgaatatttttatcc

SEQ ID NO: 4627 - DNA, 1485 bp, Ambrosia trifida
aaacctctgcgttgccactcttccacacacacatactcgccctctcatatcaactccttcagaacaaatggttatcgcgtctactagaattggtacttgtggctcaatggaactagctccagcttcattcagtacgcgacatgtaggtcgtgactgtgtttatctcaaaagtattagttccccgttgctgcagaagcagcctcggtggtttggttttctcgtgacagaaatagtaccttcagtcattcagcttgctctttgaggatggtttcaaatgattatgttggaagaagcacctacagaattaagaaggataatgataataaattatataggaggcttgattcttgtttggttattcctccacctaaaggcaagaaaccaaaagccattattaaattccttggtggcgcctttataggtgcagttccggaagttacctatagctatcttcttgggctattggcaaatgaaggctatcttattatatctgtgccgtataacgtgacttttgatcactcacaagctgctagagaagtctatgagaggtttcattcctgcttgaattcaataataacatcaggactgcccgatgatggtctattagcatcagaacttgtcgatcttcctctttattctgttggtcatagtaatggtgccttactccaagtactcagtgggagctatttttcagataagctaccaaaggctaacgccataatatcatacaacaacaggccagcaacagaggcggtaccctacttcgagcagttaggtcctctagtaagccagttgatgcctgttgtggaagcatctccggtatcttccatggctaagggtgctgcagacgcctggaaagctctgcttgatacagcccaagcaatgacacctgattatgatcctgaagctagggtttcattggacaaatttgttgatcagttgccttcagtttttaatcaggttgctcaaggaatatcagaattcaagccaacaccaactgagaaccgtgagtgttgcaagaacatgtataatgtcaagaaaacactcctggtgaagttcaatgttgatgccatagatgagacagatcttcttgaggagactttgaggcctcgtgtggaagctataggcggaacacttgagaaagtctcattgagtggtaaccatatcacaccatgcatccaggaaccaaaactgcaagtaggtgaggtatacactcccgctgacgcgattgcacaaggacttaagaatctttccctaaacgagaccaaaatcatggccagaaccattgtagactggtttagcagcatcagttagtaactaactgtaagtgctaatgtttagaaactttaatagcgtcagccacattatgtgaatattcacgtgaaacacacgtatatctacatgtagtaaattaaattgccaccatacttcatttgatttgaccttggggatcaatagaagatgcggattatagttgaaaaagaa

SEQ ID NO: 4628 - DNA, 2281 bp, Arnica chamissonis
cacttctctctgtctgtgtctctttcaatgctgggcacttctactgttctctgaattccgggcagttcgggcagtctcatagttattgtgattttgaatttctggaccctacgaaaatctggtcttgggatcatctctgatcatatttcctggaatttgtatcatcatgacacatccatgacatgttttcagaaagttgaataaaaagatttgaagaaatgtcatcttacataacaagttcagaaaatggaagagattcagctccattgctctacttaagcgaacctctgtcgcaatcttactcgtcggaatcacccattcttcccggaaacgagatgatgtatatgaacttttcatcagcttcagccggagagttttccggttcactggctggaaattcccagcagctcaacacctgcattgacatacccagcataggagtgcacgattccagtgttgtatcgcatcaacaattcctctcgagcattggcgaaccatggagagatggtaggaatcatgaaatgatgttaatgggtcaaatgggtcgtcagaatttgcaaggacaagggcaggggcagggactgtcactgagtcttggttcgcatattctgccagccgggtttcaattccattccggtgattacaggaatcccgacatggggttctcttcatttctgagtgcagattccgactcaatcaaaacagatgtttctccatatggaatcaggagtgtttcaagggagattactgattccaagtacctaaaagcagggcaacaactgcttgacgagatcgttaacgttggtaaagctttaaaacagcataattctgggaaagaatctatggattattcaaaagggatcgatggtgaatcgaagaacgtaacgtcttcgaatcaacaagaatcaaacgaactctcggatgctgaaaaacaggatttgcagaacaagatgacgaagttaatctcaatgctggaggaggttgacagaaggtacaaacaatactatcatcaaatgcagactgttgtatcagcatttgatgtgatcgtggggtttggggccgctaagccctacacagcactcgctctacaaacgatttcccgccatttccgttgtttgagagacgcgataagtggtcagataaaagcgactcagagaatcctcggcgagactgattccaccacaaatgagaaaggagttgggatttccaggcttcggtttgtggatcgacagctcaggcaacaacaagcccttcagcagctcggtatgatgcaacaacatacttggagaccacaaagaggccttccggaaacctctgtgtcgattcttcgtgcttggttgtttgagcattttcttcatccgtatcctaaagattcagacaagatcatgctagcaagacaaacagggttgaccagaagtcaggtctcgaactggtttataaacgcaagagttcgcctatggaagccgatggtggaagaaatgtacaaagaggaagctggagatgatgaaatagaatcaaattcttcaacagatattgcacccaaaaacacgataggtgatagaaccacttcggttgaccaagaagatatgaaccagagcactgcagcctcgggatttgactcaaaatcatcaaatcaagctcctggtgttgaaataataggaaccaacaacgacccagatttccaacacatgatggttcggtctaacatcagagatgaacaccagcggcttacggctgcagtatatcagatgccaccaaggtttggaaatgggaatggaggtggggtgtcgcttacactagggttacaacactctgaagatggaaacttaccaccaatggcttctcatggaagccatcaacacagttttacagatataagaagcggcagtaacggtggtgcggatgacaccggcgctggttcatcgctggggccagaaacggttgattttaacagtgcagattcagataaccaacaacaaggaatcggatcttctcacttgttacatgattttgtagcatgagagaacattgtggctttattcaaatgaccattttgttgaacttcttgatctattatcaagtggtgtgaagaaaaccagatgtgaaacagaaattaaatgtataactgtaaagataagatgcatatattttctttatgataataacaataataacaatgtagatttgacttgtacattatcaattcttaccatttcatggccaagaattggttgacatttcaagtaaaataaagattcaaaaatgggaaaagattaaaggt

SEQ ID NO: 4629 - DNA, 2216 bp, Echinacea purpurea
ttgggatcatccttgtacataatttgttccccacaaccgcacaccatgacataatttcagaaagttaacaaaaagatttgaagaaatgtcatcttatataagaagttcagaaaatggaacagattcagctccgatgcactacttaagagaacctctaccgcaatcctactcatcagaaccacccattctcgctagaaacgagatgatgtatatgaactattcttcaccagcttcaaccgaagagttttccggtacattggcagaaaattcccaacaactcaacagctgcattgacattccaaacaccggaattcatgattccagtgttgtatcacatcaacaattactttcgagcattggcgaaccatggagagatggtagggatcatggaatgatgttgatggatcaaatgggtagtcaaaatttgcaaggacaactatcactgagtcttggttctcgtattcaaccggctggaatccaattacattccggtgattacgggaatcccagcatgggtttctcttcatttttgagtgcagattctgactcgatcaaaacagatgtttctccttatggaatggggaatgtttcaagggcgattactgattctaagtacctaaaagcagcacaacaactgcttgatgagattgttaatgttggtaaagctttaaaacaacataattccaagaaagaatccatggattataagaaagaaattgatggcgaattgaaaaacgtaacctcttcaaatcaacaagaattaaatgaattatcggctgctgaaaaacaggatttgcagaacaagatgatgaagttaatttctatgctggaagaggttgacagaaggtacaagcaatactatcatcaaatgcagattgtggtatcagcatttgatgtggtggcgggatgtggggccgcgaagccctacacatcactcgctttgcaaacaatttccagccattttcgtagtttgagagacgcgataaacggtcaaataaaagcgactcatggaagcctaggggagactgattccaccacaaatgggaaaggagtcggaatttccaggcttcggtttgtggatcaacagttgaggcaacaaagagcccttcagcagctcgggatgatgcaacaacatacctggagaccgcaaagagggcttcctgaaacctctgtgtcaatccttcgtgcttggttgtttgagcattttcttcatccgtatcctaaagattcagacaagataatgctagcaaggcaaactgggttgaccagaagtcaggtctcaaactggtttataaacgcaagagttcgtctatggaagccaatggttgaagaaatgtacaaagaggaagctggagatgctgaaatggaatcaaattcttcatcagaaatcacacccaaaatcacgaaagcctataataagacttctgttgaccaagaagatcagaaccagtgcaccacagcctctggatttgactcaaatcaagctcctaatgttgaattaataggaaccagcaatgactcagatttccaacacgtgatggttcagtctaacagaggtggggtgtcacttacactagggttacaacacactgaagataaccaacaacaacagcagcagcaacaagaacaaagatttgaatcttctcacttgttacatgattttgtagcatgagagaacaatggtgggtggctttattcaaatgaacattttgttaaacttcttgatctagtatctagtgtgaaggaatgtaaaacagaaactaaatgtatactgtaaagataagatgcataactttatcatactatttcaaaattgccattatatgcaaggcatgataatttacatccaacaacactggattacaatatacaaaccaaaagccaaatattttggcttccaaacaacaataaattcgagcgcagagaaatatcataatggttcgcctcatcactcatcatgatcttttatataatgcagttacatcttcattcaaccatggagtttcaagaaaccaatcaccacaaccatttacatcagttttcttcatcccaaagtcattttggccacagtactcactatattcaaaccacatttttgcaatggactcctttctaaaacatgtagtatgatctttctcttcaggagaacccgcagcaactaatcgataagtgtacaccttcctcacctgtcccggtcgaaaagcccgacctatggc

SEQ ID NO: 4630 - DNA, 1693 bp, Echinacea purpurea
ttttaatcccaaacatcaaaccctagagagagaaactcaaaatccacccacattttagagagagaaaaccaaaatcaagcagcattgaatccaattcatcccattttgatcctgtttccagattagcatcatgagttctctgaactatgatgcattgaatttgaatctgaatctgaagttcatattcatcaccattcttcttacctccattaacacatccgcattgacccatcaaaaccctaaatccaactcaacccagatcaactccaactcggtcctcgtcgcacttcttgactcacactacactgagttatcggaactcgttgagaaagcccttcttcttcaaacgctagaacaagcagtgtctcgtcacaatatcaccattttcgcacccaacaatgaagctcttgaacgccagatggatccggaattcaaacggttcttacttgaacccgggaatctgaaatcgttacagaatctgttgctgtttcacatcattccgtctcgggtcgggtcgaatgaatggtcaggtcatcataaaacgttatgtgtcgatgaggctgagaacagtttaccgttgacccgcggaaattccggcgagaaaattgtaggtggtctagcgaaactgacccggcccgacgacgttacccgacccgacgggttgatccatgggattgagagattgttagttcctcgatctgtgcaggaagatttcaaccggagaagaagcttgacatccatatccgcggttttacccgaaggagctccggttgtggatccgagaacccaccggttgaaaaaaccggctgctcccgttcccgccggtgcaccaccggtcctcccgatatacgacgcaatggcaccaggtccgtcactagctccagctccggctccgggacccggtggtccacgtcaccacttcgacggtgaaagtcaagtcaaagatttcatccaaacgcttctacattacggcggttataacgaactagcagacattttggtcaacctgacatctttagcgacggaaatgggacggttagtgtctgagggttatgttttaacggttttggcgccaaatgatgaagcaatggcgaaattgaccaccgatcagttgagtgatccgggtgcaccggagcagataatgtattatcatttgataccggagtatcaaacggaagagagtatgtataactcggttaggcggtttgggaaggtgcagtatgatacattaaggttgccgcataaggttatagctgaagaggctgatgggtcggttaagttcgggtcgggtgaggaatcggggtatttgtttgacccggatatatatacggatgggcggatatcggtgcaggggatcgatggggtgttgtttccggtggaggaggagaaggagaaggagaaaccggcgagtaaggtgtctccggtgacagcggttaaggtggttgctaagcaaagaagagggaaattattggaagtagcatgttcgatgggtggcgtattcggacgttttacaagttgttattgatatatacatacatatatattatgccaaaaaagtttaatattttaggatactgtgtggaaaataggacataaaagggaaacgaatggtgcagtttggcattgaaggaagtttccccagagaatcagattcagaccccttcacatgagaacaaactttatttttattttt

SEQ ID NO: 4631 - DNA, 1597 bp, Cichorium intybus
cccaaaacctagaaagagaaacgactactctcattcaataacatttctagagagagaaatagtaaaataaaggaatacccatctcctaatcatcgtcgtcttcttcttccaattctagttctgttttttgatcttttatttttctcacttcagcatcatgggttctcccaactatggtgcattgaagcttatattcttcacgtttcttcttatatccgttaatgcaactgcattgccgcatcaaaaccccaaatcgaactccacccagatcaattcaaactccgttctcgtagcgcttctcgattcgcattacactgagctatccgaactcgttgagaaagctcttcttctacagacccttgaggaagcggtttcgcgtcacaatatcaccatttttgcacccaacaatgaagctctcgagaggcagatggatcctgagttcaagcggtttctacttgagcctggaaatctgaaatcgctacagaatctgttgctttttcatattattccgtctcgggtcgggtcgaaagaatggccacgtgaggattttgaatcggtggctcatcataaaacgctttgtgtcgatgaagctgacaaccatttgccgttgacccgcgggaattccggcgagaaaatagtgggcggtctagccagagtcacccgacccgatgatgtcatccgacccgatggattaatccatgggattgagcggttgttggtccctcgatctgtgcaagaagattttaaccggaggaggagtttgacttccatttctgctgttttaccagaaggtgcacctgttgttgatcccagaacccaccggttgaaaaaaccggctactcccgttcctgcaggtgctccaccggttctccctgtatacgatgcaatggcacctggtccttctctagctccagctccagcccctggacctggtggggcacgccaccacttcgacggagagagccaggtcaaggatttcatccaaaccctcctacattacggcggatacaacgaattagcagacattttggtaaatttgacatcgttagcgacggagatggggaagttagtgtcggagggttatgttctaacggtgttggcaccaaacgatgaagccatggctaaactcaccaccgaccagctgagtgatccgggtgcaccagagcagataatgtactatcatttgataccggagtaccaaaccgaggagagtatgtataattcggtaaggcggtttgggaaggttcagtacgatactctgcggttaccgcataaagttgtggctgaggaggccgatggatcggttaaattcgggcaaggtgaggggtcagcgtatttgtttgacccagatatttacaccgatgggaggatatcggtgcagggtattgatggggtattgtttcctgtggaagagacgacggaaaaaccagctagcaaggttgcgccgtcgacggtgcctaaggtcgtggctaagcaaagaagagggaaattattggaagtggcatgctcgattattggagcattcagacaagattcttattttacaagttgttattgatatatatacacatatataattaagatataaagcatgtgt

SEQ ID NO: 4632 - DNA, 1482 bp, Ambrosia trifida
tatcaaacctagagagagaaaccaataccacaccaacatttctagagagagaaactacaattcatcatctcattgttgcacacctttaaactttccaaccttgaccttctctccatattttagcatcatgagttctatgaactatgatgcattgcatttaaatcctatattattattattattcactattcttcttacttcaatcaacgcaactgcattgaccaatcaaaacgctaaacccaactcaacccagatcaactccaactcggtcctggtggcgcttcttgactcacactacactgagttatcagaactcgttgaaaaagctcttcttttacaaaccctagagcaagcagtatctcatcacaatatcaccatattcgcaccaaacaatgaagctcttgaacggaatatggatcctgaattcaaacggtttttacttgaacccggtaatttaaaatccttacaaaaacttttactttttcacattattccgtctcgggtcgggtcaagagaatggccgggtcaagatgctggatcagtaacccatcataaaactctgtgtgttgaggaacccgacaaccgtttaccgttgaccattggaaattcaggtgagaaaatagttggcggtctagctaaaataacccgacccgatgacgtgacccgacccgacgggttgatccacgggattgaacgattgttggtgcctcgatctgtgcaagaagaatttaacaggagaaggagtttgacttctatatcagcggttttacccgaaggagctccagttgtggatccgagaacacaccggttaaaaaaaccggctccggttccagccggagctccaccggttctaccgatatatgatgcaatggcaccgggtccatcgctggctccagcgccagcgcctggacccggtgggccacgtcatcattttgatggcgagagtcaggtcaaagattttattcaaacgcttctacattacggtggatataatgaattagcggatattttggtcaacttaacgtcgttagcgacggagatggggaggttagtgtctgaaggttatgttttaacggtgttggccccaaatgatgaggcaatggctaagcttactactgaccaattgagtgatcctggtgcacctgaacagataatgtattatcatttgattcctgagtatcagacggaagagagtatgtataattcggttcgacggttcgggaaggtgcagtatgatacattgaggctgccacataaggtggtggctgaggaggctgatgggtcggttaagttcgggtcgggtgaggggtcggcttatttgtttgatccggatatttacaccgacgggcggatatcagttcaggggattgacggtgtgttgtttcccatggaagagacgacggagaaacctgtcggtaaggtttctccagcaacgacggctaaggtcgttgctaaacaaaaaagaaaaagtaaccgactgcg

SEQ ID NO: 4633 - DNA, 2087 bp, Lactuca sativa
caaacacttatgtcggtttactttacatttaactttctatttttgttatttagcggctagagcctagaggcaagccaagccgtttgagagccgaagcaggatgctttcttccacacgtgtggtccctacatacagcctgtgctaccctacgccttcttcctaactcgtaaaacggcatcggggcatgtcgtttcacttaccttctctgtttttctaccacctgtcctgtctcccactctcttttaatcccaaaacaaaacccatcttccccttttcattctcacctctcaccactatgtccaaaaggaccaaaacctagaaagagaaacgacaattcccattcaattacattatttctcgagagagagaaagagtaaaataaaggagtacccatctcctaatcatcctcgtcttcttcttcttccgattcttcttctgcttttgatcttttgtttttcctagttcagcatcatgggttctctgaactatggtgcattgaaccttatattcttaacgtttcttcttataaccattgattcaactgcattgccgcatcaaaaccccaaatctaactccacccagatcaattccaactccgttctcgtagcgcttctcgattcgcattacactgagctatctgaactcgtcgaaaaagctcttcttctacaaaccctcgaggaagcggtttcgcgtcataatatcaccatttttgctcccaacaatgaagctctggagaggcagatggatcctgaattcaagcggtttctactcgagcctggtaatctgaaatcgctacagaatctgttgcttttccatattattccgtctcgggtcgggtcgaaagaatggccacgtaaggattttgaatcgatagctcatcataaaacgctttgtgtcgatgaagctgacaaccatttgccgttgactcgcgggaattccggcgagaaaatagtgggcggtctagccagagtcaccaggcccgatgatgttatccgacctgacgggttgatccatgggatcgagcggttgttggtgcctcgatctgtgcaggaagattttaaccggaggaggagtttgacttccatttctgctgttttaccagaaggtgctcctgttgtcgatcccagaacccaccggttgaaaaaaccggctacccccgttcctgcaggtgctccaccagttctccctgtatacgatgcattggcacctggtccttctctagctccggctccagccccgggacccggtgggccacgccaccacttcgacggcgagagccaggtgaaagatttcatccaaaccctcctacattacggtggatacaacgaattagcagacattttggtaaatttgacgtcgttagcgacggagatgggtaagttagtgtcggagggttatgttttaacggtgttggcaccgaatgatgaagccatgtcgaaactcaccaccgaccaactgagtgatccaggtgcaccggagcagataatgtactatcatttggtaccagagtatcaaaccgaagagagtatgtataattcggtaaggcggttcgggaaggttcaatacgacactctgcggttgccgcataaagttgtggcggaggaggccgatgggtcggttaaattcgggcaaggtgagggatcggcgtatttatttgacccggacatttacaccgatgggaggatatcggtgcaaggtatcgatggggtattgtttcctatggaagagccgacggaaaaaccagctagcaaggttgctccaacgacggcgcctaaggtcgtggctaagcaaagaagaggttcgctttcttacttttaatcttcctggtatattattaatgccgtcattcgattacaataatctgatcggacctgttgcaagaactttccgttgagtggttgccggaataagtttaatggttgtctgttgtggtgggtcacatggaattattcgtccgcgtctattgcactcatacgactttatagtttatactcatgaaacttaaaagagtagattacccctttcatagcataaggtacaactgagcgaggcttgattttgttagccaatttggtaacctttttttt

SEQ ID NO: 4634 - DNA, 2196 bp, Lactuca sativa
cacttttttacttgacaaccatttttaaaatttgttaaaagatgattattttcttataattcgttagattatttcatttctgaaatatatatttttttcctaattcatgcaattccagagaataggaaaaaggcttagccactatgagctgggaagccatacaagaaccgcaaaaaggctttttgtccaccgtgtgggacccatcctgtcagccagcctgtgttttcccttcctaactcataaaacgacaccaccgcttgccgtttcgtttttctctctcatcttaccacctgaacccgctgttttaatcccatcttccatttaattccactcaaaccctatagagagagaaaccagtttttagcaaagggaaagtgcaaaattttataaaaacacgacacacattttcgtcaaatctatagaaagaaagtgttctcgaatctcaagtagtcaagttcatcatcatcttcttcaggtaatctgtaatcttgtaaatttctcccacttaggcgccatggattctcagatctatggtgcattaaacctcatcgtcttctttctcgccattaatgtaaatgcattgacggcacaaaaccccaaatctagttctacccagattaattccaactcggttctggtagcacttctcgattcacactacacagagctatcggagctcgttgagaaagcacttcttctacagacgctggagcaagcggtttcgcatcacaacatcaccattttcgcacccaataatgaagctcttgagagacaaatggatcctgagttcaaacgcttcttgcttgagccccggaatctcaagtctctacagaatctattgctttaccatataattccgtctcgggttggggcaaaggaatggcctgaacaagaagttgttcaccatcagacgctttgtgttgacgaatccgacaaccgcttgccgttgacacgagggaattccggcgagaaaatggtcggtggtctagctagagttgttcgtcccgatgacgtcatccgagccgacgggttgatccatgggattgagcggttgttggttcctcgatcggtgcaagaagattttaatcggcggaggagtttgagttctatttctgctgttttaccggaaggagctcctgttgtggatccgagaacccaccgtttaaagaaatcagctactccagctcctgccggtgccccaccggcacttccggtatacgacgcattggccccgggcccttctctagccccagctccagccccaggtcccggtggtccccgccaccacttcgacggcgagagccaggtgaaagatttcatccaaacgctactccattacggtggctacaacgaattagcagacatactggtaaatctaacgtcgttagcgacggagatggggaaattagtgtctgagggttatgttttaactgtgttggcacccaacgatgaagccatggctaaacttaccaccgaccaactcagtgacccgggtgcaccggagcagataatgtactatcatataataccggagtatcagaccgaagaaagtatgtacaactcagtacggcggttcggaaaggtccgatatgatacactccggctaccacataaggtggtggcggaggaggctgatgggtcagtgaagttcggtcaaggcgaggagtctgcgtatttgttcgacccggatatttacaccgacgggaggatatcagtgcagggtattgatggagttctatttccggtggaggaaacgacggagactccgtctagcaaggtggcaccgacgacggcgccgaaggttgtctcaaagcaaaggagagggaaattaatggaagtggcatgtacattagctggagcacttggacagagttgttaatttgtttttttatattcaaagaaaattacaaaaaaatgaaaagaaatcaaatacagcgttgcagagaaagttatattaggaaagattctgtccaaatactatagataaaagggaagtggacggtgcagattacatttccctagacgatgaacaaagtttgccttttttttgaagaattattttattttattactataaaactgtaattactataaatgattttttgatgtatttattttgtttttcgataaatatacaaatgtgtctttttaatctaccgagcaaagatgaaaattatatatcgatcttattttaat

SEQ ID NO: 4635 - DNA, 1667 bp, Echinacea purpurea
aaaaagaatagttttagagccaagccaagctgagccgtataagccgactcactcagctttcaactttcacctttctcccactcgtgtggcccctacatccagtctgtacaccttcatcctaactcataaaacgacactcataattgccgtttcaccacctgtcctgtctctccctcttttaatcctctgcaccaaaaaaccccctctctccaaaacctagagagagaaacaaagaaaccaacaaaccaaacaacccccatttccaattctagagagagaaaccacaccatcttcttcttctgatctcatctccacttttgcatcatgggttctctgaactatgatgcattcatccccttactctttacaactttcattctagttcaaacctccattatcaccaccgcattgcctgttcaaccggctcaaccgcttcaaacccacatcaattccaactcagtactcgttgcgcttctcgattcgcactacactgagttatctgaactcgttgagaaagctctgctgttacaaaccctagaacaaactgtttcaacacagaatataaccattttcgcaccagacaatgaagctctggagcggcaaatggatccggagttcaaacggttcttactcgagcctcggaatcttaaatcgcttcagaatctgctgatgtttcatatcgtcccgggtcgggtcgggtccggtgaatggtctgggcaccataaaacactctgtgtagatgaatccgataatcgtttaccgttgacacggggaaaaaccggggagaagattgtaaacggtgtagcgaaactgacccggcccgatgacgtcatccgacccgacgggttgatccatggaatcgagagattactggtgcctagatccgtacaagaggactttaaccggagaagaagtttgacttcaatatccgcggttttaccaaccggagctccggaagtggatccgagaacacaccggttgaaaaaaccggctgctcctgttcccgccggttcgccaccggttctcccggtttacgacgcgatggctccgggtccgtcgctagctccggcgccggcaccgggacccggcggtgcacgtcaccatttcgacggagaaagtcaggtaaaagatttcatccaaacgctactacattacggcggttataatgaactagcagatattctagtgaacttaacgtcgttagcgacggagatggggaaattggtatccgagggttatgtcttaacggtgttagcaccgaatgatgaggctatggcgaaattgactactgatcagttgagtgatccaggtgccccagaacagataatgtattatcatttgatacccgagtatcaaacggaagagagtatgtataactcggttaggcggtttgggaaggtgcagtatgatacattaaggttaccacataaggttatggctgaagaggctgatgggtcggttaagttcgggtcgggtgaggggtctgcgtatttgttcgacccggatatttataccgatggaaggatatcggtgcaggggattgacggggttttgtttccggtggaggagacgacggagaaacctgcgagtaaggttgctccggcgacggcgactaaggtcgttgctaagcaaagaagaggaaaattattggaagtagcatgttcgat

SEQ ID NO: 4636 - DNA, 1406 bp, Chrysanthemum coronarium
ttcaacacaaaaacaacacaaaatctttttattttgatcttcttacatatctagcatcatgagttctaacaagaactatgatgcatttgttcttgttacattttttattactacaatgttgtttttcaactcatcaacaaccgcattgacccaaatcaattccaactcggtgttagtcgcgcttcttgactcgcactacaccgagttatccgaactcgttgaaaaagcacttttattacaaactttggagaaaacggtgtcgtttcataatattactattttcgctccgagtaatgaagccttggagagacaaatggatcctgagtttaagcggtttttacttgaacccgggaatctcaagtcgttgcaaagcttgttgttgtaccatattatcccgggtcgggtcgggtcaagtgagtggaaaggtgtgcacaagacattgttggtggatggaatggatagtcatttaccgttgacgatggaatctaatgagaaggtagtcgggtcagcgagagtgacccgacccgatgatttgatccgacccgacgggttgatccacgggattgagcgtttactagtgccgagatccgtacaagaggatttcaacaaacgacgtagtttaacctcaatatccgcggttttacccgagggtgctccagttgttgaccctagaacccaccgtttgaaaaaacctgccccggtgccagccggggcacccccggtcctgccggtgtacgacgcactggccccgggtccctcgctggcgccagcgccagctccaggacccggtggggcccaccgtcatttcgacggtgaggcccaggtaaaagactttatacaaacactcctacattacggagggtataatgaactagctgacattctagtcaacttaacttcattagccaccgaaatgggtaaactggtatcagaagggtatgttctaactgtcctggcacctaatgacgaagcaatggcgaaattaacaactgatcagttatccgacgttggtgcacctgagcaaataatgtattatcatatcataccagaatatcaaacagaagaaagtatgtataattctgtcagaaggtttggcaaagtgagttatgatagtttgaggttgccttataaagtggtggctgaagaggctgatgggtcggttaagttcgggtcgggtgatgggtcggcttatttgtttgacccggatatttatactgatgggaggatatcggttcaagggattgatggtgttttgtggcccgaggagagtaaggagaaagatgtgggaaaagcgcccgtggcggcgcctaaggtcgttgctaagcaaagaagagggaaattattggaagtagcatgttccattgctggaacatttggacattttacaaggtgttattgatttatac

SEQ ID NO: 4637 - DNA, 1778 bp, Lactuca sativa
aaccgctataacatgttatttgttcacgggcttttgtctcctccactccttttccaaacgaaacgacaacacatcctgccgtttcattctctctcttcccccacctgccttcttcactccgccataaccaaaacctagagagagaaacaactccattaacagttgttgatattttcactagagagagaaatcagaaaacagagtaaacccacattttccccgtctcaatattgtcttcaatcttgatattttcacagattagcaccatggattttcagatctatggtgcattggggatcttatttttcatattttatctcataccacctgcatccatcaatgcaactgagatacctcaacaacacaccaaatctagctctacccagatcaattcaaactcggttctagtcgcgcttctggattcgcactacactgagctatccgagctcgttgagaaagcccttcttctacagacccttgaggaggcagtttctcgtcataacatcaccatttttgctccgagcaatgaagctttggagagacatttagatcctgagttcaaacggttcttacttgaacctgggaatctcaaatctctacagaatctgttgttatttcatatcattccgtctcgggtcgggtcgaaggagtggccggaagaggatttagcatcagtagcgtatgaaacactgtgtgttgaggaagctgagaatcatctgccgttaacccgagaaaactccggtgagaaaatagtggtcggtttagctaaagtaatccgtcccgatgatgtaatcagaccagatggggtgattcacgggattgagagattgttggtgccccgattagtacaagaagagtttaaccggaggagaagcttgagttcaatttcagctgttttacccgaaggagctccggtggtggatccgagaaccaaccggttgaagaaaccagccactccagctcccgccggtgctccaccagcactaccggtatacgatgcgatggctccggggccttctctagctccggcaccagcaccaggtccaggcggaccccgccaccacttcgacggcgagaaccaggttaaagacttcatccaaacactcctccattacggcggctacaacgaattagcagacatattggtcaatttaacgtcattagcgacggagatgggtaagctggtgtccgaaggttacgttttaacagtcttagctcccaacgatgaagccatggctaaattgacaacagaccagttaagcgaccccggagcaccggagcagataatttactaccatttgatcccggagtatcaaacggaggagagtatgtacaactccgtacggcggttgggtaaggttcagtatgatacattgcggctgccgcataaggtggtggcggaggagggtgatggatcggtgaaattcgggcaaggggaggagacagcttacttgtttgacccggatatctacaccgacggaagaatatctgtgcagggtattgatggggttttgtttccgttcgagcagacggtggaaaaaccggccagcaaggttgctccggcgccgccgacgaagaagatcgcggctgagcaaaaaagaggtgtgtttactgtttactgtttattccttctaaattctaatccccattaattaatgcttttttttgccaaattcatgttagaattgatgatcagagtcgataataacagcttgaaagaaactatcaaacagattaacattttggaaattaccttcatttgttcttattgaaaacag

SEQ ID NO: 4638 - DNA, 1234 bp, Solanum phureja
ccctagttaagcggcaagtttttctatataaagccctctaaaaccctctctcataccgccctctataatctttgctcttcgcatagcagtcttttttgctctcttacttcgcccccaatttttttgagctttcaaacaaacaatcatcaatggagttttggggtgttgaagtgaaagcaggacaaacactaaaggttaagcctgagcttttcaagctcattcatgtttcccaggctgccatcggtgaagtgaaggatgtcaaagaagccaaatatgttccactacgcctaactgttggagataacagttatgtcattggaactctatccgctgaggatagacctcagttgatgtttgacttggtctttgaaaaggagtttgaactttcacatggatggaaaaatgggagtgtgcacttcattggatacactgctgatgatcctagcggtgatgaaatcgactctggagatgatgttttttcagatgaagagaatgttttggaggcactgaatgggaaacttgaggctgatgtgaaggatgtaaagcctgatgcaaagaagtctgcacctgttaaggatgagaaaaatgctaaggtagctgaatcaaagaaagaggcggagtctgatgaagatgactctgatgatgaagatgattctgaagatgactctgatgtgcctctaggcatggatggtccagaagggatggatttttctggtgattctgaggatgatgatgattcagaagaagagacacctaaaaaggttgagcagaagaagagaccagctccatctcctcaagtagctcctggctctggcaaaaaagctaaacaagcaacacccgacaacaagtcaggcggtaagaaaggtccagccaccccgtttgctaagcaaaatggtaaacctgcattcaatggtaacaacaaaccaaaaactcagtccccgaaatctggtggtcagttctctggcaacaaatctaacaacaagaacttcagtggccaaaagaatttcaagggcaagcaaggaaggaagtagagggcttgaaagatctttttgaagagcaaagattttactttttatttatagatgtttggtctctatggtttaagctattttccttagttttagtaggtcaatttttgatgaatgtttttgttaccagaaagttttgcccctatctatattcattactttcattatatcttcctttaatcttatgacttcttagtttattgttt

SEQ ID NO: 4639 - DNA, 1219 bp, Solanum tuberosum
cctattagcggcagcttttctatataaagcctctaaaaccctctctcataccgccctctataatctttgctcttcgcatagcagtcttttttgctctcttacttcgcccccaatttttttgagctttcaaacaaacaatcatcaatggagttttggggtgttgaagtgaaagcaggacaaacactaaaggttaagcctgagcttttcaagctcattcatgtttcccaggctgccatcggtgaagtgaaggatgtcaaagaagccaaatatgttccactacgcctaactgttggagaaaacagttatgtcattggaactctatccgctgaggatagacctcagttgatgtttgacttggtctttgaaaaggagtttgaactttcacatggatggaaaaatgggagtgtgcacttcattggatacactgctgatgatcctagcggtgatgaaatcgactctggagatgatgttttttcggatgaagagaatgttttggaggcactgaatgggaaacttgaggctgatgtgaaggatgtaaagcctgatgcaaagaagtctgcacctgttaaggatgagaaaaatgctaaggtagctgaatcaaagaaagaggcggagtctgatgaagatgactctgattctgaagatgactctgatgtgcctctaggcatggatggtccagaagggatggatttttctggtgattctgaggatgatgatgattcagaagaagagacacctaaaaaggttgagcagaagaagagaccagctccatctcctaaagtagctcctggctctggcaaaaaagctaaacaagcaacacccgacaacaagtcaggcggtaagaaaggtccagccaccccttttgctaagcaaaatggtaaacctgcattcaatggtaacaacaaaccaaaaactcagtccccgaaatctggtggtcagttctctggcaacaaatctaacaacaagaacttcagtggccaaaagaatttcaagggcaagcaaggaaggaagtagagggcttgaaagatctttttgaagagcaaagattttactttttatttatagatgtttggtctctatggtttaagctattttccttagttttagtaggtcaatttttgatgaatgtttttgttaccagaaagttttgcccctatctatattcataactatttttgaacacctttctttatatgttcctttaatctttatgacttaa

SEQ ID NO: 4640 - DNA, 1079 bp, Solanum phureja
tctatgctcttcgcatagcagtcttctttgctctcttacttcgcccccaattattttgagctttttcaaacaaacaatcatcaatggagttttggggtgttgaagtgaaagcaggacaaacactaaaggttaagcctgagcttttcaagctcattcatgtttcccaggctgccatcggtgaagtgaaggatgtcaaagaagccaaatatgttccactacgcctaactgttggagataacagttatgtcattggaactctatccgctgaggatagacctcagttgatgtttgacttggtctttgaaaaggagtttgaactttcacatggatggaaaaatgggagtgtgcacttcattggatacactgctgatgatccttgcggtgatgaaatagactctggagatgatgttttttcggctgaagagaatgttttggaggcactgaatgggaaacttgaggctgatgtgaaggatgtaaagcctgatgcaaagaagtctgcacctgttaaggatgagaaaaatgctaaggtagctgaatcaaagaaagaggcggagtctgatgaagatgactctgatgattctgatgatgtgcctctaggcatggaagggatggatttttctggtgattctgaggatgatgatgattccgaggaagatgatgattcagaagaagagacacctaaaaaggttgagcagaagaagagaccagctccatctcctaaagtagctcctggctctggcaaaaaagctaaacaagcaacactcgacaacaaatcaggcggtaagaaaggtccagccaccccttttgctaagcaaaatggtaaacctgcattcaatggtaacaacaaaccaaaacctcagtccccaaaatctggtggtcagttctctggcaacaagtctaacagcaagaacttcagtggccaaaagaatttcaagggcaagcaaggaaggaagtagagggcttgaaagatctttttgaagagcaaagattttatttttatttatagatgtttggtctctatggtttaagctattttccttaagttttagtaggtcaatttttgatgaatatttttgtta

SEQ ID NO: 4641 - DNA, 1587 bp, Capsicum annuum
gcctttgaagtaaaaaacaaatgtataagcactatatgtatgtaccacaaaagttgcaaaataatccagcgttttctcccacacaactttactaaacacctccacccatcctaaaccagaaaattgggaatacaaaataatttccttccctcatctcttctaaaataatcttcattcacatcaggtgaccagattgctgtggtattatctggaaatccacttaactctctatcaagtgacgggtaaaatagatcatgcaaaactgtggggcagcatttcatctgctccgtttaagcacttaatcacacttgatatttctgtaaatcctcctaacaaacaaattagagccgagatatccaacagcaccacagaggatgccgacgccaaggcagaacatcagagtgtagccaaagtaaaagctggtctggaagaaaccggacatcttagtctttacctccttcaactcctcaatattttttttgagctttcaatcatcaatggagttttggggtgttgaagtgaaagcaggagaatctctaaaggtcaagcctgagcttttcaagctcattcatatttcccaggctgcaataggtgaagtgaaggatgtcaaagaagccaaacatgttccattacgtctaactgttggagaaaacagttacgtcattggaacactatccgccgaggatagacctcagttgatgtttgatttggtcttcgaaaaggagtttgagctttcacatggctggaaaaatgggagtgtgtacttcattggatacacagccgatgacccaagcacggatgaaattgactctggagatgatgccttttcggatgaagagaatgttctagatgcactgagtgggaaagttgaggctgacgtgaaggatgttaagaccgatgcaaagaagtctgaacttgttaaggatgagaaaaatgctaaggtagctgaaccaaagaaagaggccgagtctgatgactctgatgatgatgatgatttcgaagatgactctgatgatgaagacgactctgatgatgatgggcctttaggcatggattctgatggtccagaaggtatggatttgtctgatgattccgaggaagatgacgattctgaagacgagacacctaaaaaggttgaggagaagaagagaccagctccatctccgaaagtagctcctggttcgggcaaaaaagcaaaacaagcaacacccgacaacaagtcagctggtaagaagaaaggtccagtaacgccttttggtaagcaaaatggaaaacctgcagcagccaatggtaacaacaagttccaatccccgaaatctggcaacaaatccaacaacaagaactttagcggccaaaagaattcgaagggtaagcaaggaaggaagtagaatgcccgaaagagacatatcatacagtgaagtgtgaagctattttgaggagcaaagagttaattatttttaatttttagtttgaagggggacatagatggtctctttatgctttttaagttattttttagttgtaggggttaaattttggatgaatgtttttgttaccagaaagttttgtctctatatatattcattg

SEQ ID NO: 4642 - DNA, 1400 bp, Secale cereale
agcactgctcctccggccaggggccggcgatctttgatcttgccgcgggggcgccttcctcgtctgtcgcgggtctggttgttgcccatgtcggcgggcgacggcgcggcggtgtcggccgtggaggggaagctggcggagctctccaccagctgcgacctcaggaccctccccaagaggggcaagtctgtatcagcaaggacattaaacactgctcagattcagcttgtcgcaagccatccggaagtttacgaaccgtgtgatgattcctttgcccttgttgatgcgctgctctctgacaaagcccaacttctgacgctacagccaagtttgtgcatggaggtaggatgtggcagtggttatgtcatcacttctctagccatcatgctcaggcaattaggctctggaacccagtacatggcaacagacatcaaccaacatgctgtggagacaactcaagcaacacttgaagcccatggtgttcacgcagatgttattgctactgatattgtgtcaggtcttgagaaacgcctggctggtatggttgatgtgattgttgtgaaccctccttatgtgccaacacccgaggaagaaattgggatgaatggcattgcttcatcttgggctggagggttgaatgggcgccaagtgatcgatcggattctccctgctgtgcgtgagctgctatcagaaaaagggtgtctctacatgattgcccttgaagataatgatcctttgggcatatgccatttgatgaacgagaaggggttcgcatcgcgtgttctgttgaagaggtgtactgacgaggagagcctctatgttctcaagttctggcaagatgctgctgctggtgcaaatgcttctcaatccggtcgatctccacgcgctgagtcgtggctttcacagttgcctttcaaatccttttggcataagaacactggcagttcttgacctcatcagtttgggccctcccatccatcatgaaatatatcaaaagcaaggaaacctttgcgaaattcatatggcggtaatgtgtagaagtgtctgaatgaggtgtttactgtcgagttcagacctgcctgtcctctgaggacacgaaccagactgacatggtgatccagtgagcaatcaaaccaatcgtagtcgcgatataccaaactttctcgtattggtaaaacagctgtcttattatgttggcatcatgcgtgttagtgtgtatatgtgctatcatgaatctattgccttcgtgaatgtgtcatatgctgttatattgcgcctttgtcttgcagagagaagtttagcccaacttctggatctgtgcaatgttagctatgttcaaaattttgatgtctgtttagtactatgatgcaaaatgcaaaggggaacatggttccatgtgc

SEQ ID NO: 4643 - DNA, 1195 bp, Avena sativa
aggcgatctagcggcggtaacttcctcgccgctccggtcgatccatgtcggcgggcgacagcgcggcggtgtcggccgtggaggggaagctctcggaactctccaccagctgcgacctcaggactctacccaggaggggcaagcctgcatcagcaaggacattgaacactgcccagattccgcttgtcgcaagccatccggaggtttatgaaccgtgtgatgattcctttgcccttgttgatgcgctgctctccgacaaagctcaacttctgacgctacagccgagtttatgcatggaggtaggatgtggaagtggttatgtcatcacatctctagccatcatgctcaggcagttaggctctggaacccagtacctagcaacagacatcaacccgcatgctgtggatacaactcaagcaacacttgaagcccatggtattcatgcagatgttattgctaccgatatcatgtcaggtcttgagaagcgtctggctggtatggttgacgtggttgtcgtgaaccctccatatgtgccaacacctgaggaagaaatcgggatcaagggcattgcttcgtcttgggctggagggttgaatgggcgccaagtgattgatcgaattcttcctgccgtgcgcgagctgctgtcagagaaagggtgtctgtacatgattgcccttgaagacaatgatcctctggggatatgccatctgatgaacgagaaggggtttgcatcacgtgttctcttgaagaggtgtactgaagaggagagcctttatgttctcaagttttggcatgacgccactgttagcacaaatgcctctcaatctggtaaatctccaggatccgagtcctcatggctttctcctttcaaatccttctggcacaagagtggtaacagctcttgacttcgtcagtctgggcttttagcattctgaaaactatatcaagcaaggaaaccctctgcaaatttcatatatgtagacatgtttgaatgtggtgttactgtctgagttctcacctgcctcggaaaacaagaaccagactgacatggtgaacttagctcatggtcctatgtgcaatatatcgaacctattctagacgataaataccaaacttttctttatcggtaaactcaccctcttatgttagcatcatgcatgtgtatatgtgctagtataatgaatctattgtcttt

SEQ ID NO: 4644 - DNA, 1622 bp, Brachypodium distachyon
accaacatacccttcgtgacttcgtcctcacaagaccagacccagacccgaaaccgagggcaacatggcgatggcggctccccttcctccccactgcgccgccgccctcctgcgatagcgccgccgcctcttctcgcctcccctctacccatcaagcactagatcccccttccccttccacccgctcccctgcgctccccgccgcgccatcaggccctagccctagtcttcgagcgaggcagcggagacacgccccggcgatttgtggtggcaacttcctccggctcttgcctctccggttgctccatgtcggctggcgacagcgcggcggtgtcggccgtggaggggaagctcgcggaggtctctaccaacagcgacttgaagagtctccccaagaggggcaaggctgcatcagggaggacactaaacactgcccagattcagcttgtcgcaaggcatccggaggtttatgaaccatgtgatgattcctttgcccttgttgatgcgctgctctctgacaaagctcaacttctggcactacagccgagtttatgccttgaggtaggatgtggcagtggttatgtcgtcacatctctggccatcatgctcaggcaattaggctctggaacccactacttagcaacagatatcaaccaacatgctgtggagacaactcaagcaacacttgaagcacatggcattcatgcagatgttattgcaactgatattgtgtcaggtcttgagaaacgtctggctggtatggttgatgtggttgttgtgaaccctccttatgtgccaacacctgaggaagaaatcgggatcaagggcattgcttcatcttgggctggagggctgaatgggcgccaagtgattgaccgaattcttcctgctgtgcgcgagctgctatcagaaagagggtgtatgtacatgattgcccttgaagataatgatcctttgggtatatgccatttgatgaatgagaaggggtatgcatcgcgtgttctcttgaagagatgtactgaagaggagagcctttatgttctcaagttttggcaagaccccactgctggctcaagtgcttctccatccgctaaatctccaggcagcgagtcctcatggatttctcagttgcctttcagatccttttggcaaaagaataatagcagttcttgacctcatcaattcagtctctcccgttctgaaagatggcaagcaaggaacggtttgcaaatttcctatgtggtacttagacgtgtttgagttaggtctttcctgttgagttctgatgtgcatcggagaacaacaagcaaactgacacggtgagctgaagtacgatcctgtgagcaatcaatcaaacgtcttcctttctcttttttgtgtcggctaaaatctgcaccatgttcgcattgtgtgtatatgtggttattatggatctatttattctgaaggtgacttgcgtagtttgggaccttttgtcatgttattctggaatttgtacaaaactagctacaaagttaccactatatggtccatctgtttaataatgatggtatgcttgttcccgtgcctttgtagtgagcgtggcaacaaaaaaacattgtacaatacaattcttagttcca

SEQ ID NO: 4645 - DNA, 1659 bp, Brachypodium distachyon
cgcaccaacatacccttcgtgacttcgtcctcacaagaccagacccagacccgaaaccgagggcaacatggcgatggcggctccccttcctccccactgcgccgccgccctcctgcgatagcgccgccgcctcttctcgcctcccctctacccatcaagcactagatcccccttccccttccacccgctcccctgcgctccccgccgcgccatcaggccctagccctagtcttcgagcgaggcagcggagacacgccccggcgatttgtggtggcaacttcctccggctcttgcctctccggttgctccatgtcggctggcgacagcgcggcggtgtcggccgtggaggggaagctcgcggaggtctctaccaacagcgacttgaagagtctccccaagaggggcaaggctgcatcagggaggacactaaacactgcccagattcagcttgtcgcaaggcatccggaggtttatgaaccatgtgatgattcctttgcccttgttgatgcgctgctctctgacaaagctcaacttctggcactacagccgagtttatgccttgaggtaggatgtggcagtggttatgtcgtcacatctctggccatcatgctcaggcaattaggctctggaacccactacttagcaacagatatcaaccaacatgctgtggagacaactcaagcaacacttgaagcacatggcattcatgcagatgttattgcaactgatattgtgtcaggtcttgagaaacgtctggctggtatggttgatgtggttgttgtgaaccctccttatgtgccaacacctgaggaagaaatcgggatcaagggcattgcttcatcttgggctggagggctgaatgggcgccaagtgattgaccgaattcttcctgctgtgcgcgagctgctatcagaaagagggtgtatgtacatgattgcccttgaagataatgatcctttgggtatatgccatttgatgaatgagaaggggtatgcatcgcgtgttctcttgaagagatgtactgaagaggagagcctttatgttctcaagttttggcaagaccccactgctggctcaagtgcttctccatccgctaaatctccaggcagcgagtcctcatggatttctcagttgcctttcagatccttttggcaaaagaataatagcagttcttgacctcatcaattcagtctctcccgttctgaaagatggcaagcaaggaacggtttgcaaatttcctatgtggtacttagacgtgtttgagttaggtctttcctgttgagttctgatgtgcatcggagaacaacaagcaaactgacacggtgagctgaagtacgatcctgtgagcaatcaatcaaacgtcttcctttctcttttttgtgtcggctaaaatctgcaccatgttcgcattgtgtgtatatgtggttattatggatctatttattctgaaggtgacttgcgtagtttgggaccttttgtcatgttattctggaatttgtacaaaactagctacaaagttaccactatatggtccatctgtttaataatgatggtatgcttgttcccgtgcctttgtagtgagcgtggcaacaaaaaaacattgtacaatacaattcttagttccaagtatagcagtttaatactgtatttaacttgctg

SEQ ID NO: 4646 - DNA, 1390 bp, Oryza sativa
ctttttccccaataggcaactgcacgcgccgccgcagcctctctctatctctccgccgctccggctttctcctcctcttgctgctccgattgctccatggcgggcggcgacagcgcggcggtgtcggcggtggaggggaggctgtcggagctctccaccaacagcgacgagaaggggctccccaggaggggcaagtctttatcaggaaggacattaaacaccgcacagattcaactcgttgcaagccatccagaggtgtatgaaccatgtgatgattcctttgcacttgtcgatgcgcttctttctgacaaagcacaacttttgacgctaaagccaagattatgcatggagataggatgtggcagtggctatgttatcacatctctagcaatcatgctcaggcagttaggctcaggaacccagtacctcgctactgatatcaatcaacatgctgtggagacaactcaagcaacccttgaagcccatggcgtccatgcagacgtgattgctactgatattgtgtcaggtcttgagaaacgcctacatggtttggttgacgttgttgttgtgaaccctccttatgtaccaacacctgaggaagaaatcgagtccaatggcatcgcttcatcttgggctggaggtataaacgggcgccaagtgattgatcggatccttcctgctgtgcgtgagctgctatctgaaagagggtggctgtatatgattgctcttgaagataacgatcctctggatatctgtcatttgatgaatgagaagggctatgcatcacgcgttctcttgaagagatgcactgaagaagaaagcctttatgttctaaagttttggcaggacgcttccactggcacaaacgcttctcatgccgctagatcaccacgctctgaatcctcatggctttctcagctgcctttcagatccctttggcataagaatgcatagtagctgttagccttgtcgatttatctccagttccaaaagatagcaacaagttctttgcaaccttcagatggcagcagtatctgtaaacatgtctgaaatgagatgctgctgttggtctctgactcccttcaaaagagtaaaagaatcagaaatcagactgacttggtggacttagctatgaatggtcctatgagcaattagcaataaagttccaacccttttattttgggtgttcttctattttggtgtgtatatgtgctagtctggattccttatcttactgcacttgtaatatgggtcctgttattatcgaatggattagtaaaccatatcagcgaaaagaatgtacgagcaagtttctggaactataactacatcaaagtagttactacaagaatatcatgatgtctgatgtgtctgttgaatcgaatgaaac

SEQ ID NO: 4647 - DNA, 1180 bp, Festuca arundinacea
aagcctgcatctgcgaggacactgaacactgcccagattccgcttgtggcaagccatccggaagtttatgaaccatgtgatgattcttttgccctcgtagatgctctgctctctgacaaagctcaacttctggcactacagccaagtttatgcctggaggtaggatgtggcagtggttatgtcatcacatctctagccatcatgctcaggcaattaggctctggaacccagtacctagcaacagacatcaaccaacatgctgtggagacaactcaagccacacttgaagcccatggtattcatgcagacgttattgccaccgatatcgtgtcaggtcttgagaaacgtctggctggtatggttgacgtggttgtcgtgaaccctccatatgtgccaacacctgaggaagaaatcgggatcaagggcattgctgcatcttgggctggagggttgaatgggcgccaagtgatcgaccggattcttcctgctgtgcgtgagctgctatcagaaaaagggtgcctgtacatgattgccctcgaagataatgatcctctgggtatatgccatttgatgaacgagaaggggtttgcatctcgtgttctcttgaagaggtgtacagaagaggagagcctctatgttctcaagttttggcaagatgctgctgttagcacaaatgcctctcaatctggcaaatctccaggatccgagtcctcttggctttctccgttcagatccttttggcataagaatagcagttcttgacttcatcagtttgggcttttaccatctgcaaatttcatatgatggtggtatatgtggacatttccgaatgcagtgttactgtcgagttctcacctgcctcagaaaacaagaactatactgacatggtgagcttaattagctatcgtcctatgagcaatatatcgaaccaattctagactataagtaccaaacttttatttatcggtaaaatcagcttcttatgttagcatcatgtgtgtatatgtgctagtataatgaatctattgtcttcctgaatgcgacgttatgcagttgattttaccttacttatcttgttgggagaatttgtgcccaacttctggaaatgtacagaagcagctacaaaactattatcagtgtatgatatatctatttaacaaaaaaaaaaaaaaaaaaaaaa

SEQ ID NO: 4648 - DNA, 1338 bp, Setaria italica
gacccttccgtttcttttctttcttttccccaactcgccgccccgccgccaccagcaacggggtccacatcgcggcagcatctcaccccccaggctcctgctgttccatggcggacggagacggcgcggcggcgtcgggaaagctcacggagcactccgccagcggcgccgagaaggggctccccaggaggggcaagtctctttccggaaggacattaaacactgcacagattccgcttgtcgcaagccatccagaggtgtatgagccatgtgatgattcctttgcccttgttgatgcactgctctcagacaaagcacaacttttgacgctgcagccaaggttatgtatggaggtagggtgcgggagtggttatgtcatcacctctcttgcaatcatgctcaggcaattagcctctggaacccagtacctagcaactgatatcaacaaacacgctgccgagacaactcaagcaacccttgaagcccatggcgtgcatgcggatgtgattgttactgatatcgtgtctggtcttgagaaacatctagctggtatggttgatgtggtagttattaaccctccttatgtgccaactccagaggaagaaattagatgcaagggcattgcttcgtcttgggctggagggttgaatgggcgccaggtgatagacaggatccttcctgctgtgcgagagatcctatcagaaagagggtggctgtacatggtggccctcgaagataatgatcctttggacatatgtcatctgatgagcgagatggggtatgcatcacgcgttgtcttgaaaagatgtactgaggaggagagcctttttgttctcaagttttggcgagatccgcatactggtacaagtgcgtcccctaaatctcctaaatctgagtcttggttctctcagttgcctttcaaatccctttggcacaagggttcatagcagttcatggcctcgtcagtttggagtcttcagttctgaaaaaagatcaagaaatcctttgcaaattgtgtttggatgaaatgtaacagttgatttctgacttgccatggacactcagagtacaagaatcagcccaacctgattggttgaaggtgtgaaccaaacaggtttagaccagaaagtattgaacctttttattttggtagcttaaattgttattttgtgttctcgttgtgtgtgtatatattgtactattgaatcctatcgcgctgcatttggattccgtgttttgatatggatctgttgctttgagagttcgattatttgaatatgagaggaaataatacttttcttgtgccctgtacgagatcagctacaggaatgccagcat

SEQ ID NO: 4649 - DNA, 1656 bp, Setaria italica
ggacgatgacgcgacggtggcggtggagacgagcgccatgcgagcatgcggcggccgccggcggcgggggaggaggggtttaggattccaccacgccttggattttgggggagatttttgcctccgggaagtggatagagtcgcggcctgaacctgacctgtccgagccgtcggttcggttaagaagactggtgactcggacgcgccgcgacccttccgtttcttttctttcttttccccaactcgccgccccgccgccaccagcaacggggtccacatcgcggcagcatctcaccccccaggctcctgctgttccatggcggacggagacggcgcggcggcgtcgggaaagctcacggagcactccgccagcggcgccgagaaggggctccccaggaggggcaagtctctttccggaaggacattaaacactgcacagattccgcttgtcgcaagccatccagaggtgtatgagccatgtgatgattcctttgcccttgttgatgcactgctctcagacaaagcacaacttttgacgctgcagccaaggttatgtatggaggtagggtgcgggagtggttatgtcatcacctctcttgcaatcatgctcaggcaattagcctctggaacccagtacctagcaactgatatcaacaaacacgctgccgagacaactcaagcaacccttgaagcccatggcgtgcatgcggatgtgattgttactgatatcgtgtctggtcttgagaaacatctagctggtatggttgatgtggtagttattaaccctccttatgtgccaactccagaggaagaaattagatgcaagggcattgcttcgtcttgggctggagggttgaatgggcgccaggtgatagacaggatccttcctgctgtgcgagagatcctatcagaaagagggtggctgtacatggtggccctcgaagataatgatcctttggacatatgtcatctgatgagcgagatggggtatgcatcacgcgttgtcttgaaaagatgtactgaggaggagagcctttttgttctcaagttttggcgagatccgcatactggtacaagtgcgtcccctaaatctcctaaatctgagtcttggttctctcagttgcctttcaaatccctttggcacaagggttcatagcagttcatggcctcgtcagtttggagtcttcagttctgaaaaaagatcaagaaatcctttgcaaattgtgtttggatgaaatgtaacagttgatttctgacttgccatggacactcagagtacaagaatcagcccaacctgattggttgaaggtgtgaaccaaacaggtttagaccagaaagtattgaacctttttattttggtagcttaaattgttattttgtgttctcgttgtgtgtgtatatattgtactattgaatcctatcgcgctgcatttggattccgtgttttgatatggatctgttgctttgagagttcgattatttgaatatgagaggaaataatacttttcttgtgccctgtacgagatcagctacaggaatgccagcatcaggtatattatttagaaaatttgttttatttgcactctagagtctggactctggagcacagttacgttgcaaagaattccacatgcagcagctcgctttagtaacggc

SEQ ID NO: 4650 - DNA, 1823 bp, Secale cereale
agaaggtctcatttgtttcccatccatctattatacgtgttcgaatatatcattcacttttccatgtgttgttgatggcttgatccagcttctgcttgcgtacctcgggatcccgcggtacgagggcccggaggtggacccggcggcggcggcgcgcgacgccagggagctgtaccgcgccggcgagaagcggctgggcaccgacgagcgcgccttcatccgcgtcttcaccgagcgcagctgggcgcacctcgccgccgtcgccgacgcctaccaccacctctacgcccgctccctggacaaggccgtgaagagcgagacgtcggggacgttcgagctggggctgctgacgatcctccggtgcgccgagtgcccggcgaggtacttcgccaaggcgctgcacaaggcgatgaaggggctgggcaccagcgacacgacgctgatacgggtggtggtgaccagggcggaggtggacatgcagtacatcaaggccgagtaccacaagaagtacaagcgctcgctcgccgacgccatccactccgagacctccggcaactaccgcaccttcctcctctccctcgtcggccgcgaccgctaacatgatccgaccatctcaccgccgagaccgccttgcttgatcgaccggtcggactacttgtgtatatatgtgtctcctttggctgtgtgaagctattccaatggtaaagcagccaggagcgaatgctatggcgactgctcagtatgttcatgtgttcatgttaacagtgaaatgaaaccgacaactactacgtctttatttatgcctcgacatagccacggagaacacctccatttacaccacaacaccacgacctagctcgcacgggctgacacagcctgcattattgccttattcactactacgagcatacaacacagggagcccaaagttcaggggcgcgtagcaccttacgctatacactacacaaattcatgtcctctgctcgaaataacatactcgacaagcggtgattcacatacggcacgctttaggcggcatatataacacaacaacagcagggcagcgaggcgggcaagatcacgcggtcacagacggcgcattggagccaaaccacttgctatctcagtccgtgggcttctgcctcacctgccgggaagctgaatacgactgcacggcagaggtcgtcatgccgatcgagtgcttggtaaggtccaggctcttccttgcggcaaaccaaatcgtccaaaagaatccgatccaaccagtagcaatcagaactccgacaattgcagagataacggtggcagagatgacgaatatggcaatagatactgctccgacatacactgccactaagcaagcaaagaacaaagccaggaatcctccagcagctgccaaggacataagaactgaaacgataatggcattagcggtcgcaaccagcaggaaggacatgaaaatcagcaggccagtcagtgatatcatcgtgattgttccgaccgagatgacgaggatggcgcggaggccgctgccctgcttggtccaggcgagcaggtcgcgggccgagttcctggaggcgtcccgcagccgcggcgcggcctcgcaggtcgccgcgcggaggcgccgcaggagcggatccccgccgtcgccgggcggccagacgccgtccacgaagccgcggagcaccgcggggagcgtgtcctcgccgccggcgacctcgacggcgcggccgtcgtcgtagacctcgccgttggccatcttgccgtccgccccgtcggattcggccatctccggtcgtggatggaaggattggggaacagtc

SEQ ID NO: 4651 - DNA, 1191 bp, Secale cereale
gcccggagatggccgaatccgacacggcggccggcaagatggccgaatccgacgcggcggacggtaagatggccaacggcgaggtctacgacgacggccgcgccgtcgaggtcgccggcggcgaggacaccctccccgcggtgctccgcggcttcgtggacggcgtctggccgcccggcgacggcggagatccgctgctgcggcgcctccgcgcggcgacctgcgaggccgcgccgcggctgcgggacgcctccaggaactcggcccgcgacctgctcgcctggaccaagcagggcagcggcctccgcgccatcctcgtcatctcggtcggaacaatcacgatgatatcactgactggcctgctgattttcatgtccttcctgctggttgcgaccgctaatgccattatcgtttcagttcttatgtccttggcagctgctggaggattcctggctttgttctttgcttgcttagtggcagtgtatgtcggagcagtatctattgccatattcgtcatctctgccaccgttatctctgcaattgtcggagttctgattgctactggttggatcggattcttttggacgatttggtttgccgcaaggaagagcctggaccttaccaagcactcgatcggcatgacgacctcggccgtgcagtcgtactcagcttcccggcaggtgaagcagaagcccacgacagactgagatagcagcaagcggtttgacagtgcgctgttgccgcgtgatgctgctgccctgctgttgtgttatgtgctgcgtaaagagtgttgtatgtgagttaccgcttgtctagtaagttaccgggagtagcagccggcatgaactgttcctgtatagtgatccagatttgccgcccctgaacgtttggcgctatgatactcgtagcagcgaataaggctttatggaaggcgcgtcggcgctttggagaagcgagtaggcaataacgctggccgcgtttgcgagcgaggctagttgtgatgttgtggtgtaaatgcaggtgttctcttctccctgaatgtgttgaggtagaggaatactactagtaataaataaagtacggtagttgtatttttaccaaaaaaaaaaaagaaaaaaaaaagtaaaatactgggtcgtatactacagctcttgagactagtcgacgacgacacacgggaggtagaggggg

SEQ ID NO: 4652 - DNA, 1109 bp, Pseudoroegneria spicata
gccccctccgtccccctctcccattcacgacttctcgccgcgcccgcacatggccgaatccgacgcggcggccggcaagatggcccacggcgaggtctccgacgacggccgcgccgtcgaggtctccgacgacggccgcgcggtcgaggtctccgccgcggacaccctccccgcggtgctccgcagcttcgtcgacggcgtctggtcgcccggcgacggcgcagatccgctgctgcagcgcctccgggcggcctcctgcgagaccgcgccgcggctgcgcgaggcctccaggaactcggcccgcgacctgctcgcctggaccaagcagggcagcggcctccgcgctatcctcgtcatctcggttggaacaattacgctgatatcactgactggcctgctgattttcatgtccttcctgctggttgcgaccgttaatgccattatcgtttcagttcttatgtccttggcagctgctggaggattcctggccttgttctttgcttgcttagttgcagtgtatgtcggagcagtatcaattgccatattcgtcatttccgccaccgttatctctgcaattgtgggagtcatcattgctactggttggatcggattcttttggacgatttggtttgccgcaaggaagagcctggaccttacgaagcactcgatcggcgtgacgacctcggctgtgcaatcatattcgacttctcggtctgcagggcagaagcccacagactgagtgagatagcagcaactggtttagctccaatgctcttgtctgttatcgcctgatgttgccgcctcgctgccctgctgttgttgtgttatatatgctgcccaaagcccgccgtatgtgaatcaccgcttgtcgagtatgttattgcgaatagaggacatgaatccctgtatagtgatccggatgtagtgtaaggttgaacttccggcaccctgtgttgcagtatactcatagtaacgaataacgcaataatgccggccgtgccggcgagtgcgggctaggttgcggtgttgtgctgtaaatggaagtgttctccatggctgtgttgaggcatagcggattaaataatgacacagttgtcaatttcatttca

SEQ ID NO: 4653 - DNA, 1063 bp, Leymus cinereus x Leymus triticoides
cctccccccgcctgcacatggccgaatccgacgcggcggccgggaagatggccaacggggaggtctccgacgacggccgcgcggtcgaggtctccggcggcgaggacaccctccccggggtgctccgcagcttcgtggacggcgtctggtcgcccggcgacggcggagatccgctgctgcagcgcctccgggcggcctcctgcgagaccgcgccgcggctgcgggacgcctccaggaactcggctcgcgacctgctcgcctggaccaagcggggcagcggcctccgcgctatcctcgtcatctcggtcggcacaattacgcttatatcactgacgggcctgctaattttcatgtccttcctgctggttgccaccaccaatgccattatcgtttcagttcttatgtccttggcagctgctggaggattcctggctttgttcttcgcttgcttagttgcagtgtatgtcggagcagtgtcaattgctatattcgtcatttctgccaccgttatctctgcaattgttggagtcatgattgctactggttggatcggattcttctggacgatttggtttgctgcaaggaagagcctggacgttaccaagcactcgatcggcatgacaacctcggctatgcaatcgttttcaacttctcggcgtgcagggcagaaggccacagaatgactgagttagcaagtggtttagctccaatgcgatgtatgttattgcgtgatgttgctgcctcgctgccctgctgctgttgtgttaataggctgcctaaagcgtgccgtatgtgaatcaccgcttgtcgactacgtatgttattgcgagtagaggacatgaatccctgtatagtgatcccgatttagtgtaaggtgccacgcacgcgcccctgaacttccggcaccctgtgttgtatactcaatagtagcgaataaggcaataatgcaggctgcgattggcgagtgcgggctaggttgtggtgttctgctgtaatggaggtgttctccctggctgtgttgaggcatagaggaataaataaaggcatgcttgtcaatttcaaa

SEQ ID NO: 4654 - DNA, 878 bp, Lolium multiflorum
actgcggtgtgctattccgttccccctcgcccgatcgacgagttccattgactccccactcaaccccgggcatggccgaatccggcgcgtcggccaccaagatggccaacggcgaggtctccgacggccgcgcggtggacgtctccggcgaggacacgctccccggggtgctccgcagcttcgtcgacggcgtctggtcgcccggcgccgacggggacccgctgctgcgccgcctccggacggcgtcctgcgacagcgcgccgcggctgcgggaggcctccaagaactcggcgcgcgacctgctcgcctggaccaagcagggcagcggcctccgggctatcctcgtcatctcggttggaacgattatgctgatagcactgactggcctgctgattttcatgtccttcctgctggttgcaaccacgaatgccattgttgtttcagtccttatgtccttggcggctgctggaggattcctggctctgttctttgcttgcttagttgcagtgtatgttggagcagtatcagttgccatattcgtcatttcggccacagttatctcagctattgttgcagtcatgattgctactggttggattggattcttttggacgatatggtttgctgccaggaagagcatggaccttactaagcactcgatcggcatgacaacttcggctatgcaatcatattcagcttctcggcatgtgagggagaagcccgcagaatgagatggccatttgctgccgcatgctgtagctgcgtcctcgccgagctgctgtggttatgtacttcctgaagctttgccctatgtgatttaaggcttgtgtagtagcttttcgagggtggaggacatgaccgtttcctgtatattggtc

SEQ ID NO: 4655 - DNA, 2909 bp, Brachypodium distachyon
atccccacaggccacggcagtgttatatctagagctaggtcgaggagagcggaaagcccagtaagaaaaataaataaattcagcggagagcagcggtggtggttcagtcatcgctcgtcgtcagcggtagagtagggtagagagagagagggagagagaaaggggcggatgcgggagatcccacggggggtcgccgccggaggaggagatggacacgcccgataggccccgcgccgccgccaccaacgccgccgccgccgggttcgaggactcccccgtcttcaattttatcaacaatctatctcctataccacctcctaaacctcaagcctcagcccataatgtgcagctattcaagtcatcggacttggctcctgtttcttcaatctttgcctcaccacatgtcaatccagcaaaggaatctaaacttgtggtcagggatgatcccgttcaacttcctcaagattcaaactctcctaacagtgtcagaactcggttagggactgctattagattgatcaaaagcaaaaacattgtctcagagaattgcagtttcacttgccacctaagtcaggcacctattgattcttctatcaatacatcaatctctacaagtaatttgcctcaacccatccagtttgttggtggcagtgcagaatgtgataagaatcagaatgcaggtggtgacaaagatctttctacagatcaggagtgtccagtagaaggtgtcttctttgatcacactggcatagataagatggactcatcacaacctggaagaattgttcatgaaaaccaactatgtgaacaaagtagggatggatttgtggcatatgatgaggattacttggctacagaagaactaaacagcgacatgctgagattagccccgccatttgatgcagagacacagttaatgaacgggacgttaaatgctgataatgcacactctggtaccttgttgactgatgggtcaagtggctcttacatcaacaatgctgcacatgatcctcatctttactgggatggggctgttgatgggtccgcaatggattataccccccaattgctccctggtgtttgtcaaaatcagttggtgtcaaatgatcaactctgtaatgctctcactgagcccagcaatcacatgccaatggaccaaagtgccttgtcacagcatatgcgtggaacacgcaggcgttgccttttcaacgaaaaggctggggctgtcaataaagctgcaaagaagacctcagatcgtcattctgcaaatacaactacccctagatgcaaaactagttctagtgatcacaactcaaagcctatgaaaacacctccatgtgcattgcctggtattggtttgcacctgaatgcacttgcgacaataccgaaagacaaaatagtcccttatgctgctcaatcttctacaattcaagcaagcaacttcccttctgctgtcagttcttctccagcaacatctgaaccaaatactgcaaatgaagattcctctcaggcaatcgttgttgcaaatgctgatgagtctggtcagggcagtcccaagaagaaaagacacaagtttgataatggtgatgggacttcatgcaagcgttgtagctgtaagaagtcaaaatgcttgaaactttactgtgaatgttttcatgctggagtcttttgttcagaaccctgttcatgtcaaggctgtctgaataagcctagcaacatggaaacagttctatctactcgagagcagatcgaatctcgtaatccactagcatttgctcctaaagtaattcgtacatctgagcctggtcaggaattaggggagcagtctaacaaaactcctgcttcggctcgccacaaaagaggctgcaactgcaagaagtcatcgtgtctaaaaaaatattgtgaatgctttcagggtggcgtgggatgctccataagttgcagatgtgagggctgtaagaatgcttttggaagaagggagggagttgtactgttaagcatagaacaagctaagcagggatccgtggaaaacattgcttgtgtgaaggaagaaacaagcgaaaatgataatcagctcgttatctaccaagctgctaatccagcttctgctgagaatgtactgacaacaccttcagttgaggatatcagacccttgtctgctcttccaccttcaagctccaagaggccacgatcttcaacaaagctcattggacattcttctcgactatgcaattctcaagctcctttgaagaccgacattctgctctccccattcgaaagctatgcagaaatggttcttggggatggtgcatcagatgtcctgaaaggaggttcgtctcctcaaacttctgtcaaagttgtgtcacctaataaaaagaggatatctcccccgcgtatcggtacgggattatctccaatctgcaagaacggcaggaagttgatcctgaaatccatcccttcattcccttctctgtgtggtgatgtaaataaagtggatccgaagaccagttcaccagcttcctaaattcgtcggtatttggcacttagatcgccaatgtccgatagacttcatcagagttatttcatgctttaggtgatgaacagccaagggaattttgtttcacaagttcaaattagaggctaataattatcccatgatctctctatacagaggaatgttcaaccatctgatgcatgtaccaaccagattgtcccctcaagagccacttgtatgcagtggtttgctatagattatgcccattgttgggtatccatgttcatctgtataattattttttcctggtttatgtacatctgagatcaaactatcgagccttctttgtactttgaatcaaaccatcaatccttctttgtattttggatcaaaatctgttgagatttatgtaaaa

SEQ ID NO: 4656 - DNA, 2930 bp, Brachypodium distachyon
ccccacaggccacggcagtgttatatctagagctaggtcgaggagagcggaaagcccagtaagaaaaataaataaattcagcggagagcagcggtggtggttcagtcatcgctcgtcgtcagcggtagagtagggtagagagagagagggagagagaaaggggcggatgcgggagatcccacggggggtcgccgccggaggaggagatggacacgcccgataggccccgcgccgccgccaccaacgccgccgccgccgggttcgaggactcccccgtcttcaattttatcaacaatctatctcctataccacctcctaaacctcaagcctcagcccataatgtgcagctattcaagtcatcggacttggctcctgtttcttcaatctttgcctcaccacatgtcaatccagcaaaggaatctaaacttgtggtcagggatgatcccgttcaacttcctcaagattcaaactctcctaacagtgtcagaactcggttagggactgctattagattgatcaaaagcaaaaacattgtctcagagaattgcagtttcacttgccacctaagtcaggcacctattgattcttctatcaatacatcaatctctacaagtaatttgcctcaacccatccagtttgttggtggcagtgcagaatgtgataagaatcagaatgcaggtggtgacaaagatctttctacagatcaggagtgtccagtagaaggtgtcttctttgatcacactggcatagataagatggactcatcacaacctggaagaattgttcatgaaaaccaactatgtgaacaaagtagggatggatttgtggcatatgatgaggattacttggctacagaagaactaaacagcgacatgctgagattagccccgccatttgatgcagagacacagttaatgaacgggacgttaaatgctgataatgcacactctggtaccttgttgactgatgggtcaagtggctcttacatcaacaatgctgcacatgatcctcatctttactgggatggggctgttgatgggtccgcaatggattataccccccaattgctccctggtgtttgtcaaaatcagttggtgtcaaatgatcaactctgtaatgctctcactgagcccagcaatcacatgccaatggaccaaagtgccttgtcacagcatatgcgtggaacacgcaggcgttgccttttcaacgaaaaggctggggctgtcaataaagctgcaaagaagacctcagatcgtcattctgcaaatacaactacccctagatgcaaaactagttctagtgatcacaactcaaagcctatgaaaacacctccatgtgcattgcctggtattggtttgcacctgaatgcacttgcgacaataccgaaagacaaaatagtcccttatgctgctcaatcttctacaattcaagcaagcaacttcccttctgctgtcagttcttctccagcaacatctgaaccaaatactgcaaatgaagattcctctcaggcaatcgttgttgcaaatgctgatgagtctggtcagggcagtcccaagaagaaaagacacaagtttgataatggtgatgggacttcatgcaagcgttgtagctgtaagaagtcaaaatgcttgaaactttactgtgaatgttttcatgctggagtcttttgttcagaaccctgttcatgtcaaggctgtctgaataagcctagcaacatggaaacagttctatctactcgagagcagatcgaatctcgtaatccactagcatttgctcctaaagtaattcgtacatctgagcctggtcaggaattaggggagcagtctaacaaaactcctgcttcggctcgccacaaaagaggctgcaactgcaagaagtcatcgtgtctaaaaaaatattgtgaatgctttcagggtggcgtgggatgctccataagttgcagatgtgagggctgtaagaatgcttttggaagaagggagggagttgtactgttaagcatagaacaagctaagcagggatccgtggaaaacattgcttgtgtgaaggaagaaacaagcgaaaatgataatcagctcgttatctaccaagctgctaatccagcttctgctgagaatgtactgacaacaccttcagttgaggatatcagacccttgtctgctcttccaccttcaagctccaagaggccacgatcttcaacaaagctcattggacattcttctcgactatgcaattctcaagctcctttgaagaccgacattctgctctccccattcgaaagctatgcagaaatggttcttggggatggtgcatcagatgtcctgaaaggaggttcgtctcctcaaacttctgtcaaagttgtgtcacctaataaaaagaggatatctcccccgcgtatcggtacgggattatctccaatctgcaagaacggcaggaagttgatcctgaaatccatcccttcattcccttctctgtgtggtgatgtaaataaagtggatccgaagaccagttcaccagcttcctaaattcgtcggtatttggcacttagatcgccaatgtccgatagacttcatcagagttatttcatgctttaggtgatgaacagccaagggaattttgtttcacaagttcaaattagaggctaataattatcccatgatctctctatacagaggaatgttcaaccatctgatgcatgtaccaaccagattgtcccctcaagagccacttgtatgcagtggtttgctatagattatgcccattgttgggtatccatgttcatctgtataattattttttcctggtttatgtacatctgagatcaaactatcgagccttctttgtactttgaatcaaaccatcaatccttctttgtattttggatcaaaatctgttgagatttatgtaaaagctctgctatttgaaccttaaaa

SEQ ID NO: 4657 - DNA, 1384 bp, Pseudoroegneria spicata
agcaatccggtcgaattgataggggagacgaggagcagcgatggccgccgttcgagcccgatggcggctcctcgcgctgcccctggcgctgttcctcgcgatcggttcgccgcgcggcctcgacgcggcgcccaagccccccgtccccaaggccatctccgacctgagggaggcgatcgtcaaggggctggggctccagtcggaggagctcaaggtgtccgggttcgacgtgagggacgcgctggtggggcacgcggtggcgtacgagttcgacatggaggtcgggaggaaggtcgtgccggtgcggctgctcgaggacgtcaaccggtgggacttcgtcgacctgcccatcttccggtcacaggccgacgccgacgacacggcgctcgccgagatcggacgtgggagcttcgacccgacgctgccgcccttccagctcgccggacccatggagctctggatccaggacggcgacgacgtcaggctcgctttgccgcatgatgtggaagctggaaccctgaagaaagttgttcttgctgatggtgcggtggtaacagtgaaaggtgctagcgcggtgagcctccgtttgcccctcgaactaccacttcctctcaaccgcaccacatacaagggccgcctgtctagcttgctttccattgctcgagccctacgcggtgcagctcggtctaatcagaaacccctgatgtccctccggatcgagggtccaacctccttatcctcaaccccttccatgtcaccgaatgacaagctcaagctcaaaaggttggcccccggtcaagtggagctctcctcgcgtgcgatccctgctgtcacagacgatgaggatgaatcacctagccccggattgtggccctttttgtcattgaatgcatcagatggcagcctgcaggggcttgaagaactactcgcgaaggttctcggtaagaaggcgggtgagaagggcacgttcaagttggtgaatgcacgggcctcggcacaaacatatgtcaaaatgggattcacggtggagaagcggattgctgatggagaggtgaactggtctaacttgcctgagtggaaaacaaagcccaagaagttgagagcgcactatgaagttcttgctcgcgtggagcgtggccaggcgatccccgaaaggatcgcccaggtgcagcctttccaggtcgacgaggccatgtccgagagcatgctcactggaaacgtgtcgagatcgaagatggaggtggtaaaccccccaccggtttatttcactttgtgagactgggaggggacggaagctttttatttcccaagttctacttgggatggatgtggcaaaaagtactgattttatgcaatggagccggggagccttcctcttgatcta

SEQ ID NO: 4658 - DNA, 1809 bp, Secale cereale
gactgtggtattttgtccagctactagtcaaaggtgtggtatataatccaataaaaagaaaggtgtggtatagggtcaaagttccaggaaacgtgtggcatttcctcaaattgccccttcctcgccgaaggagcggcaagcaatccggtcgaattgataggggagacgaggagcagcgatggccgccgctcgagcccgatggcggttcctcgcgctgcccctggcgctgttcctcgcgatcggctcgtcgcgcggcctcggcgcggcgcccaagccccccgtccccaaggccatctccgacctgagggaggcgatcgtgaaggggctggggttccagtcggaggagctcaaggtgtccgggttcgacgtgagggacgcgctggtggggcacgcggtggcgtacgagttcgacatggaggtagggaggaaggtcgtgccggtgcggctgctcgaggacgtcaaccggtgggacttcgtcgacctgcccatcttccggtcccaggccgacgccgacgacacggcgctcgccgagatcggacgcgggagcttcgaccccacactgccgcccttccagctcgccgggcccatggagctctggatccaggacggcgacgacgtcaggctcgctttgccgcatgatgtggaagctggaaccctgaagaaagttgttcttgctgatggtgcggtggtaacagtgaaaggtgctagggcggtgagcctccgtttgcccctcgaactaccacttcctctcaaccgcaccacatacaagggccgcctgtctagcttgctttccattgctcgagccctgcgcggtgcagctcggtctaatcagaaacccctgatgtccctccggatcgagggtccaacctccttatcctcaaccccttccatgtctccgaatgacaagctcaagctcaaacggttggctccaggtcaagtggagctctcctcgcgtgcgatccctgccgtcacagacgatgaggatgaatcacctagccccggattgtggccctttttatcattgaatgcatcagatgggagcctgcaggggcttgaagaactactggcgaagtttctgggtaagaaggcgggtgagaagggcacgttcaagttggtgaatgctcgggcctcggcacaaacatatgtcaaaatggggttcacagtggagaagcggattgctgatggagaggtgaactggtctaacttgcctgagtggaaaacaaaacccaagaagttgagagcgcactatgaagttcttgcccgcgtggagcgtggccaggcgatcccggaaaggatcgcccaggtgcagcctttccaggtcgacgaggccatgtccgagagcatgctcaccggaaacgtgtcgaggtcgaagatggaggtggtaaaccccccgccagtatttttcactttgtgagactgggaggggctggaagctttttatttccaaagctctacttgggatggatgtggcaaaaagtactgatttctgtgttagcatggaacttcttgtgtgttatactggctagctttgtaaattacgggcgcgaacaatgaggccttatagtgtgaagtgcagcaataagcaaattgtatgtacacagtacacatctcaaagcaaagcaaagcaaaagcgctcagagcatgggatggccgttttggctctgggcaaccctgatgaacagtaaattcaaaccaaatagaaactaaaaaaattccgattgtagatgtttcacgttagtggaacaaaggtgcttggcagtttgtgaatcagtgggaaaaaagttacatttgaaggtgagttcgactttt
